United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 228

SEQ ID NO: 9437459 - DNA, 20 bp, Homo sapiens
tgggtcctgtgggagaagaa

SEQ ID NO: 9437460 - DNA, 22 bp, Homo sapiens
tgggtcctgtctccttgttctg

SEQ ID NO: 9437461 - DNA, 22 bp, Homo sapiens
tgggtccttgctaacttctatg

SEQ ID NO: 9437462 - DNA, 22 bp, Homo sapiens
tgggtccttgccatcttggagt

SEQ ID NO: 9437463 - DNA, 22 bp, Homo sapiens
tgggtccttcaaagctgggtct

SEQ ID NO: 9437464 - DNA, 22 bp, Homo sapiens
tgggtctcctgtgcctgggagg

SEQ ID NO: 9437465 - DNA, 22 bp, Homo sapiens
tgggtctccagttcagggcagg

SEQ ID NO: 9437466 - DNA, 22 bp, Homo sapiens
tgggtctcctgtgcctgggagg

SEQ ID NO: 9437467 - DNA, 23 bp, Homo sapiens
tgggtctctagtacaggcaggca

SEQ ID NO: 9437468 - DNA, 23 bp, Homo sapiens
tgggtctctagtacaggcaggca

SEQ ID NO: 9437469 - DNA, 20 bp, Homo sapiens
tgggtctgcttggcttcagt

SEQ ID NO: 9437470 - DNA, 22 bp, Homo sapiens
tgggtctgtagggctgtccaat

SEQ ID NO: 9437471 - DNA, 22 bp, Homo sapiens
tgggtctgtagggctgtccaat

SEQ ID NO: 9437472 - DNA, 22 bp, Homo sapiens
tgggtcctggctttgtcagggt

SEQ ID NO: 9437473 - DNA, 22 bp, Homo sapiens
tgggtcctggaaggcgacaggt

SEQ ID NO: 9437474 - DNA, 20 bp, Homo sapiens
tgggtcctgcttcttcctga

SEQ ID NO: 9437475 - DNA, 22 bp, Homo sapiens
tgggtcctgcactgcaagcacc

SEQ ID NO: 9437476 - DNA, 20 bp, Homo sapiens
tgggtcctgcacattctcca

SEQ ID NO: 9437477 - DNA, 22 bp, Homo sapiens
tgggtcctctggagcagcagca

SEQ ID NO: 9437478 - DNA, 22 bp, Homo sapiens
tgggtcctctgagagggcagcg

SEQ ID NO: 9437479 - DNA, 22 bp, Homo sapiens
tgggtcctaaatgcagtcacat

SEQ ID NO: 9437480 - DNA, 22 bp, Homo sapiens
tgggtcctcgtcttccaaggca

SEQ ID NO: 9437481 - DNA, 22 bp, Homo sapiens
tgggtcccaaactcctagaggt

SEQ ID NO: 9437482 - DNA, 21 bp, Homo sapiens
tgggtccccgacacgctacct

SEQ ID NO: 9437483 - DNA, 22 bp, Homo sapiens
tggggtggatagaaagtgatgt

SEQ ID NO: 9437484 - DNA, 22 bp, Homo sapiens
tggggtggatagaaagtgatgt

SEQ ID NO: 9437485 - DNA, 22 bp, Homo sapiens
tggggtggaacccttctgctgg

SEQ ID NO: 9437486 - DNA, 22 bp, Homo sapiens
tggggtggaacccttctgctgg

SEQ ID NO: 9437487 - DNA, 22 bp, Homo sapiens
tggggtgccgacagggagggca

SEQ ID NO: 9437488 - DNA, 22 bp, Homo sapiens
tggggtgccgacagggagggca

SEQ ID NO: 9437489 - DNA, 22 bp, Homo sapiens
tggggtggaacccttctgctgg

SEQ ID NO: 9437490 - DNA, 22 bp, Homo sapiens
tggggtgtgagaagtagaggga

SEQ ID NO: 9437491 - DNA, 22 bp, Homo sapiens
tggggtgtgagaagtagaggga

SEQ ID NO: 9437492 - DNA, 22 bp, Homo sapiens
tggggtgtgctcagagcagggg

SEQ ID NO: 9437493 - DNA, 17 bp, Homo sapiens
tggggtgttgaagggtt

SEQ ID NO: 9437494 - DNA, 17 bp, Homo sapiens
tggggtgttgaagggtt

SEQ ID NO: 9437495 - DNA, 22 bp, Homo sapiens
tggggtggtgggaaccaagtag

SEQ ID NO: 9437496 - DNA, 22 bp, Homo sapiens
tggggtggtaatacaccgttct

SEQ ID NO: 9437497 - DNA, 22 bp, Homo sapiens
tggggtgggcatgcgctgtcct

SEQ ID NO: 9437498 - DNA, 22 bp, Homo sapiens
tggggtgggcatgcgctgtcct

SEQ ID NO: 9437499 - DNA, 22 bp, Homo sapiens
tggggtgggcatgcgctgtcct

SEQ ID NO: 9437500 - DNA, 22 bp, Homo sapiens
tggggtgggcatgcgctgtcct

SEQ ID NO: 9437501 - DNA, 22 bp, Homo sapiens
tggggtggggttactcattctg

SEQ ID NO: 9437502 - DNA, 22 bp, Homo sapiens
tggggtggggttactcattctg

SEQ ID NO: 9437503 - DNA, 22 bp, Homo sapiens
tggggtctggagttgcccatga

SEQ ID NO: 9437504 - DNA, 22 bp, Homo sapiens
tggggtctggagttgcccatga

SEQ ID NO: 9437505 - DNA, 18 bp, Homo sapiens
tggggtctctcaggtaag

SEQ ID NO: 9437506 - DNA, 22 bp, Homo sapiens
tggggtctgagtatctgcattt

SEQ ID NO: 9437507 - DNA, 22 bp, Homo sapiens
tggggtctgagtatctgcattt

SEQ ID NO: 9437508 - DNA, 22 bp, Homo sapiens
tgggggtggttcttgcctccag

SEQ ID NO: 9437509 - DNA, 22 bp, Homo sapiens
tgggggtggttcttgcctccag

SEQ ID NO: 9437510 - DNA, 22 bp, Homo sapiens
tgggggtgctgagaagacagga

SEQ ID NO: 9437511 - DNA, 20 bp, Homo sapiens
tggggtctagttggcctggg

SEQ ID NO: 9437512 - DNA, 18 bp, Homo sapiens
tggggtctctcaggtaag

SEQ ID NO: 9437513 - DNA, 21 bp, Homo sapiens
tgggggtgaggcctaggaatc

SEQ ID NO: 9437514 - DNA, 21 bp, Homo sapiens
tgggggtgaggcctaggaatc

SEQ ID NO: 9437515 - DNA, 22 bp, Homo sapiens
tgggggtgccctatgaggaagc

SEQ ID NO: 9437516 - DNA, 22 bp, Homo sapiens
tgggggtgccctatgaggaagc

SEQ ID NO: 9437517 - DNA, 22 bp, Homo sapiens
tgggggtgccctatgaggaagc

SEQ ID NO: 9437518 - DNA, 22 bp, Homo sapiens
tgggggctgtgcacaggctcac

SEQ ID NO: 9437519 - DNA, 22 bp, Homo sapiens
tgggggctgtgcacaggctcac

SEQ ID NO: 9437520 - DNA, 22 bp, Homo sapiens
tgggggctgtgcacaggctcac

SEQ ID NO: 9437521 - DNA, 22 bp, Homo sapiens
tggggggatacttgctactggc

SEQ ID NO: 9437522 - DNA, 22 bp, Homo sapiens
tggggggcatgaacctccacgg

SEQ ID NO: 9437523 - DNA, 18 bp, Homo sapiens
tggggggcttgtctgaag

SEQ ID NO: 9437524 - DNA, 22 bp, Homo sapiens
tgggggtgaaagtctggacagt

SEQ ID NO: 9437525 - DNA, 22 bp, Homo sapiens
tgggggtgaaagtctggacagt

SEQ ID NO: 9437526 - DNA, 22 bp, Homo sapiens
tgggggtgactatctcgggaat

SEQ ID NO: 9437527 - DNA, 22 bp, Homo sapiens
tgggggtgactatctcgggaat

SEQ ID NO: 9437528 - DNA, 22 bp, Homo sapiens
tgggtgcaggtcttgtgccagg

SEQ ID NO: 9437529 - DNA, 22 bp, Homo sapiens
tgggtgcaggatgagtgctggc

SEQ ID NO: 9437530 - DNA, 22 bp, Homo sapiens
tgggtgcaggatgagtgctggc

SEQ ID NO: 9437531 - DNA, 22 bp, Homo sapiens
tgggtgctctgcgaccgtaggg

SEQ ID NO: 9437532 - DNA, 22 bp, Homo sapiens
tgggtgctctgcgaccgtaggg

SEQ ID NO: 9437533 - DNA, 22 bp, Homo sapiens
tgggtgcatgtgagcacgtgca

SEQ ID NO: 9437534 - DNA, 22 bp, Homo sapiens
tgggtgcatgtgagcacgtgca

SEQ ID NO: 9437535 - DNA, 17 bp, Homo sapiens
tgggtgctgggatgagg

SEQ ID NO: 9437536 - DNA, 17 bp, Homo sapiens
tgggtgctgggatgagg

SEQ ID NO: 9437537 - DNA, 22 bp, Homo sapiens
tgggtgctgctttagggggtca

SEQ ID NO: 9437538 - DNA, 22 bp, Homo sapiens
tgggtgctctgcgaccgtaggg

SEQ ID NO: 9437539 - DNA, 22 bp, Homo sapiens
tgggtgctctgcgaccgtaggg

SEQ ID NO: 9437540 - DNA, 22 bp, Homo sapiens
tgggtgctctgcgaccgtaggg

SEQ ID NO: 9437541 - DNA, 22 bp, Homo sapiens
tgggtgctctgcttccctgcac

SEQ ID NO: 9437542 - DNA, 22 bp, Homo sapiens
tgggtgctctgcgaccgtaggg

SEQ ID NO: 9437543 - DNA, 22 bp, Homo sapiens
tgggtgcttcgtcagctctgag

SEQ ID NO: 9437544 - DNA, 21 bp, Homo sapiens
tgggtggaagcgggaggccgc

SEQ ID NO: 9437545 - DNA, 22 bp, Homo sapiens
tgggtgcttcgtcagctctgag

SEQ ID NO: 9437546 - DNA, 22 bp, Homo sapiens
tgggtgggagcgccctgtctgg

SEQ ID NO: 9437547 - DNA, 22 bp, Homo sapiens
tgggtgagcggctgcacacccg

SEQ ID NO: 9437548 - DNA, 22 bp, Homo sapiens
tgggtgaggagaggctgtctaa

SEQ ID NO: 9437549 - DNA, 22 bp, Homo sapiens
tgggtgaggagaggctgtctaa

SEQ ID NO: 9437550 - DNA, 22 bp, Homo sapiens
tgggtgaggagaggctgtctaa

SEQ ID NO: 9437551 - DNA, 22 bp, Homo sapiens
tgggtgaggagaggctgtctaa

SEQ ID NO: 9437552 - DNA, 22 bp, Homo sapiens
tgggtgagccacaggagttgtc

SEQ ID NO: 9437553 - DNA, 22 bp, Homo sapiens
tgggtgagccacaggagttgtc

SEQ ID NO: 9437554 - DNA, 22 bp, Homo sapiens
tgggtgagccacaggagttgtc

SEQ ID NO: 9437555 - DNA, 22 bp, Homo sapiens
tgggtgagccacaggagttgtc

SEQ ID NO: 9437556 - DNA, 22 bp, Homo sapiens
tgggtgaggatgatgaggcagc

SEQ ID NO: 9437557 - DNA, 22 bp, Homo sapiens
tgggtgaggatgatgaggcagc

SEQ ID NO: 9437558 - DNA, 22 bp, Homo sapiens
tgggtgagtggagggcattcta

SEQ ID NO: 9437559 - DNA, 22 bp, Homo sapiens
tgggtgagtggagggcattcta

SEQ ID NO: 9437560 - DNA, 22 bp, Homo sapiens
tgggtgaggatgatgaggcagc

SEQ ID NO: 9437561 - DNA, 22 bp, Homo sapiens
tgggtgagtggagggcattcta

SEQ ID NO: 9437562 - DNA, 22 bp, Homo sapiens
tgggtgagtggagggcattcta

SEQ ID NO: 9437563 - DNA, 22 bp, Homo sapiens
tgggtgaggatgatgaggcagc

SEQ ID NO: 9437564 - DNA, 22 bp, Homo sapiens
tgggtgtgcccagatggtgtcc

SEQ ID NO: 9437565 - DNA, 22 bp, Homo sapiens
tgggtgtgcccagatggtgtcc

SEQ ID NO: 9437566 - DNA, 22 bp, Homo sapiens
tgggtgtgcccagatggtgtcc

SEQ ID NO: 9437567 - DNA, 22 bp, Homo sapiens
tgggtggtccaggctcagcaga

SEQ ID NO: 9437568 - DNA, 22 bp, Homo sapiens
tgggtgtgaagtctgttggcct

SEQ ID NO: 9437569 - DNA, 22 bp, Homo sapiens
tgggtgtgaagtctgttggcct

SEQ ID NO: 9437570 - DNA, 22 bp, Homo sapiens
tgggtggttgctgaggctcctt

SEQ ID NO: 9437571 - DNA, 22 bp, Homo sapiens
tgggtggtttatgagtgggttt

SEQ ID NO: 9437572 - DNA, 22 bp, Homo sapiens
tgggtggtttatgagtgggttt

SEQ ID NO: 9437573 - DNA, 17 bp, Homo sapiens
tgggtggtagggagagg

SEQ ID NO: 9437574 - DNA, 17 bp, Homo sapiens
tgggtggtagggagagg

SEQ ID NO: 9437575 - DNA, 21 bp, Homo sapiens
tgggtgggcagagtctcttca

SEQ ID NO: 9437576 - DNA, 21 bp, Homo sapiens
tgggtgggcagagtctcttca

SEQ ID NO: 9437577 - DNA, 21 bp, Homo sapiens
tgggtgggcagagtctcttca

SEQ ID NO: 9437578 - DNA, 21 bp, Homo sapiens
tgggtgggcagagtctcttca

SEQ ID NO: 9437579 - DNA, 21 bp, Homo sapiens
tgggtgggcagagtctcttca

SEQ ID NO: 9437580 - DNA, 16 bp, Homo sapiens
tgggtgggaggagcgg

SEQ ID NO: 9437581 - DNA, 16 bp, Homo sapiens
tgggtgggaggagcgg

SEQ ID NO: 9437582 - DNA, 16 bp, Homo sapiens
tgggtgggaggagcgg

SEQ ID NO: 9437583 - DNA, 16 bp, Homo sapiens
tgggtgggaggagcgg

SEQ ID NO: 9437584 - DNA, 16 bp, Homo sapiens
tgggtgggaggagcgg

SEQ ID NO: 9437585 - DNA, 22 bp, Homo sapiens
tgggtgggagcgccctgtctgg

SEQ ID NO: 9437586 - DNA, 22 bp, Homo sapiens
tgggtgggagcgccctgtctgg

SEQ ID NO: 9437587 - DNA, 22 bp, Homo sapiens
tgggtgggagcgccctgtctgg

SEQ ID NO: 9437588 - DNA, 22 bp, Homo sapiens
tgggtgggagcgccctgtctgg

SEQ ID NO: 9437589 - DNA, 22 bp, Homo sapiens
tgggttatcagaggaatctttc

SEQ ID NO: 9437590 - DNA, 22 bp, Homo sapiens
tgggttcagatcccagctctgt

SEQ ID NO: 9437591 - DNA, 22 bp, Homo sapiens
tgggttctagagggaccagaac

SEQ ID NO: 9437592 - DNA, 22 bp, Homo sapiens
tgggttcagatcccagctctgt

SEQ ID NO: 9437593 - DNA, 22 bp, Homo sapiens
tgggttctttcacttctcagtt

SEQ ID NO: 9437594 - DNA, 22 bp, Homo sapiens
tgggttctttcacttctcagtt

SEQ ID NO: 9437595 - DNA, 19 bp, Homo sapiens
tgggttggaagggaatgaa

SEQ ID NO: 9437596 - DNA, 22 bp, Homo sapiens
tggtaagataagagccaggcct

SEQ ID NO: 9437597 - DNA, 22 bp, Homo sapiens
tggtaagaataggggctttgga

SEQ ID NO: 9437598 - DNA, 23 bp, Homo sapiens
tggtaaattgtttggcaagtctg

SEQ ID NO: 9437599 - DNA, 22 bp, Homo sapiens
tggtaaattatttttatatccc

SEQ ID NO: 9437600 - DNA, 22 bp, Homo sapiens
tggtaaagtggcttcacagtgt

SEQ ID NO: 9437601 - DNA, 22 bp, Homo sapiens
tggtaaagttgattggtgctct

SEQ ID NO: 9437602 - DNA, 22 bp, Homo sapiens
tggtaaatgctattcctatatt

SEQ ID NO: 9437603 - DNA, 22 bp, Homo sapiens
tggtaaatgtctaacaatcact

SEQ ID NO: 9437604 - DNA, 22 bp, Homo sapiens
tggtaaatgctccaagcagtac

SEQ ID NO: 9437605 - DNA, 22 bp, Homo sapiens
tggtaaatatgtccattctctt

SEQ ID NO: 9437606 - DNA, 22 bp, Homo sapiens
tggtaaatatgtccattctctt

SEQ ID NO: 9437607 - DNA, 22 bp, Homo sapiens
tggtaaagaaatgtcagggcag

SEQ ID NO: 9437608 - DNA, 22 bp, Homo sapiens
tggtaaaaactgcaattacttt

SEQ ID NO: 9437609 - DNA, 22 bp, Homo sapiens
tggtaaaaactgcaattacttt

SEQ ID NO: 9437610 - DNA, 22 bp, Homo sapiens
tggtaaaaactgcaattacttt

SEQ ID NO: 9437611 - DNA, 22 bp, Homo sapiens
tggtcacacatgtatctcaatg

SEQ ID NO: 9437612 - DNA, 22 bp, Homo sapiens
tggtcaagttaagataaggtga

SEQ ID NO: 9437613 - DNA, 22 bp, Homo sapiens
tggtcaagggacagagctgaac

SEQ ID NO: 9437614 - DNA, 22 bp, Homo sapiens
tggtcaaggcttggagatagta

SEQ ID NO: 9437615 - DNA, 22 bp, Homo sapiens
tggtcaagattacacactggtg

SEQ ID NO: 9437616 - DNA, 22 bp, Homo sapiens
tggtcaaatgccaatctgtagt

SEQ ID NO: 9437617 - DNA, 22 bp, Homo sapiens
tggtcaaaagctactatgaatg

SEQ ID NO: 9437618 - DNA, 22 bp, Homo sapiens
tggtatttcagcttttgtatct

SEQ ID NO: 9437619 - DNA, 22 bp, Homo sapiens
tggtatttcagcttttgtatct

SEQ ID NO: 9437620 - DNA, 22 bp, Homo sapiens
tggtagtgactcccccagggct

SEQ ID NO: 9437621 - DNA, 22 bp, Homo sapiens
tggtagggacactatgcagaaa

SEQ ID NO: 9437622 - DNA, 22 bp, Homo sapiens
tggtagtcggcctcggtggctc

SEQ ID NO: 9437623 - DNA, 22 bp, Homo sapiens
tggtataagctgtgtcagagcc

SEQ ID NO: 9437624 - DNA, 22 bp, Homo sapiens
tggtataatacagtaagtgttg

SEQ ID NO: 9437625 - DNA, 22 bp, Homo sapiens
tggtataaaagagtaaactatg

SEQ ID NO: 9437626 - DNA, 22 bp, Homo sapiens
tggtatcaaacaattaattaga

SEQ ID NO: 9437627 - DNA, 20 bp, Homo sapiens
tggtatcaattactagattg

SEQ ID NO: 9437628 - DNA, 21 bp, Homo sapiens
tggtatcaaactatacaatat

SEQ ID NO: 9437629 - DNA, 22 bp, Homo sapiens
tggtatggctaacgaggtcaag

SEQ ID NO: 9437630 - DNA, 22 bp, Homo sapiens
tggtatggcctggagaatgcag

SEQ ID NO: 9437631 - DNA, 22 bp, Homo sapiens
tggtatgtaaattgtaactcaa

SEQ ID NO: 9437632 - DNA, 22 bp, Homo sapiens
tggtatggtcaaagcctgtgta

SEQ ID NO: 9437633 - DNA, 22 bp, Homo sapiens
tggtatggatggtgtggctttc

SEQ ID NO: 9437634 - DNA, 22 bp, Homo sapiens
tggtatgaccgtggtgcaagca

SEQ ID NO: 9437635 - DNA, 22 bp, Homo sapiens
tgggatagtagctgagagacaa

SEQ ID NO: 9437636 - DNA, 22 bp, Homo sapiens
tgggagtgatacagtatggaat

SEQ ID NO: 9437637 - DNA, 22 bp, Homo sapiens
tgggagtgcacctgggacacga

SEQ ID NO: 9437638 - DNA, 22 bp, Homo sapiens
tgggagtgcacctgggacacga

SEQ ID NO: 9437639 - DNA, 22 bp, Homo sapiens
tgggatagggctattgctcaca

SEQ ID NO: 9437640 - DNA, 23 bp, Homo sapiens
tgggatggattcaccagtgtgct

SEQ ID NO: 9437641 - DNA, 23 bp, Homo sapiens
tgggatggattcaccagtgtgct

SEQ ID NO: 9437642 - DNA, 22 bp, Homo sapiens
tgggatggcatcctgggccttg

SEQ ID NO: 9437643 - DNA, 23 bp, Homo sapiens
tgggatggattcaccagtgtgct

SEQ ID NO: 9437644 - DNA, 23 bp, Homo sapiens
tgggatggattcaccagtgtgct

SEQ ID NO: 9437645 - DNA, 23 bp, Homo sapiens
tgggatggattcaccagtgtgct

SEQ ID NO: 9437646 - DNA, 23 bp, Homo sapiens
tgggatggattcaccagtgtgct

SEQ ID NO: 9437647 - DNA, 18 bp, Homo sapiens
tgggatggagagtaactg

SEQ ID NO: 9437648 - DNA, 22 bp, Homo sapiens
tgggatgccctgaccctctgga

SEQ ID NO: 9437649 - DNA, 22 bp, Homo sapiens
tgggatgctcagggcctggagc

SEQ ID NO: 9437650 - DNA, 22 bp, Homo sapiens
tgggatggagcctgagtatagt

SEQ ID NO: 9437651 - DNA, 22 bp, Homo sapiens
tgggatggagcctgagtatagt

SEQ ID NO: 9437652 - DNA, 18 bp, Homo sapiens
tgggatggagagtaactg

SEQ ID NO: 9437653 - DNA, 22 bp, Homo sapiens
tgggatgagggtgagccacatg

SEQ ID NO: 9437654 - DNA, 22 bp, Homo sapiens
tgggatgagttgttaggactga

SEQ ID NO: 9437655 - DNA, 22 bp, Homo sapiens
tgggagtcactgttgttgaggg

SEQ ID NO: 9437656 - DNA, 22 bp, Homo sapiens
tgggagtagatgaggagtgggc

SEQ ID NO: 9437657 - DNA, 20 bp, Homo sapiens
tgggagtacaatcatgagca

SEQ ID NO: 9437658 - DNA, 22 bp, Homo sapiens
tgggagtcatcgtgtttggatc

SEQ ID NO: 9437659 - DNA, 22 bp, Homo sapiens
tgggagtgaggcagagtctatc

SEQ ID NO: 9437660 - DNA, 22 bp, Homo sapiens
tgggagtgatacagtatggaat

SEQ ID NO: 9437661 - DNA, 22 bp, Homo sapiens
tgggaggtctcttgcggcctag

SEQ ID NO: 9437662 - DNA, 22 bp, Homo sapiens
tgggaggcttccagaccttgct

SEQ ID NO: 9437663 - DNA, 22 bp, Homo sapiens
tgggaggccgaggcaggtggat

SEQ ID NO: 9437664 - DNA, 22 bp, Homo sapiens
tgggaggcttccagaccttgct

SEQ ID NO: 9437665 - DNA, 22 bp, Homo sapiens
tgggaggccaaggcaggcggat

SEQ ID NO: 9437666 - DNA, 22 bp, Homo sapiens
tgggaggccaaggcaggcggat

SEQ ID NO: 9437667 - DNA, 22 bp, Homo sapiens
tgggaggccaaggcaggcggat

SEQ ID NO: 9437668 - DNA, 22 bp, Homo sapiens
tgggaggccaaggcaggcggat

SEQ ID NO: 9437669 - DNA, 22 bp, Homo sapiens
tgggaggcaggtaggtgatgat

SEQ ID NO: 9437670 - DNA, 22 bp, Homo sapiens
tgggaggcaggtaggtgatgat

SEQ ID NO: 9437671 - DNA, 22 bp, Homo sapiens
tgggaggcaggtaggtgatgat

SEQ ID NO: 9437672 - DNA, 22 bp, Homo sapiens
tgggaggcccaggcctggcagg

SEQ ID NO: 9437673 - DNA, 22 bp, Homo sapiens
tgggaggcccaggcctggcagg

SEQ ID NO: 9437674 - DNA, 22 bp, Homo sapiens
tgggaggccgaggcaggtggat

SEQ ID NO: 9437675 - DNA, 22 bp, Homo sapiens
tgggaggccgaggcaggtggat

SEQ ID NO: 9437676 - DNA, 22 bp, Homo sapiens
tgggaggccgaggcaggtggat

SEQ ID NO: 9437677 - DNA, 22 bp, Homo sapiens
tgggcagagtcatacaggagac

SEQ ID NO: 9437678 - DNA, 22 bp, Homo sapiens
tgggcagagtagctcagaagaa

SEQ ID NO: 9437679 - DNA, 22 bp, Homo sapiens
tgggcagaggctctgaagtcca

SEQ ID NO: 9437680 - DNA, 22 bp, Homo sapiens
tgggcagagtagctcagaagaa

SEQ ID NO: 9437681 - DNA, 22 bp, Homo sapiens
tgggcagagtagctcagaagaa

SEQ ID NO: 9437682 - DNA, 22 bp, Homo sapiens
tgggcagagtcgtggggaatag

SEQ ID NO: 9437683 - DNA, 22 bp, Homo sapiens
tgggcagagtcgtggggaatag

SEQ ID NO: 9437684 - DNA, 22 bp, Homo sapiens
tgggcagagtcgtggggaatag

SEQ ID NO: 9437685 - DNA, 22 bp, Homo sapiens
tgggcagagtcatacaggagac

SEQ ID NO: 9437686 - DNA, 22 bp, Homo sapiens
tgggcagagtcatacaggagac

SEQ ID NO: 9437687 - DNA, 22 bp, Homo sapiens
tgggcagaggctctgaagtcca

SEQ ID NO: 9437688 - DNA, 22 bp, Homo sapiens
tgggcagaggcagcagaaacct

SEQ ID NO: 9437689 - DNA, 22 bp, Homo sapiens
tgggcagaggcagcagaaacct

SEQ ID NO: 9437690 - DNA, 22 bp, Homo sapiens
tgggcagaggacagggaagatc

SEQ ID NO: 9437691 - DNA, 22 bp, Homo sapiens
tgggcagaggacagggaagatc

SEQ ID NO: 9437692 - DNA, 22 bp, Homo sapiens
tgggcagagatctggatcaaac

SEQ ID NO: 9437693 - DNA, 22 bp, Homo sapiens
tgggcagagatctggatcaaac

SEQ ID NO: 9437694 - DNA, 22 bp, Homo sapiens
tgggcagaggacagggaagatc

SEQ ID NO: 9437695 - DNA, 22 bp, Homo sapiens
tgggcagagatctggatcaaac

SEQ ID NO: 9437696 - DNA, 22 bp, Homo sapiens
tgggcagagatctggatcaaac

SEQ ID NO: 9437697 - DNA, 20 bp, Homo sapiens
tgggcaccagatgggatgcc

SEQ ID NO: 9437698 - DNA, 22 bp, Homo sapiens
tgggcacctgaggcctggcagg

SEQ ID NO: 9437699 - DNA, 22 bp, Homo sapiens
tgggcacatagttttatggtca

SEQ ID NO: 9437700 - DNA, 22 bp, Homo sapiens
tgggcacagtgagttgccttta

SEQ ID NO: 9437701 - DNA, 22 bp, Homo sapiens
tgggcacatagttttatggtca

SEQ ID NO: 9437702 - DNA, 22 bp, Homo sapiens
tgggcacaggggtaggaatgag

SEQ ID NO: 9437703 - DNA, 22 bp, Homo sapiens
tgggcagagagtagaggcaacg

SEQ ID NO: 9437704 - DNA, 22 bp, Homo sapiens
tgggcagagagtagaggcaacg

SEQ ID NO: 9437705 - DNA, 22 bp, Homo sapiens
tgggcagactgagccctgtccc

SEQ ID NO: 9437706 - DNA, 22 bp, Homo sapiens
tgggcagagagtagaggcaacg

SEQ ID NO: 9437707 - DNA, 22 bp, Homo sapiens
tgggcagactgagccctgtccc

SEQ ID NO: 9437708 - DNA, 22 bp, Homo sapiens
tgggcactcaggctgaggccgt

SEQ ID NO: 9437709 - DNA, 22 bp, Homo sapiens
tgggcaagtatcggactctgag

SEQ ID NO: 9437710 - DNA, 22 bp, Homo sapiens
tgggcaagggacaggcctggct

SEQ ID NO: 9437711 - DNA, 22 bp, Homo sapiens
tgggcaatatgactcagtattt

SEQ ID NO: 9437712 - DNA, 22 bp, Homo sapiens
tgggcaattttctttcctcatt

SEQ ID NO: 9437713 - DNA, 22 bp, Homo sapiens
tgggcaatttatttggtcatca

SEQ ID NO: 9437714 - DNA, 22 bp, Homo sapiens
tgggcaagtcacttctgtcttt

SEQ ID NO: 9437715 - DNA, 22 bp, Homo sapiens
tgggcaagtcacttctgtcttt

SEQ ID NO: 9437716 - DNA, 22 bp, Homo sapiens
tgggcacagagtcccatctgcc

SEQ ID NO: 9437717 - DNA, 22 bp, Homo sapiens
tgggcacagagtcccatctgcc

SEQ ID NO: 9437718 - DNA, 22 bp, Homo sapiens
tgggcacagaatagatggccca

SEQ ID NO: 9437719 - DNA, 22 bp, Homo sapiens
tgggcacaaacatctgcctgtt

SEQ ID NO: 9437720 - DNA, 22 bp, Homo sapiens
tgggattcaccatgggcttcag

SEQ ID NO: 9437721 - DNA, 22 bp, Homo sapiens
tgggatgggatctcgctgtgtc

SEQ ID NO: 9437722 - DNA, 21 bp, Homo sapiens
tgggatgggtctgggaccagc

SEQ ID NO: 9437723 - DNA, 22 bp, Homo sapiens
tgggatgggatctcgctgtgtc

SEQ ID NO: 9437724 - DNA, 22 bp, Homo sapiens
tgggatggcctttgaaagccag

SEQ ID NO: 9437725 - DNA, 22 bp, Homo sapiens
tgggatggcctttgaaagccag

SEQ ID NO: 9437726 - DNA, 23 bp, Homo sapiens
tgggcagcttctgcatgcccacc

SEQ ID NO: 9437727 - DNA, 19 bp, Homo sapiens
tgggcagctccctctgtcc

SEQ ID NO: 9437728 - DNA, 23 bp, Homo sapiens
tgggcagcttctgcatgcccacc

SEQ ID NO: 9437729 - DNA, 19 bp, Homo sapiens
tgggcagctccctctgtcc

SEQ ID NO: 9437730 - DNA, 23 bp, Homo sapiens
tgggcagcttctgcatgcccacc

SEQ ID NO: 9437731 - DNA, 22 bp, Homo sapiens
tgggcagcttccacttagttag

SEQ ID NO: 9437732 - DNA, 19 bp, Homo sapiens
tgggcagctccctctgtcc

SEQ ID NO: 9437733 - DNA, 19 bp, Homo sapiens
tgggcagctccctctgtcc

SEQ ID NO: 9437734 - DNA, 22 bp, Homo sapiens
tgggcagccatcccagcctctc

SEQ ID NO: 9437735 - DNA, 22 bp, Homo sapiens
tgggcagcatcctccacagtca

SEQ ID NO: 9437736 - DNA, 22 bp, Homo sapiens
tgggcagggagctggaaccaca

SEQ ID NO: 9437737 - DNA, 22 bp, Homo sapiens
tgggcagggagctggaaccaca

SEQ ID NO: 9437738 - DNA, 22 bp, Homo sapiens
tgggcagggagctggaaccaca

SEQ ID NO: 9437739 - DNA, 22 bp, Homo sapiens
tgggcaggagagaagctaaaga

SEQ ID NO: 9437740 - DNA, 22 bp, Homo sapiens
tgggcaggagagaagctaaaga

SEQ ID NO: 9437741 - DNA, 22 bp, Homo sapiens
tgggcagggagctggaaccaca

SEQ ID NO: 9437742 - DNA, 22 bp, Homo sapiens
tgggcaggagagaagctaaaga

SEQ ID NO: 9437743 - DNA, 22 bp, Homo sapiens
tgggcagggatctcttttgcaa

SEQ ID NO: 9437744 - DNA, 22 bp, Homo sapiens
tgggcagggatctcttttgcaa

SEQ ID NO: 9437745 - DNA, 22 bp, Homo sapiens
tgggcagggagctggaaccaca

SEQ ID NO: 9437746 - DNA, 22 bp, Homo sapiens
tgggcagggagctggaaccaca

SEQ ID NO: 9437747 - DNA, 22 bp, Homo sapiens
tgggcagggagctggaaccaca

SEQ ID NO: 9437748 - DNA, 22 bp, Homo sapiens
tgggcagggagctggaaccaca

SEQ ID NO: 9437749 - DNA, 22 bp, Homo sapiens
tgggcagggagctggaaccaca

SEQ ID NO: 9437750 - DNA, 22 bp, Homo sapiens
tgggcagggagctggaaccaca

SEQ ID NO: 9437751 - DNA, 22 bp, Homo sapiens
tgggcagggagctggaaccaca

SEQ ID NO: 9437752 - DNA, 22 bp, Homo sapiens
tgggcagggatctcttttgcaa

SEQ ID NO: 9437753 - DNA, 22 bp, Homo sapiens
tgggcaggggccctgcttccgt

SEQ ID NO: 9437754 - DNA, 22 bp, Homo sapiens
tgggcaggggccctgcttccgt

SEQ ID NO: 9437755 - DNA, 22 bp, Homo sapiens
tgggcaggggccctgcttccgt

SEQ ID NO: 9437756 - DNA, 22 bp, Homo sapiens
tgggcagcagcaaagccagact

SEQ ID NO: 9437757 - DNA, 22 bp, Homo sapiens
tgggcagcatcctccacagtca

SEQ ID NO: 9437758 - DNA, 20 bp, Homo sapiens
tgggcagcactgctggctgg

SEQ ID NO: 9437759 - DNA, 22 bp, Homo sapiens
tgggcagcagaaccaggccgac

SEQ ID NO: 9437760 - DNA, 22 bp, Homo sapiens
tgggcagcagaaccaggccgac

SEQ ID NO: 9437761 - DNA, 22 bp, Homo sapiens
tgggcagcagaaccaggccgac

SEQ ID NO: 9437762 - DNA, 20 bp, Homo sapiens
tgggcagcactgctggctgg

SEQ ID NO: 9437763 - DNA, 22 bp, Homo sapiens
tgggcagcaaagactgtgtgct

SEQ ID NO: 9437764 - DNA, 22 bp, Homo sapiens
tgggcagcaaagactgtgtgct

SEQ ID NO: 9437765 - DNA, 22 bp, Homo sapiens
tgggcagattaatgcagtggct

SEQ ID NO: 9437766 - DNA, 22 bp, Homo sapiens
tgggcagattaatgcagtggct

SEQ ID NO: 9437767 - DNA, 22 bp, Homo sapiens
tgggcagattaatgcagtggct

SEQ ID NO: 9437768 - DNA, 22 bp, Homo sapiens
tgggcagattaatgcagtggct

SEQ ID NO: 9437769 - DNA, 22 bp, Homo sapiens
tgggcagcaaagactgtgtgct

SEQ ID NO: 9437770 - DNA, 22 bp, Homo sapiens
tgggcagatctttggtggctag

SEQ ID NO: 9437771 - DNA, 15 bp, Homo sapiens
tgggcagatcacttg

SEQ ID NO: 9437772 - DNA, 15 bp, Homo sapiens
tgggcagatcacttg

SEQ ID NO: 9437773 - DNA, 22 bp, Homo sapiens
tgggcagagttgtgatgaactg

SEQ ID NO: 9437774 - DNA, 22 bp, Homo sapiens
tgggcagagttgtgatgaactg

SEQ ID NO: 9437775 - DNA, 22 bp, Homo sapiens
tgggcagagttgtgatgaactg

SEQ ID NO: 9437776 - DNA, 21 bp, Homo sapiens
tgggcagatggcagtgtggct

SEQ ID NO: 9437777 - DNA, 16 bp, Homo sapiens
tgggcagatgagaaga

SEQ ID NO: 9437778 - DNA, 16 bp, Homo sapiens
tgggcagatgagaaga

SEQ ID NO: 9437779 - DNA, 22 bp, Homo sapiens
tgggcagatctttggtggctag

SEQ ID NO: 9437780 - DNA, 22 bp, Homo sapiens
tgggcagatctttggtggctag

SEQ ID NO: 9437781 - DNA, 22 bp, Homo sapiens
tgggcagatctttggtggctag

SEQ ID NO: 9437782 - DNA, 21 bp, Homo sapiens
tgggcagatggcagtgtggct

SEQ ID NO: 9437783 - DNA, 21 bp, Homo sapiens
tgggcagatggcagtgtggct

SEQ ID NO: 9437784 - DNA, 21 bp, Homo sapiens
tgggcagatggcagtgtggct

SEQ ID NO: 9437785 - DNA, 22 bp, Homo sapiens
tgggcagatgtcctctgaagtg

SEQ ID NO: 9437786 - DNA, 22 bp, Homo sapiens
tgggcagatgtcctctgaagtg

SEQ ID NO: 9437787 - DNA, 22 bp, Homo sapiens
tgggcagattaatgcagtggct

SEQ ID NO: 9437788 - DNA, 22 bp, Homo sapiens
tgggcagatgtggctctccttg

SEQ ID NO: 9437789 - DNA, 22 bp, Homo sapiens
tgggcagatgtggctctccttg

SEQ ID NO: 9437790 - DNA, 22 bp, Homo sapiens
tgggcagatgtggctctccttg

SEQ ID NO: 9437791 - DNA, 22 bp, Homo sapiens
tgggccagctgaagtgccgccc

SEQ ID NO: 9437792 - DNA, 22 bp, Homo sapiens
tgggccagctgaagtgccgccc

SEQ ID NO: 9437793 - DNA, 22 bp, Homo sapiens
tgggccagctgaagtgccgccc

SEQ ID NO: 9437794 - DNA, 22 bp, Homo sapiens
tgggccagctgaagtgccgccc

SEQ ID NO: 9437795 - DNA, 22 bp, Homo sapiens
tgggccaggatttcaagaccct

SEQ ID NO: 9437796 - DNA, 22 bp, Homo sapiens
tgggccaggatttcaagaccct

SEQ ID NO: 9437797 - DNA, 22 bp, Homo sapiens
tgggccagctccctgcccctgg

SEQ ID NO: 9437798 - DNA, 22 bp, Homo sapiens
tgggccagctccctgcccctgg

SEQ ID NO: 9437799 - DNA, 22 bp, Homo sapiens
tgggccagctccctgcccctgg

SEQ ID NO: 9437800 - DNA, 22 bp, Homo sapiens
tgggccagcactgggtgctcat

SEQ ID NO: 9437801 - DNA, 22 bp, Homo sapiens
tgggccagcactgggtgctcat

SEQ ID NO: 9437802 - DNA, 22 bp, Homo sapiens
tgggccagcactgggtgctcat

SEQ ID NO: 9437803 - DNA, 22 bp, Homo sapiens
tgggccagcactgggtgctcat

SEQ ID NO: 9437804 - DNA, 22 bp, Homo sapiens
tgggccagcaattgctgctcag

SEQ ID NO: 9437805 - DNA, 22 bp, Homo sapiens
tgggccagcaattgctgctcag

SEQ ID NO: 9437806 - DNA, 22 bp, Homo sapiens
tgggccacgtcatctcccacaa

SEQ ID NO: 9437807 - DNA, 22 bp, Homo sapiens
tgggccagcaattgctgctcag

SEQ ID NO: 9437808 - DNA, 22 bp, Homo sapiens
tgggccacacacagaagaatca

SEQ ID NO: 9437809 - DNA, 22 bp, Homo sapiens
tgggccacaagccatgggacca

SEQ ID NO: 9437810 - DNA, 22 bp, Homo sapiens
tgggccacagctcacacatcca

SEQ ID NO: 9437811 - DNA, 22 bp, Homo sapiens
tgggccacagttcaccaatccc

SEQ ID NO: 9437812 - DNA, 22 bp, Homo sapiens
tgggcaggggccctgcttccgt

SEQ ID NO: 9437813 - DNA, 22 bp, Homo sapiens
tgggcaggggccctgcttccgt

SEQ ID NO: 9437814 - DNA, 22 bp, Homo sapiens
tgggcaggggccctgcttccgt

SEQ ID NO: 9437815 - DNA, 22 bp, Homo sapiens
tgggcaggggccctgcttccgt

SEQ ID NO: 9437816 - DNA, 22 bp, Homo sapiens
tgggcagggtctctgttatcag

SEQ ID NO: 9437817 - DNA, 22 bp, Homo sapiens
tgggcagggtctctgttatcag

SEQ ID NO: 9437818 - DNA, 19 bp, Homo sapiens
tgggcaggttcagtaatgg

SEQ ID NO: 9437819 - DNA, 19 bp, Homo sapiens
tgggcaggttcagtaatgg

SEQ ID NO: 9437820 - DNA, 19 bp, Homo sapiens
tgggcaggttcagtaatgg

SEQ ID NO: 9437821 - DNA, 22 bp, Homo sapiens
tgggcaggtgctattttccatg

SEQ ID NO: 9437822 - DNA, 22 bp, Homo sapiens
tgggcaggtgctattttccatg

SEQ ID NO: 9437823 - DNA, 19 bp, Homo sapiens
tgggcaggttcagtaatgg

SEQ ID NO: 9437824 - DNA, 19 bp, Homo sapiens
tgggcaggttcagtaatgg

SEQ ID NO: 9437825 - DNA, 19 bp, Homo sapiens
tgggcagtgccagggctta

SEQ ID NO: 9437826 - DNA, 19 bp, Homo sapiens
tgggcagtgccagggctta

SEQ ID NO: 9437827 - DNA, 22 bp, Homo sapiens
tgggcagtgagaaaggtcaggt

SEQ ID NO: 9437828 - DNA, 22 bp, Homo sapiens
tgggcagtgagaaaggtcaggt

SEQ ID NO: 9437829 - DNA, 22 bp, Homo sapiens
tgggcaggttgttatttgacat

SEQ ID NO: 9437830 - DNA, 22 bp, Homo sapiens
tgggcaggttgttatttgacat

SEQ ID NO: 9437831 - DNA, 22 bp, Homo sapiens
tgggcaggttgttatttgacat

SEQ ID NO: 9437832 - DNA, 22 bp, Homo sapiens
tgggcagtatttgcagaataat

SEQ ID NO: 9437833 - DNA, 22 bp, Homo sapiens
tgggcatcatggacagcagagg

SEQ ID NO: 9437834 - DNA, 22 bp, Homo sapiens
tgggcatcatggacagcagagg

SEQ ID NO: 9437835 - DNA, 22 bp, Homo sapiens
tgggcagtgggcctaggtgtga

SEQ ID NO: 9437836 - DNA, 22 bp, Homo sapiens
tgggcatggactgtggagccgc

SEQ ID NO: 9437837 - DNA, 22 bp, Homo sapiens
tgggcatgaagaaggaagtggg

SEQ ID NO: 9437838 - DNA, 22 bp, Homo sapiens
tgggcatgagtggacagagaag

SEQ ID NO: 9437839 - DNA, 22 bp, Homo sapiens
tgggctgagcactgaggaagga

SEQ ID NO: 9437840 - DNA, 20 bp, Homo sapiens
tgggctgaggatcaggtgcc

SEQ ID NO: 9437841 - DNA, 22 bp, Homo sapiens
tgggctgagtgtggaactagtt

SEQ ID NO: 9437842 - DNA, 22 bp, Homo sapiens
tgggctgagtggcagccagagt

SEQ ID NO: 9437843 - DNA, 22 bp, Homo sapiens
tgggctgagtggcagccagagt

SEQ ID NO: 9437844 - DNA, 22 bp, Homo sapiens
tgggctgagcactgaggaagga

SEQ ID NO: 9437845 - DNA, 22 bp, Homo sapiens
tgggctgagcagtgaagctcat

SEQ ID NO: 9437846 - DNA, 20 bp, Homo sapiens
tgggctgaggatcaggtgcc

SEQ ID NO: 9437847 - DNA, 20 bp, Homo sapiens
tgggctgaggatcaggtgcc

SEQ ID NO: 9437848 - DNA, 21 bp, Homo sapiens
tgggctctttaacccaggcac

SEQ ID NO: 9437849 - DNA, 21 bp, Homo sapiens
tgggctctttaacccaggcac

SEQ ID NO: 9437850 - DNA, 21 bp, Homo sapiens
tgggctctttaacccaggcac

SEQ ID NO: 9437851 - DNA, 22 bp, Homo sapiens
tgggctgaaatgctgtggacta

SEQ ID NO: 9437852 - DNA, 22 bp, Homo sapiens
tgggctctgtgccaggttggtg

SEQ ID NO: 9437853 - DNA, 22 bp, Homo sapiens
tgggctctggtttcctggctgg

SEQ ID NO: 9437854 - DNA, 22 bp, Homo sapiens
tgggctgcaccctcagcctctg

SEQ ID NO: 9437855 - DNA, 22 bp, Homo sapiens
tgggctgcaccctcagcctctg

SEQ ID NO: 9437856 - DNA, 22 bp, Homo sapiens
tgggctgcaccctcagcctctg

SEQ ID NO: 9437857 - DNA, 22 bp, Homo sapiens
tgggctgagtgtggaactagtt

SEQ ID NO: 9437858 - DNA, 22 bp, Homo sapiens
tgggctgcaggggttgagagct

SEQ ID NO: 9437859 - DNA, 22 bp, Homo sapiens
tgggctgcagagcccggccttc

SEQ ID NO: 9437860 - DNA, 22 bp, Homo sapiens
tgggctgccagctctccagatg

SEQ ID NO: 9437861 - DNA, 22 bp, Homo sapiens
tgggctgcactgctctttatcg

SEQ ID NO: 9437862 - DNA, 22 bp, Homo sapiens
tgggctgcactccattttctgc

SEQ ID NO: 9437863 - DNA, 22 bp, Homo sapiens
tgggctgccctgatggtcctca

SEQ ID NO: 9437864 - DNA, 22 bp, Homo sapiens
tgggctgccctgatggtcctca

SEQ ID NO: 9437865 - DNA, 22 bp, Homo sapiens
tgggctgccggcaggctctgcc

SEQ ID NO: 9437866 - DNA, 22 bp, Homo sapiens
tgggctgccggcaggctctgcc

SEQ ID NO: 9437867 - DNA, 22 bp, Homo sapiens
tgggctgcccaaggtggccatg

SEQ ID NO: 9437868 - DNA, 22 bp, Homo sapiens
tgggctgccctgatggtcctca

SEQ ID NO: 9437869 - DNA, 22 bp, Homo sapiens
tgggctgccagctctccagatg

SEQ ID NO: 9437870 - DNA, 22 bp, Homo sapiens
tgggctctggggaaactgtgat

SEQ ID NO: 9437871 - DNA, 22 bp, Homo sapiens
tgggctctgggtggcctgagca

SEQ ID NO: 9437872 - DNA, 22 bp, Homo sapiens
tgggctctgggtggcctgagca

SEQ ID NO: 9437873 - DNA, 22 bp, Homo sapiens
tgggctctggacaaacccttgc

SEQ ID NO: 9437874 - DNA, 22 bp, Homo sapiens
tgggctctggacaaacccttgc

SEQ ID NO: 9437875 - DNA, 22 bp, Homo sapiens
tgggctctggaattgagtggcc

SEQ ID NO: 9437876 - DNA, 22 bp, Homo sapiens
tgggctctggagggcctaggat

SEQ ID NO: 9437877 - DNA, 22 bp, Homo sapiens
tgggctctggagggcctaggat

SEQ ID NO: 9437878 - DNA, 22 bp, Homo sapiens
tgggctctgctgcgtaccagtt

SEQ ID NO: 9437879 - DNA, 20 bp, Homo sapiens
tgggctctgcttcctggagt

SEQ ID NO: 9437880 - DNA, 22 bp, Homo sapiens
tgggctctgctgcgtaccagtt

SEQ ID NO: 9437881 - DNA, 22 bp, Homo sapiens
tgggctctgctgcgtaccagtt

SEQ ID NO: 9437882 - DNA, 22 bp, Homo sapiens
tgggctctgctgcgtaccagtt

SEQ ID NO: 9437883 - DNA, 22 bp, Homo sapiens
tgggctctgcatcagtgcccat

SEQ ID NO: 9437884 - DNA, 22 bp, Homo sapiens
tgggctctgcatcagtgcccat

SEQ ID NO: 9437885 - DNA, 22 bp, Homo sapiens
tgggctctgcatcagtgcccat

SEQ ID NO: 9437886 - DNA, 22 bp, Homo sapiens
tgggctctgaagtcagtctgct

SEQ ID NO: 9437887 - DNA, 22 bp, Homo sapiens
tgggctctgaagtcagtctgct

SEQ ID NO: 9437888 - DNA, 22 bp, Homo sapiens
tgggctctgaagggtcccggat

SEQ ID NO: 9437889 - DNA, 22 bp, Homo sapiens
tgggctctgaagggtcccggat

SEQ ID NO: 9437890 - DNA, 22 bp, Homo sapiens
tgggctctctggcaggaaggct

SEQ ID NO: 9437891 - DNA, 22 bp, Homo sapiens
tgggctctctcacctggaggct

SEQ ID NO: 9437892 - DNA, 22 bp, Homo sapiens
tgggctctcgtccctgcagaag

SEQ ID NO: 9437893 - DNA, 22 bp, Homo sapiens
tgggctctcgtccctgcagaag

SEQ ID NO: 9437894 - DNA, 22 bp, Homo sapiens
tgggctctctcacctggaggct

SEQ ID NO: 9437895 - DNA, 22 bp, Homo sapiens
tgggctctcctggaggacaaca

SEQ ID NO: 9437896 - DNA, 22 bp, Homo sapiens
tgggctctcagtcagactggca

SEQ ID NO: 9437897 - DNA, 22 bp, Homo sapiens
tgggctctcacacatgttctga

SEQ ID NO: 9437898 - DNA, 22 bp, Homo sapiens
tgggctctattcagagtttttc

SEQ ID NO: 9437899 - DNA, 22 bp, Homo sapiens
tgggctctcaaagtgcggcttg

SEQ ID NO: 9437900 - DNA, 22 bp, Homo sapiens
tgggccttacttggggctgact

SEQ ID NO: 9437901 - DNA, 22 bp, Homo sapiens
tgggcgaggagaatgctgtgaa

SEQ ID NO: 9437902 - DNA, 22 bp, Homo sapiens
tgggcgacagagcaagactccg

SEQ ID NO: 9437903 - DNA, 22 bp, Homo sapiens
tgggcgacagagcaagactccg

SEQ ID NO: 9437904 - DNA, 22 bp, Homo sapiens
tgggcctgttgcctgagtccat

SEQ ID NO: 9437905 - DNA, 22 bp, Homo sapiens
tgggcctgttgcctgagtccat

SEQ ID NO: 9437906 - DNA, 22 bp, Homo sapiens
tgggcctgtttcccttcagggc

SEQ ID NO: 9437907 - DNA, 22 bp, Homo sapiens
tgggcctgtttcccttcagggc

SEQ ID NO: 9437908 - DNA, 22 bp, Homo sapiens
tgggcctgtttcccttcagggc

SEQ ID NO: 9437909 - DNA, 22 bp, Homo sapiens
tgggcctgtgatgctgggctat

SEQ ID NO: 9437910 - DNA, 22 bp, Homo sapiens
tgggcctgggtctttgctgcca

SEQ ID NO: 9437911 - DNA, 22 bp, Homo sapiens
tgggcctgggttcctcctgggc

SEQ ID NO: 9437912 - DNA, 22 bp, Homo sapiens
tgggcctgtggcttggctctag

SEQ ID NO: 9437913 - DNA, 22 bp, Homo sapiens
tgggcctgtggcttggctctag

SEQ ID NO: 9437914 - DNA, 20 bp, Homo sapiens
tgggcctgtggcagaagtct

SEQ ID NO: 9437915 - DNA, 20 bp, Homo sapiens
tgggcctgtggcagaagtct

SEQ ID NO: 9437916 - DNA, 22 bp, Homo sapiens
tgggcctgtgatgctgggctat

SEQ ID NO: 9437917 - DNA, 22 bp, Homo sapiens
tgggctcaggaccccagaggcc

SEQ ID NO: 9437918 - DNA, 22 bp, Homo sapiens
tgggctcagccttcatgtggcc

SEQ ID NO: 9437919 - DNA, 22 bp, Homo sapiens
tgggctcagccttcatgtggcc

SEQ ID NO: 9437920 - DNA, 22 bp, Homo sapiens
tgggctattaggaccaggccat

SEQ ID NO: 9437921 - DNA, 22 bp, Homo sapiens
tgggctagcagggaagagagac

SEQ ID NO: 9437922 - DNA, 23 bp, Homo sapiens
tgggcgaggcaggagtggagcac

SEQ ID NO: 9437923 - DNA, 22 bp, Homo sapiens
tgggcgaggcccagggctgcgt

SEQ ID NO: 9437924 - DNA, 22 bp, Homo sapiens
tgggcctctgtttcctcatctg

SEQ ID NO: 9437925 - DNA, 22 bp, Homo sapiens
tgggcctctgtttcctcatctg

SEQ ID NO: 9437926 - DNA, 20 bp, Homo sapiens
tgggcctctggtgcctctgg

SEQ ID NO: 9437927 - DNA, 22 bp, Homo sapiens
tgggcctgaaggagctgcgccc

SEQ ID NO: 9437928 - DNA, 22 bp, Homo sapiens
tgggcctgaaggagctgcgccc

SEQ ID NO: 9437929 - DNA, 22 bp, Homo sapiens
tgggcctcggggaagcccgtgt

SEQ ID NO: 9437930 - DNA, 22 bp, Homo sapiens
tgggcctcggagcacaggagac

SEQ ID NO: 9437931 - DNA, 23 bp, Homo sapiens
tgggcctctccacccttttctgt

SEQ ID NO: 9437932 - DNA, 23 bp, Homo sapiens
tgggcctctccacccttttctgt

SEQ ID NO: 9437933 - DNA, 22 bp, Homo sapiens
tgggcctctgccacgctccccc

SEQ ID NO: 9437934 - DNA, 22 bp, Homo sapiens
tgggcctctgggttagtcccta

SEQ ID NO: 9437935 - DNA, 22 bp, Homo sapiens
tgggcctctgccacgctccccc

SEQ ID NO: 9437936 - DNA, 22 bp, Homo sapiens
tgggcctgagctcaccaggggc

SEQ ID NO: 9437937 - DNA, 20 bp, Homo sapiens
tgggcctgagcctgtgggct

SEQ ID NO: 9437938 - DNA, 20 bp, Homo sapiens
tgggcctgagcctgtgggct

SEQ ID NO: 9437939 - DNA, 22 bp, Homo sapiens
tgggcctgagctcaccaggggc

SEQ ID NO: 9437940 - DNA, 22 bp, Homo sapiens
tgggcctgactcacctgcctcc

SEQ ID NO: 9437941 - DNA, 18 bp, Homo sapiens
tgggcctgcatcctagtc

SEQ ID NO: 9437942 - DNA, 18 bp, Homo sapiens
tgggcctgcatcctagtc

SEQ ID NO: 9437943 - DNA, 22 bp, Homo sapiens
tgggcctgattcttgaatcctg

SEQ ID NO: 9437944 - DNA, 22 bp, Homo sapiens
tgggcctgatttatcatcttca

SEQ ID NO: 9437945 - DNA, 22 bp, Homo sapiens
tgggcctgattcttgaatcctg

SEQ ID NO: 9437946 - DNA, 21 bp, Homo sapiens
tgggcctgattcccagggtca

SEQ ID NO: 9437947 - DNA, 21 bp, Homo sapiens
tgggcctgattcccagggtca

SEQ ID NO: 9437948 - DNA, 21 bp, Homo sapiens
tgggcctgattcccagggtca

SEQ ID NO: 9437949 - DNA, 21 bp, Homo sapiens
tgggcctgattcccagggtca

SEQ ID NO: 9437950 - DNA, 18 bp, Homo sapiens
tgggcctgcatcctagtc

SEQ ID NO: 9437951 - DNA, 18 bp, Homo sapiens
tgggcctgcatcctagtc

SEQ ID NO: 9437952 - DNA, 22 bp, Homo sapiens
tgggcctgccccaggcttcagc

SEQ ID NO: 9437953 - DNA, 22 bp, Homo sapiens
tgggcctgccccaggcttcagc

SEQ ID NO: 9437954 - DNA, 22 bp, Homo sapiens
tgggcctgccccaggcttcagc

SEQ ID NO: 9437955 - DNA, 22 bp, Homo sapiens
tgggcctgccccaggcttcagc

SEQ ID NO: 9437956 - DNA, 22 bp, Homo sapiens
tgggcctgggctggacagcctg

SEQ ID NO: 9437957 - DNA, 22 bp, Homo sapiens
tgggcctgggctggacagcctg

SEQ ID NO: 9437958 - DNA, 22 bp, Homo sapiens
tgggcctgggctcctgtcctct

SEQ ID NO: 9437959 - DNA, 22 bp, Homo sapiens
tgggcctgggctcctgtcctct

SEQ ID NO: 9437960 - DNA, 22 bp, Homo sapiens
tgggcctgggctggacagcctg

SEQ ID NO: 9437961 - DNA, 22 bp, Homo sapiens
tgggcctcatgcccagccaccc

SEQ ID NO: 9437962 - DNA, 21 bp, Homo sapiens
tgggcctcaggcagctgtgac

SEQ ID NO: 9437963 - DNA, 22 bp, Homo sapiens
tgggcctcctgccctggcctag

SEQ ID NO: 9437964 - DNA, 22 bp, Homo sapiens
tgggcctccgcatggcccagcg

SEQ ID NO: 9437965 - DNA, 22 bp, Homo sapiens
tgggcctcctgccctggcctag

SEQ ID NO: 9437966 - DNA, 22 bp, Homo sapiens
tgggcctcctggaagaatgtgg

SEQ ID NO: 9437967 - DNA, 22 bp, Homo sapiens
tgggccagttggtgactacaaa

SEQ ID NO: 9437968 - DNA, 22 bp, Homo sapiens
tgggccagtttctcattgaaat

SEQ ID NO: 9437969 - DNA, 19 bp, Homo sapiens
tgggcctcacaatgctccc

SEQ ID NO: 9437970 - DNA, 22 bp, Homo sapiens
tgggccagtttctcattgaaat

SEQ ID NO: 9437971 - DNA, 19 bp, Homo sapiens
tgggcctcacaatgctccc

SEQ ID NO: 9437972 - DNA, 22 bp, Homo sapiens
tgggccagttggtgactacaaa

SEQ ID NO: 9437973 - DNA, 22 bp, Homo sapiens
tgggccagttggaatggatact

SEQ ID NO: 9437974 - DNA, 22 bp, Homo sapiens
tgggccagttggaatggatact

SEQ ID NO: 9437975 - DNA, 22 bp, Homo sapiens
tgggccagttggaatggatact

SEQ ID NO: 9437976 - DNA, 22 bp, Homo sapiens
tgggccagtcctgcctaaggtg

SEQ ID NO: 9437977 - DNA, 22 bp, Homo sapiens
tgggccagttatttcacctctg

SEQ ID NO: 9437978 - DNA, 23 bp, Homo sapiens
tgggccagttctgttgaaagcca

SEQ ID NO: 9437979 - DNA, 22 bp, Homo sapiens
tgggccagttctttactcgtcc

SEQ ID NO: 9437980 - DNA, 23 bp, Homo sapiens
tgggccagttctgttgaaagcca

SEQ ID NO: 9437981 - DNA, 22 bp, Homo sapiens
tgggccagtccagccccaggga

SEQ ID NO: 9437982 - DNA, 22 bp, Homo sapiens
tgggccagtcctgcctaaggtg

SEQ ID NO: 9437983 - DNA, 22 bp, Homo sapiens
tgggccagtccagccccaggga

SEQ ID NO: 9437984 - DNA, 22 bp, Homo sapiens
tgggccagtccagccccaggga

SEQ ID NO: 9437985 - DNA, 22 bp, Homo sapiens
tgggccagtagctactcgcaag

SEQ ID NO: 9437986 - DNA, 21 bp, Homo sapiens
tgggccagtagaaaggaaggc

SEQ ID NO: 9437987 - DNA, 21 bp, Homo sapiens
tgggccagtagaaaggaaggc

SEQ ID NO: 9437988 - DNA, 22 bp, Homo sapiens
tgggccaggtgcagtgctttag

SEQ ID NO: 9437989 - DNA, 22 bp, Homo sapiens
tgggccaggtgcagtgctttag

SEQ ID NO: 9437990 - DNA, 17 bp, Homo sapiens
tgggccagtagaaggga

SEQ ID NO: 9437991 - DNA, 17 bp, Homo sapiens
tgggccagtagaaggga

SEQ ID NO: 9437992 - DNA, 21 bp, Homo sapiens
tgggccagtagaaaggaaggc

SEQ ID NO: 9437993 - DNA, 17 bp, Homo sapiens
tgggccagtagaaggga

SEQ ID NO: 9437994 - DNA, 17 bp, Homo sapiens
tgggccagtagaaggga

SEQ ID NO: 9437995 - DNA, 22 bp, Homo sapiens
tgggccaggtctgtgtcagctg

SEQ ID NO: 9437996 - DNA, 22 bp, Homo sapiens
tgggccaggggcctcttctgat

SEQ ID NO: 9437997 - DNA, 22 bp, Homo sapiens
tgggccaggtctgcggtcattt

SEQ ID NO: 9437998 - DNA, 22 bp, Homo sapiens
tgggccaggggcctcttctgat

SEQ ID NO: 9437999 - DNA, 22 bp, Homo sapiens
tgggccaggcatgtgatcagca

SEQ ID NO: 9438000 - DNA, 22 bp, Homo sapiens
tgggccaggcatgtgatcagca

SEQ ID NO: 9438001 - DNA, 22 bp, Homo sapiens
tgggccagggcacccagtccag

SEQ ID NO: 9438002 - DNA, 22 bp, Homo sapiens
tgggccagggcacccagtccag

SEQ ID NO: 9438003 - DNA, 22 bp, Homo sapiens
tgggccagggcacccagtccag

SEQ ID NO: 9438004 - DNA, 23 bp, Homo sapiens
tgggccagggagtccggtttctt

SEQ ID NO: 9438005 - DNA, 20 bp, Homo sapiens
tgtgtgctaggactacagtg

SEQ ID NO: 9438006 - DNA, 22 bp, Homo sapiens
tgtgtgctcgatggccctgcag

SEQ ID NO: 9438007 - DNA, 22 bp, Homo sapiens
tgtgtgctctaatgcctagtac

SEQ ID NO: 9438008 - DNA, 19 bp, Homo sapiens
tgtgtgctgactgccagag

SEQ ID NO: 9438009 - DNA, 22 bp, Homo sapiens
tgtgtgggagcacgggctgttg

SEQ ID NO: 9438010 - DNA, 22 bp, Homo sapiens
tgtgtgggagcacgggctgttg

SEQ ID NO: 9438011 - DNA, 22 bp, Homo sapiens
tgtgtgggagcacgggctgttg

SEQ ID NO: 9438012 - DNA, 21 bp, Homo sapiens
tgtgtgggcatatctgctgca

SEQ ID NO: 9438013 - DNA, 21 bp, Homo sapiens
tgtgtgggcatatctgctgca

SEQ ID NO: 9438014 - DNA, 22 bp, Homo sapiens
tgtgtggattcatctcaaagag

SEQ ID NO: 9438015 - DNA, 22 bp, Homo sapiens
tgtgtggcaagctgtatgctag

SEQ ID NO: 9438016 - DNA, 22 bp, Homo sapiens
tgtgtggcctccatagggtact

SEQ ID NO: 9438017 - DNA, 22 bp, Homo sapiens
tgtgtgggagcacgggctgttg

SEQ ID NO: 9438018 - DNA, 22 bp, Homo sapiens
tgtgtgggagcacgggctgttg

SEQ ID NO: 9438019 - DNA, 22 bp, Homo sapiens
tgtgtggcgttgcgtggctagg

SEQ ID NO: 9438020 - DNA, 22 bp, Homo sapiens
tgtgtgtgagtcctggctttcc

SEQ ID NO: 9438021 - DNA, 22 bp, Homo sapiens
tgtgtgtgagtcctggctttcc

SEQ ID NO: 9438022 - DNA, 22 bp, Homo sapiens
tgtgtgtgactcatactagaac

SEQ ID NO: 9438023 - DNA, 22 bp, Homo sapiens
tgtgtgtgactcatactagaac

SEQ ID NO: 9438024 - DNA, 22 bp, Homo sapiens
tgtgtgtgcacatgcatataca

SEQ ID NO: 9438025 - DNA, 22 bp, Homo sapiens
tgtgtgtgagtcctggctttcc

SEQ ID NO: 9438026 - DNA, 22 bp, Homo sapiens
tgtgtgtgcacatgcatataca

SEQ ID NO: 9438027 - DNA, 22 bp, Homo sapiens
tgtgtgtgcacatgcatataca

SEQ ID NO: 9438028 - DNA, 22 bp, Homo sapiens
tgtgtgtgcacatgcatataca

SEQ ID NO: 9438029 - DNA, 22 bp, Homo sapiens
tgtgtgtgaaccattgagggct

SEQ ID NO: 9438030 - DNA, 22 bp, Homo sapiens
tgtgtgtgaaccattgagggct

SEQ ID NO: 9438031 - DNA, 22 bp, Homo sapiens
tgtgtgtgaaccattgagggct

SEQ ID NO: 9438032 - DNA, 22 bp, Homo sapiens
tgtgtgtgaaccattgagggct

SEQ ID NO: 9438033 - DNA, 22 bp, Homo sapiens
tgtgtgtgaaccattgagggct

SEQ ID NO: 9438034 - DNA, 22 bp, Homo sapiens
tgtgtgtctttgcctcctctca

SEQ ID NO: 9438035 - DNA, 22 bp, Homo sapiens
tgtgtgtgacaacctagttcag

SEQ ID NO: 9438036 - DNA, 22 bp, Homo sapiens
tgtgtgtgacaacctagttcag

SEQ ID NO: 9438037 - DNA, 22 bp, Homo sapiens
tgtgtgtgacaacctagttcag

SEQ ID NO: 9438038 - DNA, 22 bp, Homo sapiens
tgtgtgtgactcatactagaac

SEQ ID NO: 9438039 - DNA, 22 bp, Homo sapiens
tgtgtcagaatttttgtggcaa

SEQ ID NO: 9438040 - DNA, 22 bp, Homo sapiens
tgtgtcagaggtagagatggca

SEQ ID NO: 9438041 - DNA, 22 bp, Homo sapiens
tgtgtcagaggtagagatggca

SEQ ID NO: 9438042 - DNA, 22 bp, Homo sapiens
tgtgtgcattagcattctaggg

SEQ ID NO: 9438043 - DNA, 22 bp, Homo sapiens
tgtgtgcatgttaatgagaaaa

SEQ ID NO: 9438044 - DNA, 22 bp, Homo sapiens
tgtgtgcatgcttggggcagca

SEQ ID NO: 9438045 - DNA, 22 bp, Homo sapiens
tgtgtgcattcacatgcatgcc

SEQ ID NO: 9438046 - DNA, 22 bp, Homo sapiens
tgtgtgcattcacatgcatgcc

SEQ ID NO: 9438047 - DNA, 22 bp, Homo sapiens
tgtgtgccagcctacgaggagc

SEQ ID NO: 9438048 - DNA, 22 bp, Homo sapiens
tgtgtgccccagatgagtagct

SEQ ID NO: 9438049 - DNA, 22 bp, Homo sapiens
tgtgtgctaatgtatgctctaa

SEQ ID NO: 9438050 - DNA, 22 bp, Homo sapiens
tgtgtgctaatgtatgctctaa

SEQ ID NO: 9438051 - DNA, 22 bp, Homo sapiens
tgtgtgcctgagccgtgcctgg

SEQ ID NO: 9438052 - DNA, 22 bp, Homo sapiens
tgtgtgctaatgtatgctctaa

SEQ ID NO: 9438053 - DNA, 22 bp, Homo sapiens
tgtgtcagaaggcaatggggat

SEQ ID NO: 9438054 - DNA, 22 bp, Homo sapiens
tgtgtcagaagtacttttggaa

SEQ ID NO: 9438055 - DNA, 22 bp, Homo sapiens
tgtgtcagaaggcaatggggat

SEQ ID NO: 9438056 - DNA, 22 bp, Homo sapiens
tgtgtcagaaatcagtgcctcg

SEQ ID NO: 9438057 - DNA, 22 bp, Homo sapiens
tgtgtcaagacatttagtcatt

SEQ ID NO: 9438058 - DNA, 22 bp, Homo sapiens
tgtgtcaacctgtggccgggtg

SEQ ID NO: 9438059 - DNA, 22 bp, Homo sapiens
tgtgtcaagacatttagtcatt

SEQ ID NO: 9438060 - DNA, 22 bp, Homo sapiens
tgtgtcaacaacagccttggat

SEQ ID NO: 9438061 - DNA, 22 bp, Homo sapiens
tgtgtcaaagtgtggagtattt

SEQ ID NO: 9438062 - DNA, 22 bp, Homo sapiens
tgtgtcaaattgttttacacag

SEQ ID NO: 9438063 - DNA, 21 bp, Homo sapiens
tgtgtcactaactagaggcta

SEQ ID NO: 9438064 - DNA, 22 bp, Homo sapiens
tgtgtcaatttatgtcattcat

SEQ ID NO: 9438065 - DNA, 22 bp, Homo sapiens
tgtgtcaattttcattcctact

SEQ ID NO: 9438066 - DNA, 22 bp, Homo sapiens
tgtgtcaagtggaatttcaggg

SEQ ID NO: 9438067 - DNA, 22 bp, Homo sapiens
tgtgtcaaggcatcagcccagc

SEQ ID NO: 9438068 - DNA, 22 bp, Homo sapiens
tgtgtattaccattttacagct

SEQ ID NO: 9438069 - DNA, 22 bp, Homo sapiens
tgtgtatttctggaacagacta

SEQ ID NO: 9438070 - DNA, 22 bp, Homo sapiens
tgtgtcaaagtcaggtgtcact

SEQ ID NO: 9438071 - DNA, 22 bp, Homo sapiens
tgtgtattctgaggtaggtata

SEQ ID NO: 9438072 - DNA, 22 bp, Homo sapiens
tgtgtattaccattttacagct

SEQ ID NO: 9438073 - DNA, 22 bp, Homo sapiens
tgtgtagctcatattagtgtta

SEQ ID NO: 9438074 - DNA, 20 bp, Homo sapiens
tgtgtagcaggtgctgtgcc

SEQ ID NO: 9438075 - DNA, 23 bp, Homo sapiens
tgtgtgtgtattctacgcaaggt

SEQ ID NO: 9438076 - DNA, 23 bp, Homo sapiens
tgtgtgtgtattctacgcaaggt

SEQ ID NO: 9438077 - DNA, 23 bp, Homo sapiens
tgtgtgtgtattctacgcaaggt

SEQ ID NO: 9438078 - DNA, 22 bp, Homo sapiens
tgtgtgtgtcctcatttgcaga

SEQ ID NO: 9438079 - DNA, 20 bp, Homo sapiens
tgtgtgtgtacttctaaata

SEQ ID NO: 9438080 - DNA, 22 bp, Homo sapiens
tgtgtgtgtaaaagcatttata

SEQ ID NO: 9438081 - DNA, 20 bp, Homo sapiens
tgtgtgtgtacttctaaata

SEQ ID NO: 9438082 - DNA, 20 bp, Homo sapiens
tgtgtgtgtacttctaaata

SEQ ID NO: 9438083 - DNA, 20 bp, Homo sapiens
tgtgtgtgtacttctaaata

SEQ ID NO: 9438084 - DNA, 22 bp, Homo sapiens
tgtgtgtgtgcgcgcacgcata

SEQ ID NO: 9438085 - DNA, 22 bp, Homo sapiens
tgtgtgtgtcctcatttgcaga

SEQ ID NO: 9438086 - DNA, 22 bp, Homo sapiens
tgtgtgtgtcctcatttgcaga

SEQ ID NO: 9438087 - DNA, 22 bp, Homo sapiens
tgtgtgtgtgcgcgcacgcata

SEQ ID NO: 9438088 - DNA, 22 bp, Homo sapiens
tgtgtgtgtgcgcgcacgcata

SEQ ID NO: 9438089 - DNA, 22 bp, Homo sapiens
tgtgtgtgttcctcctcagcta

SEQ ID NO: 9438090 - DNA, 22 bp, Homo sapiens
tgtgtgtgttcctcctcagcta

SEQ ID NO: 9438091 - DNA, 22 bp, Homo sapiens
tgtgtgtggggaggcagcagat

SEQ ID NO: 9438092 - DNA, 22 bp, Homo sapiens
tgtgtgtggggaggcagcagat

SEQ ID NO: 9438093 - DNA, 22 bp, Homo sapiens
tgtgtgtgtaaaagcatttata

SEQ ID NO: 9438094 - DNA, 22 bp, Homo sapiens
tgtgtgtgtaaaagcatttata

SEQ ID NO: 9438095 - DNA, 22 bp, Homo sapiens
tgtgtgtgtaaaagcatttata

SEQ ID NO: 9438096 - DNA, 22 bp, Homo sapiens
tgtgtgtgggcggaacggcccc

SEQ ID NO: 9438097 - DNA, 22 bp, Homo sapiens
tgtgtgtgggcggaacggcccc

SEQ ID NO: 9438098 - DNA, 22 bp, Homo sapiens
tgtgtgtgggcggaacggcccc

SEQ ID NO: 9438099 - DNA, 22 bp, Homo sapiens
tgtgtgtggggaggcagcagat

SEQ ID NO: 9438100 - DNA, 22 bp, Homo sapiens
tgtgtgtgcaggagagcaggtg

SEQ ID NO: 9438101 - DNA, 22 bp, Homo sapiens
tgtgtgtgcaggagagcaggtg

SEQ ID NO: 9438102 - DNA, 21 bp, Homo sapiens
tgtgtgtgcaggcacacacac

SEQ ID NO: 9438103 - DNA, 21 bp, Homo sapiens
tgtgtgtgcaggcacacacac

SEQ ID NO: 9438104 - DNA, 22 bp, Homo sapiens
tgtgtgtgcaggagagcaggtg

SEQ ID NO: 9438105 - DNA, 22 bp, Homo sapiens
tgtgtgtgcacgtgcgcgcgag

SEQ ID NO: 9438106 - DNA, 22 bp, Homo sapiens
tgtgtgtgcacgtgcgcgcgag

SEQ ID NO: 9438107 - DNA, 22 bp, Homo sapiens
tgtgtgtgcacgtgcgcgcgag

SEQ ID NO: 9438108 - DNA, 22 bp, Homo sapiens
tgtgtgttaacttatttaatgt

SEQ ID NO: 9438109 - DNA, 22 bp, Homo sapiens
tgtgtgtgtttctgctcataca

SEQ ID NO: 9438110 - DNA, 22 bp, Homo sapiens
tgtgtgtgtttctgctcataca

SEQ ID NO: 9438111 - DNA, 22 bp, Homo sapiens
tgtgtgttagtctcaaagccgt

SEQ ID NO: 9438112 - DNA, 22 bp, Homo sapiens
tgtgtgttatcttagttcatct

SEQ ID NO: 9438113 - DNA, 22 bp, Homo sapiens
tgtgtgttattttcagccatta

SEQ ID NO: 9438114 - DNA, 22 bp, Homo sapiens
tgtgtgttcagagatagatata

SEQ ID NO: 9438115 - DNA, 22 bp, Homo sapiens
tgtgtgttggctggagagggct

SEQ ID NO: 9438116 - DNA, 19 bp, Homo sapiens
tgtgtgtttatatatgtat

SEQ ID NO: 9438117 - DNA, 22 bp, Homo sapiens
tgtgtgttctcaattattgatg

SEQ ID NO: 9438118 - DNA, 22 bp, Homo sapiens
tgtgtgtgtttacagtttctca

SEQ ID NO: 9438119 - DNA, 22 bp, Homo sapiens
tgtgtgtgtttacagtttctca

SEQ ID NO: 9438120 - DNA, 22 bp, Homo sapiens
tgtgtgtgtttacagtttctca

SEQ ID NO: 9438121 - DNA, 22 bp, Homo sapiens
tgtgtgtgtttataaatctaaa

SEQ ID NO: 9438122 - DNA, 22 bp, Homo sapiens
tgtgtgtgtttctgctcataca

SEQ ID NO: 9438123 - DNA, 22 bp, Homo sapiens
tgtgtgtgtttctgctcataca

SEQ ID NO: 9438124 - DNA, 22 bp, Homo sapiens
tgtgtgtgtttataaatctaaa

SEQ ID NO: 9438125 - DNA, 22 bp, Homo sapiens
tgtgtgtgtttataaatctaaa

SEQ ID NO: 9438126 - DNA, 22 bp, Homo sapiens
tgtgtgtgtttataaatctaaa

SEQ ID NO: 9438127 - DNA, 22 bp, Homo sapiens
tgttaaactgtattgcataagg

SEQ ID NO: 9438128 - DNA, 22 bp, Homo sapiens
tgttaaacctagtacaggtcct

SEQ ID NO: 9438129 - DNA, 22 bp, Homo sapiens
tgttaaaaccacaggtgaggac

SEQ ID NO: 9438130 - DNA, 22 bp, Homo sapiens
tgttaaaaattcagctctagat

SEQ ID NO: 9438131 - DNA, 22 bp, Homo sapiens
tgtgttaaggtgcatctagtgc

SEQ ID NO: 9438132 - DNA, 22 bp, Homo sapiens
tgttaaaaattcagctctagat

SEQ ID NO: 9438133 - DNA, 22 bp, Homo sapiens
tgttaaaaatgcagattcctat

SEQ ID NO: 9438134 - DNA, 19 bp, Homo sapiens
tgtgtgtttatatatgtat

SEQ ID NO: 9438135 - DNA, 19 bp, Homo sapiens
tgtgtgtttatatatgtat

SEQ ID NO: 9438136 - DNA, 19 bp, Homo sapiens
tgtggctgagcactcctta

SEQ ID NO: 9438137 - DNA, 19 bp, Homo sapiens
tgtggctgagcactcctta

SEQ ID NO: 9438138 - DNA, 22 bp, Homo sapiens
tgtggctgatcaaagcgctcag

SEQ ID NO: 9438139 - DNA, 23 bp, Homo sapiens
tgtggctgagaaattgacaactt

SEQ ID NO: 9438140 - DNA, 22 bp, Homo sapiens
tgtggctgactcctggtcccca

SEQ ID NO: 9438141 - DNA, 21 bp, Homo sapiens
tgtggctgacaccctttggga

SEQ ID NO: 9438142 - DNA, 22 bp, Homo sapiens
tgtggctccactccacattaat

SEQ ID NO: 9438143 - DNA, 22 bp, Homo sapiens
tgtggctctcatgcactcccag

SEQ ID NO: 9438144 - DNA, 22 bp, Homo sapiens
tgtggcctttcaaggatggaat

SEQ ID NO: 9438145 - DNA, 22 bp, Homo sapiens
tgtggccttgcagcctggaggt

SEQ ID NO: 9438146 - DNA, 22 bp, Homo sapiens
tgtggcgagaacattggaccat

SEQ ID NO: 9438147 - DNA, 22 bp, Homo sapiens
tgtggccttgcagcctggaggt

SEQ ID NO: 9438148 - DNA, 22 bp, Homo sapiens
tgtggccttgcagcctggaggt

SEQ ID NO: 9438149 - DNA, 22 bp, Homo sapiens
tgtggaatgctcctaagtgaat

SEQ ID NO: 9438150 - DNA, 22 bp, Homo sapiens
tgtggaatgggagtgagaagac

SEQ ID NO: 9438151 - DNA, 22 bp, Homo sapiens
tgtggaagaacactggccaggc

SEQ ID NO: 9438152 - DNA, 22 bp, Homo sapiens
tgtggaagaacactggccaggc

SEQ ID NO: 9438153 - DNA, 22 bp, Homo sapiens
tgtggaagaaacaagacacttt

SEQ ID NO: 9438154 - DNA, 22 bp, Homo sapiens
tgtggaagaacttcttgcttgg

SEQ ID NO: 9438155 - DNA, 22 bp, Homo sapiens
tgtggaagaacttcttgcttgg

SEQ ID NO: 9438156 - DNA, 22 bp, Homo sapiens
tgtggaagaaacaagacacttt

SEQ ID NO: 9438157 - DNA, 22 bp, Homo sapiens
tgtggaacacctagaatgggta

SEQ ID NO: 9438158 - DNA, 22 bp, Homo sapiens
tgtggaagggacactggactgg

SEQ ID NO: 9438159 - DNA, 22 bp, Homo sapiens
tgtggaagggacactggactgg

SEQ ID NO: 9438160 - DNA, 22 bp, Homo sapiens
tgtggaagccggtgggaagcag

SEQ ID NO: 9438161 - DNA, 22 bp, Homo sapiens
tgtggaaggcttccctggggtc

SEQ ID NO: 9438162 - DNA, 22 bp, Homo sapiens
tgtggaagggacactggactgg

SEQ ID NO: 9438163 - DNA, 22 bp, Homo sapiens
tgtgggaagtttggagggaaag

SEQ ID NO: 9438164 - DNA, 22 bp, Homo sapiens
tgtgggaatcagccaggggggc

SEQ ID NO: 9438165 - DNA, 22 bp, Homo sapiens
tgtgggaagatgttgcaggaga

SEQ ID NO: 9438166 - DNA, 22 bp, Homo sapiens
tgtgggaagatgttgcaggaga

SEQ ID NO: 9438167 - DNA, 22 bp, Homo sapiens
tgtggctgccaccctgaagccg

SEQ ID NO: 9438168 - DNA, 22 bp, Homo sapiens
tgtgggaaatgggagtggaaga

SEQ ID NO: 9438169 - DNA, 22 bp, Homo sapiens
tgtggctgcaggcgatggagga

SEQ ID NO: 9438170 - DNA, 22 bp, Homo sapiens
tgtggctgcaggcgatggagga

SEQ ID NO: 9438171 - DNA, 22 bp, Homo sapiens
tgtggctgcagacactggagcc

SEQ ID NO: 9438172 - DNA, 22 bp, Homo sapiens
tgtggctgcaaaggaaggctgc

SEQ ID NO: 9438173 - DNA, 22 bp, Homo sapiens
tgtggctgcaaaggaaggctgc

SEQ ID NO: 9438174 - DNA, 22 bp, Homo sapiens
tgtggctgcaaaggaaggctgc

SEQ ID NO: 9438175 - DNA, 23 bp, Homo sapiens
tgtgggaatgttggagaggaaac

SEQ ID NO: 9438176 - DNA, 22 bp, Homo sapiens
tgtgggaatgacgaggaagagg

SEQ ID NO: 9438177 - DNA, 22 bp, Homo sapiens
tgtgggaatgacgaggaagagg

SEQ ID NO: 9438178 - DNA, 22 bp, Homo sapiens
tgtgggaatgctgatgggatct

SEQ ID NO: 9438179 - DNA, 23 bp, Homo sapiens
tgtgggaatgttggagaggaaac

SEQ ID NO: 9438180 - DNA, 22 bp, Homo sapiens
tgtgggagaaggaagcaagctg

SEQ ID NO: 9438181 - DNA, 22 bp, Homo sapiens
tgtgggaaatgggagtggaaga

SEQ ID NO: 9438182 - DNA, 22 bp, Homo sapiens
tgtgggagaaggaagcaagctg

SEQ ID NO: 9438183 - DNA, 22 bp, Homo sapiens
tgtgggagaaggaagcaagctg

SEQ ID NO: 9438184 - DNA, 22 bp, Homo sapiens
tgtgggaggaattagaatggga

SEQ ID NO: 9438185 - DNA, 22 bp, Homo sapiens
tgtgggcaggcccgggtctgag

SEQ ID NO: 9438186 - DNA, 22 bp, Homo sapiens
tgtgggcaggcccgggtctgag

SEQ ID NO: 9438187 - DNA, 23 bp, Homo sapiens
tgtgggcgcattgtaagggtagc

SEQ ID NO: 9438188 - DNA, 22 bp, Homo sapiens
tgtgggctgtactgagggcagg

SEQ ID NO: 9438189 - DNA, 22 bp, Homo sapiens
tgtgggctctaatggcagcaga

SEQ ID NO: 9438190 - DNA, 22 bp, Homo sapiens
tgtgggaggaattagaatggga

SEQ ID NO: 9438191 - DNA, 22 bp, Homo sapiens
tgtgggaggattcagaattggg

SEQ ID NO: 9438192 - DNA, 22 bp, Homo sapiens
tgtgggaggattcagaattggg

SEQ ID NO: 9438193 - DNA, 22 bp, Homo sapiens
tgtgggaggtctggaaggctcc

SEQ ID NO: 9438194 - DNA, 22 bp, Homo sapiens
tgtgggcactaatgacatgcag

SEQ ID NO: 9438195 - DNA, 22 bp, Homo sapiens
tgtgggcactaatgacatgcag

SEQ ID NO: 9438196 - DNA, 22 bp, Homo sapiens
tgtgggcagctggagctgttca

SEQ ID NO: 9438197 - DNA, 22 bp, Homo sapiens
tgtgggcagatacacagacacg

SEQ ID NO: 9438198 - DNA, 22 bp, Homo sapiens
tgtgtacattgccttttaaagg

SEQ ID NO: 9438199 - DNA, 22 bp, Homo sapiens
tgtgtactcaattgagccattt

SEQ ID NO: 9438200 - DNA, 22 bp, Homo sapiens
tgtgtacatctcttctcacatt

SEQ ID NO: 9438201 - DNA, 23 bp, Homo sapiens
tgtgtacatacatatgtacacac

SEQ ID NO: 9438202 - DNA, 23 bp, Homo sapiens
tgtgtacatacatatgtacacac

SEQ ID NO: 9438203 - DNA, 22 bp, Homo sapiens
tgtgtacatatacacaaataca

SEQ ID NO: 9438204 - DNA, 22 bp, Homo sapiens
tgtgtacagcatggtccagcag

SEQ ID NO: 9438205 - DNA, 22 bp, Homo sapiens
tgtgtacaggaactgatcagat

SEQ ID NO: 9438206 - DNA, 22 bp, Homo sapiens
tgtgtacacatgacaggcaccc

SEQ ID NO: 9438207 - DNA, 22 bp, Homo sapiens
tgtgtacacacagatatataca

SEQ ID NO: 9438208 - DNA, 22 bp, Homo sapiens
tgtgtacacaatgattgcagag

SEQ ID NO: 9438209 - DNA, 22 bp, Homo sapiens
tgtgtacacaagtatatataca

SEQ ID NO: 9438210 - DNA, 22 bp, Homo sapiens
tgtgtacaagagtgtttactgt

SEQ ID NO: 9438211 - DNA, 22 bp, Homo sapiens
tgtgtacaagcctgagtacaga

SEQ ID NO: 9438212 - DNA, 22 bp, Homo sapiens
tgtgtacaaactaacaacatat

SEQ ID NO: 9438213 - DNA, 22 bp, Homo sapiens
tgtggggactgagtggaggctt

SEQ ID NO: 9438214 - DNA, 22 bp, Homo sapiens
tgtggggacctggctgccaccc

SEQ ID NO: 9438215 - DNA, 22 bp, Homo sapiens
tgtggggacccatgccatgggc

SEQ ID NO: 9438216 - DNA, 22 bp, Homo sapiens
tgtggggacctggctgccaccc

SEQ ID NO: 9438217 - DNA, 22 bp, Homo sapiens
tgttctttgctgttgatgtaga

SEQ ID NO: 9438218 - DNA, 22 bp, Homo sapiens
tgttcttatggctatttctccc

SEQ ID NO: 9438219 - DNA, 22 bp, Homo sapiens
tgttcttgagcctttagaccta

SEQ ID NO: 9438220 - DNA, 22 bp, Homo sapiens
tgttctttagcagaccatgttg

SEQ ID NO: 9438221 - DNA, 22 bp, Homo sapiens
tgttcttgggaatcttacagtt

SEQ ID NO: 9438222 - DNA, 22 bp, Homo sapiens
tgttctttcagttagacacagt

SEQ ID NO: 9438223 - DNA, 22 bp, Homo sapiens
tgttctttcagttagacacagt

SEQ ID NO: 9438224 - DNA, 19 bp, Homo sapiens
tgttcttaaactgatggca

SEQ ID NO: 9438225 - DNA, 17 bp, Homo sapiens
tgttctgttggaaagca

SEQ ID NO: 9438226 - DNA, 22 bp, Homo sapiens
tgttcttaacttttgtgtatat

SEQ ID NO: 9438227 - DNA, 22 bp, Homo sapiens
tgttcttaagactggaagttac

SEQ ID NO: 9438228 - DNA, 22 bp, Homo sapiens
tgttcttacggaacttatcttt

SEQ ID NO: 9438229 - DNA, 22 bp, Homo sapiens
tgttcttaggtatttgacagtc

SEQ ID NO: 9438230 - DNA, 22 bp, Homo sapiens
tgttcttagcatgcaaaatatg

SEQ ID NO: 9438231 - DNA, 22 bp, Homo sapiens
tgttagtattggcaaatttgtt

SEQ ID NO: 9438232 - DNA, 22 bp, Homo sapiens
tgttagaagttaatcactaatt

SEQ ID NO: 9438233 - DNA, 22 bp, Homo sapiens
tgttagaatattgtaatattcg

SEQ ID NO: 9438234 - DNA, 22 bp, Homo sapiens
tgttaaattgattcacctttct

SEQ ID NO: 9438235 - DNA, 22 bp, Homo sapiens
tgttaaattgattcacctttct

SEQ ID NO: 9438236 - DNA, 22 bp, Homo sapiens
tgttaaattgattcacctttct

SEQ ID NO: 9438237 - DNA, 22 bp, Homo sapiens
tgttaaatgttttgctagtgtc

SEQ ID NO: 9438238 - DNA, 22 bp, Homo sapiens
tgttaaatgttcctttactgga

SEQ ID NO: 9438239 - DNA, 22 bp, Homo sapiens
tgttaacaataagtccaggcat

SEQ ID NO: 9438240 - DNA, 22 bp, Homo sapiens
tgttaacatgtgtattgtatga

SEQ ID NO: 9438241 - DNA, 22 bp, Homo sapiens
tgttaacaggtaactgaggctg

SEQ ID NO: 9438242 - DNA, 22 bp, Homo sapiens
tgttaaatgagattggaatttg

SEQ ID NO: 9438243 - DNA, 22 bp, Homo sapiens
tgttaaatgagattggaatttg

SEQ ID NO: 9438244 - DNA, 18 bp, Homo sapiens
tgttaaatgaagatttgc

SEQ ID NO: 9438245 - DNA, 18 bp, Homo sapiens
tgttaaatgaagatttgc

SEQ ID NO: 9438246 - DNA, 22 bp, Homo sapiens
tgttaaatgtattatgtgttct

SEQ ID NO: 9438247 - DNA, 22 bp, Homo sapiens
tgttaacttgcaagctgaagaa

SEQ ID NO: 9438248 - DNA, 22 bp, Homo sapiens
tgttaactaatggtctaacatt

SEQ ID NO: 9438249 - DNA, 22 bp, Homo sapiens
tgttaacatgtgtattgtatga

SEQ ID NO: 9438250 - DNA, 22 bp, Homo sapiens
tgttactattagtttgagcata

SEQ ID NO: 9438251 - DNA, 22 bp, Homo sapiens
tgttactgatttgatatacagt

SEQ ID NO: 9438252 - DNA, 22 bp, Homo sapiens
tgttactctggggttgtggtga

SEQ ID NO: 9438253 - DNA, 22 bp, Homo sapiens
tgttactccttccctactcatg

SEQ ID NO: 9438254 - DNA, 22 bp, Homo sapiens
tgttactgtggttaccagaagc

SEQ ID NO: 9438255 - DNA, 22 bp, Homo sapiens
tgttagaaattattagtaatat

SEQ ID NO: 9438256 - DNA, 22 bp, Homo sapiens
tgttacttatctcacgtgatgc

SEQ ID NO: 9438257 - DNA, 22 bp, Homo sapiens
tgttacttcttggtaaaggaga

SEQ ID NO: 9438258 - DNA, 22 bp, Homo sapiens
tgtttatagggtctgtcacttg

SEQ ID NO: 9438259 - DNA, 22 bp, Homo sapiens
tgtttataccttggtataacca

SEQ ID NO: 9438260 - DNA, 22 bp, Homo sapiens
tgtttataccttggtataacca

SEQ ID NO: 9438261 - DNA, 22 bp, Homo sapiens
tgtttactgcattctatttgct

SEQ ID NO: 9438262 - DNA, 22 bp, Homo sapiens
tgtttatagatggccacaatga

SEQ ID NO: 9438263 - DNA, 22 bp, Homo sapiens
tgtttatagggtctgtcacttg

SEQ ID NO: 9438264 - DNA, 22 bp, Homo sapiens
tgtttatagggtctgtcacttg

SEQ ID NO: 9438265 - DNA, 22 bp, Homo sapiens
tgtttatcagggtaaagtgtag

SEQ ID NO: 9438266 - DNA, 22 bp, Homo sapiens
tgtttatagggtctgtcacttg

SEQ ID NO: 9438267 - DNA, 22 bp, Homo sapiens
tgtttatgcatcgttaatacca

SEQ ID NO: 9438268 - DNA, 21 bp, Homo sapiens
tgtttatggaaaagagacaaa

SEQ ID NO: 9438269 - DNA, 22 bp, Homo sapiens
tgtttattacagttcttggaat

SEQ ID NO: 9438270 - DNA, 22 bp, Homo sapiens
tgtttattacagttcttggaat

SEQ ID NO: 9438271 - DNA, 22 bp, Homo sapiens
tgtttatgtgtgtgcatatata

SEQ ID NO: 9438272 - DNA, 22 bp, Homo sapiens
tgtttatgtgtgtgcatatata

SEQ ID NO: 9438273 - DNA, 22 bp, Homo sapiens
tgtttattacagttcttggaat

SEQ ID NO: 9438274 - DNA, 22 bp, Homo sapiens
tgtttattcatggctaatgaaa

SEQ ID NO: 9438275 - DNA, 18 bp, Homo sapiens
tgtttattctcctgacag

SEQ ID NO: 9438276 - DNA, 18 bp, Homo sapiens
tgtttattctcctgacag

SEQ ID NO: 9438277 - DNA, 22 bp, Homo sapiens
tgtttattgagtgcctactata

SEQ ID NO: 9438278 - DNA, 22 bp, Homo sapiens
tgtttattgagtgcctactata

SEQ ID NO: 9438279 - DNA, 22 bp, Homo sapiens
tgtttattgagtgcctactata

SEQ ID NO: 9438280 - DNA, 22 bp, Homo sapiens
tgtttattgcagtgctgggctg

SEQ ID NO: 9438281 - DNA, 22 bp, Homo sapiens
tgtttattttcaggatggattg

SEQ ID NO: 9438282 - DNA, 22 bp, Homo sapiens
tgtttattttcaggatggattg

SEQ ID NO: 9438283 - DNA, 22 bp, Homo sapiens
tgtttattgctgcaattgtgcc

SEQ ID NO: 9438284 - DNA, 22 bp, Homo sapiens
tgtttaaatagaacatactgca

SEQ ID NO: 9438285 - DNA, 22 bp, Homo sapiens
tgttgttcagtctttgctggct

SEQ ID NO: 9438286 - DNA, 21 bp, Homo sapiens
tgttgttttatggctatgaat

SEQ ID NO: 9438287 - DNA, 21 bp, Homo sapiens
tgtttactccctgcaagcacg

SEQ ID NO: 9438288 - DNA, 22 bp, Homo sapiens
tgtttactccagctgatggaac

SEQ ID NO: 9438289 - DNA, 20 bp, Homo sapiens
tgtttactctagagggtaga

SEQ ID NO: 9438290 - DNA, 20 bp, Homo sapiens
tgtttactctagagggtaga

SEQ ID NO: 9438291 - DNA, 22 bp, Homo sapiens
tgtttactgcattctatttgct

SEQ ID NO: 9438292 - DNA, 22 bp, Homo sapiens
tgtttactcctgatatattttt

SEQ ID NO: 9438293 - DNA, 22 bp, Homo sapiens
tgtttaaatagaacatactgca

SEQ ID NO: 9438294 - DNA, 22 bp, Homo sapiens
tgtttaaatagaacatactgca

SEQ ID NO: 9438295 - DNA, 22 bp, Homo sapiens
tgtttaaccatctgcttttatg

SEQ ID NO: 9438296 - DNA, 22 bp, Homo sapiens
tgttgagtatatacctacaagt

SEQ ID NO: 9438297 - DNA, 22 bp, Homo sapiens
tgttgagtatatacctacaagt

SEQ ID NO: 9438298 - DNA, 22 bp, Homo sapiens
tgttgagtatatacctacaagt

SEQ ID NO: 9438299 - DNA, 18 bp, Homo sapiens
tgttgaaacttcaggtaa

SEQ ID NO: 9438300 - DNA, 22 bp, Homo sapiens
tgttcttttctctaaactgata

SEQ ID NO: 9438301 - DNA, 19 bp, Homo sapiens
tgttgacattctgagttga

SEQ ID NO: 9438302 - DNA, 22 bp, Homo sapiens
tgttgtaaaatttgagatgtca

SEQ ID NO: 9438303 - DNA, 22 bp, Homo sapiens
tgttggggtcaggagctagcct

SEQ ID NO: 9438304 - DNA, 22 bp, Homo sapiens
tgttgggatcgaatggtggaac

SEQ ID NO: 9438305 - DNA, 22 bp, Homo sapiens
tgttttagttctgtcttgcatg

SEQ ID NO: 9438306 - DNA, 22 bp, Homo sapiens
tgttttatataagcagagcggt

SEQ ID NO: 9438307 - DNA, 22 bp, Homo sapiens
tgttttatcaagatggcatgtc

SEQ ID NO: 9438308 - DNA, 22 bp, Homo sapiens
tgttttatcaagatggcatgtc

SEQ ID NO: 9438309 - DNA, 22 bp, Homo sapiens
tgttttatgagccatataacct

SEQ ID NO: 9438310 - DNA, 22 bp, Homo sapiens
tgttttatgagccatataacct

SEQ ID NO: 9438311 - DNA, 22 bp, Homo sapiens
tgttttatttctccaagaggga

SEQ ID NO: 9438312 - DNA, 22 bp, Homo sapiens
tgttttatgagccatataacct

SEQ ID NO: 9438313 - DNA, 22 bp, Homo sapiens
tgttttatgagccatataacct

SEQ ID NO: 9438314 - DNA, 22 bp, Homo sapiens
tgttttatgagccatataacct

SEQ ID NO: 9438315 - DNA, 22 bp, Homo sapiens
tgttttatgagccatataacct

SEQ ID NO: 9438316 - DNA, 22 bp, Homo sapiens
tgttttcaagtcaaggccaaat

SEQ ID NO: 9438317 - DNA, 22 bp, Homo sapiens
tgttttaagctctagaagggga

SEQ ID NO: 9438318 - DNA, 22 bp, Homo sapiens
tgttttaagagcgcactttata

SEQ ID NO: 9438319 - DNA, 22 bp, Homo sapiens
tgttttaagagcgcactttata

SEQ ID NO: 9438320 - DNA, 22 bp, Homo sapiens
tgttttaagagcgcactttata

SEQ ID NO: 9438321 - DNA, 22 bp, Homo sapiens
tgttttaatctcccattgctct

SEQ ID NO: 9438322 - DNA, 22 bp, Homo sapiens
tgttttaatctcccattgctct

SEQ ID NO: 9438323 - DNA, 22 bp, Homo sapiens
tgttttaagggtcaactgtcac

SEQ ID NO: 9438324 - DNA, 22 bp, Homo sapiens
tgttttaagggtcaactgtcac

SEQ ID NO: 9438325 - DNA, 22 bp, Homo sapiens
tgttttaagggtcaactgtcac

SEQ ID NO: 9438326 - DNA, 22 bp, Homo sapiens
tgttttaagggtcaactgtcac

SEQ ID NO: 9438327 - DNA, 22 bp, Homo sapiens
tgttttaatctcccattgctct

SEQ ID NO: 9438328 - DNA, 20 bp, Homo sapiens
tgtttgtgtggggccttggc

SEQ ID NO: 9438329 - DNA, 20 bp, Homo sapiens
tgtttgtgtggggccttggc

SEQ ID NO: 9438330 - DNA, 20 bp, Homo sapiens
tgtttgtgtggggccttggc

SEQ ID NO: 9438331 - DNA, 22 bp, Homo sapiens
tgtttgtgctgcctggtgggca

SEQ ID NO: 9438332 - DNA, 22 bp, Homo sapiens
tgtttgtggaatattctttaag

SEQ ID NO: 9438333 - DNA, 20 bp, Homo sapiens
tgtttgtgccagctttgtca

SEQ ID NO: 9438334 - DNA, 20 bp, Homo sapiens
tgtttgtgccagctttgtca

SEQ ID NO: 9438335 - DNA, 22 bp, Homo sapiens
tgtttgtgctgcctggtgggca

SEQ ID NO: 9438336 - DNA, 22 bp, Homo sapiens
tgtttgtcatcattgtgagaga

SEQ ID NO: 9438337 - DNA, 20 bp, Homo sapiens
tgtttgtgccagctttgtca

SEQ ID NO: 9438338 - DNA, 22 bp, Homo sapiens
tgtttgtccccatccctcagca

SEQ ID NO: 9438339 - DNA, 22 bp, Homo sapiens
tgtttgtagagacagctgatgc

SEQ ID NO: 9438340 - DNA, 22 bp, Homo sapiens
tgtttgcttacttgtatgctgc

SEQ ID NO: 9438341 - DNA, 22 bp, Homo sapiens
tgtttgtaaagcagagccagta

SEQ ID NO: 9438342 - DNA, 22 bp, Homo sapiens
tgtttcaaaggttatacagtca

SEQ ID NO: 9438343 - DNA, 22 bp, Homo sapiens
tgtttcaaaggttatacagtca

SEQ ID NO: 9438344 - DNA, 22 bp, Homo sapiens
tgtttgctctgactatcttgcg

SEQ ID NO: 9438345 - DNA, 22 bp, Homo sapiens
tgtttgctatatcctacttcat

SEQ ID NO: 9438346 - DNA, 22 bp, Homo sapiens
tgtttgctagggttggtattta

SEQ ID NO: 9438347 - DNA, 18 bp, Homo sapiens
tgtttatttttctcttac

SEQ ID NO: 9438348 - DNA, 18 bp, Homo sapiens
tgtttatttttctcttac

SEQ ID NO: 9438349 - DNA, 18 bp, Homo sapiens
tgtttatttttctcttac

SEQ ID NO: 9438350 - DNA, 18 bp, Homo sapiens
tgtttatttttctcttac

SEQ ID NO: 9438351 - DNA, 18 bp, Homo sapiens
tgtttatttttctcttac

SEQ ID NO: 9438352 - DNA, 22 bp, Homo sapiens
ttaaaaatatgtagggcccgat

SEQ ID NO: 9438353 - DNA, 22 bp, Homo sapiens
ttaaaaatatgtagggcccgat

SEQ ID NO: 9438354 - DNA, 22 bp, Homo sapiens
ttaaaacagcgtgaatctggca

SEQ ID NO: 9438355 - DNA, 20 bp, Homo sapiens
ttaaaaagagtcacaggaga

SEQ ID NO: 9438356 - DNA, 22 bp, Homo sapiens
ttaaaaatatgtagggcccgat

SEQ ID NO: 9438357 - DNA, 20 bp, Homo sapiens
ttaaaaagagtcacaggaga

SEQ ID NO: 9438358 - DNA, 22 bp, Homo sapiens
ttaaaaaccatcttcctttcct

SEQ ID NO: 9438359 - DNA, 22 bp, Homo sapiens
ttaaaaaccatcttcctttcct

SEQ ID NO: 9438360 - DNA, 20 bp, Homo sapiens
ttaaaaagagtcacaggaga

SEQ ID NO: 9438361 - DNA, 20 bp, Homo sapiens
ttaaaaagagtcacaggaga

SEQ ID NO: 9438362 - DNA, 17 bp, Homo sapiens
tgttttttccctgttct

SEQ ID NO: 9438363 - DNA, 17 bp, Homo sapiens
tgttttttccctgttct

SEQ ID NO: 9438364 - DNA, 22 bp, Homo sapiens
tgttttttccttatgcaatctg

SEQ ID NO: 9438365 - DNA, 22 bp, Homo sapiens
tgttttttccttatgcaatctg

SEQ ID NO: 9438366 - DNA, 22 bp, Homo sapiens
tgttttttccttatgcaatctg

SEQ ID NO: 9438367 - DNA, 22 bp, Homo sapiens
tgtttttttatatacctgaagt

SEQ ID NO: 9438368 - DNA, 22 bp, Homo sapiens
ttaaaaaccatcttcctttcct

SEQ ID NO: 9438369 - DNA, 22 bp, Homo sapiens
tgtttttttatatacctgaagt

SEQ ID NO: 9438370 - DNA, 22 bp, Homo sapiens
tgtttttttatatacctgaagt

SEQ ID NO: 9438371 - DNA, 22 bp, Homo sapiens
ttaaaacagcgtgaatctggca

SEQ ID NO: 9438372 - DNA, 22 bp, Homo sapiens
ttaaaagaatcctgttatcctc

SEQ ID NO: 9438373 - DNA, 22 bp, Homo sapiens
ttaaaagacctgttgaggttag

SEQ ID NO: 9438374 - DNA, 22 bp, Homo sapiens
ttaaaagagacttcctttgttt

SEQ ID NO: 9438375 - DNA, 22 bp, Homo sapiens
ttaaaagagacttcctttgttt

SEQ ID NO: 9438376 - DNA, 22 bp, Homo sapiens
ttaaaagagacttcctttgttt

SEQ ID NO: 9438377 - DNA, 22 bp, Homo sapiens
ttaaaagagacttcctttgttt

SEQ ID NO: 9438378 - DNA, 22 bp, Homo sapiens
ttaaaatgcagattatgactca

SEQ ID NO: 9438379 - DNA, 22 bp, Homo sapiens
ttaaaatgcagattatgactca

SEQ ID NO: 9438380 - DNA, 22 bp, Homo sapiens
ttaaaatgcagattctgattca

SEQ ID NO: 9438381 - DNA, 22 bp, Homo sapiens
ttaaacagagtctgaaatgtaa

SEQ ID NO: 9438382 - DNA, 22 bp, Homo sapiens
ttaaacatttatggaggcagca

SEQ ID NO: 9438383 - DNA, 22 bp, Homo sapiens
ttaaacagacagtaaatgaaac

SEQ ID NO: 9438384 - DNA, 22 bp, Homo sapiens
ttaaacagacagtaaatgaaac

SEQ ID NO: 9438385 - DNA, 22 bp, Homo sapiens
ttaaacagacagtaaatgaaac

SEQ ID NO: 9438386 - DNA, 22 bp, Homo sapiens
ttaaacagacagtaaatgaaac

SEQ ID NO: 9438387 - DNA, 22 bp, Homo sapiens
ttaaacatttatggaggcagca

SEQ ID NO: 9438388 - DNA, 22 bp, Homo sapiens
ttaaacatttttgatgatcgat

SEQ ID NO: 9438389 - DNA, 22 bp, Homo sapiens
ttaaacatttttgatgatcgat

SEQ ID NO: 9438390 - DNA, 22 bp, Homo sapiens
ttaaaccaccagaagccattat

SEQ ID NO: 9438391 - DNA, 22 bp, Homo sapiens
ttaaaccatagtttaacataag

SEQ ID NO: 9438392 - DNA, 22 bp, Homo sapiens
ttaaaccatagtttaacataag

SEQ ID NO: 9438393 - DNA, 17 bp, Homo sapiens
ttaaaccataaagaagg

SEQ ID NO: 9438394 - DNA, 22 bp, Homo sapiens
ttaaaatttccccaccatgtat

SEQ ID NO: 9438395 - DNA, 22 bp, Homo sapiens
ttaaaatttccccaccatgtat

SEQ ID NO: 9438396 - DNA, 22 bp, Homo sapiens
ttaaaatttccccaccatgtat

SEQ ID NO: 9438397 - DNA, 22 bp, Homo sapiens
ttaaacaccaagtgcaaaccac

SEQ ID NO: 9438398 - DNA, 22 bp, Homo sapiens
ttaaaattatggcccatttgga

SEQ ID NO: 9438399 - DNA, 22 bp, Homo sapiens
ttaaaatttccccaccatgtat

SEQ ID NO: 9438400 - DNA, 22 bp, Homo sapiens
ttaaaatttccccaccatgtat

SEQ ID NO: 9438401 - DNA, 16 bp, Homo sapiens
tgtgcatgttctgtgt

SEQ ID NO: 9438402 - DNA, 22 bp, Homo sapiens
tgtgcatgtctgggcctgtaag

SEQ ID NO: 9438403 - DNA, 20 bp, Homo sapiens
tgtgccaaaactgtttgctt

SEQ ID NO: 9438404 - DNA, 22 bp, Homo sapiens
tgtgccaagactatattgtgct

SEQ ID NO: 9438405 - DNA, 22 bp, Homo sapiens
tgtgccaagatcaaacttttct

SEQ ID NO: 9438406 - DNA, 22 bp, Homo sapiens
tgtgccaagactatattgtgct

SEQ ID NO: 9438407 - DNA, 20 bp, Homo sapiens
tgtgcatgaactgagggatt

SEQ ID NO: 9438408 - DNA, 22 bp, Homo sapiens
tgtgcatgtaccttattctgga

SEQ ID NO: 9438409 - DNA, 22 bp, Homo sapiens
tgtgcagttttaagtggtctaa

SEQ ID NO: 9438410 - DNA, 22 bp, Homo sapiens
tgtgcagttcaaacccgtgttg

SEQ ID NO: 9438411 - DNA, 22 bp, Homo sapiens
tgtgcctagttctgtatttaca

SEQ ID NO: 9438412 - DNA, 22 bp, Homo sapiens
tgtgcctcaccctgctcttggc

SEQ ID NO: 9438413 - DNA, 22 bp, Homo sapiens
tgtgcctgactaggtgaatcaa

SEQ ID NO: 9438414 - DNA, 18 bp, Homo sapiens
tgtgcctctgcaggacgt

SEQ ID NO: 9438415 - DNA, 22 bp, Homo sapiens
tgtgcctctgaagggcggacgg

SEQ ID NO: 9438416 - DNA, 19 bp, Homo sapiens
tgtgcctcctcgtctccta

SEQ ID NO: 9438417 - DNA, 19 bp, Homo sapiens
tgtgcctcctcgtctccta

SEQ ID NO: 9438418 - DNA, 22 bp, Homo sapiens
tgtgccctcagaagagtacatc

SEQ ID NO: 9438419 - DNA, 22 bp, Homo sapiens
tgtgcccgtttataaatatttg

SEQ ID NO: 9438420 - DNA, 19 bp, Homo sapiens
tgtgccccctccagcctgc

SEQ ID NO: 9438421 - DNA, 22 bp, Homo sapiens
tgtgcccgaagtattttaaaat

SEQ ID NO: 9438422 - DNA, 18 bp, Homo sapiens
tgtgcccggaaaatacct

SEQ ID NO: 9438423 - DNA, 19 bp, Homo sapiens
tgtgccccctccagcctgc

SEQ ID NO: 9438424 - DNA, 22 bp, Homo sapiens
tgtgccagaaaatatgctgagg

SEQ ID NO: 9438425 - DNA, 19 bp, Homo sapiens
tgtgcccttggcaatggga

SEQ ID NO: 9438426 - DNA, 20 bp, Homo sapiens
tgtgcaggagagtgaggctg

SEQ ID NO: 9438427 - DNA, 20 bp, Homo sapiens
tgtgcaggagagtgaggctg

SEQ ID NO: 9438428 - DNA, 22 bp, Homo sapiens
tgtgcagggaagggcatgctat

SEQ ID NO: 9438429 - DNA, 22 bp, Homo sapiens
tgtgcagggaagggcatgctat

SEQ ID NO: 9438430 - DNA, 22 bp, Homo sapiens
tgtgcagggaagggcatgctat

SEQ ID NO: 9438431 - DNA, 22 bp, Homo sapiens
tgtgcagttcaaacccgtgttg

SEQ ID NO: 9438432 - DNA, 22 bp, Homo sapiens
tgtgcagtttctatgttgtcca

SEQ ID NO: 9438433 - DNA, 22 bp, Homo sapiens
tgtgcagtgtgaccagggctgc

SEQ ID NO: 9438434 - DNA, 22 bp, Homo sapiens
tgtgcagttcaaacccgtgttg

SEQ ID NO: 9438435 - DNA, 21 bp, Homo sapiens
tgtgcagtccaatgtgctagc

SEQ ID NO: 9438436 - DNA, 22 bp, Homo sapiens
tgtgcagagcggggaagagcac

SEQ ID NO: 9438437 - DNA, 22 bp, Homo sapiens
tgtgcagctttctggctttaag

SEQ ID NO: 9438438 - DNA, 22 bp, Homo sapiens
tgtgcagctctagagccaagcc

SEQ ID NO: 9438439 - DNA, 22 bp, Homo sapiens
tgtgcagctctagagccaagcc

SEQ ID NO: 9438440 - DNA, 22 bp, Homo sapiens
tgtgcagcagcagctgtggaga

SEQ ID NO: 9438441 - DNA, 22 bp, Homo sapiens
tgtgcaaattaagtagattttc

SEQ ID NO: 9438442 - DNA, 22 bp, Homo sapiens
tgtgcaaagtgtacaaattaat

SEQ ID NO: 9438443 - DNA, 23 bp, Homo sapiens
tgtgcacatctgacgggtgaagg

SEQ ID NO: 9438444 - DNA, 22 bp, Homo sapiens
tgtgcagaaactgggaaggaag

SEQ ID NO: 9438445 - DNA, 22 bp, Homo sapiens
tgtgcacataaaacagtactag

SEQ ID NO: 9438446 - DNA, 23 bp, Homo sapiens
tgtgctcccaaatgtaggtctat

SEQ ID NO: 9438447 - DNA, 22 bp, Homo sapiens
tgtgctccatcatccataatct

SEQ ID NO: 9438448 - DNA, 22 bp, Homo sapiens
tgtgctctgaagagtgcatgtc

SEQ ID NO: 9438449 - DNA, 22 bp, Homo sapiens
tgtgctctacctcagtgtcatt

SEQ ID NO: 9438450 - DNA, 22 bp, Homo sapiens
tgtgctctgactttctcctggt

SEQ ID NO: 9438451 - DNA, 22 bp, Homo sapiens
tgtgctctgcaatcagttcttt

SEQ ID NO: 9438452 - DNA, 22 bp, Homo sapiens
tgtgcgtggttcccggggccat

SEQ ID NO: 9438453 - DNA, 22 bp, Homo sapiens
tgtgctcactctaaattaagat

SEQ ID NO: 9438454 - DNA, 22 bp, Homo sapiens
tgtgctcatggtccagcatggt

SEQ ID NO: 9438455 - DNA, 22 bp, Homo sapiens
tgtgctcagccaggggcaggcc

SEQ ID NO: 9438456 - DNA, 22 bp, Homo sapiens
tgtgctcagtctttggctggga

SEQ ID NO: 9438457 - DNA, 22 bp, Homo sapiens
tgtgctgacaattcacagagaa

SEQ ID NO: 9438458 - DNA, 22 bp, Homo sapiens
tgtgctgctctcagtgacagcc

SEQ ID NO: 9438459 - DNA, 22 bp, Homo sapiens
tgtgctgctctcagtgacagcc

SEQ ID NO: 9438460 - DNA, 22 bp, Homo sapiens
tgtgctcttctgttacttgtag

SEQ ID NO: 9438461 - DNA, 22 bp, Homo sapiens
tgtgctctggagttgccttcac

SEQ ID NO: 9438462 - DNA, 22 bp, Homo sapiens
tgtgctcttctgttacttgtag

SEQ ID NO: 9438463 - DNA, 22 bp, Homo sapiens
tgtgctgctctcagtgacagcc

SEQ ID NO: 9438464 - DNA, 22 bp, Homo sapiens
tgtggaaaaaccacaagtttgg

SEQ ID NO: 9438465 - DNA, 22 bp, Homo sapiens
tgtggaacaaaatgttgggaga

SEQ ID NO: 9438466 - DNA, 22 bp, Homo sapiens
tgtggaaagtcaagttccagga

SEQ ID NO: 9438467 - DNA, 22 bp, Homo sapiens
tgtggaaagtggtctaagcaca

SEQ ID NO: 9438468 - DNA, 22 bp, Homo sapiens
tgtggaaaagccccacaggact

SEQ ID NO: 9438469 - DNA, 22 bp, Homo sapiens
tgtgcctgagttggctgagtac

SEQ ID NO: 9438470 - DNA, 22 bp, Homo sapiens
tgtgcctgagtctcggcccacc

SEQ ID NO: 9438471 - DNA, 22 bp, Homo sapiens
tgtgcctgagttggctgagtac

SEQ ID NO: 9438472 - DNA, 22 bp, Homo sapiens
tgtgcctgatggtcacgtggcc

SEQ ID NO: 9438473 - DNA, 22 bp, Homo sapiens
tgtgcctgctagatggttgtcg

SEQ ID NO: 9438474 - DNA, 22 bp, Homo sapiens
tgtgcctggagtccctgaggag

SEQ ID NO: 9438475 - DNA, 22 bp, Homo sapiens
tgtgcctggagtccctgaggag

SEQ ID NO: 9438476 - DNA, 22 bp, Homo sapiens
tgtgcctggatctctgtgacaa

SEQ ID NO: 9438477 - DNA, 22 bp, Homo sapiens
tgtgcctggatctctgtgacaa

SEQ ID NO: 9438478 - DNA, 22 bp, Homo sapiens
tgtgcctggcattctgggcttc

SEQ ID NO: 9438479 - DNA, 22 bp, Homo sapiens
tgtgcctggcccagtggtgtca

SEQ ID NO: 9438480 - DNA, 22 bp, Homo sapiens
tgtgcctggtccctgagtcgag

SEQ ID NO: 9438481 - DNA, 22 bp, Homo sapiens
tgtgcctggcattctgggcttc

SEQ ID NO: 9438482 - DNA, 22 bp, Homo sapiens
tgtgcctggcattctgggcttc

SEQ ID NO: 9438483 - DNA, 22 bp, Homo sapiens
tgtgcctgtgacagcgacctgg

SEQ ID NO: 9438484 - DNA, 22 bp, Homo sapiens
tgtgcctgttcccactttgcct

SEQ ID NO: 9438485 - DNA, 22 bp, Homo sapiens
tgtgcctgtgacagcgacctgg

SEQ ID NO: 9438486 - DNA, 22 bp, Homo sapiens
tgtgcctggtccctgagtcgag

SEQ ID NO: 9438487 - DNA, 22 bp, Homo sapiens
tgtgcctgtcccgcattctggt

SEQ ID NO: 9438488 - DNA, 22 bp, Homo sapiens
tgtgcctgtcccgcattctggt

SEQ ID NO: 9438489 - DNA, 22 bp, Homo sapiens
tgtgcctgtcaccctcagagag

SEQ ID NO: 9438490 - DNA, 22 bp, Homo sapiens
tgtgcgcgtgcagcggagtgtt

SEQ ID NO: 9438491 - DNA, 22 bp, Homo sapiens
tgtgcgctccggcgagtcagcg

SEQ ID NO: 9438492 - DNA, 22 bp, Homo sapiens
tgtgcgtggattcctgtactca

SEQ ID NO: 9438493 - DNA, 22 bp, Homo sapiens
tgtgcgtgggcacacacatatg

SEQ ID NO: 9438494 - DNA, 22 bp, Homo sapiens
tgtgcgtgatggaccgggcctg

SEQ ID NO: 9438495 - DNA, 23 bp, Homo sapiens
tgtgcgtgatgctttgttgaagg

SEQ ID NO: 9438496 - DNA, 17 bp, Homo sapiens
tgtgcgcttgtgtgagg

SEQ ID NO: 9438497 - DNA, 22 bp, Homo sapiens
tgtgaaatgctattgtgacaaa

SEQ ID NO: 9438498 - DNA, 22 bp, Homo sapiens
tgtgaaatgtggatgttaatag

SEQ ID NO: 9438499 - DNA, 22 bp, Homo sapiens
tgtgaaatgagtatatttgaat

SEQ ID NO: 9438500 - DNA, 22 bp, Homo sapiens
tgtgaaatgagtatatttgaat

SEQ ID NO: 9438501 - DNA, 22 bp, Homo sapiens
tgtgaaatgaagataattcttg

SEQ ID NO: 9438502 - DNA, 22 bp, Homo sapiens
tgtgaaatgtgtgtataattaa

SEQ ID NO: 9438503 - DNA, 22 bp, Homo sapiens
tgtgaaattacttaaaggaaat

SEQ ID NO: 9438504 - DNA, 22 bp, Homo sapiens
tgtgaaatgtgtgtataattaa

SEQ ID NO: 9438505 - DNA, 22 bp, Homo sapiens
tgtgaaattgagaaactttcac

SEQ ID NO: 9438506 - DNA, 21 bp, Homo sapiens
tgtgaaatagctatgctacat

SEQ ID NO: 9438507 - DNA, 22 bp, Homo sapiens
tgtgaaatattggcaatttcat

SEQ ID NO: 9438508 - DNA, 22 bp, Homo sapiens
tgtgaaatattggcaatttcat

SEQ ID NO: 9438509 - DNA, 22 bp, Homo sapiens
tgtgaaatatttatatactcaa

SEQ ID NO: 9438510 - DNA, 22 bp, Homo sapiens
tgtgaaatctgatgaattgacc

SEQ ID NO: 9438511 - DNA, 22 bp, Homo sapiens
tgtgaaatctgatgaattgacc

SEQ ID NO: 9438512 - DNA, 22 bp, Homo sapiens
tgtgaaaggagccatagacagt

SEQ ID NO: 9438513 - DNA, 22 bp, Homo sapiens
tgtgaaacggagtcagggaagg

SEQ ID NO: 9438514 - DNA, 22 bp, Homo sapiens
tgtgacagatctctatacatga

SEQ ID NO: 9438515 - DNA, 22 bp, Homo sapiens
tgtgacagatctttaaataatg

SEQ ID NO: 9438516 - DNA, 22 bp, Homo sapiens
tgtgacagatctttaaataatg

SEQ ID NO: 9438517 - DNA, 22 bp, Homo sapiens
tgtgacaagcattgtatattgg

SEQ ID NO: 9438518 - DNA, 22 bp, Homo sapiens
tgtgacactgacatctgctccc

SEQ ID NO: 9438519 - DNA, 23 bp, Homo sapiens
tgtgaattgaggacatcaaaagc

SEQ ID NO: 9438520 - DNA, 23 bp, Homo sapiens
tgtgacagggtcattgaaaaggg

SEQ ID NO: 9438521 - DNA, 23 bp, Homo sapiens
tgtgacagggtcattgaaaaggg

SEQ ID NO: 9438522 - DNA, 23 bp, Homo sapiens
tgtgacagggtcattgaaaaggg

SEQ ID NO: 9438523 - DNA, 22 bp, Homo sapiens
tgtgacagccagtaaagtaagc

SEQ ID NO: 9438524 - DNA, 23 bp, Homo sapiens
tgtgacagtgacaatactgactt

SEQ ID NO: 9438525 - DNA, 22 bp, Homo sapiens
tgtgacagtcgttaggagctca

SEQ ID NO: 9438526 - DNA, 22 bp, Homo sapiens
tgtgaagtccagagaagtcagg

SEQ ID NO: 9438527 - DNA, 22 bp, Homo sapiens
tgtgaatggacaattaaatcta

SEQ ID NO: 9438528 - DNA, 22 bp, Homo sapiens
tgtgagagagtgcatttgcata

SEQ ID NO: 9438529 - DNA, 22 bp, Homo sapiens
tgtgagagagtgcatttgcata

SEQ ID NO: 9438530 - DNA, 22 bp, Homo sapiens
tgtgagagaagtgtgtgctccc

SEQ ID NO: 9438531 - DNA, 22 bp, Homo sapiens
tgtgagagaagtgtgtgctccc

SEQ ID NO: 9438532 - DNA, 22 bp, Homo sapiens
tgtgagaagggcatgcagggag

SEQ ID NO: 9438533 - DNA, 22 bp, Homo sapiens
tgtgagaagggtgaggctttta

SEQ ID NO: 9438534 - DNA, 22 bp, Homo sapiens
tgtgagaattcctgatcacagg

SEQ ID NO: 9438535 - DNA, 22 bp, Homo sapiens
tgtgagaaaatgattgcacagt

SEQ ID NO: 9438536 - DNA, 22 bp, Homo sapiens
tgtgacttataacatagaattt

SEQ ID NO: 9438537 - DNA, 22 bp, Homo sapiens
tgtgacttgatgtttgcaccag

SEQ ID NO: 9438538 - DNA, 19 bp, Homo sapiens
tgtgactggttgtctcgct

SEQ ID NO: 9438539 - DNA, 22 bp, Homo sapiens
tgtgactggttgtcccgctttc

SEQ ID NO: 9438540 - DNA, 22 bp, Homo sapiens
tgtgactgaggctccaagctag

SEQ ID NO: 9438541 - DNA, 22 bp, Homo sapiens
tgtgactggagtccagcccact

SEQ ID NO: 9438542 - DNA, 22 bp, Homo sapiens
tgtgactggagtccagcccact

SEQ ID NO: 9438543 - DNA, 22 bp, Homo sapiens
tgtgactggcagaggtgtctgg

SEQ ID NO: 9438544 - DNA, 22 bp, Homo sapiens
tgtgactaggcctgagctcttg

SEQ ID NO: 9438545 - DNA, 22 bp, Homo sapiens
tgtgactgaagtgtctagacct

SEQ ID NO: 9438546 - DNA, 22 bp, Homo sapiens
tgtgactgagctgcagagtgtc

SEQ ID NO: 9438547 - DNA, 22 bp, Homo sapiens
tgtgactgagctgcagagtgtc

SEQ ID NO: 9438548 - DNA, 22 bp, Homo sapiens
tgtgactctggcacatggtgag

SEQ ID NO: 9438549 - DNA, 22 bp, Homo sapiens
tgtgactctcaactgattgtat

SEQ ID NO: 9438550 - DNA, 17 bp, Homo sapiens
tgtgacattgggacatt

SEQ ID NO: 9438551 - DNA, 22 bp, Homo sapiens
tgtgaccactagcacagctgcc

SEQ ID NO: 9438552 - DNA, 22 bp, Homo sapiens
tgtgaccataatttgtaaataa

SEQ ID NO: 9438553 - DNA, 22 bp, Homo sapiens
tgtgaccatttgccacaatggt

SEQ ID NO: 9438554 - DNA, 22 bp, Homo sapiens
tgtgacctcatcttaactggaa

SEQ ID NO: 9438555 - DNA, 22 bp, Homo sapiens
tgtgacccccgtcacggctgct

SEQ ID NO: 9438556 - DNA, 22 bp, Homo sapiens
tgtgaccttatttagaaatacc

SEQ ID NO: 9438557 - DNA, 22 bp, Homo sapiens
tgtgagagcagaagacacatag

SEQ ID NO: 9438558 - DNA, 19 bp, Homo sapiens
tgtgagaggctagctgccc

SEQ ID NO: 9438559 - DNA, 22 bp, Homo sapiens
tgtgagagttgagatattttgc

SEQ ID NO: 9438560 - DNA, 22 bp, Homo sapiens
tgtgagagttgagatattttgc

SEQ ID NO: 9438561 - DNA, 22 bp, Homo sapiens
tgtgagaggagaaatgcattaa

SEQ ID NO: 9438562 - DNA, 22 bp, Homo sapiens
tgtgagattttatttgatatgc

SEQ ID NO: 9438563 - DNA, 22 bp, Homo sapiens
tgtgagcactatggctaggctc

SEQ ID NO: 9438564 - DNA, 22 bp, Homo sapiens
tgtgagcaagtgactggtgaga

SEQ ID NO: 9438565 - DNA, 22 bp, Homo sapiens
tgtgagtgacagttcccttggt

SEQ ID NO: 9438566 - DNA, 22 bp, Homo sapiens
tgtgagttattttcaggagttt

SEQ ID NO: 9438567 - DNA, 22 bp, Homo sapiens
tgtgagttcttagaaagtcagt

SEQ ID NO: 9438568 - DNA, 22 bp, Homo sapiens
tgtgagcactggctgggaaagt

SEQ ID NO: 9438569 - DNA, 22 bp, Homo sapiens
tgtgagtgaatgggtctgaagt

SEQ ID NO: 9438570 - DNA, 22 bp, Homo sapiens
tgtgatggttcactgggcatga

SEQ ID NO: 9438571 - DNA, 22 bp, Homo sapiens
tgtgatctgccttggatctgca

SEQ ID NO: 9438572 - DNA, 22 bp, Homo sapiens
tgtgatcaggtgatcatgtgag

SEQ ID NO: 9438573 - DNA, 22 bp, Homo sapiens
tgtgatcaggtgatcatgtgag

SEQ ID NO: 9438574 - DNA, 22 bp, Homo sapiens
tgtgatgctggagtgcgaatat

SEQ ID NO: 9438575 - DNA, 19 bp, Homo sapiens
tgtgataagcagaattcca

SEQ ID NO: 9438576 - DNA, 22 bp, Homo sapiens
tgtgattatattgtagtacatt

SEQ ID NO: 9438577 - DNA, 22 bp, Homo sapiens
tgtgattttcgttatggcttgg

SEQ ID NO: 9438578 - DNA, 22 bp, Homo sapiens
tgtgatttattgaaaagagctt

SEQ ID NO: 9438579 - DNA, 22 bp, Homo sapiens
tgtgatttcatctgaggccagg

SEQ ID NO: 9438580 - DNA, 19 bp, Homo sapiens
tgtcttaattaactcagag

SEQ ID NO: 9438581 - DNA, 22 bp, Homo sapiens
tgtcttaatatgtgcattctgt

SEQ ID NO: 9438582 - DNA, 22 bp, Homo sapiens
tgtcttaatttggatgatgttt

SEQ ID NO: 9438583 - DNA, 22 bp, Homo sapiens
tgtcttaatttggatgatgttt

SEQ ID NO: 9438584 - DNA, 22 bp, Homo sapiens
tgtcttaaacttgtgggacttc

SEQ ID NO: 9438585 - DNA, 22 bp, Homo sapiens
tgtctgttattggtgtataaga

SEQ ID NO: 9438586 - DNA, 22 bp, Homo sapiens
tgtcttaagtagattacagcct

SEQ ID NO: 9438587 - DNA, 22 bp, Homo sapiens
tgtcttaagtagattacagcct

SEQ ID NO: 9438588 - DNA, 22 bp, Homo sapiens
tgtcttaagaaattgcatttgt

SEQ ID NO: 9438589 - DNA, 22 bp, Homo sapiens
tgtcttaagaaattgcatttgt

SEQ ID NO: 9438590 - DNA, 22 bp, Homo sapiens
tgtctgtgatttaggccagggc

SEQ ID NO: 9438591 - DNA, 20 bp, Homo sapiens
tgtctgtgccacggcactcc

SEQ ID NO: 9438592 - DNA, 22 bp, Homo sapiens
tgtctgtgcccaaggctcccgg

SEQ ID NO: 9438593 - DNA, 22 bp, Homo sapiens
tgtctgtggcaattgtgggtaa

SEQ ID NO: 9438594 - DNA, 22 bp, Homo sapiens
tgtctgtggcaattgtgggtaa

SEQ ID NO: 9438595 - DNA, 22 bp, Homo sapiens
tgtctgtgatttaggccagggc

SEQ ID NO: 9438596 - DNA, 22 bp, Homo sapiens
tgtctgtggcaattgtgggtaa

SEQ ID NO: 9438597 - DNA, 22 bp, Homo sapiens
tgtctgtgggcaacgcctccca

SEQ ID NO: 9438598 - DNA, 22 bp, Homo sapiens
tgtctgtgtgagcaaatgactt

SEQ ID NO: 9438599 - DNA, 22 bp, Homo sapiens
tgtctgttattggtgtataaga

SEQ ID NO: 9438600 - DNA, 22 bp, Homo sapiens
tgtctgtgtccaaatttcctct

SEQ ID NO: 9438601 - DNA, 22 bp, Homo sapiens
tgtcttcaggagtaaatatcat

SEQ ID NO: 9438602 - DNA, 22 bp, Homo sapiens
tgtcttcagcaaatgcctttct

SEQ ID NO: 9438603 - DNA, 22 bp, Homo sapiens
tgtcttcagataggcattcttc

SEQ ID NO: 9438604 - DNA, 22 bp, Homo sapiens
tgtcttcagataggcattcttc

SEQ ID NO: 9438605 - DNA, 22 bp, Homo sapiens
tgtcttcacatgataagccatt

SEQ ID NO: 9438606 - DNA, 22 bp, Homo sapiens
tgtcttatgtagatactgagaa

SEQ ID NO: 9438607 - DNA, 22 bp, Homo sapiens
tgtcttatggtcttgggcttcc

SEQ ID NO: 9438608 - DNA, 22 bp, Homo sapiens
tgtcttatgctgcatagactat

SEQ ID NO: 9438609 - DNA, 22 bp, Homo sapiens
tgtcttatggcatgtccactgg

SEQ ID NO: 9438610 - DNA, 22 bp, Homo sapiens
tgtcttacatgagtcaccccaa

SEQ ID NO: 9438611 - DNA, 22 bp, Homo sapiens
tgtcttatgctgcatagactat

SEQ ID NO: 9438612 - DNA, 17 bp, Homo sapiens
tgtcttatctgtcctgt

SEQ ID NO: 9438613 - DNA, 22 bp, Homo sapiens
tgtcttattccttctgttcagc

SEQ ID NO: 9438614 - DNA, 22 bp, Homo sapiens
tgtcttattaagaccagtgact

SEQ ID NO: 9438615 - DNA, 22 bp, Homo sapiens
tgtcttcaaatattgaaatcct

SEQ ID NO: 9438616 - DNA, 22 bp, Homo sapiens
tgtctgtctttagtgagattgc

SEQ ID NO: 9438617 - DNA, 22 bp, Homo sapiens
tgtctgtgacctctttggagcc

SEQ ID NO: 9438618 - DNA, 22 bp, Homo sapiens
tgtctgtgatttaggccagggc

SEQ ID NO: 9438619 - DNA, 22 bp, Homo sapiens
tgtctgtgacctcttaggcaag

SEQ ID NO: 9438620 - DNA, 22 bp, Homo sapiens
tgtctgtgacagacctttgcta

SEQ ID NO: 9438621 - DNA, 22 bp, Homo sapiens
tgtctgggatgttggcagccac

SEQ ID NO: 9438622 - DNA, 22 bp, Homo sapiens
tgtctggcctcaaaagccattt

SEQ ID NO: 9438623 - DNA, 22 bp, Homo sapiens
tgtctggcatagttgctccctg

SEQ ID NO: 9438624 - DNA, 23 bp, Homo sapiens
tgtctggctcatggtgggtctca

SEQ ID NO: 9438625 - DNA, 22 bp, Homo sapiens
tgtctggctcattttctgcagt

SEQ ID NO: 9438626 - DNA, 22 bp, Homo sapiens
tgtctgggagggacagggctac

SEQ ID NO: 9438627 - DNA, 22 bp, Homo sapiens
tgtctgggagggacagggctac

SEQ ID NO: 9438628 - DNA, 22 bp, Homo sapiens
tgtctgggagggacagggctac

SEQ ID NO: 9438629 - DNA, 22 bp, Homo sapiens
tgtctggaggtcaggtcctggg

SEQ ID NO: 9438630 - DNA, 23 bp, Homo sapiens
tgtctggagcctgagcaggtgct

SEQ ID NO: 9438631 - DNA, 22 bp, Homo sapiens
tgtctggacattgacaatcatg

SEQ ID NO: 9438632 - DNA, 22 bp, Homo sapiens
tgtctggacagagattctcaat

SEQ ID NO: 9438633 - DNA, 19 bp, Homo sapiens
tgtctggaagagctgcagg

SEQ ID NO: 9438634 - DNA, 19 bp, Homo sapiens
tgtctgctgatgactctat

SEQ ID NO: 9438635 - DNA, 22 bp, Homo sapiens
tgtcttttggagcatctttctt

SEQ ID NO: 9438636 - DNA, 22 bp, Homo sapiens
tgtcttttggagcatctttctt

SEQ ID NO: 9438637 - DNA, 22 bp, Homo sapiens
tgtcttttggagcatctttctt

SEQ ID NO: 9438638 - DNA, 22 bp, Homo sapiens
tgtctttttactatgttcaatc

SEQ ID NO: 9438639 - DNA, 22 bp, Homo sapiens
tgtgaaaaaagttctagaagga

SEQ ID NO: 9438640 - DNA, 22 bp, Homo sapiens
tgtgaaaaaagttctagaagga

SEQ ID NO: 9438641 - DNA, 22 bp, Homo sapiens
tgtgaaaagggctttgtacaaa

SEQ ID NO: 9438642 - DNA, 22 bp, Homo sapiens
tgtgaaaagggctttgtacaaa

SEQ ID NO: 9438643 - DNA, 22 bp, Homo sapiens
tgtgaaaagcgtgtgttctagg

SEQ ID NO: 9438644 - DNA, 22 bp, Homo sapiens
tgtgaaaagcgtgtgttctagg

SEQ ID NO: 9438645 - DNA, 22 bp, Homo sapiens
tgtgaaaagcaggctactttct

SEQ ID NO: 9438646 - DNA, 22 bp, Homo sapiens
tgtgaaaagcaggctactttct

SEQ ID NO: 9438647 - DNA, 22 bp, Homo sapiens
tgtgaaaagcaggctactttct

SEQ ID NO: 9438648 - DNA, 22 bp, Homo sapiens
tgtcttttacctaatgagctgg

SEQ ID NO: 9438649 - DNA, 22 bp, Homo sapiens
tgtcttttgccaaagatcagtt

SEQ ID NO: 9438650 - DNA, 22 bp, Homo sapiens
tgtcttttgccaaagatcagtt

SEQ ID NO: 9438651 - DNA, 22 bp, Homo sapiens
tgtcttttataactgacatata

SEQ ID NO: 9438652 - DNA, 22 bp, Homo sapiens
tgtcttttataactgacatata

SEQ ID NO: 9438653 - DNA, 21 bp, Homo sapiens
tgtcttcatatgagatggtgt

SEQ ID NO: 9438654 - DNA, 22 bp, Homo sapiens
tgtcttcagtgtgttaccatgg

SEQ ID NO: 9438655 - DNA, 22 bp, Homo sapiens
tgtcttcatctccatgcacaga

SEQ ID NO: 9438656 - DNA, 22 bp, Homo sapiens
tgtcttcagtaaaatacactat

SEQ ID NO: 9438657 - DNA, 22 bp, Homo sapiens
tgtcttcaggagtaaatatcat

SEQ ID NO: 9438658 - DNA, 22 bp, Homo sapiens
tgtcttcagtaaaatacactat

SEQ ID NO: 9438659 - DNA, 22 bp, Homo sapiens
tgtcttcagtaaaatacactat

SEQ ID NO: 9438660 - DNA, 22 bp, Homo sapiens
tgtcttcagtaaaatacactat

SEQ ID NO: 9438661 - DNA, 20 bp, Homo sapiens
tgtcttcattatggtgccct

SEQ ID NO: 9438662 - DNA, 22 bp, Homo sapiens
tgtcttcatgcctgaaagaaga

SEQ ID NO: 9438663 - DNA, 22 bp, Homo sapiens
tgtcttcatctccatgcacaga

SEQ ID NO: 9438664 - DNA, 22 bp, Homo sapiens
tgtcttcattccccatgaagtc

SEQ ID NO: 9438665 - DNA, 22 bp, Homo sapiens
tgtcttcattccccatgaagtc

SEQ ID NO: 9438666 - DNA, 17 bp, Homo sapiens
tgtcttctgaagagagc

SEQ ID NO: 9438667 - DNA, 17 bp, Homo sapiens
tgtcttctgaagagagc

SEQ ID NO: 9438668 - DNA, 17 bp, Homo sapiens
tgtcttctgaagagagc

SEQ ID NO: 9438669 - DNA, 22 bp, Homo sapiens
tgtcttctgtattcaagtctat

SEQ ID NO: 9438670 - DNA, 22 bp, Homo sapiens
tgtcttctaccttgacagcatt

SEQ ID NO: 9438671 - DNA, 22 bp, Homo sapiens
tgtcttctaccttgacagcatt

SEQ ID NO: 9438672 - DNA, 22 bp, Homo sapiens
tgtcttctaccttgacagcatt

SEQ ID NO: 9438673 - DNA, 22 bp, Homo sapiens
tgtcttctaccttgacagcatt

SEQ ID NO: 9438674 - DNA, 17 bp, Homo sapiens
tgtcttctgaagagagc

SEQ ID NO: 9438675 - DNA, 22 bp, Homo sapiens
tgtcttgtctgtgagggcattg

SEQ ID NO: 9438676 - DNA, 22 bp, Homo sapiens
tgtcttggttcttctgaaacac

SEQ ID NO: 9438677 - DNA, 22 bp, Homo sapiens
tgtcttggctctggagggggat

SEQ ID NO: 9438678 - DNA, 22 bp, Homo sapiens
tgtcttggccactaggagtgcc

SEQ ID NO: 9438679 - DNA, 22 bp, Homo sapiens
tgtcttggccactaggagtgcc

SEQ ID NO: 9438680 - DNA, 22 bp, Homo sapiens
tgtcttggattatctgtgcaac

SEQ ID NO: 9438681 - DNA, 22 bp, Homo sapiens
tgtcttggatgaggattaacag

SEQ ID NO: 9438682 - DNA, 22 bp, Homo sapiens
tgtcttgattgaagagatagaa

SEQ ID NO: 9438683 - DNA, 22 bp, Homo sapiens
tgtctcgggagaaaggagtggg

SEQ ID NO: 9438684 - DNA, 22 bp, Homo sapiens
tgtctccttgcttttccctgta

SEQ ID NO: 9438685 - DNA, 21 bp, Homo sapiens
tgtctcctgttggcacatggc

SEQ ID NO: 9438686 - DNA, 21 bp, Homo sapiens
tgtctcctgttggcacatggc

SEQ ID NO: 9438687 - DNA, 22 bp, Homo sapiens
tgtctccttgcttttccctgta

SEQ ID NO: 9438688 - DNA, 18 bp, Homo sapiens
tgtctctcctttctgtgt

SEQ ID NO: 9438689 - DNA, 22 bp, Homo sapiens
tgtctctcctgatgatctggtg

SEQ ID NO: 9438690 - DNA, 22 bp, Homo sapiens
tgtctcctgggtcccttccacc

SEQ ID NO: 9438691 - DNA, 21 bp, Homo sapiens
tgtctcctgttggcacatggc

SEQ ID NO: 9438692 - DNA, 22 bp, Homo sapiens
tgtctcctctgtcctgtcagga

SEQ ID NO: 9438693 - DNA, 22 bp, Homo sapiens
tgtctcctgggccctggccctg

SEQ ID NO: 9438694 - DNA, 22 bp, Homo sapiens
tgtctcctgcaggggtgtgggc

SEQ ID NO: 9438695 - DNA, 22 bp, Homo sapiens
tgtctcctgagagctggacaga

SEQ ID NO: 9438696 - DNA, 23 bp, Homo sapiens
tgtctccatctcattacttgggg

SEQ ID NO: 9438697 - DNA, 23 bp, Homo sapiens
tgtctccatctcattacttgggg

SEQ ID NO: 9438698 - DNA, 22 bp, Homo sapiens
tgtctccattttcaagtagcag

SEQ ID NO: 9438699 - DNA, 22 bp, Homo sapiens
tgtctccatgtgatagtggcct

SEQ ID NO: 9438700 - DNA, 22 bp, Homo sapiens
tgtctcccaggtgtgcccagtg

SEQ ID NO: 9438701 - DNA, 19 bp, Homo sapiens
tgtctcctcatgcaagtgt

SEQ ID NO: 9438702 - DNA, 22 bp, Homo sapiens
tgtctcctatttcctgctaagg

SEQ ID NO: 9438703 - DNA, 22 bp, Homo sapiens
tgtctcctatttcctgctaagg

SEQ ID NO: 9438704 - DNA, 22 bp, Homo sapiens
tgtctacaaacgtgtacacatt

SEQ ID NO: 9438705 - DNA, 22 bp, Homo sapiens
tgtctacaaacgtgtacacatt

SEQ ID NO: 9438706 - DNA, 22 bp, Homo sapiens
tgtctaatggcaatttcatgtg

SEQ ID NO: 9438707 - DNA, 22 bp, Homo sapiens
tgtctaatgaattaattaatta

SEQ ID NO: 9438708 - DNA, 22 bp, Homo sapiens
tgtctaatgaattaattaatta

SEQ ID NO: 9438709 - DNA, 22 bp, Homo sapiens
tgtctaaacttgttttatctca

SEQ ID NO: 9438710 - DNA, 22 bp, Homo sapiens
tgtctaaatgcaatggatttcc

SEQ ID NO: 9438711 - DNA, 22 bp, Homo sapiens
tgtcgggcatgcattctgagaa

SEQ ID NO: 9438712 - DNA, 23 bp, Homo sapiens
tgtcctttttgaggcctcctcct

SEQ ID NO: 9438713 - DNA, 22 bp, Homo sapiens
tgtctaggaaataaggagattc

SEQ ID NO: 9438714 - DNA, 22 bp, Homo sapiens
tgtctacttgggctctacagca

SEQ ID NO: 9438715 - DNA, 22 bp, Homo sapiens
tgtctactgctgacactaacag

SEQ ID NO: 9438716 - DNA, 22 bp, Homo sapiens
tgtctccaccatcatcttacca

SEQ ID NO: 9438717 - DNA, 22 bp, Homo sapiens
tgtctccacaggtgtcagctca

SEQ ID NO: 9438718 - DNA, 20 bp, Homo sapiens
tgtctccagggctgagtgga

SEQ ID NO: 9438719 - DNA, 20 bp, Homo sapiens
tgtctccagggctgagtgga

SEQ ID NO: 9438720 - DNA, 22 bp, Homo sapiens
tgtctccagaaagcaccaggag

SEQ ID NO: 9438721 - DNA, 22 bp, Homo sapiens
tgtctccaggggcaggccagcc

SEQ ID NO: 9438722 - DNA, 22 bp, Homo sapiens
tgtctccatagaagagactgca

SEQ ID NO: 9438723 - DNA, 22 bp, Homo sapiens
tgtctccatagaagagactgca

SEQ ID NO: 9438724 - DNA, 22 bp, Homo sapiens
tgtctccaactcactgtatact

SEQ ID NO: 9438725 - DNA, 22 bp, Homo sapiens
tgtctccaactcactgtatact

SEQ ID NO: 9438726 - DNA, 22 bp, Homo sapiens
tgtctccaaaacaatctcagat

SEQ ID NO: 9438727 - DNA, 22 bp, Homo sapiens
tgtctccaaaacaatctcagat

SEQ ID NO: 9438728 - DNA, 22 bp, Homo sapiens
tgtctccaaaacaatctcagat

SEQ ID NO: 9438729 - DNA, 22 bp, Homo sapiens
tgtctaggtctaggttggcaat

SEQ ID NO: 9438730 - DNA, 22 bp, Homo sapiens
tgtctagggtctgccccaccag

SEQ ID NO: 9438731 - DNA, 22 bp, Homo sapiens
tgtctaggttgcggttttatgt

SEQ ID NO: 9438732 - DNA, 22 bp, Homo sapiens
tgtctgaggaagtcagcccttt

SEQ ID NO: 9438733 - DNA, 22 bp, Homo sapiens
tgtctgaggaagtcagcccttt

SEQ ID NO: 9438734 - DNA, 21 bp, Homo sapiens
tgtctgagtgactgggtctgc

SEQ ID NO: 9438735 - DNA, 22 bp, Homo sapiens
tgtctgagtcatgcagagatat

SEQ ID NO: 9438736 - DNA, 18 bp, Homo sapiens
tgtctgagagctgggcgc

SEQ ID NO: 9438737 - DNA, 22 bp, Homo sapiens
tgtctgaattttggaatcaagt

SEQ ID NO: 9438738 - DNA, 22 bp, Homo sapiens
tgtctgagctggggcagacaga

SEQ ID NO: 9438739 - DNA, 22 bp, Homo sapiens
tgtctgagctggggcagacaga

SEQ ID NO: 9438740 - DNA, 22 bp, Homo sapiens
tgtctgaatcgcttcctagagg

SEQ ID NO: 9438741 - DNA, 22 bp, Homo sapiens
tgtctgaaggcctgacctacat

SEQ ID NO: 9438742 - DNA, 22 bp, Homo sapiens
tgtctgaaggcaggtggagaac

SEQ ID NO: 9438743 - DNA, 22 bp, Homo sapiens
tgtctgaattcaagaaattcaa

SEQ ID NO: 9438744 - DNA, 22 bp, Homo sapiens
tgtctgaatctcggtttcctca

SEQ ID NO: 9438745 - DNA, 22 bp, Homo sapiens
tgtctgaagcagccagtgctgt

SEQ ID NO: 9438746 - DNA, 22 bp, Homo sapiens
tgtctgaacaaactctgcctcc

SEQ ID NO: 9438747 - DNA, 22 bp, Homo sapiens
tgtctgaactgcactgaaagac

SEQ ID NO: 9438748 - DNA, 22 bp, Homo sapiens
tgtctgaacgaagtaggtccac

SEQ ID NO: 9438749 - DNA, 22 bp, Homo sapiens
tgtctgagtgtgcctgggcatt

SEQ ID NO: 9438750 - DNA, 22 bp, Homo sapiens
tgtctgagttagctcttctcag

SEQ ID NO: 9438751 - DNA, 22 bp, Homo sapiens
tgtctgagtggtgcaaggctga

SEQ ID NO: 9438752 - DNA, 18 bp, Homo sapiens
tgtctgagttcttccatt

SEQ ID NO: 9438753 - DNA, 22 bp, Homo sapiens
tgtctgatgatagtgtctctcc

SEQ ID NO: 9438754 - DNA, 23 bp, Homo sapiens
tgtctgagttggaaggccacctc

SEQ ID NO: 9438755 - DNA, 22 bp, Homo sapiens
tgtctgatgatagtgtctctcc

SEQ ID NO: 9438756 - DNA, 22 bp, Homo sapiens
tgtctgcagtgccacagtggga

SEQ ID NO: 9438757 - DNA, 21 bp, Homo sapiens
tgtctgatgtattttttgcct

SEQ ID NO: 9438758 - DNA, 22 bp, Homo sapiens
tgtctgcagaagatggcatggg

SEQ ID NO: 9438759 - DNA, 22 bp, Homo sapiens
tgtctgcagaagatggcatggg

SEQ ID NO: 9438760 - DNA, 22 bp, Homo sapiens
tgtctgcctgtctctgtgcaaa

SEQ ID NO: 9438761 - DNA, 22 bp, Homo sapiens
tgtctgcccattcatgggcaca

SEQ ID NO: 9438762 - DNA, 21 bp, Homo sapiens
tgtctgctgaaggctggtcac

SEQ ID NO: 9438763 - DNA, 20 bp, Homo sapiens
tgtctgctcataataaaccc

SEQ ID NO: 9438764 - DNA, 22 bp, Homo sapiens
tgtctgctagctggtggcaatt

SEQ ID NO: 9438765 - DNA, 22 bp, Homo sapiens
tgtctctgaagccccctccttt

SEQ ID NO: 9438766 - DNA, 18 bp, Homo sapiens
tgtctctgaattccagtg

SEQ ID NO: 9438767 - DNA, 18 bp, Homo sapiens
tgtctctgaattccagtg

SEQ ID NO: 9438768 - DNA, 22 bp, Homo sapiens
tgtctctgaaatatgtggctcc

SEQ ID NO: 9438769 - DNA, 22 bp, Homo sapiens
tgtctctgaaatatgtggctcc

SEQ ID NO: 9438770 - DNA, 22 bp, Homo sapiens
tgtctctgaaatatgtggctcc

SEQ ID NO: 9438771 - DNA, 19 bp, Homo sapiens
tgtctctgaaagatgagct

SEQ ID NO: 9438772 - DNA, 22 bp, Homo sapiens
tgtctctgaggtgagggtcagc

SEQ ID NO: 9438773 - DNA, 22 bp, Homo sapiens
tgtctctgccagctagcagaat

SEQ ID NO: 9438774 - DNA, 22 bp, Homo sapiens
tgtctctgaggtgagggtcagc

SEQ ID NO: 9438775 - DNA, 22 bp, Homo sapiens
tgtctctttggcctcccatatg

SEQ ID NO: 9438776 - DNA, 22 bp, Homo sapiens
tgtctctttgggttcctcttgg

SEQ ID NO: 9438777 - DNA, 22 bp, Homo sapiens
tgtctcttttcaagctaccctt

SEQ ID NO: 9438778 - DNA, 20 bp, Homo sapiens
tgtctgaaaaggaagctatc

SEQ ID NO: 9438779 - DNA, 22 bp, Homo sapiens
tgtctgaaacttggtcctatgc

SEQ ID NO: 9438780 - DNA, 22 bp, Homo sapiens
tgtctgaaagaggacgagctgg

SEQ ID NO: 9438781 - DNA, 22 bp, Homo sapiens
tgtctgaaagaggacgagctgg

SEQ ID NO: 9438782 - DNA, 22 bp, Homo sapiens
tgtctctgctgcaccttctggg

SEQ ID NO: 9438783 - DNA, 22 bp, Homo sapiens
tgtctctgctgcaccttctggg

SEQ ID NO: 9438784 - DNA, 22 bp, Homo sapiens
tgtctctgctttccttgcaggg

SEQ ID NO: 9438785 - DNA, 22 bp, Homo sapiens
tgtctctgctttccttgcaggg

SEQ ID NO: 9438786 - DNA, 22 bp, Homo sapiens
tgtctctgctttccttgcaggg

SEQ ID NO: 9438787 - DNA, 22 bp, Homo sapiens
tgtctcttggctctatcactta

SEQ ID NO: 9438788 - DNA, 22 bp, Homo sapiens
tgtctctgctttccttgcaggg

SEQ ID NO: 9438789 - DNA, 22 bp, Homo sapiens
tgtctcttggctctatcactta

SEQ ID NO: 9438790 - DNA, 22 bp, Homo sapiens
tgtctcttggctctatcactta

SEQ ID NO: 9438791 - DNA, 22 bp, Homo sapiens
ttagaacatagcaacagaatta

SEQ ID NO: 9438792 - DNA, 21 bp, Homo sapiens
ttagaacatcaacagcaccta

SEQ ID NO: 9438793 - DNA, 22 bp, Homo sapiens
ttagaacatagcaacagaatta

SEQ ID NO: 9438794 - DNA, 22 bp, Homo sapiens
ttagaacagtgtttgcctcgct

SEQ ID NO: 9438795 - DNA, 22 bp, Homo sapiens
ttagaacagtagaagaaagggt

SEQ ID NO: 9438796 - DNA, 22 bp, Homo sapiens
ttagaacaccattctatattac

SEQ ID NO: 9438797 - DNA, 22 bp, Homo sapiens
ttagaacactgagaaagtgatg

SEQ ID NO: 9438798 - DNA, 22 bp, Homo sapiens
ttagaacactgagaaagtgatg

SEQ ID NO: 9438799 - DNA, 22 bp, Homo sapiens
ttagaacactgagaaagtgatg

SEQ ID NO: 9438800 - DNA, 22 bp, Homo sapiens
ttagaacagtagaagaaagggt

SEQ ID NO: 9438801 - DNA, 22 bp, Homo sapiens
ttagaacagtagaagaaagggt

SEQ ID NO: 9438802 - DNA, 21 bp, Homo sapiens
ttagaacacttgctcttggaa

SEQ ID NO: 9438803 - DNA, 22 bp, Homo sapiens
ttagaacagtagaagaaagggt

SEQ ID NO: 9438804 - DNA, 22 bp, Homo sapiens
ttagaacactgagaaagtgatg

SEQ ID NO: 9438805 - DNA, 19 bp, Homo sapiens
ttagaacatcctctaggga

SEQ ID NO: 9438806 - DNA, 22 bp, Homo sapiens
ttagaacatctgtgtctttatg

SEQ ID NO: 9438807 - DNA, 22 bp, Homo sapiens
ttagaacatctctcttctgcca

SEQ ID NO: 9438808 - DNA, 22 bp, Homo sapiens
ttagaacatttttagaccaata

SEQ ID NO: 9438809 - DNA, 22 bp, Homo sapiens
ttagaacatttttagaccaata

SEQ ID NO: 9438810 - DNA, 22 bp, Homo sapiens
ttagaacattccatcactgggt

SEQ ID NO: 9438811 - DNA, 22 bp, Homo sapiens
ttagaacatttttagaccaata

SEQ ID NO: 9438812 - DNA, 22 bp, Homo sapiens
ttagaaccataatgaatcaatg

SEQ ID NO: 9438813 - DNA, 22 bp, Homo sapiens
ttagaactgaagaagattaagg

SEQ ID NO: 9438814 - DNA, 22 bp, Homo sapiens
ttagaacttaaacttcagaaag

SEQ ID NO: 9438815 - DNA, 22 bp, Homo sapiens
ttagatatgtttttgctaatgc

SEQ ID NO: 9438816 - DNA, 22 bp, Homo sapiens
ttagataatgttattgtaattt

SEQ ID NO: 9438817 - DNA, 22 bp, Homo sapiens
ttagataatgttattgtaattt

SEQ ID NO: 9438818 - DNA, 22 bp, Homo sapiens
ttagataatgtagagatatgag

SEQ ID NO: 9438819 - DNA, 22 bp, Homo sapiens
ttagataatgtagagatatgag

SEQ ID NO: 9438820 - DNA, 22 bp, Homo sapiens
ttagataacagtagaatatcaa

SEQ ID NO: 9438821 - DNA, 22 bp, Homo sapiens
ttagaacttaagaatactgtct

SEQ ID NO: 9438822 - DNA, 22 bp, Homo sapiens
ttacattttgcacagatgtccc

SEQ ID NO: 9438823 - DNA, 22 bp, Homo sapiens
ttacattttgcacagatgtccc

SEQ ID NO: 9438824 - DNA, 22 bp, Homo sapiens
ttacattttgcacagatgtccc

SEQ ID NO: 9438825 - DNA, 22 bp, Homo sapiens
ttacattttgcacagatgtccc

SEQ ID NO: 9438826 - DNA, 22 bp, Homo sapiens
ttacattttgcacagatgtccc

SEQ ID NO: 9438827 - DNA, 22 bp, Homo sapiens
ttacattttggggtaaggataa

SEQ ID NO: 9438828 - DNA, 22 bp, Homo sapiens
ttacattttggggtaaggataa

SEQ ID NO: 9438829 - DNA, 22 bp, Homo sapiens
ttagaaagctttccatagtcaa

SEQ ID NO: 9438830 - DNA, 22 bp, Homo sapiens
ttagaaaggttttgctctgaaa

SEQ ID NO: 9438831 - DNA, 22 bp, Homo sapiens
ttagaaagggtgtctgaatctg

SEQ ID NO: 9438832 - DNA, 22 bp, Homo sapiens
ttagaaagggtgtctgaatctg

SEQ ID NO: 9438833 - DNA, 22 bp, Homo sapiens
ttagaaatacaagtgaggttga

SEQ ID NO: 9438834 - DNA, 21 bp, Homo sapiens
ttagaacaatatttggtatag

SEQ ID NO: 9438835 - DNA, 22 bp, Homo sapiens
ttagaacaccattctatattac

SEQ ID NO: 9438836 - DNA, 22 bp, Homo sapiens
ttagaacaaagccaccaggtga

SEQ ID NO: 9438837 - DNA, 22 bp, Homo sapiens
ttagaaatgtcacagatctgat

SEQ ID NO: 9438838 - DNA, 22 bp, Homo sapiens
ttagaacaaagccaccaggtga

SEQ ID NO: 9438839 - DNA, 22 bp, Homo sapiens
ttagaacaatattctccctaca

SEQ ID NO: 9438840 - DNA, 22 bp, Homo sapiens
ttagaaatgtcacagatctgat

SEQ ID NO: 9438841 - DNA, 22 bp, Homo sapiens
ttagaaatgcacccaagaccta

SEQ ID NO: 9438842 - DNA, 22 bp, Homo sapiens
ttagaaatgtcacagatctgat

SEQ ID NO: 9438843 - DNA, 22 bp, Homo sapiens
ttagaaatgtcacagatctgat

SEQ ID NO: 9438844 - DNA, 22 bp, Homo sapiens
ttagaaatctgctgccatgcaa

SEQ ID NO: 9438845 - DNA, 22 bp, Homo sapiens
ttagaaatgcacccaagaccta

SEQ ID NO: 9438846 - DNA, 22 bp, Homo sapiens
ttagaaatgatttcacctcttt

SEQ ID NO: 9438847 - DNA, 22 bp, Homo sapiens
ttagaaatgatttcacctcttt

SEQ ID NO: 9438848 - DNA, 22 bp, Homo sapiens
ttagaaatcacctctgaagatc

SEQ ID NO: 9438849 - DNA, 22 bp, Homo sapiens
ttagaaatcacctctgaagatc

SEQ ID NO: 9438850 - DNA, 22 bp, Homo sapiens
ttagaaatcacctctgaagatc

SEQ ID NO: 9438851 - DNA, 22 bp, Homo sapiens
ttagaaatatggtgctgccgcc

SEQ ID NO: 9438852 - DNA, 22 bp, Homo sapiens
ttagggagctcagtcctcagat

SEQ ID NO: 9438853 - DNA, 22 bp, Homo sapiens
ttagggaagtgttattctcagg

SEQ ID NO: 9438854 - DNA, 19 bp, Homo sapiens
ttaggggtatgaagtggta

SEQ ID NO: 9438855 - DNA, 22 bp, Homo sapiens
ttagggcaggcatgagagaact

SEQ ID NO: 9438856 - DNA, 22 bp, Homo sapiens
ttagggaagtgttattctcagg

SEQ ID NO: 9438857 - DNA, 22 bp, Homo sapiens
ttaggaagcacacagtaaatat

SEQ ID NO: 9438858 - DNA, 22 bp, Homo sapiens
ttaggaagcaggcctaaaattt

SEQ ID NO: 9438859 - DNA, 22 bp, Homo sapiens
ttagggaaatatttatatactt

SEQ ID NO: 9438860 - DNA, 22 bp, Homo sapiens
ttaggaagcaggcctaaaattt

SEQ ID NO: 9438861 - DNA, 22 bp, Homo sapiens
ttaggaagagctttcaatcact

SEQ ID NO: 9438862 - DNA, 22 bp, Homo sapiens
ttaggaagagctttcaatcact

SEQ ID NO: 9438863 - DNA, 22 bp, Homo sapiens
ttaggaagaaggaggcagtatt

SEQ ID NO: 9438864 - DNA, 22 bp, Homo sapiens
ttagcatttctggaatcacaag

SEQ ID NO: 9438865 - DNA, 22 bp, Homo sapiens
ttagcatttcagtacacatgtt

SEQ ID NO: 9438866 - DNA, 22 bp, Homo sapiens
ttagcatttcagtacacatgtt

SEQ ID NO: 9438867 - DNA, 22 bp, Homo sapiens
ttagggttacaccagcctcctg

SEQ ID NO: 9438868 - DNA, 22 bp, Homo sapiens
ttaggtaaggatggtgacagta

SEQ ID NO: 9438869 - DNA, 22 bp, Homo sapiens
ttaggtgtgacattttgttcct

SEQ ID NO: 9438870 - DNA, 22 bp, Homo sapiens
ttagtaaataaagtctactttc

SEQ ID NO: 9438871 - DNA, 22 bp, Homo sapiens
ttagtaaataaagtctactttc

SEQ ID NO: 9438872 - DNA, 22 bp, Homo sapiens
ttaggtaagtaggatcaaaaaa

SEQ ID NO: 9438873 - DNA, 19 bp, Homo sapiens
ttaggtattattgctttcc

SEQ ID NO: 9438874 - DNA, 22 bp, Homo sapiens
ttagcaaacctggactacagat

SEQ ID NO: 9438875 - DNA, 22 bp, Homo sapiens
ttagcagcaatggcatcaacta

SEQ ID NO: 9438876 - DNA, 22 bp, Homo sapiens
ttagcagcggtcagttttgaag

SEQ ID NO: 9438877 - DNA, 22 bp, Homo sapiens
ttagcagcatccctggcctgta

SEQ ID NO: 9438878 - DNA, 22 bp, Homo sapiens
ttagcagctaaactgacagacc

SEQ ID NO: 9438879 - DNA, 22 bp, Homo sapiens
ttagcagctaagtcatgctgca

SEQ ID NO: 9438880 - DNA, 22 bp, Homo sapiens
ttagcattctctgtgtgcataa

SEQ ID NO: 9438881 - DNA, 22 bp, Homo sapiens
ttagcagcttttaaatggttct

SEQ ID NO: 9438882 - DNA, 22 bp, Homo sapiens
ttagcagcttagactgcctggg

SEQ ID NO: 9438883 - DNA, 22 bp, Homo sapiens
ttagatgtgcaggacttttatc

SEQ ID NO: 9438884 - DNA, 22 bp, Homo sapiens
ttagatgtggacttatgttatt

SEQ ID NO: 9438885 - DNA, 22 bp, Homo sapiens
ttagatcattttgaactaattt

SEQ ID NO: 9438886 - DNA, 22 bp, Homo sapiens
ttagatttatatgtgagaatgg

SEQ ID NO: 9438887 - DNA, 22 bp, Homo sapiens
ttagatttacaagcactgttta

SEQ ID NO: 9438888 - DNA, 22 bp, Homo sapiens
ttagcaaaaatatctcatatta

SEQ ID NO: 9438889 - DNA, 22 bp, Homo sapiens
ttagcaaaaatatctcatatta

SEQ ID NO: 9438890 - DNA, 22 bp, Homo sapiens
ttagcaaaaatatctcatatta

SEQ ID NO: 9438891 - DNA, 17 bp, Homo sapiens
ttagcaaaatagcactt

SEQ ID NO: 9438892 - DNA, 22 bp, Homo sapiens
ttagcaaacaaatgaaatggtt

SEQ ID NO: 9438893 - DNA, 22 bp, Homo sapiens
ttagcaaacccttgctggtgag

SEQ ID NO: 9438894 - DNA, 22 bp, Homo sapiens
ttagcaaacctggactacagat

SEQ ID NO: 9438895 - DNA, 22 bp, Homo sapiens
ttagcaaacaaatgaaatggtt

SEQ ID NO: 9438896 - DNA, 22 bp, Homo sapiens
ttagtgaatcacagagtacata

SEQ ID NO: 9438897 - DNA, 22 bp, Homo sapiens
ttagtgaaatgactgcataggt

SEQ ID NO: 9438898 - DNA, 22 bp, Homo sapiens
ttagtgaaatgactgcataggt

SEQ ID NO: 9438899 - DNA, 22 bp, Homo sapiens
ttagtgaaaagaaaatgagtgg

SEQ ID NO: 9438900 - DNA, 22 bp, Homo sapiens
ttagtgatcaaaatcaaaattg

SEQ ID NO: 9438901 - DNA, 22 bp, Homo sapiens
ttagtgcattttaatagagatg

SEQ ID NO: 9438902 - DNA, 22 bp, Homo sapiens
ttagtgcaccatcctgaggtgt

SEQ ID NO: 9438903 - DNA, 22 bp, Homo sapiens
ttagtgcaaacctcagagacac

SEQ ID NO: 9438904 - DNA, 22 bp, Homo sapiens
ttagtgcaattcagagaacaat

SEQ ID NO: 9438905 - DNA, 22 bp, Homo sapiens
ttagtgattacagatatataaa

SEQ ID NO: 9438906 - DNA, 22 bp, Homo sapiens
ttagtgcaaacctcagagacac

SEQ ID NO: 9438907 - DNA, 22 bp, Homo sapiens
ttagtagtaagagtcatatgta

SEQ ID NO: 9438908 - DNA, 18 bp, Homo sapiens
ttagtataactgcctgtg

SEQ ID NO: 9438909 - DNA, 22 bp, Homo sapiens
ttagtattaggatcatatttga

SEQ ID NO: 9438910 - DNA, 22 bp, Homo sapiens
ttagtcaatagtgaatatagag

SEQ ID NO: 9438911 - DNA, 22 bp, Homo sapiens
ttagtcttcttccttatatgtt

SEQ ID NO: 9438912 - DNA, 22 bp, Homo sapiens
ttagtctctttgcattgccata

SEQ ID NO: 9438913 - DNA, 22 bp, Homo sapiens
ttatatgtatgcttataaacca

SEQ ID NO: 9438914 - DNA, 22 bp, Homo sapiens
ttatatgtatgcttataaacca

SEQ ID NO: 9438915 - DNA, 22 bp, Homo sapiens
ttagtgctcacgtgttagaaag

SEQ ID NO: 9438916 - DNA, 22 bp, Homo sapiens
ttatatgtatgcttataaacca

SEQ ID NO: 9438917 - DNA, 22 bp, Homo sapiens
ttatatgtatgcttataaacca

SEQ ID NO: 9438918 - DNA, 18 bp, Homo sapiens
ttatctctggcatgtgcc

SEQ ID NO: 9438919 - DNA, 22 bp, Homo sapiens
ttatctgaaacttttgggacca

SEQ ID NO: 9438920 - DNA, 22 bp, Homo sapiens
ttatctgtctatcaagactagc

SEQ ID NO: 9438921 - DNA, 22 bp, Homo sapiens
ttatctgtgatcctaaatgtct

SEQ ID NO: 9438922 - DNA, 22 bp, Homo sapiens
ttatctgtgatcctaaatgtct

SEQ ID NO: 9438923 - DNA, 20 bp, Homo sapiens
ttatctgtcaatctgtctca

SEQ ID NO: 9438924 - DNA, 19 bp, Homo sapiens
ttatctgtgttgcagtggt

SEQ ID NO: 9438925 - DNA, 22 bp, Homo sapiens
ttatctgttgttttagtacaat

SEQ ID NO: 9438926 - DNA, 22 bp, Homo sapiens
ttatctgtttaacaaagtatct

SEQ ID NO: 9438927 - DNA, 22 bp, Homo sapiens
ttatcttagaggtgattgtatt

SEQ ID NO: 9438928 - DNA, 22 bp, Homo sapiens
ttatctgtttaacaaagtatct

SEQ ID NO: 9438929 - DNA, 22 bp, Homo sapiens
ttatgatttgccacagattggt

SEQ ID NO: 9438930 - DNA, 22 bp, Homo sapiens
ttatgatttagaaagattcact

SEQ ID NO: 9438931 - DNA, 22 bp, Homo sapiens
ttatgatttagaaagattcact

SEQ ID NO: 9438932 - DNA, 22 bp, Homo sapiens
ttatgatttgccacagattggt

SEQ ID NO: 9438933 - DNA, 22 bp, Homo sapiens
ttatgagatatttatactgctg

SEQ ID NO: 9438934 - DNA, 22 bp, Homo sapiens
ttatgatttagaaagattcact

SEQ ID NO: 9438935 - DNA, 22 bp, Homo sapiens
ttatgagactgttttacacact

SEQ ID NO: 9438936 - DNA, 22 bp, Homo sapiens
ttatgagactgttttacacact

SEQ ID NO: 9438937 - DNA, 22 bp, Homo sapiens
ttatgacatatgagtacaagta

SEQ ID NO: 9438938 - DNA, 22 bp, Homo sapiens
ttattattgattcgctctcaaa

SEQ ID NO: 9438939 - DNA, 22 bp, Homo sapiens
ttattatgtggatgaaagatgt

SEQ ID NO: 9438940 - DNA, 22 bp, Homo sapiens
ttattattccccaagtcattat

SEQ ID NO: 9438941 - DNA, 22 bp, Homo sapiens
ttatgatttgccacagattggt

SEQ ID NO: 9438942 - DNA, 18 bp, Homo sapiens
ttatgcaaaactgttttc

SEQ ID NO: 9438943 - DNA, 22 bp, Homo sapiens
ttatgatttgccacagattggt

SEQ ID NO: 9438944 - DNA, 22 bp, Homo sapiens
ttatgatttgccacagattggt

SEQ ID NO: 9438945 - DNA, 22 bp, Homo sapiens
ttatgcaacaggtgagcagaca

SEQ ID NO: 9438946 - DNA, 22 bp, Homo sapiens
ttatgcaaagaaatagactaat

SEQ ID NO: 9438947 - DNA, 18 bp, Homo sapiens
ttatgcaaaactgttttc

SEQ ID NO: 9438948 - DNA, 22 bp, Homo sapiens
ttatcttgggtaactttgtgca

SEQ ID NO: 9438949 - DNA, 17 bp, Homo sapiens
ttatcttgctgtttcta

SEQ ID NO: 9438950 - DNA, 22 bp, Homo sapiens
ttatcttagaggtgattgtatt

SEQ ID NO: 9438951 - DNA, 22 bp, Homo sapiens
ttatcttgagtattgagattct

SEQ ID NO: 9438952 - DNA, 22 bp, Homo sapiens
ttatgaaaacaatcagtaggca

SEQ ID NO: 9438953 - DNA, 22 bp, Homo sapiens
ttatcttgtagagatattttcg

SEQ ID NO: 9438954 - DNA, 22 bp, Homo sapiens
ttatgaaaacaatcagtaggca

SEQ ID NO: 9438955 - DNA, 22 bp, Homo sapiens
ttatgaaaacaatcagtaggca

SEQ ID NO: 9438956 - DNA, 22 bp, Homo sapiens
ttatgaagttcctgttacagtg

SEQ ID NO: 9438957 - DNA, 19 bp, Homo sapiens
ttatgaatagcttcatcca

SEQ ID NO: 9438958 - DNA, 22 bp, Homo sapiens
ttatgacaggaaaatcacagaa

SEQ ID NO: 9438959 - DNA, 22 bp, Homo sapiens
ttatgacagaaatgaaaagctg

SEQ ID NO: 9438960 - DNA, 22 bp, Homo sapiens
ttatgaaagacatttctgttgg

SEQ ID NO: 9438961 - DNA, 22 bp, Homo sapiens
ttatgaacaatttctaggaatg

SEQ ID NO: 9438962 - DNA, 22 bp, Homo sapiens
ttatgaaagacatttctgttgg

SEQ ID NO: 9438963 - DNA, 22 bp, Homo sapiens
ttatgaaagacatttctgttgg

SEQ ID NO: 9438964 - DNA, 22 bp, Homo sapiens
ttatgaaagacatttctgttgg

SEQ ID NO: 9438965 - DNA, 22 bp, Homo sapiens
ttatgaaagacatttctgttgg

SEQ ID NO: 9438966 - DNA, 22 bp, Homo sapiens
ttattattggtgagttaaggaa

SEQ ID NO: 9438967 - DNA, 22 bp, Homo sapiens
ttattcagggataacatccagg

SEQ ID NO: 9438968 - DNA, 22 bp, Homo sapiens
ttattcagtgcatatattaaaa

SEQ ID NO: 9438969 - DNA, 22 bp, Homo sapiens
ttattcagtgcatatattaaaa

SEQ ID NO: 9438970 - DNA, 22 bp, Homo sapiens
ttattccacagctcagaatttt

SEQ ID NO: 9438971 - DNA, 22 bp, Homo sapiens
ttattccacagctcagaatttt

SEQ ID NO: 9438972 - DNA, 22 bp, Homo sapiens
ttattccacctccattttccta

SEQ ID NO: 9438973 - DNA, 22 bp, Homo sapiens
ttattccaatttctcctacaaa

SEQ ID NO: 9438974 - DNA, 22 bp, Homo sapiens
ttattcattaacagggaccaaa

SEQ ID NO: 9438975 - DNA, 22 bp, Homo sapiens
ttattcatcagtgcattaattt

SEQ ID NO: 9438976 - DNA, 22 bp, Homo sapiens
ttattcatcagtgcattaattt

SEQ ID NO: 9438977 - DNA, 22 bp, Homo sapiens
ttattcatcagtgcattaattt

SEQ ID NO: 9438978 - DNA, 22 bp, Homo sapiens
ttattcatcagtgcattaattt

SEQ ID NO: 9438979 - DNA, 22 bp, Homo sapiens
ttattcatcagtgcattaattt

SEQ ID NO: 9438980 - DNA, 22 bp, Homo sapiens
ttattccattatttcacttagg

SEQ ID NO: 9438981 - DNA, 22 bp, Homo sapiens
ttattccacctccattttccta

SEQ ID NO: 9438982 - DNA, 22 bp, Homo sapiens
ttattccaggcacagaaggagg

SEQ ID NO: 9438983 - DNA, 22 bp, Homo sapiens
ttattctgagagttgaagtaat

SEQ ID NO: 9438984 - DNA, 21 bp, Homo sapiens
ttattctgagatgagattctt

SEQ ID NO: 9438985 - DNA, 22 bp, Homo sapiens
ttattctgagagttgaagtaat

SEQ ID NO: 9438986 - DNA, 22 bp, Homo sapiens
ttattctgccaggagcgtcagt

SEQ ID NO: 9438987 - DNA, 22 bp, Homo sapiens
ttattctgcacttttaaaatat

SEQ ID NO: 9438988 - DNA, 22 bp, Homo sapiens
ttattctgcacttttaaaatat

SEQ ID NO: 9438989 - DNA, 22 bp, Homo sapiens
ttattctcatctccctacttag

SEQ ID NO: 9438990 - DNA, 22 bp, Homo sapiens
ttattctgaactagactctcat

SEQ ID NO: 9438991 - DNA, 22 bp, Homo sapiens
ttattctgactaatgtataact

SEQ ID NO: 9438992 - DNA, 22 bp, Homo sapiens
ttattcttggatctgagtctct

SEQ ID NO: 9438993 - DNA, 22 bp, Homo sapiens
ttattctttaaacatatatgtt

SEQ ID NO: 9438994 - DNA, 22 bp, Homo sapiens
ttatttatggcactgttggtgg

SEQ ID NO: 9438995 - DNA, 22 bp, Homo sapiens
ttatttatggcactgttggtgg

SEQ ID NO: 9438996 - DNA, 22 bp, Homo sapiens
ttattcttggatctgagtctct

SEQ ID NO: 9438997 - DNA, 22 bp, Homo sapiens
ttatttatggccctcacctgat

SEQ ID NO: 9438998 - DNA, 22 bp, Homo sapiens
ttatttatggccctcacctgat

SEQ ID NO: 9438999 - DNA, 22 bp, Homo sapiens
ttatttcattgatttctaagac

SEQ ID NO: 9439000 - DNA, 22 bp, Homo sapiens
ttatttcattgatttctaagac

SEQ ID NO: 9439001 - DNA, 22 bp, Homo sapiens
ttattctgtctttggtctcaat

SEQ ID NO: 9439002 - DNA, 22 bp, Homo sapiens
ttattctgtgaacatggttaat

SEQ ID NO: 9439003 - DNA, 19 bp, Homo sapiens
ttattctgtcagagcacac

SEQ ID NO: 9439004 - DNA, 19 bp, Homo sapiens
ttattctgtcagagcacac

SEQ ID NO: 9439005 - DNA, 22 bp, Homo sapiens
ttattctgtcaaacttatacat

SEQ ID NO: 9439006 - DNA, 22 bp, Homo sapiens
ttattctgtcaaacttatacat

SEQ ID NO: 9439007 - DNA, 22 bp, Homo sapiens
ttattctgtcaaacttatacat

SEQ ID NO: 9439008 - DNA, 22 bp, Homo sapiens
ttattctgtatttcaggtatgt

SEQ ID NO: 9439009 - DNA, 22 bp, Homo sapiens
ttattctgtagaacctagtaca

SEQ ID NO: 9439010 - DNA, 22 bp, Homo sapiens
ttattctgtatttcaggtatgt

SEQ ID NO: 9439011 - DNA, 22 bp, Homo sapiens
ttattctggaggaagcaaatgg

SEQ ID NO: 9439012 - DNA, 22 bp, Homo sapiens
ttattctggaggaagcaaatgg

SEQ ID NO: 9439013 - DNA, 17 bp, Homo sapiens
ttattctggcatatgtg

SEQ ID NO: 9439014 - DNA, 22 bp, Homo sapiens
ttattctgttgcttttacagta

SEQ ID NO: 9439015 - DNA, 22 bp, Homo sapiens
ttattctgttgcttttacagta

SEQ ID NO: 9439016 - DNA, 22 bp, Homo sapiens
ttattctgttggccctctcatc

SEQ ID NO: 9439017 - DNA, 22 bp, Homo sapiens
ttattctgttggccctctcatc

SEQ ID NO: 9439018 - DNA, 22 bp, Homo sapiens
ttattctgtttgccgaccagta

SEQ ID NO: 9439019 - DNA, 22 bp, Homo sapiens
ttattctgttgttcagggttgg

SEQ ID NO: 9439020 - DNA, 22 bp, Homo sapiens
ttattctgttgttcagggttgg

SEQ ID NO: 9439021 - DNA, 22 bp, Homo sapiens
ttattctgtttgccgaccagta

SEQ ID NO: 9439022 - DNA, 22 bp, Homo sapiens
ttattcttggatctgagtctct

SEQ ID NO: 9439023 - DNA, 19 bp, Homo sapiens
ttattcttaaagtagctta

SEQ ID NO: 9439024 - DNA, 22 bp, Homo sapiens
ttacaaaggtagttttgtctat

SEQ ID NO: 9439025 - DNA, 22 bp, Homo sapiens
ttacaaagtgctgcaccatttt

SEQ ID NO: 9439026 - DNA, 22 bp, Homo sapiens
ttacaaagtgttatgataaaca

SEQ ID NO: 9439027 - DNA, 22 bp, Homo sapiens
ttacaaagtgttatgataaaca

SEQ ID NO: 9439028 - DNA, 22 bp, Homo sapiens
ttacaaagtgctgcaccatttt

SEQ ID NO: 9439029 - DNA, 20 bp, Homo sapiens
ttacaaagaggcatcgcttt

SEQ ID NO: 9439030 - DNA, 21 bp, Homo sapiens
ttacaaagctacagatgttgc

SEQ ID NO: 9439031 - DNA, 21 bp, Homo sapiens
ttacaaagctacagatgttgc

SEQ ID NO: 9439032 - DNA, 20 bp, Homo sapiens
ttacaaagaggcatcgcttt

SEQ ID NO: 9439033 - DNA, 21 bp, Homo sapiens
ttacaaagctacagatgttgc

SEQ ID NO: 9439034 - DNA, 21 bp, Homo sapiens
ttacaaagctacagatgttgc

SEQ ID NO: 9439035 - DNA, 22 bp, Homo sapiens
ttacaaagttctgagttcaaac

SEQ ID NO: 9439036 - DNA, 22 bp, Homo sapiens
ttacaaagtttaaggtggcact

SEQ ID NO: 9439037 - DNA, 22 bp, Homo sapiens
ttacaaagttctgagttcaaac

SEQ ID NO: 9439038 - DNA, 22 bp, Homo sapiens
ttacaaagttctgagttcaaac

SEQ ID NO: 9439039 - DNA, 22 bp, Homo sapiens
ttacaaagttctgagttcaaac

SEQ ID NO: 9439040 - DNA, 22 bp, Homo sapiens
ttacaaagttctgagttcaaac

SEQ ID NO: 9439041 - DNA, 22 bp, Homo sapiens
ttacaaagtgttatgataaaca

SEQ ID NO: 9439042 - DNA, 22 bp, Homo sapiens
ttacaaagtgttatgataaaca

SEQ ID NO: 9439043 - DNA, 22 bp, Homo sapiens
ttacaaagtgttatgataaaca

SEQ ID NO: 9439044 - DNA, 22 bp, Homo sapiens
ttacaaagtgttatgataaaca

SEQ ID NO: 9439045 - DNA, 22 bp, Homo sapiens
ttacaaagtgttatgataaaca

SEQ ID NO: 9439046 - DNA, 22 bp, Homo sapiens
ttaatgttttaagttatagaga

SEQ ID NO: 9439047 - DNA, 22 bp, Homo sapiens
ttaatgttttaagttatagaga

SEQ ID NO: 9439048 - DNA, 22 bp, Homo sapiens
ttaattaaattcatgagcattg

SEQ ID NO: 9439049 - DNA, 22 bp, Homo sapiens
ttaattaaattcatgagcattg

SEQ ID NO: 9439050 - DNA, 22 bp, Homo sapiens
ttaattaactagccaaccacta

SEQ ID NO: 9439051 - DNA, 22 bp, Homo sapiens
ttaattaactagccaaccacta

SEQ ID NO: 9439052 - DNA, 22 bp, Homo sapiens
ttaattaagagatactgcagta

SEQ ID NO: 9439053 - DNA, 20 bp, Homo sapiens
ttacaaagaggcatcgcttt

SEQ ID NO: 9439054 - DNA, 22 bp, Homo sapiens
ttacaaagagaagttgtagaat

SEQ ID NO: 9439055 - DNA, 22 bp, Homo sapiens
ttacaaagaaaattaggcattt

SEQ ID NO: 9439056 - DNA, 22 bp, Homo sapiens
ttacaaagaaaattaggcattt

SEQ ID NO: 9439057 - DNA, 22 bp, Homo sapiens
ttacaaagaaaattaggcattt

SEQ ID NO: 9439058 - DNA, 22 bp, Homo sapiens
ttacaaagaaaattaggcattt

SEQ ID NO: 9439059 - DNA, 22 bp, Homo sapiens
ttaattaagagatactgcagta

SEQ ID NO: 9439060 - DNA, 23 bp, Homo sapiens
ttacaacagtgtccatatttgta

SEQ ID NO: 9439061 - DNA, 23 bp, Homo sapiens
ttacaacagtgtccatatttgta

SEQ ID NO: 9439062 - DNA, 23 bp, Homo sapiens
ttacaacagtgtccatatttgta

SEQ ID NO: 9439063 - DNA, 17 bp, Homo sapiens
ttacaacgtcatctctg

SEQ ID NO: 9439064 - DNA, 21 bp, Homo sapiens
ttacaacatttgtgttctatg

SEQ ID NO: 9439065 - DNA, 21 bp, Homo sapiens
ttacaacatttgtgttctatg

SEQ ID NO: 9439066 - DNA, 21 bp, Homo sapiens
ttacaacatttgtgttctatg

SEQ ID NO: 9439067 - DNA, 21 bp, Homo sapiens
ttacaacatttgtgttctatg

SEQ ID NO: 9439068 - DNA, 22 bp, Homo sapiens
ttacaacatatttagcttgatt

SEQ ID NO: 9439069 - DNA, 21 bp, Homo sapiens
ttacaacatttgtgttctatg

SEQ ID NO: 9439070 - DNA, 21 bp, Homo sapiens
ttacaacatttgtgttctatg

SEQ ID NO: 9439071 - DNA, 22 bp, Homo sapiens
ttacaactttcctgtgtcaaat

SEQ ID NO: 9439072 - DNA, 22 bp, Homo sapiens
ttacaacttgcagaggatgttg

SEQ ID NO: 9439073 - DNA, 22 bp, Homo sapiens
ttacaagacacagtgctgaagg

SEQ ID NO: 9439074 - DNA, 22 bp, Homo sapiens
ttacaactgaagctaatgtgct

SEQ ID NO: 9439075 - DNA, 22 bp, Homo sapiens
ttacaactctagagaaaagaaa

SEQ ID NO: 9439076 - DNA, 17 bp, Homo sapiens
ttacaacaattcatgag

SEQ ID NO: 9439077 - DNA, 22 bp, Homo sapiens
ttacaacaaaggcacgtgcatg

SEQ ID NO: 9439078 - DNA, 17 bp, Homo sapiens
ttacaacaattcatgag

SEQ ID NO: 9439079 - DNA, 22 bp, Homo sapiens
ttacaacaaaggcacgtgcatg

SEQ ID NO: 9439080 - DNA, 22 bp, Homo sapiens
ttacaacaaaggcacgtgcatg

SEQ ID NO: 9439081 - DNA, 22 bp, Homo sapiens
ttacaacaccaggcagtatcct

SEQ ID NO: 9439082 - DNA, 22 bp, Homo sapiens
ttacaacaccaggcagtatcct

SEQ ID NO: 9439083 - DNA, 22 bp, Homo sapiens
ttacaacaccaggcagtatcct

SEQ ID NO: 9439084 - DNA, 17 bp, Homo sapiens
ttacaacaattcatgag

SEQ ID NO: 9439085 - DNA, 17 bp, Homo sapiens
ttacaacaattcatgag

SEQ ID NO: 9439086 - DNA, 17 bp, Homo sapiens
ttacaacaattcatgag

SEQ ID NO: 9439087 - DNA, 17 bp, Homo sapiens
ttacaacaattcatgag

SEQ ID NO: 9439088 - DNA, 22 bp, Homo sapiens
ttacaacagacacatattctaa

SEQ ID NO: 9439089 - DNA, 22 bp, Homo sapiens
ttacaacagacacatattctaa

SEQ ID NO: 9439090 - DNA, 22 bp, Homo sapiens
ttacaacagacacatattctaa

SEQ ID NO: 9439091 - DNA, 22 bp, Homo sapiens
ttacaacactacttatccttga

SEQ ID NO: 9439092 - DNA, 22 bp, Homo sapiens
ttacaacactacttatccttga

SEQ ID NO: 9439093 - DNA, 22 bp, Homo sapiens
ttacaacagcgatttacctgtc

SEQ ID NO: 9439094 - DNA, 22 bp, Homo sapiens
ttacaacagcgatttacctgtc

SEQ ID NO: 9439095 - DNA, 22 bp, Homo sapiens
ttacaacagcgatttacctgtc

SEQ ID NO: 9439096 - DNA, 22 bp, Homo sapiens
ttacaacagacacatattctaa

SEQ ID NO: 9439097 - DNA, 22 bp, Homo sapiens
ttacaacagacacatattctaa

SEQ ID NO: 9439098 - DNA, 22 bp, Homo sapiens
ttacaacagacacatattctaa

SEQ ID NO: 9439099 - DNA, 22 bp, Homo sapiens
ttacaacagacacatattctaa

SEQ ID NO: 9439100 - DNA, 22 bp, Homo sapiens
ttaatacagtctccagaagtaa

SEQ ID NO: 9439101 - DNA, 22 bp, Homo sapiens
ttaatacagtctccagaagtaa

SEQ ID NO: 9439102 - DNA, 22 bp, Homo sapiens
ttaatacactatatgatcacat

SEQ ID NO: 9439103 - DNA, 22 bp, Homo sapiens
ttaatacagaagcaagacactg

SEQ ID NO: 9439104 - DNA, 22 bp, Homo sapiens
ttaatacagaagcaagacactg

SEQ ID NO: 9439105 - DNA, 21 bp, Homo sapiens
ttaatgctatgcagaaaatct

SEQ ID NO: 9439106 - DNA, 21 bp, Homo sapiens
ttaatgctatgcagaaaatct

SEQ ID NO: 9439107 - DNA, 22 bp, Homo sapiens
ttaatggcagggcagaatatta

SEQ ID NO: 9439108 - DNA, 22 bp, Homo sapiens
ttaatgtcaacatttctgaaga

SEQ ID NO: 9439109 - DNA, 22 bp, Homo sapiens
ttaatgtgtgtacaggattttg

SEQ ID NO: 9439110 - DNA, 22 bp, Homo sapiens
ttaatacaagcatatgcacaca

SEQ ID NO: 9439111 - DNA, 22 bp, Homo sapiens
ttaatacaagcatatgcacaca

SEQ ID NO: 9439112 - DNA, 22 bp, Homo sapiens
ttaatacaactgttgtcactgg

SEQ ID NO: 9439113 - DNA, 22 bp, Homo sapiens
ttaatacaactgttgtcactgg

SEQ ID NO: 9439114 - DNA, 22 bp, Homo sapiens
ttaatacaactgttgtcactgg

SEQ ID NO: 9439115 - DNA, 22 bp, Homo sapiens
ttaatacaactgttgtcactgg

SEQ ID NO: 9439116 - DNA, 22 bp, Homo sapiens
ttaatacaactgttgtcactgg

SEQ ID NO: 9439117 - DNA, 22 bp, Homo sapiens
ttaatacaactgttgtcactgg

SEQ ID NO: 9439118 - DNA, 22 bp, Homo sapiens
ttaataataatgagcccatttt

SEQ ID NO: 9439119 - DNA, 22 bp, Homo sapiens
ttaataagtagtagttattgtt

SEQ ID NO: 9439120 - DNA, 22 bp, Homo sapiens
ttaataacattgtgtatcaccc

SEQ ID NO: 9439121 - DNA, 22 bp, Homo sapiens
ttaataataatgagcccatttt

SEQ ID NO: 9439122 - DNA, 22 bp, Homo sapiens
ttaataataatgagcccatttt

SEQ ID NO: 9439123 - DNA, 22 bp, Homo sapiens
ttaataaagtatgaattggaaa

SEQ ID NO: 9439124 - DNA, 22 bp, Homo sapiens
ttaataaagtatgaattggaaa

SEQ ID NO: 9439125 - DNA, 22 bp, Homo sapiens
ttaataaagtatgaattggaaa

SEQ ID NO: 9439126 - DNA, 22 bp, Homo sapiens
ttaataaagtatgaattggaaa

SEQ ID NO: 9439127 - DNA, 22 bp, Homo sapiens
ttaaagcaggcatcattcctca

SEQ ID NO: 9439128 - DNA, 22 bp, Homo sapiens
ttaaagcagtttgtatacatgg

SEQ ID NO: 9439129 - DNA, 22 bp, Homo sapiens
ttaaagcagtttgtatacatgg

SEQ ID NO: 9439130 - DNA, 22 bp, Homo sapiens
ttaataaagtatgaattggaaa

SEQ ID NO: 9439131 - DNA, 22 bp, Homo sapiens
ttaataaagtatgaattggaaa

SEQ ID NO: 9439132 - DNA, 22 bp, Homo sapiens
ttaataaagtatgaattggaaa

SEQ ID NO: 9439133 - DNA, 22 bp, Homo sapiens
ttaaagcagtttgtatacatgg

SEQ ID NO: 9439134 - DNA, 22 bp, Homo sapiens
ttaataaagtatgaattggaaa

SEQ ID NO: 9439135 - DNA, 22 bp, Homo sapiens
ttaaagcaaccatcaatttgga

SEQ ID NO: 9439136 - DNA, 22 bp, Homo sapiens
ttaaagcaacctcagccctctt

SEQ ID NO: 9439137 - DNA, 22 bp, Homo sapiens
ttaaagattctgaggctgatta

SEQ ID NO: 9439138 - DNA, 22 bp, Homo sapiens
ttaaagatgcagctttagagaa

SEQ ID NO: 9439139 - DNA, 22 bp, Homo sapiens
ttaaagagtctactgcacatcc

SEQ ID NO: 9439140 - DNA, 22 bp, Homo sapiens
ttaaagagtctactgcacatcc

SEQ ID NO: 9439141 - DNA, 22 bp, Homo sapiens
ttaaagagtttattacttgtaa

SEQ ID NO: 9439142 - DNA, 22 bp, Homo sapiens
ttaaagaggcaggttaaataat

SEQ ID NO: 9439143 - DNA, 22 bp, Homo sapiens
ttaaagaggcatgggaatgtat

SEQ ID NO: 9439144 - DNA, 22 bp, Homo sapiens
ttaaagagaactcaatgaatga

SEQ ID NO: 9439145 - DNA, 22 bp, Homo sapiens
ttaaagaggcaggttaaataat

SEQ ID NO: 9439146 - DNA, 22 bp, Homo sapiens
ttaaagaggcaggttaaataat

SEQ ID NO: 9439147 - DNA, 22 bp, Homo sapiens
ttaaactatagcttgatgtgaa

SEQ ID NO: 9439148 - DNA, 22 bp, Homo sapiens
ttaaaccatagtttaacataag

SEQ ID NO: 9439149 - DNA, 22 bp, Homo sapiens
ttacacaaacacattccagata

SEQ ID NO: 9439150 - DNA, 22 bp, Homo sapiens
ttacacaaacacattccagata

SEQ ID NO: 9439151 - DNA, 22 bp, Homo sapiens
ttacacaaaagcaagtgtgtgt

SEQ ID NO: 9439152 - DNA, 22 bp, Homo sapiens
ttacacaaaaataagatatggc

SEQ ID NO: 9439153 - DNA, 22 bp, Homo sapiens
ttacacaaaaataagatatggc

SEQ ID NO: 9439154 - DNA, 22 bp, Homo sapiens
ttacacaaaaataagatatggc

SEQ ID NO: 9439155 - DNA, 22 bp, Homo sapiens
ttacagaaaagggctttaagag

SEQ ID NO: 9439156 - DNA, 22 bp, Homo sapiens
ttacagaaaaggggttgtcctt

SEQ ID NO: 9439157 - DNA, 22 bp, Homo sapiens
ttacagaaaatgtgttttaact

SEQ ID NO: 9439158 - DNA, 22 bp, Homo sapiens
ttacagacaaactgtgttaagt

SEQ ID NO: 9439159 - DNA, 22 bp, Homo sapiens
ttacagatactttgtaggcaag

SEQ ID NO: 9439160 - DNA, 22 bp, Homo sapiens
ttacagatacatttcttttgtt

SEQ ID NO: 9439161 - DNA, 22 bp, Homo sapiens
ttacaagcagctacatatcaca

SEQ ID NO: 9439162 - DNA, 22 bp, Homo sapiens
ttacaagattaattattggagt

SEQ ID NO: 9439163 - DNA, 22 bp, Homo sapiens
ttacaagattgatttgcttggc

SEQ ID NO: 9439164 - DNA, 22 bp, Homo sapiens
ttacaagatatgtgagaactag

SEQ ID NO: 9439165 - DNA, 22 bp, Homo sapiens
ttacaagatctttgaaggcaag

SEQ ID NO: 9439166 - DNA, 22 bp, Homo sapiens
ttacaagatctttgaaggcaag

SEQ ID NO: 9439167 - DNA, 22 bp, Homo sapiens
ttacaagatgggaaagggaagt

SEQ ID NO: 9439168 - DNA, 22 bp, Homo sapiens
ttacaagataacggagaaagca

SEQ ID NO: 9439169 - DNA, 22 bp, Homo sapiens
ttacaagatatgtgagaactag

SEQ ID NO: 9439170 - DNA, 22 bp, Homo sapiens
ttacaagataacggagaaagca

SEQ ID NO: 9439171 - DNA, 22 bp, Homo sapiens
ttacaagataacctgatgctgt

SEQ ID NO: 9439172 - DNA, 22 bp, Homo sapiens
ttacaagacagtgtggtaaata

SEQ ID NO: 9439173 - DNA, 22 bp, Homo sapiens
ttacaagacactgctgacacag

SEQ ID NO: 9439174 - DNA, 22 bp, Homo sapiens
ttacaagacagtgtggtaaata

SEQ ID NO: 9439175 - DNA, 22 bp, Homo sapiens
ttacaagacagtgtggtaaata

SEQ ID NO: 9439176 - DNA, 22 bp, Homo sapiens
ttacaagggtcagtgtgtttgt

SEQ ID NO: 9439177 - DNA, 22 bp, Homo sapiens
ttacaaggaggatagcatttcc

SEQ ID NO: 9439178 - DNA, 22 bp, Homo sapiens
ttacaatgggagcccttggact

SEQ ID NO: 9439179 - DNA, 21 bp, Homo sapiens
ttacaatgcattttctttggc

SEQ ID NO: 9439180 - DNA, 22 bp, Homo sapiens
ttacaatgggagcccttggact

SEQ ID NO: 9439181 - DNA, 22 bp, Homo sapiens
ttacaagtactgaatatgattt

SEQ ID NO: 9439182 - DNA, 22 bp, Homo sapiens
ttacaatgggtatacttccatt

SEQ ID NO: 9439183 - DNA, 22 bp, Homo sapiens
ttacaattacttgatctcagct

SEQ ID NO: 9439184 - DNA, 22 bp, Homo sapiens
ttacaattgagtctattgtatg

SEQ ID NO: 9439185 - DNA, 22 bp, Homo sapiens
ttacaattgagtctattgtatg

SEQ ID NO: 9439186 - DNA, 22 bp, Homo sapiens
ttacaattgagtctattgtatg

SEQ ID NO: 9439187 - DNA, 22 bp, Homo sapiens
ttacagattaaaatgctgaggt

SEQ ID NO: 9439188 - DNA, 19 bp, Homo sapiens
ttacagatgtggaaattga

SEQ ID NO: 9439189 - DNA, 22 bp, Homo sapiens
ttacagatgtaggaactgaagt

SEQ ID NO: 9439190 - DNA, 22 bp, Homo sapiens
ttacagatgtaggaactgaagt

SEQ ID NO: 9439191 - DNA, 19 bp, Homo sapiens
ttacagatgtggaaattga

SEQ ID NO: 9439192 - DNA, 22 bp, Homo sapiens
ttacagatggcagtttcttgag

SEQ ID NO: 9439193 - DNA, 22 bp, Homo sapiens
ttacagatggatctagcaaaat

SEQ ID NO: 9439194 - DNA, 22 bp, Homo sapiens
ttacagatggggttgcaataaa

SEQ ID NO: 9439195 - DNA, 22 bp, Homo sapiens
ttacagatgtaggaactgaagt

SEQ ID NO: 9439196 - DNA, 22 bp, Homo sapiens
ttacagcagtgggaaggagtca

SEQ ID NO: 9439197 - DNA, 19 bp, Homo sapiens
ttacatgacatatgaagga

SEQ ID NO: 9439198 - DNA, 22 bp, Homo sapiens
ttacagctagccaattatttag

SEQ ID NO: 9439199 - DNA, 22 bp, Homo sapiens
ttacatggatgtaaaaaagtta

SEQ ID NO: 9439200 - DNA, 22 bp, Homo sapiens
ttacatgggccatttagacatg

SEQ ID NO: 9439201 - DNA, 22 bp, Homo sapiens
ttacatgggcttgtgagtcctt

SEQ ID NO: 9439202 - DNA, 22 bp, Homo sapiens
ttacatggtaaacactctttta

SEQ ID NO: 9439203 - DNA, 22 bp, Homo sapiens
ttacatttcccccttggaggct

SEQ ID NO: 9439204 - DNA, 22 bp, Homo sapiens
ttacatttggctatgtcctcta

SEQ ID NO: 9439205 - DNA, 22 bp, Homo sapiens
ttacatttggctatgtcctcta

SEQ ID NO: 9439206 - DNA, 22 bp, Homo sapiens
ttacatttcccccttggaggct

SEQ ID NO: 9439207 - DNA, 22 bp, Homo sapiens
ttacatttggctatgtcctcta

SEQ ID NO: 9439208 - DNA, 22 bp, Homo sapiens
ttacattttagttaacctgtga

SEQ ID NO: 9439209 - DNA, 22 bp, Homo sapiens
ttacattttgcacagatgtccc

SEQ ID NO: 9439210 - DNA, 22 bp, Homo sapiens
ttacatttggctatgtcctcta

SEQ ID NO: 9439211 - DNA, 22 bp, Homo sapiens
ttacattttagttaacctgtga

SEQ ID NO: 9439212 - DNA, 22 bp, Homo sapiens
ttacattcaatttctagaggta

SEQ ID NO: 9439213 - DNA, 22 bp, Homo sapiens
ttacattcttatctcagttatt

SEQ ID NO: 9439214 - DNA, 22 bp, Homo sapiens
ttacatgtactggtttgactta

SEQ ID NO: 9439215 - DNA, 22 bp, Homo sapiens
ttacatgtactggtttgactta

SEQ ID NO: 9439216 - DNA, 22 bp, Homo sapiens
ttacatgtggagtctgattgca

SEQ ID NO: 9439217 - DNA, 22 bp, Homo sapiens
ttacatgtaatctaaaataatt

SEQ ID NO: 9439218 - DNA, 22 bp, Homo sapiens
ttacatgtacaaacaattctta

SEQ ID NO: 9439219 - DNA, 22 bp, Homo sapiens
ttacatgtaatctaaaataatt

SEQ ID NO: 9439220 - DNA, 21 bp, Homo sapiens
ttacatggtttatcatatgga

SEQ ID NO: 9439221 - DNA, 21 bp, Homo sapiens
ttacatggtttatcatatgga

SEQ ID NO: 9439222 - DNA, 22 bp, Homo sapiens
ttacatggttgttggaaatgct

SEQ ID NO: 9439223 - DNA, 22 bp, Homo sapiens
ttacatgttagaaaaggctgtt

SEQ ID NO: 9439224 - DNA, 22 bp, Homo sapiens
ttacatgttctcatacacagag

SEQ ID NO: 9439225 - DNA, 22 bp, Homo sapiens
ttacatgttctcatacacagag

SEQ ID NO: 9439226 - DNA, 22 bp, Homo sapiens
ttacatgtttacggatacactt

SEQ ID NO: 9439227 - DNA, 22 bp, Homo sapiens
ttacatgtttacggatacactt

SEQ ID NO: 9439228 - DNA, 23 bp, Homo sapiens
ttacatgtgtgcacacattctgg

SEQ ID NO: 9439229 - DNA, 22 bp, Homo sapiens
ttacatgtttatgtggtacatg

SEQ ID NO: 9439230 - DNA, 22 bp, Homo sapiens
ttacattagacccactttcatg

SEQ ID NO: 9439231 - DNA, 22 bp, Homo sapiens
ttacattagacccactttcatg

SEQ ID NO: 9439232 - DNA, 22 bp, Homo sapiens
ttcacattgtgcagattatggt

SEQ ID NO: 9439233 - DNA, 22 bp, Homo sapiens
ttcacattgtgcagattatggt

SEQ ID NO: 9439234 - DNA, 22 bp, Homo sapiens
ttcacattggttcttgatagct

SEQ ID NO: 9439235 - DNA, 22 bp, Homo sapiens
ttcacattggttcttgatagct

SEQ ID NO: 9439236 - DNA, 22 bp, Homo sapiens
ttcacattggtgatatgtttct

SEQ ID NO: 9439237 - DNA, 22 bp, Homo sapiens
ttcacattgtgcagattatggt

SEQ ID NO: 9439238 - DNA, 22 bp, Homo sapiens
ttcacattgtggttcatgtgaa

SEQ ID NO: 9439239 - DNA, 22 bp, Homo sapiens
ttcacattgtggttcatgtgaa

SEQ ID NO: 9439240 - DNA, 22 bp, Homo sapiens
ttcacattgttttaatgtgaat

SEQ ID NO: 9439241 - DNA, 22 bp, Homo sapiens
ttcacattgttttaatgtgaat

SEQ ID NO: 9439242 - DNA, 22 bp, Homo sapiens
ttcacatttactggtttgtccg

SEQ ID NO: 9439243 - DNA, 22 bp, Homo sapiens
ttcacatttcataccacagctt

SEQ ID NO: 9439244 - DNA, 22 bp, Homo sapiens
ttcacatttgcccttatgtgtg

SEQ ID NO: 9439245 - DNA, 22 bp, Homo sapiens
ttcacatttgcccttatgtgtg

SEQ ID NO: 9439246 - DNA, 19 bp, Homo sapiens
ttcacatttttgtggcact

SEQ ID NO: 9439247 - DNA, 19 bp, Homo sapiens
ttcacattttgctctgagg

SEQ ID NO: 9439248 - DNA, 22 bp, Homo sapiens
ttcacatttctctgctgtttga

SEQ ID NO: 9439249 - DNA, 20 bp, Homo sapiens
ttcacatttctgtagtgatt

SEQ ID NO: 9439250 - DNA, 22 bp, Homo sapiens
ttcacatttgaaaggaaagata

SEQ ID NO: 9439251 - DNA, 19 bp, Homo sapiens
ttcaccatctcaccaaacc

SEQ ID NO: 9439252 - DNA, 22 bp, Homo sapiens
ttcaccatgggatgacaacagt

SEQ ID NO: 9439253 - DNA, 22 bp, Homo sapiens
ttcaccatgtaaaccatgtggc

SEQ ID NO: 9439254 - DNA, 18 bp, Homo sapiens
ttcaccagtgtgatgggt

SEQ ID NO: 9439255 - DNA, 22 bp, Homo sapiens
ttcaccataatgcaaagtggga

SEQ ID NO: 9439256 - DNA, 22 bp, Homo sapiens
ttatttggcaatgcttcaccat

SEQ ID NO: 9439257 - DNA, 22 bp, Homo sapiens
ttatttgtgaatcatttatcta

SEQ ID NO: 9439258 - DNA, 22 bp, Homo sapiens
ttatttgtgaatcatttatcta

SEQ ID NO: 9439259 - DNA, 22 bp, Homo sapiens
ttatttgtgaatcatttatcta

SEQ ID NO: 9439260 - DNA, 23 bp, Homo sapiens
ttatttggattttagtggaaaga

SEQ ID NO: 9439261 - DNA, 22 bp, Homo sapiens
ttatttggaaatatggcttctg

SEQ ID NO: 9439262 - DNA, 22 bp, Homo sapiens
ttatttgccagaatttctcttg

SEQ ID NO: 9439263 - DNA, 22 bp, Homo sapiens
ttatttgattagtaaacctgta

SEQ ID NO: 9439264 - DNA, 22 bp, Homo sapiens
ttatttgcccatgtttagcaga

SEQ ID NO: 9439265 - DNA, 22 bp, Homo sapiens
ttatttcctagggaatttgcct

SEQ ID NO: 9439266 - DNA, 22 bp, Homo sapiens
ttatttcctgacacagctgatt

SEQ ID NO: 9439267 - DNA, 20 bp, Homo sapiens
ttatttctcattctcctact

SEQ ID NO: 9439268 - DNA, 22 bp, Homo sapiens
ttatttcttgtctatgtagcca

SEQ ID NO: 9439269 - DNA, 22 bp, Homo sapiens
ttatttgaatgatggcacaatt

SEQ ID NO: 9439270 - DNA, 22 bp, Homo sapiens
ttatttgacttcttgctatgct

SEQ ID NO: 9439271 - DNA, 22 bp, Homo sapiens
ttatttcttgtctatgtagcca

SEQ ID NO: 9439272 - DNA, 22 bp, Homo sapiens
ttatttcttgtctatgtagcca

SEQ ID NO: 9439273 - DNA, 22 bp, Homo sapiens
ttatttcttgtctatgtagcca

SEQ ID NO: 9439274 - DNA, 22 bp, Homo sapiens
ttatttcttgtctatgtagcca

SEQ ID NO: 9439275 - DNA, 22 bp, Homo sapiens
ttcagcttcatttgtctttatg

SEQ ID NO: 9439276 - DNA, 22 bp, Homo sapiens
ttcagcattggtatgaaaaccc

SEQ ID NO: 9439277 - DNA, 23 bp, Homo sapiens
ttcaggaaatgaatacagacaca

SEQ ID NO: 9439278 - DNA, 22 bp, Homo sapiens
ttcagctttgaggttgattttc

SEQ ID NO: 9439279 - DNA, 23 bp, Homo sapiens
ttcaggaaatgaatacagacaca

SEQ ID NO: 9439280 - DNA, 22 bp, Homo sapiens
ttcagcttggagagaattttta

SEQ ID NO: 9439281 - DNA, 22 bp, Homo sapiens
ttcagcttggctgtaggtttta

SEQ ID NO: 9439282 - DNA, 23 bp, Homo sapiens
ttcaggaaatgaatacagacaca

SEQ ID NO: 9439283 - DNA, 22 bp, Homo sapiens
ttcagcttgaatctggctttga

SEQ ID NO: 9439284 - DNA, 22 bp, Homo sapiens
ttcagcttgctgactgcggcag

SEQ ID NO: 9439285 - DNA, 22 bp, Homo sapiens
ttcaggaataattatcatatga

SEQ ID NO: 9439286 - DNA, 22 bp, Homo sapiens
ttcaggaataattatcatatga

SEQ ID NO: 9439287 - DNA, 22 bp, Homo sapiens
ttcaggaagtgctgcctggtgt

SEQ ID NO: 9439288 - DNA, 22 bp, Homo sapiens
ttcaggaaatgtctgcctacca

SEQ ID NO: 9439289 - DNA, 22 bp, Homo sapiens
ttcaggaaatgtctgcctacca

SEQ ID NO: 9439290 - DNA, 22 bp, Homo sapiens
ttcaggaaattggagtccttct

SEQ ID NO: 9439291 - DNA, 22 bp, Homo sapiens
ttcaggaaggtcctatagcaga

SEQ ID NO: 9439292 - DNA, 22 bp, Homo sapiens
ttcaggaagcctttcttggtct

SEQ ID NO: 9439293 - DNA, 22 bp, Homo sapiens
ttcactatgcttggaaacttct

SEQ ID NO: 9439294 - DNA, 19 bp, Homo sapiens
ttcactaattgtaagattt

SEQ ID NO: 9439295 - DNA, 22 bp, Homo sapiens
ttcacgttgttgaagaaaatac

SEQ ID NO: 9439296 - DNA, 22 bp, Homo sapiens
ttcactatgcttggaaacttct

SEQ ID NO: 9439297 - DNA, 22 bp, Homo sapiens
ttcactgaagtttcttccatgt

SEQ ID NO: 9439298 - DNA, 22 bp, Homo sapiens
ttcactgaattaaaaagagtat

SEQ ID NO: 9439299 - DNA, 22 bp, Homo sapiens
ttcactgcagcccatgaaggga

SEQ ID NO: 9439300 - DNA, 22 bp, Homo sapiens
ttcactgagagacatgaaggtc

SEQ ID NO: 9439301 - DNA, 22 bp, Homo sapiens
ttcactgcaacctccgcctccc

SEQ ID NO: 9439302 - DNA, 22 bp, Homo sapiens
ttcacctggcacatgtgagcct

SEQ ID NO: 9439303 - DNA, 22 bp, Homo sapiens
ttcaccctggaccagaaattgg

SEQ ID NO: 9439304 - DNA, 22 bp, Homo sapiens
ttcaccctgagccccacctctg

SEQ ID NO: 9439305 - DNA, 22 bp, Homo sapiens
ttcaccccaaattcccagtgga

SEQ ID NO: 9439306 - DNA, 22 bp, Homo sapiens
ttcaccctggaccagaaattgg

SEQ ID NO: 9439307 - DNA, 22 bp, Homo sapiens
ttcacccaatataactagagga

SEQ ID NO: 9439308 - DNA, 22 bp, Homo sapiens
ttcaccatttcccactaaacca

SEQ ID NO: 9439309 - DNA, 22 bp, Homo sapiens
ttcaccattacatacaaagatg

SEQ ID NO: 9439310 - DNA, 22 bp, Homo sapiens
ttcaccattacatacaaagatg

SEQ ID NO: 9439311 - DNA, 22 bp, Homo sapiens
ttcactggggagatgtggcaga

SEQ ID NO: 9439312 - DNA, 22 bp, Homo sapiens
ttcactggggagatgtggcaga

SEQ ID NO: 9439313 - DNA, 22 bp, Homo sapiens
ttcactggtcctttataggaac

SEQ ID NO: 9439314 - DNA, 22 bp, Homo sapiens
ttcagcagcttttagtacattg

SEQ ID NO: 9439315 - DNA, 17 bp, Homo sapiens
ttcagcagtgtttctcc

SEQ ID NO: 9439316 - DNA, 22 bp, Homo sapiens
ttcagcagtcgtccaggaaaag

SEQ ID NO: 9439317 - DNA, 22 bp, Homo sapiens
ttcagcagtgcagacacccagt

SEQ ID NO: 9439318 - DNA, 20 bp, Homo sapiens
ttcattcacgtagctgttga

SEQ ID NO: 9439319 - DNA, 20 bp, Homo sapiens
ttcattcacgtagctgttga

SEQ ID NO: 9439320 - DNA, 22 bp, Homo sapiens
ttcattcacccaggaaacatct

SEQ ID NO: 9439321 - DNA, 22 bp, Homo sapiens
ttcattcatctctaaaatgcct

SEQ ID NO: 9439322 - DNA, 22 bp, Homo sapiens
ttcattcagtgagactaggacg

SEQ ID NO: 9439323 - DNA, 22 bp, Homo sapiens
ttcattcagtgagactaggacg

SEQ ID NO: 9439324 - DNA, 22 bp, Homo sapiens
ttcattcatcacatgcagctgg

SEQ ID NO: 9439325 - DNA, 22 bp, Homo sapiens
ttcatgtttgtaggactgaggc

SEQ ID NO: 9439326 - DNA, 22 bp, Homo sapiens
ttcatgtttgcctatttgactt

SEQ ID NO: 9439327 - DNA, 19 bp, Homo sapiens
ttcatgtttgtagatggtg

SEQ ID NO: 9439328 - DNA, 22 bp, Homo sapiens
ttcaggaatcaaccaagtcatt

SEQ ID NO: 9439329 - DNA, 22 bp, Homo sapiens
ttcaggaatcaaccaagtcatt

SEQ ID NO: 9439330 - DNA, 23 bp, Homo sapiens
ttcattcaaaaggaaaagtcatg

SEQ ID NO: 9439331 - DNA, 22 bp, Homo sapiens
ttcattactgcggtagtcacac

SEQ ID NO: 9439332 - DNA, 22 bp, Homo sapiens
ttcattactgaattctcactac

SEQ ID NO: 9439333 - DNA, 22 bp, Homo sapiens
ttcattcttgtctttgtatagt

SEQ ID NO: 9439334 - DNA, 22 bp, Homo sapiens
ttcattcttgtctttgtatagt

SEQ ID NO: 9439335 - DNA, 22 bp, Homo sapiens
ttcattcttgtctttgtatagt

SEQ ID NO: 9439336 - DNA, 22 bp, Homo sapiens
ttcattcttgtctttgtatagt

SEQ ID NO: 9439337 - DNA, 22 bp, Homo sapiens
ttcattcatgtattgtctatgg

SEQ ID NO: 9439338 - DNA, 22 bp, Homo sapiens
ttcattcatgtattgtctatgg

SEQ ID NO: 9439339 - DNA, 22 bp, Homo sapiens
ttcattcttttacatgtgaata

SEQ ID NO: 9439340 - DNA, 22 bp, Homo sapiens
ttcattcttttacatgtgaata

SEQ ID NO: 9439341 - DNA, 19 bp, Homo sapiens
ttcattctttctacttacc

SEQ ID NO: 9439342 - DNA, 22 bp, Homo sapiens
ttcattctttgaatctgaggta

SEQ ID NO: 9439343 - DNA, 22 bp, Homo sapiens
ttcattcttttacatgtgaata

SEQ ID NO: 9439344 - DNA, 22 bp, Homo sapiens
ttccagaggctctaggggagaa

SEQ ID NO: 9439345 - DNA, 22 bp, Homo sapiens
ttcattgaagcacaagtgatct

SEQ ID NO: 9439346 - DNA, 22 bp, Homo sapiens
ttcattgagctgtacacttagg

SEQ ID NO: 9439347 - DNA, 22 bp, Homo sapiens
ttcattgatgtggtttaatgta

SEQ ID NO: 9439348 - DNA, 22 bp, Homo sapiens
ttccagcttagagcatcatgtt

SEQ ID NO: 9439349 - DNA, 22 bp, Homo sapiens
ttccagagttgggggagtggtt

SEQ ID NO: 9439350 - DNA, 22 bp, Homo sapiens
ttccagaggcttcagggaagaa

SEQ ID NO: 9439351 - DNA, 22 bp, Homo sapiens
ttccagaggtagcaatgacttg

SEQ ID NO: 9439352 - DNA, 22 bp, Homo sapiens
ttccagccagatttgctgggtt

SEQ ID NO: 9439353 - DNA, 22 bp, Homo sapiens
ttccagccagatttgctgggtt

SEQ ID NO: 9439354 - DNA, 22 bp, Homo sapiens
ttccagccatggtttccctatg

SEQ ID NO: 9439355 - DNA, 22 bp, Homo sapiens
ttccagcccgcgacttgttcag

SEQ ID NO: 9439356 - DNA, 20 bp, Homo sapiens
ttccagccgccacttccgcc

SEQ ID NO: 9439357 - DNA, 22 bp, Homo sapiens
ttccagcctttatccatccaga

SEQ ID NO: 9439358 - DNA, 22 bp, Homo sapiens
ttccagctaactcacatccctt

SEQ ID NO: 9439359 - DNA, 22 bp, Homo sapiens
ttccagctaactcacatccctt

SEQ ID NO: 9439360 - DNA, 22 bp, Homo sapiens
ttccagctaactcacatccctt

SEQ ID NO: 9439361 - DNA, 22 bp, Homo sapiens
ttccagcagggtacttgtaatt

SEQ ID NO: 9439362 - DNA, 22 bp, Homo sapiens
ttccagcagggtacttgtaatt

SEQ ID NO: 9439363 - DNA, 22 bp, Homo sapiens
ttccagccactttatactgcta

SEQ ID NO: 9439364 - DNA, 22 bp, Homo sapiens
ttccagatttctacacaagacc

SEQ ID NO: 9439365 - DNA, 22 bp, Homo sapiens
ttccagcacagaagtatacatt

SEQ ID NO: 9439366 - DNA, 22 bp, Homo sapiens
ttccagcacagaagtatacatt

SEQ ID NO: 9439367 - DNA, 22 bp, Homo sapiens
ttccagatgtttaagttctgct

SEQ ID NO: 9439368 - DNA, 22 bp, Homo sapiens
ttccagatatttttatgtggaa

SEQ ID NO: 9439369 - DNA, 22 bp, Homo sapiens
tgaatggattcagaaaatgtgt

SEQ ID NO: 9439370 - DNA, 22 bp, Homo sapiens
tgaatgttgatatgagtacaga

SEQ ID NO: 9439371 - DNA, 22 bp, Homo sapiens
tgaatgttctctaaatactcct

SEQ ID NO: 9439372 - DNA, 22 bp, Homo sapiens
tgaatgtgggagagctggcaat

SEQ ID NO: 9439373 - DNA, 22 bp, Homo sapiens
tgaatgtgatgctaaacatatg

SEQ ID NO: 9439374 - DNA, 22 bp, Homo sapiens
tgaatgtgatgctaaacatatg

SEQ ID NO: 9439375 - DNA, 18 bp, Homo sapiens
tgaattagtttgtggttt

SEQ ID NO: 9439376 - DNA, 22 bp, Homo sapiens
tgaattatcttgtaattttgaa

SEQ ID NO: 9439377 - DNA, 19 bp, Homo sapiens
tgaattagaattatcctct

SEQ ID NO: 9439378 - DNA, 19 bp, Homo sapiens
tgaattaaagattaaagtc

SEQ ID NO: 9439379 - DNA, 18 bp, Homo sapiens
tgaatgttttctggaccc

SEQ ID NO: 9439380 - DNA, 22 bp, Homo sapiens
tgaatgtttgatgagaaataga

SEQ ID NO: 9439381 - DNA, 22 bp, Homo sapiens
tgaatggatataacaacagtgt

SEQ ID NO: 9439382 - DNA, 22 bp, Homo sapiens
tgaatggatataacaacagtgt

SEQ ID NO: 9439383 - DNA, 22 bp, Homo sapiens
tgaatggattcagaaaatgtgt

SEQ ID NO: 9439384 - DNA, 22 bp, Homo sapiens
tgaatgctttggagccttctaa

SEQ ID NO: 9439385 - DNA, 21 bp, Homo sapiens
tgaatgcttcgtcatcctggc

SEQ ID NO: 9439386 - DNA, 22 bp, Homo sapiens
tgaatgacctttgaggatggaa

SEQ ID NO: 9439387 - DNA, 22 bp, Homo sapiens
tgaatgaatcctaacaaagaca

SEQ ID NO: 9439388 - DNA, 22 bp, Homo sapiens
tgaatgaatgaattaatagagt

SEQ ID NO: 9439389 - DNA, 22 bp, Homo sapiens
tgaatgaactaaatcatagttc

SEQ ID NO: 9439390 - DNA, 22 bp, Homo sapiens
tgaatgaatcctaacaaagaca

SEQ ID NO: 9439391 - DNA, 22 bp, Homo sapiens
tgaatgaatcctaacaaagaca

SEQ ID NO: 9439392 - DNA, 22 bp, Homo sapiens
tgaatacaggaaaatatactga

SEQ ID NO: 9439393 - DNA, 22 bp, Homo sapiens
tgaatacaggaaaatatactga

SEQ ID NO: 9439394 - DNA, 22 bp, Homo sapiens
tgaatagatggtgacagtatga

SEQ ID NO: 9439395 - DNA, 21 bp, Homo sapiens
tgaatagggccagaaccaaag

SEQ ID NO: 9439396 - DNA, 22 bp, Homo sapiens
tgaatagtccttggaataactg

SEQ ID NO: 9439397 - DNA, 22 bp, Homo sapiens
tgaatagactggggctgtgaag

SEQ ID NO: 9439398 - DNA, 22 bp, Homo sapiens
tgaatatgtgactttgatttca

SEQ ID NO: 9439399 - DNA, 22 bp, Homo sapiens
tgaatcaaagctgaagttttca

SEQ ID NO: 9439400 - DNA, 22 bp, Homo sapiens
tgaatcaatagttgcaagtatt

SEQ ID NO: 9439401 - DNA, 22 bp, Homo sapiens
tgaatatggcaactcttgtaac

SEQ ID NO: 9439402 - DNA, 22 bp, Homo sapiens
tgaatatgtatttcttatttac

SEQ ID NO: 9439403 - DNA, 22 bp, Homo sapiens
tgaatatggcacctctgtgtaa

SEQ ID NO: 9439404 - DNA, 22 bp, Homo sapiens
tgaatagttctactacttgaca

SEQ ID NO: 9439405 - DNA, 20 bp, Homo sapiens
tgaatatgaccttatttgga

SEQ ID NO: 9439406 - DNA, 22 bp, Homo sapiens
tgaatcagtataaattctcaaa

SEQ ID NO: 9439407 - DNA, 22 bp, Homo sapiens
tgaatccagagctatttcgtcc

SEQ ID NO: 9439408 - DNA, 22 bp, Homo sapiens
tgaatcaatgaattgcacttca

SEQ ID NO: 9439409 - DNA, 22 bp, Homo sapiens
tgaatcaatagttgcaagtatt

SEQ ID NO: 9439410 - DNA, 22 bp, Homo sapiens
tgaatcaatgaattgcacttca

SEQ ID NO: 9439411 - DNA, 22 bp, Homo sapiens
tgaatcaattgtcttaagacat

SEQ ID NO: 9439412 - DNA, 23 bp, Homo sapiens
tgaatcaattatgggattcaatg

SEQ ID NO: 9439413 - DNA, 23 bp, Homo sapiens
tgaatcaattatgggattcaatg

SEQ ID NO: 9439414 - DNA, 20 bp, Homo sapiens
tgacaaagagtaagaggagg

SEQ ID NO: 9439415 - DNA, 22 bp, Homo sapiens
tgacaaagcctcatccttcaga

SEQ ID NO: 9439416 - DNA, 20 bp, Homo sapiens
tgacaaagagtaagaggagg

SEQ ID NO: 9439417 - DNA, 22 bp, Homo sapiens
tgacaaagaccttcaacaagat

SEQ ID NO: 9439418 - DNA, 22 bp, Homo sapiens
tgacaaaactgcaattactttt

SEQ ID NO: 9439419 - DNA, 22 bp, Homo sapiens
tgacaaaactgcaattactttt

SEQ ID NO: 9439420 - DNA, 22 bp, Homo sapiens
tgacaaaactgcaattactttt

SEQ ID NO: 9439421 - DNA, 22 bp, Homo sapiens
tgacaaaactgcaattactttt

SEQ ID NO: 9439422 - DNA, 20 bp, Homo sapiens
tgacacaaattgctttctca

SEQ ID NO: 9439423 - DNA, 22 bp, Homo sapiens
tgacacaaacaagatatttgcc

SEQ ID NO: 9439424 - DNA, 22 bp, Homo sapiens
tgacaatttggcagagtctggc

SEQ ID NO: 9439425 - DNA, 22 bp, Homo sapiens
tgacaattgtgggcagtttgtg

SEQ ID NO: 9439426 - DNA, 22 bp, Homo sapiens
tgacaaattcatatttcagagg

SEQ ID NO: 9439427 - DNA, 22 bp, Homo sapiens
tgacaaatgttaattcagtgga

SEQ ID NO: 9439428 - DNA, 22 bp, Homo sapiens
tgacaaatacaataagatctgt

SEQ ID NO: 9439429 - DNA, 23 bp, Homo sapiens
tgacaaagtggtcgttcaaggtg

SEQ ID NO: 9439430 - DNA, 22 bp, Homo sapiens
tgacaaatacaataagatctgt

SEQ ID NO: 9439431 - DNA, 23 bp, Homo sapiens
tgacaaagtcatctctccttctt

SEQ ID NO: 9439432 - DNA, 22 bp, Homo sapiens
tgacaaagtgaggtcttcagta

SEQ ID NO: 9439433 - DNA, 22 bp, Homo sapiens
tgaattcaggggctattatatt

SEQ ID NO: 9439434 - DNA, 17 bp, Homo sapiens
tgaattcaatctgcact

SEQ ID NO: 9439435 - DNA, 22 bp, Homo sapiens
tgaattccctgcaggcatcctc

SEQ ID NO: 9439436 - DNA, 22 bp, Homo sapiens
tgaattcttaatgaaatctact

SEQ ID NO: 9439437 - DNA, 22 bp, Homo sapiens
tgaattcttaatgaaatctact

SEQ ID NO: 9439438 - DNA, 22 bp, Homo sapiens
tgaatttaccttgcctatattt

SEQ ID NO: 9439439 - DNA, 22 bp, Homo sapiens
tgaatttaccttgcctatattt

SEQ ID NO: 9439440 - DNA, 22 bp, Homo sapiens
tgaatttatcaaagattcttaa

SEQ ID NO: 9439441 - DNA, 22 bp, Homo sapiens
tgaatttatcaaagattcttaa

SEQ ID NO: 9439442 - DNA, 22 bp, Homo sapiens
tgaatttatcaaagattcttaa

SEQ ID NO: 9439443 - DNA, 23 bp, Homo sapiens
tgaattttggcatattctgaaat

SEQ ID NO: 9439444 - DNA, 23 bp, Homo sapiens
tgaattttggcatattctgaaat

SEQ ID NO: 9439445 - DNA, 21 bp, Homo sapiens
tgaatttcggtatggctataa

SEQ ID NO: 9439446 - DNA, 21 bp, Homo sapiens
tgaatttcggtatggctataa

SEQ ID NO: 9439447 - DNA, 23 bp, Homo sapiens
tgaatttggaactcagagaatta

SEQ ID NO: 9439448 - DNA, 22 bp, Homo sapiens
tgaattcttttagaattcagtg

SEQ ID NO: 9439449 - DNA, 22 bp, Homo sapiens
tgaatttaagcactgatgttaa

SEQ ID NO: 9439450 - DNA, 22 bp, Homo sapiens
tgaatttaccttgcctatattt

SEQ ID NO: 9439451 - DNA, 22 bp, Homo sapiens
tgaatttaaaataaatgtagtt

SEQ ID NO: 9439452 - DNA, 22 bp, Homo sapiens
tgaagccaatctgccaggcaga

SEQ ID NO: 9439453 - DNA, 22 bp, Homo sapiens
tgaagcatctggtctgagaatt

SEQ ID NO: 9439454 - DNA, 22 bp, Homo sapiens
tgaagcagttctcagaagtggg

SEQ ID NO: 9439455 - DNA, 22 bp, Homo sapiens
tgaagcagttctcagaagtggg

SEQ ID NO: 9439456 - DNA, 22 bp, Homo sapiens
tgaagccacagagcatctgcct

SEQ ID NO: 9439457 - DNA, 22 bp, Homo sapiens
tgaagccacactagcttgtcct

SEQ ID NO: 9439458 - DNA, 22 bp, Homo sapiens
tgaagccaatctgccaggcaga

SEQ ID NO: 9439459 - DNA, 22 bp, Homo sapiens
tgaagccaccgaaccagaagag

SEQ ID NO: 9439460 - DNA, 22 bp, Homo sapiens
tgaagccactttccagaatcac

SEQ ID NO: 9439461 - DNA, 22 bp, Homo sapiens
tgaagccactttccagaatcac

SEQ ID NO: 9439462 - DNA, 22 bp, Homo sapiens
tgaagccactttccagaatcac

SEQ ID NO: 9439463 - DNA, 22 bp, Homo sapiens
tgaagccagctttggaagacac

SEQ ID NO: 9439464 - DNA, 22 bp, Homo sapiens
tgaagccagtcaatgttaagtt

SEQ ID NO: 9439465 - DNA, 22 bp, Homo sapiens
tgaagccagggactgacacttc

SEQ ID NO: 9439466 - DNA, 22 bp, Homo sapiens
tgaagccataggacagaggata

SEQ ID NO: 9439467 - DNA, 22 bp, Homo sapiens
tgaagctatataagttacagca

SEQ ID NO: 9439468 - DNA, 22 bp, Homo sapiens
tgaagcctcacctgctcagtat

SEQ ID NO: 9439469 - DNA, 22 bp, Homo sapiens
tgaagccattactgtgttaggg

SEQ ID NO: 9439470 - DNA, 22 bp, Homo sapiens
tgaagccatctcagagtcaaga

SEQ ID NO: 9439471 - DNA, 23 bp, Homo sapiens
tgaagcccagtgattttgtttca

SEQ ID NO: 9439472 - DNA, 22 bp, Homo sapiens
tgaagccctgtcttatggaaga

SEQ ID NO: 9439473 - DNA, 22 bp, Homo sapiens
tgaagccatcaggaagccagca

SEQ ID NO: 9439474 - DNA, 22 bp, Homo sapiens
tgaagccatcaggaagccagca

SEQ ID NO: 9439475 - DNA, 22 bp, Homo sapiens
tgaagccatccctcagatggcc

SEQ ID NO: 9439476 - DNA, 22 bp, Homo sapiens
tgaaggagatttttagggaggc

SEQ ID NO: 9439477 - DNA, 22 bp, Homo sapiens
tgaaggagctcaggagatagtc

SEQ ID NO: 9439478 - DNA, 22 bp, Homo sapiens
tgaaggagctgatgtaaggggt

SEQ ID NO: 9439479 - DNA, 22 bp, Homo sapiens
tgaagctggaagcatgcagact

SEQ ID NO: 9439480 - DNA, 22 bp, Homo sapiens
tgaaggagggaagaaggctctg

SEQ ID NO: 9439481 - DNA, 22 bp, Homo sapiens
tgaaggagctgatgtaaggggt

SEQ ID NO: 9439482 - DNA, 19 bp, Homo sapiens
tgaaggagggggatggcca

SEQ ID NO: 9439483 - DNA, 22 bp, Homo sapiens
tgaaggcacttgcctaggggca

SEQ ID NO: 9439484 - DNA, 22 bp, Homo sapiens
tgaaggcacgtgggtggatact

SEQ ID NO: 9439485 - DNA, 22 bp, Homo sapiens
tgaaggcacagtttaaccagta

SEQ ID NO: 9439486 - DNA, 22 bp, Homo sapiens
tgaaggcacagtttaaccagta

SEQ ID NO: 9439487 - DNA, 22 bp, Homo sapiens
tgaaggcaactgagaaaaagca

SEQ ID NO: 9439488 - DNA, 22 bp, Homo sapiens
tgaaggcaaaacatgttacacc

SEQ ID NO: 9439489 - DNA, 22 bp, Homo sapiens
tgaaggcaaaacatgttacacc

SEQ ID NO: 9439490 - DNA, 22 bp, Homo sapiens
tgaaggcaactgagaaaaagca

SEQ ID NO: 9439491 - DNA, 22 bp, Homo sapiens
tgaaggtggcataggagagatg

SEQ ID NO: 9439492 - DNA, 22 bp, Homo sapiens
tgaaggtggctgtttgtgcata

SEQ ID NO: 9439493 - DNA, 22 bp, Homo sapiens
tgaaggtggaagggtggttctg

SEQ ID NO: 9439494 - DNA, 22 bp, Homo sapiens
tgaaggtgattatgaatgtata

SEQ ID NO: 9439495 - DNA, 22 bp, Homo sapiens
tgaaggtgagcatttgctgatt

SEQ ID NO: 9439496 - DNA, 22 bp, Homo sapiens
tgaaggtgacctgacagtggct

SEQ ID NO: 9439497 - DNA, 20 bp, Homo sapiens
tgaaggtgactcctttcttg

SEQ ID NO: 9439498 - DNA, 22 bp, Homo sapiens
tgaaggtgaatgtctatgggga

SEQ ID NO: 9439499 - DNA, 22 bp, Homo sapiens
tgaaggtgaatgtctatgggga

SEQ ID NO: 9439500 - DNA, 22 bp, Homo sapiens
tgaaggtgaatgtctatgggga

SEQ ID NO: 9439501 - DNA, 22 bp, Homo sapiens
tgaaggtgaaagattgaagcca

SEQ ID NO: 9439502 - DNA, 22 bp, Homo sapiens
tgaagtttcttgaatcttggag

SEQ ID NO: 9439503 - DNA, 22 bp, Homo sapiens
tgaaggtgggaattcaccaggt

SEQ ID NO: 9439504 - DNA, 22 bp, Homo sapiens
tgaagttgttaaggttgccatt

SEQ ID NO: 9439505 - DNA, 22 bp, Homo sapiens
tgaagtttaaggttagataagt

SEQ ID NO: 9439506 - DNA, 22 bp, Homo sapiens
tgaagttgttaaggttgccatt

SEQ ID NO: 9439507 - DNA, 22 bp, Homo sapiens
tgaataaattgagagcgaatgt

SEQ ID NO: 9439508 - DNA, 22 bp, Homo sapiens
tgaataagaattattataatga

SEQ ID NO: 9439509 - DNA, 22 bp, Homo sapiens
tgaataaatcaaagactgccct

SEQ ID NO: 9439510 - DNA, 22 bp, Homo sapiens
tgaataaagtatgtcctgggaa

SEQ ID NO: 9439511 - DNA, 22 bp, Homo sapiens
tgaataaatcaaagactgccct

SEQ ID NO: 9439512 - DNA, 21 bp, Homo sapiens
tgaataaagctgctgtcgata

SEQ ID NO: 9439513 - DNA, 22 bp, Homo sapiens
tgaataatccacagtcattcat

SEQ ID NO: 9439514 - DNA, 22 bp, Homo sapiens
tgaataatcttgggtattaata

SEQ ID NO: 9439515 - DNA, 22 bp, Homo sapiens
tgaataatcttgggtattaata

SEQ ID NO: 9439516 - DNA, 22 bp, Homo sapiens
tgaataatcatgtccatagtgt

SEQ ID NO: 9439517 - DNA, 22 bp, Homo sapiens
tgaataaattgagagcgaatgt

SEQ ID NO: 9439518 - DNA, 22 bp, Homo sapiens
tgaagttttacatcctctccaa

SEQ ID NO: 9439519 - DNA, 22 bp, Homo sapiens
tgaagttttctggttgattaag

SEQ ID NO: 9439520 - DNA, 22 bp, Homo sapiens
tgaataaactatgaggaggaat

SEQ ID NO: 9439521 - DNA, 22 bp, Homo sapiens
tgaataaactatgaggaggaat

SEQ ID NO: 9439522 - DNA, 22 bp, Homo sapiens
tgaataaactatgaggaggaat

SEQ ID NO: 9439523 - DNA, 22 bp, Homo sapiens
tgaataaactatgaggaggaat

SEQ ID NO: 9439524 - DNA, 22 bp, Homo sapiens
tgaagtttttccagacaagtcc

SEQ ID NO: 9439525 - DNA, 22 bp, Homo sapiens
tgaaggcattgatgaaggaatc

SEQ ID NO: 9439526 - DNA, 22 bp, Homo sapiens
tgaaggcatttgagttggtgag

SEQ ID NO: 9439527 - DNA, 20 bp, Homo sapiens
tgaaggcaggtaagaaagat

SEQ ID NO: 9439528 - DNA, 20 bp, Homo sapiens
tgaaggcaggtaagaaagat

SEQ ID NO: 9439529 - DNA, 20 bp, Homo sapiens
tgaaggcaggtaagaaagat

SEQ ID NO: 9439530 - DNA, 22 bp, Homo sapiens
tgaaggcagtgagtttgtgttt

SEQ ID NO: 9439531 - DNA, 22 bp, Homo sapiens
tgaaggcccagccacagaatgg

SEQ ID NO: 9439532 - DNA, 22 bp, Homo sapiens
tgaaggcctaacttccagtgct

SEQ ID NO: 9439533 - DNA, 23 bp, Homo sapiens
tgaaggccctggagccacgaggc

SEQ ID NO: 9439534 - DNA, 22 bp, Homo sapiens
tgaaggcatttgagttggtgag

SEQ ID NO: 9439535 - DNA, 22 bp, Homo sapiens
tgaaggcattgatgaaggaatc

SEQ ID NO: 9439536 - DNA, 22 bp, Homo sapiens
tgaaggccagcagagtgaaggc

SEQ ID NO: 9439537 - DNA, 22 bp, Homo sapiens
tgaaggccagggatttgcagcc

SEQ ID NO: 9439538 - DNA, 22 bp, Homo sapiens
tgaagggcaaccccaggcccag

SEQ ID NO: 9439539 - DNA, 22 bp, Homo sapiens
tgaaggcttttagctctgaaaa

SEQ ID NO: 9439540 - DNA, 22 bp, Homo sapiens
tgaaggcttgactgaggcagga

SEQ ID NO: 9439541 - DNA, 22 bp, Homo sapiens
tgaaggcttggtggcagcctct

SEQ ID NO: 9439542 - DNA, 22 bp, Homo sapiens
tgaaggcttggtggcagcctct

SEQ ID NO: 9439543 - DNA, 22 bp, Homo sapiens
tgaaggcttgactgaggcagga

SEQ ID NO: 9439544 - DNA, 22 bp, Homo sapiens
tgaaggctgtcacctgcacctt

SEQ ID NO: 9439545 - DNA, 22 bp, Homo sapiens
tgaagggcaaccccaggcccag

SEQ ID NO: 9439546 - DNA, 21 bp, Homo sapiens
tgaaggggtggcagtgtgctt

SEQ ID NO: 9439547 - DNA, 22 bp, Homo sapiens
tgaaggggttcagcatgggggt

SEQ ID NO: 9439548 - DNA, 22 bp, Homo sapiens
tgacactgcatatattgaagtt

SEQ ID NO: 9439549 - DNA, 22 bp, Homo sapiens
tgacactgcatatattgaagtt

SEQ ID NO: 9439550 - DNA, 22 bp, Homo sapiens
tgacactgccgaaactgtagag

SEQ ID NO: 9439551 - DNA, 22 bp, Homo sapiens
tgacactgacctaaagacctgg

SEQ ID NO: 9439552 - DNA, 22 bp, Homo sapiens
tgacactgcaaatataaatatt

SEQ ID NO: 9439553 - DNA, 22 bp, Homo sapiens
tgacactgcaaatataaatatt

SEQ ID NO: 9439554 - DNA, 22 bp, Homo sapiens
tgacactgcaaatataaatatt

SEQ ID NO: 9439555 - DNA, 22 bp, Homo sapiens
tgacacttccagttaaaaatat

SEQ ID NO: 9439556 - DNA, 22 bp, Homo sapiens
tgacacttccagttaaaaatat

SEQ ID NO: 9439557 - DNA, 22 bp, Homo sapiens
tgacacttccggtaaaaaatgc

SEQ ID NO: 9439558 - DNA, 22 bp, Homo sapiens
tgacacttgggctttgagaggt

SEQ ID NO: 9439559 - DNA, 22 bp, Homo sapiens
tgacagaaagaatatgtcaatc

SEQ ID NO: 9439560 - DNA, 22 bp, Homo sapiens
tgacagaaagagtattaaagat

SEQ ID NO: 9439561 - DNA, 22 bp, Homo sapiens
tgacagaaatagttcttaattt

SEQ ID NO: 9439562 - DNA, 16 bp, Homo sapiens
tgacagaaagatctat

SEQ ID NO: 9439563 - DNA, 22 bp, Homo sapiens
tgacagaaatagttcttaattt

SEQ ID NO: 9439564 - DNA, 22 bp, Homo sapiens
tgacagaaaaatgtagctccat

SEQ ID NO: 9439565 - DNA, 22 bp, Homo sapiens
tgacagaaagaatatgtcaatc

SEQ ID NO: 9439566 - DNA, 22 bp, Homo sapiens
tgacagattttttctgagctaa

SEQ ID NO: 9439567 - DNA, 22 bp, Homo sapiens
tgacagattttgatggctaata

SEQ ID NO: 9439568 - DNA, 22 bp, Homo sapiens
tgacagcagcatagtgagcaat

SEQ ID NO: 9439569 - DNA, 21 bp, Homo sapiens
tgacagcacatgcaatcggag

SEQ ID NO: 9439570 - DNA, 22 bp, Homo sapiens
tgacagcaataattttatcttc

SEQ ID NO: 9439571 - DNA, 21 bp, Homo sapiens
tgacagcacatgcaatcggag

SEQ ID NO: 9439572 - DNA, 22 bp, Homo sapiens
tgacagatgaagctggggacca

SEQ ID NO: 9439573 - DNA, 22 bp, Homo sapiens
tgacagaactttttcacatctc

SEQ ID NO: 9439574 - DNA, 22 bp, Homo sapiens
tgacagaactcattctcaccaa

SEQ ID NO: 9439575 - DNA, 22 bp, Homo sapiens
tgacagaactttttcacatctc

SEQ ID NO: 9439576 - DNA, 22 bp, Homo sapiens
tgacagaatgtgactctcagat

SEQ ID NO: 9439577 - DNA, 18 bp, Homo sapiens
tgacagaacctggagcct

SEQ ID NO: 9439578 - DNA, 19 bp, Homo sapiens
tgacacagctaggtttgct

SEQ ID NO: 9439579 - DNA, 22 bp, Homo sapiens
tgacacagattagagacatacc

SEQ ID NO: 9439580 - DNA, 22 bp, Homo sapiens
tgacacagaatttggctatcac

SEQ ID NO: 9439581 - DNA, 22 bp, Homo sapiens
tgacacactgccaggcgctcgg

SEQ ID NO: 9439582 - DNA, 22 bp, Homo sapiens
tgacacagaatttggctatcac

SEQ ID NO: 9439583 - DNA, 22 bp, Homo sapiens
tgacacagaaattaagctgtca

SEQ ID NO: 9439584 - DNA, 23 bp, Homo sapiens
tgacacaggtcaaaaataagatg

SEQ ID NO: 9439585 - DNA, 22 bp, Homo sapiens
tgacacaggggaaggagtctgg

SEQ ID NO: 9439586 - DNA, 22 bp, Homo sapiens
tgacacaggggaaggagtctgg

SEQ ID NO: 9439587 - DNA, 22 bp, Homo sapiens
tgacacagggcatgcagcagaa

SEQ ID NO: 9439588 - DNA, 22 bp, Homo sapiens
tgacacagggcatgcagcagaa

SEQ ID NO: 9439589 - DNA, 22 bp, Homo sapiens
tgacacagggaaagcggatcca

SEQ ID NO: 9439590 - DNA, 22 bp, Homo sapiens
tgacacagggcatgcagcagaa

SEQ ID NO: 9439591 - DNA, 22 bp, Homo sapiens
tgacacagttgtcgactctaca

SEQ ID NO: 9439592 - DNA, 22 bp, Homo sapiens
tgacacagttgtcgactctaca

SEQ ID NO: 9439593 - DNA, 22 bp, Homo sapiens
tgacacagtagaaagatgatga

SEQ ID NO: 9439594 - DNA, 22 bp, Homo sapiens
tgacacagtatcaaacatgatt

SEQ ID NO: 9439595 - DNA, 22 bp, Homo sapiens
tgacacatgtgcttgtgggtag

SEQ ID NO: 9439596 - DNA, 22 bp, Homo sapiens
tgacacattaaatgctcacaaa

SEQ ID NO: 9439597 - DNA, 23 bp, Homo sapiens
tgacacatttcctttccactgca

SEQ ID NO: 9439598 - DNA, 22 bp, Homo sapiens
tgacacattaaatgctcacaaa

SEQ ID NO: 9439599 - DNA, 21 bp, Homo sapiens
tgacacccagagcctcctccc

SEQ ID NO: 9439600 - DNA, 21 bp, Homo sapiens
tgacacccagagcctcctccc

SEQ ID NO: 9439601 - DNA, 22 bp, Homo sapiens
tgacacccatctgtgccagtcc

SEQ ID NO: 9439602 - DNA, 22 bp, Homo sapiens
tgacacccattatctgtgtgac

SEQ ID NO: 9439603 - DNA, 22 bp, Homo sapiens
tgacacccatctgtgccagtcc

SEQ ID NO: 9439604 - DNA, 22 bp, Homo sapiens
tgacaccttgctaaatggcacc

SEQ ID NO: 9439605 - DNA, 22 bp, Homo sapiens
tgacaccctctcctggagagag

SEQ ID NO: 9439606 - DNA, 22 bp, Homo sapiens
tgacacccattatctgtgtgac

SEQ ID NO: 9439607 - DNA, 22 bp, Homo sapiens
tgacacccatctgtgccagtcc

SEQ ID NO: 9439608 - DNA, 23 bp, Homo sapiens
tgacaccctcattgtgtgtcgca

SEQ ID NO: 9439609 - DNA, 23 bp, Homo sapiens
tgacaccctcattgtgtgtcgca

SEQ ID NO: 9439610 - DNA, 22 bp, Homo sapiens
tgacaggggctggtggataaat

SEQ ID NO: 9439611 - DNA, 22 bp, Homo sapiens
tgacagggcttccctttaatca

SEQ ID NO: 9439612 - DNA, 22 bp, Homo sapiens
tgacagggggcagaggtggctg

SEQ ID NO: 9439613 - DNA, 22 bp, Homo sapiens
tgacagggggcagaggtggctg

SEQ ID NO: 9439614 - DNA, 22 bp, Homo sapiens
tgacagggggcagaggtggctg

SEQ ID NO: 9439615 - DNA, 22 bp, Homo sapiens
tgacagggctagaggcaatgca

SEQ ID NO: 9439616 - DNA, 22 bp, Homo sapiens
tgacagggctagaggcaatgca

SEQ ID NO: 9439617 - DNA, 22 bp, Homo sapiens
tgacagggccatgctgcactgc

SEQ ID NO: 9439618 - DNA, 22 bp, Homo sapiens
tgacagggcaggcttactggtt

SEQ ID NO: 9439619 - DNA, 22 bp, Homo sapiens
tgacagggacagtggagatgga

SEQ ID NO: 9439620 - DNA, 22 bp, Homo sapiens
tgacagggaggtggaataagta

SEQ ID NO: 9439621 - DNA, 22 bp, Homo sapiens
tgacagggtgtttgtgagacta

SEQ ID NO: 9439622 - DNA, 22 bp, Homo sapiens
tgacagggtgattatgagagct

SEQ ID NO: 9439623 - DNA, 22 bp, Homo sapiens
tgacagggtcagagctgagctg

SEQ ID NO: 9439624 - DNA, 22 bp, Homo sapiens
tgacagggtcagagctgagctg

SEQ ID NO: 9439625 - DNA, 22 bp, Homo sapiens
tgacagggtcagagctgagctg

SEQ ID NO: 9439626 - DNA, 22 bp, Homo sapiens
tgacagtgaataagtctcttaa

SEQ ID NO: 9439627 - DNA, 22 bp, Homo sapiens
tgacagtgacagccaaaggctt

SEQ ID NO: 9439628 - DNA, 22 bp, Homo sapiens
tgacagtagtgttagaactgat

SEQ ID NO: 9439629 - DNA, 22 bp, Homo sapiens
tgacagcagcatagtgagcaat

SEQ ID NO: 9439630 - DNA, 22 bp, Homo sapiens
tgacagcagccacctctcaccc

SEQ ID NO: 9439631 - DNA, 22 bp, Homo sapiens
tgacagcagcatagtgagcaat

SEQ ID NO: 9439632 - DNA, 22 bp, Homo sapiens
tgacagcagcatagtgagcaat

SEQ ID NO: 9439633 - DNA, 22 bp, Homo sapiens
tgacagcagcatagtgagcaat

SEQ ID NO: 9439634 - DNA, 23 bp, Homo sapiens
tgacagcaggaactgattatgta

SEQ ID NO: 9439635 - DNA, 22 bp, Homo sapiens
tgacagcataacactggtcttg

SEQ ID NO: 9439636 - DNA, 22 bp, Homo sapiens
tgacagcagccacctctcaccc

SEQ ID NO: 9439637 - DNA, 22 bp, Homo sapiens
tgacagcagccacctctcaccc

SEQ ID NO: 9439638 - DNA, 22 bp, Homo sapiens
tgacagcataacactggtcttg

SEQ ID NO: 9439639 - DNA, 22 bp, Homo sapiens
tgacagcataacactggtcttg

SEQ ID NO: 9439640 - DNA, 19 bp, Homo sapiens
tgacagcatgaattaggac

SEQ ID NO: 9439641 - DNA, 21 bp, Homo sapiens
tgacagcatagagcagggagg

SEQ ID NO: 9439642 - DNA, 21 bp, Homo sapiens
tgacagcatagagcagggagg

SEQ ID NO: 9439643 - DNA, 19 bp, Homo sapiens
tgacagcatgaattaggac

SEQ ID NO: 9439644 - DNA, 22 bp, Homo sapiens
tgacaggaggcttgaggccagg

SEQ ID NO: 9439645 - DNA, 22 bp, Homo sapiens
tgacaggaggcttgaggccagg

SEQ ID NO: 9439646 - DNA, 22 bp, Homo sapiens
tgacaggaaacatgcagtgatt

SEQ ID NO: 9439647 - DNA, 22 bp, Homo sapiens
tgacaggacagagaaatgacct

SEQ ID NO: 9439648 - DNA, 22 bp, Homo sapiens
tgacaggacagagaaatgacct

SEQ ID NO: 9439649 - DNA, 22 bp, Homo sapiens
tgacagctgaggcccagagtac

SEQ ID NO: 9439650 - DNA, 22 bp, Homo sapiens
tgacagcattactaatacatgt

SEQ ID NO: 9439651 - DNA, 22 bp, Homo sapiens
tgacagcattactaatacatgt

SEQ ID NO: 9439652 - DNA, 22 bp, Homo sapiens
tgacagcatgaccacagggtct

SEQ ID NO: 9439653 - DNA, 22 bp, Homo sapiens
tgacagcatgaccacagggtct

SEQ ID NO: 9439654 - DNA, 22 bp, Homo sapiens
tgacagccatgatccttactgt

SEQ ID NO: 9439655 - DNA, 22 bp, Homo sapiens
tgacagccatgatccttactgt

SEQ ID NO: 9439656 - DNA, 22 bp, Homo sapiens
tgacagctgagccccaggcaag

SEQ ID NO: 9439657 - DNA, 22 bp, Homo sapiens
tgacaggattggttgcttctga

SEQ ID NO: 9439658 - DNA, 22 bp, Homo sapiens
tgacaggatgatgagcaggggg

SEQ ID NO: 9439659 - DNA, 22 bp, Homo sapiens
tgacaggaggcttgaggccagg

SEQ ID NO: 9439660 - DNA, 22 bp, Homo sapiens
tgacaggagggttgtggcaggg

SEQ ID NO: 9439661 - DNA, 22 bp, Homo sapiens
tgacaggagggttgtggcaggg

SEQ ID NO: 9439662 - DNA, 22 bp, Homo sapiens
tgacaggatagtaggaagatct

SEQ ID NO: 9439663 - DNA, 22 bp, Homo sapiens
tgacaggagtggctagtgggag

SEQ ID NO: 9439664 - DNA, 22 bp, Homo sapiens
tgacaggaggcttgaggccagg

SEQ ID NO: 9439665 - DNA, 22 bp, Homo sapiens
tgacaggctaggaggctgaagg

SEQ ID NO: 9439666 - DNA, 22 bp, Homo sapiens
tgacagggacagtggagatgga

SEQ ID NO: 9439667 - DNA, 22 bp, Homo sapiens
tgacagggacagtggagatgga

SEQ ID NO: 9439668 - DNA, 22 bp, Homo sapiens
tgacttctagcatttagcaacc

SEQ ID NO: 9439669 - DNA, 22 bp, Homo sapiens
tgacttcctgcactcaggtgat

SEQ ID NO: 9439670 - DNA, 22 bp, Homo sapiens
tgacttcctgcactcaggtgat

SEQ ID NO: 9439671 - DNA, 22 bp, Homo sapiens
tgacttcctgcactcaggtgat

SEQ ID NO: 9439672 - DNA, 22 bp, Homo sapiens
tgacttccagcaacttcctcca

SEQ ID NO: 9439673 - DNA, 22 bp, Homo sapiens
tgacttaagctgttctttagat

SEQ ID NO: 9439674 - DNA, 17 bp, Homo sapiens
tgacttaacagcaaggc

SEQ ID NO: 9439675 - DNA, 22 bp, Homo sapiens
tgacttcaaaggctctactcct

SEQ ID NO: 9439676 - DNA, 22 bp, Homo sapiens
tgacttactctagagaatgctg

SEQ ID NO: 9439677 - DNA, 22 bp, Homo sapiens
tgacttgtctctttgggagaca

SEQ ID NO: 9439678 - DNA, 22 bp, Homo sapiens
tgacttctgattgcttctattt

SEQ ID NO: 9439679 - DNA, 22 bp, Homo sapiens
tgacttctgattgcttctattt

SEQ ID NO: 9439680 - DNA, 22 bp, Homo sapiens
tgactgaggcctgataacagtt

SEQ ID NO: 9439681 - DNA, 22 bp, Homo sapiens
tgactgaggcctgataacagtt

SEQ ID NO: 9439682 - DNA, 22 bp, Homo sapiens
tgactgtgcctgttgaatgaat

SEQ ID NO: 9439683 - DNA, 22 bp, Homo sapiens
tgactgtgccgtgcccctagga

SEQ ID NO: 9439684 - DNA, 22 bp, Homo sapiens
tgactgccgattgtccttctct

SEQ ID NO: 9439685 - DNA, 22 bp, Homo sapiens
tgactgccgattgtccttctct

SEQ ID NO: 9439686 - DNA, 22 bp, Homo sapiens
tgactgccccttccattcctgc

SEQ ID NO: 9439687 - DNA, 22 bp, Homo sapiens
tgactgccgattgtccttctct

SEQ ID NO: 9439688 - DNA, 21 bp, Homo sapiens
tgactccattctccatctgct

SEQ ID NO: 9439689 - DNA, 22 bp, Homo sapiens
tgactcagtacatctggagttg

SEQ ID NO: 9439690 - DNA, 22 bp, Homo sapiens
tgactcacttaatttacaagtc

SEQ ID NO: 9439691 - DNA, 22 bp, Homo sapiens
tgactcacagtggagaaagagg

SEQ ID NO: 9439692 - DNA, 22 bp, Homo sapiens
tgactctgtacctgtctgcctt

SEQ ID NO: 9439693 - DNA, 19 bp, Homo sapiens
tgactctgtggaacagaag

SEQ ID NO: 9439694 - DNA, 22 bp, Homo sapiens
tgactctgcccagccgcttgtc

SEQ ID NO: 9439695 - DNA, 20 bp, Homo sapiens
tgactctgcaaccgtctctc

SEQ ID NO: 9439696 - DNA, 22 bp, Homo sapiens
tgacctttcaacccttcttggc

SEQ ID NO: 9439697 - DNA, 22 bp, Homo sapiens
tgaccttatttggagacacagt

SEQ ID NO: 9439698 - DNA, 22 bp, Homo sapiens
tgacctgggcattacaggtgca

SEQ ID NO: 9439699 - DNA, 22 bp, Homo sapiens
tgacctgacatgaattaaaaac

SEQ ID NO: 9439700 - DNA, 22 bp, Homo sapiens
tgacctgacatgaattaaaaac

SEQ ID NO: 9439701 - DNA, 22 bp, Homo sapiens
tgacctcttgtcggagctccag

SEQ ID NO: 9439702 - DNA, 22 bp, Homo sapiens
tgacctctgtcctgcagtctgg

SEQ ID NO: 9439703 - DNA, 22 bp, Homo sapiens
tgactaattgataactctgtaa

SEQ ID NO: 9439704 - DNA, 22 bp, Homo sapiens
tgactagaattgtatttagtgt

SEQ ID NO: 9439705 - DNA, 22 bp, Homo sapiens
tgactacaacctccacctcccg

SEQ ID NO: 9439706 - DNA, 21 bp, Homo sapiens
tgactaattgtgataaagtgc

SEQ ID NO: 9439707 - DNA, 21 bp, Homo sapiens
tgactaattgtgataaagtgc

SEQ ID NO: 9439708 - DNA, 22 bp, Homo sapiens
tgacatttgagagagatataca

SEQ ID NO: 9439709 - DNA, 22 bp, Homo sapiens
tgacatttgagagagatataca

SEQ ID NO: 9439710 - DNA, 22 bp, Homo sapiens
tgacatttgagagagatataca

SEQ ID NO: 9439711 - DNA, 22 bp, Homo sapiens
tgacatttgagcatacatgtaa

SEQ ID NO: 9439712 - DNA, 22 bp, Homo sapiens
tgacatttgagcatacatgtaa

SEQ ID NO: 9439713 - DNA, 22 bp, Homo sapiens
tgacatttcctagtgctttgtg

SEQ ID NO: 9439714 - DNA, 22 bp, Homo sapiens
tgacatttcctagtgctttgtg

SEQ ID NO: 9439715 - DNA, 22 bp, Homo sapiens
tgacatttcctagtgctttgtg

SEQ ID NO: 9439716 - DNA, 18 bp, Homo sapiens
tgacatttccagagtgta

SEQ ID NO: 9439717 - DNA, 22 bp, Homo sapiens
tgacatttcggtgtatgtgatg

SEQ ID NO: 9439718 - DNA, 22 bp, Homo sapiens
tgacatttcttgttgatataaa

SEQ ID NO: 9439719 - DNA, 22 bp, Homo sapiens
tgacatttcttgttgatataaa

SEQ ID NO: 9439720 - DNA, 18 bp, Homo sapiens
tgaccctttctccctgtg

SEQ ID NO: 9439721 - DNA, 22 bp, Homo sapiens
tgaccctggcagcccactggcc

SEQ ID NO: 9439722 - DNA, 22 bp, Homo sapiens
tgaccctggcctggtggcggaa

SEQ ID NO: 9439723 - DNA, 21 bp, Homo sapiens
tgacatttggattcatagtaa

SEQ ID NO: 9439724 - DNA, 22 bp, Homo sapiens
tgacattttatcaatatcacag

SEQ ID NO: 9439725 - DNA, 22 bp, Homo sapiens
tgacattttatcaatatcacag

SEQ ID NO: 9439726 - DNA, 22 bp, Homo sapiens
tgacatttttaaaaccactagt

SEQ ID NO: 9439727 - DNA, 22 bp, Homo sapiens
tgacatttttaaaaccactagt

SEQ ID NO: 9439728 - DNA, 22 bp, Homo sapiens
tgacatttttataagagtcaaa

SEQ ID NO: 9439729 - DNA, 22 bp, Homo sapiens
tgacatttttataagagtcaaa

SEQ ID NO: 9439730 - DNA, 22 bp, Homo sapiens
tgacatttaagcctctgatttc

SEQ ID NO: 9439731 - DNA, 22 bp, Homo sapiens
tgacatttaagcctctgatttc

SEQ ID NO: 9439732 - DNA, 22 bp, Homo sapiens
tgacattgtgtgcatttaaagt

SEQ ID NO: 9439733 - DNA, 22 bp, Homo sapiens
tgacattccgcagtaaggttaa

SEQ ID NO: 9439734 - DNA, 22 bp, Homo sapiens
tgacatttaatccctaaatatt

SEQ ID NO: 9439735 - DNA, 22 bp, Homo sapiens
tgacatttaagcctctgatttc

SEQ ID NO: 9439736 - DNA, 22 bp, Homo sapiens
tgacatttaattaacgaatgct

SEQ ID NO: 9439737 - DNA, 22 bp, Homo sapiens
tgacatttaatccctaaatatt

SEQ ID NO: 9439738 - DNA, 22 bp, Homo sapiens
tgacatgtcctgagaagatggc

SEQ ID NO: 9439739 - DNA, 22 bp, Homo sapiens
tgacatttatcaaagaaatggt

SEQ ID NO: 9439740 - DNA, 22 bp, Homo sapiens
tgacatttatcaaagaaatggt

SEQ ID NO: 9439741 - DNA, 22 bp, Homo sapiens
tgacatttaattaacgaatgct

SEQ ID NO: 9439742 - DNA, 22 bp, Homo sapiens
tgacatttactattcctggtta

SEQ ID NO: 9439743 - DNA, 22 bp, Homo sapiens
tgacatttactattcctggtta

SEQ ID NO: 9439744 - DNA, 21 bp, Homo sapiens
tgacatttagtagcattgtca

SEQ ID NO: 9439745 - DNA, 21 bp, Homo sapiens
tgacatttagtagcattgtca

SEQ ID NO: 9439746 - DNA, 22 bp, Homo sapiens
tgacatttcagatatggtattt

SEQ ID NO: 9439747 - DNA, 22 bp, Homo sapiens
tgacatttcagatatggtattt

SEQ ID NO: 9439748 - DNA, 22 bp, Homo sapiens
tgacatttatcttctacaatga

SEQ ID NO: 9439749 - DNA, 21 bp, Homo sapiens
tgacatttccaatataaagcc

SEQ ID NO: 9439750 - DNA, 21 bp, Homo sapiens
tgacatttccaatataaagcc

SEQ ID NO: 9439751 - DNA, 21 bp, Homo sapiens
tgacatttccaatataaagcc

SEQ ID NO: 9439752 - DNA, 18 bp, Homo sapiens
tgacatttccagagtgta

SEQ ID NO: 9439753 - DNA, 21 bp, Homo sapiens
tgacatttccaatataaagcc

SEQ ID NO: 9439754 - DNA, 22 bp, Homo sapiens
tgaaatgtctgaaagccaatct

SEQ ID NO: 9439755 - DNA, 22 bp, Homo sapiens
tgaaatgtctttgcaattgaaa

SEQ ID NO: 9439756 - DNA, 22 bp, Homo sapiens
tgaaatgtgtaatgtggatgcc

SEQ ID NO: 9439757 - DNA, 22 bp, Homo sapiens
tgaaatgtgatctgagcttggc

SEQ ID NO: 9439758 - DNA, 22 bp, Homo sapiens
tgaaatgtggagatggtaagta

SEQ ID NO: 9439759 - DNA, 22 bp, Homo sapiens
tgaaatgtggagatggtaagta

SEQ ID NO: 9439760 - DNA, 22 bp, Homo sapiens
tgaaatgtgtccatgttatttc

SEQ ID NO: 9439761 - DNA, 22 bp, Homo sapiens
tgaaatgtacataaaaacgcac

SEQ ID NO: 9439762 - DNA, 23 bp, Homo sapiens
tgaaatgtagaggaattccacct

SEQ ID NO: 9439763 - DNA, 22 bp, Homo sapiens
tgaaatgtacataaaaacgcac

SEQ ID NO: 9439764 - DNA, 22 bp, Homo sapiens
tgaaatgtagattaggcattct

SEQ ID NO: 9439765 - DNA, 22 bp, Homo sapiens
tgaaatgtagtgaagcatggaa

SEQ ID NO: 9439766 - DNA, 22 bp, Homo sapiens
tgaaatgtagtgaagcatggaa

SEQ ID NO: 9439767 - DNA, 22 bp, Homo sapiens
tgaaatgtatattgccagtgta

SEQ ID NO: 9439768 - DNA, 22 bp, Homo sapiens
tgaaatgtcagtgttttataag

SEQ ID NO: 9439769 - DNA, 22 bp, Homo sapiens
tgaaatgtatattgccagtgta

SEQ ID NO: 9439770 - DNA, 22 bp, Homo sapiens
tgaaatgtctcacttagacttt

SEQ ID NO: 9439771 - DNA, 22 bp, Homo sapiens
tgaaatgtcatcctttagccat

SEQ ID NO: 9439772 - DNA, 22 bp, Homo sapiens
tgaaatgttggcatcggtacct

SEQ ID NO: 9439773 - DNA, 22 bp, Homo sapiens
tgaaatgttgccatgaggtctc

SEQ ID NO: 9439774 - DNA, 22 bp, Homo sapiens
tgaaatgttggtaattttatat

SEQ ID NO: 9439775 - DNA, 22 bp, Homo sapiens
tgaaatgtttgggtccagaagt

SEQ ID NO: 9439776 - DNA, 22 bp, Homo sapiens
tgaaatgtttgggtccagaagt

SEQ ID NO: 9439777 - DNA, 22 bp, Homo sapiens
tgaaatgtttgtatataaggtc

SEQ ID NO: 9439778 - DNA, 22 bp, Homo sapiens
tgaaatgtttatctctcctgct

SEQ ID NO: 9439779 - DNA, 22 bp, Homo sapiens
tgaaatgtttgaagaccactga

SEQ ID NO: 9439780 - DNA, 22 bp, Homo sapiens
tgaaatgtttaggaccactaga

SEQ ID NO: 9439781 - DNA, 22 bp, Homo sapiens
tgaaatgtttaggaccactaga

SEQ ID NO: 9439782 - DNA, 22 bp, Homo sapiens
tgaaatgtgttctagtgttttg

SEQ ID NO: 9439783 - DNA, 22 bp, Homo sapiens
tgaaatgtgttatctgggcctg

SEQ ID NO: 9439784 - DNA, 22 bp, Homo sapiens
tgaaatgttaaacaagtggctc

SEQ ID NO: 9439785 - DNA, 22 bp, Homo sapiens
tgaaatgttaaacaagtggctc

SEQ ID NO: 9439786 - DNA, 22 bp, Homo sapiens
tgaaatgttaatcacacaaagg

SEQ ID NO: 9439787 - DNA, 22 bp, Homo sapiens
tgaaatgttaatcacacaaagg

SEQ ID NO: 9439788 - DNA, 22 bp, Homo sapiens
tgaaatgttctggagtttctgt

SEQ ID NO: 9439789 - DNA, 22 bp, Homo sapiens
tgaaatcttcactaagtctctt

SEQ ID NO: 9439790 - DNA, 22 bp, Homo sapiens
tgaaatcttatactttggtagt

SEQ ID NO: 9439791 - DNA, 22 bp, Homo sapiens
tgaaatgaaacagaacatatca

SEQ ID NO: 9439792 - DNA, 22 bp, Homo sapiens
tgaaatgctgtagagactgtat

SEQ ID NO: 9439793 - DNA, 22 bp, Homo sapiens
tgaaatggcaaggcagagcttt

SEQ ID NO: 9439794 - DNA, 22 bp, Homo sapiens
tgaaatgtacaagtgctttttt

SEQ ID NO: 9439795 - DNA, 22 bp, Homo sapiens
tgaaatgtaagcatagaggttg

SEQ ID NO: 9439796 - DNA, 22 bp, Homo sapiens
tgaaatgtaagcatagaggttg

SEQ ID NO: 9439797 - DNA, 22 bp, Homo sapiens
tgaaatgtacataaaaacgcac

SEQ ID NO: 9439798 - DNA, 22 bp, Homo sapiens
tgaaatgtaaataggactagaa

SEQ ID NO: 9439799 - DNA, 22 bp, Homo sapiens
tgaaatgtaaataggactagaa

SEQ ID NO: 9439800 - DNA, 22 bp, Homo sapiens
tgaaatcatgtagttattgcaa

SEQ ID NO: 9439801 - DNA, 22 bp, Homo sapiens
tgaaatcattgccaagtattga

SEQ ID NO: 9439802 - DNA, 22 bp, Homo sapiens
tgaaatcatgaacaaggtaggt

SEQ ID NO: 9439803 - DNA, 22 bp, Homo sapiens
tgaaatcatgaacaaggtaggt

SEQ ID NO: 9439804 - DNA, 22 bp, Homo sapiens
tgaaatcatctgccaataagtt

SEQ ID NO: 9439805 - DNA, 22 bp, Homo sapiens
tgaaatcatgagatagtgtcac

SEQ ID NO: 9439806 - DNA, 22 bp, Homo sapiens
tgaaatcattggggttgaataa

SEQ ID NO: 9439807 - DNA, 22 bp, Homo sapiens
tgaaatcattggggttgaataa

SEQ ID NO: 9439808 - DNA, 22 bp, Homo sapiens
tgaaatctaccctattcagggt

SEQ ID NO: 9439809 - DNA, 21 bp, Homo sapiens
tgaaatctgatgggacaaatg

SEQ ID NO: 9439810 - DNA, 21 bp, Homo sapiens
tgaaatctgatgggacaaatg

SEQ ID NO: 9439811 - DNA, 22 bp, Homo sapiens
tgaaatcttagccattctgcct

SEQ ID NO: 9439812 - DNA, 22 bp, Homo sapiens
tgaaatctgtcccactttagct

SEQ ID NO: 9439813 - DNA, 22 bp, Homo sapiens
tgaaatatcattttcatctccc

SEQ ID NO: 9439814 - DNA, 22 bp, Homo sapiens
tgaaatatccagcccagcagga

SEQ ID NO: 9439815 - DNA, 22 bp, Homo sapiens
tgaaatatcattttcatctccc

SEQ ID NO: 9439816 - DNA, 22 bp, Homo sapiens
tgaaatatcattttcatctccc

SEQ ID NO: 9439817 - DNA, 22 bp, Homo sapiens
tgaaatagacacagtgctatac

SEQ ID NO: 9439818 - DNA, 22 bp, Homo sapiens
tgaaataatatctggatcaatc

SEQ ID NO: 9439819 - DNA, 22 bp, Homo sapiens
tgaaataatatctggatcaatc

SEQ ID NO: 9439820 - DNA, 22 bp, Homo sapiens
tgaaataacttttgggtgagtt

SEQ ID NO: 9439821 - DNA, 20 bp, Homo sapiens
tgaaataaggagttgtcctt

SEQ ID NO: 9439822 - DNA, 20 bp, Homo sapiens
tgaaataaggagttgtcctt

SEQ ID NO: 9439823 - DNA, 22 bp, Homo sapiens
tgaaatcatctgccaataagtt

SEQ ID NO: 9439824 - DNA, 22 bp, Homo sapiens
tgaaatcagtatgtctttctca

SEQ ID NO: 9439825 - DNA, 22 bp, Homo sapiens
tgaaatcaattgcaatgtttat

SEQ ID NO: 9439826 - DNA, 22 bp, Homo sapiens
tgaaatcaatgtcttctgtctc

SEQ ID NO: 9439827 - DNA, 22 bp, Homo sapiens
tgaaatatttagagagtaagtt

SEQ ID NO: 9439828 - DNA, 22 bp, Homo sapiens
tgaaatatgctcccattcactt

SEQ ID NO: 9439829 - DNA, 23 bp, Homo sapiens
tgaaatattcttttgcatgagct

SEQ ID NO: 9439830 - DNA, 22 bp, Homo sapiens
tgaaatatgctcccattcactt

SEQ ID NO: 9439831 - DNA, 22 bp, Homo sapiens
tgaaatatttagagagtaagtt

SEQ ID NO: 9439832 - DNA, 22 bp, Homo sapiens
tgaaatatttagagagtaagtt

SEQ ID NO: 9439833 - DNA, 23 bp, Homo sapiens
tgaaatattcttttgcatgagct

SEQ ID NO: 9439834 - DNA, 22 bp, Homo sapiens
tgaaagtatttgatttctatta

SEQ ID NO: 9439835 - DNA, 22 bp, Homo sapiens
tgaaagtgaatgtcactgttga

SEQ ID NO: 9439836 - DNA, 22 bp, Homo sapiens
tgaaagtgtcatagaaacccat

SEQ ID NO: 9439837 - DNA, 22 bp, Homo sapiens
tgaaagttgcacataagagaat

SEQ ID NO: 9439838 - DNA, 22 bp, Homo sapiens
tgaaagttaggatgtagtaatt

SEQ ID NO: 9439839 - DNA, 22 bp, Homo sapiens
tgaaagttacaggaaaacagat

SEQ ID NO: 9439840 - DNA, 22 bp, Homo sapiens
tgaaagatgctcaatgaatggt

SEQ ID NO: 9439841 - DNA, 22 bp, Homo sapiens
tgaaagcaacctgtaacagtga

SEQ ID NO: 9439842 - DNA, 22 bp, Homo sapiens
tgaaagcaacctgtaacagtga

SEQ ID NO: 9439843 - DNA, 22 bp, Homo sapiens
tgaaagattgtgattcaatatg

SEQ ID NO: 9439844 - DNA, 22 bp, Homo sapiens
tgaaagatgaaagcaggctggt

SEQ ID NO: 9439845 - DNA, 22 bp, Homo sapiens
tgaaagataagttattatgtac

SEQ ID NO: 9439846 - DNA, 22 bp, Homo sapiens
tgaaagataagttattatgtac

SEQ ID NO: 9439847 - DNA, 22 bp, Homo sapiens
tgaaagagtttgacatgattct

SEQ ID NO: 9439848 - DNA, 22 bp, Homo sapiens
tgaaagcactcacttctgctct

SEQ ID NO: 9439849 - DNA, 22 bp, Homo sapiens
tgaaagcacaagttctaacagg

SEQ ID NO: 9439850 - DNA, 23 bp, Homo sapiens
tgaaagcaatgggtctatagtat

SEQ ID NO: 9439851 - DNA, 22 bp, Homo sapiens
tgaactaatgaggaaatggtct

SEQ ID NO: 9439852 - DNA, 22 bp, Homo sapiens
tgaacgcaggtccacatggctc

SEQ ID NO: 9439853 - DNA, 22 bp, Homo sapiens
tgaacgcaggtccacatggctc

SEQ ID NO: 9439854 - DNA, 22 bp, Homo sapiens
tgaactccaaatactgctgatt

SEQ ID NO: 9439855 - DNA, 22 bp, Homo sapiens
tgaactacaaaaatcaacattt

SEQ ID NO: 9439856 - DNA, 22 bp, Homo sapiens
tgaactcctgacctcatgatcc

SEQ ID NO: 9439857 - DNA, 22 bp, Homo sapiens
tgaactctctcaagtgacagaa

SEQ ID NO: 9439858 - DNA, 22 bp, Homo sapiens
tgaactctcccccattgccctc

SEQ ID NO: 9439859 - DNA, 22 bp, Homo sapiens
tgaactctccaggcaaatgatc

SEQ ID NO: 9439860 - DNA, 22 bp, Homo sapiens
tgaactttcacaagaatatgct

SEQ ID NO: 9439861 - DNA, 22 bp, Homo sapiens
tgaactttgtagtaatggagat

SEQ ID NO: 9439862 - DNA, 18 bp, Homo sapiens
tgaactttggtgtctctc

SEQ ID NO: 9439863 - DNA, 22 bp, Homo sapiens
tgaacttagtgggaatatctct

SEQ ID NO: 9439864 - DNA, 22 bp, Homo sapiens
tgaacttacaaattaaaagact

SEQ ID NO: 9439865 - DNA, 18 bp, Homo sapiens
tgaactggcatcagaatc

SEQ ID NO: 9439866 - DNA, 22 bp, Homo sapiens
tgaactgtagcaggtttagagt

SEQ ID NO: 9439867 - DNA, 22 bp, Homo sapiens
tgaacattgtcacattcctagc

SEQ ID NO: 9439868 - DNA, 22 bp, Homo sapiens
tgaacattgtcacattcctagc

SEQ ID NO: 9439869 - DNA, 22 bp, Homo sapiens
tgaacattgtcacattcctagc

SEQ ID NO: 9439870 - DNA, 22 bp, Homo sapiens
tgaaccagagtctccagtggtt

SEQ ID NO: 9439871 - DNA, 22 bp, Homo sapiens
tgaaccttgttcctgccctcct

SEQ ID NO: 9439872 - DNA, 21 bp, Homo sapiens
tgaacccagagctcatgacca

SEQ ID NO: 9439873 - DNA, 22 bp, Homo sapiens
tgaaccatctggctccagaaga

SEQ ID NO: 9439874 - DNA, 22 bp, Homo sapiens
tgaacctgtttccaggctcatt

SEQ ID NO: 9439875 - DNA, 22 bp, Homo sapiens
tgaacatacaattattaagaac

SEQ ID NO: 9439876 - DNA, 22 bp, Homo sapiens
tgaacatacaattattaagaac

SEQ ID NO: 9439877 - DNA, 22 bp, Homo sapiens
tgaacatattcacctctaaata

SEQ ID NO: 9439878 - DNA, 22 bp, Homo sapiens
tgaacatgctgttgatggcctg

SEQ ID NO: 9439879 - DNA, 22 bp, Homo sapiens
tgaacatgctgttgatggcctg

SEQ ID NO: 9439880 - DNA, 22 bp, Homo sapiens
tgaacatgctgttgatggcctg

SEQ ID NO: 9439881 - DNA, 22 bp, Homo sapiens
tgaacattggcacaaggcagca

SEQ ID NO: 9439882 - DNA, 22 bp, Homo sapiens
tgaacattcctgaatgaagcat

SEQ ID NO: 9439883 - DNA, 22 bp, Homo sapiens
tgaacattcctgaatgaagcat

SEQ ID NO: 9439884 - DNA, 22 bp, Homo sapiens
tgaacatgctgttgatggcctg

SEQ ID NO: 9439885 - DNA, 22 bp, Homo sapiens
tgaacattagttgagtaaagtc

SEQ ID NO: 9439886 - DNA, 22 bp, Homo sapiens
tgaacagtgtatctagatcatg

SEQ ID NO: 9439887 - DNA, 22 bp, Homo sapiens
tgaacagtggttcatgtcacgg

SEQ ID NO: 9439888 - DNA, 22 bp, Homo sapiens
tgaacagttactttgtagaaga

SEQ ID NO: 9439889 - DNA, 22 bp, Homo sapiens
tgaacagtcatttagaatgtgc

SEQ ID NO: 9439890 - DNA, 22 bp, Homo sapiens
tgaacagtgatctacatgtggc

SEQ ID NO: 9439891 - DNA, 22 bp, Homo sapiens
tgaacaaatgaatcagtgtagc

SEQ ID NO: 9439892 - DNA, 22 bp, Homo sapiens
tgaacaaatggaaataaccagt

SEQ ID NO: 9439893 - DNA, 22 bp, Homo sapiens
tgaacaactgcaaaaatctcca

SEQ ID NO: 9439894 - DNA, 22 bp, Homo sapiens
tgaacaaatggaaataaccagt

SEQ ID NO: 9439895 - DNA, 22 bp, Homo sapiens
tgaacaaatggaaataaccagt

SEQ ID NO: 9439896 - DNA, 22 bp, Homo sapiens
tgaacacacacatcttaataat

SEQ ID NO: 9439897 - DNA, 22 bp, Homo sapiens
tgaaattatgcattgttgtacc

SEQ ID NO: 9439898 - DNA, 22 bp, Homo sapiens
tgaaattatgcattgttgtacc

SEQ ID NO: 9439899 - DNA, 22 bp, Homo sapiens
tgaaattagaaatatgtatggg

SEQ ID NO: 9439900 - DNA, 22 bp, Homo sapiens
tgaaattagaaatatgtatggg

SEQ ID NO: 9439901 - DNA, 22 bp, Homo sapiens
tgaaattagtgaagttacagtt

SEQ ID NO: 9439902 - DNA, 22 bp, Homo sapiens
tgaaattatgcattgttgtacc

SEQ ID NO: 9439903 - DNA, 22 bp, Homo sapiens
tgaaatttaggtgcagataaat

SEQ ID NO: 9439904 - DNA, 22 bp, Homo sapiens
tgaaattcaaaacacatttgtc

SEQ ID NO: 9439905 - DNA, 22 bp, Homo sapiens
tgaacaaactgcattcttcact

SEQ ID NO: 9439906 - DNA, 22 bp, Homo sapiens
tgaagaatcccagggaatttgg

SEQ ID NO: 9439907 - DNA, 22 bp, Homo sapiens
tgaagaatgttgcagtgagcat

SEQ ID NO: 9439908 - DNA, 22 bp, Homo sapiens
tgaagacacatacaagggaatg

SEQ ID NO: 9439909 - DNA, 22 bp, Homo sapiens
tgaagacagaccaaggagaatg

SEQ ID NO: 9439910 - DNA, 22 bp, Homo sapiens
tgaagacacatacaagggaatg

SEQ ID NO: 9439911 - DNA, 22 bp, Homo sapiens
tgaagactcagaagctaagata

SEQ ID NO: 9439912 - DNA, 22 bp, Homo sapiens
tgaagactcagaagctaagata

SEQ ID NO: 9439913 - DNA, 22 bp, Homo sapiens
tgaagactcagaagctaagata

SEQ ID NO: 9439914 - DNA, 22 bp, Homo sapiens
tgaagactcagaagctaagata

SEQ ID NO: 9439915 - DNA, 22 bp, Homo sapiens
tgaagactttgctcttaaccac

SEQ ID NO: 9439916 - DNA, 22 bp, Homo sapiens
tgaagagaagaaaattatcttt

SEQ ID NO: 9439917 - DNA, 22 bp, Homo sapiens
tgaagactcagaagctaagata

SEQ ID NO: 9439918 - DNA, 22 bp, Homo sapiens
tgaagacagttttactcatgag

SEQ ID NO: 9439919 - DNA, 22 bp, Homo sapiens
tgaagacagggtctttaacgag

SEQ ID NO: 9439920 - DNA, 22 bp, Homo sapiens
tgaagaataagatagatggagc

SEQ ID NO: 9439921 - DNA, 22 bp, Homo sapiens
tgaagaagccaattggtaggct

SEQ ID NO: 9439922 - DNA, 22 bp, Homo sapiens
tgaagaacctgatgagctgtgt

SEQ ID NO: 9439923 - DNA, 22 bp, Homo sapiens
tgaagaaacgcagagaggtagg

SEQ ID NO: 9439924 - DNA, 22 bp, Homo sapiens
tgaagaaacgcagagaggtagg

SEQ ID NO: 9439925 - DNA, 22 bp, Homo sapiens
tgaagaaacgcagagaggtagg

SEQ ID NO: 9439926 - DNA, 22 bp, Homo sapiens
tgaagaaacgcagagaggtagg

SEQ ID NO: 9439927 - DNA, 22 bp, Homo sapiens
tgaagaaaggtgtgggatactc

SEQ ID NO: 9439928 - DNA, 22 bp, Homo sapiens
tgaagaaaggtgtgggatactc

SEQ ID NO: 9439929 - DNA, 22 bp, Homo sapiens
tgaagaaacgcagagaggtagg

SEQ ID NO: 9439930 - DNA, 22 bp, Homo sapiens
tgaagaaacgcagagaggtagg

SEQ ID NO: 9439931 - DNA, 22 bp, Homo sapiens
tgaagaaacagaccaagaggat

SEQ ID NO: 9439932 - DNA, 22 bp, Homo sapiens
tgaagaaacagaccaagaggat

SEQ ID NO: 9439933 - DNA, 22 bp, Homo sapiens
tgaagaaacagaccaagaggat

SEQ ID NO: 9439934 - DNA, 22 bp, Homo sapiens
tgaagaaacagaccaagaggat

SEQ ID NO: 9439935 - DNA, 22 bp, Homo sapiens
tgaagaaacagaccaagaggat

SEQ ID NO: 9439936 - DNA, 18 bp, Homo sapiens
tgaacttttcctgctgct

SEQ ID NO: 9439937 - DNA, 22 bp, Homo sapiens
tgaagaaaatatgattacccca

SEQ ID NO: 9439938 - DNA, 19 bp, Homo sapiens
tgaagcagcaaactctcag

SEQ ID NO: 9439939 - DNA, 20 bp, Homo sapiens
tgaagcagccttgattctgt

SEQ ID NO: 9439940 - DNA, 22 bp, Homo sapiens
tgaagcagttctcagaagtggg

SEQ ID NO: 9439941 - DNA, 22 bp, Homo sapiens
tgaagcaggtgaatggatgtcg

SEQ ID NO: 9439942 - DNA, 22 bp, Homo sapiens
tgaagcaggtgaatggatgtcg

SEQ ID NO: 9439943 - DNA, 22 bp, Homo sapiens
tgaagcaggcattgactgatga

SEQ ID NO: 9439944 - DNA, 19 bp, Homo sapiens
tgaagcaggcagagaagat

SEQ ID NO: 9439945 - DNA, 22 bp, Homo sapiens
tgaagcaaattgtttagcctga

SEQ ID NO: 9439946 - DNA, 22 bp, Homo sapiens
tgaagcaaattgtttagcctga

SEQ ID NO: 9439947 - DNA, 22 bp, Homo sapiens
tgaagcaaacgcttctgttcct

SEQ ID NO: 9439948 - DNA, 22 bp, Homo sapiens
tgaagcaaatttttctcagagt

SEQ ID NO: 9439949 - DNA, 22 bp, Homo sapiens
tgaagcaacaagtctggcccca

SEQ ID NO: 9439950 - DNA, 22 bp, Homo sapiens
tgaagcaactggacaagttggc

SEQ ID NO: 9439951 - DNA, 19 bp, Homo sapiens
tgaagcaataccatttttg

SEQ ID NO: 9439952 - DNA, 22 bp, Homo sapiens
tgaagcaagtctattgccctgg

SEQ ID NO: 9439953 - DNA, 22 bp, Homo sapiens
tgaagcaagatagaaagctgct

SEQ ID NO: 9439954 - DNA, 22 bp, Homo sapiens
tgaagcaagatagaaagctgct

SEQ ID NO: 9439955 - DNA, 22 bp, Homo sapiens
tgaagcaatagagacaagacca

SEQ ID NO: 9439956 - DNA, 22 bp, Homo sapiens
tgaagcaatagagacaagacca

SEQ ID NO: 9439957 - DNA, 22 bp, Homo sapiens
tgaagcaatgatagcagaatga

SEQ ID NO: 9439958 - DNA, 22 bp, Homo sapiens
tgaagcaatgatcttttggtgg

SEQ ID NO: 9439959 - DNA, 22 bp, Homo sapiens
tgaaaatggcctgaagaagcaa

SEQ ID NO: 9439960 - DNA, 22 bp, Homo sapiens
tgaaaattaagcagatgaatga

SEQ ID NO: 9439961 - DNA, 22 bp, Homo sapiens
tgaaaattgttgtacttgataa

SEQ ID NO: 9439962 - DNA, 22 bp, Homo sapiens
tgaaaatttccatcagttatat

SEQ ID NO: 9439963 - DNA, 22 bp, Homo sapiens
tgaaaattgttgtacttgataa

SEQ ID NO: 9439964 - DNA, 22 bp, Homo sapiens
tgaaaattgttgtacttgataa

SEQ ID NO: 9439965 - DNA, 22 bp, Homo sapiens
tgaaaattgttgtacttgataa

SEQ ID NO: 9439966 - DNA, 22 bp, Homo sapiens
tgaaacaaaagtatgtagcttg

SEQ ID NO: 9439967 - DNA, 22 bp, Homo sapiens
tgaaaatttccatcagttatat

SEQ ID NO: 9439968 - DNA, 22 bp, Homo sapiens
tgaaaatttccatcagttatat

SEQ ID NO: 9439969 - DNA, 22 bp, Homo sapiens
tgaaaacttgacaagtgaggta

SEQ ID NO: 9439970 - DNA, 20 bp, Homo sapiens
tgaaaaggtcaggagacatg

SEQ ID NO: 9439971 - DNA, 22 bp, Homo sapiens
tgaaaagggtagatccctaagt

SEQ ID NO: 9439972 - DNA, 22 bp, Homo sapiens
tgaaaaggagtccttgttttca

SEQ ID NO: 9439973 - DNA, 22 bp, Homo sapiens
tgaaaatatagttttccagact

SEQ ID NO: 9439974 - DNA, 22 bp, Homo sapiens
tgaaaatatagttttccagact

SEQ ID NO: 9439975 - DNA, 22 bp, Homo sapiens
tgaaaatatagttttccagact

SEQ ID NO: 9439976 - DNA, 22 bp, Homo sapiens
tgaaaatatagttttccagact

SEQ ID NO: 9439977 - DNA, 22 bp, Homo sapiens
tgaaaatatagttttccagact

SEQ ID NO: 9439978 - DNA, 22 bp, Homo sapiens
tgaaaatgcacgctggaaagca

SEQ ID NO: 9439979 - DNA, 22 bp, Homo sapiens
tgaaaaaacaagttggcccatt

SEQ ID NO: 9439980 - DNA, 22 bp, Homo sapiens
tgaaaaaacaagttggcccatt

SEQ ID NO: 9439981 - DNA, 22 bp, Homo sapiens
tgaaaaacactaattggaaagc

SEQ ID NO: 9439982 - DNA, 22 bp, Homo sapiens
tgaaaaacactaattggaaagc

SEQ ID NO: 9439983 - DNA, 22 bp, Homo sapiens
tgaaaaacctcagtccgcttta

SEQ ID NO: 9439984 - DNA, 22 bp, Homo sapiens
tgaaaaactttaatccataaag

SEQ ID NO: 9439985 - DNA, 22 bp, Homo sapiens
tgaaaaactttaatccataaag

SEQ ID NO: 9439986 - DNA, 22 bp, Homo sapiens
tgaaaaactttaatccataaag

SEQ ID NO: 9439987 - DNA, 22 bp, Homo sapiens
tgaaaaactttaatccataaag

SEQ ID NO: 9439988 - DNA, 22 bp, Homo sapiens
tgaaaactccaagtttcatcag

SEQ ID NO: 9439989 - DNA, 22 bp, Homo sapiens
tgaaaacagaatccttgttttc

SEQ ID NO: 9439990 - DNA, 22 bp, Homo sapiens
tgaaaacactttagtttaggtc

SEQ ID NO: 9439991 - DNA, 22 bp, Homo sapiens
tgaaaacagaatccttgttttc

SEQ ID NO: 9439992 - DNA, 22 bp, Homo sapiens
tgaaaacactttagtttaggtc

SEQ ID NO: 9439993 - DNA, 22 bp, Homo sapiens
tgaaaaactttaatccataaag

SEQ ID NO: 9439994 - DNA, 22 bp, Homo sapiens
tgaaaaaacaagttggcccatt

SEQ ID NO: 9439995 - DNA, 22 bp, Homo sapiens
tctttttttcctgtgcagagct

SEQ ID NO: 9439996 - DNA, 22 bp, Homo sapiens
tctttttttcctgtgcagagct

SEQ ID NO: 9439997 - DNA, 22 bp, Homo sapiens
tctttttcttattcccacactg

SEQ ID NO: 9439998 - DNA, 22 bp, Homo sapiens
tctttttcttattcccacactg

SEQ ID NO: 9439999 - DNA, 22 bp, Homo sapiens
tctttttcttctgtggaaggtg

SEQ ID NO: 9440000 - DNA, 22 bp, Homo sapiens
tctttttctgcacacgtgtccc

SEQ ID NO: 9440001 - DNA, 22 bp, Homo sapiens
tctttttatattgacaaaaggt

SEQ ID NO: 9440002 - DNA, 22 bp, Homo sapiens
tctttttatattgacaaaaggt

SEQ ID NO: 9440003 - DNA, 22 bp, Homo sapiens
tcttttgttgcctacttattaa

SEQ ID NO: 9440004 - DNA, 23 bp, Homo sapiens
tctttttaagagatctagtgacg

SEQ ID NO: 9440005 - DNA, 22 bp, Homo sapiens
tctttttatattgacaaaaggt

SEQ ID NO: 9440006 - DNA, 22 bp, Homo sapiens
tctttttatattgacaaaaggt

SEQ ID NO: 9440007 - DNA, 22 bp, Homo sapiens
tctttttatattgacaaaaggt

SEQ ID NO: 9440008 - DNA, 22 bp, Homo sapiens
tctttttatattgacaaaaggt

SEQ ID NO: 9440009 - DNA, 22 bp, Homo sapiens
tgaaacaaaccagtaattttgt

SEQ ID NO: 9440010 - DNA, 22 bp, Homo sapiens
tgaaacaaaattaagattctcg

SEQ ID NO: 9440011 - DNA, 22 bp, Homo sapiens
tgaaacaaaagtatgtagcttg

SEQ ID NO: 9440012 - DNA, 22 bp, Homo sapiens
tgaaacaaaattaagattctcg

SEQ ID NO: 9440013 - DNA, 22 bp, Homo sapiens
tgaaacaaaccagtaattttgt

SEQ ID NO: 9440014 - DNA, 22 bp, Homo sapiens
tgaaacaaaccagtaattttgt

SEQ ID NO: 9440015 - DNA, 22 bp, Homo sapiens
tgaaacaaaccagtaattttgt

SEQ ID NO: 9440016 - DNA, 19 bp, Homo sapiens
tgaaacaaacttaaaagga

SEQ ID NO: 9440017 - DNA, 19 bp, Homo sapiens
tgaaacaaacttaaaagga

SEQ ID NO: 9440018 - DNA, 19 bp, Homo sapiens
tgaaacaaacttaaaagga

SEQ ID NO: 9440019 - DNA, 19 bp, Homo sapiens
tgaaacaaacttaaaagga

SEQ ID NO: 9440020 - DNA, 19 bp, Homo sapiens
tgaaacaaacttaaaagga

SEQ ID NO: 9440021 - DNA, 19 bp, Homo sapiens
tgaaacaaacttaaaagga

SEQ ID NO: 9440022 - DNA, 22 bp, Homo sapiens
tgaaacaggaagtaaacagaca

SEQ ID NO: 9440023 - DNA, 22 bp, Homo sapiens
tgaaacaggaagtaaacagaca

SEQ ID NO: 9440024 - DNA, 22 bp, Homo sapiens
tgaaacagtattctcaaccttt

SEQ ID NO: 9440025 - DNA, 22 bp, Homo sapiens
tgaaacattaggaaatcattat

SEQ ID NO: 9440026 - DNA, 22 bp, Homo sapiens
tgaaacattatagaatatttat

SEQ ID NO: 9440027 - DNA, 22 bp, Homo sapiens
tgaaacattatagaatatttat

SEQ ID NO: 9440028 - DNA, 22 bp, Homo sapiens
tgaaacataaagttatcttcag

SEQ ID NO: 9440029 - DNA, 21 bp, Homo sapiens
tgaaacatttgatcaaagcac

SEQ ID NO: 9440030 - DNA, 23 bp, Homo sapiens
tgaaacatttagggtagaatttc

SEQ ID NO: 9440031 - DNA, 22 bp, Homo sapiens
tgaaacatttgatgatctttgg

SEQ ID NO: 9440032 - DNA, 21 bp, Homo sapiens
tgaaacatttgatcaaagcac

SEQ ID NO: 9440033 - DNA, 23 bp, Homo sapiens
tgaaacatttagggtagaatttc

SEQ ID NO: 9440034 - DNA, 23 bp, Homo sapiens
tgaaacatttagggtagaatttc

SEQ ID NO: 9440035 - DNA, 22 bp, Homo sapiens
tgaaacattgcactgtatgaat

SEQ ID NO: 9440036 - DNA, 22 bp, Homo sapiens
tgaaacattgcactgtatgaat

SEQ ID NO: 9440037 - DNA, 22 bp, Homo sapiens
tgaaacttataagaatatgaat

SEQ ID NO: 9440038 - DNA, 22 bp, Homo sapiens
tgaaacttatatatcccaggtt

SEQ ID NO: 9440039 - DNA, 22 bp, Homo sapiens
tgaaacttataagaatatgaat

SEQ ID NO: 9440040 - DNA, 22 bp, Homo sapiens
tgaaacttataagaatatgaat

SEQ ID NO: 9440041 - DNA, 22 bp, Homo sapiens
tgaaactgaaaggtatttatag

SEQ ID NO: 9440042 - DNA, 22 bp, Homo sapiens
tgaaactgaaaggtatttatag

SEQ ID NO: 9440043 - DNA, 22 bp, Homo sapiens
tgaaactgaaaggtatttatag

SEQ ID NO: 9440044 - DNA, 21 bp, Homo sapiens
tgaaactacctacaagctacc

SEQ ID NO: 9440045 - DNA, 22 bp, Homo sapiens
tgaaactaggccaatcaaatta

SEQ ID NO: 9440046 - DNA, 22 bp, Homo sapiens
tgaaaccattctcaggtacact

SEQ ID NO: 9440047 - DNA, 22 bp, Homo sapiens
tgaaacatttgatgatctttgg

SEQ ID NO: 9440048 - DNA, 22 bp, Homo sapiens
tgaaagaaacaggtatattggg

SEQ ID NO: 9440049 - DNA, 22 bp, Homo sapiens
tgaaagaactagcatcttcaag

SEQ ID NO: 9440050 - DNA, 22 bp, Homo sapiens
tgaaacttttgaggttcttcca

SEQ ID NO: 9440051 - DNA, 21 bp, Homo sapiens
tgaaagaaggtgcagtctgaa

SEQ ID NO: 9440052 - DNA, 21 bp, Homo sapiens
tgaaagaaggtgcagtctgaa

SEQ ID NO: 9440053 - DNA, 22 bp, Homo sapiens
tgaaagaagtgtcacattgcca

SEQ ID NO: 9440054 - DNA, 22 bp, Homo sapiens
tgaaagaagtgtcacattgcca

SEQ ID NO: 9440055 - DNA, 22 bp, Homo sapiens
tgaaagaagtgtcacattgcca

SEQ ID NO: 9440056 - DNA, 22 bp, Homo sapiens
tgaaagaactagcatcttcaag

SEQ ID NO: 9440057 - DNA, 22 bp, Homo sapiens
tgaaagaactagcatcttcaag

SEQ ID NO: 9440058 - DNA, 22 bp, Homo sapiens
tgaaagaactagcatcttcaag

SEQ ID NO: 9440059 - DNA, 22 bp, Homo sapiens
tgaaagaagggtggaaaatgta

SEQ ID NO: 9440060 - DNA, 21 bp, Homo sapiens
tgaaagaaggtgcagtctgaa

SEQ ID NO: 9440061 - DNA, 22 bp, Homo sapiens
tgaaagaagggtggaaaatgta

SEQ ID NO: 9440062 - DNA, 21 bp, Homo sapiens
tcttttctctgcaggattcct

SEQ ID NO: 9440063 - DNA, 21 bp, Homo sapiens
tcttttctctgcaggattcct

SEQ ID NO: 9440064 - DNA, 22 bp, Homo sapiens
tcttttctccagacctgggatc

SEQ ID NO: 9440065 - DNA, 21 bp, Homo sapiens
tcttttctcagctttgtggtt

SEQ ID NO: 9440066 - DNA, 22 bp, Homo sapiens
tcttttctccagacctgggatc

SEQ ID NO: 9440067 - DNA, 22 bp, Homo sapiens
tcttttctagcaaatccaggag

SEQ ID NO: 9440068 - DNA, 21 bp, Homo sapiens
tcttttctcagctttgtggtt

SEQ ID NO: 9440069 - DNA, 21 bp, Homo sapiens
tcttttctcagctttgtggtt

SEQ ID NO: 9440070 - DNA, 21 bp, Homo sapiens
tcttttctcagctttgtggtt

SEQ ID NO: 9440071 - DNA, 21 bp, Homo sapiens
tcttttcctttctgtgtgcaa

SEQ ID NO: 9440072 - DNA, 18 bp, Homo sapiens
tcttttccttccacttcc

SEQ ID NO: 9440073 - DNA, 18 bp, Homo sapiens
tcttttccttccacttcc

SEQ ID NO: 9440074 - DNA, 22 bp, Homo sapiens
tcttttcctcctcttgttggcc

SEQ ID NO: 9440075 - DNA, 18 bp, Homo sapiens
tcttttccttccacttcc

SEQ ID NO: 9440076 - DNA, 22 bp, Homo sapiens
tcttttcctcctcttgttggcc

SEQ ID NO: 9440077 - DNA, 22 bp, Homo sapiens
tcttttcctcctcttgttggcc

SEQ ID NO: 9440078 - DNA, 18 bp, Homo sapiens
tcttttccttccacttcc

SEQ ID NO: 9440079 - DNA, 22 bp, Homo sapiens
tcttttccttccctacagatct

SEQ ID NO: 9440080 - DNA, 21 bp, Homo sapiens
tcttttcctttctgtgtgcaa

SEQ ID NO: 9440081 - DNA, 21 bp, Homo sapiens
tcttttcctttctgtgtgcaa

SEQ ID NO: 9440082 - DNA, 22 bp, Homo sapiens
tcttttccttgatggttaaata

SEQ ID NO: 9440083 - DNA, 22 bp, Homo sapiens
tcttttattaggctgaaatggg

SEQ ID NO: 9440084 - DNA, 22 bp, Homo sapiens
tcttttattaggctgaaatggg

SEQ ID NO: 9440085 - DNA, 22 bp, Homo sapiens
tcttttattaggctgaaatggg

SEQ ID NO: 9440086 - DNA, 20 bp, Homo sapiens
tcttttattggcagatcctg

SEQ ID NO: 9440087 - DNA, 20 bp, Homo sapiens
tcttttattggcagatcctg

SEQ ID NO: 9440088 - DNA, 20 bp, Homo sapiens
tcttttattggcagatcctg

SEQ ID NO: 9440089 - DNA, 22 bp, Homo sapiens
tcttttattaggctgaaatggg

SEQ ID NO: 9440090 - DNA, 22 bp, Homo sapiens
tcttttatctgttgtgtaacaa

SEQ ID NO: 9440091 - DNA, 22 bp, Homo sapiens
tcttttatctgttgtgtaacaa

SEQ ID NO: 9440092 - DNA, 22 bp, Homo sapiens
tcttttatcctacatttagctc

SEQ ID NO: 9440093 - DNA, 22 bp, Homo sapiens
tcttttatcctacatttagctc

SEQ ID NO: 9440094 - DNA, 23 bp, Homo sapiens
tcttttcaatggttctttatgtg

SEQ ID NO: 9440095 - DNA, 22 bp, Homo sapiens
tcttttcacagacaaatggaga

SEQ ID NO: 9440096 - DNA, 19 bp, Homo sapiens
tcttttcacgcattttgaa

SEQ ID NO: 9440097 - DNA, 22 bp, Homo sapiens
tctttgtttgcctttatcaaga

SEQ ID NO: 9440098 - DNA, 18 bp, Homo sapiens
tctttgtttccttcttgc

SEQ ID NO: 9440099 - DNA, 22 bp, Homo sapiens
tctttgtttgtactgttagaat

SEQ ID NO: 9440100 - DNA, 22 bp, Homo sapiens
tctttgttattgctttatctat

SEQ ID NO: 9440101 - DNA, 22 bp, Homo sapiens
tctttgttattgctttatctat

SEQ ID NO: 9440102 - DNA, 22 bp, Homo sapiens
tctttgttattgctttatctat

SEQ ID NO: 9440103 - DNA, 20 bp, Homo sapiens
tctttgttaattttatctcc

SEQ ID NO: 9440104 - DNA, 20 bp, Homo sapiens
tctttgttaattttatctcc

SEQ ID NO: 9440105 - DNA, 22 bp, Homo sapiens
tctttgtgttcaggagccacgt

SEQ ID NO: 9440106 - DNA, 20 bp, Homo sapiens
tctttgttaattttatctcc

SEQ ID NO: 9440107 - DNA, 20 bp, Homo sapiens
tctttgtgtcagatggacag

SEQ ID NO: 9440108 - DNA, 22 bp, Homo sapiens
tcttttaagcctctggcatagg

SEQ ID NO: 9440109 - DNA, 21 bp, Homo sapiens
tcttttaacaccaggaattcc

SEQ ID NO: 9440110 - DNA, 22 bp, Homo sapiens
tcttttatcctacatttagctc

SEQ ID NO: 9440111 - DNA, 22 bp, Homo sapiens
tcttttatcctacatttagctc

SEQ ID NO: 9440112 - DNA, 22 bp, Homo sapiens
tcttttatcctacatttagctc

SEQ ID NO: 9440113 - DNA, 22 bp, Homo sapiens
tcttttatagtgaattttcttg

SEQ ID NO: 9440114 - DNA, 22 bp, Homo sapiens
tcttttatagtgaattttcttg

SEQ ID NO: 9440115 - DNA, 22 bp, Homo sapiens
tcttttatagtgaattttcttg

SEQ ID NO: 9440116 - DNA, 22 bp, Homo sapiens
tctttgcaaatgttattatctt

SEQ ID NO: 9440117 - DNA, 22 bp, Homo sapiens
tctttgattttgttactaagac

SEQ ID NO: 9440118 - DNA, 22 bp, Homo sapiens
tctttgattttgttactaagac

SEQ ID NO: 9440119 - DNA, 22 bp, Homo sapiens
tctttgatttgacaatatcttg

SEQ ID NO: 9440120 - DNA, 22 bp, Homo sapiens
tctttgatttgacaatatcttg

SEQ ID NO: 9440121 - DNA, 22 bp, Homo sapiens
tctttgcacacagcgattcttc

SEQ ID NO: 9440122 - DNA, 22 bp, Homo sapiens
tctttgcagaatttaactttgc

SEQ ID NO: 9440123 - DNA, 22 bp, Homo sapiens
tctttgcagaacgatgaagatg

SEQ ID NO: 9440124 - DNA, 22 bp, Homo sapiens
tctttgcagttctgattaaata

SEQ ID NO: 9440125 - DNA, 22 bp, Homo sapiens
tctttgcagtggtgaataaaga

SEQ ID NO: 9440126 - DNA, 22 bp, Homo sapiens
tctttgctcttacacagttagt

SEQ ID NO: 9440127 - DNA, 22 bp, Homo sapiens
tctttgctgagtacatctccaa

SEQ ID NO: 9440128 - DNA, 22 bp, Homo sapiens
tctttggaaatgctttgagaat

SEQ ID NO: 9440129 - DNA, 22 bp, Homo sapiens
tctttggaaaaaatggacaatc

SEQ ID NO: 9440130 - DNA, 22 bp, Homo sapiens
tctttggaagctttcagagaag

SEQ ID NO: 9440131 - DNA, 22 bp, Homo sapiens
tctttgctattgtgaatagtgc

SEQ ID NO: 9440132 - DNA, 22 bp, Homo sapiens
tctttgcatcccttccatagtt

SEQ ID NO: 9440133 - DNA, 22 bp, Homo sapiens
tctttggatctcaaggtggcag

SEQ ID NO: 9440134 - DNA, 22 bp, Homo sapiens
tctttggatcccaactggctgg

SEQ ID NO: 9440135 - DNA, 22 bp, Homo sapiens
tctttggaatgctagcattcta

SEQ ID NO: 9440136 - DNA, 22 bp, Homo sapiens
tctttgtggcgggcttaaatac

SEQ ID NO: 9440137 - DNA, 20 bp, Homo sapiens
tctttgtgtcagatggacag

SEQ ID NO: 9440138 - DNA, 22 bp, Homo sapiens
tctttggcatcagggccagcta

SEQ ID NO: 9440139 - DNA, 22 bp, Homo sapiens
tctttggcatcagggccagcta

SEQ ID NO: 9440140 - DNA, 22 bp, Homo sapiens
tctttggcatttaggagcagga

SEQ ID NO: 9440141 - DNA, 22 bp, Homo sapiens
tctttggcatcagggccagcta

SEQ ID NO: 9440142 - DNA, 22 bp, Homo sapiens
tctttgtaactgtctattgaga

SEQ ID NO: 9440143 - DNA, 22 bp, Homo sapiens
tgagacaggcttccttcttggg

SEQ ID NO: 9440144 - DNA, 19 bp, Homo sapiens
tgagacagggattcaggtg

SEQ ID NO: 9440145 - DNA, 22 bp, Homo sapiens
tgagacagcctctgcactcatg

SEQ ID NO: 9440146 - DNA, 18 bp, Homo sapiens
tgagacagctaccacttg

SEQ ID NO: 9440147 - DNA, 18 bp, Homo sapiens
tgagacagctaccacttg

SEQ ID NO: 9440148 - DNA, 22 bp, Homo sapiens
tgagacaggagaggcccctcct

SEQ ID NO: 9440149 - DNA, 22 bp, Homo sapiens
tgagacagcccttctgcacagg

SEQ ID NO: 9440150 - DNA, 22 bp, Homo sapiens
tgagacagcagtcagggaaata

SEQ ID NO: 9440151 - DNA, 22 bp, Homo sapiens
tgagacagcccttctgcacagg

SEQ ID NO: 9440152 - DNA, 22 bp, Homo sapiens
tgagacagcctctgcactcatg

SEQ ID NO: 9440153 - DNA, 22 bp, Homo sapiens
tgagacagcccttctgcacagg

SEQ ID NO: 9440154 - DNA, 22 bp, Homo sapiens
tgagacagcctctgcactcatg

SEQ ID NO: 9440155 - DNA, 22 bp, Homo sapiens
tgagacagggtcttgctctgtt

SEQ ID NO: 9440156 - DNA, 17 bp, Homo sapiens
tgagacagggcaggccc

SEQ ID NO: 9440157 - DNA, 17 bp, Homo sapiens
tgagacagggcaggccc

SEQ ID NO: 9440158 - DNA, 17 bp, Homo sapiens
tgagacagggcaggccc

SEQ ID NO: 9440159 - DNA, 22 bp, Homo sapiens
tgagacagggtcttgctctgtt

SEQ ID NO: 9440160 - DNA, 17 bp, Homo sapiens
tgagacagggcaggccc

SEQ ID NO: 9440161 - DNA, 22 bp, Homo sapiens
tgagacagtcaccaggcaggcc

SEQ ID NO: 9440162 - DNA, 22 bp, Homo sapiens
tgagacagtatcgccccaaggc

SEQ ID NO: 9440163 - DNA, 22 bp, Homo sapiens
tgagacagtaattgtatagttt

SEQ ID NO: 9440164 - DNA, 22 bp, Homo sapiens
tgagacagttctgcagctgggt

SEQ ID NO: 9440165 - DNA, 22 bp, Homo sapiens
tgagacagtcccatgatctgca

SEQ ID NO: 9440166 - DNA, 22 bp, Homo sapiens
tgagacagtcaccaggcaggcc

SEQ ID NO: 9440167 - DNA, 22 bp, Homo sapiens
tgagacaaaattgacagacaaa

SEQ ID NO: 9440168 - DNA, 22 bp, Homo sapiens
tgagaattttttgtcatgcatt

SEQ ID NO: 9440169 - DNA, 22 bp, Homo sapiens
tgagaatttttggcagaaacaa

SEQ ID NO: 9440170 - DNA, 22 bp, Homo sapiens
tgagaattttcagtttcacttt

SEQ ID NO: 9440171 - DNA, 22 bp, Homo sapiens
tgagaattttttgtcatgcatt

SEQ ID NO: 9440172 - DNA, 22 bp, Homo sapiens
tgagaatttgcatttctaacaa

SEQ ID NO: 9440173 - DNA, 22 bp, Homo sapiens
tgagaattctacaatagatcaa

SEQ ID NO: 9440174 - DNA, 22 bp, Homo sapiens
tgagaagctgcttgtgctgtat

SEQ ID NO: 9440175 - DNA, 22 bp, Homo sapiens
tgagaatgccataagagctatt

SEQ ID NO: 9440176 - DNA, 22 bp, Homo sapiens
tgagaagctgcttgtgctgtat

SEQ ID NO: 9440177 - DNA, 22 bp, Homo sapiens
tgagaattacaaatgagtcaca

SEQ ID NO: 9440178 - DNA, 18 bp, Homo sapiens
tgagaatgtaagaaatgg

SEQ ID NO: 9440179 - DNA, 18 bp, Homo sapiens
tgagaatgtaagaaatgg

SEQ ID NO: 9440180 - DNA, 22 bp, Homo sapiens
tgagaagctgctgacttagcct

SEQ ID NO: 9440181 - DNA, 20 bp, Homo sapiens
tgagaagctcctgtctcctc

SEQ ID NO: 9440182 - DNA, 22 bp, Homo sapiens
tgagacaataaggctgagaagc

SEQ ID NO: 9440183 - DNA, 22 bp, Homo sapiens
tgagacaatatcctttgtaacc

SEQ ID NO: 9440184 - DNA, 23 bp, Homo sapiens
tgagacactcattcatggagtat

SEQ ID NO: 9440185 - DNA, 22 bp, Homo sapiens
tgagacaaaattgacagacaaa

SEQ ID NO: 9440186 - DNA, 22 bp, Homo sapiens
tgagacaacagcttgtgctgct

SEQ ID NO: 9440187 - DNA, 20 bp, Homo sapiens
tgagacaaggctggagagac

SEQ ID NO: 9440188 - DNA, 22 bp, Homo sapiens
tgagacaaggaaaggaagctga

SEQ ID NO: 9440189 - DNA, 22 bp, Homo sapiens
tgagacaacctaattaaacacc

SEQ ID NO: 9440190 - DNA, 22 bp, Homo sapiens
tgagacaacattgggcaagtcc

SEQ ID NO: 9440191 - DNA, 19 bp, Homo sapiens
tgagacagagaccagttct

SEQ ID NO: 9440192 - DNA, 22 bp, Homo sapiens
tgagacagcagtcagggaaata

SEQ ID NO: 9440193 - DNA, 22 bp, Homo sapiens
tgagacagcagattagcaatga

SEQ ID NO: 9440194 - DNA, 19 bp, Homo sapiens
tgagacagaagatgagcct

SEQ ID NO: 9440195 - DNA, 19 bp, Homo sapiens
tgagacagaagatgagcct

SEQ ID NO: 9440196 - DNA, 19 bp, Homo sapiens
tgagacagaagatgagcct

SEQ ID NO: 9440197 - DNA, 20 bp, Homo sapiens
tgagaaagtagagactcagg

SEQ ID NO: 9440198 - DNA, 20 bp, Homo sapiens
tgagaaagtagagactcagg

SEQ ID NO: 9440199 - DNA, 20 bp, Homo sapiens
tgagaaagtagagactcagg

SEQ ID NO: 9440200 - DNA, 22 bp, Homo sapiens
tgagaaaggtatttcatgcact

SEQ ID NO: 9440201 - DNA, 22 bp, Homo sapiens
tgagaaagtgggtgcctagcaa

SEQ ID NO: 9440202 - DNA, 22 bp, Homo sapiens
tgagaaatattgcacagtgagg

SEQ ID NO: 9440203 - DNA, 22 bp, Homo sapiens
tgagaaatggcagcattactgg

SEQ ID NO: 9440204 - DNA, 22 bp, Homo sapiens
tgagaaatggcagcattactgg

SEQ ID NO: 9440205 - DNA, 22 bp, Homo sapiens
tgagaaatgggtctgctgaaga

SEQ ID NO: 9440206 - DNA, 22 bp, Homo sapiens
tgagaaatgggtctgctgaaga

SEQ ID NO: 9440207 - DNA, 22 bp, Homo sapiens
tgagaaattcgacatatattta

SEQ ID NO: 9440208 - DNA, 22 bp, Homo sapiens
tgagaaattcgacatatattta

SEQ ID NO: 9440209 - DNA, 22 bp, Homo sapiens
tgagaaaggtatttcatgcact

SEQ ID NO: 9440210 - DNA, 22 bp, Homo sapiens
tgagaaagcctttagtcccagg

SEQ ID NO: 9440211 - DNA, 22 bp, Homo sapiens
tgagaaacatatgagagatttg

SEQ ID NO: 9440212 - DNA, 22 bp, Homo sapiens
tgagaaacttgccaagcatctc

SEQ ID NO: 9440213 - DNA, 22 bp, Homo sapiens
tgagaaacacaggcatgaatag

SEQ ID NO: 9440214 - DNA, 22 bp, Homo sapiens
tgagaaacacaggcatgaatag

SEQ ID NO: 9440215 - DNA, 22 bp, Homo sapiens
tgagaaacatatgagagatttg

SEQ ID NO: 9440216 - DNA, 22 bp, Homo sapiens
tgagaaaattactataattgtc

SEQ ID NO: 9440217 - DNA, 22 bp, Homo sapiens
tgagaaaattactataattgtc

SEQ ID NO: 9440218 - DNA, 22 bp, Homo sapiens
tgagaaaattactataattgtc

SEQ ID NO: 9440219 - DNA, 22 bp, Homo sapiens
tgagaaaagtgtggaggtcaat

SEQ ID NO: 9440220 - DNA, 22 bp, Homo sapiens
tgagaaaatccagaggctagtt

SEQ ID NO: 9440221 - DNA, 22 bp, Homo sapiens
tgagaacttgtgctattgcaca

SEQ ID NO: 9440222 - DNA, 22 bp, Homo sapiens
tgagaaccatgaaaagctgtca

SEQ ID NO: 9440223 - DNA, 22 bp, Homo sapiens
tgagaacggatactaagggctg

SEQ ID NO: 9440224 - DNA, 23 bp, Homo sapiens
tgagaaattttgattcagtagga

SEQ ID NO: 9440225 - DNA, 22 bp, Homo sapiens
tgagaacatacaaacagagaaa

SEQ ID NO: 9440226 - DNA, 22 bp, Homo sapiens
tgagaacagttggaagcagtca

SEQ ID NO: 9440227 - DNA, 22 bp, Homo sapiens
tgagaacagttggaagcagtca

SEQ ID NO: 9440228 - DNA, 22 bp, Homo sapiens
tgagaacatttgcagggagagt

SEQ ID NO: 9440229 - DNA, 22 bp, Homo sapiens
tgagaacattgggaaagctatg

SEQ ID NO: 9440230 - DNA, 22 bp, Homo sapiens
tgagaagcagcttacaggtgtc

SEQ ID NO: 9440231 - DNA, 22 bp, Homo sapiens
tgagaagcagcttacaggtgtc

SEQ ID NO: 9440232 - DNA, 22 bp, Homo sapiens
tgagaagcagtttcagtaagaa

SEQ ID NO: 9440233 - DNA, 22 bp, Homo sapiens
tgagaagcagcttacaggtgtc

SEQ ID NO: 9440234 - DNA, 22 bp, Homo sapiens
tgagaagattgggcagagtgga

SEQ ID NO: 9440235 - DNA, 22 bp, Homo sapiens
tgagaagatttgctcttctgag

SEQ ID NO: 9440236 - DNA, 22 bp, Homo sapiens
tgagaagagcaaggaactggtt

SEQ ID NO: 9440237 - DNA, 22 bp, Homo sapiens
tgagaagattgggcagagtgga

SEQ ID NO: 9440238 - DNA, 23 bp, Homo sapiens
tgagaagccgccgggcagcctgg

SEQ ID NO: 9440239 - DNA, 23 bp, Homo sapiens
tgagaagccattagagcaggtgg

SEQ ID NO: 9440240 - DNA, 23 bp, Homo sapiens
tgagaagccaggggagcgtgagg

SEQ ID NO: 9440241 - DNA, 18 bp, Homo sapiens
tgagagaatgttcatgct

SEQ ID NO: 9440242 - DNA, 18 bp, Homo sapiens
tgagagaatgttcatgct

SEQ ID NO: 9440243 - DNA, 18 bp, Homo sapiens
tgagagaatgttcatgct

SEQ ID NO: 9440244 - DNA, 22 bp, Homo sapiens
tgagagaaacgttccttacatc

SEQ ID NO: 9440245 - DNA, 22 bp, Homo sapiens
tgagagaaacgttccttacatc

SEQ ID NO: 9440246 - DNA, 22 bp, Homo sapiens
tgagacttgtgagtccttctag

SEQ ID NO: 9440247 - DNA, 21 bp, Homo sapiens
tgagagactggtggatacagg

SEQ ID NO: 9440248 - DNA, 22 bp, Homo sapiens
tgagagagcctgaatctcttac

SEQ ID NO: 9440249 - DNA, 22 bp, Homo sapiens
tgagagagggatgcaccctcct

SEQ ID NO: 9440250 - DNA, 22 bp, Homo sapiens
tgagagaggatgccctcatatt

SEQ ID NO: 9440251 - DNA, 22 bp, Homo sapiens
tgagagagcgcctgggatcatt

SEQ ID NO: 9440252 - DNA, 22 bp, Homo sapiens
tgagagaggggactgcctgctt

SEQ ID NO: 9440253 - DNA, 21 bp, Homo sapiens
tgagagagtagcaggacatat

SEQ ID NO: 9440254 - DNA, 22 bp, Homo sapiens
tgagagagtaattgagtggtaa

SEQ ID NO: 9440255 - DNA, 22 bp, Homo sapiens
tgagagattttcatgagtgctt

SEQ ID NO: 9440256 - DNA, 22 bp, Homo sapiens
tgagagatgaagttagttgttc

SEQ ID NO: 9440257 - DNA, 22 bp, Homo sapiens
tgagagattgctgtatgttttg

SEQ ID NO: 9440258 - DNA, 22 bp, Homo sapiens
tgagagatgaagttagttgttc

SEQ ID NO: 9440259 - DNA, 22 bp, Homo sapiens
tgagagatgaactctgatatgt

SEQ ID NO: 9440260 - DNA, 22 bp, Homo sapiens
tgagagcagaggtgggcagcct

SEQ ID NO: 9440261 - DNA, 22 bp, Homo sapiens
tgagagccagaagggcctgagg

SEQ ID NO: 9440262 - DNA, 17 bp, Homo sapiens
tgagagcagggctgggc

SEQ ID NO: 9440263 - DNA, 17 bp, Homo sapiens
tgagagcagggctgggc

SEQ ID NO: 9440264 - DNA, 22 bp, Homo sapiens
tgagagcagaggtgggcagcct

SEQ ID NO: 9440265 - DNA, 23 bp, Homo sapiens
tgagagcctggcagcctgggttc

SEQ ID NO: 9440266 - DNA, 23 bp, Homo sapiens
tgagagcctggcagcctgggttc

SEQ ID NO: 9440267 - DNA, 18 bp, Homo sapiens
tgagagcctgcttgtccc

SEQ ID NO: 9440268 - DNA, 21 bp, Homo sapiens
tgagagcctccaaccggctac

SEQ ID NO: 9440269 - DNA, 22 bp, Homo sapiens
tgagagccaggatctgctctat

SEQ ID NO: 9440270 - DNA, 22 bp, Homo sapiens
tgagagccaggatctgctctat

SEQ ID NO: 9440271 - DNA, 22 bp, Homo sapiens
tgagagccagaagggcctgagg

SEQ ID NO: 9440272 - DNA, 22 bp, Homo sapiens
tgagagccaggatctgctctat

SEQ ID NO: 9440273 - DNA, 22 bp, Homo sapiens
tgagaggaacaggcagtaggtt

SEQ ID NO: 9440274 - DNA, 22 bp, Homo sapiens
tgagagcttgagtatcactggc

SEQ ID NO: 9440275 - DNA, 22 bp, Homo sapiens
tgagagctgtccacctgtggga

SEQ ID NO: 9440276 - DNA, 20 bp, Homo sapiens
tgagagctgggcagggatac

SEQ ID NO: 9440277 - DNA, 22 bp, Homo sapiens
tgagagctgccacgtgaccatg

SEQ ID NO: 9440278 - DNA, 22 bp, Homo sapiens
tgagagctgctgagactgtcct

SEQ ID NO: 9440279 - DNA, 22 bp, Homo sapiens
tgagagctgccacgtgaccatg

SEQ ID NO: 9440280 - DNA, 22 bp, Homo sapiens
tgagagctgccacgtgaccatg

SEQ ID NO: 9440281 - DNA, 22 bp, Homo sapiens
tgagagctgaagatatgttaac

SEQ ID NO: 9440282 - DNA, 22 bp, Homo sapiens
tgagagcctgtgttcaaatgcc

SEQ ID NO: 9440283 - DNA, 22 bp, Homo sapiens
tgagaggaacaggcagtaggtt

SEQ ID NO: 9440284 - DNA, 20 bp, Homo sapiens
tgagaggacatttttcatgt

SEQ ID NO: 9440285 - DNA, 18 bp, Homo sapiens
tgagaggctattttttgc

SEQ ID NO: 9440286 - DNA, 22 bp, Homo sapiens
tgagaggctagatcagctctgt

SEQ ID NO: 9440287 - DNA, 18 bp, Homo sapiens
tgagaggctattttttgc

SEQ ID NO: 9440288 - DNA, 22 bp, Homo sapiens
tgagaggcgctcactctcaggt

SEQ ID NO: 9440289 - DNA, 22 bp, Homo sapiens
tgagaggatattttgggaggat

SEQ ID NO: 9440290 - DNA, 18 bp, Homo sapiens
tgagaggcaggtagagga

SEQ ID NO: 9440291 - DNA, 22 bp, Homo sapiens
tgagaggccccagctcttggcc

SEQ ID NO: 9440292 - DNA, 19 bp, Homo sapiens
tgagaggcttaaggcagct

SEQ ID NO: 9440293 - DNA, 18 bp, Homo sapiens
tgagaggctattttttgc

SEQ ID NO: 9440294 - DNA, 19 bp, Homo sapiens
tgagaggcttaaggcagct

SEQ ID NO: 9440295 - DNA, 22 bp, Homo sapiens
tgagagggcccagagcacacca

SEQ ID NO: 9440296 - DNA, 22 bp, Homo sapiens
tgagagggttcccaggggtttc

SEQ ID NO: 9440297 - DNA, 22 bp, Homo sapiens
tgagaggtaggaaatgaacaag

SEQ ID NO: 9440298 - DNA, 22 bp, Homo sapiens
tgagaggtaggaaatgaacaag

SEQ ID NO: 9440299 - DNA, 22 bp, Homo sapiens
tgagagggcccagagcacacca

SEQ ID NO: 9440300 - DNA, 22 bp, Homo sapiens
tgagagggcccagagcacacca

SEQ ID NO: 9440301 - DNA, 22 bp, Homo sapiens
tgagatagtatatggaaagagt

SEQ ID NO: 9440302 - DNA, 22 bp, Homo sapiens
tgagatagtatgtagcacctga

SEQ ID NO: 9440303 - DNA, 22 bp, Homo sapiens
tgagaggtcaaagggcatggag

SEQ ID NO: 9440304 - DNA, 22 bp, Homo sapiens
tgagataatacttcttagctgg

SEQ ID NO: 9440305 - DNA, 22 bp, Homo sapiens
tgagataataaatagctttctt

SEQ ID NO: 9440306 - DNA, 22 bp, Homo sapiens
tgagataatcatgtgatttcat

SEQ ID NO: 9440307 - DNA, 22 bp, Homo sapiens
tgagataatacttcttagctgg

SEQ ID NO: 9440308 - DNA, 22 bp, Homo sapiens
tgagataattaaatcaaaacct

SEQ ID NO: 9440309 - DNA, 22 bp, Homo sapiens
tgagatcatttatttacctttc

SEQ ID NO: 9440310 - DNA, 22 bp, Homo sapiens
tgagatcattgacttgttcctg

SEQ ID NO: 9440311 - DNA, 22 bp, Homo sapiens
tgagatccccaggaaggacaac

SEQ ID NO: 9440312 - DNA, 23 bp, Homo sapiens
tgagatcgcccagctggtaggca

SEQ ID NO: 9440313 - DNA, 22 bp, Homo sapiens
tgagatcttcgctcttcacaga

SEQ ID NO: 9440314 - DNA, 22 bp, Homo sapiens
tgagatgaataactcctgctaa

SEQ ID NO: 9440315 - DNA, 22 bp, Homo sapiens
tgagatgatgggataagagggc

SEQ ID NO: 9440316 - DNA, 22 bp, Homo sapiens
tgagatgctgctgtaacaaata

SEQ ID NO: 9440317 - DNA, 21 bp, Homo sapiens
tgagatgctagaaggcaggga

SEQ ID NO: 9440318 - DNA, 22 bp, Homo sapiens
tgagatggaaggtgaggcagta

SEQ ID NO: 9440319 - DNA, 22 bp, Homo sapiens
tgagatggaaggtgaggcagta

SEQ ID NO: 9440320 - DNA, 22 bp, Homo sapiens
tgagatggagccactgcactct

SEQ ID NO: 9440321 - DNA, 22 bp, Homo sapiens
tgagatggaaggtgaggcagta

SEQ ID NO: 9440322 - DNA, 22 bp, Homo sapiens
tgagatgctgggaacaaggaag

SEQ ID NO: 9440323 - DNA, 22 bp, Homo sapiens
tgagatggagtcttgctctgtt

SEQ ID NO: 9440324 - DNA, 22 bp, Homo sapiens
tgagatggagttctgctcttgt

SEQ ID NO: 9440325 - DNA, 22 bp, Homo sapiens
tgagatggagtcttgctctgtt

SEQ ID NO: 9440326 - DNA, 22 bp, Homo sapiens
tgagatggagttctgctcttgt

SEQ ID NO: 9440327 - DNA, 22 bp, Homo sapiens
tgagatggggagggctgcagaa

SEQ ID NO: 9440328 - DNA, 22 bp, Homo sapiens
tgagatggggtcatgctttgtc

SEQ ID NO: 9440329 - DNA, 22 bp, Homo sapiens
tgagatggggtcatgctttgtc

SEQ ID NO: 9440330 - DNA, 22 bp, Homo sapiens
tgagatggggagggctgcagaa

SEQ ID NO: 9440331 - DNA, 22 bp, Homo sapiens
tgagatgggtcatcaggtttgg

SEQ ID NO: 9440332 - DNA, 22 bp, Homo sapiens
tgagatgggtggggagctcagg

SEQ ID NO: 9440333 - DNA, 22 bp, Homo sapiens
tgagatggggagggctgcagaa

SEQ ID NO: 9440334 - DNA, 22 bp, Homo sapiens
tgagatggctgggccccaggag

SEQ ID NO: 9440335 - DNA, 22 bp, Homo sapiens
tgagatggagttttggggatat

SEQ ID NO: 9440336 - DNA, 22 bp, Homo sapiens
tgagatggattgggttggttcc

SEQ ID NO: 9440337 - DNA, 22 bp, Homo sapiens
tgagatggcaacaccagctttg

SEQ ID NO: 9440338 - DNA, 22 bp, Homo sapiens
tgagatggttcacagagaaggc

SEQ ID NO: 9440339 - DNA, 22 bp, Homo sapiens
tgagatgggtgtccagggagga

SEQ ID NO: 9440340 - DNA, 22 bp, Homo sapiens
tgagatgggtgggtagccaagg

SEQ ID NO: 9440341 - DNA, 22 bp, Homo sapiens
tgagatgggtgtccagggagga

SEQ ID NO: 9440342 - DNA, 22 bp, Homo sapiens
tgagatggttcacagagaaggc

SEQ ID NO: 9440343 - DNA, 22 bp, Homo sapiens
tgagatggttcacagagaaggc

SEQ ID NO: 9440344 - DNA, 22 bp, Homo sapiens
tgagatggttcacagagaaggc

SEQ ID NO: 9440345 - DNA, 22 bp, Homo sapiens
tgagatggttcacagagaaggc

SEQ ID NO: 9440346 - DNA, 22 bp, Homo sapiens
tgagattcagttgattagtgat

SEQ ID NO: 9440347 - DNA, 22 bp, Homo sapiens
tgagatttcgccgacagtattt

SEQ ID NO: 9440348 - DNA, 19 bp, Homo sapiens
tgagatttcttaggtgatt

SEQ ID NO: 9440349 - DNA, 22 bp, Homo sapiens
tgagatttcgccgacagtattt

SEQ ID NO: 9440350 - DNA, 22 bp, Homo sapiens
tgagatttcgccgacagtattt

SEQ ID NO: 9440351 - DNA, 20 bp, Homo sapiens
tgagatttgtattataagtc

SEQ ID NO: 9440352 - DNA, 20 bp, Homo sapiens
tgagatttgtattataagtc

SEQ ID NO: 9440353 - DNA, 22 bp, Homo sapiens
tgagatttgggttgtttaacat

SEQ ID NO: 9440354 - DNA, 22 bp, Homo sapiens
tgagattttaatattgagaaaa

SEQ ID NO: 9440355 - DNA, 22 bp, Homo sapiens
tgagatttgttttataaaatag

SEQ ID NO: 9440356 - DNA, 22 bp, Homo sapiens
tgagcaaaagttgatggtgctt

SEQ ID NO: 9440357 - DNA, 21 bp, Homo sapiens
tgagcaaaatttagagtgatg

SEQ ID NO: 9440358 - DNA, 21 bp, Homo sapiens
tgagcaaaatttagagtgatg

SEQ ID NO: 9440359 - DNA, 22 bp, Homo sapiens
tgagcagggactttggagtctg

SEQ ID NO: 9440360 - DNA, 22 bp, Homo sapiens
tgagcagggactttggagtctg

SEQ ID NO: 9440361 - DNA, 22 bp, Homo sapiens
tgagcagggactttggagtctg

SEQ ID NO: 9440362 - DNA, 22 bp, Homo sapiens
tgagcagggactttggagtctg

SEQ ID NO: 9440363 - DNA, 22 bp, Homo sapiens
tgagcagggactttggagtctg

SEQ ID NO: 9440364 - DNA, 22 bp, Homo sapiens
tgagcagggagctgggctgagc

SEQ ID NO: 9440365 - DNA, 19 bp, Homo sapiens
tgagcatgcgagctgagaa

SEQ ID NO: 9440366 - DNA, 19 bp, Homo sapiens
tgagcatgcgagctgagaa

SEQ ID NO: 9440367 - DNA, 22 bp, Homo sapiens
tgagcatggtgggtgcagagca

SEQ ID NO: 9440368 - DNA, 22 bp, Homo sapiens
tgagcatggtgggtgcagagca

SEQ ID NO: 9440369 - DNA, 22 bp, Homo sapiens
tgagcatagcccttctagtgtt

SEQ ID NO: 9440370 - DNA, 22 bp, Homo sapiens
tgagcagttcgacttcttcccc

SEQ ID NO: 9440371 - DNA, 22 bp, Homo sapiens
tgagccagagtggagtgtgcct

SEQ ID NO: 9440372 - DNA, 22 bp, Homo sapiens
tgagccagagtggagtgtgcct

SEQ ID NO: 9440373 - DNA, 22 bp, Homo sapiens
tgagccagagtggagtgtgcct

SEQ ID NO: 9440374 - DNA, 22 bp, Homo sapiens
tgagccagataagggctcacgc

SEQ ID NO: 9440375 - DNA, 22 bp, Homo sapiens
tgagccagagaggttgaggcta

SEQ ID NO: 9440376 - DNA, 22 bp, Homo sapiens
tgagccagagaggttgaggcta

SEQ ID NO: 9440377 - DNA, 22 bp, Homo sapiens
tgagccaatgatttgaatagag

SEQ ID NO: 9440378 - DNA, 22 bp, Homo sapiens
tgagccaagttcacaccattgc

SEQ ID NO: 9440379 - DNA, 22 bp, Homo sapiens
tgagccaatgatttgaatagag

SEQ ID NO: 9440380 - DNA, 22 bp, Homo sapiens
tgagcattacctgaggccactg

SEQ ID NO: 9440381 - DNA, 20 bp, Homo sapiens
tgagccaaacgatgaagagc

SEQ ID NO: 9440382 - DNA, 20 bp, Homo sapiens
tgagccaaacgatgaagagc

SEQ ID NO: 9440383 - DNA, 22 bp, Homo sapiens
tgagccaaggcctcaagaattt

SEQ ID NO: 9440384 - DNA, 22 bp, Homo sapiens
tgagccaaggcctcaagaattt

SEQ ID NO: 9440385 - DNA, 22 bp, Homo sapiens
tgagccaaggagcaaagcctca

SEQ ID NO: 9440386 - DNA, 22 bp, Homo sapiens
tgagccaagcagcttcccaggg

SEQ ID NO: 9440387 - DNA, 22 bp, Homo sapiens
tgagccaaacttctccttggtc

SEQ ID NO: 9440388 - DNA, 22 bp, Homo sapiens
tgagccaggcccagtggggtca

SEQ ID NO: 9440389 - DNA, 22 bp, Homo sapiens
tgagccaggcactgctcctgga

SEQ ID NO: 9440390 - DNA, 22 bp, Homo sapiens
tgagccaggcactgctcctgga

SEQ ID NO: 9440391 - DNA, 22 bp, Homo sapiens
tgagccaggcccagtggggtca

SEQ ID NO: 9440392 - DNA, 20 bp, Homo sapiens
tgagccaggctaggaagggc

SEQ ID NO: 9440393 - DNA, 22 bp, Homo sapiens
tgagccaggctcaagtgatcct

SEQ ID NO: 9440394 - DNA, 20 bp, Homo sapiens
tgagccaggctaggaagggc

SEQ ID NO: 9440395 - DNA, 22 bp, Homo sapiens
tgagccaggctccatgccacct

SEQ ID NO: 9440396 - DNA, 22 bp, Homo sapiens
tgagccaggctcaagtgatcct

SEQ ID NO: 9440397 - DNA, 21 bp, Homo sapiens
tgagccaggctgacggctgtg

SEQ ID NO: 9440398 - DNA, 21 bp, Homo sapiens
tgagccaggctgacggctgtg

SEQ ID NO: 9440399 - DNA, 22 bp, Homo sapiens
tgagccaggctccatgccacct

SEQ ID NO: 9440400 - DNA, 22 bp, Homo sapiens
tgagccaggctccatgccacct

SEQ ID NO: 9440401 - DNA, 22 bp, Homo sapiens
tgagccagggtttccggctgct

SEQ ID NO: 9440402 - DNA, 19 bp, Homo sapiens
tgagccagggaggccatgc

SEQ ID NO: 9440403 - DNA, 19 bp, Homo sapiens
tgagccagggaggccatgc

SEQ ID NO: 9440404 - DNA, 19 bp, Homo sapiens
tgagccagggaggccatgc

SEQ ID NO: 9440405 - DNA, 21 bp, Homo sapiens
tgagccaggctgacggctgtg

SEQ ID NO: 9440406 - DNA, 22 bp, Homo sapiens
tgagccaggagtttgaggctgt

SEQ ID NO: 9440407 - DNA, 22 bp, Homo sapiens
tgagccagctccttgcctgtca

SEQ ID NO: 9440408 - DNA, 22 bp, Homo sapiens
tgagccaggcactgctcctgga

SEQ ID NO: 9440409 - DNA, 22 bp, Homo sapiens
tgagccaggagtttgaggctgt

SEQ ID NO: 9440410 - DNA, 22 bp, Homo sapiens
tgagccaggagtttgaggctgt

SEQ ID NO: 9440411 - DNA, 22 bp, Homo sapiens
tgagccagccttgcagctgtgc

SEQ ID NO: 9440412 - DNA, 22 bp, Homo sapiens
tgagccagcctcagaagtcacg

SEQ ID NO: 9440413 - DNA, 22 bp, Homo sapiens
tgagccagccttgcagctgtgc

SEQ ID NO: 9440414 - DNA, 22 bp, Homo sapiens
tgagccagataagggctcacgc

SEQ ID NO: 9440415 - DNA, 22 bp, Homo sapiens
tgagccagcaggcctccagtgg

SEQ ID NO: 9440416 - DNA, 22 bp, Homo sapiens
tgagcagagatgactgggcatt

SEQ ID NO: 9440417 - DNA, 22 bp, Homo sapiens
tgagcagagcaataggactctc

SEQ ID NO: 9440418 - DNA, 22 bp, Homo sapiens
tgagcagagcaataggactctc

SEQ ID NO: 9440419 - DNA, 22 bp, Homo sapiens
tgagcagagcaataggactctc

SEQ ID NO: 9440420 - DNA, 22 bp, Homo sapiens
tgagcagagcaggctgcgccct

SEQ ID NO: 9440421 - DNA, 21 bp, Homo sapiens
tgagcaccagctgcatgcccc

SEQ ID NO: 9440422 - DNA, 20 bp, Homo sapiens
tgagcaccaagaatcaagaa

SEQ ID NO: 9440423 - DNA, 22 bp, Homo sapiens
tgagcagagacttcaagggcag

SEQ ID NO: 9440424 - DNA, 21 bp, Homo sapiens
tgagcaccagctgcatgcccc

SEQ ID NO: 9440425 - DNA, 22 bp, Homo sapiens
tgagcaccaggcaccacagctc

SEQ ID NO: 9440426 - DNA, 23 bp, Homo sapiens
tgagcaagtgaccaactgtctgt

SEQ ID NO: 9440427 - DNA, 22 bp, Homo sapiens
tgagcaagagaaactgactgta

SEQ ID NO: 9440428 - DNA, 22 bp, Homo sapiens
tgagcaagagaaactgactgta

SEQ ID NO: 9440429 - DNA, 22 bp, Homo sapiens
tgagcacagctttcactagaaa

SEQ ID NO: 9440430 - DNA, 19 bp, Homo sapiens
tgagcacacctgtacaccc

SEQ ID NO: 9440431 - DNA, 22 bp, Homo sapiens
tgagcagaggagtgacgtaggt

SEQ ID NO: 9440432 - DNA, 22 bp, Homo sapiens
tgagcagaggagtgacgtaggt

SEQ ID NO: 9440433 - DNA, 22 bp, Homo sapiens
tgagcagaggccagcacctggg

SEQ ID NO: 9440434 - DNA, 22 bp, Homo sapiens
tgagcagagcagtaacaggagc

SEQ ID NO: 9440435 - DNA, 22 bp, Homo sapiens
tgagcagaggaggctgccaact

SEQ ID NO: 9440436 - DNA, 22 bp, Homo sapiens
tgagcagaggaggctgccaact

SEQ ID NO: 9440437 - DNA, 18 bp, Homo sapiens
tgagcagagtaaggcttt

SEQ ID NO: 9440438 - DNA, 22 bp, Homo sapiens
tgagcagagtcgctccagagtg

SEQ ID NO: 9440439 - DNA, 22 bp, Homo sapiens
tgagcagagtcgctccagagtg

SEQ ID NO: 9440440 - DNA, 22 bp, Homo sapiens
tgagcagagtcgctccagagtg

SEQ ID NO: 9440441 - DNA, 22 bp, Homo sapiens
tgagcagagttgtttctcctga

SEQ ID NO: 9440442 - DNA, 22 bp, Homo sapiens
tgagcagatggaggcttctgca

SEQ ID NO: 9440443 - DNA, 22 bp, Homo sapiens
tgagcagatgtctaacttttac

SEQ ID NO: 9440444 - DNA, 22 bp, Homo sapiens
tgagcagatggaggcttctgca

SEQ ID NO: 9440445 - DNA, 22 bp, Homo sapiens
tgagcagatggaggcttctgca

SEQ ID NO: 9440446 - DNA, 22 bp, Homo sapiens
tgagcagagttgtttctcctga

SEQ ID NO: 9440447 - DNA, 22 bp, Homo sapiens
tgagcaggcgcagcaggaggtc

SEQ ID NO: 9440448 - DNA, 22 bp, Homo sapiens
tgagcaggcgcagcaggaggtc

SEQ ID NO: 9440449 - DNA, 21 bp, Homo sapiens
tgagcaggagtcatgggaatg

SEQ ID NO: 9440450 - DNA, 22 bp, Homo sapiens
tgagcaggagataaacaggtag

SEQ ID NO: 9440451 - DNA, 22 bp, Homo sapiens
tgagcaggattcgcctcttgca

SEQ ID NO: 9440452 - DNA, 22 bp, Homo sapiens
tgagcaggcgcagcaggaggtc

SEQ ID NO: 9440453 - DNA, 22 bp, Homo sapiens
tgagcaggcgcagcaggaggtc

SEQ ID NO: 9440454 - DNA, 22 bp, Homo sapiens
tgagcaggcgcagcaggaggtc

SEQ ID NO: 9440455 - DNA, 22 bp, Homo sapiens
tgagcaggctcccacttcagtg

SEQ ID NO: 9440456 - DNA, 22 bp, Homo sapiens
tgagcagggactttgagtgtag

SEQ ID NO: 9440457 - DNA, 23 bp, Homo sapiens
tgagcagctaaaggtgatgcggg

SEQ ID NO: 9440458 - DNA, 22 bp, Homo sapiens
tgagcagctactgtgttcaggg

SEQ ID NO: 9440459 - DNA, 22 bp, Homo sapiens
tgagcagcccttcctccggcca

SEQ ID NO: 9440460 - DNA, 23 bp, Homo sapiens
tgagcagctaaaggtgatgcggg

SEQ ID NO: 9440461 - DNA, 22 bp, Homo sapiens
tgagcagcccttcctccggcca

SEQ ID NO: 9440462 - DNA, 22 bp, Homo sapiens
tgagcagcaggatcttctggta

SEQ ID NO: 9440463 - DNA, 22 bp, Homo sapiens
tgagcagcaggatcttctggta

SEQ ID NO: 9440464 - DNA, 22 bp, Homo sapiens
tgagcagcaactgtccatggca

SEQ ID NO: 9440465 - DNA, 22 bp, Homo sapiens
tgagcagatgtgccaaactgta

SEQ ID NO: 9440466 - DNA, 22 bp, Homo sapiens
tgagcagcaactgtccatggca

SEQ ID NO: 9440467 - DNA, 22 bp, Homo sapiens
tgagcagcaactgtccatggca

SEQ ID NO: 9440468 - DNA, 22 bp, Homo sapiens
tgagcagatttgttctaggggt

SEQ ID NO: 9440469 - DNA, 22 bp, Homo sapiens
tgagcaggactcactgcagcct

SEQ ID NO: 9440470 - DNA, 22 bp, Homo sapiens
tgagcaggactcactgcagcct

SEQ ID NO: 9440471 - DNA, 22 bp, Homo sapiens
tgagcagcttctgtctgaaggc

SEQ ID NO: 9440472 - DNA, 22 bp, Homo sapiens
tgagcagcttctgtctgaaggc

SEQ ID NO: 9440473 - DNA, 22 bp, Homo sapiens
tgagcagcttctgtctgaaggc

SEQ ID NO: 9440474 - DNA, 22 bp, Homo sapiens
tgagcagcttgttccgagtgtt

SEQ ID NO: 9440475 - DNA, 22 bp, Homo sapiens
tgagcaggactcactgcagcct

SEQ ID NO: 9440476 - DNA, 22 bp, Homo sapiens
tgagcaggactgaccggcctta

SEQ ID NO: 9440477 - DNA, 22 bp, Homo sapiens
tgagcaggactcactgcagcct

SEQ ID NO: 9440478 - DNA, 22 bp, Homo sapiens
tgagcaggagataaacaggtag

SEQ ID NO: 9440479 - DNA, 22 bp, Homo sapiens
tgagcaggactgaccggcctta

SEQ ID NO: 9440480 - DNA, 22 bp, Homo sapiens
tgagctggagtcgtgagcaaag

SEQ ID NO: 9440481 - DNA, 22 bp, Homo sapiens
tgagctggagtcgtgagcaaag

SEQ ID NO: 9440482 - DNA, 22 bp, Homo sapiens
tgagctggtcactccttctgaa

SEQ ID NO: 9440483 - DNA, 22 bp, Homo sapiens
tgagctggaatcttcttgactg

SEQ ID NO: 9440484 - DNA, 22 bp, Homo sapiens
tgagctggaatcttcttgactg

SEQ ID NO: 9440485 - DNA, 22 bp, Homo sapiens
tgagctggaggacaggagggta

SEQ ID NO: 9440486 - DNA, 22 bp, Homo sapiens
tgagctggttcttgaggcatga

SEQ ID NO: 9440487 - DNA, 22 bp, Homo sapiens
tgagctggttcttgaggcatga

SEQ ID NO: 9440488 - DNA, 22 bp, Homo sapiens
tgagctggtcttgagtgtagct

SEQ ID NO: 9440489 - DNA, 22 bp, Homo sapiens
tgagctggtcactccttctgaa

SEQ ID NO: 9440490 - DNA, 22 bp, Homo sapiens
tgagctggtcttgagtgtagct

SEQ ID NO: 9440491 - DNA, 22 bp, Homo sapiens
tgagctggtcactccttctgaa

SEQ ID NO: 9440492 - DNA, 22 bp, Homo sapiens
tgagctccggcatatggaatta

SEQ ID NO: 9440493 - DNA, 22 bp, Homo sapiens
tgagctgataggctgtgagcct

SEQ ID NO: 9440494 - DNA, 22 bp, Homo sapiens
tgagctgatggcatccctgttt

SEQ ID NO: 9440495 - DNA, 22 bp, Homo sapiens
tgagctgatggcatccctgttt

SEQ ID NO: 9440496 - DNA, 22 bp, Homo sapiens
tgagctgcagtgagctgagatg

SEQ ID NO: 9440497 - DNA, 19 bp, Homo sapiens
tgagctgctgctgcccatc

SEQ ID NO: 9440498 - DNA, 19 bp, Homo sapiens
tgagctgctgctgcccatc

SEQ ID NO: 9440499 - DNA, 19 bp, Homo sapiens
tgagctgctgctgcccatc

SEQ ID NO: 9440500 - DNA, 19 bp, Homo sapiens
tgagctgctgctgcccatc

SEQ ID NO: 9440501 - DNA, 22 bp, Homo sapiens
tgagctgctctaatctcgcctt

SEQ ID NO: 9440502 - DNA, 22 bp, Homo sapiens
tgagctgtactcctccccaggg

SEQ ID NO: 9440503 - DNA, 22 bp, Homo sapiens
tgagcttacgtgggaacagact

SEQ ID NO: 9440504 - DNA, 22 bp, Homo sapiens
tgagcttacttctgtacacaga

SEQ ID NO: 9440505 - DNA, 22 bp, Homo sapiens
tgagctgtgtcctgggggcagt

SEQ ID NO: 9440506 - DNA, 22 bp, Homo sapiens
tgagcttcaaagttggatctga

SEQ ID NO: 9440507 - DNA, 17 bp, Homo sapiens
tgagcttcaatcaggtg

SEQ ID NO: 9440508 - DNA, 22 bp, Homo sapiens
tgagcttcaaagttggatctga

SEQ ID NO: 9440509 - DNA, 22 bp, Homo sapiens
tgaggaaactgaggcacagatg

SEQ ID NO: 9440510 - DNA, 22 bp, Homo sapiens
tgaggaaacttacaaggcagaa

SEQ ID NO: 9440511 - DNA, 22 bp, Homo sapiens
tgaggaaacttacaaggcagaa

SEQ ID NO: 9440512 - DNA, 22 bp, Homo sapiens
tgaggaaacttacaaggcagaa

SEQ ID NO: 9440513 - DNA, 22 bp, Homo sapiens
tgaggaaacttacaaggcagaa

SEQ ID NO: 9440514 - DNA, 22 bp, Homo sapiens
tgaggaaaatgtcttatagatt

SEQ ID NO: 9440515 - DNA, 22 bp, Homo sapiens
tgaggaaactgaggcacagatg

SEQ ID NO: 9440516 - DNA, 22 bp, Homo sapiens
tgaggaaaacgtattgaaagga

SEQ ID NO: 9440517 - DNA, 22 bp, Homo sapiens
tgagcttctttatttggccaga

SEQ ID NO: 9440518 - DNA, 22 bp, Homo sapiens
tgagcttcctccctgcatccat

SEQ ID NO: 9440519 - DNA, 22 bp, Homo sapiens
tgagcttccctcctgcactaca

SEQ ID NO: 9440520 - DNA, 22 bp, Homo sapiens
tgagcttcctccctgcatccat

SEQ ID NO: 9440521 - DNA, 22 bp, Homo sapiens
tgagcttccctcctgcactaca

SEQ ID NO: 9440522 - DNA, 22 bp, Homo sapiens
tgagctttcatgtatgaaaaga

SEQ ID NO: 9440523 - DNA, 22 bp, Homo sapiens
tgagcccgtaggggccaaggct

SEQ ID NO: 9440524 - DNA, 22 bp, Homo sapiens
tgagcccatgtagcacttccat

SEQ ID NO: 9440525 - DNA, 22 bp, Homo sapiens
tgagcccatgctctttctacga

SEQ ID NO: 9440526 - DNA, 22 bp, Homo sapiens
tgagcccatgtagcacttccat

SEQ ID NO: 9440527 - DNA, 22 bp, Homo sapiens
tgagccctggagccctctgtta

SEQ ID NO: 9440528 - DNA, 22 bp, Homo sapiens
tgagccctgacctagcctggcc

SEQ ID NO: 9440529 - DNA, 22 bp, Homo sapiens
tgagccctcggctggggcagag

SEQ ID NO: 9440530 - DNA, 21 bp, Homo sapiens
tgagcccttgcctcagagccc

SEQ ID NO: 9440531 - DNA, 22 bp, Homo sapiens
tgagccgtggtctctgagggtg

SEQ ID NO: 9440532 - DNA, 22 bp, Homo sapiens
tgagccgtggtctctgagggtg

SEQ ID NO: 9440533 - DNA, 22 bp, Homo sapiens
tgagccaggtctcactcacctt

SEQ ID NO: 9440534 - DNA, 22 bp, Homo sapiens
tgagccaggttaagacaggagc

SEQ ID NO: 9440535 - DNA, 22 bp, Homo sapiens
tgagccaggtctcactcacctt

SEQ ID NO: 9440536 - DNA, 22 bp, Homo sapiens
tgagccaggtctcactcacctt

SEQ ID NO: 9440537 - DNA, 22 bp, Homo sapiens
tgagccaggttaagacaggagc

SEQ ID NO: 9440538 - DNA, 22 bp, Homo sapiens
tgagccaggttaagacaggagc

SEQ ID NO: 9440539 - DNA, 22 bp, Homo sapiens
tgagccaggttttccatcattc

SEQ ID NO: 9440540 - DNA, 20 bp, Homo sapiens
tgagccagtcaagctacatt

SEQ ID NO: 9440541 - DNA, 22 bp, Homo sapiens
tgagccaggttttccatcattc

SEQ ID NO: 9440542 - DNA, 22 bp, Homo sapiens
tgagccaggttttccatcattc

SEQ ID NO: 9440543 - DNA, 22 bp, Homo sapiens
tgagccagtctgtctgggtgaa

SEQ ID NO: 9440544 - DNA, 22 bp, Homo sapiens
tgagccagtctgtctgggtgaa

SEQ ID NO: 9440545 - DNA, 22 bp, Homo sapiens
tgagccagtggaagatggcagt

SEQ ID NO: 9440546 - DNA, 22 bp, Homo sapiens
tgagccagtggaagatggcagt

SEQ ID NO: 9440547 - DNA, 22 bp, Homo sapiens
tgagcccagtctgtctgacatg

SEQ ID NO: 9440548 - DNA, 22 bp, Homo sapiens
tgagccagtctgtctgggtgaa

SEQ ID NO: 9440549 - DNA, 22 bp, Homo sapiens
tgagccagtctctcagaaccct

SEQ ID NO: 9440550 - DNA, 22 bp, Homo sapiens
tgagccagtctctcagaaccct

SEQ ID NO: 9440551 - DNA, 22 bp, Homo sapiens
tgagcctgcaataagcacagcc

SEQ ID NO: 9440552 - DNA, 22 bp, Homo sapiens
tgagcctgcctgcaggtgtgct

SEQ ID NO: 9440553 - DNA, 22 bp, Homo sapiens
tgagcctgagttcaaggctgca

SEQ ID NO: 9440554 - DNA, 22 bp, Homo sapiens
tgagcctgcaataagcacagcc

SEQ ID NO: 9440555 - DNA, 22 bp, Homo sapiens
tgagcctgggagatggaggctg

SEQ ID NO: 9440556 - DNA, 22 bp, Homo sapiens
tgagcgtgcagtagtgttggta

SEQ ID NO: 9440557 - DNA, 22 bp, Homo sapiens
tgagctcatagctcttattatg

SEQ ID NO: 9440558 - DNA, 22 bp, Homo sapiens
tgagctaagtactctcatcaag

SEQ ID NO: 9440559 - DNA, 22 bp, Homo sapiens
tgagctacacactaggcatggg

SEQ ID NO: 9440560 - DNA, 22 bp, Homo sapiens
tgaggcttggcaaaagagtggt

SEQ ID NO: 9440561 - DNA, 22 bp, Homo sapiens
tgaggcttgtctcagatggggg

SEQ ID NO: 9440562 - DNA, 22 bp, Homo sapiens
tgaggcttgtctcagatggggg

SEQ ID NO: 9440563 - DNA, 22 bp, Homo sapiens
tgaggctttatgtaagggtgca

SEQ ID NO: 9440564 - DNA, 22 bp, Homo sapiens
tgagggaatattgatagatccg

SEQ ID NO: 9440565 - DNA, 22 bp, Homo sapiens
tgagggaatcctcacatcaatc

SEQ ID NO: 9440566 - DNA, 19 bp, Homo sapiens
tgagggacattgggagcag

SEQ ID NO: 9440567 - DNA, 19 bp, Homo sapiens
tgagggacattgggagcag

SEQ ID NO: 9440568 - DNA, 22 bp, Homo sapiens
tgagggagagggcgaaaatgaa

SEQ ID NO: 9440569 - DNA, 22 bp, Homo sapiens
tgagggagagggcgaaaatgaa

SEQ ID NO: 9440570 - DNA, 22 bp, Homo sapiens
tgagggactgcatacccagctt

SEQ ID NO: 9440571 - DNA, 22 bp, Homo sapiens
tgagggagagggcgaaaatgaa

SEQ ID NO: 9440572 - DNA, 22 bp, Homo sapiens
tgagggagagggcgaaaatgaa

SEQ ID NO: 9440573 - DNA, 22 bp, Homo sapiens
tgagggagagggcgaaaatgaa

SEQ ID NO: 9440574 - DNA, 22 bp, Homo sapiens
tgagggagagggcgaaaatgaa

SEQ ID NO: 9440575 - DNA, 22 bp, Homo sapiens
tgagggagcacacactgaagtg

SEQ ID NO: 9440576 - DNA, 22 bp, Homo sapiens
tgagggagcacacactgaagtg

SEQ ID NO: 9440577 - DNA, 22 bp, Homo sapiens
tgagggagcacacactgaagtg

SEQ ID NO: 9440578 - DNA, 22 bp, Homo sapiens
tgagggagctgacctttctgtg

SEQ ID NO: 9440579 - DNA, 22 bp, Homo sapiens
tgagggagcacacactgaagtg

SEQ ID NO: 9440580 - DNA, 22 bp, Homo sapiens
tgagggagctgacctttctgtg

SEQ ID NO: 9440581 - DNA, 22 bp, Homo sapiens
tgagggagcacacactgaagtg

SEQ ID NO: 9440582 - DNA, 22 bp, Homo sapiens
tgagggagcacacactgaagtg

SEQ ID NO: 9440583 - DNA, 22 bp, Homo sapiens
tgagggagctgacctttctgtg

SEQ ID NO: 9440584 - DNA, 22 bp, Homo sapiens
tgagggagctgacctttctgtg

SEQ ID NO: 9440585 - DNA, 22 bp, Homo sapiens
tgagggaggccctttgagcaga

SEQ ID NO: 9440586 - DNA, 22 bp, Homo sapiens
tgagggaggccctttgagcaga

SEQ ID NO: 9440587 - DNA, 22 bp, Homo sapiens
tgagggaggccctttgagcaga

SEQ ID NO: 9440588 - DNA, 22 bp, Homo sapiens
tgagggaggccctttgagcaga

SEQ ID NO: 9440589 - DNA, 22 bp, Homo sapiens
tgagggaggccctttgagcaga

SEQ ID NO: 9440590 - DNA, 22 bp, Homo sapiens
tgagggaggcctccatctgcca

SEQ ID NO: 9440591 - DNA, 22 bp, Homo sapiens
tgagggaggcctccatctgcca

SEQ ID NO: 9440592 - DNA, 22 bp, Homo sapiens
tgagggaggccctttgagcaga

SEQ ID NO: 9440593 - DNA, 22 bp, Homo sapiens
tgagggaggcctccatctgcca

SEQ ID NO: 9440594 - DNA, 22 bp, Homo sapiens
tgagggaggccctttgagcaga

SEQ ID NO: 9440595 - DNA, 22 bp, Homo sapiens
tgagggaggcctccatctgcca

SEQ ID NO: 9440596 - DNA, 22 bp, Homo sapiens
tgagggagtcatgattaaggaa

SEQ ID NO: 9440597 - DNA, 22 bp, Homo sapiens
tgagggagtcatgattaaggaa

SEQ ID NO: 9440598 - DNA, 22 bp, Homo sapiens
tgagggagtcatgattaaggaa

SEQ ID NO: 9440599 - DNA, 20 bp, Homo sapiens
tgagggagtattgatttccc

SEQ ID NO: 9440600 - DNA, 22 bp, Homo sapiens
tgagggaggcctccatctgcca

SEQ ID NO: 9440601 - DNA, 20 bp, Homo sapiens
tgagggagtattgatttccc

SEQ ID NO: 9440602 - DNA, 20 bp, Homo sapiens
tgagggagtattgatttccc

SEQ ID NO: 9440603 - DNA, 22 bp, Homo sapiens
tgaggggaaggcatgataaata

SEQ ID NO: 9440604 - DNA, 22 bp, Homo sapiens
tgaggggaactgatgcccattg

SEQ ID NO: 9440605 - DNA, 22 bp, Homo sapiens
tgaggggagaagcagcagcctg

SEQ ID NO: 9440606 - DNA, 22 bp, Homo sapiens
tgaggggagacagagtggactc

SEQ ID NO: 9440607 - DNA, 22 bp, Homo sapiens
tgaggggagacagagtggactc

SEQ ID NO: 9440608 - DNA, 22 bp, Homo sapiens
tgaggggagacagagtggactc

SEQ ID NO: 9440609 - DNA, 22 bp, Homo sapiens
tgagggagtgtggatacagtag

SEQ ID NO: 9440610 - DNA, 22 bp, Homo sapiens
tgagggagtgtggatacagtag

SEQ ID NO: 9440611 - DNA, 22 bp, Homo sapiens
tgagggagttgggtgtatagga

SEQ ID NO: 9440612 - DNA, 22 bp, Homo sapiens
tgagggagttgggtgtatagga

SEQ ID NO: 9440613 - DNA, 22 bp, Homo sapiens
tgagggagttgggtgtatagga

SEQ ID NO: 9440614 - DNA, 22 bp, Homo sapiens
tgagggagtgtggatacagtag

SEQ ID NO: 9440615 - DNA, 22 bp, Homo sapiens
tgagggagtgtggatacagtag

SEQ ID NO: 9440616 - DNA, 22 bp, Homo sapiens
tgagggagtgtggatacagtag

SEQ ID NO: 9440617 - DNA, 22 bp, Homo sapiens
tgaggggaggttggggcacatc

SEQ ID NO: 9440618 - DNA, 22 bp, Homo sapiens
tgaggggaggttggggcacatc

SEQ ID NO: 9440619 - DNA, 22 bp, Homo sapiens
tgaggggaggttggggcacatc

SEQ ID NO: 9440620 - DNA, 22 bp, Homo sapiens
tgaggggaggttggggcacatc

SEQ ID NO: 9440621 - DNA, 22 bp, Homo sapiens
tgaggggatacggtacacattg

SEQ ID NO: 9440622 - DNA, 22 bp, Homo sapiens
tgaggggcagagaggtgtccag

SEQ ID NO: 9440623 - DNA, 22 bp, Homo sapiens
tgaggggatacggtacacattg

SEQ ID NO: 9440624 - DNA, 19 bp, Homo sapiens
tgaggggaggagaggcctg

SEQ ID NO: 9440625 - DNA, 19 bp, Homo sapiens
tgaggggaggagaggcctg

SEQ ID NO: 9440626 - DNA, 19 bp, Homo sapiens
tgaggggaggagaggcctg

SEQ ID NO: 9440627 - DNA, 19 bp, Homo sapiens
tgaggggaggagaggcctg

SEQ ID NO: 9440628 - DNA, 19 bp, Homo sapiens
tgaggggaggagaggcctg

SEQ ID NO: 9440629 - DNA, 22 bp, Homo sapiens
tgaggggagctagcatgccttg

SEQ ID NO: 9440630 - DNA, 22 bp, Homo sapiens
tgaggggagcccgccctggacg

SEQ ID NO: 9440631 - DNA, 22 bp, Homo sapiens
tgaggggagcccgccctggacg

SEQ ID NO: 9440632 - DNA, 22 bp, Homo sapiens
tgaggggagcccgccctggacg

SEQ ID NO: 9440633 - DNA, 21 bp, Homo sapiens
tgaggctctgttgtgcctgca

SEQ ID NO: 9440634 - DNA, 22 bp, Homo sapiens
tgaggctctgcttctgtggctc

SEQ ID NO: 9440635 - DNA, 22 bp, Homo sapiens
tgaggctgccttgggaagaggg

SEQ ID NO: 9440636 - DNA, 22 bp, Homo sapiens
tgaggctggatgggatgcctcc

SEQ ID NO: 9440637 - DNA, 22 bp, Homo sapiens
tgaggctggatgggatgcctcc

SEQ ID NO: 9440638 - DNA, 22 bp, Homo sapiens
tgaggctggatgggatgcctcc

SEQ ID NO: 9440639 - DNA, 21 bp, Homo sapiens
tgaggctgttgtaccagggag

SEQ ID NO: 9440640 - DNA, 21 bp, Homo sapiens
tgaggctgttgtaccagggag

SEQ ID NO: 9440641 - DNA, 21 bp, Homo sapiens
tgaggctgttgtaccagggag

SEQ ID NO: 9440642 - DNA, 22 bp, Homo sapiens
tgaggcttagagaagatgggat

SEQ ID NO: 9440643 - DNA, 22 bp, Homo sapiens
tgaggcttggagaggtcaggga

SEQ ID NO: 9440644 - DNA, 22 bp, Homo sapiens
tgaggcttccaacatgtgagaa

SEQ ID NO: 9440645 - DNA, 22 bp, Homo sapiens
tgaggcttccaacatgtgagaa

SEQ ID NO: 9440646 - DNA, 22 bp, Homo sapiens
tgaggcttagagaagatgggat

SEQ ID NO: 9440647 - DNA, 22 bp, Homo sapiens
tgaggcttagagaattaagtga

SEQ ID NO: 9440648 - DNA, 22 bp, Homo sapiens
tgaggctggcaaggctggtatt

SEQ ID NO: 9440649 - DNA, 22 bp, Homo sapiens
tgaggctgttctaccagggcca

SEQ ID NO: 9440650 - DNA, 22 bp, Homo sapiens
tgaggctgttctaccagggcca

SEQ ID NO: 9440651 - DNA, 22 bp, Homo sapiens
tgaggctgttctaccagggcca

SEQ ID NO: 9440652 - DNA, 22 bp, Homo sapiens
tgaggctaaaggtgaccagatt

SEQ ID NO: 9440653 - DNA, 22 bp, Homo sapiens
tgaggcctgggcacataacctc

SEQ ID NO: 9440654 - DNA, 22 bp, Homo sapiens
tgaggccttagtaaccctgcac

SEQ ID NO: 9440655 - DNA, 22 bp, Homo sapiens
tgaggccttagtaaccctgcac

SEQ ID NO: 9440656 - DNA, 22 bp, Homo sapiens
tgaggccttttctgtctggcta

SEQ ID NO: 9440657 - DNA, 22 bp, Homo sapiens
tgaggcctggagggaggagttt

SEQ ID NO: 9440658 - DNA, 22 bp, Homo sapiens
tgaggcctggagggaggagttt

SEQ ID NO: 9440659 - DNA, 22 bp, Homo sapiens
tgaggcctggactctgcatgga

SEQ ID NO: 9440660 - DNA, 22 bp, Homo sapiens
tgaggcctggagggaggagttt

SEQ ID NO: 9440661 - DNA, 22 bp, Homo sapiens
tgaggcctgggcacataacctc

SEQ ID NO: 9440662 - DNA, 22 bp, Homo sapiens
tgaggcctggactctgcatgga

SEQ ID NO: 9440663 - DNA, 22 bp, Homo sapiens
tgaggcctgcttggaattgaat

SEQ ID NO: 9440664 - DNA, 21 bp, Homo sapiens
tgaggcctgccagtctcagaa

SEQ ID NO: 9440665 - DNA, 22 bp, Homo sapiens
tgaggcctgccctggggaagtt

SEQ ID NO: 9440666 - DNA, 22 bp, Homo sapiens
tgaggctcagtgagccctgcag

SEQ ID NO: 9440667 - DNA, 18 bp, Homo sapiens
tgaggctcagctcctggt

SEQ ID NO: 9440668 - DNA, 22 bp, Homo sapiens
tgaggctccagccaggccagca

SEQ ID NO: 9440669 - DNA, 22 bp, Homo sapiens
tgaggctccttgtagagagtgg

SEQ ID NO: 9440670 - DNA, 22 bp, Homo sapiens
tgaggctcacgaacagaagact

SEQ ID NO: 9440671 - DNA, 22 bp, Homo sapiens
tgaggctcagagaagtgctgtt

SEQ ID NO: 9440672 - DNA, 22 bp, Homo sapiens
tgaggctcagagaagtgctgtt

SEQ ID NO: 9440673 - DNA, 22 bp, Homo sapiens
tgaggggggtaatcactgggtt

SEQ ID NO: 9440674 - DNA, 22 bp, Homo sapiens
tgaggggggtaatcactgggtt

SEQ ID NO: 9440675 - DNA, 19 bp, Homo sapiens
tgaggggctcacagtctca

SEQ ID NO: 9440676 - DNA, 22 bp, Homo sapiens
tgagggggttaattaggagagt

SEQ ID NO: 9440677 - DNA, 22 bp, Homo sapiens
tgagggggttaattaggagagt

SEQ ID NO: 9440678 - DNA, 22 bp, Homo sapiens
tgaggggtctaggctgcgcacc

SEQ ID NO: 9440679 - DNA, 22 bp, Homo sapiens
tgaggggttaccttggagttga

SEQ ID NO: 9440680 - DNA, 21 bp, Homo sapiens
tgaggggttataacagggtgg

SEQ ID NO: 9440681 - DNA, 22 bp, Homo sapiens
tgagggtaacctggagctgctg

SEQ ID NO: 9440682 - DNA, 22 bp, Homo sapiens
tgagggtgcatttagcatgtag

SEQ ID NO: 9440683 - DNA, 22 bp, Homo sapiens
tgagggtctggaatctgggctt

SEQ ID NO: 9440684 - DNA, 19 bp, Homo sapiens
tgaggggctcacagtctca

SEQ ID NO: 9440685 - DNA, 19 bp, Homo sapiens
tgaggggctcacagtctca

SEQ ID NO: 9440686 - DNA, 22 bp, Homo sapiens
tgaggggcggcctgcagaggcc

SEQ ID NO: 9440687 - DNA, 22 bp, Homo sapiens
tgaggggcggcctgcagaggcc

SEQ ID NO: 9440688 - DNA, 22 bp, Homo sapiens
tgaggggcggcctgcagaggcc

SEQ ID NO: 9440689 - DNA, 22 bp, Homo sapiens
tgaggggcgctggcaggttcct

SEQ ID NO: 9440690 - DNA, 22 bp, Homo sapiens
tgaggggcgctggcaggttcct

SEQ ID NO: 9440691 - DNA, 22 bp, Homo sapiens
tgaggggcggcctgcagaggcc

SEQ ID NO: 9440692 - DNA, 22 bp, Homo sapiens
tgaggggcgctggcaggttcct

SEQ ID NO: 9440693 - DNA, 22 bp, Homo sapiens
tgaggggcgctggcaggttcct

SEQ ID NO: 9440694 - DNA, 22 bp, Homo sapiens
tgaggggccgcccaagcacttc

SEQ ID NO: 9440695 - DNA, 22 bp, Homo sapiens
tgaggggccagaccccacctag

SEQ ID NO: 9440696 - DNA, 22 bp, Homo sapiens
tgaggggcatgtgtttacacat

SEQ ID NO: 9440697 - DNA, 22 bp, Homo sapiens
tgaggggcagagaggtgtccag

SEQ ID NO: 9440698 - DNA, 22 bp, Homo sapiens
tgaggtagctgctatttgtagt

SEQ ID NO: 9440699 - DNA, 22 bp, Homo sapiens
tgaggtaggaatttgtattggg

SEQ ID NO: 9440700 - DNA, 22 bp, Homo sapiens
tgaggtaatgtgtacgttaatt

SEQ ID NO: 9440701 - DNA, 22 bp, Homo sapiens
tgaggtagaaaaagcttgtagt

SEQ ID NO: 9440702 - DNA, 22 bp, Homo sapiens
tgaggtaataagtgtttgtttt

SEQ ID NO: 9440703 - DNA, 22 bp, Homo sapiens
tgaggtaaatagaaaaaccatg

SEQ ID NO: 9440704 - DNA, 22 bp, Homo sapiens
tgaggtagagattgtgactgta

SEQ ID NO: 9440705 - DNA, 22 bp, Homo sapiens
tgagggtggcacaggcacaaag

SEQ ID NO: 9440706 - DNA, 22 bp, Homo sapiens
tgagggtgggccctgggcatct

SEQ ID NO: 9440707 - DNA, 22 bp, Homo sapiens
tgagggtggccttgtgtggact

SEQ ID NO: 9440708 - DNA, 22 bp, Homo sapiens
tgagggtggccttgtgtggact

SEQ ID NO: 9440709 - DNA, 22 bp, Homo sapiens
tgagggtgggcctgcaggaaga

SEQ ID NO: 9440710 - DNA, 22 bp, Homo sapiens
tgagggtgggccctgggcatct

SEQ ID NO: 9440711 - DNA, 22 bp, Homo sapiens
tgagggtgtgcggcccagacag

SEQ ID NO: 9440712 - DNA, 22 bp, Homo sapiens
tgagggtttccgggcagtggac

SEQ ID NO: 9440713 - DNA, 22 bp, Homo sapiens
tgaggtgaagagtggagctcag

SEQ ID NO: 9440714 - DNA, 22 bp, Homo sapiens
tgaggtgaaggagttttaaagt

SEQ ID NO: 9440715 - DNA, 22 bp, Homo sapiens
tgaggtaggagggtgatcagca

SEQ ID NO: 9440716 - DNA, 22 bp, Homo sapiens
tgaggtgacaattcattctcca

SEQ ID NO: 9440717 - DNA, 22 bp, Homo sapiens
tgaggtgacaattcattctcca

SEQ ID NO: 9440718 - DNA, 22 bp, Homo sapiens
tgaggtgaatggtgtccctgga

SEQ ID NO: 9440719 - DNA, 20 bp, Homo sapiens
tgaggtgaatgtcttttaga

SEQ ID NO: 9440720 - DNA, 22 bp, Homo sapiens
tgaggtgacacaatttactcca

SEQ ID NO: 9440721 - DNA, 22 bp, Homo sapiens
tgaggtgaccgcagatgggaag

SEQ ID NO: 9440722 - DNA, 22 bp, Homo sapiens
tgaggtgagcatctttatcttc

SEQ ID NO: 9440723 - DNA, 22 bp, Homo sapiens
tgaggtgagatggctaccccaa

SEQ ID NO: 9440724 - DNA, 22 bp, Homo sapiens
tgaggtgaggttgaggaaagaa

SEQ ID NO: 9440725 - DNA, 22 bp, Homo sapiens
tgaggtgagtcagtttctgatg

SEQ ID NO: 9440726 - DNA, 22 bp, Homo sapiens
tgaggtgagtcatgcattggag

SEQ ID NO: 9440727 - DNA, 22 bp, Homo sapiens
tgagtatcaattacatagttgt

SEQ ID NO: 9440728 - DNA, 22 bp, Homo sapiens
tgagtcacacatttcttcatac

SEQ ID NO: 9440729 - DNA, 22 bp, Homo sapiens
tgagtcactgggtaatctggat

SEQ ID NO: 9440730 - DNA, 22 bp, Homo sapiens
tgagtctgtatgtccagattta

SEQ ID NO: 9440731 - DNA, 22 bp, Homo sapiens
tgagtctgtatgtccagattta

SEQ ID NO: 9440732 - DNA, 22 bp, Homo sapiens
tgagtctgggcatgttcacttt

SEQ ID NO: 9440733 - DNA, 22 bp, Homo sapiens
tgagtagcggctatgtgtaact

SEQ ID NO: 9440734 - DNA, 22 bp, Homo sapiens
tgagtagagaattcagctaagg

SEQ ID NO: 9440735 - DNA, 22 bp, Homo sapiens
tgagtaattcacaaaacagatg

SEQ ID NO: 9440736 - DNA, 22 bp, Homo sapiens
tgaggttcagttcttggccaca

SEQ ID NO: 9440737 - DNA, 22 bp, Homo sapiens
tgagtaaaagtgaatcttatgt

SEQ ID NO: 9440738 - DNA, 22 bp, Homo sapiens
tgaggtggttactgtggtgctc

SEQ ID NO: 9440739 - DNA, 22 bp, Homo sapiens
tgaggtggttactgtggtgctc

SEQ ID NO: 9440740 - DNA, 22 bp, Homo sapiens
tgaggtggttcaagagccttgt

SEQ ID NO: 9440741 - DNA, 22 bp, Homo sapiens
tgaggtggttcaagagccttgt

SEQ ID NO: 9440742 - DNA, 22 bp, Homo sapiens
tgaggtggttcaagagccttgt

SEQ ID NO: 9440743 - DNA, 22 bp, Homo sapiens
tgaggtggtttgtatcactggg

SEQ ID NO: 9440744 - DNA, 22 bp, Homo sapiens
tgaggtggtttgtatcactggg

SEQ ID NO: 9440745 - DNA, 22 bp, Homo sapiens
tgaggtggtttgtatcactggg

SEQ ID NO: 9440746 - DNA, 22 bp, Homo sapiens
tgaggtggtttgtatcactggg

SEQ ID NO: 9440747 - DNA, 22 bp, Homo sapiens
tgaggtgtgtccccagggaggt

SEQ ID NO: 9440748 - DNA, 22 bp, Homo sapiens
tgaggtggtccaaagactgttt

SEQ ID NO: 9440749 - DNA, 22 bp, Homo sapiens
tgaggtggtgctaatctctgct

SEQ ID NO: 9440750 - DNA, 22 bp, Homo sapiens
tgaggtggtgctaatctctgct

SEQ ID NO: 9440751 - DNA, 22 bp, Homo sapiens
tgaggtggttactgtggtgctc

SEQ ID NO: 9440752 - DNA, 22 bp, Homo sapiens
tgaggtggttactgtggtgctc

SEQ ID NO: 9440753 - DNA, 22 bp, Homo sapiens
tgaggtgataataactccctgc

SEQ ID NO: 9440754 - DNA, 22 bp, Homo sapiens
tgaggtgatacagaccctactt

SEQ ID NO: 9440755 - DNA, 22 bp, Homo sapiens
tgaggtgccacccaagagcctt

SEQ ID NO: 9440756 - DNA, 22 bp, Homo sapiens
tgaggtggcacacacttcctgc

SEQ ID NO: 9440757 - DNA, 22 bp, Homo sapiens
tgaggtggcacacacttcctgc

SEQ ID NO: 9440758 - DNA, 22 bp, Homo sapiens
tgaggtggaaggatcctttgaa

SEQ ID NO: 9440759 - DNA, 22 bp, Homo sapiens
tgaggtggctagggaggcactc

SEQ ID NO: 9440760 - DNA, 22 bp, Homo sapiens
tgaggtggccgaggagcaggac

SEQ ID NO: 9440761 - DNA, 22 bp, Homo sapiens
tgaggtggctggatctcagcct

SEQ ID NO: 9440762 - DNA, 22 bp, Homo sapiens
tgaggtgggtgtcaggtcagag

SEQ ID NO: 9440763 - DNA, 22 bp, Homo sapiens
tgaggtggctagggaggcactc

SEQ ID NO: 9440764 - DNA, 22 bp, Homo sapiens
tgaggtggctagggaggcactc

SEQ ID NO: 9440765 - DNA, 22 bp, Homo sapiens
tgaggtggctggatctcagcct

SEQ ID NO: 9440766 - DNA, 19 bp, Homo sapiens
tgaggccaaggtcacagat

SEQ ID NO: 9440767 - DNA, 19 bp, Homo sapiens
tgaggccaaggtcacagat

SEQ ID NO: 9440768 - DNA, 22 bp, Homo sapiens
tgaggccaactagggagatgga

SEQ ID NO: 9440769 - DNA, 22 bp, Homo sapiens
tgaggccaactagggagatgga

SEQ ID NO: 9440770 - DNA, 22 bp, Homo sapiens
tgaggccaagaaaagctgggtg

SEQ ID NO: 9440771 - DNA, 22 bp, Homo sapiens
tgaggccaagcctcctctgcca

SEQ ID NO: 9440772 - DNA, 22 bp, Homo sapiens
tgaggccaagcctcctctgcca

SEQ ID NO: 9440773 - DNA, 22 bp, Homo sapiens
tgaggccaactagggagatgga

SEQ ID NO: 9440774 - DNA, 22 bp, Homo sapiens
tgaggccaaaatgactcaaatg

SEQ ID NO: 9440775 - DNA, 22 bp, Homo sapiens
tgaggccaactagggagatgga

SEQ ID NO: 9440776 - DNA, 22 bp, Homo sapiens
tgaggccaactagggagatgga

SEQ ID NO: 9440777 - DNA, 22 bp, Homo sapiens
tgaggccaactagggagatgga

SEQ ID NO: 9440778 - DNA, 22 bp, Homo sapiens
tgaggcatggtcctgagggagc

SEQ ID NO: 9440779 - DNA, 22 bp, Homo sapiens
tgaggcagttgagcttcctgag

SEQ ID NO: 9440780 - DNA, 22 bp, Homo sapiens
tgaggcagttgagcttcctgag

SEQ ID NO: 9440781 - DNA, 22 bp, Homo sapiens
tgaggcagttgagcttcctgag

SEQ ID NO: 9440782 - DNA, 23 bp, Homo sapiens
tgaggcaggcggatcacgaggtc

SEQ ID NO: 9440783 - DNA, 23 bp, Homo sapiens
tgaggcaggcggatcacgaggtc

SEQ ID NO: 9440784 - DNA, 23 bp, Homo sapiens
tgaggcaggcggatcacgaggtc

SEQ ID NO: 9440785 - DNA, 23 bp, Homo sapiens
tgaggcaggcggatcacgaggtc

SEQ ID NO: 9440786 - DNA, 22 bp, Homo sapiens
tgaggcagggagagtggatatg

SEQ ID NO: 9440787 - DNA, 21 bp, Homo sapiens
tgaggcaggggtgcttttgtc

SEQ ID NO: 9440788 - DNA, 21 bp, Homo sapiens
tgaggcaggggtgcttttgtc

SEQ ID NO: 9440789 - DNA, 22 bp, Homo sapiens
tgaggcaggatgcttgcacagg

SEQ ID NO: 9440790 - DNA, 22 bp, Homo sapiens
tgaggcaggatgcttgcacagg

SEQ ID NO: 9440791 - DNA, 22 bp, Homo sapiens
tgaggcaggagttcaggctgcg

SEQ ID NO: 9440792 - DNA, 22 bp, Homo sapiens
tgaggcaggagttcaggctgcg

SEQ ID NO: 9440793 - DNA, 22 bp, Homo sapiens
tgaggcaggagttcaggctgcg

SEQ ID NO: 9440794 - DNA, 22 bp, Homo sapiens
tgaggcaggagttcaggctgcg

SEQ ID NO: 9440795 - DNA, 22 bp, Homo sapiens
tgaggcaggagttaatgtgctc

SEQ ID NO: 9440796 - DNA, 22 bp, Homo sapiens
tgaggcaggagttaatgtgctc

SEQ ID NO: 9440797 - DNA, 22 bp, Homo sapiens
tgaggcaggagttcaggctgcg

SEQ ID NO: 9440798 - DNA, 22 bp, Homo sapiens
tgaggcaggagaatggcgggaa

SEQ ID NO: 9440799 - DNA, 22 bp, Homo sapiens
tgaggcaggagaatggcgggaa

SEQ ID NO: 9440800 - DNA, 20 bp, Homo sapiens
tgaggcaggagaatggcatg

SEQ ID NO: 9440801 - DNA, 20 bp, Homo sapiens
tgaggcaggagaatggcatg

SEQ ID NO: 9440802 - DNA, 20 bp, Homo sapiens
tgaggcaggagaatggcatg

SEQ ID NO: 9440803 - DNA, 22 bp, Homo sapiens
tgaggcaggaggattgcaggat

SEQ ID NO: 9440804 - DNA, 22 bp, Homo sapiens
tgaggcaggaggttgagaactg

SEQ ID NO: 9440805 - DNA, 22 bp, Homo sapiens
tgaggcctctgtgccatccagg

SEQ ID NO: 9440806 - DNA, 22 bp, Homo sapiens
tgaggcctctgtgccatccagg

SEQ ID NO: 9440807 - DNA, 22 bp, Homo sapiens
tgaggcctctgtgccatccagg

SEQ ID NO: 9440808 - DNA, 22 bp, Homo sapiens
tgaggcctgaagcctgaagtga

SEQ ID NO: 9440809 - DNA, 18 bp, Homo sapiens
tgaggcctctgctgggcc

SEQ ID NO: 9440810 - DNA, 21 bp, Homo sapiens
tgaggcctctcctgggctggc

SEQ ID NO: 9440811 - DNA, 22 bp, Homo sapiens
tgaggcctctgaggcctaggct

SEQ ID NO: 9440812 - DNA, 17 bp, Homo sapiens
tgaggcctgcatcagtg

SEQ ID NO: 9440813 - DNA, 22 bp, Homo sapiens
tgaggcctgacagaccaagcct

SEQ ID NO: 9440814 - DNA, 22 bp, Homo sapiens
tgaggcctgaagcctggagcct

SEQ ID NO: 9440815 - DNA, 22 bp, Homo sapiens
tgaggcctgaagcctggagcct

SEQ ID NO: 9440816 - DNA, 17 bp, Homo sapiens
tgaggcctgcatcagtg

SEQ ID NO: 9440817 - DNA, 17 bp, Homo sapiens
tgaggcctgcatcagtg

SEQ ID NO: 9440818 - DNA, 22 bp, Homo sapiens
tgaggcctgcattgaactagaa

SEQ ID NO: 9440819 - DNA, 22 bp, Homo sapiens
tgaggcctgcattgaactagaa

SEQ ID NO: 9440820 - DNA, 22 bp, Homo sapiens
tgaggccctctgggctggtcct

SEQ ID NO: 9440821 - DNA, 22 bp, Homo sapiens
tgaggccctagggcatgggaga

SEQ ID NO: 9440822 - DNA, 22 bp, Homo sapiens
tgaggcctacccccctgtgttt

SEQ ID NO: 9440823 - DNA, 22 bp, Homo sapiens
tgaggcctcatttagggagagg

SEQ ID NO: 9440824 - DNA, 22 bp, Homo sapiens
tgaggcctcatttagggagagg

SEQ ID NO: 9440825 - DNA, 22 bp, Homo sapiens
tgaggccaggacccccagcagg

SEQ ID NO: 9440826 - DNA, 22 bp, Homo sapiens
tgaggccaggacccccagcagg

SEQ ID NO: 9440827 - DNA, 22 bp, Homo sapiens
tgaggccccgaagctgaggttt

SEQ ID NO: 9440828 - DNA, 22 bp, Homo sapiens
tgaggccaggatcccaggctct

SEQ ID NO: 9440829 - DNA, 22 bp, Homo sapiens
tgaggccctagggcatgggaga

SEQ ID NO: 9440830 - DNA, 18 bp, Homo sapiens
tgaggcccgcagaggtgg

SEQ ID NO: 9440831 - DNA, 22 bp, Homo sapiens
tgaggccaggatcccaggctct

SEQ ID NO: 9440832 - DNA, 22 bp, Homo sapiens
tgaggccagcttcagcagtgga

SEQ ID NO: 9440833 - DNA, 22 bp, Homo sapiens
tgaggccagcttcagcagtgga

SEQ ID NO: 9440834 - DNA, 19 bp, Homo sapiens
tgaggccagctggcatttt

SEQ ID NO: 9440835 - DNA, 22 bp, Homo sapiens
tgaggccagcttcagcagtgga

SEQ ID NO: 9440836 - DNA, 19 bp, Homo sapiens
tgaggccagctggcatttt

SEQ ID NO: 9440837 - DNA, 22 bp, Homo sapiens
tgaggccaggacccccagcagg

SEQ ID NO: 9440838 - DNA, 22 bp, Homo sapiens
tgaggccagcttcagcagtgga

SEQ ID NO: 9440839 - DNA, 22 bp, Homo sapiens
tgaggccagcttcagcagtgga

SEQ ID NO: 9440840 - DNA, 22 bp, Homo sapiens
tgaggccagcttcagcagtgga

SEQ ID NO: 9440841 - DNA, 22 bp, Homo sapiens
tgaggccagagtttttaattcc

SEQ ID NO: 9440842 - DNA, 16 bp, Homo sapiens
tgaggccagccatttc

SEQ ID NO: 9440843 - DNA, 22 bp, Homo sapiens
tgaggccagccacagccaccct

SEQ ID NO: 9440844 - DNA, 22 bp, Homo sapiens
tgaggccagccacagccaccct

SEQ ID NO: 9440845 - DNA, 22 bp, Homo sapiens
tgaggccagccacagccaccct

SEQ ID NO: 9440846 - DNA, 18 bp, Homo sapiens
tgaggccagagtgggcat

SEQ ID NO: 9440847 - DNA, 18 bp, Homo sapiens
tgaggccagagtgggcat

SEQ ID NO: 9440848 - DNA, 18 bp, Homo sapiens
tgaggccagagtgggcat

SEQ ID NO: 9440849 - DNA, 18 bp, Homo sapiens
tgaggccagagtgggcat

SEQ ID NO: 9440850 - DNA, 22 bp, Homo sapiens
tgaggccagagagtttgcattt

SEQ ID NO: 9440851 - DNA, 18 bp, Homo sapiens
tgaggccagagtgggcat

SEQ ID NO: 9440852 - DNA, 18 bp, Homo sapiens
tgaggccagagtgggcat

SEQ ID NO: 9440853 - DNA, 22 bp, Homo sapiens
tgaggccacttccccacagccc

SEQ ID NO: 9440854 - DNA, 22 bp, Homo sapiens
tgaggccacagtatcagaacag

SEQ ID NO: 9440855 - DNA, 22 bp, Homo sapiens
tgaggccacagtatcagaacag

SEQ ID NO: 9440856 - DNA, 22 bp, Homo sapiens
tgaggccagagagtttgcattt

SEQ ID NO: 9440857 - DNA, 22 bp, Homo sapiens
tgaggccagactgaaaccaaca

SEQ ID NO: 9440858 - DNA, 22 bp, Homo sapiens
tgaggccacttccccacagccc

SEQ ID NO: 9440859 - DNA, 22 bp, Homo sapiens
tgaggccacttccccacagccc

SEQ ID NO: 9440860 - DNA, 21 bp, Homo sapiens
tgaggccaatagcccctggac

SEQ ID NO: 9440861 - DNA, 21 bp, Homo sapiens
tgaggccaatagcccctggac

SEQ ID NO: 9440862 - DNA, 22 bp, Homo sapiens
tgaggccaatgaccctgggcag

SEQ ID NO: 9440863 - DNA, 19 bp, Homo sapiens
tgaggccaaggtcacagat

SEQ ID NO: 9440864 - DNA, 19 bp, Homo sapiens
tgaggccaaggtcacagat

SEQ ID NO: 9440865 - DNA, 21 bp, Homo sapiens
tgaggccaatagcccctggac

SEQ ID NO: 9440866 - DNA, 21 bp, Homo sapiens
tgaggccaatagcccctggac

SEQ ID NO: 9440867 - DNA, 19 bp, Homo sapiens
tgaggccaaggtcacagat

SEQ ID NO: 9440868 - DNA, 22 bp, Homo sapiens
tgaggccacaggaaagggcccg

SEQ ID NO: 9440869 - DNA, 22 bp, Homo sapiens
tgaggccaatgaccctgggcag

SEQ ID NO: 9440870 - DNA, 22 bp, Homo sapiens
tgaggcacatccaggccagctc

SEQ ID NO: 9440871 - DNA, 22 bp, Homo sapiens
tgaggcacatccaggccagctc

SEQ ID NO: 9440872 - DNA, 22 bp, Homo sapiens
tgaggcactccaggatgctgtt

SEQ ID NO: 9440873 - DNA, 22 bp, Homo sapiens
tgaggcactccaggatgctgtt

SEQ ID NO: 9440874 - DNA, 19 bp, Homo sapiens
tgaggcactagtctggtcc

SEQ ID NO: 9440875 - DNA, 22 bp, Homo sapiens
tgaggcaattggaaattttaac

SEQ ID NO: 9440876 - DNA, 22 bp, Homo sapiens
tgaggcaatgtccttcatcctt

SEQ ID NO: 9440877 - DNA, 22 bp, Homo sapiens
tgaggcaatccctagggtaagg

SEQ ID NO: 9440878 - DNA, 22 bp, Homo sapiens
tgaggcaatgtccttcatcctt

SEQ ID NO: 9440879 - DNA, 22 bp, Homo sapiens
tgaggcacatccaggccagctc

SEQ ID NO: 9440880 - DNA, 22 bp, Homo sapiens
tgaggcacagaaaatggtaggg

SEQ ID NO: 9440881 - DNA, 22 bp, Homo sapiens
tgaggcaagctgggcccatgga

SEQ ID NO: 9440882 - DNA, 19 bp, Homo sapiens
tgaggcaagatggctctgg

SEQ ID NO: 9440883 - DNA, 19 bp, Homo sapiens
tgaggcaagctttttcttg

SEQ ID NO: 9440884 - DNA, 22 bp, Homo sapiens
tgaggcaaggctgaatgaaggc

SEQ ID NO: 9440885 - DNA, 22 bp, Homo sapiens
tgaggcaagggatggccccgtg

SEQ ID NO: 9440886 - DNA, 22 bp, Homo sapiens
tgaggcaagtctcaatctttga

SEQ ID NO: 9440887 - DNA, 22 bp, Homo sapiens
tgaggcaagtctcaatctttga

SEQ ID NO: 9440888 - DNA, 22 bp, Homo sapiens
tgaggcaagtactttccctttt

SEQ ID NO: 9440889 - DNA, 21 bp, Homo sapiens
tgaggcaagtccttttatagc

SEQ ID NO: 9440890 - DNA, 22 bp, Homo sapiens
tgaggcaagtactttccctttt

SEQ ID NO: 9440891 - DNA, 22 bp, Homo sapiens
tgaggcaaagttcaagctgaaa

SEQ ID NO: 9440892 - DNA, 17 bp, Homo sapiens
tgaggcaaccatcacta

SEQ ID NO: 9440893 - DNA, 22 bp, Homo sapiens
tgaggcaacagaaagggccaat

SEQ ID NO: 9440894 - DNA, 17 bp, Homo sapiens
tgaggcaaccatcacta

SEQ ID NO: 9440895 - DNA, 22 bp, Homo sapiens
tgaggcaagagtttgattagag

SEQ ID NO: 9440896 - DNA, 22 bp, Homo sapiens
tgaggcaaaagttatgtggtag

SEQ ID NO: 9440897 - DNA, 22 bp, Homo sapiens
tgaggcaaagacaaagcagcat

SEQ ID NO: 9440898 - DNA, 22 bp, Homo sapiens
tgaggcaaagacaaagcagcat

SEQ ID NO: 9440899 - DNA, 22 bp, Homo sapiens
tgaggcaaaaacactgattagg

SEQ ID NO: 9440900 - DNA, 22 bp, Homo sapiens
tgaggcaaaaacactgattagg

SEQ ID NO: 9440901 - DNA, 22 bp, Homo sapiens
tgaggattgagtcaagcagtat

SEQ ID NO: 9440902 - DNA, 22 bp, Homo sapiens
tgaggattggcaaaactcaggg

SEQ ID NO: 9440903 - DNA, 21 bp, Homo sapiens
tgaggatgtgcagcagcagga

SEQ ID NO: 9440904 - DNA, 22 bp, Homo sapiens
tgaggcaggactgagcgggatg

SEQ ID NO: 9440905 - DNA, 22 bp, Homo sapiens
tgaggcaggacatggacaactg

SEQ ID NO: 9440906 - DNA, 22 bp, Homo sapiens
tgaggcaggacatggacaactg

SEQ ID NO: 9440907 - DNA, 22 bp, Homo sapiens
tgaggcaggacatggacaactg

SEQ ID NO: 9440908 - DNA, 22 bp, Homo sapiens
tgaggcaggaatggggaaaagt

SEQ ID NO: 9440909 - DNA, 22 bp, Homo sapiens
tgaggcactgggagagcacact

SEQ ID NO: 9440910 - DNA, 22 bp, Homo sapiens
tgaggcagctttttctgtgtgt

SEQ ID NO: 9440911 - DNA, 22 bp, Homo sapiens
tgaggcaggagaatcacatgaa

SEQ ID NO: 9440912 - DNA, 22 bp, Homo sapiens
tgaggcaggagaatcacatgaa

SEQ ID NO: 9440913 - DNA, 20 bp, Homo sapiens
tgaggcaggagaatggcatg

SEQ ID NO: 9440914 - DNA, 20 bp, Homo sapiens
tgaggcaggagaatggcatg

SEQ ID NO: 9440915 - DNA, 22 bp, Homo sapiens
tgaggcaggactgagcgggatg

SEQ ID NO: 9440916 - DNA, 22 bp, Homo sapiens
tgaggcaggactgagcgggatg

SEQ ID NO: 9440917 - DNA, 22 bp, Homo sapiens
tgaggaggtcagagtctggctg

SEQ ID NO: 9440918 - DNA, 19 bp, Homo sapiens
tgaggagcagctggttgat

SEQ ID NO: 9440919 - DNA, 22 bp, Homo sapiens
tgaggagccactctagcagtca

SEQ ID NO: 9440920 - DNA, 22 bp, Homo sapiens
tgaggatgagatgagataacac

SEQ ID NO: 9440921 - DNA, 22 bp, Homo sapiens
tgaggatgacgatggcaatggc

SEQ ID NO: 9440922 - DNA, 21 bp, Homo sapiens
tgaggataagtaaagctgaag

SEQ ID NO: 9440923 - DNA, 22 bp, Homo sapiens
tgaggaggtgggcacacagagt

SEQ ID NO: 9440924 - DNA, 22 bp, Homo sapiens
tgaggaggtgggcacacagagt

SEQ ID NO: 9440925 - DNA, 22 bp, Homo sapiens
tgaggagtttttctagagctaa

SEQ ID NO: 9440926 - DNA, 22 bp, Homo sapiens
tgaggatggcagtgtgctcagc

SEQ ID NO: 9440927 - DNA, 22 bp, Homo sapiens
tgaggatggaatgctgtgcaag

SEQ ID NO: 9440928 - DNA, 22 bp, Homo sapiens
tgaggatggcagtgtgctcagc

SEQ ID NO: 9440929 - DNA, 22 bp, Homo sapiens
tgaggatggcagtgtgctcagc

SEQ ID NO: 9440930 - DNA, 22 bp, Homo sapiens
tgaggatggcagtgtgctcagc

SEQ ID NO: 9440931 - DNA, 22 bp, Homo sapiens
tgaggatggcagtgtgctcagc

SEQ ID NO: 9440932 - DNA, 22 bp, Homo sapiens
tgaggatggcagtgtgctcagc

SEQ ID NO: 9440933 - DNA, 22 bp, Homo sapiens
tgaggatggtcccgaggacact

SEQ ID NO: 9440934 - DNA, 22 bp, Homo sapiens
tgaggatggtgttggagagggc

SEQ ID NO: 9440935 - DNA, 22 bp, Homo sapiens
tgaggaagccaaacagctacac

SEQ ID NO: 9440936 - DNA, 22 bp, Homo sapiens
tgaggaagccaaacagctacac

SEQ ID NO: 9440937 - DNA, 22 bp, Homo sapiens
tgaggaaggaattgaggtttta

SEQ ID NO: 9440938 - DNA, 22 bp, Homo sapiens
tgaggaagcaaaggcttgtgtg

SEQ ID NO: 9440939 - DNA, 22 bp, Homo sapiens
tgaggaagcaaaggcttgtgtg

SEQ ID NO: 9440940 - DNA, 22 bp, Homo sapiens
tgaggaagcaaaggcttgtgtg

SEQ ID NO: 9440941 - DNA, 22 bp, Homo sapiens
tgaggaacaactcctgtgacta

SEQ ID NO: 9440942 - DNA, 22 bp, Homo sapiens
tgaggaaagaaaggcatgcatg

SEQ ID NO: 9440943 - DNA, 22 bp, Homo sapiens
tgaggaaagaaaggcatgcatg

SEQ ID NO: 9440944 - DNA, 22 bp, Homo sapiens
tgaggaaattgaggctcacaga

SEQ ID NO: 9440945 - DNA, 22 bp, Homo sapiens
tgaggaaattgaggctcacaga

SEQ ID NO: 9440946 - DNA, 22 bp, Homo sapiens
tgaggaaatatggtgaactctt

SEQ ID NO: 9440947 - DNA, 22 bp, Homo sapiens
tgaggagaaatgctcagagcca

SEQ ID NO: 9440948 - DNA, 22 bp, Homo sapiens
tgaggagaaatgctcagagcca

SEQ ID NO: 9440949 - DNA, 22 bp, Homo sapiens
tgaggaagttgatctcatcagt

SEQ ID NO: 9440950 - DNA, 22 bp, Homo sapiens
tgaggaagtggttgtatggttt

SEQ ID NO: 9440951 - DNA, 22 bp, Homo sapiens
tgaggaagggtgtgacggcacc

SEQ ID NO: 9440952 - DNA, 22 bp, Homo sapiens
tgaggaagggtgtgacggcacc

SEQ ID NO: 9440953 - DNA, 18 bp, Homo sapiens
tgaggaaggggaagtatt

SEQ ID NO: 9440954 - DNA, 22 bp, Homo sapiens
tgcctctgtgggcagagctgcc

SEQ ID NO: 9440955 - DNA, 22 bp, Homo sapiens
tgcctctgtgggcagagctgcc

SEQ ID NO: 9440956 - DNA, 22 bp, Homo sapiens
tgcctctgtgggcagagctgcc

SEQ ID NO: 9440957 - DNA, 22 bp, Homo sapiens
tgcctctgtgggcagagctgcc

SEQ ID NO: 9440958 - DNA, 22 bp, Homo sapiens
tgcctctgtgggcagagctgcc

SEQ ID NO: 9440959 - DNA, 22 bp, Homo sapiens
tgcctctgtgggcagagctgcc

SEQ ID NO: 9440960 - DNA, 22 bp, Homo sapiens
tgcctctgtgggccttcctggc

SEQ ID NO: 9440961 - DNA, 22 bp, Homo sapiens
tgcctctgtgggccttcctggc

SEQ ID NO: 9440962 - DNA, 22 bp, Homo sapiens
tgcctctgtgggccttcctggc

SEQ ID NO: 9440963 - DNA, 22 bp, Homo sapiens
tgcctctggttatctggtacct

SEQ ID NO: 9440964 - DNA, 22 bp, Homo sapiens
tgcctctgggtgaccaaggagc

SEQ ID NO: 9440965 - DNA, 22 bp, Homo sapiens
tgcctctgggtgaccaaggagc

SEQ ID NO: 9440966 - DNA, 22 bp, Homo sapiens
tgcctctgggtgaccaaggagc

SEQ ID NO: 9440967 - DNA, 22 bp, Homo sapiens
tgcctctggcctttggtgccca

SEQ ID NO: 9440968 - DNA, 22 bp, Homo sapiens
tgcctctggcctttggtgccca

SEQ ID NO: 9440969 - DNA, 22 bp, Homo sapiens
tgcctctgtggaaatggtggtc

SEQ ID NO: 9440970 - DNA, 22 bp, Homo sapiens
tgcctctggttatctggtacct

SEQ ID NO: 9440971 - DNA, 22 bp, Homo sapiens
tgcctgagggagtaagagtcct

SEQ ID NO: 9440972 - DNA, 22 bp, Homo sapiens
tgcctgaggtggtctgcaaatg

SEQ ID NO: 9440973 - DNA, 22 bp, Homo sapiens
tgcctgaggtggtctgcaaatg

SEQ ID NO: 9440974 - DNA, 20 bp, Homo sapiens
tgcctgacttcagcatcagt

SEQ ID NO: 9440975 - DNA, 22 bp, Homo sapiens
tgcctgagtgatgtggcagcca

SEQ ID NO: 9440976 - DNA, 22 bp, Homo sapiens
tgcctgagggagtaagagtcct

SEQ ID NO: 9440977 - DNA, 22 bp, Homo sapiens
tgcctgaggagtcagggcaggt

SEQ ID NO: 9440978 - DNA, 22 bp, Homo sapiens
tgcctgaggagtcagggcaggt

SEQ ID NO: 9440979 - DNA, 22 bp, Homo sapiens
tgcctgaacatgaatagtttat

SEQ ID NO: 9440980 - DNA, 22 bp, Homo sapiens
tgcctgaattcaattcctggct

SEQ ID NO: 9440981 - DNA, 22 bp, Homo sapiens
tgcctgaatgatcagtcagatt

SEQ ID NO: 9440982 - DNA, 22 bp, Homo sapiens
tgcctctgtgtgcaggtgagca

SEQ ID NO: 9440983 - DNA, 22 bp, Homo sapiens
tgcctctgtgtgcaggtgagca

SEQ ID NO: 9440984 - DNA, 22 bp, Homo sapiens
tgcctcttggagcctttcctct

SEQ ID NO: 9440985 - DNA, 22 bp, Homo sapiens
tgcctctgttgagccttggctg

SEQ ID NO: 9440986 - DNA, 22 bp, Homo sapiens
tgcctctgctgcatattcacct

SEQ ID NO: 9440987 - DNA, 22 bp, Homo sapiens
tgcctctgctgctgtggcatca

SEQ ID NO: 9440988 - DNA, 22 bp, Homo sapiens
tgcctctgctgctgtggcatca

SEQ ID NO: 9440989 - DNA, 22 bp, Homo sapiens
tgcctctgctgcatattcacct

SEQ ID NO: 9440990 - DNA, 23 bp, Homo sapiens
tgcctctgcctccctagtctgca

SEQ ID NO: 9440991 - DNA, 23 bp, Homo sapiens
tgcctctgcctccctagtctgca

SEQ ID NO: 9440992 - DNA, 22 bp, Homo sapiens
tgcctctgaggaagattgtgtt

SEQ ID NO: 9440993 - DNA, 22 bp, Homo sapiens
tgcctctaaagtcatgatttat

SEQ ID NO: 9440994 - DNA, 22 bp, Homo sapiens
tgcctccttcaggagggcccgg

SEQ ID NO: 9440995 - DNA, 22 bp, Homo sapiens
tgcctccctggcaagtctctcc

SEQ ID NO: 9440996 - DNA, 22 bp, Homo sapiens
tgcctccctggcaagtctctcc

SEQ ID NO: 9440997 - DNA, 22 bp, Homo sapiens
tgcctccctctctgccactgga

SEQ ID NO: 9440998 - DNA, 22 bp, Homo sapiens
tgcctccctctctgccactgga

SEQ ID NO: 9440999 - DNA, 22 bp, Homo sapiens
tgcctccctctctgccactgga

SEQ ID NO: 9441000 - DNA, 22 bp, Homo sapiens
tgcctccctctctgccactgga

SEQ ID NO: 9441001 - DNA, 22 bp, Homo sapiens
tgcctcagtctaaagtctctca

SEQ ID NO: 9441002 - DNA, 19 bp, Homo sapiens
tgcctcagggctttgagga

SEQ ID NO: 9441003 - DNA, 22 bp, Homo sapiens
tgcctcaggcacctggcaggtt

SEQ ID NO: 9441004 - DNA, 22 bp, Homo sapiens
tgcctcagctgaggccgctcca

SEQ ID NO: 9441005 - DNA, 19 bp, Homo sapiens
tgcctggcaccagctccac

SEQ ID NO: 9441006 - DNA, 19 bp, Homo sapiens
tgcctggcaccagctccac

SEQ ID NO: 9441007 - DNA, 19 bp, Homo sapiens
tgcctggcaccagctccac

SEQ ID NO: 9441008 - DNA, 19 bp, Homo sapiens
tgcctggcaccagctccac

SEQ ID NO: 9441009 - DNA, 19 bp, Homo sapiens
tgcctggcaccagctccac

SEQ ID NO: 9441010 - DNA, 22 bp, Homo sapiens
tgcctggcacagagcaggtggc

SEQ ID NO: 9441011 - DNA, 22 bp, Homo sapiens
tgcctggcacagagcaggtggc

SEQ ID NO: 9441012 - DNA, 22 bp, Homo sapiens
tgcctggcaatgccagaagcca

SEQ ID NO: 9441013 - DNA, 22 bp, Homo sapiens
tgcctggcaccccagtctgcac

SEQ ID NO: 9441014 - DNA, 22 bp, Homo sapiens
tgcctggcaccccagtctgcac

SEQ ID NO: 9441015 - DNA, 22 bp, Homo sapiens
tgcctggcactcctggagctca

SEQ ID NO: 9441016 - DNA, 22 bp, Homo sapiens
tgcctggcactcctggagctca

SEQ ID NO: 9441017 - DNA, 22 bp, Homo sapiens
tgcctggcagcttgaaagaaat

SEQ ID NO: 9441018 - DNA, 22 bp, Homo sapiens
tgcctggcatctagccctggga

SEQ ID NO: 9441019 - DNA, 22 bp, Homo sapiens
tgcctggcatctagccctggga

SEQ ID NO: 9441020 - DNA, 22 bp, Homo sapiens
tgcctggcatctagccctggga

SEQ ID NO: 9441021 - DNA, 22 bp, Homo sapiens
tgcctggcatctagccctggga

SEQ ID NO: 9441022 - DNA, 22 bp, Homo sapiens
tgcctggcagcttgaaagaaat

SEQ ID NO: 9441023 - DNA, 22 bp, Homo sapiens
tgcctggcaactgtggtgggct

SEQ ID NO: 9441024 - DNA, 22 bp, Homo sapiens
tgcctggcaagaggggctggct

SEQ ID NO: 9441025 - DNA, 22 bp, Homo sapiens
tgcctggcaagaggggctggct

SEQ ID NO: 9441026 - DNA, 22 bp, Homo sapiens
tgcctggcaatgccagaagcca

SEQ ID NO: 9441027 - DNA, 22 bp, Homo sapiens
tgcctggcaatgccagaagcca

SEQ ID NO: 9441028 - DNA, 22 bp, Homo sapiens
tgcctggcaagaggggctggct

SEQ ID NO: 9441029 - DNA, 20 bp, Homo sapiens
tgcctgcccaggtcctgcac

SEQ ID NO: 9441030 - DNA, 19 bp, Homo sapiens
tgcctgctgtattccagag

SEQ ID NO: 9441031 - DNA, 22 bp, Homo sapiens
tgcctgctgccactgctgttac

SEQ ID NO: 9441032 - DNA, 22 bp, Homo sapiens
tgcctgcccacgactacagcag

SEQ ID NO: 9441033 - DNA, 22 bp, Homo sapiens
tgcctgccaggcaacctgggag

SEQ ID NO: 9441034 - DNA, 22 bp, Homo sapiens
tgcctgccaatgatgcttgtgt

SEQ ID NO: 9441035 - DNA, 17 bp, Homo sapiens
tgcctgccagcattgga

SEQ ID NO: 9441036 - DNA, 17 bp, Homo sapiens
tgcctgccagcattgga

SEQ ID NO: 9441037 - DNA, 17 bp, Homo sapiens
tgcctgccagcattgga

SEQ ID NO: 9441038 - DNA, 17 bp, Homo sapiens
tgcctgccagcattgga

SEQ ID NO: 9441039 - DNA, 22 bp, Homo sapiens
tgcctgagtttaaccctcagag

SEQ ID NO: 9441040 - DNA, 22 bp, Homo sapiens
tgcctgcatcttggaggcccca

SEQ ID NO: 9441041 - DNA, 22 bp, Homo sapiens
tgcctgcaagagttggggctac

SEQ ID NO: 9441042 - DNA, 22 bp, Homo sapiens
tgcctgcattttgtggctggct

SEQ ID NO: 9441043 - DNA, 22 bp, Homo sapiens
tgccctgggaacacagatgcca

SEQ ID NO: 9441044 - DNA, 22 bp, Homo sapiens
tgccctgggaacacagatgcca

SEQ ID NO: 9441045 - DNA, 22 bp, Homo sapiens
tgccctgggaacacagatgcca

SEQ ID NO: 9441046 - DNA, 22 bp, Homo sapiens
tgccctgggaacacagatgcca

SEQ ID NO: 9441047 - DNA, 22 bp, Homo sapiens
tgccctggctggagtgcagtgg

SEQ ID NO: 9441048 - DNA, 22 bp, Homo sapiens
tgccctggcttcagctttggct

SEQ ID NO: 9441049 - DNA, 22 bp, Homo sapiens
tgccctggctcttcttgttcca

SEQ ID NO: 9441050 - DNA, 22 bp, Homo sapiens
tgccctgtctaagctgtcagta

SEQ ID NO: 9441051 - DNA, 22 bp, Homo sapiens
tgccctgtctaagctgtcagta

SEQ ID NO: 9441052 - DNA, 22 bp, Homo sapiens
tgccctgtctaagctgtcagta

SEQ ID NO: 9441053 - DNA, 22 bp, Homo sapiens
tgccctgggaggctttcctgtt

SEQ ID NO: 9441054 - DNA, 22 bp, Homo sapiens
tgccctgggaacacagatgcca

SEQ ID NO: 9441055 - DNA, 22 bp, Homo sapiens
tgccctgggacatgcagcggag

SEQ ID NO: 9441056 - DNA, 22 bp, Homo sapiens
tgccctgggaggctttcctgtt

SEQ ID NO: 9441057 - DNA, 17 bp, Homo sapiens
tgccctgtgcctggtgt

SEQ ID NO: 9441058 - DNA, 17 bp, Homo sapiens
tgccctgtgcctggtgt

SEQ ID NO: 9441059 - DNA, 17 bp, Homo sapiens
tgccctgtgcctggtgt

SEQ ID NO: 9441060 - DNA, 20 bp, Homo sapiens
tgccctgtggaggggaaagg

SEQ ID NO: 9441061 - DNA, 22 bp, Homo sapiens
tgccctgtggggatttccagcc

SEQ ID NO: 9441062 - DNA, 22 bp, Homo sapiens
tgccctgttcacttcatggttc

SEQ ID NO: 9441063 - DNA, 22 bp, Homo sapiens
tgccctgttcacttcatggttc

SEQ ID NO: 9441064 - DNA, 22 bp, Homo sapiens
tgccctgttatcttggaagagt

SEQ ID NO: 9441065 - DNA, 22 bp, Homo sapiens
tgccctgtgtgtgcaagcactg

SEQ ID NO: 9441066 - DNA, 22 bp, Homo sapiens
tgccctgtgggtatctgatggc

SEQ ID NO: 9441067 - DNA, 22 bp, Homo sapiens
tgccctgtgggtatctgatggc

SEQ ID NO: 9441068 - DNA, 22 bp, Homo sapiens
tgccgcactcggctcctgattt

SEQ ID NO: 9441069 - DNA, 22 bp, Homo sapiens
tgccgcactcggccaccagctg

SEQ ID NO: 9441070 - DNA, 22 bp, Homo sapiens
tgccctgttcctgcctccagct

SEQ ID NO: 9441071 - DNA, 22 bp, Homo sapiens
tgccctgttcctgcctccagct

SEQ ID NO: 9441072 - DNA, 22 bp, Homo sapiens
tgcctaaaccattccccttcct

SEQ ID NO: 9441073 - DNA, 22 bp, Homo sapiens
tgcctaagtctgcagtcacttg

SEQ ID NO: 9441074 - DNA, 22 bp, Homo sapiens
tgcctactagtactattttgtg

SEQ ID NO: 9441075 - DNA, 22 bp, Homo sapiens
tgcctacccatggttagacata

SEQ ID NO: 9441076 - DNA, 20 bp, Homo sapiens
tgccgggcagcctgaggagt

SEQ ID NO: 9441077 - DNA, 22 bp, Homo sapiens
tgccgtggggctgaggctggag

SEQ ID NO: 9441078 - DNA, 22 bp, Homo sapiens
tgccgtgtcccattgtgctctg

SEQ ID NO: 9441079 - DNA, 22 bp, Homo sapiens
tgccggctggacctgagccagc

SEQ ID NO: 9441080 - DNA, 22 bp, Homo sapiens
tgccgtggggctgaggctggag

SEQ ID NO: 9441081 - DNA, 22 bp, Homo sapiens
tgccgtgcccatattgtgggtg

SEQ ID NO: 9441082 - DNA, 22 bp, Homo sapiens
tgccgctccaggtctcgcggtg

SEQ ID NO: 9441083 - DNA, 22 bp, Homo sapiens
tgccgcagtgcggggagggccc

SEQ ID NO: 9441084 - DNA, 22 bp, Homo sapiens
tgccgcagtgcggggagggccc

SEQ ID NO: 9441085 - DNA, 22 bp, Homo sapiens
tgccgcagtgcggggagggccc

SEQ ID NO: 9441086 - DNA, 22 bp, Homo sapiens
tgccgcagtgcggggagggccc

SEQ ID NO: 9441087 - DNA, 22 bp, Homo sapiens
tgcctattcaatatatgcattt

SEQ ID NO: 9441088 - DNA, 23 bp, Homo sapiens
tgcctattcagcagagtgatagc

SEQ ID NO: 9441089 - DNA, 22 bp, Homo sapiens
tgcctattcaatatatgcattt

SEQ ID NO: 9441090 - DNA, 22 bp, Homo sapiens
tgcctcaagccctccactgcac

SEQ ID NO: 9441091 - DNA, 22 bp, Homo sapiens
tgcctcagagacctgacagtac

SEQ ID NO: 9441092 - DNA, 22 bp, Homo sapiens
tgcctcagagtgggcttgctat

SEQ ID NO: 9441093 - DNA, 22 bp, Homo sapiens
tgcctagccttcttcatgccat

SEQ ID NO: 9441094 - DNA, 22 bp, Homo sapiens
tgcctaggctggagtgcagtga

SEQ ID NO: 9441095 - DNA, 22 bp, Homo sapiens
tgcctaggctggagtgtagtgg

SEQ ID NO: 9441096 - DNA, 22 bp, Homo sapiens
tgcctaggctggagtgtagtgg

SEQ ID NO: 9441097 - DNA, 22 bp, Homo sapiens
tgcctagggcctaaccagagcc

SEQ ID NO: 9441098 - DNA, 22 bp, Homo sapiens
tgccctggctcttcttgttcca

SEQ ID NO: 9441099 - DNA, 22 bp, Homo sapiens
tgccctggctcttcttgttcca

SEQ ID NO: 9441100 - DNA, 22 bp, Homo sapiens
tgccctggctctccactagttt

SEQ ID NO: 9441101 - DNA, 22 bp, Homo sapiens
tgccctggctcttcttgttcca

SEQ ID NO: 9441102 - DNA, 22 bp, Homo sapiens
tgccctggctctccactagttt

SEQ ID NO: 9441103 - DNA, 22 bp, Homo sapiens
tgccctggctctccactagttt

SEQ ID NO: 9441104 - DNA, 22 bp, Homo sapiens
tgccctggctctccactagttt

SEQ ID NO: 9441105 - DNA, 22 bp, Homo sapiens
tgccctggcgctgtctctatgg

SEQ ID NO: 9441106 - DNA, 22 bp, Homo sapiens
tgccctggcgctgtctctatgg

SEQ ID NO: 9441107 - DNA, 22 bp, Homo sapiens
tgccctggctcctcccacgctg

SEQ ID NO: 9441108 - DNA, 22 bp, Homo sapiens
tgccctggctcctcccacgctg

SEQ ID NO: 9441109 - DNA, 22 bp, Homo sapiens
tgccctggatgctgcaggtgtg

SEQ ID NO: 9441110 - DNA, 22 bp, Homo sapiens
tgccctggcacacacacagctg

SEQ ID NO: 9441111 - DNA, 22 bp, Homo sapiens
tgccctggcattgggttggata

SEQ ID NO: 9441112 - DNA, 22 bp, Homo sapiens
tgccctggcacacacacagctg

SEQ ID NO: 9441113 - DNA, 22 bp, Homo sapiens
tgccctgctgtggctctgccca

SEQ ID NO: 9441114 - DNA, 22 bp, Homo sapiens
tgccctggaaatgagaggtgtg

SEQ ID NO: 9441115 - DNA, 22 bp, Homo sapiens
tgccctgctgtggctctgccca

SEQ ID NO: 9441116 - DNA, 22 bp, Homo sapiens
tgccctgctgtgcctggagcca

SEQ ID NO: 9441117 - DNA, 22 bp, Homo sapiens
tgccctgctgtggctctgccca

SEQ ID NO: 9441118 - DNA, 22 bp, Homo sapiens
tgccctggaaccatctacagtc

SEQ ID NO: 9441119 - DNA, 22 bp, Homo sapiens
tgccctggaaccatctacagtc

SEQ ID NO: 9441120 - DNA, 22 bp, Homo sapiens
tgccctggaaccatctacagtc

SEQ ID NO: 9441121 - DNA, 22 bp, Homo sapiens
tgccctggaaccatctacagtc

SEQ ID NO: 9441122 - DNA, 22 bp, Homo sapiens
tgccctggaaccatctacagtc

SEQ ID NO: 9441123 - DNA, 22 bp, Homo sapiens
tgccctggaaccatctacagtc

SEQ ID NO: 9441124 - DNA, 22 bp, Homo sapiens
tgccctggaaccatctacagtc

SEQ ID NO: 9441125 - DNA, 22 bp, Homo sapiens
tgccctggaggggcttacagtc

SEQ ID NO: 9441126 - DNA, 22 bp, Homo sapiens
tgccctggagtcagtggctatt

SEQ ID NO: 9441127 - DNA, 22 bp, Homo sapiens
tgccctggagtcagtggctatt

SEQ ID NO: 9441128 - DNA, 22 bp, Homo sapiens
tgccctggaggggcttacagtc

SEQ ID NO: 9441129 - DNA, 22 bp, Homo sapiens
tgccctcagaattgctccctgc

SEQ ID NO: 9441130 - DNA, 19 bp, Homo sapiens
tgccctgcacgctgtcctg

SEQ ID NO: 9441131 - DNA, 19 bp, Homo sapiens
tgccctaggggatgcgggg

SEQ ID NO: 9441132 - DNA, 22 bp, Homo sapiens
tgcccgtggcctggggcagctt

SEQ ID NO: 9441133 - DNA, 19 bp, Homo sapiens
tgccctgcacgctgtcctg

SEQ ID NO: 9441134 - DNA, 22 bp, Homo sapiens
tgccctgcagaccctgcagtgt

SEQ ID NO: 9441135 - DNA, 22 bp, Homo sapiens
tgcccctcttgctggccctgtc

SEQ ID NO: 9441136 - DNA, 22 bp, Homo sapiens
tgcccctgatgcctagaacaga

SEQ ID NO: 9441137 - DNA, 19 bp, Homo sapiens
tgccccttaagagtttctc

SEQ ID NO: 9441138 - DNA, 22 bp, Homo sapiens
tgccctgcccatctaccctgtc

SEQ ID NO: 9441139 - DNA, 22 bp, Homo sapiens
tgccctgcccatctaccctgtc

SEQ ID NO: 9441140 - DNA, 22 bp, Homo sapiens
tgccctgcccatctaccctgtc

SEQ ID NO: 9441141 - DNA, 22 bp, Homo sapiens
tgccctgccaagaccaagtggt

SEQ ID NO: 9441142 - DNA, 22 bp, Homo sapiens
tgccctgctgtgcctggagcca

SEQ ID NO: 9441143 - DNA, 22 bp, Homo sapiens
tgccctgctgtgcctggagcca

SEQ ID NO: 9441144 - DNA, 22 bp, Homo sapiens
tgccctgcggctatctagatga

SEQ ID NO: 9441145 - DNA, 19 bp, Homo sapiens
tgccctgcccgcagccttg

SEQ ID NO: 9441146 - DNA, 22 bp, Homo sapiens
tgcccagggtggagtgcagcgg

SEQ ID NO: 9441147 - DNA, 22 bp, Homo sapiens
tgcccagggtggagtgcagcgg

SEQ ID NO: 9441148 - DNA, 21 bp, Homo sapiens
tgcccaggggccaaccgctgc

SEQ ID NO: 9441149 - DNA, 21 bp, Homo sapiens
tgcccaggggccaaccgctgc

SEQ ID NO: 9441150 - DNA, 22 bp, Homo sapiens
tgcccagggataagcctagaga

SEQ ID NO: 9441151 - DNA, 22 bp, Homo sapiens
tgcccagggataagcctagaga

SEQ ID NO: 9441152 - DNA, 22 bp, Homo sapiens
tgcccagggataagcctagaga

SEQ ID NO: 9441153 - DNA, 22 bp, Homo sapiens
tgcccaggcttcaccctcagag

SEQ ID NO: 9441154 - DNA, 22 bp, Homo sapiens
tgcccaggctggagtgcagagg

SEQ ID NO: 9441155 - DNA, 22 bp, Homo sapiens
tgcccaggctggagtgcagagg

SEQ ID NO: 9441156 - DNA, 22 bp, Homo sapiens
tgcccaggctggagtgcagagg

SEQ ID NO: 9441157 - DNA, 22 bp, Homo sapiens
tgcccaggcttcaccctcagag

SEQ ID NO: 9441158 - DNA, 22 bp, Homo sapiens
tgcccaggcttcaccctcagag

SEQ ID NO: 9441159 - DNA, 22 bp, Homo sapiens
tgcccaggctggagtgcagtgg

SEQ ID NO: 9441160 - DNA, 22 bp, Homo sapiens
tgcccaggctggagtgcagtgg

SEQ ID NO: 9441161 - DNA, 22 bp, Homo sapiens
tgcccaggctggagtgcagtgg

SEQ ID NO: 9441162 - DNA, 19 bp, Homo sapiens
tgcccaggccaggttgggc

SEQ ID NO: 9441163 - DNA, 19 bp, Homo sapiens
tgcccaggccaggttgggc

SEQ ID NO: 9441164 - DNA, 19 bp, Homo sapiens
tgcccaggccaggttgggc

SEQ ID NO: 9441165 - DNA, 19 bp, Homo sapiens
tgcccaggcctcccaaaag

SEQ ID NO: 9441166 - DNA, 19 bp, Homo sapiens
tgcccaggcctcccaaaag

SEQ ID NO: 9441167 - DNA, 19 bp, Homo sapiens
tgcccaggcctcccaaaag

SEQ ID NO: 9441168 - DNA, 19 bp, Homo sapiens
tgcccaggcctcccaaaag

SEQ ID NO: 9441169 - DNA, 22 bp, Homo sapiens
tgcccaggattgtgaggtcagg

SEQ ID NO: 9441170 - DNA, 22 bp, Homo sapiens
tgcccaggattgtgaggtcagg

SEQ ID NO: 9441171 - DNA, 22 bp, Homo sapiens
tgcccaggattgtgaggtcagg

SEQ ID NO: 9441172 - DNA, 22 bp, Homo sapiens
tgcccaggctcctcgcagcctt

SEQ ID NO: 9441173 - DNA, 22 bp, Homo sapiens
tgcccaggctcctcgcagcctt

SEQ ID NO: 9441174 - DNA, 22 bp, Homo sapiens
tgcccaggctggaatgcagtgg

SEQ ID NO: 9441175 - DNA, 22 bp, Homo sapiens
tgcccaggctggaatgcagtgg

SEQ ID NO: 9441176 - DNA, 22 bp, Homo sapiens
tgcccaggctggaatgcagtgg

SEQ ID NO: 9441177 - DNA, 22 bp, Homo sapiens
tgcccaggctggagtacagtgg

SEQ ID NO: 9441178 - DNA, 22 bp, Homo sapiens
tgcccaggctggagtacagtgg

SEQ ID NO: 9441179 - DNA, 22 bp, Homo sapiens
tgcccaggctggagtacagtgg

SEQ ID NO: 9441180 - DNA, 22 bp, Homo sapiens
tgcccaggtttgagtgcccaag

SEQ ID NO: 9441181 - DNA, 22 bp, Homo sapiens
tgcccagggtttctaagagcag

SEQ ID NO: 9441182 - DNA, 22 bp, Homo sapiens
tgcccagggtttctaagagcag

SEQ ID NO: 9441183 - DNA, 22 bp, Homo sapiens
tgcccagggtttctaagagcag

SEQ ID NO: 9441184 - DNA, 22 bp, Homo sapiens
tgcccagggtttctaagagcag

SEQ ID NO: 9441185 - DNA, 22 bp, Homo sapiens
tgcccagggtggagtgcagtgg

SEQ ID NO: 9441186 - DNA, 22 bp, Homo sapiens
tgcccagggtggagtgcagtgg

SEQ ID NO: 9441187 - DNA, 22 bp, Homo sapiens
tgcccagggtggagtgcagtgg

SEQ ID NO: 9441188 - DNA, 22 bp, Homo sapiens
tgcccagggtggagtgcagcgg

SEQ ID NO: 9441189 - DNA, 22 bp, Homo sapiens
tgcccaggtttgagtgcccaag

SEQ ID NO: 9441190 - DNA, 22 bp, Homo sapiens
tgcccaggtttgagtgcccaag

SEQ ID NO: 9441191 - DNA, 22 bp, Homo sapiens
tgcccagtctccgggccagccc

SEQ ID NO: 9441192 - DNA, 22 bp, Homo sapiens
tgcccatgtttctctgtatccc

SEQ ID NO: 9441193 - DNA, 22 bp, Homo sapiens
tgcccatggaccaagcaagggg

SEQ ID NO: 9441194 - DNA, 22 bp, Homo sapiens
tgcccatgcatgacagatggct

SEQ ID NO: 9441195 - DNA, 23 bp, Homo sapiens
tgcccagtgcctttgcccatgca

SEQ ID NO: 9441196 - DNA, 22 bp, Homo sapiens
tgcccagtctccgggccagccc

SEQ ID NO: 9441197 - DNA, 22 bp, Homo sapiens
tgccccagactctgctcacctc

SEQ ID NO: 9441198 - DNA, 22 bp, Homo sapiens
tgccccagacctactgaatggg

SEQ ID NO: 9441199 - DNA, 20 bp, Homo sapiens
tgccccaggcctgcacctgc

SEQ ID NO: 9441200 - DNA, 22 bp, Homo sapiens
tgccccaggtgctgaggttgga

SEQ ID NO: 9441201 - DNA, 19 bp, Homo sapiens
tgcccccagcacctccctg

SEQ ID NO: 9441202 - DNA, 22 bp, Homo sapiens
tgcccctcgacgcaatgaaggg

SEQ ID NO: 9441203 - DNA, 22 bp, Homo sapiens
tgcccccttttcttgttacact

SEQ ID NO: 9441204 - DNA, 22 bp, Homo sapiens
tgccatggaatcacctccagct

SEQ ID NO: 9441205 - DNA, 22 bp, Homo sapiens
tgcccacagatatgtgcagtct

SEQ ID NO: 9441206 - DNA, 22 bp, Homo sapiens
tgcccacacctgggggaggctg

SEQ ID NO: 9441207 - DNA, 22 bp, Homo sapiens
tgcccacagatatgtgcagtct

SEQ ID NO: 9441208 - DNA, 22 bp, Homo sapiens
tgcccacagctcagggctgctc

SEQ ID NO: 9441209 - DNA, 20 bp, Homo sapiens
tgcccacatcactcaggagt

SEQ ID NO: 9441210 - DNA, 22 bp, Homo sapiens
tgcccaagtgtttggctgagtc

SEQ ID NO: 9441211 - DNA, 22 bp, Homo sapiens
tgcccaagccgagctctctgtt

SEQ ID NO: 9441212 - DNA, 22 bp, Homo sapiens
tgcccaagccgagctctctgtt

SEQ ID NO: 9441213 - DNA, 22 bp, Homo sapiens
tgcccaagccgagctctctgtt

SEQ ID NO: 9441214 - DNA, 22 bp, Homo sapiens
tgcccaagcagaggagtgattc

SEQ ID NO: 9441215 - DNA, 22 bp, Homo sapiens
tgcccaagcagaggagtgattc

SEQ ID NO: 9441216 - DNA, 22 bp, Homo sapiens
tgcccacatggtgccatggcca

SEQ ID NO: 9441217 - DNA, 22 bp, Homo sapiens
tgcccacattctgaagctccct

SEQ ID NO: 9441218 - DNA, 22 bp, Homo sapiens
tgcccacattcaaaaggtgatg

SEQ ID NO: 9441219 - DNA, 22 bp, Homo sapiens
tgcccacctaacagtgtttgga

SEQ ID NO: 9441220 - DNA, 22 bp, Homo sapiens
tgcccacctaacagtgtttgga

SEQ ID NO: 9441221 - DNA, 22 bp, Homo sapiens
tgcccacctttactgtgattta

SEQ ID NO: 9441222 - DNA, 22 bp, Homo sapiens
tgcccacctttactgtgattta

SEQ ID NO: 9441223 - DNA, 21 bp, Homo sapiens
tgcccaccaagctccacactg

SEQ ID NO: 9441224 - DNA, 18 bp, Homo sapiens
tgcccaccagaagaggga

SEQ ID NO: 9441225 - DNA, 20 bp, Homo sapiens
tgcccagcaagagtgcagtt

SEQ ID NO: 9441226 - DNA, 20 bp, Homo sapiens
tgcccagcaagagtgcagtt

SEQ ID NO: 9441227 - DNA, 22 bp, Homo sapiens
tgcccacttcaaaatcttcatt

SEQ ID NO: 9441228 - DNA, 22 bp, Homo sapiens
tgcccactcttttgatttgtgt

SEQ ID NO: 9441229 - DNA, 22 bp, Homo sapiens
tgcccactggataatgcaaact

SEQ ID NO: 9441230 - DNA, 22 bp, Homo sapiens
tgcccactgtgtcaaagaaata

SEQ ID NO: 9441231 - DNA, 22 bp, Homo sapiens
tgcccagaatagatgggctgtg

SEQ ID NO: 9441232 - DNA, 22 bp, Homo sapiens
tgcccagaatagatgggctgtg

SEQ ID NO: 9441233 - DNA, 22 bp, Homo sapiens
tgcccagcactgtgccagtcac

SEQ ID NO: 9441234 - DNA, 22 bp, Homo sapiens
tgcccagcacccagcatgatgc

SEQ ID NO: 9441235 - DNA, 22 bp, Homo sapiens
tgcccagcacccagcatgatgc

SEQ ID NO: 9441236 - DNA, 22 bp, Homo sapiens
tgcccagcaataaaccagaaga

SEQ ID NO: 9441237 - DNA, 20 bp, Homo sapiens
tgcccagcaagagtgcagtt

SEQ ID NO: 9441238 - DNA, 22 bp, Homo sapiens
tgcccagcaataaaccagaaga

SEQ ID NO: 9441239 - DNA, 22 bp, Homo sapiens
tgcccagcacccagcatgatgc

SEQ ID NO: 9441240 - DNA, 20 bp, Homo sapiens
tgcccagcaagagtgcagtt

SEQ ID NO: 9441241 - DNA, 22 bp, Homo sapiens
tgcccagcaataaaccagaaga

SEQ ID NO: 9441242 - DNA, 22 bp, Homo sapiens
tgcccagcaataaaccagaaga

SEQ ID NO: 9441243 - DNA, 22 bp, Homo sapiens
tgcccagcaataaaccagaaga

SEQ ID NO: 9441244 - DNA, 22 bp, Homo sapiens
tgcccagcactgtgccagtcac

SEQ ID NO: 9441245 - DNA, 22 bp, Homo sapiens
tgcccagcactgtgccagtcac

SEQ ID NO: 9441246 - DNA, 22 bp, Homo sapiens
tgcccagcactgtgccagtcac

SEQ ID NO: 9441247 - DNA, 22 bp, Homo sapiens
tgcccagcactgtgccagtcac

SEQ ID NO: 9441248 - DNA, 22 bp, Homo sapiens
tgcccagcactgtgccagtcac

SEQ ID NO: 9441249 - DNA, 22 bp, Homo sapiens
tgcccagcactgtgccagtcac

SEQ ID NO: 9441250 - DNA, 22 bp, Homo sapiens
tgcccagcactgtgccagtcac

SEQ ID NO: 9441251 - DNA, 22 bp, Homo sapiens
tgcccagcagggagctacctgg

SEQ ID NO: 9441252 - DNA, 22 bp, Homo sapiens
tgcccagcagggagctacctgg

SEQ ID NO: 9441253 - DNA, 22 bp, Homo sapiens
tgcccagcagggagctacctgg

SEQ ID NO: 9441254 - DNA, 22 bp, Homo sapiens
tgcccagcagggagctacctgg

SEQ ID NO: 9441255 - DNA, 22 bp, Homo sapiens
tgcccagcagggagctacctgg

SEQ ID NO: 9441256 - DNA, 22 bp, Homo sapiens
tgcccaggatctggcgatgctc

SEQ ID NO: 9441257 - DNA, 22 bp, Homo sapiens
tgccaggccctcccacagatta

SEQ ID NO: 9441258 - DNA, 22 bp, Homo sapiens
tgccaggcccagctccagagct

SEQ ID NO: 9441259 - DNA, 22 bp, Homo sapiens
tgccaggcccagctccagagct

SEQ ID NO: 9441260 - DNA, 22 bp, Homo sapiens
tgccaggcccagctccagagct

SEQ ID NO: 9441261 - DNA, 22 bp, Homo sapiens
tgccaggccctgtgctggatgc

SEQ ID NO: 9441262 - DNA, 22 bp, Homo sapiens
tgccaggccctgcggggtccca

SEQ ID NO: 9441263 - DNA, 22 bp, Homo sapiens
tgccaggccctgcggggtccca

SEQ ID NO: 9441264 - DNA, 22 bp, Homo sapiens
tgccaggccctcccacagatta

SEQ ID NO: 9441265 - DNA, 22 bp, Homo sapiens
tgccaggccctcccacagatta

SEQ ID NO: 9441266 - DNA, 22 bp, Homo sapiens
tgccaggctcagcccctatctt

SEQ ID NO: 9441267 - DNA, 22 bp, Homo sapiens
tgccaggctaagtggaggactt

SEQ ID NO: 9441268 - DNA, 22 bp, Homo sapiens
tgccaggccctgtgctggatgc

SEQ ID NO: 9441269 - DNA, 22 bp, Homo sapiens
tgccaggctaagtggaggactt

SEQ ID NO: 9441270 - DNA, 22 bp, Homo sapiens
tgccaggctcagcccctatctt

SEQ ID NO: 9441271 - DNA, 22 bp, Homo sapiens
tgccaggctcaggatgtccctg

SEQ ID NO: 9441272 - DNA, 22 bp, Homo sapiens
tgccaggctaagtggaggactt

SEQ ID NO: 9441273 - DNA, 22 bp, Homo sapiens
tgccaggccctgtgctggatgc

SEQ ID NO: 9441274 - DNA, 22 bp, Homo sapiens
tgccaggccaatgaaggcaggg

SEQ ID NO: 9441275 - DNA, 22 bp, Homo sapiens
tgccaggccaattctatttgac

SEQ ID NO: 9441276 - DNA, 22 bp, Homo sapiens
tgccaggccaatgaaggcaggg

SEQ ID NO: 9441277 - DNA, 22 bp, Homo sapiens
tgccaggccaattctatttgac

SEQ ID NO: 9441278 - DNA, 22 bp, Homo sapiens
tgccaggccaatgaaggcaggg

SEQ ID NO: 9441279 - DNA, 22 bp, Homo sapiens
tgccaggcatttgacagacact

SEQ ID NO: 9441280 - DNA, 22 bp, Homo sapiens
tgccaggcatgtagtagacttg

SEQ ID NO: 9441281 - DNA, 22 bp, Homo sapiens
tgccaggcatttgacagacact

SEQ ID NO: 9441282 - DNA, 22 bp, Homo sapiens
tgccaggcccagcagggcggcc

SEQ ID NO: 9441283 - DNA, 22 bp, Homo sapiens
tgccaggccacgtagcttcaag

SEQ ID NO: 9441284 - DNA, 22 bp, Homo sapiens
tgccaggccacgtagcttcaag

SEQ ID NO: 9441285 - DNA, 22 bp, Homo sapiens
tgccaggcccagctccagagct

SEQ ID NO: 9441286 - DNA, 22 bp, Homo sapiens
tgccaggcccagcagggcggcc

SEQ ID NO: 9441287 - DNA, 22 bp, Homo sapiens
tgccaggcccagcagggcggcc

SEQ ID NO: 9441288 - DNA, 20 bp, Homo sapiens
tgccaggcacggagtgcatg

SEQ ID NO: 9441289 - DNA, 22 bp, Homo sapiens
tgccaggcacgtgagagtggcc

SEQ ID NO: 9441290 - DNA, 22 bp, Homo sapiens
tgccaggcacgtgagagtggcc

SEQ ID NO: 9441291 - DNA, 22 bp, Homo sapiens
tgccaggcaggaccctagaacc

SEQ ID NO: 9441292 - DNA, 22 bp, Homo sapiens
tgccaggcaggaccctagaacc

SEQ ID NO: 9441293 - DNA, 22 bp, Homo sapiens
tgccaggcacgtgagagtggcc

SEQ ID NO: 9441294 - DNA, 22 bp, Homo sapiens
tgccaggcacgtgagagtggcc

SEQ ID NO: 9441295 - DNA, 22 bp, Homo sapiens
tgccaggcagtgtcagattgag

SEQ ID NO: 9441296 - DNA, 22 bp, Homo sapiens
tgccaggcagtgtcagattgag

SEQ ID NO: 9441297 - DNA, 22 bp, Homo sapiens
tgccaggcaggaccctagaacc

SEQ ID NO: 9441298 - DNA, 22 bp, Homo sapiens
tgccaggcatatggcctctttg

SEQ ID NO: 9441299 - DNA, 22 bp, Homo sapiens
tgccaggcagtgtcagattgag

SEQ ID NO: 9441300 - DNA, 22 bp, Homo sapiens
tgccaggcatgtagtagacttg

SEQ ID NO: 9441301 - DNA, 22 bp, Homo sapiens
tgccaggcatatggcctctttg

SEQ ID NO: 9441302 - DNA, 22 bp, Homo sapiens
tgccaggcatgtagtagacttg

SEQ ID NO: 9441303 - DNA, 22 bp, Homo sapiens
tgccaggcatatggcctctttg

SEQ ID NO: 9441304 - DNA, 22 bp, Homo sapiens
tgccagctagtcacatattaga

SEQ ID NO: 9441305 - DNA, 22 bp, Homo sapiens
tgccagctagagaagctagaaa

SEQ ID NO: 9441306 - DNA, 17 bp, Homo sapiens
tgccagcctgtcccagg

SEQ ID NO: 9441307 - DNA, 22 bp, Homo sapiens
tgccagctactctgtaggctga

SEQ ID NO: 9441308 - DNA, 22 bp, Homo sapiens
tgccagcctggcctgagtcttt

SEQ ID NO: 9441309 - DNA, 17 bp, Homo sapiens
tgccagcctgtcccagg

SEQ ID NO: 9441310 - DNA, 22 bp, Homo sapiens
tgccagcccaccttggggcctc

SEQ ID NO: 9441311 - DNA, 18 bp, Homo sapiens
tgccagccgactggcctg

SEQ ID NO: 9441312 - DNA, 18 bp, Homo sapiens
tgccagccgactggcctg

SEQ ID NO: 9441313 - DNA, 22 bp, Homo sapiens
tgccagcctcctgatatcatcc

SEQ ID NO: 9441314 - DNA, 22 bp, Homo sapiens
tgccagcctggcctgagtcttt

SEQ ID NO: 9441315 - DNA, 22 bp, Homo sapiens
tgccagcctggcctgagtcttt

SEQ ID NO: 9441316 - DNA, 22 bp, Homo sapiens
tgccaggatggccagggggcca

SEQ ID NO: 9441317 - DNA, 20 bp, Homo sapiens
tgccaggcacggagtgcatg

SEQ ID NO: 9441318 - DNA, 22 bp, Homo sapiens
tgccaggcaactgcccagccat

SEQ ID NO: 9441319 - DNA, 22 bp, Homo sapiens
tgccaggcaactgcccagccat

SEQ ID NO: 9441320 - DNA, 22 bp, Homo sapiens
tgccaggctccggaacgacagt

SEQ ID NO: 9441321 - DNA, 22 bp, Homo sapiens
tgccaggctccggaacgacagt

SEQ ID NO: 9441322 - DNA, 22 bp, Homo sapiens
tgccaggctcaggatgtccctg

SEQ ID NO: 9441323 - DNA, 22 bp, Homo sapiens
tgccaggctccggaacgacagt

SEQ ID NO: 9441324 - DNA, 22 bp, Homo sapiens
tgccaggctgaacagggtctta

SEQ ID NO: 9441325 - DNA, 20 bp, Homo sapiens
tgccaggctgcacgcctgcc

SEQ ID NO: 9441326 - DNA, 22 bp, Homo sapiens
tgccaggctgaacagggtctta

SEQ ID NO: 9441327 - DNA, 22 bp, Homo sapiens
tgccaggctgaacagggtctta

SEQ ID NO: 9441328 - DNA, 22 bp, Homo sapiens
tgccaggctgtcctgggcctgg

SEQ ID NO: 9441329 - DNA, 22 bp, Homo sapiens
tgccaggctgtcaattcaccca

SEQ ID NO: 9441330 - DNA, 22 bp, Homo sapiens
tgccaggctgtcctgggcctgg

SEQ ID NO: 9441331 - DNA, 22 bp, Homo sapiens
tgccaggctgtcaattcaccca

SEQ ID NO: 9441332 - DNA, 22 bp, Homo sapiens
tgccaggctgccctccagtctg

SEQ ID NO: 9441333 - DNA, 22 bp, Homo sapiens
tgccaggctgccctccagtctg

SEQ ID NO: 9441334 - DNA, 20 bp, Homo sapiens
tgccaggctgcacgcctgcc

SEQ ID NO: 9441335 - DNA, 20 bp, Homo sapiens
tgccaggctgcacgcctgcc

SEQ ID NO: 9441336 - DNA, 22 bp, Homo sapiens
tgccaggcttagagcaggggct

SEQ ID NO: 9441337 - DNA, 22 bp, Homo sapiens
tgccaggcttagagcaggggct

SEQ ID NO: 9441338 - DNA, 22 bp, Homo sapiens
tgccaggctttggtcaaaggct

SEQ ID NO: 9441339 - DNA, 22 bp, Homo sapiens
tgccagggagccctgctgacca

SEQ ID NO: 9441340 - DNA, 22 bp, Homo sapiens
tgccagggaccctgtcggccct

SEQ ID NO: 9441341 - DNA, 22 bp, Homo sapiens
tgccagggaccctgtcggccct

SEQ ID NO: 9441342 - DNA, 22 bp, Homo sapiens
tgccagggaccctgtcggccct

SEQ ID NO: 9441343 - DNA, 22 bp, Homo sapiens
tgccaggctttggtcaaaggct

SEQ ID NO: 9441344 - DNA, 22 bp, Homo sapiens
tgccaggctttggtcaaaggct

SEQ ID NO: 9441345 - DNA, 21 bp, Homo sapiens
tgccagggatttacagagcct

SEQ ID NO: 9441346 - DNA, 20 bp, Homo sapiens
tgccagggccagcagaggct

SEQ ID NO: 9441347 - DNA, 22 bp, Homo sapiens
tgccagggagccctgctgacca

SEQ ID NO: 9441348 - DNA, 21 bp, Homo sapiens
tgccagggatttacagagcct

SEQ ID NO: 9441349 - DNA, 22 bp, Homo sapiens
tgccagggtgtcaggagagcta

SEQ ID NO: 9441350 - DNA, 22 bp, Homo sapiens
tgccagggtgtcaggagagcta

SEQ ID NO: 9441351 - DNA, 22 bp, Homo sapiens
tgccatcctgtgtcatgctcat

SEQ ID NO: 9441352 - DNA, 22 bp, Homo sapiens
tgccatcctgtgtcatgctcat

SEQ ID NO: 9441353 - DNA, 18 bp, Homo sapiens
tgccatccccagtcaagt

SEQ ID NO: 9441354 - DNA, 22 bp, Homo sapiens
tgccatctgcacccacctgccc

SEQ ID NO: 9441355 - DNA, 22 bp, Homo sapiens
tgccaggggacctagggatgtc

SEQ ID NO: 9441356 - DNA, 22 bp, Homo sapiens
tgccaggggacctagggatgtc

SEQ ID NO: 9441357 - DNA, 22 bp, Homo sapiens
tgccagggtcctgagggccttg

SEQ ID NO: 9441358 - DNA, 22 bp, Homo sapiens
tgccagggtcctgagggccttg

SEQ ID NO: 9441359 - DNA, 20 bp, Homo sapiens
tgccagggccagcagaggct

SEQ ID NO: 9441360 - DNA, 22 bp, Homo sapiens
tgccagggccatagggagtcta

SEQ ID NO: 9441361 - DNA, 22 bp, Homo sapiens
tgccagggccatagggagtcta

SEQ ID NO: 9441362 - DNA, 22 bp, Homo sapiens
tgccagggctgctactggctga

SEQ ID NO: 9441363 - DNA, 23 bp, Homo sapiens
tgccagggccctgtgtgcaatgc

SEQ ID NO: 9441364 - DNA, 23 bp, Homo sapiens
tgccagggccctgtgtgcaatgc

SEQ ID NO: 9441365 - DNA, 22 bp, Homo sapiens
tgcagggattagaggccgggga

SEQ ID NO: 9441366 - DNA, 22 bp, Homo sapiens
tgcagggattagaggccgggga

SEQ ID NO: 9441367 - DNA, 21 bp, Homo sapiens
tgcagggatctttctgcctga

SEQ ID NO: 9441368 - DNA, 22 bp, Homo sapiens
tgcagggatgctagaggtaaga

SEQ ID NO: 9441369 - DNA, 22 bp, Homo sapiens
tgcagggatgctagaggtaaga

SEQ ID NO: 9441370 - DNA, 22 bp, Homo sapiens
tgcagggattgttggcatccat

SEQ ID NO: 9441371 - DNA, 22 bp, Homo sapiens
tgcagggattatgtaggggttg

SEQ ID NO: 9441372 - DNA, 22 bp, Homo sapiens
tgcagggattatgtaggggttg

SEQ ID NO: 9441373 - DNA, 23 bp, Homo sapiens
tgcagggcaagttagagacccca

SEQ ID NO: 9441374 - DNA, 22 bp, Homo sapiens
tgcagggcacacgcacgggtgt

SEQ ID NO: 9441375 - DNA, 22 bp, Homo sapiens
tgcagggcacggtgcgcgtggg

SEQ ID NO: 9441376 - DNA, 22 bp, Homo sapiens
tgcagggcagatatgactgtag

SEQ ID NO: 9441377 - DNA, 22 bp, Homo sapiens
tgcagggcagctagggagcttt

SEQ ID NO: 9441378 - DNA, 22 bp, Homo sapiens
tgcagggcccttggggttgaac

SEQ ID NO: 9441379 - DNA, 22 bp, Homo sapiens
tgcagggcccctctgcatgagt

SEQ ID NO: 9441380 - DNA, 22 bp, Homo sapiens
tgcagggcccctctgcatgagt

SEQ ID NO: 9441381 - DNA, 22 bp, Homo sapiens
tgcagggccgctggaggtcatg

SEQ ID NO: 9441382 - DNA, 22 bp, Homo sapiens
tgcagggctacaggactacaac

SEQ ID NO: 9441383 - DNA, 22 bp, Homo sapiens
tgcagggccagactgggttgga

SEQ ID NO: 9441384 - DNA, 22 bp, Homo sapiens
tgcagggccatggtggcggctg

SEQ ID NO: 9441385 - DNA, 22 bp, Homo sapiens
tgcagggccatggtggcggctg

SEQ ID NO: 9441386 - DNA, 22 bp, Homo sapiens
tgcagggcatctttgaagtgtg

SEQ ID NO: 9441387 - DNA, 22 bp, Homo sapiens
tgcagggcagtttgtttcggca

SEQ ID NO: 9441388 - DNA, 22 bp, Homo sapiens
tgcagggcatagggtccagttt

SEQ ID NO: 9441389 - DNA, 17 bp, Homo sapiens
tgcaggctcctgtccct

SEQ ID NO: 9441390 - DNA, 22 bp, Homo sapiens
tgcaggctccatgaggacaggc

SEQ ID NO: 9441391 - DNA, 22 bp, Homo sapiens
tgcaggctctggtttatagtgc

SEQ ID NO: 9441392 - DNA, 22 bp, Homo sapiens
tgcaggctctctgctgccagat

SEQ ID NO: 9441393 - DNA, 22 bp, Homo sapiens
tgcaggctgaggctggctcaac

SEQ ID NO: 9441394 - DNA, 22 bp, Homo sapiens
tgcaggctgcagtctcaggtgg

SEQ ID NO: 9441395 - DNA, 22 bp, Homo sapiens
tgcaggctgcagtctcaggtgg

SEQ ID NO: 9441396 - DNA, 22 bp, Homo sapiens
tgcaggctgcacccctgccctg

SEQ ID NO: 9441397 - DNA, 22 bp, Homo sapiens
tgcaggctggcagatatctcat

SEQ ID NO: 9441398 - DNA, 22 bp, Homo sapiens
tgcaggctggcagtgctgaaat

SEQ ID NO: 9441399 - DNA, 22 bp, Homo sapiens
tgcaggctggaggagggactaa

SEQ ID NO: 9441400 - DNA, 22 bp, Homo sapiens
tgcaggctgggaagagggacaa

SEQ ID NO: 9441401 - DNA, 22 bp, Homo sapiens
tgcaggctgggaagagggacaa

SEQ ID NO: 9441402 - DNA, 22 bp, Homo sapiens
tgcaggctggggaggcagactt

SEQ ID NO: 9441403 - DNA, 18 bp, Homo sapiens
tgcaggctggggttcctc

SEQ ID NO: 9441404 - DNA, 22 bp, Homo sapiens
tgcaggctggggaggcagactt

SEQ ID NO: 9441405 - DNA, 22 bp, Homo sapiens
tgcagggaagtcccagctcctg

SEQ ID NO: 9441406 - DNA, 22 bp, Homo sapiens
tgcagggaatccagtctagggt

SEQ ID NO: 9441407 - DNA, 22 bp, Homo sapiens
tgcagggaatccagtctagggt

SEQ ID NO: 9441408 - DNA, 22 bp, Homo sapiens
tgcagggaatccagtctagggt

SEQ ID NO: 9441409 - DNA, 22 bp, Homo sapiens
tgcagggaatccagtctagggt

SEQ ID NO: 9441410 - DNA, 22 bp, Homo sapiens
tgcagggaagcaagggtggctc

SEQ ID NO: 9441411 - DNA, 22 bp, Homo sapiens
tgcagggaaagtgttggcagca

SEQ ID NO: 9441412 - DNA, 22 bp, Homo sapiens
tgcagggaaagtgttggcagca

SEQ ID NO: 9441413 - DNA, 22 bp, Homo sapiens
tgcagggaaagtgttggcagca

SEQ ID NO: 9441414 - DNA, 22 bp, Homo sapiens
tgcagggaaagggcactgggct

SEQ ID NO: 9441415 - DNA, 22 bp, Homo sapiens
tgcagggaacttggacagctag

SEQ ID NO: 9441416 - DNA, 22 bp, Homo sapiens
tgcagggaacttggacagctag

SEQ ID NO: 9441417 - DNA, 22 bp, Homo sapiens
tgcagggaacttggacagctag

SEQ ID NO: 9441418 - DNA, 22 bp, Homo sapiens
tgcagggaaaacccaggatgct

SEQ ID NO: 9441419 - DNA, 22 bp, Homo sapiens
tgcagggaaaacccaggatgct

SEQ ID NO: 9441420 - DNA, 22 bp, Homo sapiens
tgcagggaaaacccaggatgct

SEQ ID NO: 9441421 - DNA, 22 bp, Homo sapiens
tgcaggctttagccccatggct

SEQ ID NO: 9441422 - DNA, 22 bp, Homo sapiens
tgcaggcttggatcacatctcc

SEQ ID NO: 9441423 - DNA, 21 bp, Homo sapiens
tgcaggctgtgcgctcctgcc

SEQ ID NO: 9441424 - DNA, 21 bp, Homo sapiens
tgcaggctgtgcgctcctgcc

SEQ ID NO: 9441425 - DNA, 17 bp, Homo sapiens
tgcaggctgttatagcc

SEQ ID NO: 9441426 - DNA, 17 bp, Homo sapiens
tgcaggctgttatagcc

SEQ ID NO: 9441427 - DNA, 21 bp, Homo sapiens
tgcaggctgtttaagaggcaa

SEQ ID NO: 9441428 - DNA, 22 bp, Homo sapiens
tgcaggctgtttggtggatctc

SEQ ID NO: 9441429 - DNA, 22 bp, Homo sapiens
tgcaggtgagtgcaggggctca

SEQ ID NO: 9441430 - DNA, 22 bp, Homo sapiens
tgcaggtgagtgcaggggctca

SEQ ID NO: 9441431 - DNA, 22 bp, Homo sapiens
tgcaggtgagtgcaggggctca

SEQ ID NO: 9441432 - DNA, 22 bp, Homo sapiens
tgcaggtgaaaattatgaggat

SEQ ID NO: 9441433 - DNA, 22 bp, Homo sapiens
tgcaggtgaaaattatgaggat

SEQ ID NO: 9441434 - DNA, 22 bp, Homo sapiens
tgcaggtaaatttgtggaggat

SEQ ID NO: 9441435 - DNA, 22 bp, Homo sapiens
tgcaggtacttgacaacttggg

SEQ ID NO: 9441436 - DNA, 22 bp, Homo sapiens
tgcaggtggattcaatgtggga

SEQ ID NO: 9441437 - DNA, 22 bp, Homo sapiens
tgcaggtggattcaatgtggga

SEQ ID NO: 9441438 - DNA, 22 bp, Homo sapiens
tgcaggtggatatctcatcaga

SEQ ID NO: 9441439 - DNA, 22 bp, Homo sapiens
tgcaggtggcagcggggcacca

SEQ ID NO: 9441440 - DNA, 22 bp, Homo sapiens
tgcaggtggcagcggggcacca

SEQ ID NO: 9441441 - DNA, 22 bp, Homo sapiens
tgcaggtggctccagggactgc

SEQ ID NO: 9441442 - DNA, 22 bp, Homo sapiens
tgcaggtggctccagggactgc

SEQ ID NO: 9441443 - DNA, 22 bp, Homo sapiens
tgcaggtggctccagggactgc

SEQ ID NO: 9441444 - DNA, 22 bp, Homo sapiens
tgcaggtgattctgatgcagtt

SEQ ID NO: 9441445 - DNA, 22 bp, Homo sapiens
tgcaggtgattctgatgcagtt

SEQ ID NO: 9441446 - DNA, 22 bp, Homo sapiens
tgcaggtggacacgggagacgg

SEQ ID NO: 9441447 - DNA, 22 bp, Homo sapiens
tgcaggtggatatctcatcaga

SEQ ID NO: 9441448 - DNA, 22 bp, Homo sapiens
tgcaggtgcagcgatactgtga

SEQ ID NO: 9441449 - DNA, 22 bp, Homo sapiens
tgcaggtggacacgggagacgg

SEQ ID NO: 9441450 - DNA, 22 bp, Homo sapiens
tgcaggtggacacgggagacgg

SEQ ID NO: 9441451 - DNA, 22 bp, Homo sapiens
tgcagggcttcctcttggagtt

SEQ ID NO: 9441452 - DNA, 23 bp, Homo sapiens
tgcaggggaggcttaaagcaggt

SEQ ID NO: 9441453 - DNA, 19 bp, Homo sapiens
tgcagggctgcgcctgggg

SEQ ID NO: 9441454 - DNA, 19 bp, Homo sapiens
tgcagggctgcgcctgggg

SEQ ID NO: 9441455 - DNA, 22 bp, Homo sapiens
tgcagggtgcacagtggggtgc

SEQ ID NO: 9441456 - DNA, 22 bp, Homo sapiens
tgcaggggcttgtctgggcctg

SEQ ID NO: 9441457 - DNA, 22 bp, Homo sapiens
tgcaggggcttgtctgggcctg

SEQ ID NO: 9441458 - DNA, 22 bp, Homo sapiens
tgcaggggcttgtctgggcctg

SEQ ID NO: 9441459 - DNA, 22 bp, Homo sapiens
tgcaggggcttgtctgggcctg

SEQ ID NO: 9441460 - DNA, 22 bp, Homo sapiens
tgcaggggcttgtctgggcctg

SEQ ID NO: 9441461 - DNA, 22 bp, Homo sapiens
tgcaggtgtgggcaggggagca

SEQ ID NO: 9441462 - DNA, 22 bp, Homo sapiens
tgcaggtgtgggcaggggagca

SEQ ID NO: 9441463 - DNA, 20 bp, Homo sapiens
tgcaggtgtgtccaagcact

SEQ ID NO: 9441464 - DNA, 22 bp, Homo sapiens
tgcaggtgtgtgcaagggaggg

SEQ ID NO: 9441465 - DNA, 22 bp, Homo sapiens
tgcaggtgtgtgcaagggaggg

SEQ ID NO: 9441466 - DNA, 20 bp, Homo sapiens
tgcaggtgttggagaaggta

SEQ ID NO: 9441467 - DNA, 22 bp, Homo sapiens
tgcaggtgtctgggggcaacag

SEQ ID NO: 9441468 - DNA, 22 bp, Homo sapiens
tgcaggtgtctgggggcaacag

SEQ ID NO: 9441469 - DNA, 22 bp, Homo sapiens
tgcaggtgtctctgtctagcgt

SEQ ID NO: 9441470 - DNA, 23 bp, Homo sapiens
tgcaggtgtgcagagggctcttg

SEQ ID NO: 9441471 - DNA, 22 bp, Homo sapiens
tgcaggtgtgggcaggggagca

SEQ ID NO: 9441472 - DNA, 22 bp, Homo sapiens
tgcaggtgtgggcaggggagca

SEQ ID NO: 9441473 - DNA, 22 bp, Homo sapiens
tgcaggtggtttggacactgct

SEQ ID NO: 9441474 - DNA, 22 bp, Homo sapiens
tgcaggtgtagagttgggctcc

SEQ ID NO: 9441475 - DNA, 22 bp, Homo sapiens
tgcaggtgtagagttgggctcc

SEQ ID NO: 9441476 - DNA, 22 bp, Homo sapiens
tgcaggtgtctccagggcaggt

SEQ ID NO: 9441477 - DNA, 22 bp, Homo sapiens
tgcaggtgtctccagggcaggt

SEQ ID NO: 9441478 - DNA, 22 bp, Homo sapiens
tgcaggtgtctccagggcaggt

SEQ ID NO: 9441479 - DNA, 22 bp, Homo sapiens
tgcaggtgtctccagggcaggt

SEQ ID NO: 9441480 - DNA, 22 bp, Homo sapiens
tgcagtgtttggatgctgagtc

SEQ ID NO: 9441481 - DNA, 22 bp, Homo sapiens
tgcagtgttcctgtgggtttat

SEQ ID NO: 9441482 - DNA, 23 bp, Homo sapiens
tgcagtgtttaacaatgacttga

SEQ ID NO: 9441483 - DNA, 22 bp, Homo sapiens
tgcagtgtggccatgtcagcta

SEQ ID NO: 9441484 - DNA, 22 bp, Homo sapiens
tgcagtgttcctgtagcctgcc

SEQ ID NO: 9441485 - DNA, 22 bp, Homo sapiens
tgcagtgtgacctgtagcgagc

SEQ ID NO: 9441486 - DNA, 20 bp, Homo sapiens
tgcagtgtcctcacttgtca

SEQ ID NO: 9441487 - DNA, 22 bp, Homo sapiens
tgcagtggttgagagcccagac

SEQ ID NO: 9441488 - DNA, 21 bp, Homo sapiens
tgcagtgtccctaacagtggt

SEQ ID NO: 9441489 - DNA, 22 bp, Homo sapiens
tgcagtgggccggaggccaggg

SEQ ID NO: 9441490 - DNA, 22 bp, Homo sapiens
tgcagtggtggtaaagatgctc

SEQ ID NO: 9441491 - DNA, 22 bp, Homo sapiens
tgcaggttctgaccagccaact

SEQ ID NO: 9441492 - DNA, 21 bp, Homo sapiens
tgcagtatgtatttgtatcca

SEQ ID NO: 9441493 - DNA, 23 bp, Homo sapiens
tgcagtaggatggggctgggcct

SEQ ID NO: 9441494 - DNA, 22 bp, Homo sapiens
tgcagtcctggtgaggggacat

SEQ ID NO: 9441495 - DNA, 21 bp, Homo sapiens
tgcagtcctttgacatgattc

SEQ ID NO: 9441496 - DNA, 22 bp, Homo sapiens
tgcagtccaagagtctcctggt

SEQ ID NO: 9441497 - DNA, 22 bp, Homo sapiens
tgcagtccaagagtctcctggt

SEQ ID NO: 9441498 - DNA, 21 bp, Homo sapiens
tgccagcatgtaggctagttg

SEQ ID NO: 9441499 - DNA, 21 bp, Homo sapiens
tgccagcatgtaggctagttg

SEQ ID NO: 9441500 - DNA, 19 bp, Homo sapiens
tgccagcattaggctgaag

SEQ ID NO: 9441501 - DNA, 21 bp, Homo sapiens
tgccagcatgtaggctagttg

SEQ ID NO: 9441502 - DNA, 22 bp, Homo sapiens
tgccagcagtagcagtaggcca

SEQ ID NO: 9441503 - DNA, 23 bp, Homo sapiens
tgccagcagggaatgggaaggac

SEQ ID NO: 9441504 - DNA, 23 bp, Homo sapiens
tgccagcagggaatgggaaggac

SEQ ID NO: 9441505 - DNA, 22 bp, Homo sapiens
tgccagccaggttctgaggcta

SEQ ID NO: 9441506 - DNA, 22 bp, Homo sapiens
tgccagccaggttctgaggcta

SEQ ID NO: 9441507 - DNA, 22 bp, Homo sapiens
tgccagccaggttctgaggcta

SEQ ID NO: 9441508 - DNA, 22 bp, Homo sapiens
tgccagccaggttctgaggcta

SEQ ID NO: 9441509 - DNA, 22 bp, Homo sapiens
tgccagcccaccttggggcctc

SEQ ID NO: 9441510 - DNA, 22 bp, Homo sapiens
tgccagcccaccttggggcctc

SEQ ID NO: 9441511 - DNA, 19 bp, Homo sapiens
tgccagcattaggctgaag

SEQ ID NO: 9441512 - DNA, 22 bp, Homo sapiens
tgccagccagggaagctcaccc

SEQ ID NO: 9441513 - DNA, 22 bp, Homo sapiens
tgccagccagggaagctcaccc

SEQ ID NO: 9441514 - DNA, 22 bp, Homo sapiens
tgccagcaagaatagacagtaa

SEQ ID NO: 9441515 - DNA, 22 bp, Homo sapiens
tgccagcaagaatagacagtaa

SEQ ID NO: 9441516 - DNA, 23 bp, Homo sapiens
tgccagaggcagtcacagtggtg

SEQ ID NO: 9441517 - DNA, 22 bp, Homo sapiens
tgccagagttacatgagggtca

SEQ ID NO: 9441518 - DNA, 22 bp, Homo sapiens
tgccagcacaagttaagagatc

SEQ ID NO: 9441519 - DNA, 22 bp, Homo sapiens
tgccagcacaagttaagagatc

SEQ ID NO: 9441520 - DNA, 22 bp, Homo sapiens
tgccagcaccttcctgctccct

SEQ ID NO: 9441521 - DNA, 22 bp, Homo sapiens
tgccagcacttctggctgtctg

SEQ ID NO: 9441522 - DNA, 23 bp, Homo sapiens
tgccagaggcagtcacagtggtg

SEQ ID NO: 9441523 - DNA, 23 bp, Homo sapiens
tgccagaggcagtcacagtggtg

SEQ ID NO: 9441524 - DNA, 22 bp, Homo sapiens
tgccagagatttcacactgcta

SEQ ID NO: 9441525 - DNA, 22 bp, Homo sapiens
tgccagagagtggctgggtgtc

SEQ ID NO: 9441526 - DNA, 19 bp, Homo sapiens
tgccagagatactcccaga

SEQ ID NO: 9441527 - DNA, 22 bp, Homo sapiens
tgccagagaggagaaagcattt

SEQ ID NO: 9441528 - DNA, 22 bp, Homo sapiens
tgccagagaagacccagtcact

SEQ ID NO: 9441529 - DNA, 22 bp, Homo sapiens
tgccaccccggaccccgaagtg

SEQ ID NO: 9441530 - DNA, 22 bp, Homo sapiens
tgccaccaggagaaccagtgca

SEQ ID NO: 9441531 - DNA, 22 bp, Homo sapiens
tgccaccaggagaaccagtgca

SEQ ID NO: 9441532 - DNA, 22 bp, Homo sapiens
tgccacatggtgcatttcctag

SEQ ID NO: 9441533 - DNA, 22 bp, Homo sapiens
tgccacagtttcatggattctg

SEQ ID NO: 9441534 - DNA, 22 bp, Homo sapiens
tgccacagttgtttgtgctcta

SEQ ID NO: 9441535 - DNA, 22 bp, Homo sapiens
tgccacagttgtttgtgctcta

SEQ ID NO: 9441536 - DNA, 22 bp, Homo sapiens
tgccacagggtcctcaggccag

SEQ ID NO: 9441537 - DNA, 22 bp, Homo sapiens
tgccacagttgtttgtgctcta

SEQ ID NO: 9441538 - DNA, 22 bp, Homo sapiens
tgccaaattgaattacataatt

SEQ ID NO: 9441539 - DNA, 17 bp, Homo sapiens
tgccaagaagagcagag

SEQ ID NO: 9441540 - DNA, 22 bp, Homo sapiens
tgccagagaagacccagtcact

SEQ ID NO: 9441541 - DNA, 22 bp, Homo sapiens
tgccactggctcaatggtgcag

SEQ ID NO: 9441542 - DNA, 22 bp, Homo sapiens
tgccactggggctaggactgtt

SEQ ID NO: 9441543 - DNA, 22 bp, Homo sapiens
tgccaccctctctgctacccgc

SEQ ID NO: 9441544 - DNA, 22 bp, Homo sapiens
tgccacccctctgcaccctcag

SEQ ID NO: 9441545 - DNA, 22 bp, Homo sapiens
tgccacccctctgcaccctcag

SEQ ID NO: 9441546 - DNA, 23 bp, Homo sapiens
tgccacccttctcttcccagctt

SEQ ID NO: 9441547 - DNA, 22 bp, Homo sapiens
tgccacctcctctaacaagtgg

SEQ ID NO: 9441548 - DNA, 22 bp, Homo sapiens
tgccaaaatggccaaaagctag

SEQ ID NO: 9441549 - DNA, 22 bp, Homo sapiens
tgcatttttgataactgtgtac

SEQ ID NO: 9441550 - DNA, 22 bp, Homo sapiens
tgccaaaatggccaaaagctag

SEQ ID NO: 9441551 - DNA, 22 bp, Homo sapiens
tgccaaatgccaccacagctgc

SEQ ID NO: 9441552 - DNA, 22 bp, Homo sapiens
tgccaaattagagttcccaggc

SEQ ID NO: 9441553 - DNA, 22 bp, Homo sapiens
tgccaaaatgggctttataccg

SEQ ID NO: 9441554 - DNA, 23 bp, Homo sapiens
tgccaaagtttacctaacactgg

SEQ ID NO: 9441555 - DNA, 22 bp, Homo sapiens
tgccaaagaagtatcaaagatg

SEQ ID NO: 9441556 - DNA, 22 bp, Homo sapiens
tgcattttcttccaccaatatc

SEQ ID NO: 9441557 - DNA, 22 bp, Homo sapiens
tgcattttacttacctgttagt

SEQ ID NO: 9441558 - DNA, 22 bp, Homo sapiens
tgcatttgttaccttattgcag

SEQ ID NO: 9441559 - DNA, 22 bp, Homo sapiens
tgcatttgttcagtgaaatgtt

SEQ ID NO: 9441560 - DNA, 20 bp, Homo sapiens
tgcatttgttatttgtactc

SEQ ID NO: 9441561 - DNA, 22 bp, Homo sapiens
tgcatttgttaccttattgcag

SEQ ID NO: 9441562 - DNA, 22 bp, Homo sapiens
tgcatttggggcagactagcag

SEQ ID NO: 9441563 - DNA, 22 bp, Homo sapiens
tgcatttgtaacattcaagaat

SEQ ID NO: 9441564 - DNA, 22 bp, Homo sapiens
tgcatttgacatttagtggggt

SEQ ID NO: 9441565 - DNA, 22 bp, Homo sapiens
tgcatttgctggggatgtgatt

SEQ ID NO: 9441566 - DNA, 21 bp, Homo sapiens
tgcatttctaactagttgacc

SEQ ID NO: 9441567 - DNA, 22 bp, Homo sapiens
tgcatttccagatttctggagt

SEQ ID NO: 9441568 - DNA, 22 bp, Homo sapiens
tgcatttcagaagaaaattcgg

SEQ ID NO: 9441569 - DNA, 22 bp, Homo sapiens
tgcatttgctggggatgtgatt

SEQ ID NO: 9441570 - DNA, 22 bp, Homo sapiens
tgcatttgagttgggagcaggc

SEQ ID NO: 9441571 - DNA, 22 bp, Homo sapiens
tgcatttgcaatgggtacacaa

SEQ ID NO: 9441572 - DNA, 23 bp, Homo sapiens
tgcatttgcaattgcagtaaggt

SEQ ID NO: 9441573 - DNA, 23 bp, Homo sapiens
tgcatttgcaattgcagtaaggt

SEQ ID NO: 9441574 - DNA, 22 bp, Homo sapiens
tgcatttcttttgagtatatgc

SEQ ID NO: 9441575 - DNA, 22 bp, Homo sapiens
tgcatttgaagtcagacaggct

SEQ ID NO: 9441576 - DNA, 22 bp, Homo sapiens
tgcatttagttttaataaagga

SEQ ID NO: 9441577 - DNA, 22 bp, Homo sapiens
tgcatttataaaatgttcgtgg

SEQ ID NO: 9441578 - DNA, 22 bp, Homo sapiens
tgcatttatttgaattgatcta

SEQ ID NO: 9441579 - DNA, 22 bp, Homo sapiens
tgcatttatttgaattgatcta

SEQ ID NO: 9441580 - DNA, 22 bp, Homo sapiens
tgcatttagttatgagaaaaac

SEQ ID NO: 9441581 - DNA, 18 bp, Homo sapiens
tgcatttagtacatctag

SEQ ID NO: 9441582 - DNA, 22 bp, Homo sapiens
tgcatttagttttaataaagga

SEQ ID NO: 9441583 - DNA, 22 bp, Homo sapiens
tgcatttagttatgagaaaaac

SEQ ID NO: 9441584 - DNA, 20 bp, Homo sapiens
tgcatttacagtgtggatac

SEQ ID NO: 9441585 - DNA, 22 bp, Homo sapiens
tgcatttacctggaggtcattt

SEQ ID NO: 9441586 - DNA, 21 bp, Homo sapiens
tgcatttaacagaaacaggaa

SEQ ID NO: 9441587 - DNA, 22 bp, Homo sapiens
tgcatttaagaaaacatgagtc

SEQ ID NO: 9441588 - DNA, 22 bp, Homo sapiens
tgcattggtcatttagaaaata

SEQ ID NO: 9441589 - DNA, 22 bp, Homo sapiens
tgcattgggttgacatactaaa

SEQ ID NO: 9441590 - DNA, 22 bp, Homo sapiens
tgcattggaaactcagcagcac

SEQ ID NO: 9441591 - DNA, 21 bp, Homo sapiens
tgcattcctccatccaacagg

SEQ ID NO: 9441592 - DNA, 22 bp, Homo sapiens
tgcattcctccacctcctgcac

SEQ ID NO: 9441593 - DNA, 21 bp, Homo sapiens
tgcattctagcagctctgagg

SEQ ID NO: 9441594 - DNA, 22 bp, Homo sapiens
tgcattcttggaagaagctctc

SEQ ID NO: 9441595 - DNA, 22 bp, Homo sapiens
tgcataaaatatgagaaatgta

SEQ ID NO: 9441596 - DNA, 22 bp, Homo sapiens
tgcataaaatatgagaaatgta

SEQ ID NO: 9441597 - DNA, 22 bp, Homo sapiens
tgcataaaatatgagaaatgta

SEQ ID NO: 9441598 - DNA, 22 bp, Homo sapiens
tgcataaaatatgagaaatgta

SEQ ID NO: 9441599 - DNA, 22 bp, Homo sapiens
tgcataaacagatacttcatgt

SEQ ID NO: 9441600 - DNA, 22 bp, Homo sapiens
tgcataaacagatacttcatgt

SEQ ID NO: 9441601 - DNA, 22 bp, Homo sapiens
tgcataaagaaagcctggagag

SEQ ID NO: 9441602 - DNA, 22 bp, Homo sapiens
tgcataaacttctctggtgtga

SEQ ID NO: 9441603 - DNA, 21 bp, Homo sapiens
tgcataaagaaatacaaatac

SEQ ID NO: 9441604 - DNA, 21 bp, Homo sapiens
tgcataaagaaatacaaatac

SEQ ID NO: 9441605 - DNA, 22 bp, Homo sapiens
tgcataaagtgccatagtatta

SEQ ID NO: 9441606 - DNA, 22 bp, Homo sapiens
tgcataaagtgccatagtatta

SEQ ID NO: 9441607 - DNA, 22 bp, Homo sapiens
tgcataaagtgccatagtatta

SEQ ID NO: 9441608 - DNA, 17 bp, Homo sapiens
tgcataaagggtgagca

SEQ ID NO: 9441609 - DNA, 19 bp, Homo sapiens
tgcataaattatatacttt

SEQ ID NO: 9441610 - DNA, 22 bp, Homo sapiens
tgcataaatcttggaagttgtt

SEQ ID NO: 9441611 - DNA, 19 bp, Homo sapiens
tgcataaattatatacttt

SEQ ID NO: 9441612 - DNA, 22 bp, Homo sapiens
tgcataaatattgttgggagta

SEQ ID NO: 9441613 - DNA, 22 bp, Homo sapiens
tgcataaatagtacctgctttt

SEQ ID NO: 9441614 - DNA, 22 bp, Homo sapiens
tgcagttctaagtagacaagtc

SEQ ID NO: 9441615 - DNA, 22 bp, Homo sapiens
tgcagttctatcacccaccccg

SEQ ID NO: 9441616 - DNA, 22 bp, Homo sapiens
tgcagtttaaacttggcaactt

SEQ ID NO: 9441617 - DNA, 20 bp, Homo sapiens
tgcagtttgtcaaggttcct

SEQ ID NO: 9441618 - DNA, 20 bp, Homo sapiens
tgcagtttgtcaaggttcct

SEQ ID NO: 9441619 - DNA, 22 bp, Homo sapiens
tgcagttttatcacatatatag

SEQ ID NO: 9441620 - DNA, 22 bp, Homo sapiens
tgcagtttgccctttgctcact

SEQ ID NO: 9441621 - DNA, 22 bp, Homo sapiens
tgcagtttgccctttgctcact

SEQ ID NO: 9441622 - DNA, 22 bp, Homo sapiens
tgcagtttgccctttgctcact

SEQ ID NO: 9441623 - DNA, 22 bp, Homo sapiens
tgcagtttaaacttggcaactt

SEQ ID NO: 9441624 - DNA, 22 bp, Homo sapiens
tgcagtttatctagtcatccat

SEQ ID NO: 9441625 - DNA, 22 bp, Homo sapiens
tgcagtttcctggtctctactt

SEQ ID NO: 9441626 - DNA, 22 bp, Homo sapiens
tgcagtttcctggtctctactt

SEQ ID NO: 9441627 - DNA, 22 bp, Homo sapiens
tgcagtttcctttctagtcttt

SEQ ID NO: 9441628 - DNA, 22 bp, Homo sapiens
tgcagtttcctttctagtcttt

SEQ ID NO: 9441629 - DNA, 22 bp, Homo sapiens
tgcagttttgccaggcaatgga

SEQ ID NO: 9441630 - DNA, 22 bp, Homo sapiens
tgcagttttctcacccccacaa

SEQ ID NO: 9441631 - DNA, 22 bp, Homo sapiens
tgcagttttgccaggcaatgga

SEQ ID NO: 9441632 - DNA, 21 bp, Homo sapiens
tgcagttttgcttgatctctg

SEQ ID NO: 9441633 - DNA, 22 bp, Homo sapiens
tgcagttttggccattgaaggc

SEQ ID NO: 9441634 - DNA, 21 bp, Homo sapiens
tgcagttttgcttgatctctg

SEQ ID NO: 9441635 - DNA, 22 bp, Homo sapiens
tgcagttttcaaaagtttacag

SEQ ID NO: 9441636 - DNA, 22 bp, Homo sapiens
tgcagttttcaaaagtttacag

SEQ ID NO: 9441637 - DNA, 22 bp, Homo sapiens
tgcagttttatcacatatatag

SEQ ID NO: 9441638 - DNA, 22 bp, Homo sapiens
tgcagttttcaaaagtttacag

SEQ ID NO: 9441639 - DNA, 22 bp, Homo sapiens
tgcagttttccttcaacattgt

SEQ ID NO: 9441640 - DNA, 22 bp, Homo sapiens
tgcagttttcaaaagtttacag

SEQ ID NO: 9441641 - DNA, 22 bp, Homo sapiens
tgcagttttccttcaacattgt

SEQ ID NO: 9441642 - DNA, 22 bp, Homo sapiens
tgcagttttctcacccccacaa

SEQ ID NO: 9441643 - DNA, 22 bp, Homo sapiens
tgcataaaacatgatttctgct

SEQ ID NO: 9441644 - DNA, 22 bp, Homo sapiens
tgcataaaacaccagcagggtg

SEQ ID NO: 9441645 - DNA, 22 bp, Homo sapiens
tgcataaaaaccacatacaagg

SEQ ID NO: 9441646 - DNA, 22 bp, Homo sapiens
tgcatagaggatccagtgtggt

SEQ ID NO: 9441647 - DNA, 22 bp, Homo sapiens
tgcatacttgtatgtgttacat

SEQ ID NO: 9441648 - DNA, 22 bp, Homo sapiens
tgcatacttttaatgactgttt

SEQ ID NO: 9441649 - DNA, 22 bp, Homo sapiens
tgcatactgaacagcatgctaa

SEQ ID NO: 9441650 - DNA, 22 bp, Homo sapiens
tgcatactgaatctgccatcac

SEQ ID NO: 9441651 - DNA, 22 bp, Homo sapiens
tgcatacatgtttgtgtatttt

SEQ ID NO: 9441652 - DNA, 19 bp, Homo sapiens
tgcataaattatatacttt

SEQ ID NO: 9441653 - DNA, 22 bp, Homo sapiens
tgcatacataatcgagaccagt

SEQ ID NO: 9441654 - DNA, 22 bp, Homo sapiens
tgcatacacacataggtatggg

SEQ ID NO: 9441655 - DNA, 22 bp, Homo sapiens
tgcatctgcctggagtagcgcc

SEQ ID NO: 9441656 - DNA, 22 bp, Homo sapiens
tgcatctgtagtggaaacctta

SEQ ID NO: 9441657 - DNA, 22 bp, Homo sapiens
tgcatctgattctcaggcagaa

SEQ ID NO: 9441658 - DNA, 22 bp, Homo sapiens
tgcatctgattctcaggcagaa

SEQ ID NO: 9441659 - DNA, 22 bp, Homo sapiens
tgcatctaagtggctaacaacc

SEQ ID NO: 9441660 - DNA, 20 bp, Homo sapiens
tgcatctagtaagagtgtca

SEQ ID NO: 9441661 - DNA, 22 bp, Homo sapiens
tgcatccttccatgggtttcaa

SEQ ID NO: 9441662 - DNA, 22 bp, Homo sapiens
tgcatcctcctttgtcctcttg

SEQ ID NO: 9441663 - DNA, 22 bp, Homo sapiens
tgcatcctgttctaggtttggg

SEQ ID NO: 9441664 - DNA, 22 bp, Homo sapiens
tgcatcctgttctaggtttggg

SEQ ID NO: 9441665 - DNA, 22 bp, Homo sapiens
tgcatcctcctttgtcctcttg

SEQ ID NO: 9441666 - DNA, 23 bp, Homo sapiens
tgcatcctcatttttcacacgag

SEQ ID NO: 9441667 - DNA, 22 bp, Homo sapiens
tgcatcatataatgtctatgga

SEQ ID NO: 9441668 - DNA, 22 bp, Homo sapiens
tgcatcagaggatagctgcagt

SEQ ID NO: 9441669 - DNA, 22 bp, Homo sapiens
tgcatcagctgtgcttcttgac

SEQ ID NO: 9441670 - DNA, 22 bp, Homo sapiens
tgcatcagagtttgctgctgct

SEQ ID NO: 9441671 - DNA, 22 bp, Homo sapiens
tgcatcatgcggaactggcttt

SEQ ID NO: 9441672 - DNA, 22 bp, Homo sapiens
tgcatcatataatgtctatgga

SEQ ID NO: 9441673 - DNA, 22 bp, Homo sapiens
tgcatcatttataatgtctttg

SEQ ID NO: 9441674 - DNA, 22 bp, Homo sapiens
tgcatcatttataatgtctttg

SEQ ID NO: 9441675 - DNA, 18 bp, Homo sapiens
tgcatcatttatgggtca

SEQ ID NO: 9441676 - DNA, 22 bp, Homo sapiens
tgcatgctcaagttagttgtga

SEQ ID NO: 9441677 - DNA, 22 bp, Homo sapiens
tgcatggagatatactatttga

SEQ ID NO: 9441678 - DNA, 22 bp, Homo sapiens
tgcatggagatatactatttga

SEQ ID NO: 9441679 - DNA, 22 bp, Homo sapiens
tgcatggaacggtctcctggtc

SEQ ID NO: 9441680 - DNA, 18 bp, Homo sapiens
tgcatgcttttgtttcca

SEQ ID NO: 9441681 - DNA, 23 bp, Homo sapiens
tgcatgctaacacagtgcacagg

SEQ ID NO: 9441682 - DNA, 17 bp, Homo sapiens
tgcatgcgtctgtgata

SEQ ID NO: 9441683 - DNA, 22 bp, Homo sapiens
tgcatgcgttagttggcgtgtt

SEQ ID NO: 9441684 - DNA, 22 bp, Homo sapiens
tgcatgcatgtgagcatgcata

SEQ ID NO: 9441685 - DNA, 22 bp, Homo sapiens
tgcatgcatgctactgggaggt

SEQ ID NO: 9441686 - DNA, 22 bp, Homo sapiens
tgcatgcagctggtcgggcgcc

SEQ ID NO: 9441687 - DNA, 22 bp, Homo sapiens
tgcatgatagagatggtattag

SEQ ID NO: 9441688 - DNA, 22 bp, Homo sapiens
tgcatgcacgtatctgcgtgtg

SEQ ID NO: 9441689 - DNA, 22 bp, Homo sapiens
tgcatgcacatgtaggtatggt

SEQ ID NO: 9441690 - DNA, 22 bp, Homo sapiens
tgcatctttagtcttatgtctg

SEQ ID NO: 9441691 - DNA, 19 bp, Homo sapiens
tgcatcttgcatgggtgag

SEQ ID NO: 9441692 - DNA, 22 bp, Homo sapiens
tgcatgtgtgtattcagagact

SEQ ID NO: 9441693 - DNA, 22 bp, Homo sapiens
tgcatgtgtgtgtatttataaa

SEQ ID NO: 9441694 - DNA, 22 bp, Homo sapiens
tgcatgtggatcatatgtccta

SEQ ID NO: 9441695 - DNA, 22 bp, Homo sapiens
tgcatgtgtcgggcctgtgcta

SEQ ID NO: 9441696 - DNA, 22 bp, Homo sapiens
tgcatgtggacccctggtgcct

SEQ ID NO: 9441697 - DNA, 22 bp, Homo sapiens
tgcatgtggatcatatgtccta

SEQ ID NO: 9441698 - DNA, 22 bp, Homo sapiens
tgcatgtgtgacaaggacagtt

SEQ ID NO: 9441699 - DNA, 22 bp, Homo sapiens
tgcatgtgtcgggcctgtgcta

SEQ ID NO: 9441700 - DNA, 22 bp, Homo sapiens
tgcatgtttataacagatgagg

SEQ ID NO: 9441701 - DNA, 22 bp, Homo sapiens
tgcatgttaagaaaatattgag

SEQ ID NO: 9441702 - DNA, 22 bp, Homo sapiens
tgcattccacagaagggaaaac

SEQ ID NO: 9441703 - DNA, 22 bp, Homo sapiens
tgcattccatgtgtttcctgag

SEQ ID NO: 9441704 - DNA, 23 bp, Homo sapiens
tgcatgtgaattcatacttgttt

SEQ ID NO: 9441705 - DNA, 22 bp, Homo sapiens
tgcatgtatttaaagttgcaat

SEQ ID NO: 9441706 - DNA, 22 bp, Homo sapiens
tgcatgtatgtgctcacatgtg

SEQ ID NO: 9441707 - DNA, 22 bp, Homo sapiens
tgcatgtgcccactctggctta

SEQ ID NO: 9441708 - DNA, 22 bp, Homo sapiens
tgcatgtggacccctggtgcct

SEQ ID NO: 9441709 - DNA, 20 bp, Homo sapiens
tgcatggcgcacatctgtgg

SEQ ID NO: 9441710 - DNA, 22 bp, Homo sapiens
tgcatggaggaagatgaatgca

SEQ ID NO: 9441711 - DNA, 21 bp, Homo sapiens
tgcatggaggaaagttataga

SEQ ID NO: 9441712 - DNA, 22 bp, Homo sapiens
tgcatggagtaattgatgcttg

SEQ ID NO: 9441713 - DNA, 22 bp, Homo sapiens
tgcatggaggataataattgag

SEQ ID NO: 9441714 - DNA, 22 bp, Homo sapiens
tgcatggaggataataattgag

SEQ ID NO: 9441715 - DNA, 22 bp, Homo sapiens
tgcatggataaaagtatattat

SEQ ID NO: 9441716 - DNA, 22 bp, Homo sapiens
tgcatggagtaattgatgcttg

SEQ ID NO: 9441717 - DNA, 22 bp, Homo sapiens
tgcagagggacagccacagctc

SEQ ID NO: 9441718 - DNA, 22 bp, Homo sapiens
tgcagagggacagccacagctc

SEQ ID NO: 9441719 - DNA, 22 bp, Homo sapiens
tgcagagggacagccacagctc

SEQ ID NO: 9441720 - DNA, 22 bp, Homo sapiens
tgcagagggacagccacagctc

SEQ ID NO: 9441721 - DNA, 22 bp, Homo sapiens
tgcagagggacagccacagctc

SEQ ID NO: 9441722 - DNA, 22 bp, Homo sapiens
tgcagagggaaaaggtgctcct

SEQ ID NO: 9441723 - DNA, 22 bp, Homo sapiens
tgcagagggaaaaggtgctcct

SEQ ID NO: 9441724 - DNA, 23 bp, Homo sapiens
tgcagagggactgaagccagctt

SEQ ID NO: 9441725 - DNA, 23 bp, Homo sapiens
tgcagagggactgaagccagctt

SEQ ID NO: 9441726 - DNA, 23 bp, Homo sapiens
tgcagagggactgaagccagctt

SEQ ID NO: 9441727 - DNA, 19 bp, Homo sapiens
tgcagagggtaggaaggcc

SEQ ID NO: 9441728 - DNA, 22 bp, Homo sapiens
tgcagagtagtgaggggacaga

SEQ ID NO: 9441729 - DNA, 22 bp, Homo sapiens
tgcagagtagtgaggggacaga

SEQ ID NO: 9441730 - DNA, 22 bp, Homo sapiens
tgcagagtagctataccatttt

SEQ ID NO: 9441731 - DNA, 22 bp, Homo sapiens
tgcagagtcacccagataatta

SEQ ID NO: 9441732 - DNA, 19 bp, Homo sapiens
tgcagagggtaggaaggcc

SEQ ID NO: 9441733 - DNA, 19 bp, Homo sapiens
tgcagagggtaggaaggcc

SEQ ID NO: 9441734 - DNA, 19 bp, Homo sapiens
tgcagagggtaggaaggcc

SEQ ID NO: 9441735 - DNA, 22 bp, Homo sapiens
tgcagagtggattctgtatacc

SEQ ID NO: 9441736 - DNA, 22 bp, Homo sapiens
tgcagagtcctctggagggact

SEQ ID NO: 9441737 - DNA, 23 bp, Homo sapiens
tgcagagtgtcacttgaaaacca

SEQ ID NO: 9441738 - DNA, 22 bp, Homo sapiens
tgcagagtgggagaggtgcggg

SEQ ID NO: 9441739 - DNA, 23 bp, Homo sapiens
tgcagagtgtcacttgaaaacca

SEQ ID NO: 9441740 - DNA, 22 bp, Homo sapiens
tgcagagttgctttgatagtcc

SEQ ID NO: 9441741 - DNA, 21 bp, Homo sapiens
tgcagataattgaaagctgac

SEQ ID NO: 9441742 - DNA, 22 bp, Homo sapiens
tgcagatgaatgctgagacact

SEQ ID NO: 9441743 - DNA, 22 bp, Homo sapiens
tgcagcaatttgcagtaattta

SEQ ID NO: 9441744 - DNA, 22 bp, Homo sapiens
tgcagcaaaaggtcagagggag

SEQ ID NO: 9441745 - DNA, 22 bp, Homo sapiens
tgcagattcaaatgaaatgcaa

SEQ ID NO: 9441746 - DNA, 22 bp, Homo sapiens
tgcagattcaaatgaaatgcaa

SEQ ID NO: 9441747 - DNA, 22 bp, Homo sapiens
tgcagatggggatcagtggctc

SEQ ID NO: 9441748 - DNA, 20 bp, Homo sapiens
tgcagcacgggccctttcca

SEQ ID NO: 9441749 - DNA, 22 bp, Homo sapiens
tgcagcacctatggacacttgt

SEQ ID NO: 9441750 - DNA, 20 bp, Homo sapiens
tgcagcacgggccctttcca

SEQ ID NO: 9441751 - DNA, 19 bp, Homo sapiens
tgcagcactaaaaactttc

SEQ ID NO: 9441752 - DNA, 22 bp, Homo sapiens
tgcagcacttgccaaactaact

SEQ ID NO: 9441753 - DNA, 22 bp, Homo sapiens
tgcagcactgttcacaatagcc

SEQ ID NO: 9441754 - DNA, 22 bp, Homo sapiens
tgcagcacctatggacacttgt

SEQ ID NO: 9441755 - DNA, 22 bp, Homo sapiens
tgcagcaccgtcccactggcta

SEQ ID NO: 9441756 - DNA, 22 bp, Homo sapiens
tgcagcaccacacctggctaat

SEQ ID NO: 9441757 - DNA, 22 bp, Homo sapiens
tgcagcaccacacctggctaat

SEQ ID NO: 9441758 - DNA, 22 bp, Homo sapiens
tgcagcagaatatggctgcagg

SEQ ID NO: 9441759 - DNA, 22 bp, Homo sapiens
tgcagcagaatatggctgcagg

SEQ ID NO: 9441760 - DNA, 21 bp, Homo sapiens
tgcagcagaagtctctgtgtc

SEQ ID NO: 9441761 - DNA, 22 bp, Homo sapiens
tgcagcagaagtgttcttctct

SEQ ID NO: 9441762 - DNA, 21 bp, Homo sapiens
tgcagcagaagtctctgtgtc

SEQ ID NO: 9441763 - DNA, 21 bp, Homo sapiens
tgcagcagaagtctctgtgtc

SEQ ID NO: 9441764 - DNA, 21 bp, Homo sapiens
tgcagcagaagtctctgtgtc

SEQ ID NO: 9441765 - DNA, 21 bp, Homo sapiens
tgcagcagaagtctctgtgtc

SEQ ID NO: 9441766 - DNA, 22 bp, Homo sapiens
tgcagacctcccatggctgcct

SEQ ID NO: 9441767 - DNA, 22 bp, Homo sapiens
tgcagagaaaactcctgggtac

SEQ ID NO: 9441768 - DNA, 22 bp, Homo sapiens
tgcagacttagaaaagtctaga

SEQ ID NO: 9441769 - DNA, 22 bp, Homo sapiens
tgcagagaaaccagtggaggac

SEQ ID NO: 9441770 - DNA, 22 bp, Homo sapiens
tgcagagatcctggactgagcg

SEQ ID NO: 9441771 - DNA, 22 bp, Homo sapiens
tgcagagatcctggactgagcg

SEQ ID NO: 9441772 - DNA, 21 bp, Homo sapiens
tgcagagatatctgaagcaga

SEQ ID NO: 9441773 - DNA, 22 bp, Homo sapiens
tgcagagaaaccagtggaggac

SEQ ID NO: 9441774 - DNA, 21 bp, Homo sapiens
tgcagacagggacagaatgga

SEQ ID NO: 9441775 - DNA, 22 bp, Homo sapiens
tgcagacagagaaatgaggccc

SEQ ID NO: 9441776 - DNA, 22 bp, Homo sapiens
tgcagacaagtcgtgggatctt

SEQ ID NO: 9441777 - DNA, 22 bp, Homo sapiens
tgcagagcagcaactgcgtgcg

SEQ ID NO: 9441778 - DNA, 22 bp, Homo sapiens
tgcagagccagtcttgtgcttc

SEQ ID NO: 9441779 - DNA, 22 bp, Homo sapiens
tgcagagcagcaactgcgtgcg

SEQ ID NO: 9441780 - DNA, 22 bp, Homo sapiens
tgcagagcagcaactgcgtgcg

SEQ ID NO: 9441781 - DNA, 20 bp, Homo sapiens
tgcagagctgacattacctg

SEQ ID NO: 9441782 - DNA, 20 bp, Homo sapiens
tgcagagctggctggctcct

SEQ ID NO: 9441783 - DNA, 22 bp, Homo sapiens
tgcagagatctgggcgtcggct

SEQ ID NO: 9441784 - DNA, 22 bp, Homo sapiens
tgcagagatttggctcttaaag

SEQ ID NO: 9441785 - DNA, 22 bp, Homo sapiens
tgcagagcttcattgcataggc

SEQ ID NO: 9441786 - DNA, 20 bp, Homo sapiens
tgcagagctggctggctcct

SEQ ID NO: 9441787 - DNA, 22 bp, Homo sapiens
tgcagaggagctggaaggctgg

SEQ ID NO: 9441788 - DNA, 23 bp, Homo sapiens
tgcagaggcatgatcactgctca

SEQ ID NO: 9441789 - DNA, 21 bp, Homo sapiens
tgcagaggcacaaacaagccc

SEQ ID NO: 9441790 - DNA, 21 bp, Homo sapiens
tgcagaggcacaaacaagccc

SEQ ID NO: 9441791 - DNA, 22 bp, Homo sapiens
tgcagaggcgccgtgggtgggg

SEQ ID NO: 9441792 - DNA, 22 bp, Homo sapiens
tgcagaggctggctcgccgggt

SEQ ID NO: 9441793 - DNA, 22 bp, Homo sapiens
tgcagagggaaaaggtgctcct

SEQ ID NO: 9441794 - DNA, 22 bp, Homo sapiens
tgcagaggagtcagcctgggca

SEQ ID NO: 9441795 - DNA, 22 bp, Homo sapiens
tgcagaggagtcagcctgggca

SEQ ID NO: 9441796 - DNA, 22 bp, Homo sapiens
tgcagaggagtcagcctgggca

SEQ ID NO: 9441797 - DNA, 22 bp, Homo sapiens
tgcagaggagtcagcctgggca

SEQ ID NO: 9441798 - DNA, 22 bp, Homo sapiens
tgcagaggagtcagcctgggca

SEQ ID NO: 9441799 - DNA, 22 bp, Homo sapiens
tgcagaggagctggaaggctgg

SEQ ID NO: 9441800 - DNA, 22 bp, Homo sapiens
tgcagaggagctggaaggctgg

SEQ ID NO: 9441801 - DNA, 22 bp, Homo sapiens
tgcagaggagctggaaggctgg

SEQ ID NO: 9441802 - DNA, 22 bp, Homo sapiens
tgcagaggagctggaaggctgg

SEQ ID NO: 9441803 - DNA, 22 bp, Homo sapiens
tgcagaggagctggaaggctgg

SEQ ID NO: 9441804 - DNA, 22 bp, Homo sapiens
tgcagaagcagagagttgccaa

SEQ ID NO: 9441805 - DNA, 22 bp, Homo sapiens
tgcagaagcagagagttgccaa

SEQ ID NO: 9441806 - DNA, 22 bp, Homo sapiens
tgcagaagaccttccagggctg

SEQ ID NO: 9441807 - DNA, 22 bp, Homo sapiens
tgcagaagaccttccagggctg

SEQ ID NO: 9441808 - DNA, 22 bp, Homo sapiens
tgcagaagctgcaggtcagtgg

SEQ ID NO: 9441809 - DNA, 19 bp, Homo sapiens
tgcagaagacacagtggtg

SEQ ID NO: 9441810 - DNA, 22 bp, Homo sapiens
tgcagaagaatgtaggcataag

SEQ ID NO: 9441811 - DNA, 22 bp, Homo sapiens
tgcagaagaatgagcttggagt

SEQ ID NO: 9441812 - DNA, 20 bp, Homo sapiens
tgcagaagaacgttctggtt

SEQ ID NO: 9441813 - DNA, 20 bp, Homo sapiens
tgcagaagaacgttctggtt

SEQ ID NO: 9441814 - DNA, 22 bp, Homo sapiens
tgcagaacgggtcttctagcac

SEQ ID NO: 9441815 - DNA, 22 bp, Homo sapiens
tgcagaagaaaacagctgtgtg

SEQ ID NO: 9441816 - DNA, 22 bp, Homo sapiens
tgcagaaccagtcctcagaccc

SEQ ID NO: 9441817 - DNA, 22 bp, Homo sapiens
tgcagaacagggccatgtcacc

SEQ ID NO: 9441818 - DNA, 22 bp, Homo sapiens
tgcagaaccagtcctcagaccc

SEQ ID NO: 9441819 - DNA, 22 bp, Homo sapiens
tgcagaaagcattgactcttcc

SEQ ID NO: 9441820 - DNA, 22 bp, Homo sapiens
tgcagaaataaagatattatca

SEQ ID NO: 9441821 - DNA, 22 bp, Homo sapiens
tgcagaaataactcatattgca

SEQ ID NO: 9441822 - DNA, 22 bp, Homo sapiens
tgcagaaaccaattcaagtaag

SEQ ID NO: 9441823 - DNA, 22 bp, Homo sapiens
tgcagaaaccaattcaagtaag

SEQ ID NO: 9441824 - DNA, 22 bp, Homo sapiens
tgcagaaagcattgactcttcc

SEQ ID NO: 9441825 - DNA, 22 bp, Homo sapiens
tgcagaaacagtcattaatgta

SEQ ID NO: 9441826 - DNA, 22 bp, Homo sapiens
tgcagaaaccaattcaagtaag

SEQ ID NO: 9441827 - DNA, 22 bp, Homo sapiens
tgcagaaataactcatattgca

SEQ ID NO: 9441828 - DNA, 22 bp, Homo sapiens
tgcagaaataactcatattgca

SEQ ID NO: 9441829 - DNA, 21 bp, Homo sapiens
tgcagaaatggtttttctaag

SEQ ID NO: 9441830 - DNA, 21 bp, Homo sapiens
tgcagaaatggtttttctaag

SEQ ID NO: 9441831 - DNA, 21 bp, Homo sapiens
tgcagaaatggtttttctaag

SEQ ID NO: 9441832 - DNA, 21 bp, Homo sapiens
tgcagaaatggtttttctaag

SEQ ID NO: 9441833 - DNA, 22 bp, Homo sapiens
tgcagaacaatgagagctgaga

SEQ ID NO: 9441834 - DNA, 22 bp, Homo sapiens
tgcacctttaaattcagcagta

SEQ ID NO: 9441835 - DNA, 22 bp, Homo sapiens
tgcacgtgggctctctgctctt

SEQ ID NO: 9441836 - DNA, 22 bp, Homo sapiens
tgcacgtgtgagcattcacatg

SEQ ID NO: 9441837 - DNA, 18 bp, Homo sapiens
tgcactagatgctggcag

SEQ ID NO: 9441838 - DNA, 18 bp, Homo sapiens
tgcactagatgctggcag

SEQ ID NO: 9441839 - DNA, 22 bp, Homo sapiens
tgcagaaacaagccatcattca

SEQ ID NO: 9441840 - DNA, 22 bp, Homo sapiens
tgcagaaacaagccatcattca

SEQ ID NO: 9441841 - DNA, 22 bp, Homo sapiens
tgcacatgtgcctgtggcacat

SEQ ID NO: 9441842 - DNA, 22 bp, Homo sapiens
tgcacatggcaatgctgctccc

SEQ ID NO: 9441843 - DNA, 22 bp, Homo sapiens
tgcacatggcaatgctgctccc

SEQ ID NO: 9441844 - DNA, 22 bp, Homo sapiens
tgcacagttggctacatcgtgg

SEQ ID NO: 9441845 - DNA, 20 bp, Homo sapiens
tgcacatggcagccatctag

SEQ ID NO: 9441846 - DNA, 20 bp, Homo sapiens
tgcacatggcagccatctag

SEQ ID NO: 9441847 - DNA, 22 bp, Homo sapiens
tgcacatggcctgagtgcctga

SEQ ID NO: 9441848 - DNA, 22 bp, Homo sapiens
tgcacagtgacccctggtgact

SEQ ID NO: 9441849 - DNA, 22 bp, Homo sapiens
tgcacagtgtaatgaatcagaa

SEQ ID NO: 9441850 - DNA, 22 bp, Homo sapiens
tgcacagtgaccactgagcaag

SEQ ID NO: 9441851 - DNA, 22 bp, Homo sapiens
tgcacagtgaccactgagcaag

SEQ ID NO: 9441852 - DNA, 22 bp, Homo sapiens
tgcacagtgacccctggtgact

SEQ ID NO: 9441853 - DNA, 22 bp, Homo sapiens
tgcacagtgtaatgaatcagaa

SEQ ID NO: 9441854 - DNA, 22 bp, Homo sapiens
tgcacagttaatatgtgacaga

SEQ ID NO: 9441855 - DNA, 22 bp, Homo sapiens
tgcacaggtggtccatctgcac

SEQ ID NO: 9441856 - DNA, 22 bp, Homo sapiens
tgcacagtatgtggtcctttgt

SEQ ID NO: 9441857 - DNA, 22 bp, Homo sapiens
tgcacagtaaacatgactggag

SEQ ID NO: 9441858 - DNA, 22 bp, Homo sapiens
tgcacagtgaccactgagcaag

SEQ ID NO: 9441859 - DNA, 22 bp, Homo sapiens
tgcacagtaaacatgactggag

SEQ ID NO: 9441860 - DNA, 22 bp, Homo sapiens
tgcaccctcatcagtcaaatgg

SEQ ID NO: 9441861 - DNA, 22 bp, Homo sapiens
tgcaccattttgtcaggctact

SEQ ID NO: 9441862 - DNA, 22 bp, Homo sapiens
tgcaccagtttctcagagaatc

SEQ ID NO: 9441863 - DNA, 22 bp, Homo sapiens
tgcaccatgtaagtggccacgt

SEQ ID NO: 9441864 - DNA, 22 bp, Homo sapiens
tgcaccagtttctcagagaatc

SEQ ID NO: 9441865 - DNA, 22 bp, Homo sapiens
tgcaccagagcagggtgcccaa

SEQ ID NO: 9441866 - DNA, 22 bp, Homo sapiens
tgcaccgttgcactccagagtg

SEQ ID NO: 9441867 - DNA, 22 bp, Homo sapiens
tgcaccctgcctgcctgcgggt

SEQ ID NO: 9441868 - DNA, 22 bp, Homo sapiens
tgcacctgtagtgagctgtgcc

SEQ ID NO: 9441869 - DNA, 22 bp, Homo sapiens
tgcacctgctcagactcctgtc

SEQ ID NO: 9441870 - DNA, 22 bp, Homo sapiens
tgcacctgtagtgagctgtgcc

SEQ ID NO: 9441871 - DNA, 21 bp, Homo sapiens
tgcacctgttcactgcagttc

SEQ ID NO: 9441872 - DNA, 22 bp, Homo sapiens
tgcacagctgcctcctctctgc

SEQ ID NO: 9441873 - DNA, 22 bp, Homo sapiens
tgcacagcgggtgtctgtcagg

SEQ ID NO: 9441874 - DNA, 22 bp, Homo sapiens
tgcacagctggctctccttttc

SEQ ID NO: 9441875 - DNA, 22 bp, Homo sapiens
tgcacaggaggctgtggagaag

SEQ ID NO: 9441876 - DNA, 22 bp, Homo sapiens
tgcacagctggctctccttttc

SEQ ID NO: 9441877 - DNA, 23 bp, Homo sapiens
tgcacaggacggccttataagta

SEQ ID NO: 9441878 - DNA, 18 bp, Homo sapiens
tgcacagctgtgggctgg

SEQ ID NO: 9441879 - DNA, 22 bp, Homo sapiens
tgcacagcgggtgtctgtcagg

SEQ ID NO: 9441880 - DNA, 22 bp, Homo sapiens
tgcacagcgggtgtctgtcagg

SEQ ID NO: 9441881 - DNA, 22 bp, Homo sapiens
tgcacacagtggacaagtcttg

SEQ ID NO: 9441882 - DNA, 22 bp, Homo sapiens
tgcacacagttctcaggaaaga

SEQ ID NO: 9441883 - DNA, 22 bp, Homo sapiens
tgcacagcaaatattgactacc

SEQ ID NO: 9441884 - DNA, 20 bp, Homo sapiens
tgcacagggtgggaagcaac

SEQ ID NO: 9441885 - DNA, 22 bp, Homo sapiens
tgcacaggtatgcaaagcatgt

SEQ ID NO: 9441886 - DNA, 22 bp, Homo sapiens
tgcacaggtgagactcaggaag

SEQ ID NO: 9441887 - DNA, 22 bp, Homo sapiens
tgcacaggtgagactcaggaag

SEQ ID NO: 9441888 - DNA, 22 bp, Homo sapiens
tgcacaggtgagactcaggaag

SEQ ID NO: 9441889 - DNA, 22 bp, Homo sapiens
tgcacaggtgagactcaggaag

SEQ ID NO: 9441890 - DNA, 22 bp, Homo sapiens
tgcacaggccttgaagggagag

SEQ ID NO: 9441891 - DNA, 22 bp, Homo sapiens
tgcacagggagggggccagctc

SEQ ID NO: 9441892 - DNA, 22 bp, Homo sapiens
tgcacagggagggggccagctc

SEQ ID NO: 9441893 - DNA, 22 bp, Homo sapiens
tgcacaggccttgaagggagag

SEQ ID NO: 9441894 - DNA, 22 bp, Homo sapiens
tgcacagggagggggccagctc

SEQ ID NO: 9441895 - DNA, 21 bp, Homo sapiens
tgcacagggcccaggagagcc

SEQ ID NO: 9441896 - DNA, 21 bp, Homo sapiens
tgcacagggcccaggagagcc

SEQ ID NO: 9441897 - DNA, 21 bp, Homo sapiens
tgcacagggcccaggagagcc

SEQ ID NO: 9441898 - DNA, 21 bp, Homo sapiens
tgcacagggcccaggagagcc

SEQ ID NO: 9441899 - DNA, 22 bp, Homo sapiens
tgcacagggagggggccagctc

SEQ ID NO: 9441900 - DNA, 22 bp, Homo sapiens
tgcaggagagtgagtcagtagg

SEQ ID NO: 9441901 - DNA, 22 bp, Homo sapiens
tgcaggagagtgagtcagtagg

SEQ ID NO: 9441902 - DNA, 22 bp, Homo sapiens
tgcaggagagtgagtcagtagg

SEQ ID NO: 9441903 - DNA, 22 bp, Homo sapiens
tgcaggagagctggtctggccc

SEQ ID NO: 9441904 - DNA, 22 bp, Homo sapiens
tgcaggagagctggtctggccc

SEQ ID NO: 9441905 - DNA, 22 bp, Homo sapiens
tgcaggagagctggtctggccc

SEQ ID NO: 9441906 - DNA, 22 bp, Homo sapiens
tgcaggagagctggtctggccc

SEQ ID NO: 9441907 - DNA, 22 bp, Homo sapiens
tgcaggagcaccagctcaccct

SEQ ID NO: 9441908 - DNA, 22 bp, Homo sapiens
tgcaggagcagagatggctgga

SEQ ID NO: 9441909 - DNA, 22 bp, Homo sapiens
tgcaggagcagagatggctgga

SEQ ID NO: 9441910 - DNA, 22 bp, Homo sapiens
tgcaggagcagagatggctgga

SEQ ID NO: 9441911 - DNA, 22 bp, Homo sapiens
tgcaggaactcgaaaactatag

SEQ ID NO: 9441912 - DNA, 22 bp, Homo sapiens
tgcaggaacttggttttactca

SEQ ID NO: 9441913 - DNA, 22 bp, Homo sapiens
tgcaggaacagaactcactccc

SEQ ID NO: 9441914 - DNA, 22 bp, Homo sapiens
tgcaggaaattccagggtggcc

SEQ ID NO: 9441915 - DNA, 21 bp, Homo sapiens
tgcaggaaagtgctgcgaccc

SEQ ID NO: 9441916 - DNA, 22 bp, Homo sapiens
tgcaggagaaagtacggagcgt

SEQ ID NO: 9441917 - DNA, 22 bp, Homo sapiens
tgcaggagacataatagggact

SEQ ID NO: 9441918 - DNA, 22 bp, Homo sapiens
tgcaggagacataatagggact

SEQ ID NO: 9441919 - DNA, 22 bp, Homo sapiens
tgcaggaagcaaccaggtccaa

SEQ ID NO: 9441920 - DNA, 22 bp, Homo sapiens
tgcaggaagacttcccaagcca

SEQ ID NO: 9441921 - DNA, 22 bp, Homo sapiens
tgcagcttcttgtcctgtgatt

SEQ ID NO: 9441922 - DNA, 22 bp, Homo sapiens
tgcaggaaaacacctatcaccc

SEQ ID NO: 9441923 - DNA, 22 bp, Homo sapiens
tgcaggaaacagaggctcaaat

SEQ ID NO: 9441924 - DNA, 22 bp, Homo sapiens
tgcaggaaacagaggctcaaat

SEQ ID NO: 9441925 - DNA, 22 bp, Homo sapiens
tgcagctgttacggaccctgtc

SEQ ID NO: 9441926 - DNA, 22 bp, Homo sapiens
tgcagcttctccaaatattaca

SEQ ID NO: 9441927 - DNA, 22 bp, Homo sapiens
tgcagctgtaacagaggcctca

SEQ ID NO: 9441928 - DNA, 22 bp, Homo sapiens
tgcagctgtaacagaggcctca

SEQ ID NO: 9441929 - DNA, 19 bp, Homo sapiens
tgcagctgtatgagcttaa

SEQ ID NO: 9441930 - DNA, 22 bp, Homo sapiens
tgcagctgtaacagaggcctca

SEQ ID NO: 9441931 - DNA, 22 bp, Homo sapiens
tgcagctgtaacagaggcctca

SEQ ID NO: 9441932 - DNA, 20 bp, Homo sapiens
tgcagctggtttcacaggga

SEQ ID NO: 9441933 - DNA, 20 bp, Homo sapiens
tgcagctggtttcacaggga

SEQ ID NO: 9441934 - DNA, 20 bp, Homo sapiens
tgcagctggtttcacaggga

SEQ ID NO: 9441935 - DNA, 20 bp, Homo sapiens
tgcagctggtttcacaggga

SEQ ID NO: 9441936 - DNA, 22 bp, Homo sapiens
tgcagctgtgcctgaaaagtac

SEQ ID NO: 9441937 - DNA, 22 bp, Homo sapiens
tgcagctgtgggagaatctctg

SEQ ID NO: 9441938 - DNA, 22 bp, Homo sapiens
tgcagctgtgggagaatctctg

SEQ ID NO: 9441939 - DNA, 22 bp, Homo sapiens
tgcagctgttacggaccctgtc

SEQ ID NO: 9441940 - DNA, 19 bp, Homo sapiens
tgcagctgtctctatatta

SEQ ID NO: 9441941 - DNA, 19 bp, Homo sapiens
tgcagctgtctctatatta

SEQ ID NO: 9441942 - DNA, 22 bp, Homo sapiens
tgcagctgtgaaagggaaccaa

SEQ ID NO: 9441943 - DNA, 22 bp, Homo sapiens
tgcagctgtgcctgaaaagtac

SEQ ID NO: 9441944 - DNA, 22 bp, Homo sapiens
tgcagctgtgcctgaaaagtac

SEQ ID NO: 9441945 - DNA, 22 bp, Homo sapiens
tgcagctgtgaaagggaaccaa

SEQ ID NO: 9441946 - DNA, 22 bp, Homo sapiens
tgcaggaggccccatggaaccg

SEQ ID NO: 9441947 - DNA, 22 bp, Homo sapiens
tgcaggaggccccatggaaccg

SEQ ID NO: 9441948 - DNA, 22 bp, Homo sapiens
tgcaggaggctttattcaggat

SEQ ID NO: 9441949 - DNA, 22 bp, Homo sapiens
tgcaggaggctttattcaggat

SEQ ID NO: 9441950 - DNA, 22 bp, Homo sapiens
tgcaggaggattttgtggagct

SEQ ID NO: 9441951 - DNA, 22 bp, Homo sapiens
tgcaggaggattttgtggagct

SEQ ID NO: 9441952 - DNA, 19 bp, Homo sapiens
tgcaggaggactgagcaga

SEQ ID NO: 9441953 - DNA, 19 bp, Homo sapiens
tgcaggaggactgagcaga

SEQ ID NO: 9441954 - DNA, 22 bp, Homo sapiens
tgcaggagtccaatcaggagac

SEQ ID NO: 9441955 - DNA, 22 bp, Homo sapiens
tgcaggagtccaatcaggagac

SEQ ID NO: 9441956 - DNA, 22 bp, Homo sapiens
tgcaggagtccaatcaggagac

SEQ ID NO: 9441957 - DNA, 22 bp, Homo sapiens
tgcaggagggagggttacagtt

SEQ ID NO: 9441958 - DNA, 22 bp, Homo sapiens
tgcaggagggagggttacagtt

SEQ ID NO: 9441959 - DNA, 22 bp, Homo sapiens
tgcaggagtccaatcaggagac

SEQ ID NO: 9441960 - DNA, 22 bp, Homo sapiens
tgcaggagccttggacttgaaa

SEQ ID NO: 9441961 - DNA, 22 bp, Homo sapiens
tgcaggagctgctgtcctgctc

SEQ ID NO: 9441962 - DNA, 22 bp, Homo sapiens
tgcaggagctgctgtcctgctc

SEQ ID NO: 9441963 - DNA, 22 bp, Homo sapiens
tgcaggagctgctgtcctgctc

SEQ ID NO: 9441964 - DNA, 22 bp, Homo sapiens
tgcaggagctgctgtcctgctc

SEQ ID NO: 9441965 - DNA, 22 bp, Homo sapiens
tgcaggagcccttgggctctgg

SEQ ID NO: 9441966 - DNA, 22 bp, Homo sapiens
tgcaggagcccttgggctctgg

SEQ ID NO: 9441967 - DNA, 22 bp, Homo sapiens
tgcaggagcccttgggctctgg

SEQ ID NO: 9441968 - DNA, 22 bp, Homo sapiens
tgcaggagcccttgggctctgg

SEQ ID NO: 9441969 - DNA, 22 bp, Homo sapiens
tgcaggagcccttgggctctgg

SEQ ID NO: 9441970 - DNA, 22 bp, Homo sapiens
tgcaggagcccaggaatactat

SEQ ID NO: 9441971 - DNA, 22 bp, Homo sapiens
tgcaggagctgtgcggtgaggg

SEQ ID NO: 9441972 - DNA, 22 bp, Homo sapiens
tgcaggagcttggctctgtccc

SEQ ID NO: 9441973 - DNA, 19 bp, Homo sapiens
tgcaggaggactgagcaga

SEQ ID NO: 9441974 - DNA, 21 bp, Homo sapiens
tgcaggagtctgtgagtcagg

SEQ ID NO: 9441975 - DNA, 21 bp, Homo sapiens
tgcaggagtgtaatgtgaccc

SEQ ID NO: 9441976 - DNA, 22 bp, Homo sapiens
tgcaggagttaagtgctctcct

SEQ ID NO: 9441977 - DNA, 22 bp, Homo sapiens
tgcaggagttaagtgctctcct

SEQ ID NO: 9441978 - DNA, 22 bp, Homo sapiens
tgcaggagttaagtgctctcct

SEQ ID NO: 9441979 - DNA, 22 bp, Homo sapiens
tgcaggagttcccctctgcctg

SEQ ID NO: 9441980 - DNA, 22 bp, Homo sapiens
tgcaggagttcccctctgcctg

SEQ ID NO: 9441981 - DNA, 22 bp, Homo sapiens
tgcaggcaccattctgcctctc

SEQ ID NO: 9441982 - DNA, 22 bp, Homo sapiens
tgcaggcagctgaaaggtgcct

SEQ ID NO: 9441983 - DNA, 22 bp, Homo sapiens
tgcaggcagctaaaccatgtaa

SEQ ID NO: 9441984 - DNA, 22 bp, Homo sapiens
tgcaggctcatctcaagagtag

SEQ ID NO: 9441985 - DNA, 22 bp, Homo sapiens
tgcaggctcacctgccagggcc

SEQ ID NO: 9441986 - DNA, 22 bp, Homo sapiens
tgcaggctcatctcaagagtag

SEQ ID NO: 9441987 - DNA, 22 bp, Homo sapiens
tgcaggctccaggtgcacatat

SEQ ID NO: 9441988 - DNA, 22 bp, Homo sapiens
tgcaggctccaggtgcacatat

SEQ ID NO: 9441989 - DNA, 22 bp, Homo sapiens
tgcaggctccaggtgcacatat

SEQ ID NO: 9441990 - DNA, 22 bp, Homo sapiens
tgcaggctcacctgccagggcc

SEQ ID NO: 9441991 - DNA, 22 bp, Homo sapiens
tgcaggctcaccctggagctga

SEQ ID NO: 9441992 - DNA, 22 bp, Homo sapiens
tgcaggctcaccctggagctga

SEQ ID NO: 9441993 - DNA, 21 bp, Homo sapiens
tgcaggctacttctgactcta

SEQ ID NO: 9441994 - DNA, 22 bp, Homo sapiens
tgcaggcctcagacttagccat

SEQ ID NO: 9441995 - DNA, 22 bp, Homo sapiens
tgcaggcctcagacttagccat

SEQ ID NO: 9441996 - DNA, 22 bp, Homo sapiens
tgcaggcagctgaaaggtgcct

SEQ ID NO: 9441997 - DNA, 23 bp, Homo sapiens
tgcaggctaggaagagagccttc

SEQ ID NO: 9441998 - DNA, 22 bp, Homo sapiens
tgcagcaggagccaggcctggt

SEQ ID NO: 9441999 - DNA, 22 bp, Homo sapiens
tgcagcaggcacaggacggaag

SEQ ID NO: 9442000 - DNA, 22 bp, Homo sapiens
tgcagcagggcccaggcacaga

SEQ ID NO: 9442001 - DNA, 22 bp, Homo sapiens
tgcagcagggcccaggcacaga

SEQ ID NO: 9442002 - DNA, 22 bp, Homo sapiens
tgcagcagggcccaggcacaga

SEQ ID NO: 9442003 - DNA, 22 bp, Homo sapiens
tgcagcagggcccaggcacaga

SEQ ID NO: 9442004 - DNA, 22 bp, Homo sapiens
tgcagcagggacctctatgtga

SEQ ID NO: 9442005 - DNA, 22 bp, Homo sapiens
tgcagcaggagccaggcctggt

SEQ ID NO: 9442006 - DNA, 22 bp, Homo sapiens
tgcagcagcagggaggaggctc

SEQ ID NO: 9442007 - DNA, 22 bp, Homo sapiens
tgcagcagccaaggttctgtgc

SEQ ID NO: 9442008 - DNA, 22 bp, Homo sapiens
tgcagcagcagggaggaggctc

SEQ ID NO: 9442009 - DNA, 22 bp, Homo sapiens
tgcagcagaatatggctgcagg

SEQ ID NO: 9442010 - DNA, 22 bp, Homo sapiens
tgcagcagacataatgtggatt

SEQ ID NO: 9442011 - DNA, 21 bp, Homo sapiens
tgcagcagagtaagcagggga

SEQ ID NO: 9442012 - DNA, 21 bp, Homo sapiens
tgcagcagagtaagcagggga

SEQ ID NO: 9442013 - DNA, 21 bp, Homo sapiens
tgcagcagagtaagcagggga

SEQ ID NO: 9442014 - DNA, 22 bp, Homo sapiens
tgcagcagactgagtatgagaa

SEQ ID NO: 9442015 - DNA, 21 bp, Homo sapiens
tgcagcagatttgggggaaga

SEQ ID NO: 9442016 - DNA, 22 bp, Homo sapiens
tgcagcagcagggaggaggctc

SEQ ID NO: 9442017 - DNA, 22 bp, Homo sapiens
tgcagcagcagggaggaggctc

SEQ ID NO: 9442018 - DNA, 22 bp, Homo sapiens
tgcagcagagtgggcctgggtg

SEQ ID NO: 9442019 - DNA, 22 bp, Homo sapiens
tgcagcagagtgggcctgggtg

SEQ ID NO: 9442020 - DNA, 21 bp, Homo sapiens
tgcagcagagtaagcagggga

SEQ ID NO: 9442021 - DNA, 21 bp, Homo sapiens
tgcagcagagtaagcagggga

SEQ ID NO: 9442022 - DNA, 22 bp, Homo sapiens
tgcagcccagccccagaacctt

SEQ ID NO: 9442023 - DNA, 22 bp, Homo sapiens
tgcagccatctttcttggagga

SEQ ID NO: 9442024 - DNA, 19 bp, Homo sapiens
tgcagccacgtgagagact

SEQ ID NO: 9442025 - DNA, 23 bp, Homo sapiens
tgcagcagggtggtctacttctc

SEQ ID NO: 9442026 - DNA, 22 bp, Homo sapiens
tgcagcctagacattctggtca

SEQ ID NO: 9442027 - DNA, 22 bp, Homo sapiens
tgcagcctagacattctggtca

SEQ ID NO: 9442028 - DNA, 21 bp, Homo sapiens
tgcagcctctgcccagcagtg

SEQ ID NO: 9442029 - DNA, 22 bp, Homo sapiens
tgcagcctctctgcttcaggaa

SEQ ID NO: 9442030 - DNA, 22 bp, Homo sapiens
tgcagcctctctgcttcaggaa

SEQ ID NO: 9442031 - DNA, 22 bp, Homo sapiens
tgcagcctggtggtcactggag

SEQ ID NO: 9442032 - DNA, 22 bp, Homo sapiens
tgcagcctggtggtcactggag

SEQ ID NO: 9442033 - DNA, 22 bp, Homo sapiens
tgcagcctggtggtcactggag

SEQ ID NO: 9442034 - DNA, 22 bp, Homo sapiens
tgcagcctggtggtcactggag

SEQ ID NO: 9442035 - DNA, 18 bp, Homo sapiens
tgcagcctgtagtcttgt

SEQ ID NO: 9442036 - DNA, 22 bp, Homo sapiens
tgcagctgctggtggctgaaag

SEQ ID NO: 9442037 - DNA, 22 bp, Homo sapiens
tgcagctgctggcccaggtgct

SEQ ID NO: 9442038 - DNA, 22 bp, Homo sapiens
tgcagctgctggcccaggtgct

SEQ ID NO: 9442039 - DNA, 22 bp, Homo sapiens
tgcagctgctggcccaggtgct

SEQ ID NO: 9442040 - DNA, 22 bp, Homo sapiens
tgcagctgctggtggctgaaag

SEQ ID NO: 9442041 - DNA, 22 bp, Homo sapiens
tgcagctgctggtggctgaaag

SEQ ID NO: 9442042 - DNA, 22 bp, Homo sapiens
tgcagctgctggtggctgaaag

SEQ ID NO: 9442043 - DNA, 22 bp, Homo sapiens
tgcagctgctcttcatttcccc

SEQ ID NO: 9442044 - DNA, 17 bp, Homo sapiens
tgcagctgctcccaggc

SEQ ID NO: 9442045 - DNA, 17 bp, Homo sapiens
tgcagctgctcccaggc

SEQ ID NO: 9442046 - DNA, 17 bp, Homo sapiens
tgcagctgctcccaggc

SEQ ID NO: 9442047 - DNA, 17 bp, Homo sapiens
tgcagctgatggggaaa

SEQ ID NO: 9442048 - DNA, 22 bp, Homo sapiens
tgcagctgagtcacccagccat

SEQ ID NO: 9442049 - DNA, 22 bp, Homo sapiens
tgcagctgagtcacccagccat

SEQ ID NO: 9442050 - DNA, 22 bp, Homo sapiens
tgcagctgaggccagctatgcc

SEQ ID NO: 9442051 - DNA, 22 bp, Homo sapiens
tgcagctgaggccagctatgcc

SEQ ID NO: 9442052 - DNA, 17 bp, Homo sapiens
tgcagctgatggggaaa

SEQ ID NO: 9442053 - DNA, 22 bp, Homo sapiens
tgcagctgataattacatgttc

SEQ ID NO: 9442054 - DNA, 22 bp, Homo sapiens
tgcagctgatgatacccccatg

SEQ ID NO: 9442055 - DNA, 22 bp, Homo sapiens
tgcagctggtatcccatggatt

SEQ ID NO: 9442056 - DNA, 22 bp, Homo sapiens
tgcagctggtttagaactagat

SEQ ID NO: 9442057 - DNA, 20 bp, Homo sapiens
tgcagctggtttcacaggga

SEQ ID NO: 9442058 - DNA, 22 bp, Homo sapiens
tgcagctggtttagaactagat

SEQ ID NO: 9442059 - DNA, 22 bp, Homo sapiens
tgcagctggtatcccatggatt

SEQ ID NO: 9442060 - DNA, 22 bp, Homo sapiens
tgcagctggtatcccatggatt

SEQ ID NO: 9442061 - DNA, 21 bp, Homo sapiens
tgcagctgggttctggtttgc

SEQ ID NO: 9442062 - DNA, 21 bp, Homo sapiens
tgcagctgggttctggtttgc

SEQ ID NO: 9442063 - DNA, 22 bp, Homo sapiens
tgcagctgggtctgccctggct

SEQ ID NO: 9442064 - DNA, 22 bp, Homo sapiens
tgcagctgggtctgccctggct

SEQ ID NO: 9442065 - DNA, 22 bp, Homo sapiens
tgcagctgggacatttttgata

SEQ ID NO: 9442066 - DNA, 22 bp, Homo sapiens
tgcagctggatttatcttttcc

SEQ ID NO: 9442067 - DNA, 22 bp, Homo sapiens
tgcagctggatttatcttttcc

SEQ ID NO: 9442068 - DNA, 22 bp, Homo sapiens
tgcagctgggtctgccctggct

SEQ ID NO: 9442069 - DNA, 22 bp, Homo sapiens
tgcagctgggtctgccctggct

SEQ ID NO: 9442070 - DNA, 22 bp, Homo sapiens
tgcagctggaacttagaggaga

SEQ ID NO: 9442071 - DNA, 22 bp, Homo sapiens
tgcagctggaacttagaggaga

SEQ ID NO: 9442072 - DNA, 22 bp, Homo sapiens
tgcagctgcttgattcatcttg

SEQ ID NO: 9442073 - DNA, 22 bp, Homo sapiens
tgcagctgcttgattcatcttg

SEQ ID NO: 9442074 - DNA, 22 bp, Homo sapiens
tgcagcctttagaagttcagat

SEQ ID NO: 9442075 - DNA, 22 bp, Homo sapiens
tgcagcctttagaagttcagat

SEQ ID NO: 9442076 - DNA, 18 bp, Homo sapiens
tgcagcctgtagtcttgt

SEQ ID NO: 9442077 - DNA, 22 bp, Homo sapiens
tgcagccttggcaaccagggac

SEQ ID NO: 9442078 - DNA, 22 bp, Homo sapiens
tgcagctcaggattctcagggc

SEQ ID NO: 9442079 - DNA, 22 bp, Homo sapiens
tgcagctcctgtgctgagtgtg

SEQ ID NO: 9442080 - DNA, 21 bp, Homo sapiens
tgcagctgacaccctttggga

SEQ ID NO: 9442081 - DNA, 21 bp, Homo sapiens
tgcagctgacaccctttggga

SEQ ID NO: 9442082 - DNA, 21 bp, Homo sapiens
tgcagctgacaccctttggga

SEQ ID NO: 9442083 - DNA, 22 bp, Homo sapiens
tgcagctgaacctagagtctgt

SEQ ID NO: 9442084 - DNA, 22 bp, Homo sapiens
tgcagctgaaaggactgaatga

SEQ ID NO: 9442085 - DNA, 22 bp, Homo sapiens
tgcagctgaacctagagtctgt

SEQ ID NO: 9442086 - DNA, 22 bp, Homo sapiens
tgcagctcttacggagggcggg

SEQ ID NO: 9442087 - DNA, 22 bp, Homo sapiens
tgcagctctgggtgtagaggct

SEQ ID NO: 9442088 - DNA, 22 bp, Homo sapiens
tgcagctctggggtaaggggtg

SEQ ID NO: 9442089 - DNA, 22 bp, Homo sapiens
tgcagctgacccactccagtcc

SEQ ID NO: 9442090 - DNA, 22 bp, Homo sapiens
tgcagctgaccagcaagtcctg

SEQ ID NO: 9442091 - DNA, 22 bp, Homo sapiens
tgcagctgacccactccagtcc

SEQ ID NO: 9442092 - DNA, 22 bp, Homo sapiens
tgcagctgacccactccagtcc

SEQ ID NO: 9442093 - DNA, 21 bp, Homo sapiens
tgcagctgacactggtatgcc

SEQ ID NO: 9442094 - DNA, 22 bp, Homo sapiens
tgcagctgaccagcaagtcctg

SEQ ID NO: 9442095 - DNA, 22 bp, Homo sapiens
tgcagctgaccagcaagtcctg

SEQ ID NO: 9442096 - DNA, 22 bp, Homo sapiens
tgcagctgaccagcaagtcctg

SEQ ID NO: 9442097 - DNA, 22 bp, Homo sapiens
tgcaaaaacagccttgaggcct

SEQ ID NO: 9442098 - DNA, 22 bp, Homo sapiens
tgcaaaaacagccttgaggcct

SEQ ID NO: 9442099 - DNA, 22 bp, Homo sapiens
tgcaaaaacagccttgaggcct

SEQ ID NO: 9442100 - DNA, 22 bp, Homo sapiens
tgatttttggatctgagctgca

SEQ ID NO: 9442101 - DNA, 22 bp, Homo sapiens
tgatttttagctattctgaaga

SEQ ID NO: 9442102 - DNA, 22 bp, Homo sapiens
tgatttttaaaattctccttgc

SEQ ID NO: 9442103 - DNA, 22 bp, Homo sapiens
tgatttttaaaattctccttgc

SEQ ID NO: 9442104 - DNA, 22 bp, Homo sapiens
tgatttttagctattctgaaga

SEQ ID NO: 9442105 - DNA, 22 bp, Homo sapiens
tgattttctccattgtaaattc

SEQ ID NO: 9442106 - DNA, 22 bp, Homo sapiens
tgattttctccattgtaaattc

SEQ ID NO: 9442107 - DNA, 22 bp, Homo sapiens
tgatttcctaggtctggagaag

SEQ ID NO: 9442108 - DNA, 22 bp, Homo sapiens
tgattttcatgggtgatctttg

SEQ ID NO: 9442109 - DNA, 22 bp, Homo sapiens
tgcaaaataatgaacgattttt

SEQ ID NO: 9442110 - DNA, 22 bp, Homo sapiens
tgcaaaataatgaacgattttt

SEQ ID NO: 9442111 - DNA, 22 bp, Homo sapiens
tgcaaaataatgaacgattttt

SEQ ID NO: 9442112 - DNA, 22 bp, Homo sapiens
tgcaaaagaatatagatattgt

SEQ ID NO: 9442113 - DNA, 22 bp, Homo sapiens
tgcaaaaattgctggaatcttt

SEQ ID NO: 9442114 - DNA, 22 bp, Homo sapiens
tgcaaaaattgctggaatcttt

SEQ ID NO: 9442115 - DNA, 22 bp, Homo sapiens
tgcaaaaattgctggaatcttt

SEQ ID NO: 9442116 - DNA, 22 bp, Homo sapiens
tgcaaaagaatatagatattgt

SEQ ID NO: 9442117 - DNA, 22 bp, Homo sapiens
tgcaaaaagagcgaggagccct

SEQ ID NO: 9442118 - DNA, 22 bp, Homo sapiens
tgcaaaaactgcaattgctttt

SEQ ID NO: 9442119 - DNA, 22 bp, Homo sapiens
tgcaaaaactgcaattgctttt

SEQ ID NO: 9442120 - DNA, 22 bp, Homo sapiens
tgcaaaaactgcaattgctttt

SEQ ID NO: 9442121 - DNA, 22 bp, Homo sapiens
tgcaaaaagagcgaggagccct

SEQ ID NO: 9442122 - DNA, 22 bp, Homo sapiens
tgcaaaaagagcgaggagccct

SEQ ID NO: 9442123 - DNA, 22 bp, Homo sapiens
tgcaaaaagagcgaggagccct

SEQ ID NO: 9442124 - DNA, 22 bp, Homo sapiens
tgcaaaaaggcagactggtgat

SEQ ID NO: 9442125 - DNA, 22 bp, Homo sapiens
tgcaaaaaggcagactggtgat

SEQ ID NO: 9442126 - DNA, 21 bp, Homo sapiens
tgatttccatcttaaaataaa

SEQ ID NO: 9442127 - DNA, 22 bp, Homo sapiens
tgatttccatgaagctgaaggc

SEQ ID NO: 9442128 - DNA, 22 bp, Homo sapiens
tgatttccagttgctgggtgct

SEQ ID NO: 9442129 - DNA, 22 bp, Homo sapiens
tgatttcaagtagtgacatgct

SEQ ID NO: 9442130 - DNA, 22 bp, Homo sapiens
tgatttcatagtatatacatga

SEQ ID NO: 9442131 - DNA, 22 bp, Homo sapiens
tgatttccaataaggagaatgt

SEQ ID NO: 9442132 - DNA, 22 bp, Homo sapiens
tgatttatgcattatactgttg

SEQ ID NO: 9442133 - DNA, 22 bp, Homo sapiens
tgatttaaaagaaacattgtct

SEQ ID NO: 9442134 - DNA, 22 bp, Homo sapiens
tgatttacaattgtaaaagttt

SEQ ID NO: 9442135 - DNA, 22 bp, Homo sapiens
tgatttaaaagaaacattgtct

SEQ ID NO: 9442136 - DNA, 22 bp, Homo sapiens
tgatttacacacctatgattta

SEQ ID NO: 9442137 - DNA, 22 bp, Homo sapiens
tgatttacaattgtaaaagttt

SEQ ID NO: 9442138 - DNA, 22 bp, Homo sapiens
tgatttacacatcaaagcagca

SEQ ID NO: 9442139 - DNA, 22 bp, Homo sapiens
tgatttacagtagtgtctaaac

SEQ ID NO: 9442140 - DNA, 22 bp, Homo sapiens
tgatttaccagttactatcttg

SEQ ID NO: 9442141 - DNA, 22 bp, Homo sapiens
tgatttacccgtaactatttct

SEQ ID NO: 9442142 - DNA, 22 bp, Homo sapiens
tgatttacccgtccaggcccta

SEQ ID NO: 9442143 - DNA, 22 bp, Homo sapiens
tgatttactcccacttagagcc

SEQ ID NO: 9442144 - DNA, 22 bp, Homo sapiens
tgatttacttcccagctgggtt

SEQ ID NO: 9442145 - DNA, 22 bp, Homo sapiens
tgatttaggaaacagctacagg

SEQ ID NO: 9442146 - DNA, 22 bp, Homo sapiens
tgatttacttctggataaatcc

SEQ ID NO: 9442147 - DNA, 22 bp, Homo sapiens
tgatttatgaccaagttagaat

SEQ ID NO: 9442148 - DNA, 22 bp, Homo sapiens
tgatttatgaccaagttagaat

SEQ ID NO: 9442149 - DNA, 22 bp, Homo sapiens
tgcaaattgcatgatgtgtatc

SEQ ID NO: 9442150 - DNA, 22 bp, Homo sapiens
tgcaaatttaatgaaactatgt

SEQ ID NO: 9442151 - DNA, 22 bp, Homo sapiens
tgcaaatttaatgaaactatgt

SEQ ID NO: 9442152 - DNA, 22 bp, Homo sapiens
tgcaaatttatatggtgactgc

SEQ ID NO: 9442153 - DNA, 19 bp, Homo sapiens
tgcaaattctaaaaactga

SEQ ID NO: 9442154 - DNA, 19 bp, Homo sapiens
tgcaaattctaaaaactga

SEQ ID NO: 9442155 - DNA, 22 bp, Homo sapiens
tgcaaattccatttaaacacta

SEQ ID NO: 9442156 - DNA, 22 bp, Homo sapiens
tgcaaatgggcatctccaagtg

SEQ ID NO: 9442157 - DNA, 22 bp, Homo sapiens
tgcaaatgggcatctccaagtg

SEQ ID NO: 9442158 - DNA, 18 bp, Homo sapiens
tgcaaatggctgtttgat

SEQ ID NO: 9442159 - DNA, 22 bp, Homo sapiens
tgcaaatgggaaacccagcagt

SEQ ID NO: 9442160 - DNA, 22 bp, Homo sapiens
tgcaaatgtgttttaaaccaaa

SEQ ID NO: 9442161 - DNA, 22 bp, Homo sapiens
tgcaaatgtgtggtgaggcatt

SEQ ID NO: 9442162 - DNA, 19 bp, Homo sapiens
tgcaaatgtaggaagaata

SEQ ID NO: 9442163 - DNA, 22 bp, Homo sapiens
tgcaaatgtgtggtgaggcatt

SEQ ID NO: 9442164 - DNA, 22 bp, Homo sapiens
tgcaaagaagcctttgccttct

SEQ ID NO: 9442165 - DNA, 22 bp, Homo sapiens
tgcaaagaagggctgaggagca

SEQ ID NO: 9442166 - DNA, 22 bp, Homo sapiens
tgcaaagaaggggaggaggatt

SEQ ID NO: 9442167 - DNA, 22 bp, Homo sapiens
tgcaaagatatgagaagctgta

SEQ ID NO: 9442168 - DNA, 22 bp, Homo sapiens
tgcaaagaaggggaggaggatt

SEQ ID NO: 9442169 - DNA, 22 bp, Homo sapiens
tgcaaagatgaaatattaaagg

SEQ ID NO: 9442170 - DNA, 22 bp, Homo sapiens
tgcaaatcctgtttggagtaag

SEQ ID NO: 9442171 - DNA, 22 bp, Homo sapiens
tgcaaatcatcctggattagag

SEQ ID NO: 9442172 - DNA, 22 bp, Homo sapiens
tgcaaatatttccttatagcca

SEQ ID NO: 9442173 - DNA, 22 bp, Homo sapiens
tgcaaatatttccttatagcca

SEQ ID NO: 9442174 - DNA, 22 bp, Homo sapiens
tgcaaacagttaagatgcaggc

SEQ ID NO: 9442175 - DNA, 22 bp, Homo sapiens
tgcaaacagttaagatgcaggc

SEQ ID NO: 9442176 - DNA, 22 bp, Homo sapiens
tgcaaacaggcatttcacaaac

SEQ ID NO: 9442177 - DNA, 22 bp, Homo sapiens
tgcaaacaggagagtaagtata

SEQ ID NO: 9442178 - DNA, 22 bp, Homo sapiens
tgcaaacagccttgaaagaggg

SEQ ID NO: 9442179 - DNA, 22 bp, Homo sapiens
tgcaaacagaaagtttattgtg

SEQ ID NO: 9442180 - DNA, 22 bp, Homo sapiens
tgcaaacagccttgaaagaggg

SEQ ID NO: 9442181 - DNA, 22 bp, Homo sapiens
tgcaaacatccgactgaaagcc

SEQ ID NO: 9442182 - DNA, 22 bp, Homo sapiens
tgcaaacatccgactgaaagcc

SEQ ID NO: 9442183 - DNA, 20 bp, Homo sapiens
tgcaaacattacttgggtgt

SEQ ID NO: 9442184 - DNA, 22 bp, Homo sapiens
tgcaaactagcatcaactagta

SEQ ID NO: 9442185 - DNA, 22 bp, Homo sapiens
tgcaaactattggtagagatgg

SEQ ID NO: 9442186 - DNA, 22 bp, Homo sapiens
tgcaaactagcatcaactagta

SEQ ID NO: 9442187 - DNA, 22 bp, Homo sapiens
tgcaaactattggtagagatgg

SEQ ID NO: 9442188 - DNA, 22 bp, Homo sapiens
tgcaaactattggtagagatgg

SEQ ID NO: 9442189 - DNA, 23 bp, Homo sapiens
tgcaaagaaatctgggtcattgt

SEQ ID NO: 9442190 - DNA, 20 bp, Homo sapiens
tgcaaacacagagtgtatga

SEQ ID NO: 9442191 - DNA, 22 bp, Homo sapiens
tgcaaacaatttcctataaagt

SEQ ID NO: 9442192 - DNA, 20 bp, Homo sapiens
tgcaaacacagagtgtatga

SEQ ID NO: 9442193 - DNA, 20 bp, Homo sapiens
tgcaaacacagagtgtatga

SEQ ID NO: 9442194 - DNA, 22 bp, Homo sapiens
tgcaaacacttcaacgtgcatc

SEQ ID NO: 9442195 - DNA, 22 bp, Homo sapiens
tgcaaacaccacagagacaatt

SEQ ID NO: 9442196 - DNA, 22 bp, Homo sapiens
tgcaaacaatttcctataaagt

SEQ ID NO: 9442197 - DNA, 22 bp, Homo sapiens
tgcaaacaatttcctataaagt

SEQ ID NO: 9442198 - DNA, 22 bp, Homo sapiens
tgcaaaatgacttctgaaaaga

SEQ ID NO: 9442199 - DNA, 23 bp, Homo sapiens
tgcaaaatttgcagagttcgatg

SEQ ID NO: 9442200 - DNA, 23 bp, Homo sapiens
tgcaaaatttgcagagttcgatg

SEQ ID NO: 9442201 - DNA, 22 bp, Homo sapiens
tgcaaggggtttatgcagatga

SEQ ID NO: 9442202 - DNA, 22 bp, Homo sapiens
tgcaagggcttagggggctgtg

SEQ ID NO: 9442203 - DNA, 22 bp, Homo sapiens
tgcaagggtagaagtgatggca

SEQ ID NO: 9442204 - DNA, 22 bp, Homo sapiens
tgcaagggtagaagtgatggca

SEQ ID NO: 9442205 - DNA, 22 bp, Homo sapiens
tgcaagggtgacaggttgctct

SEQ ID NO: 9442206 - DNA, 22 bp, Homo sapiens
tgcaagggtgtttgagctgccc

SEQ ID NO: 9442207 - DNA, 22 bp, Homo sapiens
tgcaagggtgtttgagctgccc

SEQ ID NO: 9442208 - DNA, 19 bp, Homo sapiens
tgcaagggtggtctcctgg

SEQ ID NO: 9442209 - DNA, 21 bp, Homo sapiens
tgcaatccagcctgggcgaca

SEQ ID NO: 9442210 - DNA, 21 bp, Homo sapiens
tgcaatccagcctgggcgaca

SEQ ID NO: 9442211 - DNA, 22 bp, Homo sapiens
tgcaagtaaccatcactatctc

SEQ ID NO: 9442212 - DNA, 21 bp, Homo sapiens
tgcaatccagcctgggcgaca

SEQ ID NO: 9442213 - DNA, 21 bp, Homo sapiens
tgcaatccagcctgggcgaca

SEQ ID NO: 9442214 - DNA, 21 bp, Homo sapiens
tgcaatccagcctgggcgaca

SEQ ID NO: 9442215 - DNA, 22 bp, Homo sapiens
tgcaaggcccagacaagagctc

SEQ ID NO: 9442216 - DNA, 22 bp, Homo sapiens
tgcaaggctgcagagggtgcta

SEQ ID NO: 9442217 - DNA, 22 bp, Homo sapiens
tgcaaggctattcacatgtatt

SEQ ID NO: 9442218 - DNA, 22 bp, Homo sapiens
tgcaaggctgcagagggtgcta

SEQ ID NO: 9442219 - DNA, 20 bp, Homo sapiens
tgcaaggccagggtcaggag

SEQ ID NO: 9442220 - DNA, 20 bp, Homo sapiens
tgcaaggccagggtcaggag

SEQ ID NO: 9442221 - DNA, 22 bp, Homo sapiens
tgcaaggctgcctctgaggacc

SEQ ID NO: 9442222 - DNA, 22 bp, Homo sapiens
tgcaaggctgcctctgaggacc

SEQ ID NO: 9442223 - DNA, 22 bp, Homo sapiens
tgcaaggctgcagagggtgcta

SEQ ID NO: 9442224 - DNA, 22 bp, Homo sapiens
tgcaaggcttgcaatggtgatc

SEQ ID NO: 9442225 - DNA, 22 bp, Homo sapiens
tgcaaggcttgcaatggtgatc

SEQ ID NO: 9442226 - DNA, 22 bp, Homo sapiens
tgcaaggatatttagtctagtg

SEQ ID NO: 9442227 - DNA, 22 bp, Homo sapiens
tgcaaggcacacagggggtaag

SEQ ID NO: 9442228 - DNA, 22 bp, Homo sapiens
tgcaaggcagcaccagctcttg

SEQ ID NO: 9442229 - DNA, 22 bp, Homo sapiens
tgcaaggcagcaccagctcttg

SEQ ID NO: 9442230 - DNA, 22 bp, Homo sapiens
tgcaagcaatccaggaaggcta

SEQ ID NO: 9442231 - DNA, 22 bp, Homo sapiens
tgcaagacgtgaaattgagaca

SEQ ID NO: 9442232 - DNA, 22 bp, Homo sapiens
tgcaagacgtgaaattgagaca

SEQ ID NO: 9442233 - DNA, 23 bp, Homo sapiens
tgcaagagttccaaactgttcaa

SEQ ID NO: 9442234 - DNA, 22 bp, Homo sapiens
tgcaaatttctttagtacataa

SEQ ID NO: 9442235 - DNA, 22 bp, Homo sapiens
tgcaaatttctttagtacataa

SEQ ID NO: 9442236 - DNA, 22 bp, Homo sapiens
tgcaaatttgacttcacacatc

SEQ ID NO: 9442237 - DNA, 22 bp, Homo sapiens
tgcaaatttgacttcacacatc

SEQ ID NO: 9442238 - DNA, 22 bp, Homo sapiens
tgcaaatttctttagtacataa

SEQ ID NO: 9442239 - DNA, 22 bp, Homo sapiens
tgcaacagtggggcatgctgaa

SEQ ID NO: 9442240 - DNA, 22 bp, Homo sapiens
tgcaacattattaaactaagca

SEQ ID NO: 9442241 - DNA, 22 bp, Homo sapiens
tgcaacttgtttggagagaaag

SEQ ID NO: 9442242 - DNA, 22 bp, Homo sapiens
tgcacacaggtctaggacatgg

SEQ ID NO: 9442243 - DNA, 22 bp, Homo sapiens
tgcacacagatggtacatgcat

SEQ ID NO: 9442244 - DNA, 22 bp, Homo sapiens
tgcacacagatggtacatgcat

SEQ ID NO: 9442245 - DNA, 22 bp, Homo sapiens
tgcacacagctgggcctggctg

SEQ ID NO: 9442246 - DNA, 22 bp, Homo sapiens
tgcacacactctgcatatactt

SEQ ID NO: 9442247 - DNA, 22 bp, Homo sapiens
tgcacacactctgcatatactt

SEQ ID NO: 9442248 - DNA, 22 bp, Homo sapiens
tgcacacactctgcatatactt

SEQ ID NO: 9442249 - DNA, 22 bp, Homo sapiens
tgcacacactcgtgtatatgag

SEQ ID NO: 9442250 - DNA, 22 bp, Homo sapiens
tgcacacactcgtgtatatgag

SEQ ID NO: 9442251 - DNA, 19 bp, Homo sapiens
tgcacacagataagtatct

SEQ ID NO: 9442252 - DNA, 19 bp, Homo sapiens
tgcacacagataagtatct

SEQ ID NO: 9442253 - DNA, 22 bp, Homo sapiens
tgcacacactctgcatatactt

SEQ ID NO: 9442254 - DNA, 22 bp, Homo sapiens
tgcacacacgcggcacatctgt

SEQ ID NO: 9442255 - DNA, 22 bp, Homo sapiens
tgcacacacgcggcacatctgt

SEQ ID NO: 9442256 - DNA, 22 bp, Homo sapiens
tgcacacacgcggcacatctgt

SEQ ID NO: 9442257 - DNA, 22 bp, Homo sapiens
tgcacacacggagataggcttt

SEQ ID NO: 9442258 - DNA, 22 bp, Homo sapiens
tgcacacaccgtgcttcactga

SEQ ID NO: 9442259 - DNA, 22 bp, Homo sapiens
tgcacacaccgtgcttcactga

SEQ ID NO: 9442260 - DNA, 22 bp, Homo sapiens
tgcacacaccgtgcttcactga

SEQ ID NO: 9442261 - DNA, 20 bp, Homo sapiens
tgcacacaccctgtcctcca

SEQ ID NO: 9442262 - DNA, 22 bp, Homo sapiens
tgcacacacatgcagagggaga

SEQ ID NO: 9442263 - DNA, 22 bp, Homo sapiens
tgcacacacatgaagtagcatg

SEQ ID NO: 9442264 - DNA, 22 bp, Homo sapiens
tgcacacacatgaagtagcatg

SEQ ID NO: 9442265 - DNA, 22 bp, Homo sapiens
tgcacacacaggagtctcctcc

SEQ ID NO: 9442266 - DNA, 22 bp, Homo sapiens
tgcacacacaggagtctcctcc

SEQ ID NO: 9442267 - DNA, 21 bp, Homo sapiens
tgcacaaactttctgtggctt

SEQ ID NO: 9442268 - DNA, 22 bp, Homo sapiens
tgcacaaacacagagaatagat

SEQ ID NO: 9442269 - DNA, 22 bp, Homo sapiens
tgcaattttaatacattagagg

SEQ ID NO: 9442270 - DNA, 22 bp, Homo sapiens
tgcaattttaatacattagagg

SEQ ID NO: 9442271 - DNA, 22 bp, Homo sapiens
tgcaatttggggaagaaagaga

SEQ ID NO: 9442272 - DNA, 22 bp, Homo sapiens
tgcacaaatttgtgtatgctca

SEQ ID NO: 9442273 - DNA, 17 bp, Homo sapiens
tgcacaagagacaatag

SEQ ID NO: 9442274 - DNA, 22 bp, Homo sapiens
tgcacaagtcagagtaacattt

SEQ ID NO: 9442275 - DNA, 21 bp, Homo sapiens
tgcaatttagacttgaacatt

SEQ ID NO: 9442276 - DNA, 21 bp, Homo sapiens
tgcaatttagacttgaacatt

SEQ ID NO: 9442277 - DNA, 22 bp, Homo sapiens
tgcaatttcaaatatcagaaag

SEQ ID NO: 9442278 - DNA, 22 bp, Homo sapiens
tgcaatttcaaatatcagaaag

SEQ ID NO: 9442279 - DNA, 22 bp, Homo sapiens
tgcaatttggcttccattttct

SEQ ID NO: 9442280 - DNA, 22 bp, Homo sapiens
tgcaatttcaggcatatattgt

SEQ ID NO: 9442281 - DNA, 22 bp, Homo sapiens
tgcaatctcggcactttgggag

SEQ ID NO: 9442282 - DNA, 22 bp, Homo sapiens
tgcaatctcggcactttgggag

SEQ ID NO: 9442283 - DNA, 22 bp, Homo sapiens
tgcaatccccgcctcaacagga

SEQ ID NO: 9442284 - DNA, 22 bp, Homo sapiens
tgcaatgaatatggtacattaa

SEQ ID NO: 9442285 - DNA, 22 bp, Homo sapiens
tgcaattagcattgtattctta

SEQ ID NO: 9442286 - DNA, 22 bp, Homo sapiens
tgcaattaatttacatgcttaa

SEQ ID NO: 9442287 - DNA, 23 bp, Homo sapiens
tgcaatggcatgatttcagctca

SEQ ID NO: 9442288 - DNA, 20 bp, Homo sapiens
tgcaatgtccatgttccagg

SEQ ID NO: 9442289 - DNA, 21 bp, Homo sapiens
tgcaatgcattgacagcagca

SEQ ID NO: 9442290 - DNA, 22 bp, Homo sapiens
tgatcccatgggatggcatcag

SEQ ID NO: 9442291 - DNA, 22 bp, Homo sapiens
tgatcccatgggatggcatcag

SEQ ID NO: 9442292 - DNA, 22 bp, Homo sapiens
tgatcccagatctgagagggtt

SEQ ID NO: 9442293 - DNA, 22 bp, Homo sapiens
tgatccctggacttgagtaagt

SEQ ID NO: 9442294 - DNA, 22 bp, Homo sapiens
tgatcttcaccttgttctttgg

SEQ ID NO: 9442295 - DNA, 22 bp, Homo sapiens
tgatctttactgctgtttataa

SEQ ID NO: 9442296 - DNA, 22 bp, Homo sapiens
tgatctttactgctgtttataa

SEQ ID NO: 9442297 - DNA, 18 bp, Homo sapiens
tgatctttcatgattcca

SEQ ID NO: 9442298 - DNA, 22 bp, Homo sapiens
tgatctttcctcttgtttgtct

SEQ ID NO: 9442299 - DNA, 18 bp, Homo sapiens
tgatctttcatgattcca

SEQ ID NO: 9442300 - DNA, 22 bp, Homo sapiens
tgatctggaattccctgtggta

SEQ ID NO: 9442301 - DNA, 19 bp, Homo sapiens
tgatctggaaggaaccagg

SEQ ID NO: 9442302 - DNA, 19 bp, Homo sapiens
tgatctggaaggaaccagg

SEQ ID NO: 9442303 - DNA, 22 bp, Homo sapiens
tgatctggtcctactgtgggca

SEQ ID NO: 9442304 - DNA, 22 bp, Homo sapiens
tgatctggtcctactgtgggca

SEQ ID NO: 9442305 - DNA, 20 bp, Homo sapiens
tgatcatgtgaaagtcatgt

SEQ ID NO: 9442306 - DNA, 21 bp, Homo sapiens
tgatcatttgtgtaaaggaga

SEQ ID NO: 9442307 - DNA, 22 bp, Homo sapiens
tgatccatatgtgttacttctc

SEQ ID NO: 9442308 - DNA, 22 bp, Homo sapiens
tgatcagcatcttcccagctcg

SEQ ID NO: 9442309 - DNA, 22 bp, Homo sapiens
tgatcagacagttatgtgcatg

SEQ ID NO: 9442310 - DNA, 22 bp, Homo sapiens
tgatcagacagttatgtgcatg

SEQ ID NO: 9442311 - DNA, 22 bp, Homo sapiens
tgatcaaaacattactccacca

SEQ ID NO: 9442312 - DNA, 22 bp, Homo sapiens
tgatcacaagtctgaagaatga

SEQ ID NO: 9442313 - DNA, 22 bp, Homo sapiens
tgatcacaagtctgaagaatga

SEQ ID NO: 9442314 - DNA, 22 bp, Homo sapiens
tgatattttatgagctttcata

SEQ ID NO: 9442315 - DNA, 22 bp, Homo sapiens
tgatcaaaacattactccacca

SEQ ID NO: 9442316 - DNA, 23 bp, Homo sapiens
tgagttctaggcttaaaactagc

SEQ ID NO: 9442317 - DNA, 22 bp, Homo sapiens
tgagttctcacccattcttctt

SEQ ID NO: 9442318 - DNA, 22 bp, Homo sapiens
tgatacataaaccatcattttg

SEQ ID NO: 9442319 - DNA, 22 bp, Homo sapiens
tgatagaaaatgctgtcaagct

SEQ ID NO: 9442320 - DNA, 22 bp, Homo sapiens
tgatagaaaggaaattaattgg

SEQ ID NO: 9442321 - DNA, 22 bp, Homo sapiens
tgatagaaaggaaattaattgg

SEQ ID NO: 9442322 - DNA, 22 bp, Homo sapiens
tgatagaatcagataaaaggat

SEQ ID NO: 9442323 - DNA, 22 bp, Homo sapiens
tgatagaatcagataaaaggat

SEQ ID NO: 9442324 - DNA, 22 bp, Homo sapiens
tgatagagcactaagtagtgta

SEQ ID NO: 9442325 - DNA, 22 bp, Homo sapiens
tgatagaatcagataaaaggat

SEQ ID NO: 9442326 - DNA, 22 bp, Homo sapiens
tgatagaatcagataaaaggat

SEQ ID NO: 9442327 - DNA, 17 bp, Homo sapiens
tgatagttcattttaag

SEQ ID NO: 9442328 - DNA, 22 bp, Homo sapiens
tgatataagaagtagtatggat

SEQ ID NO: 9442329 - DNA, 22 bp, Homo sapiens
tgatagtatctgattatttcac

SEQ ID NO: 9442330 - DNA, 22 bp, Homo sapiens
tgatatttgctgactgcattgt

SEQ ID NO: 9442331 - DNA, 22 bp, Homo sapiens
tgatattttatgagctttcata

SEQ ID NO: 9442332 - DNA, 22 bp, Homo sapiens
tgatatgtgaagctattagttc

SEQ ID NO: 9442333 - DNA, 22 bp, Homo sapiens
tgatatgtgaagctattagttc

SEQ ID NO: 9442334 - DNA, 22 bp, Homo sapiens
tgatatgtttggatttaggttt

SEQ ID NO: 9442335 - DNA, 22 bp, Homo sapiens
tgatatttaagcaaaaatatgg

SEQ ID NO: 9442336 - DNA, 20 bp, Homo sapiens
tgatatggtttggctgtgtt

SEQ ID NO: 9442337 - DNA, 22 bp, Homo sapiens
tgatatgggaaaagggctcgga

SEQ ID NO: 9442338 - DNA, 22 bp, Homo sapiens
tgatatggctaaagaaagtttc

SEQ ID NO: 9442339 - DNA, 22 bp, Homo sapiens
tgatatgggaaaagggctcgga

SEQ ID NO: 9442340 - DNA, 22 bp, Homo sapiens
tgatatgtaactactccttata

SEQ ID NO: 9442341 - DNA, 20 bp, Homo sapiens
tgatatggtttggctgtgtt

SEQ ID NO: 9442342 - DNA, 22 bp, Homo sapiens
tgatatgcatgtaagggagaca

SEQ ID NO: 9442343 - DNA, 22 bp, Homo sapiens
tgatatggaaggaagatgtaca

SEQ ID NO: 9442344 - DNA, 22 bp, Homo sapiens
tgatatgcatgtaagggagaca

SEQ ID NO: 9442345 - DNA, 22 bp, Homo sapiens
tgagtgggattaaatgaggtga

SEQ ID NO: 9442346 - DNA, 22 bp, Homo sapiens
tgagtgtatatgaaggttgtaa

SEQ ID NO: 9442347 - DNA, 19 bp, Homo sapiens
tgagtgtcacgtcagtgcc

SEQ ID NO: 9442348 - DNA, 22 bp, Homo sapiens
tgagtgggttatcaggaaaggt

SEQ ID NO: 9442349 - DNA, 23 bp, Homo sapiens
tgagtgtgaaaatcctggagatg

SEQ ID NO: 9442350 - DNA, 22 bp, Homo sapiens
tgagtgtctggtcatggcaggc

SEQ ID NO: 9442351 - DNA, 23 bp, Homo sapiens
tgagtgtgaaaatcctggagatg

SEQ ID NO: 9442352 - DNA, 22 bp, Homo sapiens
tgagtgtgctaggtgtctcggt

SEQ ID NO: 9442353 - DNA, 22 bp, Homo sapiens
tgagtgtggggaatgtcatgag

SEQ ID NO: 9442354 - DNA, 22 bp, Homo sapiens
tgagtgtggggaatgtcatgag

SEQ ID NO: 9442355 - DNA, 22 bp, Homo sapiens
tgagtgtgaggtgggagcttgg

SEQ ID NO: 9442356 - DNA, 22 bp, Homo sapiens
tgagtgtgaggtgggagcttgg

SEQ ID NO: 9442357 - DNA, 22 bp, Homo sapiens
tgagtgtgctaggtgtctcggt

SEQ ID NO: 9442358 - DNA, 22 bp, Homo sapiens
tgagtgtgtattatgtatcagg

SEQ ID NO: 9442359 - DNA, 19 bp, Homo sapiens
tgagtgtgtgtttctctaa

SEQ ID NO: 9442360 - DNA, 22 bp, Homo sapiens
tgagtgtgtattatgtatcagg

SEQ ID NO: 9442361 - DNA, 22 bp, Homo sapiens
tgagtgtggggaatgtcatgag

SEQ ID NO: 9442362 - DNA, 23 bp, Homo sapiens
tgagtgtggggacagtggtttgc

SEQ ID NO: 9442363 - DNA, 23 bp, Homo sapiens
tgagtgtggggacagtggtttgc

SEQ ID NO: 9442364 - DNA, 20 bp, Homo sapiens
tgagttcatttgcatgtggt

SEQ ID NO: 9442365 - DNA, 22 bp, Homo sapiens
tgagttcagatcctggctctgc

SEQ ID NO: 9442366 - DNA, 18 bp, Homo sapiens
tgagttcattagacttcc

SEQ ID NO: 9442367 - DNA, 22 bp, Homo sapiens
tgagttcatttgagtgaacact

SEQ ID NO: 9442368 - DNA, 22 bp, Homo sapiens
tgagttcaagtccaagttgctg

SEQ ID NO: 9442369 - DNA, 22 bp, Homo sapiens
tgagttcaaattttggctctgc

SEQ ID NO: 9442370 - DNA, 22 bp, Homo sapiens
tgagttcacatgaggtctggtc

SEQ ID NO: 9442371 - DNA, 22 bp, Homo sapiens
tgagttcagatcctggctctgc

SEQ ID NO: 9442372 - DNA, 22 bp, Homo sapiens
tgagttatctaaaatagtcaaa

SEQ ID NO: 9442373 - DNA, 22 bp, Homo sapiens
tgagttatctaaaatagtcaaa

SEQ ID NO: 9442374 - DNA, 22 bp, Homo sapiens
tgagttatatatactggctctg

SEQ ID NO: 9442375 - DNA, 22 bp, Homo sapiens
tgagttattgagaaataactgc

SEQ ID NO: 9442376 - DNA, 22 bp, Homo sapiens
tgagttatggagaataaagtca

SEQ ID NO: 9442377 - DNA, 22 bp, Homo sapiens
tgagttcaaattttggctctgc

SEQ ID NO: 9442378 - DNA, 22 bp, Homo sapiens
tgagttattgcagcttcctcct

SEQ ID NO: 9442379 - DNA, 23 bp, Homo sapiens
tgagtgtgttccctgtgagattt

SEQ ID NO: 9442380 - DNA, 23 bp, Homo sapiens
tgagtgtgttccctgtgagattt

SEQ ID NO: 9442381 - DNA, 22 bp, Homo sapiens
tgagttataatgaatatttgaa

SEQ ID NO: 9442382 - DNA, 22 bp, Homo sapiens
tgagttataatgaatatttgaa

SEQ ID NO: 9442383 - DNA, 22 bp, Homo sapiens
tgagttaaatgagaacatgaaa

SEQ ID NO: 9442384 - DNA, 17 bp, Homo sapiens
tgagttaagtttagatc

SEQ ID NO: 9442385 - DNA, 22 bp, Homo sapiens
tgagttactgcctagtaacttg

SEQ ID NO: 9442386 - DNA, 22 bp, Homo sapiens
tgagtgctttaaatgttatttt

SEQ ID NO: 9442387 - DNA, 22 bp, Homo sapiens
tgagtggacacctgcttcttta

SEQ ID NO: 9442388 - DNA, 22 bp, Homo sapiens
tgagtggacacctgcttcttta

SEQ ID NO: 9442389 - DNA, 22 bp, Homo sapiens
tgagtggacacctgcttcttta

SEQ ID NO: 9442390 - DNA, 22 bp, Homo sapiens
tgagtggagtagtgaatgcatt

SEQ ID NO: 9442391 - DNA, 22 bp, Homo sapiens
tgagtgggattaaatgaggtga

SEQ ID NO: 9442392 - DNA, 20 bp, Homo sapiens
tgagtgagtttgtggcagga

SEQ ID NO: 9442393 - DNA, 22 bp, Homo sapiens
tgagtgagacaccaaaggctgt

SEQ ID NO: 9442394 - DNA, 22 bp, Homo sapiens
tgagtgagacatcctgtcttaa

SEQ ID NO: 9442395 - DNA, 22 bp, Homo sapiens
tgagtgagctggggagccggtg

SEQ ID NO: 9442396 - DNA, 22 bp, Homo sapiens
tgagtgagctggggagccggtg

SEQ ID NO: 9442397 - DNA, 22 bp, Homo sapiens
tgagtgaggaagcggtggagga

SEQ ID NO: 9442398 - DNA, 22 bp, Homo sapiens
tgatgctgtgtacctcatggga

SEQ ID NO: 9442399 - DNA, 22 bp, Homo sapiens
tgatgctgttccagttatattg

SEQ ID NO: 9442400 - DNA, 22 bp, Homo sapiens
tgatgccctgctgggcggacag

SEQ ID NO: 9442401 - DNA, 19 bp, Homo sapiens
tgatgctcactggtttggg

SEQ ID NO: 9442402 - DNA, 22 bp, Homo sapiens
tgatgctgagcctgggactgac

SEQ ID NO: 9442403 - DNA, 18 bp, Homo sapiens
tgatgcaagagtgagcta

SEQ ID NO: 9442404 - DNA, 22 bp, Homo sapiens
tgatgcaatcctttagaagtaa

SEQ ID NO: 9442405 - DNA, 22 bp, Homo sapiens
tgatgcaatcctttagaagtaa

SEQ ID NO: 9442406 - DNA, 22 bp, Homo sapiens
tgatgcaatcctttagaagtaa

SEQ ID NO: 9442407 - DNA, 22 bp, Homo sapiens
tgatgcaattagattgtaattt

SEQ ID NO: 9442408 - DNA, 22 bp, Homo sapiens
tgatgcagaatcctagagtgtc

SEQ ID NO: 9442409 - DNA, 22 bp, Homo sapiens
tgatgcccccaaatctggctca

SEQ ID NO: 9442410 - DNA, 22 bp, Homo sapiens
tgatcttttctatttatggtag

SEQ ID NO: 9442411 - DNA, 22 bp, Homo sapiens
tgatctttggtagtacgataat

SEQ ID NO: 9442412 - DNA, 22 bp, Homo sapiens
tgatcttttctatttatggtag

SEQ ID NO: 9442413 - DNA, 18 bp, Homo sapiens
tgatctttgagtataatg

SEQ ID NO: 9442414 - DNA, 22 bp, Homo sapiens
tgatctttgggccattaataaa

SEQ ID NO: 9442415 - DNA, 22 bp, Homo sapiens
tgatctttggtaatctggcaca

SEQ ID NO: 9442416 - DNA, 22 bp, Homo sapiens
tgatgagtaaataaggttgagt

SEQ ID NO: 9442417 - DNA, 22 bp, Homo sapiens
tgatgagtttactcttttctaa

SEQ ID NO: 9442418 - DNA, 22 bp, Homo sapiens
tgatgaatgtcatacataatga

SEQ ID NO: 9442419 - DNA, 22 bp, Homo sapiens
tgatgaaagttcagtagtgaat

SEQ ID NO: 9442420 - DNA, 22 bp, Homo sapiens
tgatggaagtgactgtcagttc

SEQ ID NO: 9442421 - DNA, 22 bp, Homo sapiens
tgatggaatataccttcgggag

SEQ ID NO: 9442422 - DNA, 22 bp, Homo sapiens
tgatggaagtgactgtcagttc

SEQ ID NO: 9442423 - DNA, 22 bp, Homo sapiens
tgatggaacagcctttgccaaa

SEQ ID NO: 9442424 - DNA, 22 bp, Homo sapiens
tgatggaaatttgggaagcttt

SEQ ID NO: 9442425 - DNA, 22 bp, Homo sapiens
tgatggaaggtttctcggtgat

SEQ ID NO: 9442426 - DNA, 22 bp, Homo sapiens
tgatggaagagctaacaatatc

SEQ ID NO: 9442427 - DNA, 22 bp, Homo sapiens
tgatggagcatgtgtgcttcct

SEQ ID NO: 9442428 - DNA, 19 bp, Homo sapiens
tgatggaatttgacattcc

SEQ ID NO: 9442429 - DNA, 22 bp, Homo sapiens
tgatggaatggaggacatgtgg

SEQ ID NO: 9442430 - DNA, 22 bp, Homo sapiens
tgatggagcatgtgtgcttcct

SEQ ID NO: 9442431 - DNA, 22 bp, Homo sapiens
tgatggagcatgtgtgcttcct

SEQ ID NO: 9442432 - DNA, 22 bp, Homo sapiens
tgatggaggacccagcgtggga

SEQ ID NO: 9442433 - DNA, 22 bp, Homo sapiens
tgatggaggacccagcgtggga

SEQ ID NO: 9442434 - DNA, 18 bp, Homo sapiens
tgatggaggagggctggt

SEQ ID NO: 9442435 - DNA, 21 bp, Homo sapiens
tgatggaaaggattttgggtc

SEQ ID NO: 9442436 - DNA, 22 bp, Homo sapiens
tgatggaaacttgggtaagtca

SEQ ID NO: 9442437 - DNA, 22 bp, Homo sapiens
tgatggaaataaaagcatagct

SEQ ID NO: 9442438 - DNA, 22 bp, Homo sapiens
tgatggaaatatgtaatctggt

SEQ ID NO: 9442439 - DNA, 22 bp, Homo sapiens
tgatggaaaataaatcttattc

SEQ ID NO: 9442440 - DNA, 22 bp, Homo sapiens
tgatggaaatgttctgtatctg

SEQ ID NO: 9442441 - DNA, 23 bp, Homo sapiens
tgatggaaatgatctgggtctgt

SEQ ID NO: 9442442 - DNA, 22 bp, Homo sapiens
tgatggaaatattgacaccaca

SEQ ID NO: 9442443 - DNA, 22 bp, Homo sapiens
tgatggaaatgttctgtatctg

SEQ ID NO: 9442444 - DNA, 22 bp, Homo sapiens
tgatgggaggtgctgcaggacc

SEQ ID NO: 9442445 - DNA, 22 bp, Homo sapiens
tgatgggactgccagctgctga

SEQ ID NO: 9442446 - DNA, 22 bp, Homo sapiens
tgatgggactgccagctgctga

SEQ ID NO: 9442447 - DNA, 22 bp, Homo sapiens
tgatgggaaaatgaggcctggg

SEQ ID NO: 9442448 - DNA, 23 bp, Homo sapiens
tgatgggaaggaacgactaccac

SEQ ID NO: 9442449 - DNA, 22 bp, Homo sapiens
tgatgggaggtgctgcaggacc

SEQ ID NO: 9442450 - DNA, 22 bp, Homo sapiens
tgatggctccttcattatgggt

SEQ ID NO: 9442451 - DNA, 22 bp, Homo sapiens
tgatggctcccatgggcatatg

SEQ ID NO: 9442452 - DNA, 19 bp, Homo sapiens
tgatggctggaactatact

SEQ ID NO: 9442453 - DNA, 22 bp, Homo sapiens
tgatggcttatggagagagcaa

SEQ ID NO: 9442454 - DNA, 22 bp, Homo sapiens
tgatggatgtggctctggagct

SEQ ID NO: 9442455 - DNA, 22 bp, Homo sapiens
tgatggccagtcgcactggagg

SEQ ID NO: 9442456 - DNA, 18 bp, Homo sapiens
tgatggaggagggctggt

SEQ ID NO: 9442457 - DNA, 18 bp, Homo sapiens
tgatggaggagggctggt

SEQ ID NO: 9442458 - DNA, 22 bp, Homo sapiens
tgatggcctttttcaccaggct

SEQ ID NO: 9442459 - DNA, 22 bp, Homo sapiens
tgatggccagtcgcactggagg

SEQ ID NO: 9442460 - DNA, 23 bp, Homo sapiens
tgatggccgccctttgccctgtc

SEQ ID NO: 9442461 - DNA, 22 bp, Homo sapiens
tgattggtcaggctgtggtgac

SEQ ID NO: 9442462 - DNA, 22 bp, Homo sapiens
tgattgtataggggttattaat

SEQ ID NO: 9442463 - DNA, 22 bp, Homo sapiens
tgattgctgaattttaggaact

SEQ ID NO: 9442464 - DNA, 22 bp, Homo sapiens
tgattgcttctttgctatctgt

SEQ ID NO: 9442465 - DNA, 22 bp, Homo sapiens
tgattgatacaactcaatccaa

SEQ ID NO: 9442466 - DNA, 22 bp, Homo sapiens
tgattgaattcaaatgcaatct

SEQ ID NO: 9442467 - DNA, 22 bp, Homo sapiens
tgattgtatgattgaaatattt

SEQ ID NO: 9442468 - DNA, 22 bp, Homo sapiens
tgattgtatgattgaaatattt

SEQ ID NO: 9442469 - DNA, 22 bp, Homo sapiens
tgatttaaaagaaacattgtct

SEQ ID NO: 9442470 - DNA, 22 bp, Homo sapiens
tgatttaaaagaaacattgtct

SEQ ID NO: 9442471 - DNA, 22 bp, Homo sapiens
tgatttaaaagaaacattgtct

SEQ ID NO: 9442472 - DNA, 23 bp, Homo sapiens
tgattgaaatgaggagtatttgt

SEQ ID NO: 9442473 - DNA, 22 bp, Homo sapiens
tgattctttgaccaaaaaattg

SEQ ID NO: 9442474 - DNA, 22 bp, Homo sapiens
tgattctttgaccaaaaaattg

SEQ ID NO: 9442475 - DNA, 22 bp, Homo sapiens
tgattcctaggcactcttctcc

SEQ ID NO: 9442476 - DNA, 22 bp, Homo sapiens
tgattctaggtccattatttgc

SEQ ID NO: 9442477 - DNA, 22 bp, Homo sapiens
tgattctaggtccattatttgc

SEQ ID NO: 9442478 - DNA, 22 bp, Homo sapiens
tgattcatcagaataggagttt

SEQ ID NO: 9442479 - DNA, 22 bp, Homo sapiens
tgattcatcagaataggagttt

SEQ ID NO: 9442480 - DNA, 22 bp, Homo sapiens
tgattccaagacctattctatt

SEQ ID NO: 9442481 - DNA, 22 bp, Homo sapiens
tgattctgatcatcatcatggt

SEQ ID NO: 9442482 - DNA, 22 bp, Homo sapiens
tgattctgccacgtactggctg

SEQ ID NO: 9442483 - DNA, 22 bp, Homo sapiens
tgattctgccccttggctctgg

SEQ ID NO: 9442484 - DNA, 20 bp, Homo sapiens
tgattctggtctacgcttta

SEQ ID NO: 9442485 - DNA, 22 bp, Homo sapiens
tgattctgagggagcattctgc

SEQ ID NO: 9442486 - DNA, 22 bp, Homo sapiens
tgattctatctaggtagaactg

SEQ ID NO: 9442487 - DNA, 22 bp, Homo sapiens
tgattctaggtccattatttgc

SEQ ID NO: 9442488 - DNA, 22 bp, Homo sapiens
tgatgtgaactcttgatatgat

SEQ ID NO: 9442489 - DNA, 22 bp, Homo sapiens
tgatgtgatagaaaggtagtgg

SEQ ID NO: 9442490 - DNA, 22 bp, Homo sapiens
tgatgtggccccacttagctgt

SEQ ID NO: 9442491 - DNA, 22 bp, Homo sapiens
tgatgtctgccagggtcctggg

SEQ ID NO: 9442492 - DNA, 22 bp, Homo sapiens
tgatgtctctctatactctaac

SEQ ID NO: 9442493 - DNA, 22 bp, Homo sapiens
tgatgtagctggtattcacgtg

SEQ ID NO: 9442494 - DNA, 22 bp, Homo sapiens
tgattaaattaattaagatgag

SEQ ID NO: 9442495 - DNA, 22 bp, Homo sapiens
tgattaaattaattaagatgag

SEQ ID NO: 9442496 - DNA, 22 bp, Homo sapiens
tgatgtttaatactatgctttt

SEQ ID NO: 9442497 - DNA, 23 bp, Homo sapiens
tgattcagcaagtccacttctgg

SEQ ID NO: 9442498 - DNA, 23 bp, Homo sapiens
tgattcagcaagtccacttctgg

SEQ ID NO: 9442499 - DNA, 22 bp, Homo sapiens
tgattcagtactttctctaact

SEQ ID NO: 9442500 - DNA, 23 bp, Homo sapiens
tgattcagcaagtccacttctgg

SEQ ID NO: 9442501 - DNA, 22 bp, Homo sapiens
tgattcatcagaataggagttt

SEQ ID NO: 9442502 - DNA, 22 bp, Homo sapiens
tgattcagacctgtcagacttc

SEQ ID NO: 9442503 - DNA, 22 bp, Homo sapiens
tgattcaataggaattgagtag

SEQ ID NO: 9442504 - DNA, 23 bp, Homo sapiens
tgattacaagggccaaagaaagg

SEQ ID NO: 9442505 - DNA, 22 bp, Homo sapiens
tgattacaaaagattgtttgaa

SEQ ID NO: 9442506 - DNA, 22 bp, Homo sapiens
tgattacaacagagtcatccat

SEQ ID NO: 9442507 - DNA, 22 bp, Homo sapiens
tgattaagttgcattttaatat

SEQ ID NO: 9442508 - DNA, 22 bp, Homo sapiens
tgattaatatcaccaccattgg

SEQ ID NO: 9442509 - DNA, 22 bp, Homo sapiens
tgattaatatcaccaccattgg

SEQ ID NO: 9442510 - DNA, 22 bp, Homo sapiens
tgattaactgtctattaatcat

SEQ ID NO: 9442511 - DNA, 22 bp, Homo sapiens
tgattaaattaattaagatgag

SEQ ID NO: 9442512 - DNA, 22 bp, Homo sapiens
tccttcaagtgcagtacctgag

SEQ ID NO: 9442513 - DNA, 23 bp, Homo sapiens
tccttcaagttaggaagtgaaca

SEQ ID NO: 9442514 - DNA, 18 bp, Homo sapiens
tccttcacagcaggaagg

SEQ ID NO: 9442515 - DNA, 22 bp, Homo sapiens
tccttcaatcacccagtgggga

SEQ ID NO: 9442516 - DNA, 22 bp, Homo sapiens
tccttcaccttagccctcctag

SEQ ID NO: 9442517 - DNA, 22 bp, Homo sapiens
tccttcaccttagccctcctag

SEQ ID NO: 9442518 - DNA, 22 bp, Homo sapiens
tccttcacctcaagcttttgaa

SEQ ID NO: 9442519 - DNA, 22 bp, Homo sapiens
tccttcagaacctgtgatggaa

SEQ ID NO: 9442520 - DNA, 22 bp, Homo sapiens
tccttcagcttatttcttagga

SEQ ID NO: 9442521 - DNA, 22 bp, Homo sapiens
tccttcaggcctcattctcata

SEQ ID NO: 9442522 - DNA, 22 bp, Homo sapiens
tccttcagggctgaccacaggc

SEQ ID NO: 9442523 - DNA, 22 bp, Homo sapiens
tccttcaactttttacttgccc

SEQ ID NO: 9442524 - DNA, 22 bp, Homo sapiens
tccttcaagtgcagtacctgag

SEQ ID NO: 9442525 - DNA, 22 bp, Homo sapiens
tccttcaagatgccacagcttt

SEQ ID NO: 9442526 - DNA, 22 bp, Homo sapiens
tccttaggcaatttgggagagt

SEQ ID NO: 9442527 - DNA, 22 bp, Homo sapiens
tccttaggcaatttgggagagt

SEQ ID NO: 9442528 - DNA, 22 bp, Homo sapiens
tccttaggtatttagcatgaat

SEQ ID NO: 9442529 - DNA, 22 bp, Homo sapiens
tccttagggatttttccagtca

SEQ ID NO: 9442530 - DNA, 22 bp, Homo sapiens
tccttaggaaaatgatgagggg

SEQ ID NO: 9442531 - DNA, 22 bp, Homo sapiens
tccttacaacttgttatttttc

SEQ ID NO: 9442532 - DNA, 22 bp, Homo sapiens
tccttaaatgtgatctagattt

SEQ ID NO: 9442533 - DNA, 22 bp, Homo sapiens
tccttaacaagatggcatttgt

SEQ ID NO: 9442534 - DNA, 22 bp, Homo sapiens
tccttaaatgtgatctagattt

SEQ ID NO: 9442535 - DNA, 22 bp, Homo sapiens
tccttaaatgaactctgcatga

SEQ ID NO: 9442536 - DNA, 22 bp, Homo sapiens
tccttagacaaagagtgggctt

SEQ ID NO: 9442537 - DNA, 22 bp, Homo sapiens
tccttagacaaagagtgggctt

SEQ ID NO: 9442538 - DNA, 17 bp, Homo sapiens
tccttggcaaccagttc

SEQ ID NO: 9442539 - DNA, 17 bp, Homo sapiens
tccttggcaaccagttc

SEQ ID NO: 9442540 - DNA, 22 bp, Homo sapiens
tccttggagtcatgatggaggt

SEQ ID NO: 9442541 - DNA, 22 bp, Homo sapiens
tccttggagtcatgatggaggt

SEQ ID NO: 9442542 - DNA, 22 bp, Homo sapiens
tccttggagtcatgatggaggt

SEQ ID NO: 9442543 - DNA, 22 bp, Homo sapiens
tccttggaggtcaacgggacgg

SEQ ID NO: 9442544 - DNA, 22 bp, Homo sapiens
tccttgcaaatagctttctgag

SEQ ID NO: 9442545 - DNA, 22 bp, Homo sapiens
tccttgcagacatctctcttca

SEQ ID NO: 9442546 - DNA, 22 bp, Homo sapiens
tccttggagcccaggagtagca

SEQ ID NO: 9442547 - DNA, 22 bp, Homo sapiens
tccttggaagagcattcccagg

SEQ ID NO: 9442548 - DNA, 22 bp, Homo sapiens
tccttgaagcttgtatctaata

SEQ ID NO: 9442549 - DNA, 22 bp, Homo sapiens
tccttgagagccactgtcttgg

SEQ ID NO: 9442550 - DNA, 22 bp, Homo sapiens
tccttgagaggacagagccata

SEQ ID NO: 9442551 - DNA, 22 bp, Homo sapiens
tccttgagaggacagagccata

SEQ ID NO: 9442552 - DNA, 22 bp, Homo sapiens
tccttgaggaggtgacactgga

SEQ ID NO: 9442553 - DNA, 22 bp, Homo sapiens
tccttgaggaggtgacactgga

SEQ ID NO: 9442554 - DNA, 22 bp, Homo sapiens
tccttgagccgtggccagggcc

SEQ ID NO: 9442555 - DNA, 22 bp, Homo sapiens
tccttctgtagtccctgtccct

SEQ ID NO: 9442556 - DNA, 22 bp, Homo sapiens
tccttctgtagtccctgtccct

SEQ ID NO: 9442557 - DNA, 22 bp, Homo sapiens
tccttctgtagtccctgtccct

SEQ ID NO: 9442558 - DNA, 22 bp, Homo sapiens
tccttctggaggctctaagggg

SEQ ID NO: 9442559 - DNA, 22 bp, Homo sapiens
tccttctgtagtccctgtccct

SEQ ID NO: 9442560 - DNA, 22 bp, Homo sapiens
tccttctgaaaaatgcacacga

SEQ ID NO: 9442561 - DNA, 22 bp, Homo sapiens
tccttctgaaaaatgcacacga

SEQ ID NO: 9442562 - DNA, 22 bp, Homo sapiens
tccttctggaggctctaagggg

SEQ ID NO: 9442563 - DNA, 20 bp, Homo sapiens
tccttctgaggtgaggagga

SEQ ID NO: 9442564 - DNA, 20 bp, Homo sapiens
tccttctgaggtgaggagga

SEQ ID NO: 9442565 - DNA, 19 bp, Homo sapiens
tccttctccggccaccccg

SEQ ID NO: 9442566 - DNA, 19 bp, Homo sapiens
tccttctccggccaccccg

SEQ ID NO: 9442567 - DNA, 19 bp, Homo sapiens
tccttctccggccaccccg

SEQ ID NO: 9442568 - DNA, 22 bp, Homo sapiens
tccttctctggtttttactgta

SEQ ID NO: 9442569 - DNA, 21 bp, Homo sapiens
tccttctctatgattgtctga

SEQ ID NO: 9442570 - DNA, 22 bp, Homo sapiens
tccttctcctccttgagtgaca

SEQ ID NO: 9442571 - DNA, 22 bp, Homo sapiens
tccttctctacaaatccaggca

SEQ ID NO: 9442572 - DNA, 22 bp, Homo sapiens
tccttccttcctgaaattttag

SEQ ID NO: 9442573 - DNA, 21 bp, Homo sapiens
tccttccttgaggtcctttcc

SEQ ID NO: 9442574 - DNA, 22 bp, Homo sapiens
tccttccttcctgaaattttag

SEQ ID NO: 9442575 - DNA, 22 bp, Homo sapiens
tccttcctggggtctctgctgc

SEQ ID NO: 9442576 - DNA, 23 bp, Homo sapiens
tccttcctttgagaggctccatc

SEQ ID NO: 9442577 - DNA, 19 bp, Homo sapiens
tccttcagtcagatctggg

SEQ ID NO: 9442578 - DNA, 22 bp, Homo sapiens
tccttcctggggtctctgctgc

SEQ ID NO: 9442579 - DNA, 22 bp, Homo sapiens
tcctttctgtctttactctgga

SEQ ID NO: 9442580 - DNA, 22 bp, Homo sapiens
tcctttctgtctttactctgga

SEQ ID NO: 9442581 - DNA, 19 bp, Homo sapiens
tcctttctgttcctgagat

SEQ ID NO: 9442582 - DNA, 18 bp, Homo sapiens
tcctttctccctcatctt

SEQ ID NO: 9442583 - DNA, 19 bp, Homo sapiens
tcctttgaatatcagttga

SEQ ID NO: 9442584 - DNA, 19 bp, Homo sapiens
tcctttgaatatcagttga

SEQ ID NO: 9442585 - DNA, 22 bp, Homo sapiens
tcctttcttcttctgcccatgg

SEQ ID NO: 9442586 - DNA, 22 bp, Homo sapiens
tcctttcttcttctgcccatgg

SEQ ID NO: 9442587 - DNA, 22 bp, Homo sapiens
tcctttcttcttctgcccatgg

SEQ ID NO: 9442588 - DNA, 18 bp, Homo sapiens
tcctttctccctcatctt

SEQ ID NO: 9442589 - DNA, 20 bp, Homo sapiens
tcctttcctccttctaaatg

SEQ ID NO: 9442590 - DNA, 22 bp, Homo sapiens
tcctttccctttccatcctggc

SEQ ID NO: 9442591 - DNA, 22 bp, Homo sapiens
tcctttccatgcttctagaggc

SEQ ID NO: 9442592 - DNA, 22 bp, Homo sapiens
tcctttccatgcttctagaggc

SEQ ID NO: 9442593 - DNA, 22 bp, Homo sapiens
tcctttccctttccatcctggc

SEQ ID NO: 9442594 - DNA, 22 bp, Homo sapiens
tcctttccctttccatcctggc

SEQ ID NO: 9442595 - DNA, 22 bp, Homo sapiens
tccttgggaaacatcatgtaat

SEQ ID NO: 9442596 - DNA, 21 bp, Homo sapiens
tccttgggcagtgcccagctt

SEQ ID NO: 9442597 - DNA, 22 bp, Homo sapiens
tccttgggaaacatcatgtaat

SEQ ID NO: 9442598 - DNA, 22 bp, Homo sapiens
tcctttccatgcttctagaggc

SEQ ID NO: 9442599 - DNA, 22 bp, Homo sapiens
tcctttccatgcttctagaggc

SEQ ID NO: 9442600 - DNA, 22 bp, Homo sapiens
tcctttccatgcttctagaggc

SEQ ID NO: 9442601 - DNA, 22 bp, Homo sapiens
tcctttccatgcttctagaggc

SEQ ID NO: 9442602 - DNA, 22 bp, Homo sapiens
tccttgggaaacatcatgtaat

SEQ ID NO: 9442603 - DNA, 19 bp, Homo sapiens
tcgagtcaagacactaggc

SEQ ID NO: 9442604 - DNA, 22 bp, Homo sapiens
tcgataatatcttacatgtgct

SEQ ID NO: 9442605 - DNA, 22 bp, Homo sapiens
tcgcaccattgcactccagcca

SEQ ID NO: 9442606 - DNA, 22 bp, Homo sapiens
tcgagctgggcaagcttccata

SEQ ID NO: 9442607 - DNA, 22 bp, Homo sapiens
tcgagctgcacgcccccgagct

SEQ ID NO: 9442608 - DNA, 22 bp, Homo sapiens
tcgaaggaggcactcagacatg

SEQ ID NO: 9442609 - DNA, 21 bp, Homo sapiens
tcgacctgctgggctcgggct

SEQ ID NO: 9442610 - DNA, 22 bp, Homo sapiens
tcgaaatactgtttccccttta

SEQ ID NO: 9442611 - DNA, 22 bp, Homo sapiens
tcctttttctcacacaacgaac

SEQ ID NO: 9442612 - DNA, 22 bp, Homo sapiens
tcctttttatagttagagaaac

SEQ ID NO: 9442613 - DNA, 22 bp, Homo sapiens
tccttttccctgaaggtattta

SEQ ID NO: 9442614 - DNA, 22 bp, Homo sapiens
tccttttccctgaaggtattta

SEQ ID NO: 9442615 - DNA, 18 bp, Homo sapiens
tccttttctcccacccac

SEQ ID NO: 9442616 - DNA, 22 bp, Homo sapiens
tccttttctctagtaagcttta

SEQ ID NO: 9442617 - DNA, 22 bp, Homo sapiens
tccttttctcttccccagagta

SEQ ID NO: 9442618 - DNA, 22 bp, Homo sapiens
tccttttgctgggatcatcagg

SEQ ID NO: 9442619 - DNA, 23 bp, Homo sapiens
tcctttgtctttgcatagatggt

SEQ ID NO: 9442620 - DNA, 21 bp, Homo sapiens
tccttttcaatcgggcccttt

SEQ ID NO: 9442621 - DNA, 22 bp, Homo sapiens
tcctttgcttctgtcattctcc

SEQ ID NO: 9442622 - DNA, 22 bp, Homo sapiens
tcctttgacttcttgcagtcca

SEQ ID NO: 9442623 - DNA, 23 bp, Homo sapiens
tcctttgacaagagacagatgtt

SEQ ID NO: 9442624 - DNA, 22 bp, Homo sapiens
tcctttgcttctgtcattctcc

SEQ ID NO: 9442625 - DNA, 22 bp, Homo sapiens
tcctttgcttctgtcattctcc

SEQ ID NO: 9442626 - DNA, 22 bp, Homo sapiens
tcctttggcaagctctgctctt

SEQ ID NO: 9442627 - DNA, 22 bp, Homo sapiens
tctaaacattatgatagtagag

SEQ ID NO: 9442628 - DNA, 22 bp, Homo sapiens
tctaaacagtttcactcttaat

SEQ ID NO: 9442629 - DNA, 22 bp, Homo sapiens
tctaaacacgtctctttgaata

SEQ ID NO: 9442630 - DNA, 22 bp, Homo sapiens
tctaaacacgtctctttgaata

SEQ ID NO: 9442631 - DNA, 22 bp, Homo sapiens
tctaaacacgtctctttgaata

SEQ ID NO: 9442632 - DNA, 22 bp, Homo sapiens
tctaaaaaagtctgttcacttg

SEQ ID NO: 9442633 - DNA, 22 bp, Homo sapiens
tctaaaaaagtctgttcacttg

SEQ ID NO: 9442634 - DNA, 23 bp, Homo sapiens
tctaaaattcatcatttacgttc

SEQ ID NO: 9442635 - DNA, 22 bp, Homo sapiens
tctaaaatgcagatctactggt

SEQ ID NO: 9442636 - DNA, 22 bp, Homo sapiens
tctaaaatgcagatctactggt

SEQ ID NO: 9442637 - DNA, 22 bp, Homo sapiens
tctaaaatgcagatctactggt

SEQ ID NO: 9442638 - DNA, 22 bp, Homo sapiens
tctaaagatgtttattgacata

SEQ ID NO: 9442639 - DNA, 22 bp, Homo sapiens
tctaaagagaaccttttctcat

SEQ ID NO: 9442640 - DNA, 22 bp, Homo sapiens
tctaaagatgtttattgacata

SEQ ID NO: 9442641 - DNA, 22 bp, Homo sapiens
tctaaagatttggattcatttg

SEQ ID NO: 9442642 - DNA, 22 bp, Homo sapiens
tctaaagatttggattcatttg

SEQ ID NO: 9442643 - DNA, 20 bp, Homo sapiens
tctaaagtacagtttgtgtg

SEQ ID NO: 9442644 - DNA, 22 bp, Homo sapiens
tctaaactgcgagcatgccccc

SEQ ID NO: 9442645 - DNA, 22 bp, Homo sapiens
tctaaacttcactttaagtgct

SEQ ID NO: 9442646 - DNA, 22 bp, Homo sapiens
tctaaacttcactttaagtgct

SEQ ID NO: 9442647 - DNA, 22 bp, Homo sapiens
tctaaacttgtaaacaagcata

SEQ ID NO: 9442648 - DNA, 22 bp, Homo sapiens
tctaaactacgtcaaaactagt

SEQ ID NO: 9442649 - DNA, 19 bp, Homo sapiens
tctaaactctatactggta

SEQ ID NO: 9442650 - DNA, 19 bp, Homo sapiens
tctaaactctatactggta

SEQ ID NO: 9442651 - DNA, 22 bp, Homo sapiens
tcgcccaggctggaagtgcagt

SEQ ID NO: 9442652 - DNA, 17 bp, Homo sapiens
tcggtttgccaggcttc

SEQ ID NO: 9442653 - DNA, 22 bp, Homo sapiens
tcgcccaggctggaagtgcagt

SEQ ID NO: 9442654 - DNA, 22 bp, Homo sapiens
tcgcccaggctggaagtgcagt

SEQ ID NO: 9442655 - DNA, 22 bp, Homo sapiens
tcgcccaggctggaagtgcagt

SEQ ID NO: 9442656 - DNA, 22 bp, Homo sapiens
tcgtcctgtgcacctgcctgca

SEQ ID NO: 9442657 - DNA, 22 bp, Homo sapiens
tcgtgaggctctgcatcgcaca

SEQ ID NO: 9442658 - DNA, 22 bp, Homo sapiens
tcgtcaactgtagtgacttaga

SEQ ID NO: 9442659 - DNA, 22 bp, Homo sapiens
tcgtacagcagactgaagtcct

SEQ ID NO: 9442660 - DNA, 22 bp, Homo sapiens
tcgtctgtgaaattgggataag

SEQ ID NO: 9442661 - DNA, 22 bp, Homo sapiens
tcgccagggatgctgtaaggaa

SEQ ID NO: 9442662 - DNA, 22 bp, Homo sapiens
tcgcccagctcatctcccacaa

SEQ ID NO: 9442663 - DNA, 22 bp, Homo sapiens
tcgcccaggctggaagtgcagt

SEQ ID NO: 9442664 - DNA, 22 bp, Homo sapiens
tcgcaccattgcactccagcca

SEQ ID NO: 9442665 - DNA, 22 bp, Homo sapiens
tcgcaccattgcactccagcca

SEQ ID NO: 9442666 - DNA, 22 bp, Homo sapiens
tcgcaccattgcactccagcca

SEQ ID NO: 9442667 - DNA, 22 bp, Homo sapiens
tcgcagcactagccctgcattg

SEQ ID NO: 9442668 - DNA, 22 bp, Homo sapiens
tcgtggagaggccatgtggagg

SEQ ID NO: 9442669 - DNA, 22 bp, Homo sapiens
tcgtggaggcaccgtgagcttt

SEQ ID NO: 9442670 - DNA, 22 bp, Homo sapiens
tcgtggagaggccatgtggagg

SEQ ID NO: 9442671 - DNA, 22 bp, Homo sapiens
tcgtggaggcaccgtgagcttt

SEQ ID NO: 9442672 - DNA, 22 bp, Homo sapiens
tcgtgatctgtccacctcggcc

SEQ ID NO: 9442673 - DNA, 22 bp, Homo sapiens
tcgtgaggctctgcatcgcaca

SEQ ID NO: 9442674 - DNA, 22 bp, Homo sapiens
tcgtgatctgtccacctcggcc

SEQ ID NO: 9442675 - DNA, 22 bp, Homo sapiens
tcgttttaggtggacattgtgt

SEQ ID NO: 9442676 - DNA, 22 bp, Homo sapiens
tcgttttaccaaattgaatgtt

SEQ ID NO: 9442677 - DNA, 22 bp, Homo sapiens
tcgttaaatgctaaaactgaca

SEQ ID NO: 9442678 - DNA, 19 bp, Homo sapiens
tcgtggggaggtgggcagc

SEQ ID NO: 9442679 - DNA, 19 bp, Homo sapiens
tcgtggggaggtgggcagc

SEQ ID NO: 9442680 - DNA, 22 bp, Homo sapiens
tcgtgtgtattccctctccttc

SEQ ID NO: 9442681 - DNA, 22 bp, Homo sapiens
tctacataaaaattcagaaggc

SEQ ID NO: 9442682 - DNA, 22 bp, Homo sapiens
tctacaggtggggcctggcaat

SEQ ID NO: 9442683 - DNA, 22 bp, Homo sapiens
tctacaggtggggcctggcaat

SEQ ID NO: 9442684 - DNA, 22 bp, Homo sapiens
tctacaggtggggcctggcaat

SEQ ID NO: 9442685 - DNA, 22 bp, Homo sapiens
tctacagtcaagttatattgct

SEQ ID NO: 9442686 - DNA, 22 bp, Homo sapiens
tctacagtagaaagatcccagt

SEQ ID NO: 9442687 - DNA, 22 bp, Homo sapiens
tctacagccattttgagcagtg

SEQ ID NO: 9442688 - DNA, 22 bp, Homo sapiens
tctacagggtaaggggcttgcc

SEQ ID NO: 9442689 - DNA, 22 bp, Homo sapiens
tctacagctgctgcttctcatg

SEQ ID NO: 9442690 - DNA, 22 bp, Homo sapiens
tctacattttaacaagatgccc

SEQ ID NO: 9442691 - DNA, 22 bp, Homo sapiens
tctacattttcacaaggtctcc

SEQ ID NO: 9442692 - DNA, 22 bp, Homo sapiens
tctacattttctttatgtacat

SEQ ID NO: 9442693 - DNA, 21 bp, Homo sapiens
tctacatatcaatatgtaatt

SEQ ID NO: 9442694 - DNA, 22 bp, Homo sapiens
tctacatatgtgatttctaagt

SEQ ID NO: 9442695 - DNA, 22 bp, Homo sapiens
tctacatgatgtaccatctaag

SEQ ID NO: 9442696 - DNA, 22 bp, Homo sapiens
tctacaatgagaaatgatcagt

SEQ ID NO: 9442697 - DNA, 22 bp, Homo sapiens
tctacaagtcaagtctatcaag

SEQ ID NO: 9442698 - DNA, 22 bp, Homo sapiens
tctacaaataaattactatgta

SEQ ID NO: 9442699 - DNA, 22 bp, Homo sapiens
tctacaaataaattactatgta

SEQ ID NO: 9442700 - DNA, 19 bp, Homo sapiens
tctacaaagtggcatcagg

SEQ ID NO: 9442701 - DNA, 19 bp, Homo sapiens
tctacaaagtggcatcagg

SEQ ID NO: 9442702 - DNA, 22 bp, Homo sapiens
tctacaaataaattactatgta

SEQ ID NO: 9442703 - DNA, 19 bp, Homo sapiens
tctacaaagtggcatcagg

SEQ ID NO: 9442704 - DNA, 22 bp, Homo sapiens
tctacaaaggttgaggtgccct

SEQ ID NO: 9442705 - DNA, 22 bp, Homo sapiens
tctacactgtagaattataagg

SEQ ID NO: 9442706 - DNA, 22 bp, Homo sapiens
tctacactccagagtctcatca

SEQ ID NO: 9442707 - DNA, 22 bp, Homo sapiens
tctacacatttgtaaaggcatt

SEQ ID NO: 9442708 - DNA, 22 bp, Homo sapiens
tctacacatttgtaaaggcatt

SEQ ID NO: 9442709 - DNA, 22 bp, Homo sapiens
tctaaatgtggtagtcataaga

SEQ ID NO: 9442710 - DNA, 22 bp, Homo sapiens
tctaacagaaattctgacaaaa

SEQ ID NO: 9442711 - DNA, 19 bp, Homo sapiens
tctaacagaagtgtcgtcc

SEQ ID NO: 9442712 - DNA, 22 bp, Homo sapiens
tctaacattgtttttcacagat

SEQ ID NO: 9442713 - DNA, 22 bp, Homo sapiens
tctaacattgtttttcacagat

SEQ ID NO: 9442714 - DNA, 19 bp, Homo sapiens
tctaacagctttcattcta

SEQ ID NO: 9442715 - DNA, 22 bp, Homo sapiens
tctaactatacaaagaaaacat

SEQ ID NO: 9442716 - DNA, 22 bp, Homo sapiens
tctaactaactacagtaagagg

SEQ ID NO: 9442717 - DNA, 22 bp, Homo sapiens
tctaactctgccaggacacaga

SEQ ID NO: 9442718 - DNA, 22 bp, Homo sapiens
tctaactaactacagtaagagg

SEQ ID NO: 9442719 - DNA, 22 bp, Homo sapiens
tctaacttgtatgtatagtttt

SEQ ID NO: 9442720 - DNA, 22 bp, Homo sapiens
tctaacttgtatgtatagtttt

SEQ ID NO: 9442721 - DNA, 20 bp, Homo sapiens
tctaattaaaattgtctagt

SEQ ID NO: 9442722 - DNA, 20 bp, Homo sapiens
tctaattaaaattgtctagt

SEQ ID NO: 9442723 - DNA, 22 bp, Homo sapiens
tctaattccattaaattgatgt

SEQ ID NO: 9442724 - DNA, 22 bp, Homo sapiens
tctaattgcaattctcagagat

SEQ ID NO: 9442725 - DNA, 22 bp, Homo sapiens
tctaattttaggcatttgttca

SEQ ID NO: 9442726 - DNA, 22 bp, Homo sapiens
tctaattttaggcatttgttca

SEQ ID NO: 9442727 - DNA, 22 bp, Homo sapiens
tctaattttaggcatttgttca

SEQ ID NO: 9442728 - DNA, 22 bp, Homo sapiens
tctaattttggcattttaacct

SEQ ID NO: 9442729 - DNA, 22 bp, Homo sapiens
tctacaaagaagaattaatgtc

SEQ ID NO: 9442730 - DNA, 23 bp, Homo sapiens
tctacaaagctgtgtcaggaccc

SEQ ID NO: 9442731 - DNA, 22 bp, Homo sapiens
tctacaaagccattcaggatct

SEQ ID NO: 9442732 - DNA, 22 bp, Homo sapiens
tctacaaagaagaattaatgtc

SEQ ID NO: 9442733 - DNA, 22 bp, Homo sapiens
tctacaaagaagaattaatgtc

SEQ ID NO: 9442734 - DNA, 22 bp, Homo sapiens
tctacaaagccattcaggatct

SEQ ID NO: 9442735 - DNA, 22 bp, Homo sapiens
tctaggaaagcctttcacaact

SEQ ID NO: 9442736 - DNA, 22 bp, Homo sapiens
tctaggaacctgacatctctca

SEQ ID NO: 9442737 - DNA, 22 bp, Homo sapiens
tctaggagctgagagtgtgtac

SEQ ID NO: 9442738 - DNA, 22 bp, Homo sapiens
tctagcagggaaagcagagaat

SEQ ID NO: 9442739 - DNA, 22 bp, Homo sapiens
tctagatttttgtgcacctttg

SEQ ID NO: 9442740 - DNA, 22 bp, Homo sapiens
tctagcaccacattaaatagca

SEQ ID NO: 9442741 - DNA, 22 bp, Homo sapiens
tctagagaaaaaactcaagtga

SEQ ID NO: 9442742 - DNA, 22 bp, Homo sapiens
tctacttttccctatacagttt

SEQ ID NO: 9442743 - DNA, 22 bp, Homo sapiens
tctacttttccctatacagttt

SEQ ID NO: 9442744 - DNA, 22 bp, Homo sapiens
tctagaaaaaaactgctgtgga

SEQ ID NO: 9442745 - DNA, 22 bp, Homo sapiens
tctagaattttgccatatagct

SEQ ID NO: 9442746 - DNA, 20 bp, Homo sapiens
tctagacagggcacaggaat

SEQ ID NO: 9442747 - DNA, 22 bp, Homo sapiens
tctaccactcatgctacttact

SEQ ID NO: 9442748 - DNA, 22 bp, Homo sapiens
tctaccactttgacctctctgt

SEQ ID NO: 9442749 - DNA, 18 bp, Homo sapiens
tctaccctctcagagtct

SEQ ID NO: 9442750 - DNA, 17 bp, Homo sapiens
tctactcctgaaggaag

SEQ ID NO: 9442751 - DNA, 22 bp, Homo sapiens
tctactatgtttcttaaataga

SEQ ID NO: 9442752 - DNA, 22 bp, Homo sapiens
tctacctatttcttctattggt

SEQ ID NO: 9442753 - DNA, 22 bp, Homo sapiens
tctataaaactcaagagcaatt

SEQ ID NO: 9442754 - DNA, 22 bp, Homo sapiens
tctataaaactcaagagcaatt

SEQ ID NO: 9442755 - DNA, 22 bp, Homo sapiens
tctataaaactcaagagcaatt

SEQ ID NO: 9442756 - DNA, 22 bp, Homo sapiens
tctataaaactcaagagcaatt

SEQ ID NO: 9442757 - DNA, 22 bp, Homo sapiens
tctataaagggccagatagtag

SEQ ID NO: 9442758 - DNA, 22 bp, Homo sapiens
tctagttttggtatgagatgca

SEQ ID NO: 9442759 - DNA, 22 bp, Homo sapiens
tctagttttctcaaatgacttg

SEQ ID NO: 9442760 - DNA, 22 bp, Homo sapiens
tctagtgttttggaacatggaa

SEQ ID NO: 9442761 - DNA, 22 bp, Homo sapiens
tctagtgttttggaacatggaa

SEQ ID NO: 9442762 - DNA, 22 bp, Homo sapiens
tctagtgttaaggcaaagtaaa

SEQ ID NO: 9442763 - DNA, 22 bp, Homo sapiens
tctagttctagatccctgagga

SEQ ID NO: 9442764 - DNA, 22 bp, Homo sapiens
tctaggccgtaggatacagagc

SEQ ID NO: 9442765 - DNA, 20 bp, Homo sapiens
tctaggcaggcaggctcgtg

SEQ ID NO: 9442766 - DNA, 20 bp, Homo sapiens
tctaggctagattttgtcat

SEQ ID NO: 9442767 - DNA, 22 bp, Homo sapiens
tctagggaacatgggtcaagct

SEQ ID NO: 9442768 - DNA, 22 bp, Homo sapiens
tctagggagaagctctgtctgt

SEQ ID NO: 9442769 - DNA, 22 bp, Homo sapiens
tctaggggtgcagaagggatcc

SEQ ID NO: 9442770 - DNA, 22 bp, Homo sapiens
tctaggttagaacccagaaaag

SEQ ID NO: 9442771 - DNA, 22 bp, Homo sapiens
tctagtctcagccttcacctaa

SEQ ID NO: 9442772 - DNA, 22 bp, Homo sapiens
tctagtcatattttttcagtat

SEQ ID NO: 9442773 - DNA, 22 bp, Homo sapiens
tctattatggtacttatcatga

SEQ ID NO: 9442774 - DNA, 22 bp, Homo sapiens
tctattagattattctcaagga

SEQ ID NO: 9442775 - DNA, 23 bp, Homo sapiens
tctattacttattgtactctgga

SEQ ID NO: 9442776 - DNA, 22 bp, Homo sapiens
tctatgttgtgtgtcacacaga

SEQ ID NO: 9442777 - DNA, 22 bp, Homo sapiens
tctattacttaccactaattca

SEQ ID NO: 9442778 - DNA, 22 bp, Homo sapiens
tctattaatgattcaatagtgt

SEQ ID NO: 9442779 - DNA, 22 bp, Homo sapiens
tctatgtctccaccttcgcaga

SEQ ID NO: 9442780 - DNA, 22 bp, Homo sapiens
tctatgtatggaccttttctgt

SEQ ID NO: 9442781 - DNA, 22 bp, Homo sapiens
tctatgtcagcatctttctacc

SEQ ID NO: 9442782 - DNA, 22 bp, Homo sapiens
tctatgtcctttctcccattcc

SEQ ID NO: 9442783 - DNA, 22 bp, Homo sapiens
tctatgtatatctttccattca

SEQ ID NO: 9442784 - DNA, 22 bp, Homo sapiens
tctatgaatgacacagataata

SEQ ID NO: 9442785 - DNA, 19 bp, Homo sapiens
tctatgggctttttgtagt

SEQ ID NO: 9442786 - DNA, 21 bp, Homo sapiens
tctatgtacgcatctatgcct

SEQ ID NO: 9442787 - DNA, 22 bp, Homo sapiens
tctatgtaaagccatattgata

SEQ ID NO: 9442788 - DNA, 22 bp, Homo sapiens
tctatcctgcttagaagtatgt

SEQ ID NO: 9442789 - DNA, 22 bp, Homo sapiens
tctatctgaggaggtgacattt

SEQ ID NO: 9442790 - DNA, 22 bp, Homo sapiens
tctatctgaggaggtgacattt

SEQ ID NO: 9442791 - DNA, 22 bp, Homo sapiens
tctatctggccccttttatata

SEQ ID NO: 9442792 - DNA, 22 bp, Homo sapiens
tctataaagggccagatagtag

SEQ ID NO: 9442793 - DNA, 22 bp, Homo sapiens
tctataaatgcagatatgtgtg

SEQ ID NO: 9442794 - DNA, 22 bp, Homo sapiens
tctataaagggccagatagtag

SEQ ID NO: 9442795 - DNA, 22 bp, Homo sapiens
tctataaagggccagatagtag

SEQ ID NO: 9442796 - DNA, 22 bp, Homo sapiens
tctataaagggccagatagtag

SEQ ID NO: 9442797 - DNA, 22 bp, Homo sapiens
tctatgaatgacacagataata

SEQ ID NO: 9442798 - DNA, 22 bp, Homo sapiens
tctatgaatgacacagataata

SEQ ID NO: 9442799 - DNA, 21 bp, Homo sapiens
tctatgcaagaccctagtcct

SEQ ID NO: 9442800 - DNA, 21 bp, Homo sapiens
tctatgaacatggagaagggc

SEQ ID NO: 9442801 - DNA, 22 bp, Homo sapiens
tctatgaatcaattttaacatc

SEQ ID NO: 9442802 - DNA, 22 bp, Homo sapiens
tctatgaatcaattttaacatc

SEQ ID NO: 9442803 - DNA, 22 bp, Homo sapiens
tctatgaagttcagagatctat

SEQ ID NO: 9442804 - DNA, 22 bp, Homo sapiens
tctatctgggagttccccatta

SEQ ID NO: 9442805 - DNA, 22 bp, Homo sapiens
tctatctggccccttttatata

SEQ ID NO: 9442806 - DNA, 22 bp, Homo sapiens
tctatgaaaaactgttaagctc

SEQ ID NO: 9442807 - DNA, 22 bp, Homo sapiens
tctatgaaacgttgcaggaggg

SEQ ID NO: 9442808 - DNA, 22 bp, Homo sapiens
tctatgaacaaagtggtttata

SEQ ID NO: 9442809 - DNA, 22 bp, Homo sapiens
tctatgaagtgcaattaactgt

SEQ ID NO: 9442810 - DNA, 22 bp, Homo sapiens
tctatgaacctctgcaatgaca

SEQ ID NO: 9442811 - DNA, 22 bp, Homo sapiens
tctcaaactaacaatgattata

SEQ ID NO: 9442812 - DNA, 22 bp, Homo sapiens
tctcaaactaacaatgattata

SEQ ID NO: 9442813 - DNA, 22 bp, Homo sapiens
tctcaaactgtgtattataatt

SEQ ID NO: 9442814 - DNA, 22 bp, Homo sapiens
tctcaaatatttggagagagga

SEQ ID NO: 9442815 - DNA, 22 bp, Homo sapiens
tctatttttatagttgaagtgc

SEQ ID NO: 9442816 - DNA, 22 bp, Homo sapiens
tctatttttatagttgaagtgc

SEQ ID NO: 9442817 - DNA, 22 bp, Homo sapiens
tctatttttatagttgaagtgc

SEQ ID NO: 9442818 - DNA, 18 bp, Homo sapiens
tctcaaaaataatggctt

SEQ ID NO: 9442819 - DNA, 22 bp, Homo sapiens
tctattttcttgccaaaactgc

SEQ ID NO: 9442820 - DNA, 22 bp, Homo sapiens
tctattttcttgccaaaactgc

SEQ ID NO: 9442821 - DNA, 22 bp, Homo sapiens
tctattttgtttccagctctac

SEQ ID NO: 9442822 - DNA, 22 bp, Homo sapiens
tctattttgtttccagctctac

SEQ ID NO: 9442823 - DNA, 22 bp, Homo sapiens
tctattttatactcaaatcttc

SEQ ID NO: 9442824 - DNA, 22 bp, Homo sapiens
tctattttatactcaaatcttc

SEQ ID NO: 9442825 - DNA, 22 bp, Homo sapiens
tctattttatactcaaatcttc

SEQ ID NO: 9442826 - DNA, 22 bp, Homo sapiens
tctatttctgggtttgtgtggt

SEQ ID NO: 9442827 - DNA, 22 bp, Homo sapiens
tctattctgataaatgcatgga

SEQ ID NO: 9442828 - DNA, 22 bp, Homo sapiens
tctattcaggcagagtgcagca

SEQ ID NO: 9442829 - DNA, 21 bp, Homo sapiens
tctattcattacagttatttg

SEQ ID NO: 9442830 - DNA, 22 bp, Homo sapiens
tctattcattcaatttagctct

SEQ ID NO: 9442831 - DNA, 22 bp, Homo sapiens
tctatttaccaaatgtagttcc

SEQ ID NO: 9442832 - DNA, 22 bp, Homo sapiens
tctatttaccaaatgtagttcc

SEQ ID NO: 9442833 - DNA, 19 bp, Homo sapiens
tctcaattctccccactgc

SEQ ID NO: 9442834 - DNA, 19 bp, Homo sapiens
tctcaattctccccactgc

SEQ ID NO: 9442835 - DNA, 22 bp, Homo sapiens
tctcaatattatatgtcataaa

SEQ ID NO: 9442836 - DNA, 22 bp, Homo sapiens
tctcaaatcaaactttgagctt

SEQ ID NO: 9442837 - DNA, 22 bp, Homo sapiens
tctcaaatggacaatattgtgg

SEQ ID NO: 9442838 - DNA, 22 bp, Homo sapiens
tctcaaggactttgggcactaa

SEQ ID NO: 9442839 - DNA, 22 bp, Homo sapiens
tctcaagcttgttggtatgttt

SEQ ID NO: 9442840 - DNA, 22 bp, Homo sapiens
tctcaagttatgtaacagctgt

SEQ ID NO: 9442841 - DNA, 19 bp, Homo sapiens
tctcacagctctactatgt

SEQ ID NO: 9442842 - DNA, 23 bp, Homo sapiens
tctcacagcgatctaggaagagg

SEQ ID NO: 9442843 - DNA, 22 bp, Homo sapiens
tctcacagctctgctgcatgct

SEQ ID NO: 9442844 - DNA, 22 bp, Homo sapiens
tctcacagggctaggccctgcc

SEQ ID NO: 9442845 - DNA, 22 bp, Homo sapiens
tctcacagggctaggccctgcc

SEQ ID NO: 9442846 - DNA, 22 bp, Homo sapiens
tctcacagcatcattgctcatg

SEQ ID NO: 9442847 - DNA, 22 bp, Homo sapiens
tctcacagcaggggccaggtct

SEQ ID NO: 9442848 - DNA, 22 bp, Homo sapiens
tctcacagcattatccagggca

SEQ ID NO: 9442849 - DNA, 22 bp, Homo sapiens
tctcacagcatcattgctcatg

SEQ ID NO: 9442850 - DNA, 22 bp, Homo sapiens
tctcacacaacatgttactttg

SEQ ID NO: 9442851 - DNA, 22 bp, Homo sapiens
tctcacaccgtccctaaaccat

SEQ ID NO: 9442852 - DNA, 22 bp, Homo sapiens
tctcacactatttattctgctt

SEQ ID NO: 9442853 - DNA, 22 bp, Homo sapiens
tctcacacttctgtgttgcaca

SEQ ID NO: 9442854 - DNA, 22 bp, Homo sapiens
tctcacagaggcttgggctcat

SEQ ID NO: 9442855 - DNA, 22 bp, Homo sapiens
tctcacagaggcttgggctcat

SEQ ID NO: 9442856 - DNA, 20 bp, Homo sapiens
tctcacagacatcgtctcat

SEQ ID NO: 9442857 - DNA, 22 bp, Homo sapiens
tctcacagcaggggccaggtct

SEQ ID NO: 9442858 - DNA, 22 bp, Homo sapiens
taagaacagtgtctgtctcaca

SEQ ID NO: 9442859 - DNA, 22 bp, Homo sapiens
taagaacagtgtctgtctcaca

SEQ ID NO: 9442860 - DNA, 22 bp, Homo sapiens
taagaacagtgtctgtctcaca

SEQ ID NO: 9442861 - DNA, 22 bp, Homo sapiens
taagaacagtgtctgtctcaca

SEQ ID NO: 9442862 - DNA, 22 bp, Homo sapiens
taagaacagtgtctgtctcaca

SEQ ID NO: 9442863 - DNA, 22 bp, Homo sapiens
taagaacataaattcatacggg

SEQ ID NO: 9442864 - DNA, 23 bp, Homo sapiens
taagaacagacaagcatttacat

SEQ ID NO: 9442865 - DNA, 23 bp, Homo sapiens
taagaacagacaagcatttacat

SEQ ID NO: 9442866 - DNA, 23 bp, Homo sapiens
taagaacagacaagcatttacat

SEQ ID NO: 9442867 - DNA, 22 bp, Homo sapiens
taagaacagtagaacagtaggt

SEQ ID NO: 9442868 - DNA, 22 bp, Homo sapiens
taagaacagataaagtttcccc

SEQ ID NO: 9442869 - DNA, 22 bp, Homo sapiens
taagaacagataaagtttcccc

SEQ ID NO: 9442870 - DNA, 22 bp, Homo sapiens
taagaacagtgacagccaacat

SEQ ID NO: 9442871 - DNA, 22 bp, Homo sapiens
taagaagtgtttgcccagccat

SEQ ID NO: 9442872 - DNA, 22 bp, Homo sapiens
taagaatacctctcagctcttt

SEQ ID NO: 9442873 - DNA, 22 bp, Homo sapiens
taagaagtgctgaattgaatat

SEQ ID NO: 9442874 - DNA, 22 bp, Homo sapiens
taagaagtgagtgcaccttctt

SEQ ID NO: 9442875 - DNA, 22 bp, Homo sapiens
taagaagtacctcttttcctga

SEQ ID NO: 9442876 - DNA, 22 bp, Homo sapiens
taagaagtacctcttttcctga

SEQ ID NO: 9442877 - DNA, 22 bp, Homo sapiens
taagaagtacaaaaattttctg

SEQ ID NO: 9442878 - DNA, 22 bp, Homo sapiens
taagaaggtagtttccaagtca

SEQ ID NO: 9442879 - DNA, 22 bp, Homo sapiens
taagaacattttcggaaagata

SEQ ID NO: 9442880 - DNA, 22 bp, Homo sapiens
taagaacattttcggaaagata

SEQ ID NO: 9442881 - DNA, 21 bp, Homo sapiens
taagaacattatcttcttcct

SEQ ID NO: 9442882 - DNA, 21 bp, Homo sapiens
taagaacattatcttcttcct

SEQ ID NO: 9442883 - DNA, 22 bp, Homo sapiens
taagaagcagttcacaagtaaa

SEQ ID NO: 9442884 - DNA, 22 bp, Homo sapiens
taagaacttggcagcaagaaat

SEQ ID NO: 9442885 - DNA, 22 bp, Homo sapiens
taagaactttgtagcctgttct

SEQ ID NO: 9442886 - DNA, 22 bp, Homo sapiens
taagaactcgtgatcatttgaa

SEQ ID NO: 9442887 - DNA, 22 bp, Homo sapiens
taagaacttcggacatgttatc

SEQ ID NO: 9442888 - DNA, 22 bp, Homo sapiens
taagaacttggcagcaagaaat

SEQ ID NO: 9442889 - DNA, 22 bp, Homo sapiens
taagaacttcggacatgttatc

SEQ ID NO: 9442890 - DNA, 22 bp, Homo sapiens
taagaacttcggacatgttatc

SEQ ID NO: 9442891 - DNA, 22 bp, Homo sapiens
taagaattatctcatggataat

SEQ ID NO: 9442892 - DNA, 22 bp, Homo sapiens
taagaattatctcatggataat

SEQ ID NO: 9442893 - DNA, 22 bp, Homo sapiens
taagaattatctcatggataat

SEQ ID NO: 9442894 - DNA, 22 bp, Homo sapiens
taagaattatctcatggataat

SEQ ID NO: 9442895 - DNA, 22 bp, Homo sapiens
taagaatgactaccaaactgga

SEQ ID NO: 9442896 - DNA, 22 bp, Homo sapiens
taagaatgactaccaaactgga

SEQ ID NO: 9442897 - DNA, 22 bp, Homo sapiens
taagaatgacaaccataccatt

SEQ ID NO: 9442898 - DNA, 22 bp, Homo sapiens
taagaattccatcgcagagtat

SEQ ID NO: 9442899 - DNA, 18 bp, Homo sapiens
taagaattgagagtttac

SEQ ID NO: 9442900 - DNA, 22 bp, Homo sapiens
tcctgctggattgtgtctggtg

SEQ ID NO: 9442901 - DNA, 22 bp, Homo sapiens
taagaattgtgttgaatagagt

SEQ ID NO: 9442902 - DNA, 22 bp, Homo sapiens
taagaatagtgtttgcctttgg

SEQ ID NO: 9442903 - DNA, 22 bp, Homo sapiens
taagaatagtccctagatgtgt

SEQ ID NO: 9442904 - DNA, 22 bp, Homo sapiens
taagaatattgggaatggatgg

SEQ ID NO: 9442905 - DNA, 22 bp, Homo sapiens
taagaatcagtagatatagatt

SEQ ID NO: 9442906 - DNA, 22 bp, Homo sapiens
taagaatattgggaatggatgg

SEQ ID NO: 9442907 - DNA, 22 bp, Homo sapiens
taagaatcgatgtttatttaga

SEQ ID NO: 9442908 - DNA, 22 bp, Homo sapiens
tcctgcttgaaactctgccttc

SEQ ID NO: 9442909 - DNA, 22 bp, Homo sapiens
tcctgcttgaaactctgccttc

SEQ ID NO: 9442910 - DNA, 22 bp, Homo sapiens
tcctgcttaacatatggtcaag

SEQ ID NO: 9442911 - DNA, 22 bp, Homo sapiens
tcctgctgttttctggcccaca

SEQ ID NO: 9442912 - DNA, 22 bp, Homo sapiens
tcctgctgtttacctacaatgg

SEQ ID NO: 9442913 - DNA, 22 bp, Homo sapiens
tcctgctgtttacctacaatgg

SEQ ID NO: 9442914 - DNA, 22 bp, Homo sapiens
tcctgctgggtctaactctggt

SEQ ID NO: 9442915 - DNA, 22 bp, Homo sapiens
tcctgctgggtctaactctggt

SEQ ID NO: 9442916 - DNA, 22 bp, Homo sapiens
tcctgctgggcctgctttagga

SEQ ID NO: 9442917 - DNA, 21 bp, Homo sapiens
tcctgctgggtcaaccgtttt

SEQ ID NO: 9442918 - DNA, 22 bp, Homo sapiens
tcctgctggcaaggaagggact

SEQ ID NO: 9442919 - DNA, 22 bp, Homo sapiens
tcctgctggcaaggaagggact

SEQ ID NO: 9442920 - DNA, 22 bp, Homo sapiens
tcctgctggattgtgtctggtg

SEQ ID NO: 9442921 - DNA, 19 bp, Homo sapiens
tcctgctgtgtgaagggga

SEQ ID NO: 9442922 - DNA, 19 bp, Homo sapiens
tcctgctgtgtgaagggga

SEQ ID NO: 9442923 - DNA, 22 bp, Homo sapiens
tcctgctgtgtctagctggttc

SEQ ID NO: 9442924 - DNA, 22 bp, Homo sapiens
tcctgctgtgtctagctggttc

SEQ ID NO: 9442925 - DNA, 22 bp, Homo sapiens
tcctgctgtgcttattatcctg

SEQ ID NO: 9442926 - DNA, 22 bp, Homo sapiens
tcctgctggtgatggttaaggt

SEQ ID NO: 9442927 - DNA, 22 bp, Homo sapiens
tcctggagccaatgtgctgctg

SEQ ID NO: 9442928 - DNA, 22 bp, Homo sapiens
tcctggaggagatccaatctga

SEQ ID NO: 9442929 - DNA, 22 bp, Homo sapiens
tcctggaggcaaatgaagactc

SEQ ID NO: 9442930 - DNA, 22 bp, Homo sapiens
tcctggaggcaaatgagcacat

SEQ ID NO: 9442931 - DNA, 22 bp, Homo sapiens
tcctggaggcaaatgaagactc

SEQ ID NO: 9442932 - DNA, 22 bp, Homo sapiens
tcctggagggaggcggtgctac

SEQ ID NO: 9442933 - DNA, 22 bp, Homo sapiens
tcctggaggcactcgctggggc

SEQ ID NO: 9442934 - DNA, 22 bp, Homo sapiens
tcctggaggcaaatgagcacat

SEQ ID NO: 9442935 - DNA, 22 bp, Homo sapiens
tcctggaggcaaatgagcacat

SEQ ID NO: 9442936 - DNA, 22 bp, Homo sapiens
tcctggaggcactcgctggggc

SEQ ID NO: 9442937 - DNA, 22 bp, Homo sapiens
tcctggagggaggcggtgctac

SEQ ID NO: 9442938 - DNA, 22 bp, Homo sapiens
tcctggagggctcacaggcggc

SEQ ID NO: 9442939 - DNA, 22 bp, Homo sapiens
tcctggagggaggcggtgctac

SEQ ID NO: 9442940 - DNA, 20 bp, Homo sapiens
tcctggaggcttcatccata

SEQ ID NO: 9442941 - DNA, 22 bp, Homo sapiens
tcctggagggctcacaggcggc

SEQ ID NO: 9442942 - DNA, 22 bp, Homo sapiens
tcctggagggctcacaggcggc

SEQ ID NO: 9442943 - DNA, 22 bp, Homo sapiens
tcctggaggggacagcatgggc

SEQ ID NO: 9442944 - DNA, 22 bp, Homo sapiens
tcctggaggggacagcatgggc

SEQ ID NO: 9442945 - DNA, 22 bp, Homo sapiens
tcctggaggggacagcatgggc

SEQ ID NO: 9442946 - DNA, 22 bp, Homo sapiens
tcctggaggggacagcatgggc

SEQ ID NO: 9442947 - DNA, 22 bp, Homo sapiens
tcctggagtaggccttagccat

SEQ ID NO: 9442948 - DNA, 20 bp, Homo sapiens
tcctggagtattccatgctt

SEQ ID NO: 9442949 - DNA, 20 bp, Homo sapiens
tcctggagtattccatgctt

SEQ ID NO: 9442950 - DNA, 22 bp, Homo sapiens
tcctggagtatttctgtggtgt

SEQ ID NO: 9442951 - DNA, 22 bp, Homo sapiens
tcctggagataattgcagtgaa

SEQ ID NO: 9442952 - DNA, 22 bp, Homo sapiens
tcctggagataattgcagtgaa

SEQ ID NO: 9442953 - DNA, 22 bp, Homo sapiens
tcctggagataattgcagtgaa

SEQ ID NO: 9442954 - DNA, 22 bp, Homo sapiens
tcctggagataattgcagtgaa

SEQ ID NO: 9442955 - DNA, 22 bp, Homo sapiens
tcctggagataattgcagtgaa

SEQ ID NO: 9442956 - DNA, 22 bp, Homo sapiens
tcctggagataattgcagtgaa

SEQ ID NO: 9442957 - DNA, 22 bp, Homo sapiens
tcctggagagtgggcgagcaca

SEQ ID NO: 9442958 - DNA, 22 bp, Homo sapiens
tcctggagagaggcctggaaga

SEQ ID NO: 9442959 - DNA, 22 bp, Homo sapiens
tcctggagagtgggcgagcaca

SEQ ID NO: 9442960 - DNA, 22 bp, Homo sapiens
tcctggagaatcctgccacctg

SEQ ID NO: 9442961 - DNA, 22 bp, Homo sapiens
tcctggagaatggacaatgcac

SEQ ID NO: 9442962 - DNA, 22 bp, Homo sapiens
tcctggagaatggacaatgcac

SEQ ID NO: 9442963 - DNA, 22 bp, Homo sapiens
tcctggagaagaggggcttgga

SEQ ID NO: 9442964 - DNA, 22 bp, Homo sapiens
tcctggagaactgattcgcggg

SEQ ID NO: 9442965 - DNA, 22 bp, Homo sapiens
tcctggagaagaggggcttgga

SEQ ID NO: 9442966 - DNA, 22 bp, Homo sapiens
tcctggagagaggcctggaaga

SEQ ID NO: 9442967 - DNA, 22 bp, Homo sapiens
tcctggagagaggcctggaaga

SEQ ID NO: 9442968 - DNA, 22 bp, Homo sapiens
tcctggagagtgggcgagcaca

SEQ ID NO: 9442969 - DNA, 22 bp, Homo sapiens
tcctggagaatggacaatgcac

SEQ ID NO: 9442970 - DNA, 22 bp, Homo sapiens
tcctggagaaactcagagatct

SEQ ID NO: 9442971 - DNA, 22 bp, Homo sapiens
tcctggagaaactcagagatct

SEQ ID NO: 9442972 - DNA, 23 bp, Homo sapiens
tcctggagaaaagaaacatttct

SEQ ID NO: 9442973 - DNA, 22 bp, Homo sapiens
tcctggagaaactcagagatct

SEQ ID NO: 9442974 - DNA, 22 bp, Homo sapiens
tcctggagaagaggggcttgga

SEQ ID NO: 9442975 - DNA, 22 bp, Homo sapiens
tcctggagaagaggggcttgga

SEQ ID NO: 9442976 - DNA, 22 bp, Homo sapiens
tcctggaagatctctgtgagat

SEQ ID NO: 9442977 - DNA, 22 bp, Homo sapiens
tcctggaacatggataaagaat

SEQ ID NO: 9442978 - DNA, 19 bp, Homo sapiens
tcctgctttctactctgct

SEQ ID NO: 9442979 - DNA, 22 bp, Homo sapiens
tcctggaagtgcttggtgaggg

SEQ ID NO: 9442980 - DNA, 17 bp, Homo sapiens
tcctggatccatggtgg

SEQ ID NO: 9442981 - DNA, 17 bp, Homo sapiens
tcctggatccatggtgg

SEQ ID NO: 9442982 - DNA, 22 bp, Homo sapiens
tcctggagtttgtggtgatatg

SEQ ID NO: 9442983 - DNA, 22 bp, Homo sapiens
tcctggatcagcgggggcaggc

SEQ ID NO: 9442984 - DNA, 22 bp, Homo sapiens
tcctggatcagcgggggcaggc

SEQ ID NO: 9442985 - DNA, 22 bp, Homo sapiens
tcctggatggagctgccctcgc

SEQ ID NO: 9442986 - DNA, 22 bp, Homo sapiens
tcctggatggagctgccctcgc

SEQ ID NO: 9442987 - DNA, 22 bp, Homo sapiens
tcctggattaatagggagctgt

SEQ ID NO: 9442988 - DNA, 22 bp, Homo sapiens
tcctggatggcctgcaggcggt

SEQ ID NO: 9442989 - DNA, 22 bp, Homo sapiens
tcctggattaatagggagctgt

SEQ ID NO: 9442990 - DNA, 22 bp, Homo sapiens
tcctggattaatagggagctgt

SEQ ID NO: 9442991 - DNA, 22 bp, Homo sapiens
tcctggattctgccctgaaggc

SEQ ID NO: 9442992 - DNA, 22 bp, Homo sapiens
tcctggatttaaccctggctct

SEQ ID NO: 9442993 - DNA, 22 bp, Homo sapiens
tcctggattctgccctgaaggc

SEQ ID NO: 9442994 - DNA, 22 bp, Homo sapiens
tcctggatttaaccctggctct

SEQ ID NO: 9442995 - DNA, 22 bp, Homo sapiens
tcctggcaaagatgttggtgtt

SEQ ID NO: 9442996 - DNA, 22 bp, Homo sapiens
tcctggatttagaagagcctcc

SEQ ID NO: 9442997 - DNA, 19 bp, Homo sapiens
tcctggcacagtggaacca

SEQ ID NO: 9442998 - DNA, 22 bp, Homo sapiens
tcctggcacattgcaggggctc

SEQ ID NO: 9442999 - DNA, 22 bp, Homo sapiens
tcctggagtttgtaaggtgagc

SEQ ID NO: 9443000 - DNA, 22 bp, Homo sapiens
tcctggagttgtgcagtgcaca

SEQ ID NO: 9443001 - DNA, 22 bp, Homo sapiens
tcctggagtttgtaaggtgagc

SEQ ID NO: 9443002 - DNA, 22 bp, Homo sapiens
tcctggagtttgtaaggtgagc

SEQ ID NO: 9443003 - DNA, 22 bp, Homo sapiens
tcctggagtttgtggtgatatg

SEQ ID NO: 9443004 - DNA, 22 bp, Homo sapiens
tcctggagttgtgcagtgcaca

SEQ ID NO: 9443005 - DNA, 22 bp, Homo sapiens
tcctggagttgtctgtactcat

SEQ ID NO: 9443006 - DNA, 22 bp, Homo sapiens
tcctggagttgtgcagtgcaca

SEQ ID NO: 9443007 - DNA, 22 bp, Homo sapiens
tcctggagttgtgcagtgcaca

SEQ ID NO: 9443008 - DNA, 22 bp, Homo sapiens
tcctggagtggagtctgttgtt

SEQ ID NO: 9443009 - DNA, 22 bp, Homo sapiens
tcctggagttgtctgtactcat

SEQ ID NO: 9443010 - DNA, 22 bp, Homo sapiens
tcctggagttgtctgtactcat

SEQ ID NO: 9443011 - DNA, 22 bp, Homo sapiens
tcctggagtgtcttccccaagg

SEQ ID NO: 9443012 - DNA, 22 bp, Homo sapiens
tcctggagtatttctgtggtgt

SEQ ID NO: 9443013 - DNA, 22 bp, Homo sapiens
tcctggagtatttctgtggtgt

SEQ ID NO: 9443014 - DNA, 20 bp, Homo sapiens
tcctggagtctggtttggct

SEQ ID NO: 9443015 - DNA, 22 bp, Homo sapiens
tcctggcatccgtgggtctgtg

SEQ ID NO: 9443016 - DNA, 22 bp, Homo sapiens
tcctggccaagttactctctgc

SEQ ID NO: 9443017 - DNA, 22 bp, Homo sapiens
tcctggccacacattaatagtg

SEQ ID NO: 9443018 - DNA, 22 bp, Homo sapiens
tcctggccaagtagatgtggcg

SEQ ID NO: 9443019 - DNA, 22 bp, Homo sapiens
tcctggccaagttactctctgc

SEQ ID NO: 9443020 - DNA, 22 bp, Homo sapiens
tcctggccaagttactctctgc

SEQ ID NO: 9443021 - DNA, 22 bp, Homo sapiens
tcctggcattgtgcagggtgtg

SEQ ID NO: 9443022 - DNA, 22 bp, Homo sapiens
tcctggccaagtagatgtggcg

SEQ ID NO: 9443023 - DNA, 22 bp, Homo sapiens
tcctggcccaatctgcccatga

SEQ ID NO: 9443024 - DNA, 22 bp, Homo sapiens
tcctggcccaatctgcccatga

SEQ ID NO: 9443025 - DNA, 22 bp, Homo sapiens
tcctggccatgcaagatgagga

SEQ ID NO: 9443026 - DNA, 22 bp, Homo sapiens
tcctggccatgcaagatgagga

SEQ ID NO: 9443027 - DNA, 21 bp, Homo sapiens
tcctggccagggcactaggca

SEQ ID NO: 9443028 - DNA, 21 bp, Homo sapiens
tcctggccagggcactaggca

SEQ ID NO: 9443029 - DNA, 21 bp, Homo sapiens
tcctggccagggcactaggca

SEQ ID NO: 9443030 - DNA, 22 bp, Homo sapiens
tcctggccataggctatttcag

SEQ ID NO: 9443031 - DNA, 22 bp, Homo sapiens
tcctggccataggctatttcag

SEQ ID NO: 9443032 - DNA, 22 bp, Homo sapiens
tcctggccaggatgacctaaca

SEQ ID NO: 9443033 - DNA, 22 bp, Homo sapiens
tcctggccaggatgacctaaca

SEQ ID NO: 9443034 - DNA, 22 bp, Homo sapiens
tcctggccagaggacaaagctg

SEQ ID NO: 9443035 - DNA, 18 bp, Homo sapiens
tcctggccacactacctt

SEQ ID NO: 9443036 - DNA, 22 bp, Homo sapiens
tcctggccacccgacagaagtc

SEQ ID NO: 9443037 - DNA, 18 bp, Homo sapiens
tcctggccacactacctt

SEQ ID NO: 9443038 - DNA, 22 bp, Homo sapiens
tcctggcctccgttctctgcat

SEQ ID NO: 9443039 - DNA, 22 bp, Homo sapiens
tcctggcctccgttctctgcat

SEQ ID NO: 9443040 - DNA, 22 bp, Homo sapiens
tcctggcctccgttctctgcat

SEQ ID NO: 9443041 - DNA, 22 bp, Homo sapiens
tcctggcctccgttctctgcat

SEQ ID NO: 9443042 - DNA, 20 bp, Homo sapiens
tcctggcctccctggggctc

SEQ ID NO: 9443043 - DNA, 20 bp, Homo sapiens
tcctggcctccctggggctc

SEQ ID NO: 9443044 - DNA, 20 bp, Homo sapiens
tcctggcctccctggggctc

SEQ ID NO: 9443045 - DNA, 22 bp, Homo sapiens
tcctggcctcacagtcctgggt

SEQ ID NO: 9443046 - DNA, 22 bp, Homo sapiens
tcctggcctcacagtcctgggt

SEQ ID NO: 9443047 - DNA, 22 bp, Homo sapiens
tcctggcctcgctgtccacctt

SEQ ID NO: 9443048 - DNA, 22 bp, Homo sapiens
tcctggcctcgctgtccacctt

SEQ ID NO: 9443049 - DNA, 22 bp, Homo sapiens
tcctggcctcgctgtccacctt

SEQ ID NO: 9443050 - DNA, 22 bp, Homo sapiens
tcctggcctctgagtcaagaac

SEQ ID NO: 9443051 - DNA, 22 bp, Homo sapiens
tcctggcctctgagtcaagaac

SEQ ID NO: 9443052 - DNA, 22 bp, Homo sapiens
tcctggctcctgatctgtcact

SEQ ID NO: 9443053 - DNA, 17 bp, Homo sapiens
tcctggcctggtgtgtg

SEQ ID NO: 9443054 - DNA, 15 bp, Homo sapiens
tcctggcctgctctg

SEQ ID NO: 9443055 - DNA, 22 bp, Homo sapiens
tcctggctctaagtcctgagtg

SEQ ID NO: 9443056 - DNA, 22 bp, Homo sapiens
tcctggctctaagtcctgagtg

SEQ ID NO: 9443057 - DNA, 22 bp, Homo sapiens
tcctggctctaagtcctgagtg

SEQ ID NO: 9443058 - DNA, 22 bp, Homo sapiens
tcctggctctaagtcctgagtg

SEQ ID NO: 9443059 - DNA, 22 bp, Homo sapiens
tcctggctcggcttggggactt

SEQ ID NO: 9443060 - DNA, 22 bp, Homo sapiens
tcctggctcgattgctaccaat

SEQ ID NO: 9443061 - DNA, 22 bp, Homo sapiens
tcctggctcctggagacctgct

SEQ ID NO: 9443062 - DNA, 22 bp, Homo sapiens
tcctggctcctggagacctgct

SEQ ID NO: 9443063 - DNA, 22 bp, Homo sapiens
tcctggctcgattgctaccaat

SEQ ID NO: 9443064 - DNA, 22 bp, Homo sapiens
tcctggctctaagtcctgagtg

SEQ ID NO: 9443065 - DNA, 22 bp, Homo sapiens
tcctggctctgctgcctcctag

SEQ ID NO: 9443066 - DNA, 22 bp, Homo sapiens
tcctggctctgctgcctcctag

SEQ ID NO: 9443067 - DNA, 22 bp, Homo sapiens
tcctggcctagctcaccctgga

SEQ ID NO: 9443068 - DNA, 22 bp, Homo sapiens
tcctggcctagagtttgtgttc

SEQ ID NO: 9443069 - DNA, 22 bp, Homo sapiens
tcctggccgctggcccctgaga

SEQ ID NO: 9443070 - DNA, 22 bp, Homo sapiens
tcctggccgctggcccctgaga

SEQ ID NO: 9443071 - DNA, 22 bp, Homo sapiens
tcctggccgctggcccctgaga

SEQ ID NO: 9443072 - DNA, 22 bp, Homo sapiens
tcctggccgctggcccctgaga

SEQ ID NO: 9443073 - DNA, 22 bp, Homo sapiens
tcctggcctcacagtcctgggt

SEQ ID NO: 9443074 - DNA, 22 bp, Homo sapiens
tcctggcctcacagtcctgggt

SEQ ID NO: 9443075 - DNA, 22 bp, Homo sapiens
tcctggcctagctcaccctgga

SEQ ID NO: 9443076 - DNA, 22 bp, Homo sapiens
tcctggcctagctcaccctgga

SEQ ID NO: 9443077 - DNA, 22 bp, Homo sapiens
tcctggccgccgcgtggggccg

SEQ ID NO: 9443078 - DNA, 22 bp, Homo sapiens
tcctggccgccgcgtggggccg

SEQ ID NO: 9443079 - DNA, 22 bp, Homo sapiens
tcctggccgccgcgtggggccg

SEQ ID NO: 9443080 - DNA, 22 bp, Homo sapiens
tcctggccctgtggcctgcagt

SEQ ID NO: 9443081 - DNA, 22 bp, Homo sapiens
tcctggccctctgcaaacgcca

SEQ ID NO: 9443082 - DNA, 22 bp, Homo sapiens
tcctggccctgtggcctgcagt

SEQ ID NO: 9443083 - DNA, 22 bp, Homo sapiens
tcctggcccactatgccagcat

SEQ ID NO: 9443084 - DNA, 22 bp, Homo sapiens
tcctggcccactatgccagcat

SEQ ID NO: 9443085 - DNA, 22 bp, Homo sapiens
tcctggcccactcctagcttct

SEQ ID NO: 9443086 - DNA, 21 bp, Homo sapiens
tcctggcccactctatcccca

SEQ ID NO: 9443087 - DNA, 22 bp, Homo sapiens
tcctggcccgatccctgtgaag

SEQ ID NO: 9443088 - DNA, 22 bp, Homo sapiens
tcctggcccgatccctgtgaag

SEQ ID NO: 9443089 - DNA, 22 bp, Homo sapiens
tcctggcccgatccctgtgaag

SEQ ID NO: 9443090 - DNA, 16 bp, Homo sapiens
tcctggcccctatgga

SEQ ID NO: 9443091 - DNA, 16 bp, Homo sapiens
tcctggcccctatgga

SEQ ID NO: 9443092 - DNA, 22 bp, Homo sapiens
tcctggcccggccgggcctgct

SEQ ID NO: 9443093 - DNA, 22 bp, Homo sapiens
tcctggcccggccgggcctgct

SEQ ID NO: 9443094 - DNA, 22 bp, Homo sapiens
tcctggcccggccgggcctgct

SEQ ID NO: 9443095 - DNA, 22 bp, Homo sapiens
tcctggcccggccgggcctgct

SEQ ID NO: 9443096 - DNA, 22 bp, Homo sapiens
tcctggctgccgtcgtcctgcg

SEQ ID NO: 9443097 - DNA, 22 bp, Homo sapiens
tcctggctgccgtcgtcctgcg

SEQ ID NO: 9443098 - DNA, 22 bp, Homo sapiens
tcctggctgtcactcgggttga

SEQ ID NO: 9443099 - DNA, 22 bp, Homo sapiens
tcctggctgcaccagtgaccct

SEQ ID NO: 9443100 - DNA, 22 bp, Homo sapiens
tcctggctgagttcccaagtcg

SEQ ID NO: 9443101 - DNA, 22 bp, Homo sapiens
tcctggctgttagagaggcaag

SEQ ID NO: 9443102 - DNA, 22 bp, Homo sapiens
tcctggcttaggtttccagaac

SEQ ID NO: 9443103 - DNA, 22 bp, Homo sapiens
tcctggcttccacacctgtcat

SEQ ID NO: 9443104 - DNA, 22 bp, Homo sapiens
tcctggcttccactcctctgtt

SEQ ID NO: 9443105 - DNA, 22 bp, Homo sapiens
tcctggcttccactcctctgtt

SEQ ID NO: 9443106 - DNA, 22 bp, Homo sapiens
tcctggcttctgtctccttatt

SEQ ID NO: 9443107 - DNA, 18 bp, Homo sapiens
tcctgggaaaggcataca

SEQ ID NO: 9443108 - DNA, 18 bp, Homo sapiens
tcctgggaaaggcataca

SEQ ID NO: 9443109 - DNA, 22 bp, Homo sapiens
tcctggcttttcttggctcatc

SEQ ID NO: 9443110 - DNA, 21 bp, Homo sapiens
tcctggctttatgctacctct

SEQ ID NO: 9443111 - DNA, 22 bp, Homo sapiens
tcctggcttgtcacatctacgt

SEQ ID NO: 9443112 - DNA, 22 bp, Homo sapiens
tcctggcttgtcacatctacgt

SEQ ID NO: 9443113 - DNA, 22 bp, Homo sapiens
tcctgggaactcggaaagctct

SEQ ID NO: 9443114 - DNA, 18 bp, Homo sapiens
tcctgggaaaggcataca

SEQ ID NO: 9443115 - DNA, 22 bp, Homo sapiens
tcctgggaactcggaaagctct

SEQ ID NO: 9443116 - DNA, 22 bp, Homo sapiens
tcctgggaagagacctgagcat

SEQ ID NO: 9443117 - DNA, 22 bp, Homo sapiens
tcctgggaagactgtgaggaca

SEQ ID NO: 9443118 - DNA, 22 bp, Homo sapiens
tcctgggaagactgtgaggaca

SEQ ID NO: 9443119 - DNA, 22 bp, Homo sapiens
tcctgggaagcgccggcctgcg

SEQ ID NO: 9443120 - DNA, 22 bp, Homo sapiens
tcctgggaagcgccggcctgcg

SEQ ID NO: 9443121 - DNA, 21 bp, Homo sapiens
tcctgggaagcactggggtgg

SEQ ID NO: 9443122 - DNA, 22 bp, Homo sapiens
tcctgggaagtggctggctgag

SEQ ID NO: 9443123 - DNA, 22 bp, Homo sapiens
tcctgggaagagacctgagcat

SEQ ID NO: 9443124 - DNA, 21 bp, Homo sapiens
tcctgggaagcactggggtgg

SEQ ID NO: 9443125 - DNA, 21 bp, Homo sapiens
tcctgggaagcactggggtgg

SEQ ID NO: 9443126 - DNA, 22 bp, Homo sapiens
tcctgggaagagacctgagcat

SEQ ID NO: 9443127 - DNA, 22 bp, Homo sapiens
tcctgggaagtggctggctgag

SEQ ID NO: 9443128 - DNA, 22 bp, Homo sapiens
tcctgggaagtggctggctgag

SEQ ID NO: 9443129 - DNA, 22 bp, Homo sapiens
tcctgggaagtggctggctgag

SEQ ID NO: 9443130 - DNA, 22 bp, Homo sapiens
tcctgggaagttgcatcaccgt

SEQ ID NO: 9443131 - DNA, 22 bp, Homo sapiens
tcctgggacaccccaatatgag

SEQ ID NO: 9443132 - DNA, 22 bp, Homo sapiens
tcctgggacaagccgtggaagt

SEQ ID NO: 9443133 - DNA, 22 bp, Homo sapiens
tcctgggacaagccgtggaagt

SEQ ID NO: 9443134 - DNA, 22 bp, Homo sapiens
tcctgggaccgagggaagagct

SEQ ID NO: 9443135 - DNA, 22 bp, Homo sapiens
tcctgggaccgagggaagagct

SEQ ID NO: 9443136 - DNA, 22 bp, Homo sapiens
tcctgggactcaacttagaagg

SEQ ID NO: 9443137 - DNA, 22 bp, Homo sapiens
tcctgggaggctgtgcctggct

SEQ ID NO: 9443138 - DNA, 22 bp, Homo sapiens
tcctgggaggctgtgcctggct

SEQ ID NO: 9443139 - DNA, 22 bp, Homo sapiens
tcctgggaggctgtgcctggct

SEQ ID NO: 9443140 - DNA, 22 bp, Homo sapiens
tcctgggaggctgtgcctggct

SEQ ID NO: 9443141 - DNA, 22 bp, Homo sapiens
tcctgggaggcggaggttgcag

SEQ ID NO: 9443142 - DNA, 22 bp, Homo sapiens
tcctgggaggcggaggttgcag

SEQ ID NO: 9443143 - DNA, 22 bp, Homo sapiens
tcctgggaggcaggaccccttt

SEQ ID NO: 9443144 - DNA, 22 bp, Homo sapiens
tcctgggaggaacatttaccta

SEQ ID NO: 9443145 - DNA, 21 bp, Homo sapiens
tcctgggagtctgagatcctg

SEQ ID NO: 9443146 - DNA, 22 bp, Homo sapiens
tcctgggagtaattgagtcatg

SEQ ID NO: 9443147 - DNA, 22 bp, Homo sapiens
tcctgggagtaattgagtcatg

SEQ ID NO: 9443148 - DNA, 22 bp, Homo sapiens
tcctgggatcaagtgatcctcc

SEQ ID NO: 9443149 - DNA, 22 bp, Homo sapiens
tcctgggatcaagtgatcctcc

SEQ ID NO: 9443150 - DNA, 22 bp, Homo sapiens
tcctgggatgaggaaacaagga

SEQ ID NO: 9443151 - DNA, 22 bp, Homo sapiens
tcctgggatgcataaaatatgt

SEQ ID NO: 9443152 - DNA, 22 bp, Homo sapiens
tcctgggagtggccatgtaatg

SEQ ID NO: 9443153 - DNA, 22 bp, Homo sapiens
tcctgggatcaagtgatcctcc

SEQ ID NO: 9443154 - DNA, 22 bp, Homo sapiens
tcctgggcagaatgggatggct

SEQ ID NO: 9443155 - DNA, 22 bp, Homo sapiens
tcctgggcagaatgggatggct

SEQ ID NO: 9443156 - DNA, 22 bp, Homo sapiens
tcctgggcacaagtgagtctcc

SEQ ID NO: 9443157 - DNA, 22 bp, Homo sapiens
tcctgggcacaagtgagtctcc

SEQ ID NO: 9443158 - DNA, 22 bp, Homo sapiens
tcctgggcaaagaggggcagtg

SEQ ID NO: 9443159 - DNA, 22 bp, Homo sapiens
tcctgggcacaagtgagtctcc

SEQ ID NO: 9443160 - DNA, 22 bp, Homo sapiens
tcctgggattaaggtggtgatt

SEQ ID NO: 9443161 - DNA, 22 bp, Homo sapiens
tcctgggattaaggtggtgatt

SEQ ID NO: 9443162 - DNA, 22 bp, Homo sapiens
tcctgggattctgcatttctaa

SEQ ID NO: 9443163 - DNA, 22 bp, Homo sapiens
tcctgggccctccggatcaggt

SEQ ID NO: 9443164 - DNA, 22 bp, Homo sapiens
tcctgggcccaggctgccaggg

SEQ ID NO: 9443165 - DNA, 22 bp, Homo sapiens
tcctgggccctccggatcaggt

SEQ ID NO: 9443166 - DNA, 22 bp, Homo sapiens
tcctgggcctgtactccatccg

SEQ ID NO: 9443167 - DNA, 22 bp, Homo sapiens
tcctgggcccaggctgccaggg

SEQ ID NO: 9443168 - DNA, 22 bp, Homo sapiens
tcctgggcccaggctgccaggg

SEQ ID NO: 9443169 - DNA, 22 bp, Homo sapiens
tcctgggcagcgggacgctcag

SEQ ID NO: 9443170 - DNA, 19 bp, Homo sapiens
tcctgggctgcgtcttgcc

SEQ ID NO: 9443171 - DNA, 19 bp, Homo sapiens
tcctgggctgcgtcttgcc

SEQ ID NO: 9443172 - DNA, 22 bp, Homo sapiens
tcctgggctgcagggaagagca

SEQ ID NO: 9443173 - DNA, 22 bp, Homo sapiens
tcctgggctgcagggaagagca

SEQ ID NO: 9443174 - DNA, 19 bp, Homo sapiens
tcctgggcgttgactttgg

SEQ ID NO: 9443175 - DNA, 22 bp, Homo sapiens
tcctgggcggttatgtgatctg

SEQ ID NO: 9443176 - DNA, 22 bp, Homo sapiens
tcctgggctgtggccccgggca

SEQ ID NO: 9443177 - DNA, 19 bp, Homo sapiens
tcctgggctgggccaggtc

SEQ ID NO: 9443178 - DNA, 22 bp, Homo sapiens
tcctggggaggtcgaggctgag

SEQ ID NO: 9443179 - DNA, 22 bp, Homo sapiens
tcctggggagggttctggctcc

SEQ ID NO: 9443180 - DNA, 22 bp, Homo sapiens
tcctggggagggttctggctcc

SEQ ID NO: 9443181 - DNA, 22 bp, Homo sapiens
tcctggggagggttctggctcc

SEQ ID NO: 9443182 - DNA, 22 bp, Homo sapiens
tcctggggctgcaaggcctgtc

SEQ ID NO: 9443183 - DNA, 22 bp, Homo sapiens
tcctggggctgcaaggcctgtc

SEQ ID NO: 9443184 - DNA, 22 bp, Homo sapiens
tcctggggctctttgatgtgat

SEQ ID NO: 9443185 - DNA, 22 bp, Homo sapiens
tcctggggctctttgatgtgat

SEQ ID NO: 9443186 - DNA, 22 bp, Homo sapiens
tcctggggctctttgatgtgat

SEQ ID NO: 9443187 - DNA, 22 bp, Homo sapiens
tcctggggctctgagcgagaca

SEQ ID NO: 9443188 - DNA, 22 bp, Homo sapiens
tcctggggctctgagcgagaca

SEQ ID NO: 9443189 - DNA, 20 bp, Homo sapiens
tcctggggtaagccatggtc

SEQ ID NO: 9443190 - DNA, 20 bp, Homo sapiens
tcctggggtaagccatggtc

SEQ ID NO: 9443191 - DNA, 20 bp, Homo sapiens
tcctggggtaagccatggtc

SEQ ID NO: 9443192 - DNA, 21 bp, Homo sapiens
tcctggggggtaggtgagttt

SEQ ID NO: 9443193 - DNA, 21 bp, Homo sapiens
tcctggggggtaggtgagttt

SEQ ID NO: 9443194 - DNA, 21 bp, Homo sapiens
tcctggggggtaggtgagttt

SEQ ID NO: 9443195 - DNA, 22 bp, Homo sapiens
tcctggggctgcaaggcctgtc

SEQ ID NO: 9443196 - DNA, 22 bp, Homo sapiens
tcctggggctgcaaggcctgtc

SEQ ID NO: 9443197 - DNA, 21 bp, Homo sapiens
tcctggggggtaggtgagttt

SEQ ID NO: 9443198 - DNA, 21 bp, Homo sapiens
tcctggggggtaggtgagttt

SEQ ID NO: 9443199 - DNA, 22 bp, Homo sapiens
tcctggggctgcaaggcctgtc

SEQ ID NO: 9443200 - DNA, 19 bp, Homo sapiens
tcctggggatgtggtcacc

SEQ ID NO: 9443201 - DNA, 19 bp, Homo sapiens
tcctggggatgtggtcacc

SEQ ID NO: 9443202 - DNA, 19 bp, Homo sapiens
tcctggggatgtggtcacc

SEQ ID NO: 9443203 - DNA, 19 bp, Homo sapiens
tcctggggatgtggtcacc

SEQ ID NO: 9443204 - DNA, 22 bp, Homo sapiens
tcctggggaggtcgaggctgag

SEQ ID NO: 9443205 - DNA, 22 bp, Homo sapiens
tcctggggaggtcgaggctgag

SEQ ID NO: 9443206 - DNA, 22 bp, Homo sapiens
tcctggggaggtcgaggctgag

SEQ ID NO: 9443207 - DNA, 16 bp, Homo sapiens
tcctggggatactgga

SEQ ID NO: 9443208 - DNA, 16 bp, Homo sapiens
tcctggggatactgga

SEQ ID NO: 9443209 - DNA, 16 bp, Homo sapiens
tcctggggatactgga

SEQ ID NO: 9443210 - DNA, 22 bp, Homo sapiens
tcctggggccaggcacctctgg

SEQ ID NO: 9443211 - DNA, 22 bp, Homo sapiens
tcctggggccaggcacctctgg

SEQ ID NO: 9443212 - DNA, 22 bp, Homo sapiens
tcctggggccaggcacctctgg

SEQ ID NO: 9443213 - DNA, 22 bp, Homo sapiens
tcctggggctcatgggatttgt

SEQ ID NO: 9443214 - DNA, 22 bp, Homo sapiens
tcctggggctcatgggatttgt

SEQ ID NO: 9443215 - DNA, 22 bp, Homo sapiens
tcctggggctcatgggatttgt

SEQ ID NO: 9443216 - DNA, 22 bp, Homo sapiens
tcctggggccagcactggtgga

SEQ ID NO: 9443217 - DNA, 22 bp, Homo sapiens
tcctggggccagcactggtgga

SEQ ID NO: 9443218 - DNA, 22 bp, Homo sapiens
tcctggggccagcactggtgga

SEQ ID NO: 9443219 - DNA, 22 bp, Homo sapiens
tcctggggccagcactggtgga

SEQ ID NO: 9443220 - DNA, 22 bp, Homo sapiens
tcctggggccagcactggtgga

SEQ ID NO: 9443221 - DNA, 22 bp, Homo sapiens
tcctgggtgaaagaacaggcag

SEQ ID NO: 9443222 - DNA, 22 bp, Homo sapiens
tcctgggtctgggtgtctgagg

SEQ ID NO: 9443223 - DNA, 22 bp, Homo sapiens
tcctgggtctgggtgtctgagg

SEQ ID NO: 9443224 - DNA, 22 bp, Homo sapiens
tcctgggtcccgcacatctgtc

SEQ ID NO: 9443225 - DNA, 22 bp, Homo sapiens
tcctgggttaattatgattcac

SEQ ID NO: 9443226 - DNA, 22 bp, Homo sapiens
tcctgggttcatgtcctggtgc

SEQ ID NO: 9443227 - DNA, 22 bp, Homo sapiens
tcctggtggctctttgggaagg

SEQ ID NO: 9443228 - DNA, 18 bp, Homo sapiens
tcctggtattgcaagcac

SEQ ID NO: 9443229 - DNA, 22 bp, Homo sapiens
tcctgggtagagacctgatgaa

SEQ ID NO: 9443230 - DNA, 22 bp, Homo sapiens
tcctggggttttggccgcagct

SEQ ID NO: 9443231 - DNA, 22 bp, Homo sapiens
tcctggggtttagagggaagtg

SEQ ID NO: 9443232 - DNA, 22 bp, Homo sapiens
tcctggggttttggccgcagct

SEQ ID NO: 9443233 - DNA, 22 bp, Homo sapiens
tcctggggttttggccgcagct

SEQ ID NO: 9443234 - DNA, 22 bp, Homo sapiens
tcctggggttttggccgcagct

SEQ ID NO: 9443235 - DNA, 20 bp, Homo sapiens
tcctggggtaagccatggtc

SEQ ID NO: 9443236 - DNA, 22 bp, Homo sapiens
tcctggggtcctgactgcttcc

SEQ ID NO: 9443237 - DNA, 22 bp, Homo sapiens
tcctggggtcctgactgcttcc

SEQ ID NO: 9443238 - DNA, 22 bp, Homo sapiens
tcctggggtcctgactgcttcc

SEQ ID NO: 9443239 - DNA, 22 bp, Homo sapiens
tcctggggtgtgttttgctgct

SEQ ID NO: 9443240 - DNA, 22 bp, Homo sapiens
tcctggggtttagagggaagtg

SEQ ID NO: 9443241 - DNA, 22 bp, Homo sapiens
tcctggggtttagagggaagtg

SEQ ID NO: 9443242 - DNA, 22 bp, Homo sapiens
tcctggggtgtgttttgctgct

SEQ ID NO: 9443243 - DNA, 22 bp, Homo sapiens
tcctggggtgtgttttgctgct

SEQ ID NO: 9443244 - DNA, 22 bp, Homo sapiens
tcctggggtgtgttttgctgct

SEQ ID NO: 9443245 - DNA, 22 bp, Homo sapiens
tcctggggtcctgactgcttcc

SEQ ID NO: 9443246 - DNA, 22 bp, Homo sapiens
tcctgtggggaaaagcctatct

SEQ ID NO: 9443247 - DNA, 22 bp, Homo sapiens
tcctgtgggctctcggcctcca

SEQ ID NO: 9443248 - DNA, 22 bp, Homo sapiens
tcctgtggcttccacgacctaa

SEQ ID NO: 9443249 - DNA, 22 bp, Homo sapiens
tcctgtggcgttatcatgtgat

SEQ ID NO: 9443250 - DNA, 22 bp, Homo sapiens
tcctgtggcgttatcatgtgat

SEQ ID NO: 9443251 - DNA, 17 bp, Homo sapiens
tcctgtgggtgcagcag

SEQ ID NO: 9443252 - DNA, 22 bp, Homo sapiens
tcctgtggtatgggagtgatgt

SEQ ID NO: 9443253 - DNA, 22 bp, Homo sapiens
tcctgtgctttggaggatgttc

SEQ ID NO: 9443254 - DNA, 22 bp, Homo sapiens
tcctgtgctttggaggatgttc

SEQ ID NO: 9443255 - DNA, 22 bp, Homo sapiens
tcctgtggaagacagtgttggg

SEQ ID NO: 9443256 - DNA, 20 bp, Homo sapiens
tcctgtggacattgctggcc

SEQ ID NO: 9443257 - DNA, 20 bp, Homo sapiens
tcctgtggacattgctggcc

SEQ ID NO: 9443258 - DNA, 22 bp, Homo sapiens
tcctgtggagaggactggaggt

SEQ ID NO: 9443259 - DNA, 22 bp, Homo sapiens
tcctgtggagaggactggaggt

SEQ ID NO: 9443260 - DNA, 22 bp, Homo sapiens
tcctgtggcgttatcatgtgat

SEQ ID NO: 9443261 - DNA, 18 bp, Homo sapiens
tcctgtggcccagagttt

SEQ ID NO: 9443262 - DNA, 22 bp, Homo sapiens
tcctgtctgctcacagagctgg

SEQ ID NO: 9443263 - DNA, 22 bp, Homo sapiens
tcctgtctgctcacagagctgg

SEQ ID NO: 9443264 - DNA, 22 bp, Homo sapiens
tcctgtctgtctttggtccctt

SEQ ID NO: 9443265 - DNA, 22 bp, Homo sapiens
tcctgtcttaatgatctcgtgc

SEQ ID NO: 9443266 - DNA, 22 bp, Homo sapiens
tcctgtctgtctttggtccctt

SEQ ID NO: 9443267 - DNA, 22 bp, Homo sapiens
tcctgtctcagtgtatttgcag

SEQ ID NO: 9443268 - DNA, 22 bp, Homo sapiens
tcctgtctaaagacctgcaggc

SEQ ID NO: 9443269 - DNA, 22 bp, Homo sapiens
tcctgtctgctcacagagctgg

SEQ ID NO: 9443270 - DNA, 22 bp, Homo sapiens
tcctgtgcctccacctgctccg

SEQ ID NO: 9443271 - DNA, 21 bp, Homo sapiens
tcctgtgaggacctgtcagtg

SEQ ID NO: 9443272 - DNA, 22 bp, Homo sapiens
tcctgtgcaggctggttgtaga

SEQ ID NO: 9443273 - DNA, 22 bp, Homo sapiens
tcctgtgagcagcacagagaca

SEQ ID NO: 9443274 - DNA, 22 bp, Homo sapiens
tcctgtgaccagcttccatgct

SEQ ID NO: 9443275 - DNA, 22 bp, Homo sapiens
tcctgtgaagaatagcactcaa

SEQ ID NO: 9443276 - DNA, 23 bp, Homo sapiens
tcctgtgaagccatgtttgttgt

SEQ ID NO: 9443277 - DNA, 22 bp, Homo sapiens
tcctgtcttaatgatctcgtgc

SEQ ID NO: 9443278 - DNA, 22 bp, Homo sapiens
tcctggtgtcgcctggtcagtt

SEQ ID NO: 9443279 - DNA, 22 bp, Homo sapiens
tcctggtgtcgcctggtcagtt

SEQ ID NO: 9443280 - DNA, 22 bp, Homo sapiens
tcctggtgtcctggtctgctag

SEQ ID NO: 9443281 - DNA, 22 bp, Homo sapiens
tcctggtgtaatggtaagcatg

SEQ ID NO: 9443282 - DNA, 22 bp, Homo sapiens
tcctggtgtttatgtcacatag

SEQ ID NO: 9443283 - DNA, 22 bp, Homo sapiens
tcctggttagagctctctgggg

SEQ ID NO: 9443284 - DNA, 22 bp, Homo sapiens
tcctggtgtttatgtcacatag

SEQ ID NO: 9443285 - DNA, 22 bp, Homo sapiens
tcctggtgggacagaaaacctc

SEQ ID NO: 9443286 - DNA, 22 bp, Homo sapiens
tcctggtggtctgtgcttcttc

SEQ ID NO: 9443287 - DNA, 22 bp, Homo sapiens
tcctggtggtctgtgcttcttc

SEQ ID NO: 9443288 - DNA, 22 bp, Homo sapiens
tcctggtggtttgaaaactgaa

SEQ ID NO: 9443289 - DNA, 22 bp, Homo sapiens
tcctggtggtgccagctgcagg

SEQ ID NO: 9443290 - DNA, 22 bp, Homo sapiens
tcctggtggtgccagctgcagg

SEQ ID NO: 9443291 - DNA, 22 bp, Homo sapiens
tcctggtttatagactgatggc

SEQ ID NO: 9443292 - DNA, 22 bp, Homo sapiens
tcctggtttatagactgatggc

SEQ ID NO: 9443293 - DNA, 21 bp, Homo sapiens
tcctgtaagcttgggtggctc

SEQ ID NO: 9443294 - DNA, 18 bp, Homo sapiens
tcctggttctgtggccac

SEQ ID NO: 9443295 - DNA, 22 bp, Homo sapiens
tcctgtagttgctaagtttgtt

SEQ ID NO: 9443296 - DNA, 21 bp, Homo sapiens
tcctgtaagcttgggtggctc

SEQ ID NO: 9443297 - DNA, 22 bp, Homo sapiens
tcctgtagttgctaagtttgtt

SEQ ID NO: 9443298 - DNA, 23 bp, Homo sapiens
tcctgtcaagtgcttgttcctgc

SEQ ID NO: 9443299 - DNA, 22 bp, Homo sapiens
tcctgtcagtgaggcagatgaa

SEQ ID NO: 9443300 - DNA, 22 bp, Homo sapiens
tcctgtccacagccctgacctc

SEQ ID NO: 9443301 - DNA, 22 bp, Homo sapiens
tcctgtcctctgggtgccccat

SEQ ID NO: 9443302 - DNA, 20 bp, Homo sapiens
tcctgtccgcgccttgcgtc

SEQ ID NO: 9443303 - DNA, 22 bp, Homo sapiens
tcctgtctaaagacctgcaggc

SEQ ID NO: 9443304 - DNA, 22 bp, Homo sapiens
tcctgtctaaagacctgcaggc

SEQ ID NO: 9443305 - DNA, 22 bp, Homo sapiens
tcctgtctaaagacctgcaggc

SEQ ID NO: 9443306 - DNA, 22 bp, Homo sapiens
tcctgtcctgaggctccaggcc

SEQ ID NO: 9443307 - DNA, 22 bp, Homo sapiens
tcctgtcctgaggctccaggcc

SEQ ID NO: 9443308 - DNA, 22 bp, Homo sapiens
tcctgtcctgaggctccaggcc

SEQ ID NO: 9443309 - DNA, 22 bp, Homo sapiens
tctctggagtataaccagggat

SEQ ID NO: 9443310 - DNA, 21 bp, Homo sapiens
tctctggagttagcagagaga

SEQ ID NO: 9443311 - DNA, 22 bp, Homo sapiens
tctctggagtataaccagggat

SEQ ID NO: 9443312 - DNA, 22 bp, Homo sapiens
tctctggagggctccaggcggg

SEQ ID NO: 9443313 - DNA, 22 bp, Homo sapiens
tctctggaattttgagagtgac

SEQ ID NO: 9443314 - DNA, 22 bp, Homo sapiens
tctctggacttccacctctatt

SEQ ID NO: 9443315 - DNA, 22 bp, Homo sapiens
tctctggactcgagcttactca

SEQ ID NO: 9443316 - DNA, 22 bp, Homo sapiens
tctctggaattggctgaggcaa

SEQ ID NO: 9443317 - DNA, 22 bp, Homo sapiens
tctctggaagcgcagatctgtt

SEQ ID NO: 9443318 - DNA, 21 bp, Homo sapiens
tctctggaattagaccatgtt

SEQ ID NO: 9443319 - DNA, 19 bp, Homo sapiens
tctctgcttctcttggcat

SEQ ID NO: 9443320 - DNA, 22 bp, Homo sapiens
tctctgctctgtgcctcagttt

SEQ ID NO: 9443321 - DNA, 22 bp, Homo sapiens
tctctgctctgtgcctcagttt

SEQ ID NO: 9443322 - DNA, 22 bp, Homo sapiens
tctctgctctgtgcctcagttt

SEQ ID NO: 9443323 - DNA, 22 bp, Homo sapiens
tctctgctaagattgtgtctag

SEQ ID NO: 9443324 - DNA, 22 bp, Homo sapiens
tctctgagttcctgtggatttt

SEQ ID NO: 9443325 - DNA, 22 bp, Homo sapiens
tctctgagttctcctccagccc

SEQ ID NO: 9443326 - DNA, 19 bp, Homo sapiens
tctctgccgatcagggccc

SEQ ID NO: 9443327 - DNA, 22 bp, Homo sapiens
tctctggctggcaccccaggga

SEQ ID NO: 9443328 - DNA, 22 bp, Homo sapiens
tctctggctgatattcctctgc

SEQ ID NO: 9443329 - DNA, 22 bp, Homo sapiens
tctctggctcctgccgggtcca

SEQ ID NO: 9443330 - DNA, 22 bp, Homo sapiens
tctctggccgagagtccctggg

SEQ ID NO: 9443331 - DNA, 22 bp, Homo sapiens
tctctggccgagagtccctggg

SEQ ID NO: 9443332 - DNA, 23 bp, Homo sapiens
tctctggcctttgatcaggttga

SEQ ID NO: 9443333 - DNA, 21 bp, Homo sapiens
tctctggcggtgtttggctcc

SEQ ID NO: 9443334 - DNA, 19 bp, Homo sapiens
tctctggcagttcagagca

SEQ ID NO: 9443335 - DNA, 19 bp, Homo sapiens
tctctggcatagactcaat

SEQ ID NO: 9443336 - DNA, 19 bp, Homo sapiens
tctctggcatagactcaat

SEQ ID NO: 9443337 - DNA, 20 bp, Homo sapiens
tctctggccagaaacaacag

SEQ ID NO: 9443338 - DNA, 22 bp, Homo sapiens
tctctggccccatggctgagct

SEQ ID NO: 9443339 - DNA, 22 bp, Homo sapiens
tctctggccctgttttctatct

SEQ ID NO: 9443340 - DNA, 22 bp, Homo sapiens
tctctggccccatggctgagct

SEQ ID NO: 9443341 - DNA, 21 bp, Homo sapiens
tctctggagttagcagagaga

SEQ ID NO: 9443342 - DNA, 21 bp, Homo sapiens
tctctggagttagcagagaga

SEQ ID NO: 9443343 - DNA, 21 bp, Homo sapiens
tctctggagttagcagagaga

SEQ ID NO: 9443344 - DNA, 19 bp, Homo sapiens
tctctggatgacagacact

SEQ ID NO: 9443345 - DNA, 20 bp, Homo sapiens
tctctggcaagaagctgcag

SEQ ID NO: 9443346 - DNA, 22 bp, Homo sapiens
tctctggcacataataaggtct

SEQ ID NO: 9443347 - DNA, 22 bp, Homo sapiens
tctctggcactcccttatggct

SEQ ID NO: 9443348 - DNA, 19 bp, Homo sapiens
tctctggatgacagacact

SEQ ID NO: 9443349 - DNA, 22 bp, Homo sapiens
tctctggcagacacctccctga

SEQ ID NO: 9443350 - DNA, 22 bp, Homo sapiens
tctctggcagactggctgggct

SEQ ID NO: 9443351 - DNA, 22 bp, Homo sapiens
tctctggcagactggctgggct

SEQ ID NO: 9443352 - DNA, 22 bp, Homo sapiens
tctctggcagaggccctatccc

SEQ ID NO: 9443353 - DNA, 22 bp, Homo sapiens
tctctggcagaggccctatccc

SEQ ID NO: 9443354 - DNA, 22 bp, Homo sapiens
tctctggcagaggccctatccc

SEQ ID NO: 9443355 - DNA, 19 bp, Homo sapiens
tctctggcagttcagagca

SEQ ID NO: 9443356 - DNA, 22 bp, Homo sapiens
tctctggcagggatatctggct

SEQ ID NO: 9443357 - DNA, 22 bp, Homo sapiens
tctctggcagcttgtgctgttg

SEQ ID NO: 9443358 - DNA, 22 bp, Homo sapiens
tctctggcagcttgtgctgttg

SEQ ID NO: 9443359 - DNA, 22 bp, Homo sapiens
tctctgggggtagaactcaggc

SEQ ID NO: 9443360 - DNA, 22 bp, Homo sapiens
tctctggggcctttctacatca

SEQ ID NO: 9443361 - DNA, 22 bp, Homo sapiens
tctctggggcctttctacatca

SEQ ID NO: 9443362 - DNA, 22 bp, Homo sapiens
tctctggggatgcttattcttg

SEQ ID NO: 9443363 - DNA, 22 bp, Homo sapiens
tctctggggatggacctgggag

SEQ ID NO: 9443364 - DNA, 22 bp, Homo sapiens
tctctggggatggacctgggag

SEQ ID NO: 9443365 - DNA, 22 bp, Homo sapiens
tctctgggtattcactgccttc

SEQ ID NO: 9443366 - DNA, 22 bp, Homo sapiens
tctctgggtattcactgccttc

SEQ ID NO: 9443367 - DNA, 22 bp, Homo sapiens
tctctgggtattcactgccttc

SEQ ID NO: 9443368 - DNA, 22 bp, Homo sapiens
tctctgggtatggtaacgttgg

SEQ ID NO: 9443369 - DNA, 22 bp, Homo sapiens
tctctgggtaaagttctctcat

SEQ ID NO: 9443370 - DNA, 22 bp, Homo sapiens
tctctgggtaaagttctctcat

SEQ ID NO: 9443371 - DNA, 22 bp, Homo sapiens
tctctgggtaaagttctctcat

SEQ ID NO: 9443372 - DNA, 22 bp, Homo sapiens
tctctggggtagggcccaggac

SEQ ID NO: 9443373 - DNA, 22 bp, Homo sapiens
tctctggggtagggcccaggac

SEQ ID NO: 9443374 - DNA, 22 bp, Homo sapiens
tctctggggtagggcccaggac

SEQ ID NO: 9443375 - DNA, 22 bp, Homo sapiens
tctctgggttctcactcagcac

SEQ ID NO: 9443376 - DNA, 22 bp, Homo sapiens
tctctgggttctcactcagcac

SEQ ID NO: 9443377 - DNA, 20 bp, Homo sapiens
tctctgggttctcactcagc

SEQ ID NO: 9443378 - DNA, 20 bp, Homo sapiens
tctctgggttctcactcagc

SEQ ID NO: 9443379 - DNA, 20 bp, Homo sapiens
tctctgggttctcactcagc

SEQ ID NO: 9443380 - DNA, 22 bp, Homo sapiens
tctctgggttgagaactaggac

SEQ ID NO: 9443381 - DNA, 22 bp, Homo sapiens
tctctgggttgagaactaggac

SEQ ID NO: 9443382 - DNA, 16 bp, Homo sapiens
tctctgggttgcacag

SEQ ID NO: 9443383 - DNA, 22 bp, Homo sapiens
tctctgggttctcactcagcac

SEQ ID NO: 9443384 - DNA, 22 bp, Homo sapiens
tctctgggttctcactcagcac

SEQ ID NO: 9443385 - DNA, 22 bp, Homo sapiens
tctctgggtctcagtttgtaca

SEQ ID NO: 9443386 - DNA, 22 bp, Homo sapiens
tctctgggtcctggcaagctca

SEQ ID NO: 9443387 - DNA, 22 bp, Homo sapiens
tctctgggtcctggcaagctca

SEQ ID NO: 9443388 - DNA, 22 bp, Homo sapiens
tctctgggtcctggcaagctca

SEQ ID NO: 9443389 - DNA, 22 bp, Homo sapiens
tctctgggtgatggcagggcac

SEQ ID NO: 9443390 - DNA, 22 bp, Homo sapiens
tctctgggtgatggcagggcac

SEQ ID NO: 9443391 - DNA, 22 bp, Homo sapiens
tctctgggtgatggcagggcac

SEQ ID NO: 9443392 - DNA, 22 bp, Homo sapiens
tctctgggtgatggcagggcac

SEQ ID NO: 9443393 - DNA, 23 bp, Homo sapiens
tctctgggtgggctgtgtctata

SEQ ID NO: 9443394 - DNA, 22 bp, Homo sapiens
tctctgggcctccctttccaag

SEQ ID NO: 9443395 - DNA, 22 bp, Homo sapiens
tctctgggcctgttttctcatc

SEQ ID NO: 9443396 - DNA, 22 bp, Homo sapiens
tctctgggcctccctttccaag

SEQ ID NO: 9443397 - DNA, 22 bp, Homo sapiens
tctctgggcctccctttccaag

SEQ ID NO: 9443398 - DNA, 22 bp, Homo sapiens
tctctgggctaaaatcaaggtg

SEQ ID NO: 9443399 - DNA, 22 bp, Homo sapiens
tctctgggctaaaatcaaggtg

SEQ ID NO: 9443400 - DNA, 22 bp, Homo sapiens
tctctgggctaaaatcaaggtg

SEQ ID NO: 9443401 - DNA, 22 bp, Homo sapiens
tctctgggctaaaatcaaggtg

SEQ ID NO: 9443402 - DNA, 22 bp, Homo sapiens
tctctgggcctgttttctcatc

SEQ ID NO: 9443403 - DNA, 22 bp, Homo sapiens
tctctggggatgcttattcttg

SEQ ID NO: 9443404 - DNA, 19 bp, Homo sapiens
tctctggggacactttcac

SEQ ID NO: 9443405 - DNA, 19 bp, Homo sapiens
tctctggggacactttcac

SEQ ID NO: 9443406 - DNA, 19 bp, Homo sapiens
tctctggggacactttcac

SEQ ID NO: 9443407 - DNA, 22 bp, Homo sapiens
tctctgggctcaggagcccggc

SEQ ID NO: 9443408 - DNA, 22 bp, Homo sapiens
tctctgggctcaggagcccggc

SEQ ID NO: 9443409 - DNA, 22 bp, Homo sapiens
tctctggggaaaaggctgatac

SEQ ID NO: 9443410 - DNA, 22 bp, Homo sapiens
tctctggggaaaaggctgatac

SEQ ID NO: 9443411 - DNA, 22 bp, Homo sapiens
tctctggggaaaaggctgatac

SEQ ID NO: 9443412 - DNA, 22 bp, Homo sapiens
tctctgggctcaggagcccggc

SEQ ID NO: 9443413 - DNA, 19 bp, Homo sapiens
tctctggcttgtctgcctg

SEQ ID NO: 9443414 - DNA, 19 bp, Homo sapiens
tctctggcttgtctgcctg

SEQ ID NO: 9443415 - DNA, 22 bp, Homo sapiens
tctctggctggcaccccaggga

SEQ ID NO: 9443416 - DNA, 22 bp, Homo sapiens
tctctggcttaggttgagtgca

SEQ ID NO: 9443417 - DNA, 22 bp, Homo sapiens
tctctgggatcaggtggcccag

SEQ ID NO: 9443418 - DNA, 22 bp, Homo sapiens
tctctgggatcaggtggcccag

SEQ ID NO: 9443419 - DNA, 22 bp, Homo sapiens
tctctgggatcaggtggcccag

SEQ ID NO: 9443420 - DNA, 22 bp, Homo sapiens
tctctgggatcgttttgggctc

SEQ ID NO: 9443421 - DNA, 22 bp, Homo sapiens
tctctgggatcaggtggcccag

SEQ ID NO: 9443422 - DNA, 22 bp, Homo sapiens
tctctgggatcgttttgggctc

SEQ ID NO: 9443423 - DNA, 22 bp, Homo sapiens
tctctgggcccagaccttcctt

SEQ ID NO: 9443424 - DNA, 22 bp, Homo sapiens
tctctgggcccagaccttcctt

SEQ ID NO: 9443425 - DNA, 22 bp, Homo sapiens
tctctgggcccagaccttcctt

SEQ ID NO: 9443426 - DNA, 21 bp, Homo sapiens
tctctgggccctcctgtgggg

SEQ ID NO: 9443427 - DNA, 22 bp, Homo sapiens
tctctgggcctcagttttctca

SEQ ID NO: 9443428 - DNA, 22 bp, Homo sapiens
tctctgggcctcagttttctca

SEQ ID NO: 9443429 - DNA, 21 bp, Homo sapiens
tctctgggccctcctgtgggg

SEQ ID NO: 9443430 - DNA, 22 bp, Homo sapiens
tctctctttttaatcatgtaat

SEQ ID NO: 9443431 - DNA, 22 bp, Homo sapiens
tctctctttttaatcatgtaat

SEQ ID NO: 9443432 - DNA, 22 bp, Homo sapiens
tctctctgccaactcacagcca

SEQ ID NO: 9443433 - DNA, 22 bp, Homo sapiens
tctctgaagatatttattatta

SEQ ID NO: 9443434 - DNA, 22 bp, Homo sapiens
tctctgaagagtcagacataac

SEQ ID NO: 9443435 - DNA, 22 bp, Homo sapiens
tctctgaagatatttattatta

SEQ ID NO: 9443436 - DNA, 22 bp, Homo sapiens
tctctgaagagtcagacataac

SEQ ID NO: 9443437 - DNA, 22 bp, Homo sapiens
tctctctttttaatcatgtaat

SEQ ID NO: 9443438 - DNA, 22 bp, Homo sapiens
tctctgaaagcagctgctcatc

SEQ ID NO: 9443439 - DNA, 22 bp, Homo sapiens
tctctgaaagcagctgctcatc

SEQ ID NO: 9443440 - DNA, 22 bp, Homo sapiens
tctctgaaggctgtgttgatgg

SEQ ID NO: 9443441 - DNA, 22 bp, Homo sapiens
tctctgaagctgttgtagtctc

SEQ ID NO: 9443442 - DNA, 22 bp, Homo sapiens
tctctgaaggggagctgtttaa

SEQ ID NO: 9443443 - DNA, 22 bp, Homo sapiens
tctctgacagtgaaagagttca

SEQ ID NO: 9443444 - DNA, 22 bp, Homo sapiens
tctctgaattgtttaagttatt

SEQ ID NO: 9443445 - DNA, 22 bp, Homo sapiens
tctctgaattgtttaagttatt

SEQ ID NO: 9443446 - DNA, 22 bp, Homo sapiens
tctctgaattctgatgcaagtg

SEQ ID NO: 9443447 - DNA, 22 bp, Homo sapiens
tctctgaattctgatgcaagtg

SEQ ID NO: 9443448 - DNA, 18 bp, Homo sapiens
tctctgaatattttatgt

SEQ ID NO: 9443449 - DNA, 18 bp, Homo sapiens
tctctgaatattttatgt

SEQ ID NO: 9443450 - DNA, 22 bp, Homo sapiens
tctctgagaagttcctttgtga

SEQ ID NO: 9443451 - DNA, 22 bp, Homo sapiens
tctctgagaagctgaggctggg

SEQ ID NO: 9443452 - DNA, 22 bp, Homo sapiens
tctctgacttgatgcaatggcc

SEQ ID NO: 9443453 - DNA, 22 bp, Homo sapiens
tctctgagaaacatgttcaaag

SEQ ID NO: 9443454 - DNA, 22 bp, Homo sapiens
tctctgagaaacatgttcaaag

SEQ ID NO: 9443455 - DNA, 22 bp, Homo sapiens
tctctgagaagctgaggctggg

SEQ ID NO: 9443456 - DNA, 22 bp, Homo sapiens
tctctgagaatatcccataaga

SEQ ID NO: 9443457 - DNA, 22 bp, Homo sapiens
tctctgagaatatcccataaga

SEQ ID NO: 9443458 - DNA, 22 bp, Homo sapiens
tctctgacatgcctaagacttt

SEQ ID NO: 9443459 - DNA, 22 bp, Homo sapiens
tctctgaccaagagaattggta

SEQ ID NO: 9443460 - DNA, 22 bp, Homo sapiens
tctctgaccaagagaattggta

SEQ ID NO: 9443461 - DNA, 22 bp, Homo sapiens
tctctgaccactgagggattta

SEQ ID NO: 9443462 - DNA, 21 bp, Homo sapiens
tctctgacccaggaagagggc

SEQ ID NO: 9443463 - DNA, 22 bp, Homo sapiens
tctctgactcatatttgtgcct

SEQ ID NO: 9443464 - DNA, 22 bp, Homo sapiens
tctctgactaggtctgattttc

SEQ ID NO: 9443465 - DNA, 22 bp, Homo sapiens
tctctgactggcctttcacctg

SEQ ID NO: 9443466 - DNA, 22 bp, Homo sapiens
tctctgactggcctttcacctg

SEQ ID NO: 9443467 - DNA, 20 bp, Homo sapiens
tctctgacttctccccgcct

SEQ ID NO: 9443468 - DNA, 22 bp, Homo sapiens
tctctgaggttgtttccagcac

SEQ ID NO: 9443469 - DNA, 22 bp, Homo sapiens
tctctgaggttgtttccagcac

SEQ ID NO: 9443470 - DNA, 22 bp, Homo sapiens
tctctgaggttgtttccagcac

SEQ ID NO: 9443471 - DNA, 22 bp, Homo sapiens
tctctgagtaagtgacagttca

SEQ ID NO: 9443472 - DNA, 22 bp, Homo sapiens
tctctgagggagatggcctgcc

SEQ ID NO: 9443473 - DNA, 22 bp, Homo sapiens
tctctgaggcaggatgcgtagg

SEQ ID NO: 9443474 - DNA, 22 bp, Homo sapiens
tctctgaggcaggatgcgtagg

SEQ ID NO: 9443475 - DNA, 22 bp, Homo sapiens
tctctgagggagatggcctgcc

SEQ ID NO: 9443476 - DNA, 22 bp, Homo sapiens
tctctgagggagatggcctgcc

SEQ ID NO: 9443477 - DNA, 22 bp, Homo sapiens
tctctgagggagatggcctgcc

SEQ ID NO: 9443478 - DNA, 22 bp, Homo sapiens
tctctgagtatcctgaactgcc

SEQ ID NO: 9443479 - DNA, 22 bp, Homo sapiens
tctctgagttctcctccagccc

SEQ ID NO: 9443480 - DNA, 16 bp, Homo sapiens
tctctgagtgctaagt

SEQ ID NO: 9443481 - DNA, 22 bp, Homo sapiens
tctctgagtcaccgtggagacg

SEQ ID NO: 9443482 - DNA, 22 bp, Homo sapiens
tctctgagtcaccgtggagacg

SEQ ID NO: 9443483 - DNA, 22 bp, Homo sapiens
tctctgagctgcttcttgcata

SEQ ID NO: 9443484 - DNA, 22 bp, Homo sapiens
tctctgagctcaggagctgcag

SEQ ID NO: 9443485 - DNA, 22 bp, Homo sapiens
tctctgagctcaggagctgcag

SEQ ID NO: 9443486 - DNA, 22 bp, Homo sapiens
tctctgagctcaggagctgcag

SEQ ID NO: 9443487 - DNA, 22 bp, Homo sapiens
tctctgagctcaggagctgcag

SEQ ID NO: 9443488 - DNA, 22 bp, Homo sapiens
tctctgagctcaggagctgcag

SEQ ID NO: 9443489 - DNA, 22 bp, Homo sapiens
tctctgagctgcttcttgcata

SEQ ID NO: 9443490 - DNA, 22 bp, Homo sapiens
tctctgagctgcttcttgcata

SEQ ID NO: 9443491 - DNA, 20 bp, Homo sapiens
tctctgagcttctcttgggg

SEQ ID NO: 9443492 - DNA, 20 bp, Homo sapiens
tctctgagcttctcttgggg

SEQ ID NO: 9443493 - DNA, 22 bp, Homo sapiens
tctctgagctggatttgttctt

SEQ ID NO: 9443494 - DNA, 22 bp, Homo sapiens
tctctgagcttaaggtgtttca

SEQ ID NO: 9443495 - DNA, 22 bp, Homo sapiens
tctctgaggaagaggctgtaat

SEQ ID NO: 9443496 - DNA, 20 bp, Homo sapiens
tctctgagcttctcttgggg

SEQ ID NO: 9443497 - DNA, 22 bp, Homo sapiens
tctctgagcgcattcctccggc

SEQ ID NO: 9443498 - DNA, 22 bp, Homo sapiens
tctctgagcgcattcctccggc

SEQ ID NO: 9443499 - DNA, 22 bp, Homo sapiens
tctctgagcgcattcctccggc

SEQ ID NO: 9443500 - DNA, 22 bp, Homo sapiens
tctctgagcgcattcctccggc

SEQ ID NO: 9443501 - DNA, 22 bp, Homo sapiens
tctctgagcccctgcctctttc

SEQ ID NO: 9443502 - DNA, 22 bp, Homo sapiens
tctctgagcccagtgtccccct

SEQ ID NO: 9443503 - DNA, 22 bp, Homo sapiens
tctctgagcccctgcctctttc

SEQ ID NO: 9443504 - DNA, 22 bp, Homo sapiens
tctctgagcccctgcctctttc

SEQ ID NO: 9443505 - DNA, 22 bp, Homo sapiens
tctctgagcccaatgtagcaat

SEQ ID NO: 9443506 - DNA, 23 bp, Homo sapiens
tctctgagccatagcagtcccaa

SEQ ID NO: 9443507 - DNA, 23 bp, Homo sapiens
tctctgagccatagcagtcccaa

SEQ ID NO: 9443508 - DNA, 23 bp, Homo sapiens
tctctgagccatagcagtcccaa

SEQ ID NO: 9443509 - DNA, 22 bp, Homo sapiens
tctctgagcccagtgtccccct

SEQ ID NO: 9443510 - DNA, 21 bp, Homo sapiens
tctctgagcccaccaggatct

SEQ ID NO: 9443511 - DNA, 22 bp, Homo sapiens
tctctgagcccaatgtagcaat

SEQ ID NO: 9443512 - DNA, 21 bp, Homo sapiens
tctctgagcccaccaggatct

SEQ ID NO: 9443513 - DNA, 21 bp, Homo sapiens
tctctgagcccaccaggatct

SEQ ID NO: 9443514 - DNA, 22 bp, Homo sapiens
tctctgagcccaatgtagcaat

SEQ ID NO: 9443515 - DNA, 22 bp, Homo sapiens
tctctgagcatgccatattgct

SEQ ID NO: 9443516 - DNA, 22 bp, Homo sapiens
tctctgagcaccagtgtattcg

SEQ ID NO: 9443517 - DNA, 22 bp, Homo sapiens
tctctgagcatgccatattgct

SEQ ID NO: 9443518 - DNA, 22 bp, Homo sapiens
tctctgagatcagccactgact

SEQ ID NO: 9443519 - DNA, 22 bp, Homo sapiens
tctctgagatcagccactgact

SEQ ID NO: 9443520 - DNA, 22 bp, Homo sapiens
tctctgagatcagccactgact

SEQ ID NO: 9443521 - DNA, 21 bp, Homo sapiens
tctctgagaggtctgcttaga

SEQ ID NO: 9443522 - DNA, 21 bp, Homo sapiens
tctctgagaggtctgcttaga

SEQ ID NO: 9443523 - DNA, 22 bp, Homo sapiens
tctctgagacagtagcctctgc

SEQ ID NO: 9443524 - DNA, 21 bp, Homo sapiens
tctctgagacactctggagcc

SEQ ID NO: 9443525 - DNA, 21 bp, Homo sapiens
tctctgagacactctggagcc

SEQ ID NO: 9443526 - DNA, 22 bp, Homo sapiens
tctctgagacagtagcctctgc

SEQ ID NO: 9443527 - DNA, 22 bp, Homo sapiens
tctctgagacagtagcctctgc

SEQ ID NO: 9443528 - DNA, 22 bp, Homo sapiens
tctctgagacagtagcctctgc

SEQ ID NO: 9443529 - DNA, 22 bp, Homo sapiens
tctctgagacagtagcctctgc

SEQ ID NO: 9443530 - DNA, 22 bp, Homo sapiens
tctctgagacagtagcctctgc

SEQ ID NO: 9443531 - DNA, 22 bp, Homo sapiens
tctctcctgtgttctgatgttt

SEQ ID NO: 9443532 - DNA, 22 bp, Homo sapiens
tctctccttatcattgtgttta

SEQ ID NO: 9443533 - DNA, 22 bp, Homo sapiens
tctctccttatcattgtgttta

SEQ ID NO: 9443534 - DNA, 22 bp, Homo sapiens
tctctctcagccattacagaac

SEQ ID NO: 9443535 - DNA, 18 bp, Homo sapiens
tctctctgaagagttccc

SEQ ID NO: 9443536 - DNA, 18 bp, Homo sapiens
tctctctgaagagttccc

SEQ ID NO: 9443537 - DNA, 22 bp, Homo sapiens
tctctcctgtgttctgatgttt

SEQ ID NO: 9443538 - DNA, 21 bp, Homo sapiens
tctctcctcaagctcgacccc

SEQ ID NO: 9443539 - DNA, 22 bp, Homo sapiens
tctctccctttccttatcagtt

SEQ ID NO: 9443540 - DNA, 22 bp, Homo sapiens
tctctccctttccttatcagtt

SEQ ID NO: 9443541 - DNA, 22 bp, Homo sapiens
tctctccctttccttatcagtt

SEQ ID NO: 9443542 - DNA, 22 bp, Homo sapiens
tctctcccaaatctgcagatag

SEQ ID NO: 9443543 - DNA, 22 bp, Homo sapiens
tctctcccaaatctgcagatag

SEQ ID NO: 9443544 - DNA, 22 bp, Homo sapiens
tctctcccctggccgctacgcg

SEQ ID NO: 9443545 - DNA, 22 bp, Homo sapiens
tctctcccaaatctgcagatag

SEQ ID NO: 9443546 - DNA, 22 bp, Homo sapiens
tctctcactggtgcctctgttg

SEQ ID NO: 9443547 - DNA, 20 bp, Homo sapiens
tctctcacgggttggtttct

SEQ ID NO: 9443548 - DNA, 20 bp, Homo sapiens
tctctattcccacgaggaaa

SEQ ID NO: 9443549 - DNA, 22 bp, Homo sapiens
tctctatttgcctaggcttgtg

SEQ ID NO: 9443550 - DNA, 22 bp, Homo sapiens
tctctattaattgacaatggct

SEQ ID NO: 9443551 - DNA, 22 bp, Homo sapiens
tctctattaattgacaatggct

SEQ ID NO: 9443552 - DNA, 22 bp, Homo sapiens
tctctcagactccccatggttt

SEQ ID NO: 9443553 - DNA, 22 bp, Homo sapiens
tctctcagaggaagaggcagtg

SEQ ID NO: 9443554 - DNA, 22 bp, Homo sapiens
tctctcagaggaagaggcagtg

SEQ ID NO: 9443555 - DNA, 22 bp, Homo sapiens
tctctcagaggaagaggcagtg

SEQ ID NO: 9443556 - DNA, 22 bp, Homo sapiens
tctctcagaaagcccatgtctg

SEQ ID NO: 9443557 - DNA, 22 bp, Homo sapiens
tctctcagaaagcccatgtctg

SEQ ID NO: 9443558 - DNA, 22 bp, Homo sapiens
tctctcagaaagcccatgtctg

SEQ ID NO: 9443559 - DNA, 22 bp, Homo sapiens
tctctcagaaagcccatgtctg

SEQ ID NO: 9443560 - DNA, 22 bp, Homo sapiens
tctctcagaactgcagctgcag

SEQ ID NO: 9443561 - DNA, 22 bp, Homo sapiens
tctctcatagagaaaaatatat

SEQ ID NO: 9443562 - DNA, 22 bp, Homo sapiens
tctctccaacatggtggtgctg

SEQ ID NO: 9443563 - DNA, 18 bp, Homo sapiens
tctctcagggaaacagaa

SEQ ID NO: 9443564 - DNA, 22 bp, Homo sapiens
tctctcaggctggagtgcagtg

SEQ ID NO: 9443565 - DNA, 22 bp, Homo sapiens
tctctcagggggaaggctgaag

SEQ ID NO: 9443566 - DNA, 22 bp, Homo sapiens
tctctcagggggaaggctgaag

SEQ ID NO: 9443567 - DNA, 22 bp, Homo sapiens
tctctcagctttgagacctgct

SEQ ID NO: 9443568 - DNA, 22 bp, Homo sapiens
tctctcaggaggcaggttccta

SEQ ID NO: 9443569 - DNA, 22 bp, Homo sapiens
tctctcagctttgagacctgct

SEQ ID NO: 9443570 - DNA, 22 bp, Homo sapiens
tctctcagctttgagacctgct

SEQ ID NO: 9443571 - DNA, 22 bp, Homo sapiens
tctctcaggctggagtgcagtg

SEQ ID NO: 9443572 - DNA, 22 bp, Homo sapiens
tctctcaggctggagtgcagtg

SEQ ID NO: 9443573 - DNA, 22 bp, Homo sapiens
tctctcaggctggagtgcagtg

SEQ ID NO: 9443574 - DNA, 22 bp, Homo sapiens
tctctcaggctggagtgcagtg

SEQ ID NO: 9443575 - DNA, 22 bp, Homo sapiens
tctctcagaggaagaggcagtg

SEQ ID NO: 9443576 - DNA, 22 bp, Homo sapiens
tctctcagaggccagggtcctg

SEQ ID NO: 9443577 - DNA, 22 bp, Homo sapiens
tctctcagatggggcactagta

SEQ ID NO: 9443578 - DNA, 22 bp, Homo sapiens
tctctcagatggggcactagta

SEQ ID NO: 9443579 - DNA, 22 bp, Homo sapiens
tctctcagatggggcactagta

SEQ ID NO: 9443580 - DNA, 22 bp, Homo sapiens
tctctcagatggggcactagta

SEQ ID NO: 9443581 - DNA, 22 bp, Homo sapiens
tctctgtggcaagcatgctgct

SEQ ID NO: 9443582 - DNA, 22 bp, Homo sapiens
tctctgtgcttgactttcccat

SEQ ID NO: 9443583 - DNA, 22 bp, Homo sapiens
tctctgtggagcagtgtgttca

SEQ ID NO: 9443584 - DNA, 22 bp, Homo sapiens
tctctgtgggtttcaccagcgc

SEQ ID NO: 9443585 - DNA, 22 bp, Homo sapiens
tctctgtgagatttgtattaag

SEQ ID NO: 9443586 - DNA, 22 bp, Homo sapiens
tctctgtgagatgccttcctga

SEQ ID NO: 9443587 - DNA, 22 bp, Homo sapiens
tctctgtgaagctcccgttagg

SEQ ID NO: 9443588 - DNA, 22 bp, Homo sapiens
tctctgtgacatttctgagcct

SEQ ID NO: 9443589 - DNA, 22 bp, Homo sapiens
tctctgtgactgcagctttgca

SEQ ID NO: 9443590 - DNA, 22 bp, Homo sapiens
tctctgtgagatgccttcctga

SEQ ID NO: 9443591 - DNA, 22 bp, Homo sapiens
tctctgggtttttgtcctgtac

SEQ ID NO: 9443592 - DNA, 22 bp, Homo sapiens
tctctgggtttttgtcctgtac

SEQ ID NO: 9443593 - DNA, 22 bp, Homo sapiens
tctctgggtttttgtcctgtac

SEQ ID NO: 9443594 - DNA, 22 bp, Homo sapiens
tctctgggtttttgtcctgtac

SEQ ID NO: 9443595 - DNA, 21 bp, Homo sapiens
tctctggttctgaaatggttt

SEQ ID NO: 9443596 - DNA, 22 bp, Homo sapiens
tctctgtcacacaatctacaca

SEQ ID NO: 9443597 - DNA, 22 bp, Homo sapiens
tctctgtccctaggagccttgc

SEQ ID NO: 9443598 - DNA, 22 bp, Homo sapiens
tctctgtctgagcctggcagac

SEQ ID NO: 9443599 - DNA, 22 bp, Homo sapiens
tctctgtctttgttgtcttcac

SEQ ID NO: 9443600 - DNA, 22 bp, Homo sapiens
tctctgtctgagcctggcagac

SEQ ID NO: 9443601 - DNA, 22 bp, Homo sapiens
tctcttattttgcctttgacaa

SEQ ID NO: 9443602 - DNA, 22 bp, Homo sapiens
tctcttaggagaaattcataaa

SEQ ID NO: 9443603 - DNA, 22 bp, Homo sapiens
tctcttagtcttatatgtaaaa

SEQ ID NO: 9443604 - DNA, 22 bp, Homo sapiens
tctcttcacatgcttgctccaa

SEQ ID NO: 9443605 - DNA, 22 bp, Homo sapiens
tctcttcagcccattataaggg

SEQ ID NO: 9443606 - DNA, 22 bp, Homo sapiens
tctcttcatagtgacacccatc

SEQ ID NO: 9443607 - DNA, 22 bp, Homo sapiens
tctcttaatccggtgctttctg

SEQ ID NO: 9443608 - DNA, 22 bp, Homo sapiens
tctcttagtcttatatgtaaaa

SEQ ID NO: 9443609 - DNA, 23 bp, Homo sapiens
tctcttacctgagacatttccta

SEQ ID NO: 9443610 - DNA, 22 bp, Homo sapiens
tctcttaggagaaattcataaa

SEQ ID NO: 9443611 - DNA, 22 bp, Homo sapiens
tctcttcccctttcctttaaca

SEQ ID NO: 9443612 - DNA, 22 bp, Homo sapiens
tctcttcccggataaagtaagt

SEQ ID NO: 9443613 - DNA, 22 bp, Homo sapiens
tctcttccagtaagagtcttta

SEQ ID NO: 9443614 - DNA, 22 bp, Homo sapiens
tctcttctaacactagaaattc

SEQ ID NO: 9443615 - DNA, 22 bp, Homo sapiens
tctcttctaacactagaaattc

SEQ ID NO: 9443616 - DNA, 22 bp, Homo sapiens
tctcttccttgacctattgtaa

SEQ ID NO: 9443617 - DNA, 22 bp, Homo sapiens
tctcttctaacactagaaattc

SEQ ID NO: 9443618 - DNA, 22 bp, Homo sapiens
tctcttcctcagcctggggcct

SEQ ID NO: 9443619 - DNA, 22 bp, Homo sapiens
tctcttctgacctagccttgga

SEQ ID NO: 9443620 - DNA, 20 bp, Homo sapiens
tctcttctggggagataaaa

SEQ ID NO: 9443621 - DNA, 22 bp, Homo sapiens
tctcttctgaaacctgtcttta

SEQ ID NO: 9443622 - DNA, 22 bp, Homo sapiens
tctcttctgaaacctgtcttta

SEQ ID NO: 9443623 - DNA, 22 bp, Homo sapiens
tctcttctgaaacctgtcttta

SEQ ID NO: 9443624 - DNA, 18 bp, Homo sapiens
tctcttcttggcagtcaa

SEQ ID NO: 9443625 - DNA, 18 bp, Homo sapiens
tctcttcttggcagtcaa

SEQ ID NO: 9443626 - DNA, 18 bp, Homo sapiens
tctcttcttggcagtcaa

SEQ ID NO: 9443627 - DNA, 22 bp, Homo sapiens
tctcttcttgtgttttcctgcc

SEQ ID NO: 9443628 - DNA, 22 bp, Homo sapiens
tctcttcttgattttcactgga

SEQ ID NO: 9443629 - DNA, 22 bp, Homo sapiens
tctcttcttgattttcactgga

SEQ ID NO: 9443630 - DNA, 22 bp, Homo sapiens
tctcttcttgattttcactgga

SEQ ID NO: 9443631 - DNA, 22 bp, Homo sapiens
tctcttctatttgagactattt

SEQ ID NO: 9443632 - DNA, 22 bp, Homo sapiens
tctcttctatttgagactattt

SEQ ID NO: 9443633 - DNA, 22 bp, Homo sapiens
tctcttctagcttcttgtggtt

SEQ ID NO: 9443634 - DNA, 22 bp, Homo sapiens
tctcttctaattagggtccatg

SEQ ID NO: 9443635 - DNA, 22 bp, Homo sapiens
tctcttctaattttcccgagta

SEQ ID NO: 9443636 - DNA, 22 bp, Homo sapiens
tctcttctatttgagactattt

SEQ ID NO: 9443637 - DNA, 22 bp, Homo sapiens
tctcttctatttgagactattt

SEQ ID NO: 9443638 - DNA, 22 bp, Homo sapiens
tctcttctgaaacctgtcttta

SEQ ID NO: 9443639 - DNA, 22 bp, Homo sapiens
tctcttctctagtgagcaactg

SEQ ID NO: 9443640 - DNA, 19 bp, Homo sapiens
tctcttctccctggtttta

SEQ ID NO: 9443641 - DNA, 22 bp, Homo sapiens
tctgaagagtcttgcaagaaag

SEQ ID NO: 9443642 - DNA, 22 bp, Homo sapiens
tctgaagagtcatctttgggtg

SEQ ID NO: 9443643 - DNA, 22 bp, Homo sapiens
tctgaagaggctcttgataaga

SEQ ID NO: 9443644 - DNA, 22 bp, Homo sapiens
tctgaagagctttggaagtatg

SEQ ID NO: 9443645 - DNA, 22 bp, Homo sapiens
tctgaagagaatgctgctgaac

SEQ ID NO: 9443646 - DNA, 19 bp, Homo sapiens
tctgaagaattagagagca

SEQ ID NO: 9443647 - DNA, 19 bp, Homo sapiens
tctgaagaattagagagca

SEQ ID NO: 9443648 - DNA, 19 bp, Homo sapiens
tctgaagaattagagagca

SEQ ID NO: 9443649 - DNA, 22 bp, Homo sapiens
tctgaagacatatgatatggtg

SEQ ID NO: 9443650 - DNA, 22 bp, Homo sapiens
tctgaagagtcttgcaagaaag

SEQ ID NO: 9443651 - DNA, 22 bp, Homo sapiens
tctgaagagtcttgcaagaaag

SEQ ID NO: 9443652 - DNA, 22 bp, Homo sapiens
tctgaagagtcttgcaagaaag

SEQ ID NO: 9443653 - DNA, 22 bp, Homo sapiens
tctgaagattaccagctaaatg

SEQ ID NO: 9443654 - DNA, 22 bp, Homo sapiens
tctgaagattaccagctaaatg

SEQ ID NO: 9443655 - DNA, 22 bp, Homo sapiens
tctgaagattaccagctaaatg

SEQ ID NO: 9443656 - DNA, 22 bp, Homo sapiens
tctgaagattaccagctaaatg

SEQ ID NO: 9443657 - DNA, 22 bp, Homo sapiens
tctgaagattctttccactatt

SEQ ID NO: 9443658 - DNA, 22 bp, Homo sapiens
tctgaagcacagcaggaagggt

SEQ ID NO: 9443659 - DNA, 22 bp, Homo sapiens
tctgaagccacctctgcttgtc

SEQ ID NO: 9443660 - DNA, 22 bp, Homo sapiens
tctgaaggtctgagaaccagga

SEQ ID NO: 9443661 - DNA, 22 bp, Homo sapiens
tctgaagggctgagtggaggag

SEQ ID NO: 9443662 - DNA, 22 bp, Homo sapiens
tctgaaggtctgagaaccagga

SEQ ID NO: 9443663 - DNA, 22 bp, Homo sapiens
tctgaaggtgctagagaaagct

SEQ ID NO: 9443664 - DNA, 22 bp, Homo sapiens
tctgaattttaactacacaaag

SEQ ID NO: 9443665 - DNA, 22 bp, Homo sapiens
tctgaaggttgagaagggctga

SEQ ID NO: 9443666 - DNA, 22 bp, Homo sapiens
tctgaaggtgctagagaaagct

SEQ ID NO: 9443667 - DNA, 21 bp, Homo sapiens
tctgaaggcattttccaaggt

SEQ ID NO: 9443668 - DNA, 22 bp, Homo sapiens
tctgaaggcctggagggtccca

SEQ ID NO: 9443669 - DNA, 22 bp, Homo sapiens
tctgaaggattttgtactcaaa

SEQ ID NO: 9443670 - DNA, 18 bp, Homo sapiens
tctgaaggaatgattcca

SEQ ID NO: 9443671 - DNA, 18 bp, Homo sapiens
tctgaaggaatgattcca

SEQ ID NO: 9443672 - DNA, 22 bp, Homo sapiens
tctgaagcctttgtacaggcct

SEQ ID NO: 9443673 - DNA, 17 bp, Homo sapiens
tctgaagccagtctgct

SEQ ID NO: 9443674 - DNA, 22 bp, Homo sapiens
tctgaaggaaaagggtagatat

SEQ ID NO: 9443675 - DNA, 22 bp, Homo sapiens
tctgaagctggaggaagctttg

SEQ ID NO: 9443676 - DNA, 20 bp, Homo sapiens
tctgaacaaaatgtaatgtc

SEQ ID NO: 9443677 - DNA, 22 bp, Homo sapiens
tctgaagaactgtctagagaac

SEQ ID NO: 9443678 - DNA, 22 bp, Homo sapiens
tctgaagaactgtctagagaac

SEQ ID NO: 9443679 - DNA, 22 bp, Homo sapiens
tctgaagaactgtctagagaac

SEQ ID NO: 9443680 - DNA, 22 bp, Homo sapiens
tctgaagaactgtctagagaac

SEQ ID NO: 9443681 - DNA, 22 bp, Homo sapiens
tctgaagaactgagtaaacatg

SEQ ID NO: 9443682 - DNA, 22 bp, Homo sapiens
tctgaagaaatacagctggggt

SEQ ID NO: 9443683 - DNA, 20 bp, Homo sapiens
tctgaagaaagacagggact

SEQ ID NO: 9443684 - DNA, 22 bp, Homo sapiens
tctgaactccagccctgctctc

SEQ ID NO: 9443685 - DNA, 20 bp, Homo sapiens
tctgaagaaagacagggact

SEQ ID NO: 9443686 - DNA, 22 bp, Homo sapiens
tctgaaataggaaagcaaatgg

SEQ ID NO: 9443687 - DNA, 22 bp, Homo sapiens
tctgaaatagaagtgtctttct

SEQ ID NO: 9443688 - DNA, 22 bp, Homo sapiens
tctgaaattccttccagacttt

SEQ ID NO: 9443689 - DNA, 22 bp, Homo sapiens
tctgaaagccctagtttgtaat

SEQ ID NO: 9443690 - DNA, 22 bp, Homo sapiens
tctgaaagctagaaaatgctct

SEQ ID NO: 9443691 - DNA, 22 bp, Homo sapiens
tctgaaagtctgaaacagtgtc

SEQ ID NO: 9443692 - DNA, 22 bp, Homo sapiens
tctgaaagtatctggatctttt

SEQ ID NO: 9443693 - DNA, 22 bp, Homo sapiens
tctgaaataagggagaagggaa

SEQ ID NO: 9443694 - DNA, 22 bp, Homo sapiens
tctgaaagagagtacatacagt

SEQ ID NO: 9443695 - DNA, 22 bp, Homo sapiens
tctgaaaatgttgactttgttt

SEQ ID NO: 9443696 - DNA, 22 bp, Homo sapiens
tctgaaagaaagattttgtttc

SEQ ID NO: 9443697 - DNA, 20 bp, Homo sapiens
tctcttttagcttacagctg

SEQ ID NO: 9443698 - DNA, 20 bp, Homo sapiens
tctcttttagcttacagctg

SEQ ID NO: 9443699 - DNA, 20 bp, Homo sapiens
tctcttttagcttacagctg

SEQ ID NO: 9443700 - DNA, 22 bp, Homo sapiens
tctctttgtggccaggagagga

SEQ ID NO: 9443701 - DNA, 22 bp, Homo sapiens
tctctttgtggccaggagagga

SEQ ID NO: 9443702 - DNA, 22 bp, Homo sapiens
tctctttgtctgctcttagttg

SEQ ID NO: 9443703 - DNA, 22 bp, Homo sapiens
tctctttgtctgctcttagttg

SEQ ID NO: 9443704 - DNA, 22 bp, Homo sapiens
tctctttgtctgctcttagttg

SEQ ID NO: 9443705 - DNA, 22 bp, Homo sapiens
tctctttaagtataatcttata

SEQ ID NO: 9443706 - DNA, 22 bp, Homo sapiens
tctctttaagtataatcttata

SEQ ID NO: 9443707 - DNA, 22 bp, Homo sapiens
tctctttaaagactcagagatt

SEQ ID NO: 9443708 - DNA, 23 bp, Homo sapiens
tctctttcaagagcttaatgtgc

SEQ ID NO: 9443709 - DNA, 22 bp, Homo sapiens
tctctttaaaaatagtgaaata

SEQ ID NO: 9443710 - DNA, 22 bp, Homo sapiens
tctctttaaagactcagagatt

SEQ ID NO: 9443711 - DNA, 22 bp, Homo sapiens
tctctttaaaaatagtgaaata

SEQ ID NO: 9443712 - DNA, 17 bp, Homo sapiens
tctcttgttcactgctg

SEQ ID NO: 9443713 - DNA, 22 bp, Homo sapiens
tctcttcttgtgttttcctgcc

SEQ ID NO: 9443714 - DNA, 22 bp, Homo sapiens
tctctttgaccctttagctcca

SEQ ID NO: 9443715 - DNA, 22 bp, Homo sapiens
tctctttgcctgctgccatcca

SEQ ID NO: 9443716 - DNA, 21 bp, Homo sapiens
tctctttgggaacattaatca

SEQ ID NO: 9443717 - DNA, 22 bp, Homo sapiens
tctctttctttgtatgtctatt

SEQ ID NO: 9443718 - DNA, 22 bp, Homo sapiens
tctcagagtggtggtccctctg

SEQ ID NO: 9443719 - DNA, 22 bp, Homo sapiens
tctcagagtggtggtccctctg

SEQ ID NO: 9443720 - DNA, 22 bp, Homo sapiens
tctcagagttcctctggagtcc

SEQ ID NO: 9443721 - DNA, 22 bp, Homo sapiens
tctcagagggaaacatgagtga

SEQ ID NO: 9443722 - DNA, 22 bp, Homo sapiens
tctcagagggaaacatgagtga

SEQ ID NO: 9443723 - DNA, 22 bp, Homo sapiens
tctcagaggtcttcagcctctg

SEQ ID NO: 9443724 - DNA, 22 bp, Homo sapiens
tctcagaggtcttcagcctctg

SEQ ID NO: 9443725 - DNA, 22 bp, Homo sapiens
tctcagaggtgccctggcatct

SEQ ID NO: 9443726 - DNA, 22 bp, Homo sapiens
tctcagagtttagagctgagcc

SEQ ID NO: 9443727 - DNA, 22 bp, Homo sapiens
tctcagcagccagatccagagc

SEQ ID NO: 9443728 - DNA, 22 bp, Homo sapiens
tctcagcaaggaaagaggcagg

SEQ ID NO: 9443729 - DNA, 22 bp, Homo sapiens
tctcaggctcctgacatatatg

SEQ ID NO: 9443730 - DNA, 22 bp, Homo sapiens
tctcaggctagtaaaagatggg

SEQ ID NO: 9443731 - DNA, 22 bp, Homo sapiens
tctcaggctcttggaacctgtt

SEQ ID NO: 9443732 - DNA, 22 bp, Homo sapiens
tctcaggctcttggaacctgtt

SEQ ID NO: 9443733 - DNA, 22 bp, Homo sapiens
tctcaggctaccttgcacaagg

SEQ ID NO: 9443734 - DNA, 22 bp, Homo sapiens
tctcaggcccctgagtttctct

SEQ ID NO: 9443735 - DNA, 21 bp, Homo sapiens
tctcaggcgagaattctttta

SEQ ID NO: 9443736 - DNA, 21 bp, Homo sapiens
tctcaggcgagaattctttta

SEQ ID NO: 9443737 - DNA, 20 bp, Homo sapiens
tctcaggccccctccttgct

SEQ ID NO: 9443738 - DNA, 22 bp, Homo sapiens
tctcaggcccctgagtttctct

SEQ ID NO: 9443739 - DNA, 20 bp, Homo sapiens
tctcaggccccagttttctt

SEQ ID NO: 9443740 - DNA, 20 bp, Homo sapiens
tctcaggccccctccttgct

SEQ ID NO: 9443741 - DNA, 22 bp, Homo sapiens
tctcagctcttttttcacagaa

SEQ ID NO: 9443742 - DNA, 22 bp, Homo sapiens
tctcagctcttttttcacagaa

SEQ ID NO: 9443743 - DNA, 22 bp, Homo sapiens
tctcagctcagcttccacagag

SEQ ID NO: 9443744 - DNA, 22 bp, Homo sapiens
tctcagctcagcttccacagag

SEQ ID NO: 9443745 - DNA, 22 bp, Homo sapiens
tctcagctcagcttccacagag

SEQ ID NO: 9443746 - DNA, 22 bp, Homo sapiens
tctcagggagttgaggctgcct

SEQ ID NO: 9443747 - DNA, 22 bp, Homo sapiens
tctcagggaggttccccgttct

SEQ ID NO: 9443748 - DNA, 22 bp, Homo sapiens
tctcagggagttgaggctgcct

SEQ ID NO: 9443749 - DNA, 22 bp, Homo sapiens
tctcagggagttgaggctgcct

SEQ ID NO: 9443750 - DNA, 22 bp, Homo sapiens
tctcagggcaattctcagcgac

SEQ ID NO: 9443751 - DNA, 22 bp, Homo sapiens
tctcagggcctccctctgtttc

SEQ ID NO: 9443752 - DNA, 22 bp, Homo sapiens
tctcagggccccaaaggctagt

SEQ ID NO: 9443753 - DNA, 22 bp, Homo sapiens
tctcaggctgacattgggactc

SEQ ID NO: 9443754 - DNA, 22 bp, Homo sapiens
tctcaggctcttggaacctgtt

SEQ ID NO: 9443755 - DNA, 19 bp, Homo sapiens
tctcaggctgggcggctgc

SEQ ID NO: 9443756 - DNA, 22 bp, Homo sapiens
tctcaggctgtgtgtggaggac

SEQ ID NO: 9443757 - DNA, 22 bp, Homo sapiens
tctcaggcttcctggtgctgtg

SEQ ID NO: 9443758 - DNA, 22 bp, Homo sapiens
tctcagggagcccagtacttac

SEQ ID NO: 9443759 - DNA, 22 bp, Homo sapiens
tctcagggagggcgagtcagcg

SEQ ID NO: 9443760 - DNA, 22 bp, Homo sapiens
tctcagggagagctgctggcat

SEQ ID NO: 9443761 - DNA, 22 bp, Homo sapiens
tctcaggcttcctggtgctgtg

SEQ ID NO: 9443762 - DNA, 23 bp, Homo sapiens
tctcagaggattcctgggccttg

SEQ ID NO: 9443763 - DNA, 22 bp, Homo sapiens
tctcagagagatgaaacttcca

SEQ ID NO: 9443764 - DNA, 22 bp, Homo sapiens
tctcagaaggcaagggctgggg

SEQ ID NO: 9443765 - DNA, 22 bp, Homo sapiens
tctcagaacacccttctatggt

SEQ ID NO: 9443766 - DNA, 22 bp, Homo sapiens
tctcagaaatactatgttgtca

SEQ ID NO: 9443767 - DNA, 22 bp, Homo sapiens
tctcactgatttgagaccaagg

SEQ ID NO: 9443768 - DNA, 22 bp, Homo sapiens
tctcactgatttgagaccaagg

SEQ ID NO: 9443769 - DNA, 22 bp, Homo sapiens
tctcactgggtcacagcagagg

SEQ ID NO: 9443770 - DNA, 22 bp, Homo sapiens
tctcactgggtataaatgagta

SEQ ID NO: 9443771 - DNA, 22 bp, Homo sapiens
tctcactgggtataaatgagta

SEQ ID NO: 9443772 - DNA, 22 bp, Homo sapiens
tctcactgggtcacagcagagg

SEQ ID NO: 9443773 - DNA, 22 bp, Homo sapiens
tctcactgggtcacagcagagg

SEQ ID NO: 9443774 - DNA, 22 bp, Homo sapiens
tctcagaaaagagcttcagaaa

SEQ ID NO: 9443775 - DNA, 22 bp, Homo sapiens
tctcacccaacgtgcaatgagt

SEQ ID NO: 9443776 - DNA, 22 bp, Homo sapiens
tctcaccatggtgcttgcttat

SEQ ID NO: 9443777 - DNA, 22 bp, Homo sapiens
tctcacattttaaaaggacata

SEQ ID NO: 9443778 - DNA, 22 bp, Homo sapiens
tctcacatctgccctgtgctgg

SEQ ID NO: 9443779 - DNA, 19 bp, Homo sapiens
tctcacagtttccttgcct

SEQ ID NO: 9443780 - DNA, 19 bp, Homo sapiens
tctcacagtttccttgcct

SEQ ID NO: 9443781 - DNA, 22 bp, Homo sapiens
tctcacagtgcaggtctgtctc

SEQ ID NO: 9443782 - DNA, 22 bp, Homo sapiens
tctcacagttgtccactgaaaa

SEQ ID NO: 9443783 - DNA, 22 bp, Homo sapiens
tctcacagttgtccactgaaaa

SEQ ID NO: 9443784 - DNA, 22 bp, Homo sapiens
tctcacagtgcaggtctgtctc

SEQ ID NO: 9443785 - DNA, 20 bp, Homo sapiens
tctcacaggggcttttctct

SEQ ID NO: 9443786 - DNA, 22 bp, Homo sapiens
tctcacaggtgcacgtggctgt

SEQ ID NO: 9443787 - DNA, 22 bp, Homo sapiens
tctcacagtatgaattgttcac

SEQ ID NO: 9443788 - DNA, 22 bp, Homo sapiens
tctcacagtgagcctgaggtcg

SEQ ID NO: 9443789 - DNA, 22 bp, Homo sapiens
tctcacagtatgaattgttcac

SEQ ID NO: 9443790 - DNA, 22 bp, Homo sapiens
tctcacagtatgaattgttcac

SEQ ID NO: 9443791 - DNA, 22 bp, Homo sapiens
tctcacagtgagcctgaggtcg

SEQ ID NO: 9443792 - DNA, 22 bp, Homo sapiens
tctcacagtgagcctgaggtcg

SEQ ID NO: 9443793 - DNA, 22 bp, Homo sapiens
tctcatggagtcaggagcagaa

SEQ ID NO: 9443794 - DNA, 22 bp, Homo sapiens
tctcatggcttaacaagcccac

SEQ ID NO: 9443795 - DNA, 22 bp, Homo sapiens
tctcatgcctggaattatcatt

SEQ ID NO: 9443796 - DNA, 22 bp, Homo sapiens
tctcatcttgttcatctaccct

SEQ ID NO: 9443797 - DNA, 22 bp, Homo sapiens
tctcatcttcattgtctcccat

SEQ ID NO: 9443798 - DNA, 22 bp, Homo sapiens
tctcatctttaaatgaaaattt

SEQ ID NO: 9443799 - DNA, 22 bp, Homo sapiens
tctcatgatgcctatgcagggt

SEQ ID NO: 9443800 - DNA, 22 bp, Homo sapiens
tctcatctcggatcagaagtga

SEQ ID NO: 9443801 - DNA, 22 bp, Homo sapiens
tctcatctgcgagctctgccag

SEQ ID NO: 9443802 - DNA, 22 bp, Homo sapiens
tctcatctgcgagctctgccag

SEQ ID NO: 9443803 - DNA, 22 bp, Homo sapiens
tctcatcttcatatctgaaaga

SEQ ID NO: 9443804 - DNA, 22 bp, Homo sapiens
tctcatcttcatatctgaaaga

SEQ ID NO: 9443805 - DNA, 22 bp, Homo sapiens
tctcagtggacgtgtctgtctt

SEQ ID NO: 9443806 - DNA, 22 bp, Homo sapiens
tctcagtttctcattataaaag

SEQ ID NO: 9443807 - DNA, 23 bp, Homo sapiens
tctcagtgccgattgcatacaca

SEQ ID NO: 9443808 - DNA, 22 bp, Homo sapiens
tctcatcacttaacatctgctt

SEQ ID NO: 9443809 - DNA, 22 bp, Homo sapiens
tctcatcattccttcaaagccc

SEQ ID NO: 9443810 - DNA, 22 bp, Homo sapiens
tctcatctcaaattgtaatccc

SEQ ID NO: 9443811 - DNA, 22 bp, Homo sapiens
tctcatctccattatagcatca

SEQ ID NO: 9443812 - DNA, 22 bp, Homo sapiens
tctcatctattcacattaactg

SEQ ID NO: 9443813 - DNA, 17 bp, Homo sapiens
tctcagtgactgatagc

SEQ ID NO: 9443814 - DNA, 22 bp, Homo sapiens
tctcagtgacactcttcataca

SEQ ID NO: 9443815 - DNA, 23 bp, Homo sapiens
tctcagtgaatctcagaattcgc

SEQ ID NO: 9443816 - DNA, 23 bp, Homo sapiens
tctcagtgaatctcagaattcgc

SEQ ID NO: 9443817 - DNA, 22 bp, Homo sapiens
tctcagtatgcttgattggatt

SEQ ID NO: 9443818 - DNA, 22 bp, Homo sapiens
tctcagtgcagcttgacagaga

SEQ ID NO: 9443819 - DNA, 22 bp, Homo sapiens
tctcagtgcagcttgacagaga

SEQ ID NO: 9443820 - DNA, 22 bp, Homo sapiens
tctcagtgcagcaaggaattta

SEQ ID NO: 9443821 - DNA, 22 bp, Homo sapiens
tctcagtgcagcttgacagaga

SEQ ID NO: 9443822 - DNA, 22 bp, Homo sapiens
tctcagtgcagagaggctatct

SEQ ID NO: 9443823 - DNA, 22 bp, Homo sapiens
tctcagtgcagcaaggaattta

SEQ ID NO: 9443824 - DNA, 22 bp, Homo sapiens
tctcagtgcagcaaggaattta

SEQ ID NO: 9443825 - DNA, 22 bp, Homo sapiens
tctcagtgactgctgggtcccc

SEQ ID NO: 9443826 - DNA, 22 bp, Homo sapiens
tctcagtgatggcccatttgga

SEQ ID NO: 9443827 - DNA, 23 bp, Homo sapiens
tctcagtgcacgcaccatgcctg

SEQ ID NO: 9443828 - DNA, 22 bp, Homo sapiens
tctcagggcttttcttttgaat

SEQ ID NO: 9443829 - DNA, 22 bp, Homo sapiens
tctcagggctcagagctcaggc

SEQ ID NO: 9443830 - DNA, 22 bp, Homo sapiens
tctcagggctcagagctcaggc

SEQ ID NO: 9443831 - DNA, 22 bp, Homo sapiens
tctcaggggcctggagtcctgg

SEQ ID NO: 9443832 - DNA, 22 bp, Homo sapiens
tctcaggggcctggagtcctgg

SEQ ID NO: 9443833 - DNA, 22 bp, Homo sapiens
tctcagggtttgtacaagtgta

SEQ ID NO: 9443834 - DNA, 22 bp, Homo sapiens
tctcagggtttcctgggggctg

SEQ ID NO: 9443835 - DNA, 22 bp, Homo sapiens
tctcagggtttgtacaagtgta

SEQ ID NO: 9443836 - DNA, 20 bp, Homo sapiens
tctcagggttcagcaaagta

SEQ ID NO: 9443837 - DNA, 20 bp, Homo sapiens
tctcagggtcttagatggaa

SEQ ID NO: 9443838 - DNA, 22 bp, Homo sapiens
tctcattcatccaaggatttat

SEQ ID NO: 9443839 - DNA, 22 bp, Homo sapiens
tctcattcatccaaggatttat

SEQ ID NO: 9443840 - DNA, 23 bp, Homo sapiens
tctcatttcccttgatctatctt

SEQ ID NO: 9443841 - DNA, 22 bp, Homo sapiens
tctcatttacttccacaggctg

SEQ ID NO: 9443842 - DNA, 22 bp, Homo sapiens
tctcatttacttccacaggctg

SEQ ID NO: 9443843 - DNA, 22 bp, Homo sapiens
tctcattggtatatacatgtgt

SEQ ID NO: 9443844 - DNA, 22 bp, Homo sapiens
tctcatgttttacctgtcctca

SEQ ID NO: 9443845 - DNA, 22 bp, Homo sapiens
tctcattattgtattcttagtt

SEQ ID NO: 9443846 - DNA, 20 bp, Homo sapiens
tctcattatatccaagaggc

SEQ ID NO: 9443847 - DNA, 22 bp, Homo sapiens
tctcatgtgattcccgtgcatg

SEQ ID NO: 9443848 - DNA, 22 bp, Homo sapiens
tctcatggtttgtgattcaaat

SEQ ID NO: 9443849 - DNA, 22 bp, Homo sapiens
tctcatgtattgccctggtgtg

SEQ ID NO: 9443850 - DNA, 22 bp, Homo sapiens
tctcattttgagtcagacacta

SEQ ID NO: 9443851 - DNA, 22 bp, Homo sapiens
tctcatttgtgtgcaattcaga

SEQ ID NO: 9443852 - DNA, 22 bp, Homo sapiens
tctcatttgtgtgcaattcaga

SEQ ID NO: 9443853 - DNA, 22 bp, Homo sapiens
tctcatttgtgtgcaattcaga

SEQ ID NO: 9443854 - DNA, 22 bp, Homo sapiens
tctccaaactcagactaagtat

SEQ ID NO: 9443855 - DNA, 22 bp, Homo sapiens
tctccaaatagttatatttaga

SEQ ID NO: 9443856 - DNA, 22 bp, Homo sapiens
tctccaaatagttatatttaga

SEQ ID NO: 9443857 - DNA, 22 bp, Homo sapiens
tctccaaatagttatatttaga

SEQ ID NO: 9443858 - DNA, 19 bp, Homo sapiens
tctccaaaaccaatcacta

SEQ ID NO: 9443859 - DNA, 22 bp, Homo sapiens
tctcatttgcctcatctataaa

SEQ ID NO: 9443860 - DNA, 22 bp, Homo sapiens
tctcatttgcctcatctataaa

SEQ ID NO: 9443861 - DNA, 22 bp, Homo sapiens
tctcatttgcctcatctataaa

SEQ ID NO: 9443862 - DNA, 22 bp, Homo sapiens
tctcatttggctttgttttaaa

SEQ ID NO: 9443863 - DNA, 22 bp, Homo sapiens
tctccaggcacttggctgctac

SEQ ID NO: 9443864 - DNA, 22 bp, Homo sapiens
tctccaggcccactgatttata

SEQ ID NO: 9443865 - DNA, 19 bp, Homo sapiens
tctccaggcaggtgagcga

SEQ ID NO: 9443866 - DNA, 19 bp, Homo sapiens
tctccaggcaggtgagcga

SEQ ID NO: 9443867 - DNA, 22 bp, Homo sapiens
tctccaggcactacctgggtaa

SEQ ID NO: 9443868 - DNA, 22 bp, Homo sapiens
tctccaggagcaagtcacccag

SEQ ID NO: 9443869 - DNA, 22 bp, Homo sapiens
tctccaggagaaatatgaagga

SEQ ID NO: 9443870 - DNA, 22 bp, Homo sapiens
tctccaggactgagctccagcc

SEQ ID NO: 9443871 - DNA, 22 bp, Homo sapiens
tctccaggactgagctccagcc

SEQ ID NO: 9443872 - DNA, 22 bp, Homo sapiens
tctccaggaagccctccctgac

SEQ ID NO: 9443873 - DNA, 17 bp, Homo sapiens
tctccaggacgagctca

SEQ ID NO: 9443874 - DNA, 22 bp, Homo sapiens
tctccacaagctgatgctagga

SEQ ID NO: 9443875 - DNA, 22 bp, Homo sapiens
tctccaatctgtagctgtttgt

SEQ ID NO: 9443876 - DNA, 22 bp, Homo sapiens
tctccaatctgatgtgactggt

SEQ ID NO: 9443877 - DNA, 22 bp, Homo sapiens
tctccaaatcaatcaatatgaa

SEQ ID NO: 9443878 - DNA, 22 bp, Homo sapiens
tctccaaatcaatcaatatgaa

SEQ ID NO: 9443879 - DNA, 22 bp, Homo sapiens
tctccaagaaaagatctcagct

SEQ ID NO: 9443880 - DNA, 22 bp, Homo sapiens
tctcctggtcacctcagaagtc

SEQ ID NO: 9443881 - DNA, 20 bp, Homo sapiens
tctcctggtgacagtaccca

SEQ ID NO: 9443882 - DNA, 22 bp, Homo sapiens
tctcctgtcttctcagcacccc

SEQ ID NO: 9443883 - DNA, 22 bp, Homo sapiens
tctcctgtcttctcagcacccc

SEQ ID NO: 9443884 - DNA, 22 bp, Homo sapiens
tctcctgtgcaccctccctgtg

SEQ ID NO: 9443885 - DNA, 22 bp, Homo sapiens
tctcctgtatgggactggcgag

SEQ ID NO: 9443886 - DNA, 22 bp, Homo sapiens
tctcctgtatgggactggcgag

SEQ ID NO: 9443887 - DNA, 23 bp, Homo sapiens
tctcctgtcctaattaccacccc

SEQ ID NO: 9443888 - DNA, 22 bp, Homo sapiens
tctcctgtgcaccctccctgtg

SEQ ID NO: 9443889 - DNA, 22 bp, Homo sapiens
tctcctgtgcaccctccctgtg

SEQ ID NO: 9443890 - DNA, 22 bp, Homo sapiens
tctcctggtacccttcctagca

SEQ ID NO: 9443891 - DNA, 22 bp, Homo sapiens
tctcctggtatgtatgcacctg

SEQ ID NO: 9443892 - DNA, 22 bp, Homo sapiens
tctcctggtatgtatgcacctg

SEQ ID NO: 9443893 - DNA, 22 bp, Homo sapiens
tctcctggtacccttcctagca

SEQ ID NO: 9443894 - DNA, 22 bp, Homo sapiens
tctcctttcttttaaaatgtca

SEQ ID NO: 9443895 - DNA, 22 bp, Homo sapiens
tctcctttctggagcctgctca

SEQ ID NO: 9443896 - DNA, 22 bp, Homo sapiens
tctcgatctcctgaccttgtga

SEQ ID NO: 9443897 - DNA, 22 bp, Homo sapiens
tctcgctctgtcgcccaggctg

SEQ ID NO: 9443898 - DNA, 22 bp, Homo sapiens
tctcctttctggagcctgctca

SEQ ID NO: 9443899 - DNA, 22 bp, Homo sapiens
tctccttcgaggcccagctccc

SEQ ID NO: 9443900 - DNA, 22 bp, Homo sapiens
tctccttcgaggcccagctccc

SEQ ID NO: 9443901 - DNA, 22 bp, Homo sapiens
tctccttcgaggcccagctccc

SEQ ID NO: 9443902 - DNA, 22 bp, Homo sapiens
tctctaaacttatatgaactat

SEQ ID NO: 9443903 - DNA, 22 bp, Homo sapiens
tctctaaagatatttatggcaa

SEQ ID NO: 9443904 - DNA, 22 bp, Homo sapiens
tctctagtctcctttaacctga

SEQ ID NO: 9443905 - DNA, 22 bp, Homo sapiens
tctcgctctgtcgcccaggctg

SEQ ID NO: 9443906 - DNA, 22 bp, Homo sapiens
tctcgctctgtcgcccaggctg

SEQ ID NO: 9443907 - DNA, 22 bp, Homo sapiens
tctcgctctgtcgcccaggctg

SEQ ID NO: 9443908 - DNA, 22 bp, Homo sapiens
tctcgctctgtcgcccaggctg

SEQ ID NO: 9443909 - DNA, 22 bp, Homo sapiens
tctcgctctgtcgcccaggctg

SEQ ID NO: 9443910 - DNA, 22 bp, Homo sapiens
tctcgctctgtcgcccaggctg

SEQ ID NO: 9443911 - DNA, 22 bp, Homo sapiens
tctcgctctgtcgcccaggctg

SEQ ID NO: 9443912 - DNA, 22 bp, Homo sapiens
tctcctgcttcaactgatggac

SEQ ID NO: 9443913 - DNA, 22 bp, Homo sapiens
tctcctgctcccaactgctgca

SEQ ID NO: 9443914 - DNA, 22 bp, Homo sapiens
tctcctggaagaataccacact

SEQ ID NO: 9443915 - DNA, 22 bp, Homo sapiens
tctcctggaagaataccacact

SEQ ID NO: 9443916 - DNA, 22 bp, Homo sapiens
tctcctgctcagaacagcctca

SEQ ID NO: 9443917 - DNA, 22 bp, Homo sapiens
tctcctgcagtcagcagtctca

SEQ ID NO: 9443918 - DNA, 22 bp, Homo sapiens
tctcctggagcaggaaggtggg

SEQ ID NO: 9443919 - DNA, 22 bp, Homo sapiens
tctcctctcttacctggtacaa

SEQ ID NO: 9443920 - DNA, 22 bp, Homo sapiens
tctcctctcttacctggtacaa

SEQ ID NO: 9443921 - DNA, 22 bp, Homo sapiens
tctcctctcctttcatgttgtt

SEQ ID NO: 9443922 - DNA, 22 bp, Homo sapiens
tctcctctcctttcatgttgtt

SEQ ID NO: 9443923 - DNA, 22 bp, Homo sapiens
tctcctgatatctgcagaccta

SEQ ID NO: 9443924 - DNA, 22 bp, Homo sapiens
tctcctgaagtttatgaaaact

SEQ ID NO: 9443925 - DNA, 22 bp, Homo sapiens
tctcctgacatgtctggaggaa

SEQ ID NO: 9443926 - DNA, 22 bp, Homo sapiens
tctcctgatatctgcagaccta

SEQ ID NO: 9443927 - DNA, 22 bp, Homo sapiens
tctcctgatgatggtactggca

SEQ ID NO: 9443928 - DNA, 22 bp, Homo sapiens
tctcctctgcgcggcagtgccc

SEQ ID NO: 9443929 - DNA, 21 bp, Homo sapiens
tctcctcccggggagaggccg

SEQ ID NO: 9443930 - DNA, 21 bp, Homo sapiens
tctcctcccggggagaggccg

SEQ ID NO: 9443931 - DNA, 22 bp, Homo sapiens
tctcctctactgggtctgcaga

SEQ ID NO: 9443932 - DNA, 22 bp, Homo sapiens
tctcctctactgggtctgcaga

SEQ ID NO: 9443933 - DNA, 23 bp, Homo sapiens
tctcctcctagatacagtcatgg

SEQ ID NO: 9443934 - DNA, 22 bp, Homo sapiens
tctcctcccaggctcttccagg

SEQ ID NO: 9443935 - DNA, 22 bp, Homo sapiens
tctcctactcactcaaggcttg

SEQ ID NO: 9443936 - DNA, 22 bp, Homo sapiens
tctcctaggctggagtgcagtg

SEQ ID NO: 9443937 - DNA, 22 bp, Homo sapiens
tctcctaggctggagtgcagtg

SEQ ID NO: 9443938 - DNA, 22 bp, Homo sapiens
tctcctcaccaccagcagcaga

SEQ ID NO: 9443939 - DNA, 22 bp, Homo sapiens
tctccaggcctttcccatctta

SEQ ID NO: 9443940 - DNA, 23 bp, Homo sapiens
tctccaggccttactccaggcct

SEQ ID NO: 9443941 - DNA, 23 bp, Homo sapiens
tctccaggccttactccaggcct

SEQ ID NO: 9443942 - DNA, 23 bp, Homo sapiens
tctccaggccttactccaggcct

SEQ ID NO: 9443943 - DNA, 22 bp, Homo sapiens
tctccaggcttaatctcagctt

SEQ ID NO: 9443944 - DNA, 22 bp, Homo sapiens
tctccaggcttaatctcagctt

SEQ ID NO: 9443945 - DNA, 22 bp, Homo sapiens
tctccagggacatgtttctgga

SEQ ID NO: 9443946 - DNA, 22 bp, Homo sapiens
tctccaggctttttgtgaattg

SEQ ID NO: 9443947 - DNA, 22 bp, Homo sapiens
tctccagggactgaggctggag

SEQ ID NO: 9443948 - DNA, 22 bp, Homo sapiens
tctccagggactgaggctggag

SEQ ID NO: 9443949 - DNA, 22 bp, Homo sapiens
tctccagggactgaggctggag

SEQ ID NO: 9443950 - DNA, 22 bp, Homo sapiens
tctccaggggctgctgtgccac

SEQ ID NO: 9443951 - DNA, 22 bp, Homo sapiens
tctccaggtaaatggcatcctg

SEQ ID NO: 9443952 - DNA, 22 bp, Homo sapiens
tctccagggtgagctaggccag

SEQ ID NO: 9443953 - DNA, 22 bp, Homo sapiens
tctccagggcccccgagcgttg

SEQ ID NO: 9443954 - DNA, 22 bp, Homo sapiens
tctccaggggcagggtctggag

SEQ ID NO: 9443955 - DNA, 22 bp, Homo sapiens
tctccagggaggtagcccagtg

SEQ ID NO: 9443956 - DNA, 22 bp, Homo sapiens
tctccagggaggtagcccagtg

SEQ ID NO: 9443957 - DNA, 22 bp, Homo sapiens
tctccagggcagagaatagcaa

SEQ ID NO: 9443958 - DNA, 22 bp, Homo sapiens
tctccaggtgaaacttgcaggg

SEQ ID NO: 9443959 - DNA, 22 bp, Homo sapiens
tctccaggtgaaacttgcaggg

SEQ ID NO: 9443960 - DNA, 22 bp, Homo sapiens
tctccaggtagatatgtcagga

SEQ ID NO: 9443961 - DNA, 22 bp, Homo sapiens
tctccaggtagatatgtcagga

SEQ ID NO: 9443962 - DNA, 19 bp, Homo sapiens
tctccaggtgccccaaaca

SEQ ID NO: 9443963 - DNA, 19 bp, Homo sapiens
tctccaggtgccccaaaca

SEQ ID NO: 9443964 - DNA, 22 bp, Homo sapiens
tctccaggtgactctgatgtat

SEQ ID NO: 9443965 - DNA, 22 bp, Homo sapiens
tctccaggtgagggtggttaga

SEQ ID NO: 9443966 - DNA, 22 bp, Homo sapiens
tctccaggtgctaagtgtgcct

SEQ ID NO: 9443967 - DNA, 22 bp, Homo sapiens
tctccaggtgctaagtgtgcct

SEQ ID NO: 9443968 - DNA, 22 bp, Homo sapiens
tctccaggtggcttgggcttct

SEQ ID NO: 9443969 - DNA, 22 bp, Homo sapiens
tctccaggtggggtcacctttt

SEQ ID NO: 9443970 - DNA, 22 bp, Homo sapiens
tctcccacggtacaggataaac

SEQ ID NO: 9443971 - DNA, 22 bp, Homo sapiens
tctccaggttcagtcgatggaa

SEQ ID NO: 9443972 - DNA, 22 bp, Homo sapiens
tctcccactgcaagcccaggct

SEQ ID NO: 9443973 - DNA, 22 bp, Homo sapiens
tctcccagaggatcccagtgga

SEQ ID NO: 9443974 - DNA, 22 bp, Homo sapiens
tctcccagaggatcccagtgga

SEQ ID NO: 9443975 - DNA, 22 bp, Homo sapiens
tctcccagaggatcccagtgga

SEQ ID NO: 9443976 - DNA, 22 bp, Homo sapiens
tctcccagaagtcctcagtaca

SEQ ID NO: 9443977 - DNA, 22 bp, Homo sapiens
tctcccagaggatcccagtgga

SEQ ID NO: 9443978 - DNA, 22 bp, Homo sapiens
tctcccactggccttgtatgat

SEQ ID NO: 9443979 - DNA, 22 bp, Homo sapiens
tctcccagaagtcctcagtaca

SEQ ID NO: 9443980 - DNA, 20 bp, Homo sapiens
tctcccaggctcagggaaga

SEQ ID NO: 9443981 - DNA, 20 bp, Homo sapiens
tctcccaggctcagggaaga

SEQ ID NO: 9443982 - DNA, 20 bp, Homo sapiens
tctcccaggctcagggaaga

SEQ ID NO: 9443983 - DNA, 20 bp, Homo sapiens
tctcccaggctcagggaaga

SEQ ID NO: 9443984 - DNA, 20 bp, Homo sapiens
tctcccaggctcagggaaga

SEQ ID NO: 9443985 - DNA, 22 bp, Homo sapiens
tctcccaggctgccctgtggac

SEQ ID NO: 9443986 - DNA, 22 bp, Homo sapiens
tctcccaggctgccctgtggac

SEQ ID NO: 9443987 - DNA, 22 bp, Homo sapiens
tctcccaggctggagtgcagtg

SEQ ID NO: 9443988 - DNA, 22 bp, Homo sapiens
tctcccaggctgccctgtggac

SEQ ID NO: 9443989 - DNA, 22 bp, Homo sapiens
tctcccaggcaggagtgcagtg

SEQ ID NO: 9443990 - DNA, 22 bp, Homo sapiens
tctcccagaggatcccagtgga

SEQ ID NO: 9443991 - DNA, 22 bp, Homo sapiens
tctcccaggcaggagtgcagtg

SEQ ID NO: 9443992 - DNA, 22 bp, Homo sapiens
tctcccaggcaggagtgcagtg

SEQ ID NO: 9443993 - DNA, 22 bp, Homo sapiens
tctcccaggcaggagtgcagtg

SEQ ID NO: 9443994 - DNA, 22 bp, Homo sapiens
tctcccaggcaggagtgcagtg

SEQ ID NO: 9443995 - DNA, 22 bp, Homo sapiens
tctcccaggcaggagtgcagtg

SEQ ID NO: 9443996 - DNA, 22 bp, Homo sapiens
tctcccagtggtgcagaaagca

SEQ ID NO: 9443997 - DNA, 22 bp, Homo sapiens
tctcccagtggtgcagaaagca

SEQ ID NO: 9443998 - DNA, 22 bp, Homo sapiens
tctcccagtcctctgtgcttac

SEQ ID NO: 9443999 - DNA, 22 bp, Homo sapiens
tctcccaggtgggtgcctggag

SEQ ID NO: 9444000 - DNA, 22 bp, Homo sapiens
tctcccaggtgggtgcctggag

SEQ ID NO: 9444001 - DNA, 22 bp, Homo sapiens
tctcccaggtgggtgcctggag

SEQ ID NO: 9444002 - DNA, 22 bp, Homo sapiens
tctcccaggtgggtgcctggag

SEQ ID NO: 9444003 - DNA, 22 bp, Homo sapiens
tctcccaggtcatacacagaga

SEQ ID NO: 9444004 - DNA, 22 bp, Homo sapiens
tctcccaggctggagtgcagtg

SEQ ID NO: 9444005 - DNA, 22 bp, Homo sapiens
tctcccaggctggagtgcagtg

SEQ ID NO: 9444006 - DNA, 22 bp, Homo sapiens
tctcccaggctggagtgcagtg

SEQ ID NO: 9444007 - DNA, 22 bp, Homo sapiens
tctcccaggctggagtgcagtg

SEQ ID NO: 9444008 - DNA, 22 bp, Homo sapiens
tctcccaggctggagtgcagtg

SEQ ID NO: 9444009 - DNA, 22 bp, Homo sapiens
tctcccagtgtctggcagtcag

SEQ ID NO: 9444010 - DNA, 22 bp, Homo sapiens
tctcccagtgtctggcagtcag

SEQ ID NO: 9444011 - DNA, 22 bp, Homo sapiens
tctcccagtgtctggcagtcag

SEQ ID NO: 9444012 - DNA, 22 bp, Homo sapiens
tctcccagtgtctggcagtcag

SEQ ID NO: 9444013 - DNA, 22 bp, Homo sapiens
tctcccattcagcttgcagtca

SEQ ID NO: 9444014 - DNA, 22 bp, Homo sapiens
tctcccatgaggctgcggtcaa

SEQ ID NO: 9444015 - DNA, 19 bp, Homo sapiens
tctcccatgcctgtgtcta

SEQ ID NO: 9444016 - DNA, 22 bp, Homo sapiens
tctccccagctgagctgccctt

SEQ ID NO: 9444017 - DNA, 22 bp, Homo sapiens
tctccccagctgagctgccctt

SEQ ID NO: 9444018 - DNA, 22 bp, Homo sapiens
tctccccaaaggactcactctc

SEQ ID NO: 9444019 - DNA, 22 bp, Homo sapiens
tctccccaggggtatgggtatt

SEQ ID NO: 9444020 - DNA, 22 bp, Homo sapiens
tctccccaggggtatgggtatt

SEQ ID NO: 9444021 - DNA, 22 bp, Homo sapiens
tctcccctccctggaccagtgc

SEQ ID NO: 9444022 - DNA, 22 bp, Homo sapiens
tctcccctgttggccaggtttt

SEQ ID NO: 9444023 - DNA, 22 bp, Homo sapiens
tctcccccagtctctacagcag

SEQ ID NO: 9444024 - DNA, 23 bp, Homo sapiens
tctccctcatgcctaggcctggg

SEQ ID NO: 9444025 - DNA, 23 bp, Homo sapiens
tctccctcatgcctaggcctggg

SEQ ID NO: 9444026 - DNA, 23 bp, Homo sapiens
tctccctcatgcctaggcctggg

SEQ ID NO: 9444027 - DNA, 22 bp, Homo sapiens
tctccctactgactccaggacc

SEQ ID NO: 9444028 - DNA, 22 bp, Homo sapiens
tctccctcattcctgcttccat

SEQ ID NO: 9444029 - DNA, 22 bp, Homo sapiens
tctgccctaattcagtgcttag

SEQ ID NO: 9444030 - DNA, 22 bp, Homo sapiens
tctgccctaattcagtgcttag

SEQ ID NO: 9444031 - DNA, 22 bp, Homo sapiens
tctgcccgttcaaatccttgtt

SEQ ID NO: 9444032 - DNA, 22 bp, Homo sapiens
tctgcccagtttgtgctcaggt

SEQ ID NO: 9444033 - DNA, 22 bp, Homo sapiens
tctgcccattcttagagtctag

SEQ ID NO: 9444034 - DNA, 19 bp, Homo sapiens
tctgcccagttgtctgccc

SEQ ID NO: 9444035 - DNA, 22 bp, Homo sapiens
tctgcccagtttgtgctcaggt

SEQ ID NO: 9444036 - DNA, 21 bp, Homo sapiens
tctgccctccaggagctcata

SEQ ID NO: 9444037 - DNA, 21 bp, Homo sapiens
tctgccctccaggagctcata

SEQ ID NO: 9444038 - DNA, 21 bp, Homo sapiens
tctgccctccaggagctcata

SEQ ID NO: 9444039 - DNA, 22 bp, Homo sapiens
tctgccctcattgctgcctgga

SEQ ID NO: 9444040 - DNA, 22 bp, Homo sapiens
tctgccctcattgctgcctgga

SEQ ID NO: 9444041 - DNA, 22 bp, Homo sapiens
tctgccctcattgctgcctgga

SEQ ID NO: 9444042 - DNA, 22 bp, Homo sapiens
tctgccctcattgctgcctgga

SEQ ID NO: 9444043 - DNA, 22 bp, Homo sapiens
tctgccctcattgctgcctgga

SEQ ID NO: 9444044 - DNA, 20 bp, Homo sapiens
tctgcccaccccggctccca

SEQ ID NO: 9444045 - DNA, 22 bp, Homo sapiens
tctgcccaccagcggttgcata

SEQ ID NO: 9444046 - DNA, 22 bp, Homo sapiens
tctgcccacagcctcctgtcca

SEQ ID NO: 9444047 - DNA, 22 bp, Homo sapiens
tctgcccacagtccaatagttg

SEQ ID NO: 9444048 - DNA, 22 bp, Homo sapiens
tctgcccactgctctgctgccc

SEQ ID NO: 9444049 - DNA, 22 bp, Homo sapiens
tctgcccactgctctgctgccc

SEQ ID NO: 9444050 - DNA, 22 bp, Homo sapiens
tctgcccagctaaaaatgggag

SEQ ID NO: 9444051 - DNA, 22 bp, Homo sapiens
tctgcccagccagacccaaggt

SEQ ID NO: 9444052 - DNA, 22 bp, Homo sapiens
tctgcccaggacacctgccact

SEQ ID NO: 9444053 - DNA, 22 bp, Homo sapiens
tctgcccaggaggtcccatggg

SEQ ID NO: 9444054 - DNA, 18 bp, Homo sapiens
tctgcccaggacttggac

SEQ ID NO: 9444055 - DNA, 22 bp, Homo sapiens
tctgcccagggacccacaggga

SEQ ID NO: 9444056 - DNA, 22 bp, Homo sapiens
tctgcccagggacaggacacag

SEQ ID NO: 9444057 - DNA, 19 bp, Homo sapiens
tctgcccagttgtctgccc

SEQ ID NO: 9444058 - DNA, 22 bp, Homo sapiens
tctgcccagggacccacaggga

SEQ ID NO: 9444059 - DNA, 22 bp, Homo sapiens
tctgcccagggcagggcttgca

SEQ ID NO: 9444060 - DNA, 21 bp, Homo sapiens
tctgcctgagactttgctggt

SEQ ID NO: 9444061 - DNA, 22 bp, Homo sapiens
tctgcctgagcagagggaggcc

SEQ ID NO: 9444062 - DNA, 22 bp, Homo sapiens
tctgccgtgcgaggtcccacca

SEQ ID NO: 9444063 - DNA, 22 bp, Homo sapiens
tctgccctgccattcactggaa

SEQ ID NO: 9444064 - DNA, 22 bp, Homo sapiens
tctgccctgccattcactggaa

SEQ ID NO: 9444065 - DNA, 18 bp, Homo sapiens
tctgccctgccattcact

SEQ ID NO: 9444066 - DNA, 22 bp, Homo sapiens
tctgccctgcagggagcagtaa

SEQ ID NO: 9444067 - DNA, 22 bp, Homo sapiens
tctgccctggggtcagcctcca

SEQ ID NO: 9444068 - DNA, 22 bp, Homo sapiens
tctgccctggggtcagcctcca

SEQ ID NO: 9444069 - DNA, 22 bp, Homo sapiens
tctgccctggggtcagcctcca

SEQ ID NO: 9444070 - DNA, 22 bp, Homo sapiens
tctgccctggggtcagcctcca

SEQ ID NO: 9444071 - DNA, 22 bp, Homo sapiens
tctgcctgaggactgacaccag

SEQ ID NO: 9444072 - DNA, 22 bp, Homo sapiens
tctgcctgagggagctgaggaa

SEQ ID NO: 9444073 - DNA, 22 bp, Homo sapiens
tctgcctgagggagctgaggaa

SEQ ID NO: 9444074 - DNA, 18 bp, Homo sapiens
tctgcctgcagggcatct

SEQ ID NO: 9444075 - DNA, 18 bp, Homo sapiens
tctgcctgcagggcatct

SEQ ID NO: 9444076 - DNA, 18 bp, Homo sapiens
tctgcctgcagggcatct

SEQ ID NO: 9444077 - DNA, 22 bp, Homo sapiens
tctgcctgagggagctgaggaa

SEQ ID NO: 9444078 - DNA, 22 bp, Homo sapiens
tctgcctgccagtctggtcctc

SEQ ID NO: 9444079 - DNA, 22 bp, Homo sapiens
tctgcctgccagtctggtcctc

SEQ ID NO: 9444080 - DNA, 22 bp, Homo sapiens
tctgcctgcagtgtggcagggc

SEQ ID NO: 9444081 - DNA, 22 bp, Homo sapiens
tctgcctgcgctcacggggccg

SEQ ID NO: 9444082 - DNA, 22 bp, Homo sapiens
tctgcctgcgctcacggggccg

SEQ ID NO: 9444083 - DNA, 22 bp, Homo sapiens
tctgcctgccgagaacacctac

SEQ ID NO: 9444084 - DNA, 22 bp, Homo sapiens
tctgcctgccgagaacacctac

SEQ ID NO: 9444085 - DNA, 22 bp, Homo sapiens
tctgcctggaccctggtgagct

SEQ ID NO: 9444086 - DNA, 22 bp, Homo sapiens
tctgcctggagagttcttctct

SEQ ID NO: 9444087 - DNA, 22 bp, Homo sapiens
tctgcctggagagttcttctct

SEQ ID NO: 9444088 - DNA, 22 bp, Homo sapiens
tctgcctggatgatggcagggc

SEQ ID NO: 9444089 - DNA, 19 bp, Homo sapiens
tctgcctgcttgtaggggc

SEQ ID NO: 9444090 - DNA, 19 bp, Homo sapiens
tctgcctgcttgtaggggc

SEQ ID NO: 9444091 - DNA, 22 bp, Homo sapiens
tctgcctgcttcttcatagtct

SEQ ID NO: 9444092 - DNA, 22 bp, Homo sapiens
tctgcctgcttcttcatagtct

SEQ ID NO: 9444093 - DNA, 22 bp, Homo sapiens
tctgcctgctgcctgggggctc

SEQ ID NO: 9444094 - DNA, 22 bp, Homo sapiens
tctgcctgctgcctgggggctc

SEQ ID NO: 9444095 - DNA, 22 bp, Homo sapiens
tctgcctgctaactcctgcacc

SEQ ID NO: 9444096 - DNA, 22 bp, Homo sapiens
tctgcctgctaactcctgcacc

SEQ ID NO: 9444097 - DNA, 22 bp, Homo sapiens
tctgcctgcggctgcaggtggc

SEQ ID NO: 9444098 - DNA, 22 bp, Homo sapiens
tctgcctgcgctcacggggccg

SEQ ID NO: 9444099 - DNA, 22 bp, Homo sapiens
tctgcctgcggctgcaggtggc

SEQ ID NO: 9444100 - DNA, 22 bp, Homo sapiens
tctgcctggattccattctcca

SEQ ID NO: 9444101 - DNA, 22 bp, Homo sapiens
tctgcctggcctggagggcaca

SEQ ID NO: 9444102 - DNA, 22 bp, Homo sapiens
tctgcctggcctggagggcaca

SEQ ID NO: 9444103 - DNA, 22 bp, Homo sapiens
tctgcctggattttggaaagct

SEQ ID NO: 9444104 - DNA, 22 bp, Homo sapiens
tctgcctggattttggaaagct

SEQ ID NO: 9444105 - DNA, 22 bp, Homo sapiens
tctgcctgtaatatttggagaa

SEQ ID NO: 9444106 - DNA, 22 bp, Homo sapiens
tctgcctgggtgtggagcagag

SEQ ID NO: 9444107 - DNA, 22 bp, Homo sapiens
tctgcctgtacctcttttttgc

SEQ ID NO: 9444108 - DNA, 22 bp, Homo sapiens
tctgcctgtagtcccacacctc

SEQ ID NO: 9444109 - DNA, 22 bp, Homo sapiens
tctgcctgggtgtggagcagag

SEQ ID NO: 9444110 - DNA, 22 bp, Homo sapiens
tctgcctgggtgtggagcagag

SEQ ID NO: 9444111 - DNA, 22 bp, Homo sapiens
tctgcctggctcatggcagtga

SEQ ID NO: 9444112 - DNA, 22 bp, Homo sapiens
tctgcctggcggactcccggaa

SEQ ID NO: 9444113 - DNA, 22 bp, Homo sapiens
tctgcctggctcatggcagtga

SEQ ID NO: 9444114 - DNA, 22 bp, Homo sapiens
tctgcctggctcatggcagtga

SEQ ID NO: 9444115 - DNA, 22 bp, Homo sapiens
tctgcctgttgagcctaaggcc

SEQ ID NO: 9444116 - DNA, 22 bp, Homo sapiens
tctgcctgttgctagaatgtca

SEQ ID NO: 9444117 - DNA, 22 bp, Homo sapiens
tctgcctgttgagcctaaggcc

SEQ ID NO: 9444118 - DNA, 22 bp, Homo sapiens
tctgccttagcaattgtcaagg

SEQ ID NO: 9444119 - DNA, 22 bp, Homo sapiens
tctgccttccccataatctgat

SEQ ID NO: 9444120 - DNA, 22 bp, Homo sapiens
tctgcctgtgctgtgttttcat

SEQ ID NO: 9444121 - DNA, 22 bp, Homo sapiens
tctgcctgtctccttgaattgt

SEQ ID NO: 9444122 - DNA, 22 bp, Homo sapiens
tctgcctgtggatacatgctct

SEQ ID NO: 9444123 - DNA, 22 bp, Homo sapiens
tctgcctgtggatacatgctct

SEQ ID NO: 9444124 - DNA, 22 bp, Homo sapiens
tctgcctgtggatacatgctct

SEQ ID NO: 9444125 - DNA, 22 bp, Homo sapiens
tctgcctgtggtggaggaagtt

SEQ ID NO: 9444126 - DNA, 22 bp, Homo sapiens
tctgcctgttcaagtcttctag

SEQ ID NO: 9444127 - DNA, 22 bp, Homo sapiens
tctgcctgttcaagtcttctag

SEQ ID NO: 9444128 - DNA, 22 bp, Homo sapiens
tctgcctgttcaagtcttctag

SEQ ID NO: 9444129 - DNA, 22 bp, Homo sapiens
tctgcctgttcccgattccatg

SEQ ID NO: 9444130 - DNA, 22 bp, Homo sapiens
tctgcctgttcaagtcttctag

SEQ ID NO: 9444131 - DNA, 22 bp, Homo sapiens
tctgccttcgctgctccctgaa

SEQ ID NO: 9444132 - DNA, 22 bp, Homo sapiens
tctgccttcgctgctccctgaa

SEQ ID NO: 9444133 - DNA, 22 bp, Homo sapiens
tctgccttcttttagtcatctt

SEQ ID NO: 9444134 - DNA, 22 bp, Homo sapiens
tctgccttgaggtcctcagctc

SEQ ID NO: 9444135 - DNA, 22 bp, Homo sapiens
tctgccttcttttagtcatctt

SEQ ID NO: 9444136 - DNA, 22 bp, Homo sapiens
tctgccttgatggcattgagaa

SEQ ID NO: 9444137 - DNA, 22 bp, Homo sapiens
tctgctcacatggctccatgca

SEQ ID NO: 9444138 - DNA, 20 bp, Homo sapiens
tctgctcagccctcagtggc

SEQ ID NO: 9444139 - DNA, 20 bp, Homo sapiens
tctgctcagccctcagtggc

SEQ ID NO: 9444140 - DNA, 22 bp, Homo sapiens
tctgctcaggttacctagctag

SEQ ID NO: 9444141 - DNA, 22 bp, Homo sapiens
tctgctcagtgcttatctctaa

SEQ ID NO: 9444142 - DNA, 22 bp, Homo sapiens
tctgcaggctctagatgaggtt

SEQ ID NO: 9444143 - DNA, 22 bp, Homo sapiens
tctgcaggcctcgacaaggcca

SEQ ID NO: 9444144 - DNA, 22 bp, Homo sapiens
tctgcaggatcagagccagagg

SEQ ID NO: 9444145 - DNA, 22 bp, Homo sapiens
tctgcaggatcagagccagagg

SEQ ID NO: 9444146 - DNA, 22 bp, Homo sapiens
tctgcaggactgaggcctgttt

SEQ ID NO: 9444147 - DNA, 18 bp, Homo sapiens
tctgcaggacctcagggc

SEQ ID NO: 9444148 - DNA, 22 bp, Homo sapiens
tctgcagcttcttgccagagag

SEQ ID NO: 9444149 - DNA, 22 bp, Homo sapiens
tctgcagcttcttgccagagag

SEQ ID NO: 9444150 - DNA, 22 bp, Homo sapiens
tctgcagcttactttcacatga

SEQ ID NO: 9444151 - DNA, 22 bp, Homo sapiens
tctgcaggaaaaaagtgcctgg

SEQ ID NO: 9444152 - DNA, 22 bp, Homo sapiens
tctgcagcttgcacaggcaggc

SEQ ID NO: 9444153 - DNA, 22 bp, Homo sapiens
tctgcacatgtagtaaatatta

SEQ ID NO: 9444154 - DNA, 22 bp, Homo sapiens
tctgcaccatcgtatgcttaat

SEQ ID NO: 9444155 - DNA, 22 bp, Homo sapiens
tctgcacatgtagtaaatatta

SEQ ID NO: 9444156 - DNA, 22 bp, Homo sapiens
tctgcacataggtaggctggaa

SEQ ID NO: 9444157 - DNA, 22 bp, Homo sapiens
tctgcacatcccccaaagtatt

SEQ ID NO: 9444158 - DNA, 22 bp, Homo sapiens
tctgcacagattctctgagaat

SEQ ID NO: 9444159 - DNA, 22 bp, Homo sapiens
tctgcacaaaactgtcgcagaa

SEQ ID NO: 9444160 - DNA, 22 bp, Homo sapiens
tctgcacacaatttatctttct

SEQ ID NO: 9444161 - DNA, 22 bp, Homo sapiens
tctgcacaccgccaggctgact

SEQ ID NO: 9444162 - DNA, 22 bp, Homo sapiens
tctgcacacaatttatctttct

SEQ ID NO: 9444163 - DNA, 22 bp, Homo sapiens
tctgcaagctcagttctgactt

SEQ ID NO: 9444164 - DNA, 22 bp, Homo sapiens
tctgcaagggcacagccaaccc

SEQ ID NO: 9444165 - DNA, 19 bp, Homo sapiens
tctgcaagtgtcagaggcg

SEQ ID NO: 9444166 - DNA, 22 bp, Homo sapiens
tctgcagcacttaatgtttcgt

SEQ ID NO: 9444167 - DNA, 22 bp, Homo sapiens
tctgcagaactttatgagcaaa

SEQ ID NO: 9444168 - DNA, 22 bp, Homo sapiens
tctgcagaagaattaaggacag

SEQ ID NO: 9444169 - DNA, 22 bp, Homo sapiens
tctgcagaactttatgagcaaa

SEQ ID NO: 9444170 - DNA, 22 bp, Homo sapiens
tctgcagaaagtggctcagtgg

SEQ ID NO: 9444171 - DNA, 22 bp, Homo sapiens
tctgcaccctgtggtcctctag

SEQ ID NO: 9444172 - DNA, 22 bp, Homo sapiens
tctgcacctcctgcttgctaga

SEQ ID NO: 9444173 - DNA, 18 bp, Homo sapiens
tctgcactcctgagagag

SEQ ID NO: 9444174 - DNA, 18 bp, Homo sapiens
tctgcactcctgagagag

SEQ ID NO: 9444175 - DNA, 22 bp, Homo sapiens
tctgcactcctgtttcacctgg

SEQ ID NO: 9444176 - DNA, 22 bp, Homo sapiens
tctgcactgggagcatgtctgg

SEQ ID NO: 9444177 - DNA, 22 bp, Homo sapiens
tctgcagaaactgtgactatgt

SEQ ID NO: 9444178 - DNA, 22 bp, Homo sapiens
tctgcagaaactgtgactatgt

SEQ ID NO: 9444179 - DNA, 22 bp, Homo sapiens
tctgcattgtcccagaagtgac

SEQ ID NO: 9444180 - DNA, 22 bp, Homo sapiens
tctgcatttttaacaagatccc

SEQ ID NO: 9444181 - DNA, 21 bp, Homo sapiens
tctgcattttagcaagatctc

SEQ ID NO: 9444182 - DNA, 22 bp, Homo sapiens
tctgcatctgtgttgagtgccc

SEQ ID NO: 9444183 - DNA, 22 bp, Homo sapiens
tctgcatatttatcatgagtct

SEQ ID NO: 9444184 - DNA, 22 bp, Homo sapiens
tctgcaggtcacgctccagcct

SEQ ID NO: 9444185 - DNA, 22 bp, Homo sapiens
tctgcagggcccttggctcctg

SEQ ID NO: 9444186 - DNA, 22 bp, Homo sapiens
tctgcaggtagagctcaggaat

SEQ ID NO: 9444187 - DNA, 22 bp, Homo sapiens
tctgcaggtagagctcaggaat

SEQ ID NO: 9444188 - DNA, 22 bp, Homo sapiens
tctgcaggcttggagtggcagc

SEQ ID NO: 9444189 - DNA, 22 bp, Homo sapiens
tctgcaggctctagatgaggtt

SEQ ID NO: 9444190 - DNA, 21 bp, Homo sapiens
tctgcccacactggccactgc

SEQ ID NO: 9444191 - DNA, 22 bp, Homo sapiens
tctgcccacagcctcctgtcca

SEQ ID NO: 9444192 - DNA, 22 bp, Homo sapiens
tctgcccaaggctgtcactaga

SEQ ID NO: 9444193 - DNA, 19 bp, Homo sapiens
tctgcccacaagaaaggga

SEQ ID NO: 9444194 - DNA, 22 bp, Homo sapiens
tctgcccaaggctgtcactaga

SEQ ID NO: 9444195 - DNA, 22 bp, Homo sapiens
tctgccatgctaacttcagtat

SEQ ID NO: 9444196 - DNA, 22 bp, Homo sapiens
tctgccatcttaattctctttt

SEQ ID NO: 9444197 - DNA, 23 bp, Homo sapiens
tctgccagtgtgtgccaggagcc

SEQ ID NO: 9444198 - DNA, 23 bp, Homo sapiens
tctgccagtgtgtgccaggagcc

SEQ ID NO: 9444199 - DNA, 23 bp, Homo sapiens
tctgccagtgtgtgccaggagcc

SEQ ID NO: 9444200 - DNA, 22 bp, Homo sapiens
tctgccagtttatagacaagcc

SEQ ID NO: 9444201 - DNA, 22 bp, Homo sapiens
tctgccatcaagatgctctggc

SEQ ID NO: 9444202 - DNA, 22 bp, Homo sapiens
tctgccacactggttcagtgga

SEQ ID NO: 9444203 - DNA, 22 bp, Homo sapiens
tctgccacatgagggcacagca

SEQ ID NO: 9444204 - DNA, 16 bp, Homo sapiens
tctgccagggacaggc

SEQ ID NO: 9444205 - DNA, 22 bp, Homo sapiens
tctgccaggcttggtgctagat

SEQ ID NO: 9444206 - DNA, 22 bp, Homo sapiens
tctgccaggcctgcttccgggg

SEQ ID NO: 9444207 - DNA, 22 bp, Homo sapiens
tctgccaggtggggagaggcca

SEQ ID NO: 9444208 - DNA, 22 bp, Homo sapiens
tctgccaggtggggagaggcca

SEQ ID NO: 9444209 - DNA, 22 bp, Homo sapiens
tctgccagtggattcttattct

SEQ ID NO: 9444210 - DNA, 22 bp, Homo sapiens
tctgagctagaaagtatgccct

SEQ ID NO: 9444211 - DNA, 22 bp, Homo sapiens
tctgagctaatcctgttgccga

SEQ ID NO: 9444212 - DNA, 22 bp, Homo sapiens
tctgagctacgatgcctgtcac

SEQ ID NO: 9444213 - DNA, 22 bp, Homo sapiens
tctgagccgtatggcttggcta

SEQ ID NO: 9444214 - DNA, 22 bp, Homo sapiens
tctgagctaatcctgttgccga

SEQ ID NO: 9444215 - DNA, 22 bp, Homo sapiens
tctgagccctcttttgcagccc

SEQ ID NO: 9444216 - DNA, 22 bp, Homo sapiens
tctgagcccagtgagtctcgca

SEQ ID NO: 9444217 - DNA, 22 bp, Homo sapiens
tctgagccctcttttgcagccc

SEQ ID NO: 9444218 - DNA, 22 bp, Homo sapiens
tctgagctcaagtgacagttag

SEQ ID NO: 9444219 - DNA, 21 bp, Homo sapiens
tctgagctgagtcctctaggt

SEQ ID NO: 9444220 - DNA, 22 bp, Homo sapiens
tctgagctctatctgtgggaat

SEQ ID NO: 9444221 - DNA, 22 bp, Homo sapiens
tctgagctgcccctttactttg

SEQ ID NO: 9444222 - DNA, 22 bp, Homo sapiens
tctgagctgcagagtggggtgg

SEQ ID NO: 9444223 - DNA, 22 bp, Homo sapiens
tctgagctgcagagtggggtgg

SEQ ID NO: 9444224 - DNA, 22 bp, Homo sapiens
tctgagctctatctgtgggaat

SEQ ID NO: 9444225 - DNA, 21 bp, Homo sapiens
tctgagctgagtcctctaggt

SEQ ID NO: 9444226 - DNA, 22 bp, Homo sapiens
tctgagcttccctctgaggcag

SEQ ID NO: 9444227 - DNA, 22 bp, Homo sapiens
tctgagcttctgcatttccaac

SEQ ID NO: 9444228 - DNA, 22 bp, Homo sapiens
tctgagcttctgcatttccaac

SEQ ID NO: 9444229 - DNA, 23 bp, Homo sapiens
tctgagctgtcttttcagcagaa

SEQ ID NO: 9444230 - DNA, 22 bp, Homo sapiens
tctgagctgtggccattcttcc

SEQ ID NO: 9444231 - DNA, 22 bp, Homo sapiens
tctgagctgtggccattcttcc

SEQ ID NO: 9444232 - DNA, 22 bp, Homo sapiens
tctgagctgtaagtagacaagg

SEQ ID NO: 9444233 - DNA, 22 bp, Homo sapiens
tctgagctgggggcctggcatg

SEQ ID NO: 9444234 - DNA, 22 bp, Homo sapiens
tctgagctgggcacagaaggcg

SEQ ID NO: 9444235 - DNA, 22 bp, Homo sapiens
tctgagctggagcccatcacct

SEQ ID NO: 9444236 - DNA, 22 bp, Homo sapiens
tctgagctgctaggtatgcatt

SEQ ID NO: 9444237 - DNA, 22 bp, Homo sapiens
tctgagctggagcccatcacct

SEQ ID NO: 9444238 - DNA, 22 bp, Homo sapiens
tctgagctggagcccatcacct

SEQ ID NO: 9444239 - DNA, 22 bp, Homo sapiens
tctgagcacatcacacagctca

SEQ ID NO: 9444240 - DNA, 22 bp, Homo sapiens
tctgagcagatgctcgctctcc

SEQ ID NO: 9444241 - DNA, 22 bp, Homo sapiens
tctgagcagatgctcgctctcc

SEQ ID NO: 9444242 - DNA, 22 bp, Homo sapiens
tctgagagagggtcagatgcta

SEQ ID NO: 9444243 - DNA, 22 bp, Homo sapiens
tctgagagagggtcagatgcta

SEQ ID NO: 9444244 - DNA, 22 bp, Homo sapiens
tctgagagagggtcagatgcta

SEQ ID NO: 9444245 - DNA, 22 bp, Homo sapiens
tctgagagagggtcagatgcta

SEQ ID NO: 9444246 - DNA, 22 bp, Homo sapiens
tctgagagatacaaggaggcaa

SEQ ID NO: 9444247 - DNA, 22 bp, Homo sapiens
tctgagagatacaaggaggcaa

SEQ ID NO: 9444248 - DNA, 22 bp, Homo sapiens
tctgagacccatacaggcccac

SEQ ID NO: 9444249 - DNA, 20 bp, Homo sapiens
tctgagacctttccacaccc

SEQ ID NO: 9444250 - DNA, 22 bp, Homo sapiens
tctgagacactcttgtgatggg

SEQ ID NO: 9444251 - DNA, 22 bp, Homo sapiens
tctgagacaacttagccctcga

SEQ ID NO: 9444252 - DNA, 22 bp, Homo sapiens
tctgagacaacttagccctcga

SEQ ID NO: 9444253 - DNA, 20 bp, Homo sapiens
tctgagacttgtagtgtgga

SEQ ID NO: 9444254 - DNA, 22 bp, Homo sapiens
tctgagactttaacctggggcc

SEQ ID NO: 9444255 - DNA, 22 bp, Homo sapiens
tctgagacttctgaagctagaa

SEQ ID NO: 9444256 - DNA, 21 bp, Homo sapiens
tctgagactgggttagaatgt

SEQ ID NO: 9444257 - DNA, 23 bp, Homo sapiens
tctgagagaacaatgcctcctat

SEQ ID NO: 9444258 - DNA, 23 bp, Homo sapiens
tctgagagaacaatgcctcctat

SEQ ID NO: 9444259 - DNA, 22 bp, Homo sapiens
tctgagagagcacctatccact

SEQ ID NO: 9444260 - DNA, 22 bp, Homo sapiens
tctgagagagcacctatccact

SEQ ID NO: 9444261 - DNA, 22 bp, Homo sapiens
tctgagccataagagtacagga

SEQ ID NO: 9444262 - DNA, 22 bp, Homo sapiens
tctgagcccagtgagtctcgca

SEQ ID NO: 9444263 - DNA, 22 bp, Homo sapiens
tctgagcccctagaactgagcg

SEQ ID NO: 9444264 - DNA, 22 bp, Homo sapiens
tctgagcccctagaactgagcg

SEQ ID NO: 9444265 - DNA, 22 bp, Homo sapiens
tctgagccagacaagacagcca

SEQ ID NO: 9444266 - DNA, 22 bp, Homo sapiens
tctgagccagacaagacagcca

SEQ ID NO: 9444267 - DNA, 22 bp, Homo sapiens
tctgagccagccacctccttca

SEQ ID NO: 9444268 - DNA, 22 bp, Homo sapiens
tctgagccagggtctcctccct

SEQ ID NO: 9444269 - DNA, 22 bp, Homo sapiens
tctgagccaatttctgtgtcca

SEQ ID NO: 9444270 - DNA, 22 bp, Homo sapiens
tctgagccaatttctgtgtcca

SEQ ID NO: 9444271 - DNA, 22 bp, Homo sapiens
tctgagccacctgagcccatgg

SEQ ID NO: 9444272 - DNA, 22 bp, Homo sapiens
tctgagccacctgagcccatgg

SEQ ID NO: 9444273 - DNA, 22 bp, Homo sapiens
tctgagccacagatgtcctgtt

SEQ ID NO: 9444274 - DNA, 22 bp, Homo sapiens
tctgagcagggcagtgtccatg

SEQ ID NO: 9444275 - DNA, 22 bp, Homo sapiens
tctgagaagcgggagcctgtga

SEQ ID NO: 9444276 - DNA, 20 bp, Homo sapiens
tctgagaagccactgtccaa

SEQ ID NO: 9444277 - DNA, 20 bp, Homo sapiens
tctgagaagccactgtccaa

SEQ ID NO: 9444278 - DNA, 22 bp, Homo sapiens
tctgagaagcaccttctggaca

SEQ ID NO: 9444279 - DNA, 22 bp, Homo sapiens
tctgagaaggaagctctgtgta

SEQ ID NO: 9444280 - DNA, 22 bp, Homo sapiens
tctgagaagctagaggacaaag

SEQ ID NO: 9444281 - DNA, 22 bp, Homo sapiens
tctgagaagcgtgtctctgttt

SEQ ID NO: 9444282 - DNA, 22 bp, Homo sapiens
tctgagaagctagaggacaaag

SEQ ID NO: 9444283 - DNA, 23 bp, Homo sapiens
tctgagaaggtttcagccagact

SEQ ID NO: 9444284 - DNA, 22 bp, Homo sapiens
tctgagaaggtgcatcagctgc

SEQ ID NO: 9444285 - DNA, 22 bp, Homo sapiens
tctgagaagggtaggctccatt

SEQ ID NO: 9444286 - DNA, 23 bp, Homo sapiens
tctgagaaggtttcagccagact

SEQ ID NO: 9444287 - DNA, 23 bp, Homo sapiens
tctgagaaggtttcagccagact

SEQ ID NO: 9444288 - DNA, 22 bp, Homo sapiens
tctgagaatagtgccactgtgg

SEQ ID NO: 9444289 - DNA, 22 bp, Homo sapiens
tctgagaatggagctaaaaatc

SEQ ID NO: 9444290 - DNA, 22 bp, Homo sapiens
tctgagaatggagctaaaaatc

SEQ ID NO: 9444291 - DNA, 22 bp, Homo sapiens
tctgagaatggagctaaaaatc

SEQ ID NO: 9444292 - DNA, 17 bp, Homo sapiens
tctgagaatgctggagg

SEQ ID NO: 9444293 - DNA, 17 bp, Homo sapiens
tctgagaatgctggagg

SEQ ID NO: 9444294 - DNA, 22 bp, Homo sapiens
tctgagaatagtgccactgtgg

SEQ ID NO: 9444295 - DNA, 17 bp, Homo sapiens
tctgagaaaggagaatc

SEQ ID NO: 9444296 - DNA, 22 bp, Homo sapiens
tctgagaaagtactgtatgttc

SEQ ID NO: 9444297 - DNA, 17 bp, Homo sapiens
tctgagaaaggagaatc

SEQ ID NO: 9444298 - DNA, 22 bp, Homo sapiens
tctgagaaatcagtggtgaata

SEQ ID NO: 9444299 - DNA, 22 bp, Homo sapiens
tctgagaaatcagtggtgaata

SEQ ID NO: 9444300 - DNA, 17 bp, Homo sapiens
tctgagaacttgaagca

SEQ ID NO: 9444301 - DNA, 20 bp, Homo sapiens
tctgagaagcaaacaatgtt

SEQ ID NO: 9444302 - DNA, 20 bp, Homo sapiens
tctgagaagcaaacaatgtt

SEQ ID NO: 9444303 - DNA, 20 bp, Homo sapiens
tctgagaagcaaacaatgtt

SEQ ID NO: 9444304 - DNA, 22 bp, Homo sapiens
tctgagaactccgggttagatc

SEQ ID NO: 9444305 - DNA, 21 bp, Homo sapiens
tctgagaacttctgctgcagc

SEQ ID NO: 9444306 - DNA, 21 bp, Homo sapiens
tctgagaacttctgctgcagc

SEQ ID NO: 9444307 - DNA, 21 bp, Homo sapiens
tctgagaacttctgctgcagc

SEQ ID NO: 9444308 - DNA, 22 bp, Homo sapiens
tctgaccacagacaacctgcta

SEQ ID NO: 9444309 - DNA, 23 bp, Homo sapiens
tctgacctcgtttgctgtgttct

SEQ ID NO: 9444310 - DNA, 22 bp, Homo sapiens
tctgacttggcgctcttgtctt

SEQ ID NO: 9444311 - DNA, 19 bp, Homo sapiens
tctgacacttacacacccc

SEQ ID NO: 9444312 - DNA, 22 bp, Homo sapiens
tctgacaagtcaagtcttgact

SEQ ID NO: 9444313 - DNA, 22 bp, Homo sapiens
tctgacaatgaacaatctatag

SEQ ID NO: 9444314 - DNA, 21 bp, Homo sapiens
tctgacaatctcatttcaaac

SEQ ID NO: 9444315 - DNA, 22 bp, Homo sapiens
tctgacaatgaacaatctatag

SEQ ID NO: 9444316 - DNA, 21 bp, Homo sapiens
tctgacaatctcatttcaaac

SEQ ID NO: 9444317 - DNA, 22 bp, Homo sapiens
tctgacagggccaaacatgaca

SEQ ID NO: 9444318 - DNA, 22 bp, Homo sapiens
tctgacagggccaaacatgaca

SEQ ID NO: 9444319 - DNA, 22 bp, Homo sapiens
tctgacaggtcattttctatag

SEQ ID NO: 9444320 - DNA, 22 bp, Homo sapiens
tctgacaggttgggatatggaa

SEQ ID NO: 9444321 - DNA, 22 bp, Homo sapiens
tctgacagtcacagtggaggat

SEQ ID NO: 9444322 - DNA, 22 bp, Homo sapiens
tctgacagtcacagtggaggat

SEQ ID NO: 9444323 - DNA, 22 bp, Homo sapiens
tctgacatagcaggacctaggc

SEQ ID NO: 9444324 - DNA, 22 bp, Homo sapiens
tctgagggctgtactatgcacg

SEQ ID NO: 9444325 - DNA, 22 bp, Homo sapiens
tctgagggctgtactatgcacg

SEQ ID NO: 9444326 - DNA, 23 bp, Homo sapiens
tctgagggagtgggcagtggcac

SEQ ID NO: 9444327 - DNA, 23 bp, Homo sapiens
tctgagggagtgggcagtggcac

SEQ ID NO: 9444328 - DNA, 22 bp, Homo sapiens
tctgagggcttgaggggaagta

SEQ ID NO: 9444329 - DNA, 22 bp, Homo sapiens
tctgaggggccagggatctggg

SEQ ID NO: 9444330 - DNA, 19 bp, Homo sapiens
tctgagggtccagatgcat

SEQ ID NO: 9444331 - DNA, 22 bp, Homo sapiens
tctgaggggctggaagggctgc

SEQ ID NO: 9444332 - DNA, 22 bp, Homo sapiens
tctgaggggctggaagggctgc

SEQ ID NO: 9444333 - DNA, 22 bp, Homo sapiens
tctgagggtgaggcccagaatc

SEQ ID NO: 9444334 - DNA, 22 bp, Homo sapiens
tctgagggtgggagaaggagct

SEQ ID NO: 9444335 - DNA, 22 bp, Homo sapiens
tctgagggttggctggctgtag

SEQ ID NO: 9444336 - DNA, 22 bp, Homo sapiens
tctgagggttggctggctgtag

SEQ ID NO: 9444337 - DNA, 22 bp, Homo sapiens
tctgagggttgtagagagggac

SEQ ID NO: 9444338 - DNA, 22 bp, Homo sapiens
tctgagggttgtagagagggac

SEQ ID NO: 9444339 - DNA, 22 bp, Homo sapiens
tctgaggtcacagatttcaaga

SEQ ID NO: 9444340 - DNA, 20 bp, Homo sapiens
tctgaggctgagctctactt

SEQ ID NO: 9444341 - DNA, 20 bp, Homo sapiens
tctgaggctgagctctactt

SEQ ID NO: 9444342 - DNA, 22 bp, Homo sapiens
tctgaggctgcatctatgtgac

SEQ ID NO: 9444343 - DNA, 20 bp, Homo sapiens
tctgaggctgagcccagcgt

SEQ ID NO: 9444344 - DNA, 20 bp, Homo sapiens
tctgaggctgagctctactt

SEQ ID NO: 9444345 - DNA, 22 bp, Homo sapiens
tctgaggctatgttcaggctaa

SEQ ID NO: 9444346 - DNA, 22 bp, Homo sapiens
tctgaggctatgttcaggctaa

SEQ ID NO: 9444347 - DNA, 22 bp, Homo sapiens
tctgaggctgaatggactccgt

SEQ ID NO: 9444348 - DNA, 22 bp, Homo sapiens
tctgaggctgaatggactccgt

SEQ ID NO: 9444349 - DNA, 20 bp, Homo sapiens
tctgaggctgagcccagcgt

SEQ ID NO: 9444350 - DNA, 22 bp, Homo sapiens
tctgaggctgaatggactccgt

SEQ ID NO: 9444351 - DNA, 22 bp, Homo sapiens
tctgaggctgaatggactccgt

SEQ ID NO: 9444352 - DNA, 23 bp, Homo sapiens
tctgagggagtgggcagtggcac

SEQ ID NO: 9444353 - DNA, 23 bp, Homo sapiens
tctgagggagtgggcagtggcac

SEQ ID NO: 9444354 - DNA, 22 bp, Homo sapiens
tctgagggaatagctattgtag

SEQ ID NO: 9444355 - DNA, 19 bp, Homo sapiens
tctgaggcttctccccttg

SEQ ID NO: 9444356 - DNA, 19 bp, Homo sapiens
tctgaggcttctccccttg

SEQ ID NO: 9444357 - DNA, 22 bp, Homo sapiens
tctgaggcttcagactgtactg

SEQ ID NO: 9444358 - DNA, 22 bp, Homo sapiens
tctgaggctgtctctgggctcc

SEQ ID NO: 9444359 - DNA, 22 bp, Homo sapiens
tctgaggcttcagactgtactg

SEQ ID NO: 9444360 - DNA, 22 bp, Homo sapiens
tctgaggctgtctctgggctcc

SEQ ID NO: 9444361 - DNA, 22 bp, Homo sapiens
tctgaggctgtctctgggctcc

SEQ ID NO: 9444362 - DNA, 22 bp, Homo sapiens
tctgaggctgcatctatgtgac

SEQ ID NO: 9444363 - DNA, 22 bp, Homo sapiens
tctgagcttttattatcaacct

SEQ ID NO: 9444364 - DNA, 22 bp, Homo sapiens
tctgagctttcttgtgctcaag

SEQ ID NO: 9444365 - DNA, 22 bp, Homo sapiens
tctgagctttagctgggatttt

SEQ ID NO: 9444366 - DNA, 22 bp, Homo sapiens
tctgagcttctgcctgctgcaa

SEQ ID NO: 9444367 - DNA, 22 bp, Homo sapiens
tctgagcttctgcctgctgcaa

SEQ ID NO: 9444368 - DNA, 22 bp, Homo sapiens
tctgagctttagctgggatttt

SEQ ID NO: 9444369 - DNA, 22 bp, Homo sapiens
tctgaggaaagagagtgggatg

SEQ ID NO: 9444370 - DNA, 22 bp, Homo sapiens
tctgaggaaagagagtgggatg

SEQ ID NO: 9444371 - DNA, 22 bp, Homo sapiens
tctgaggaagcagcaggaagtg

SEQ ID NO: 9444372 - DNA, 22 bp, Homo sapiens
tctgaggaaaagaggaggtagc

SEQ ID NO: 9444373 - DNA, 22 bp, Homo sapiens
tctgaggaatcttgacacattt

SEQ ID NO: 9444374 - DNA, 22 bp, Homo sapiens
tctgaggaatcttgacacattt

SEQ ID NO: 9444375 - DNA, 22 bp, Homo sapiens
tctgaggaatcttgacacattt

SEQ ID NO: 9444376 - DNA, 22 bp, Homo sapiens
tctgaggaataagaaggaagtg

SEQ ID NO: 9444377 - DNA, 22 bp, Homo sapiens
tctgaggaataagaaggaagtg

SEQ ID NO: 9444378 - DNA, 18 bp, Homo sapiens
tctgaggaatggaagagc

SEQ ID NO: 9444379 - DNA, 22 bp, Homo sapiens
tctgaggaattctgcagtgaga

SEQ ID NO: 9444380 - DNA, 22 bp, Homo sapiens
tctgaggaattctgcagtgaga

SEQ ID NO: 9444381 - DNA, 22 bp, Homo sapiens
tctgaggccctaccctgagcct

SEQ ID NO: 9444382 - DNA, 22 bp, Homo sapiens
tctgaggccctaccctgagcct

SEQ ID NO: 9444383 - DNA, 22 bp, Homo sapiens
tctgaggccctgcaggcagtgt

SEQ ID NO: 9444384 - DNA, 22 bp, Homo sapiens
tctgaggccctgcaggcagtgt

SEQ ID NO: 9444385 - DNA, 22 bp, Homo sapiens
tctgaggccctaccctgagcct

SEQ ID NO: 9444386 - DNA, 22 bp, Homo sapiens
tctgaggctaagagacagaggc

SEQ ID NO: 9444387 - DNA, 22 bp, Homo sapiens
tctgaggctatgttcaggctaa

SEQ ID NO: 9444388 - DNA, 22 bp, Homo sapiens
tctgaggctaagagacagaggc

SEQ ID NO: 9444389 - DNA, 22 bp, Homo sapiens
tctgaggctaagagacagaggc

SEQ ID NO: 9444390 - DNA, 22 bp, Homo sapiens
tctgaggccttgggacagaagt

SEQ ID NO: 9444391 - DNA, 22 bp, Homo sapiens
tctgaggccttgggacagaagt

SEQ ID NO: 9444392 - DNA, 22 bp, Homo sapiens
tctgaggccttgggacagaagt

SEQ ID NO: 9444393 - DNA, 22 bp, Homo sapiens
tctgaggccttgggacagaagt

SEQ ID NO: 9444394 - DNA, 22 bp, Homo sapiens
tctgaggccttggcagctaagg

SEQ ID NO: 9444395 - DNA, 22 bp, Homo sapiens
tctgaggccttcagcatgaatc

SEQ ID NO: 9444396 - DNA, 22 bp, Homo sapiens
tctgaggccttggcagctaagg

SEQ ID NO: 9444397 - DNA, 17 bp, Homo sapiens
tctgaggcctctaggag

SEQ ID NO: 9444398 - DNA, 17 bp, Homo sapiens
tctgaggcctctaggag

SEQ ID NO: 9444399 - DNA, 22 bp, Homo sapiens
tctgaggcctagagaggggctt

SEQ ID NO: 9444400 - DNA, 22 bp, Homo sapiens
tctgaggcctagagaggggctt

SEQ ID NO: 9444401 - DNA, 22 bp, Homo sapiens
tctgaggcctagagaggggctt

SEQ ID NO: 9444402 - DNA, 22 bp, Homo sapiens
tctgaggccctgcaggcagtgt

SEQ ID NO: 9444403 - DNA, 22 bp, Homo sapiens
tctgaggccctgcaggcagtgt

SEQ ID NO: 9444404 - DNA, 22 bp, Homo sapiens
tctgaggccttcagcatgaatc

SEQ ID NO: 9444405 - DNA, 22 bp, Homo sapiens
tctgaggccttcagcatgaatc

SEQ ID NO: 9444406 - DNA, 22 bp, Homo sapiens
tctgaggcctgaagcagcagag

SEQ ID NO: 9444407 - DNA, 22 bp, Homo sapiens
tctgaggcctgaagcagcagag

SEQ ID NO: 9444408 - DNA, 22 bp, Homo sapiens
tctgaggcctgaagcagcagag

SEQ ID NO: 9444409 - DNA, 22 bp, Homo sapiens
tctgaggtggggctggagcatt

SEQ ID NO: 9444410 - DNA, 23 bp, Homo sapiens
tctgaggtccaccagtttgcaga

SEQ ID NO: 9444411 - DNA, 22 bp, Homo sapiens
tctgaggtcagtgctgcagtta

SEQ ID NO: 9444412 - DNA, 22 bp, Homo sapiens
tctgatgataaagcatccttta

SEQ ID NO: 9444413 - DNA, 17 bp, Homo sapiens
tctgatgactagaggaa

SEQ ID NO: 9444414 - DNA, 22 bp, Homo sapiens
tctgaggttaatcctgctgcat

SEQ ID NO: 9444415 - DNA, 22 bp, Homo sapiens
tctgaggttactgctttgtaga

SEQ ID NO: 9444416 - DNA, 21 bp, Homo sapiens
tctgatggtagatgagatgtg

SEQ ID NO: 9444417 - DNA, 21 bp, Homo sapiens
tctgatggtagatgagatgtg

SEQ ID NO: 9444418 - DNA, 21 bp, Homo sapiens
tctgatggtagatgagatgtg

SEQ ID NO: 9444419 - DNA, 21 bp, Homo sapiens
tctgatggtagatgagatgtg

SEQ ID NO: 9444420 - DNA, 21 bp, Homo sapiens
tctgatggtagatgagatgtg

SEQ ID NO: 9444421 - DNA, 23 bp, Homo sapiens
tctgatgttctcttatgctgtag

SEQ ID NO: 9444422 - DNA, 22 bp, Homo sapiens
tctgatgttgatgcttctgcct

SEQ ID NO: 9444423 - DNA, 22 bp, Homo sapiens
tctgatgtggcagctgcatcta

SEQ ID NO: 9444424 - DNA, 22 bp, Homo sapiens
tctgatgtctgaaatgctcttg

SEQ ID NO: 9444425 - DNA, 22 bp, Homo sapiens
tctgatgtctgaaatgctcttg

SEQ ID NO: 9444426 - DNA, 21 bp, Homo sapiens
tctgatgtgtttaatggtggg

SEQ ID NO: 9444427 - DNA, 22 bp, Homo sapiens
tctgatgttgtgacatcacttc

SEQ ID NO: 9444428 - DNA, 22 bp, Homo sapiens
tctgattagagcattcttgagt

SEQ ID NO: 9444429 - DNA, 22 bp, Homo sapiens
tctgattagcagtttagggaaa

SEQ ID NO: 9444430 - DNA, 22 bp, Homo sapiens
tctgattagagcattcttgagt

SEQ ID NO: 9444431 - DNA, 22 bp, Homo sapiens
tctgattacttgagttatttag

SEQ ID NO: 9444432 - DNA, 22 bp, Homo sapiens
tctgattcattcatgtgcacca

SEQ ID NO: 9444433 - DNA, 22 bp, Homo sapiens
tctgattcattcatgtgcacca

SEQ ID NO: 9444434 - DNA, 22 bp, Homo sapiens
tctgattccagagcattgctca

SEQ ID NO: 9444435 - DNA, 22 bp, Homo sapiens
tctgattgatgcagaccatatt

SEQ ID NO: 9444436 - DNA, 22 bp, Homo sapiens
tctgatttactggaaaaaagga

SEQ ID NO: 9444437 - DNA, 22 bp, Homo sapiens
tctgcaacagtgccctgtaaat

SEQ ID NO: 9444438 - DNA, 22 bp, Homo sapiens
tctgatttatatatgcagatac

SEQ ID NO: 9444439 - DNA, 20 bp, Homo sapiens
tctgcaaacaagttttagac

SEQ ID NO: 9444440 - DNA, 22 bp, Homo sapiens
tctgatttgtagctacatgtct

SEQ ID NO: 9444441 - DNA, 22 bp, Homo sapiens
tctgcaaaagtgttcataaaga

SEQ ID NO: 9444442 - DNA, 22 bp, Homo sapiens
tctgcaagatggtcttagaggt

SEQ ID NO: 9444443 - DNA, 22 bp, Homo sapiens
tctgcaagatggtcttagaggt

SEQ ID NO: 9444444 - DNA, 22 bp, Homo sapiens
tctgcaagatcattaaagcaga

SEQ ID NO: 9444445 - DNA, 22 bp, Homo sapiens
tctgcaagcgtcacatgattct

SEQ ID NO: 9444446 - DNA, 22 bp, Homo sapiens
tctgcaagcgtcacatgattct

SEQ ID NO: 9444447 - DNA, 22 bp, Homo sapiens
tctgcaagctaaggaagcatct

SEQ ID NO: 9444448 - DNA, 22 bp, Homo sapiens
tctgcaacattcctctccccac

SEQ ID NO: 9444449 - DNA, 22 bp, Homo sapiens
tctggagagcagatgcctctgg

SEQ ID NO: 9444450 - DNA, 22 bp, Homo sapiens
tctggagaggaggatgtggaca

SEQ ID NO: 9444451 - DNA, 22 bp, Homo sapiens
tctggagaggggcctagaattt

SEQ ID NO: 9444452 - DNA, 22 bp, Homo sapiens
tctggagagtcacagtgccaga

SEQ ID NO: 9444453 - DNA, 22 bp, Homo sapiens
tctggagagtcacagtgccaga

SEQ ID NO: 9444454 - DNA, 22 bp, Homo sapiens
tctggagagtcctgctcacgtc

SEQ ID NO: 9444455 - DNA, 22 bp, Homo sapiens
tctggagagtcctgctcacgtc

SEQ ID NO: 9444456 - DNA, 22 bp, Homo sapiens
tctggagagtcacagtgccaga

SEQ ID NO: 9444457 - DNA, 22 bp, Homo sapiens
tctggagataagacagacagat

SEQ ID NO: 9444458 - DNA, 22 bp, Homo sapiens
tctggagataagcagcaatgaa

SEQ ID NO: 9444459 - DNA, 22 bp, Homo sapiens
tctggagataagacagacagat

SEQ ID NO: 9444460 - DNA, 22 bp, Homo sapiens
tctggagataagacagacagat

SEQ ID NO: 9444461 - DNA, 22 bp, Homo sapiens
tctggactttcggtgcaagagt

SEQ ID NO: 9444462 - DNA, 22 bp, Homo sapiens
tctggagaaagttgagtttgtg

SEQ ID NO: 9444463 - DNA, 20 bp, Homo sapiens
tctggactgtcagacaggga

SEQ ID NO: 9444464 - DNA, 22 bp, Homo sapiens
tctggactctagggggactgtg

SEQ ID NO: 9444465 - DNA, 22 bp, Homo sapiens
tctggacttgaatcagagtaga

SEQ ID NO: 9444466 - DNA, 22 bp, Homo sapiens
tctggagaagaaacttgctctg

SEQ ID NO: 9444467 - DNA, 22 bp, Homo sapiens
tctggagaacttgcaagaggat

SEQ ID NO: 9444468 - DNA, 22 bp, Homo sapiens
tctggagaaggaagagtctttg

SEQ ID NO: 9444469 - DNA, 22 bp, Homo sapiens
tctggagaagcagtgagagtca

SEQ ID NO: 9444470 - DNA, 22 bp, Homo sapiens
tctggagaatctgtcagtgtgg

SEQ ID NO: 9444471 - DNA, 22 bp, Homo sapiens
tctggagaatctgtcagtgtgg

SEQ ID NO: 9444472 - DNA, 22 bp, Homo sapiens
tctggagaatctgtcagtgtgg

SEQ ID NO: 9444473 - DNA, 22 bp, Homo sapiens
tctggagaagcccagggagctg

SEQ ID NO: 9444474 - DNA, 22 bp, Homo sapiens
tctggagaagcccagggagctg

SEQ ID NO: 9444475 - DNA, 22 bp, Homo sapiens
tctggagaagcccagggagctg

SEQ ID NO: 9444476 - DNA, 22 bp, Homo sapiens
tctggaaggaagagctgagtcc

SEQ ID NO: 9444477 - DNA, 22 bp, Homo sapiens
tctggaagacattaatttggtt

SEQ ID NO: 9444478 - DNA, 22 bp, Homo sapiens
tctggaagacagtgagcccgct

SEQ ID NO: 9444479 - DNA, 22 bp, Homo sapiens
tctggaagctggagtccaggaa

SEQ ID NO: 9444480 - DNA, 22 bp, Homo sapiens
tctggaagctggagtccaggaa

SEQ ID NO: 9444481 - DNA, 22 bp, Homo sapiens
tctggaaggaacccttagagga

SEQ ID NO: 9444482 - DNA, 22 bp, Homo sapiens
tctggaataaccctgcttccaa

SEQ ID NO: 9444483 - DNA, 22 bp, Homo sapiens
tctggaagttagaggaggaaag

SEQ ID NO: 9444484 - DNA, 22 bp, Homo sapiens
tctggaataggtcctgagtatt

SEQ ID NO: 9444485 - DNA, 22 bp, Homo sapiens
tctggaatcagacctaatccca

SEQ ID NO: 9444486 - DNA, 22 bp, Homo sapiens
tctggaatgatttccttcccct

SEQ ID NO: 9444487 - DNA, 22 bp, Homo sapiens
tctggaatgaatgaggttctgt

SEQ ID NO: 9444488 - DNA, 22 bp, Homo sapiens
tctggaatgaatgaggttctgt

SEQ ID NO: 9444489 - DNA, 22 bp, Homo sapiens
tctggaatcagtggcttaccct

SEQ ID NO: 9444490 - DNA, 23 bp, Homo sapiens
tctggaatcctcccccttggttc

SEQ ID NO: 9444491 - DNA, 22 bp, Homo sapiens
tctggaattctcaagtcctgga

SEQ ID NO: 9444492 - DNA, 22 bp, Homo sapiens
tctggaattgctgtgtgagttc

SEQ ID NO: 9444493 - DNA, 22 bp, Homo sapiens
tctggaattttattgatcaaaa

SEQ ID NO: 9444494 - DNA, 23 bp, Homo sapiens
tctggacataacggagaagcaaa

SEQ ID NO: 9444495 - DNA, 22 bp, Homo sapiens
tctggacagtagagcaatgatt

SEQ ID NO: 9444496 - DNA, 22 bp, Homo sapiens
tctggacaatcctgagacagac

SEQ ID NO: 9444497 - DNA, 22 bp, Homo sapiens
tctggacatttggtaggataga

SEQ ID NO: 9444498 - DNA, 22 bp, Homo sapiens
tctggacatttggtaggataga

SEQ ID NO: 9444499 - DNA, 22 bp, Homo sapiens
tctggacatcctggagaatgac

SEQ ID NO: 9444500 - DNA, 22 bp, Homo sapiens
tctggacatcctggagaatgac

SEQ ID NO: 9444501 - DNA, 22 bp, Homo sapiens
tctggacgtgttggtgaggacc

SEQ ID NO: 9444502 - DNA, 22 bp, Homo sapiens
tctggactaacagcagcctcag

SEQ ID NO: 9444503 - DNA, 22 bp, Homo sapiens
tctggactccatgctgcctgga

SEQ ID NO: 9444504 - DNA, 22 bp, Homo sapiens
tctggactaatattctggctgc

SEQ ID NO: 9444505 - DNA, 23 bp, Homo sapiens
tctgctctgaagttcggctgagc

SEQ ID NO: 9444506 - DNA, 22 bp, Homo sapiens
tctgctctccatacttccgcac

SEQ ID NO: 9444507 - DNA, 22 bp, Homo sapiens
tctgctctccatacttccgcac

SEQ ID NO: 9444508 - DNA, 22 bp, Homo sapiens
tctgctctccatacttccgcac

SEQ ID NO: 9444509 - DNA, 22 bp, Homo sapiens
tctgctctagttgcttcctgcc

SEQ ID NO: 9444510 - DNA, 22 bp, Homo sapiens
tctgctctagttgcttcctgcc

SEQ ID NO: 9444511 - DNA, 22 bp, Homo sapiens
tctgctctgggccagctattaa

SEQ ID NO: 9444512 - DNA, 23 bp, Homo sapiens
tctgctctgaagttcggctgagc

SEQ ID NO: 9444513 - DNA, 22 bp, Homo sapiens
tctgctctgtggcttcagctaa

SEQ ID NO: 9444514 - DNA, 22 bp, Homo sapiens
tctgctctgtggcttcagctaa

SEQ ID NO: 9444515 - DNA, 22 bp, Homo sapiens
tctgctgacctttctctgacac

SEQ ID NO: 9444516 - DNA, 22 bp, Homo sapiens
tctgctgagatgcccatggtta

SEQ ID NO: 9444517 - DNA, 22 bp, Homo sapiens
tctgctgaggccttcccactcc

SEQ ID NO: 9444518 - DNA, 22 bp, Homo sapiens
tctgctgagtcagacctctggg

SEQ ID NO: 9444519 - DNA, 22 bp, Homo sapiens
tctgctgccatgcagagcagta

SEQ ID NO: 9444520 - DNA, 22 bp, Homo sapiens
tctgctgcctgcagggcagaga

SEQ ID NO: 9444521 - DNA, 22 bp, Homo sapiens
tctgctgctgaccaacactgtg

SEQ ID NO: 9444522 - DNA, 22 bp, Homo sapiens
tctgctgtgattctactagtgt

SEQ ID NO: 9444523 - DNA, 22 bp, Homo sapiens
tctgctgtgaaaggtgaatatt

SEQ ID NO: 9444524 - DNA, 22 bp, Homo sapiens
tctgctgttcattcttttagct

SEQ ID NO: 9444525 - DNA, 22 bp, Homo sapiens
tctgctgtgtccctggtctcct

SEQ ID NO: 9444526 - DNA, 22 bp, Homo sapiens
tctgctgtgtcccctgtgcggg

SEQ ID NO: 9444527 - DNA, 22 bp, Homo sapiens
tctggaagaacggggcatgctg

SEQ ID NO: 9444528 - DNA, 22 bp, Homo sapiens
tctgctgttgagcacaagtgaa

SEQ ID NO: 9444529 - DNA, 22 bp, Homo sapiens
tctgctgttctcatgctgattt

SEQ ID NO: 9444530 - DNA, 22 bp, Homo sapiens
tctgctggtcaaggctgggtcc

SEQ ID NO: 9444531 - DNA, 23 bp, Homo sapiens
tctgctggtgacacggtcacatt

SEQ ID NO: 9444532 - DNA, 23 bp, Homo sapiens
tctgctggtgacacggtcacatt

SEQ ID NO: 9444533 - DNA, 22 bp, Homo sapiens
tctgctggtcaaggctgggtcc

SEQ ID NO: 9444534 - DNA, 22 bp, Homo sapiens
tctgctggccttagcaggtcta

SEQ ID NO: 9444535 - DNA, 22 bp, Homo sapiens
tctgctggtgatgacctcataa

SEQ ID NO: 9444536 - DNA, 22 bp, Homo sapiens
tctgctggtgatgacctcataa

SEQ ID NO: 9444537 - DNA, 22 bp, Homo sapiens
tctgctggttccgaattaggcc

SEQ ID NO: 9444538 - DNA, 19 bp, Homo sapiens
tctgctggcagaattccct

SEQ ID NO: 9444539 - DNA, 20 bp, Homo sapiens
tctgctggccaaaacttcac

SEQ ID NO: 9444540 - DNA, 22 bp, Homo sapiens
tctgctgctgagcacactccta

SEQ ID NO: 9444541 - DNA, 22 bp, Homo sapiens
tctggaggggtttagagggaca

SEQ ID NO: 9444542 - DNA, 22 bp, Homo sapiens
tctggaggggtttagagggaca

SEQ ID NO: 9444543 - DNA, 22 bp, Homo sapiens
tctggaggggtttagagggaca

SEQ ID NO: 9444544 - DNA, 22 bp, Homo sapiens
tctggagggggatgcctcatcc

SEQ ID NO: 9444545 - DNA, 22 bp, Homo sapiens
tctggagggggatgcctcatcc

SEQ ID NO: 9444546 - DNA, 22 bp, Homo sapiens
tctggagggggatgcctcatcc

SEQ ID NO: 9444547 - DNA, 18 bp, Homo sapiens
tctggagggaagctttga

SEQ ID NO: 9444548 - DNA, 22 bp, Homo sapiens
tctggaggctctgagggtgagt

SEQ ID NO: 9444549 - DNA, 22 bp, Homo sapiens
tctggagggcccacatccacaa

SEQ ID NO: 9444550 - DNA, 22 bp, Homo sapiens
tctggaggctctgagggtgagt

SEQ ID NO: 9444551 - DNA, 23 bp, Homo sapiens
tctggaggggacactgcagatgc

SEQ ID NO: 9444552 - DNA, 23 bp, Homo sapiens
tctggaggggacactgcagatgc

SEQ ID NO: 9444553 - DNA, 23 bp, Homo sapiens
tctggaggggacactgcagatgc

SEQ ID NO: 9444554 - DNA, 21 bp, Homo sapiens
tctggagccctaagctgagaa

SEQ ID NO: 9444555 - DNA, 22 bp, Homo sapiens
tctggagccacaaacctcagct

SEQ ID NO: 9444556 - DNA, 22 bp, Homo sapiens
tctggagcaacagagcaggaca

SEQ ID NO: 9444557 - DNA, 22 bp, Homo sapiens
tctggagcaacagagcaggaca

SEQ ID NO: 9444558 - DNA, 22 bp, Homo sapiens
tctggagcaacagagcaggaca

SEQ ID NO: 9444559 - DNA, 22 bp, Homo sapiens
tctggagatcatgtggggtgga

SEQ ID NO: 9444560 - DNA, 22 bp, Homo sapiens
tctggagatcatgtggggtgga

SEQ ID NO: 9444561 - DNA, 22 bp, Homo sapiens
tctggagatcatgtggggtgga

SEQ ID NO: 9444562 - DNA, 22 bp, Homo sapiens
tctggagataagcagcaatgaa

SEQ ID NO: 9444563 - DNA, 22 bp, Homo sapiens
tctggagtatgtccctggtgaa

SEQ ID NO: 9444564 - DNA, 22 bp, Homo sapiens
tctggagtggacccagagcact

SEQ ID NO: 9444565 - DNA, 23 bp, Homo sapiens
tctggatgccaccacatactaac

SEQ ID NO: 9444566 - DNA, 22 bp, Homo sapiens
tctggatgctctgagcccaagg

SEQ ID NO: 9444567 - DNA, 22 bp, Homo sapiens
tctggatgagattaatggtgtg

SEQ ID NO: 9444568 - DNA, 22 bp, Homo sapiens
tctggatgagattaatggtgtg

SEQ ID NO: 9444569 - DNA, 22 bp, Homo sapiens
tctggatgacagaatggtcata

SEQ ID NO: 9444570 - DNA, 22 bp, Homo sapiens
tctggatgatatgtgaacttga

SEQ ID NO: 9444571 - DNA, 22 bp, Homo sapiens
tctggatgaaagggctatatat

SEQ ID NO: 9444572 - DNA, 22 bp, Homo sapiens
tctggatgaagacccagaggct

SEQ ID NO: 9444573 - DNA, 22 bp, Homo sapiens
tctggatgacagaatggtcata

SEQ ID NO: 9444574 - DNA, 22 bp, Homo sapiens
tctggatgacagaatggtcata

SEQ ID NO: 9444575 - DNA, 22 bp, Homo sapiens
tctggatgaagacccagaggct

SEQ ID NO: 9444576 - DNA, 22 bp, Homo sapiens
tctggatctccctcatcctggg

SEQ ID NO: 9444577 - DNA, 22 bp, Homo sapiens
tctggatcgggttcctcaggtc

SEQ ID NO: 9444578 - DNA, 22 bp, Homo sapiens
tctggcaaaggcaaccacagtt

SEQ ID NO: 9444579 - DNA, 22 bp, Homo sapiens
tctggatttgtggaaaatctgc

SEQ ID NO: 9444580 - DNA, 17 bp, Homo sapiens
tctggatgtcatggaag

SEQ ID NO: 9444581 - DNA, 22 bp, Homo sapiens
tctggatgttgcggagtacaga

SEQ ID NO: 9444582 - DNA, 22 bp, Homo sapiens
tctggatgttgcggagtacaga

SEQ ID NO: 9444583 - DNA, 17 bp, Homo sapiens
tctggatgtcatggaag

SEQ ID NO: 9444584 - DNA, 22 bp, Homo sapiens
tctggagttttttctgtctgtg

SEQ ID NO: 9444585 - DNA, 22 bp, Homo sapiens
tctggatcctatgcactggact

SEQ ID NO: 9444586 - DNA, 22 bp, Homo sapiens
tctggatcgccggcgcctgggc

SEQ ID NO: 9444587 - DNA, 22 bp, Homo sapiens
tctggatcctatgcactggact

SEQ ID NO: 9444588 - DNA, 22 bp, Homo sapiens
tctggagttgaagttcttcccc

SEQ ID NO: 9444589 - DNA, 22 bp, Homo sapiens
tctggagttgaagttcttcccc

SEQ ID NO: 9444590 - DNA, 22 bp, Homo sapiens
tctggagttcctgcaggctgtg

SEQ ID NO: 9444591 - DNA, 22 bp, Homo sapiens
tctggagttactgctggctttg

SEQ ID NO: 9444592 - DNA, 22 bp, Homo sapiens
tctggagtgtccagttctactc

SEQ ID NO: 9444593 - DNA, 20 bp, Homo sapiens
tctggcacactgagaagctc

SEQ ID NO: 9444594 - DNA, 22 bp, Homo sapiens
tctggcaccactgagtctgcag

SEQ ID NO: 9444595 - DNA, 22 bp, Homo sapiens
tctggcaaaggcaaccacagtt

SEQ ID NO: 9444596 - DNA, 22 bp, Homo sapiens
tctggcacttgccagtttctat

SEQ ID NO: 9444597 - DNA, 22 bp, Homo sapiens
tctggcactgggctgtgtgagc

SEQ ID NO: 9444598 - DNA, 22 bp, Homo sapiens
tctggcaccctgacttagtgtt

SEQ ID NO: 9444599 - DNA, 22 bp, Homo sapiens
tctggcaccactgagtctgcag

SEQ ID NO: 9444600 - DNA, 22 bp, Homo sapiens
tctggcagaagtgctgtcagta

SEQ ID NO: 9444601 - DNA, 22 bp, Homo sapiens
tctggcagaggaaggaggcctg

SEQ ID NO: 9444602 - DNA, 22 bp, Homo sapiens
tctggcagagtcagtgcacaca

SEQ ID NO: 9444603 - DNA, 22 bp, Homo sapiens
tctggcagagtcagtgcacaca

SEQ ID NO: 9444604 - DNA, 22 bp, Homo sapiens
tctggcagtgaagtcatgaggt

SEQ ID NO: 9444605 - DNA, 22 bp, Homo sapiens
tctggcagtgaagtcatgaggt

SEQ ID NO: 9444606 - DNA, 22 bp, Homo sapiens
tctggcaggttcccatgttatg

SEQ ID NO: 9444607 - DNA, 22 bp, Homo sapiens
tctggcagagtgataggataag

SEQ ID NO: 9444608 - DNA, 22 bp, Homo sapiens
tctggcagcaagataacaatgg

SEQ ID NO: 9444609 - DNA, 22 bp, Homo sapiens
tctggccaatgttgtgatcaca

SEQ ID NO: 9444610 - DNA, 22 bp, Homo sapiens
tctggccaacaaaaactaagtc

SEQ ID NO: 9444611 - DNA, 22 bp, Homo sapiens
tctggccaaccctcaagttgta

SEQ ID NO: 9444612 - DNA, 22 bp, Homo sapiens
tctggccacccgaggcccctgc

SEQ ID NO: 9444613 - DNA, 22 bp, Homo sapiens
tctggcatctgttttcatattt

SEQ ID NO: 9444614 - DNA, 22 bp, Homo sapiens
tctggcatttcaggcatctata

SEQ ID NO: 9444615 - DNA, 22 bp, Homo sapiens
tctggcatcactcgcaagagca

SEQ ID NO: 9444616 - DNA, 22 bp, Homo sapiens
tctggcagttgccgcttcagtc

SEQ ID NO: 9444617 - DNA, 22 bp, Homo sapiens
tctggcagttccttgttgatat

SEQ ID NO: 9444618 - DNA, 22 bp, Homo sapiens
tctggcagtggatgagggcagc

SEQ ID NO: 9444619 - DNA, 22 bp, Homo sapiens
tctggccagaaagacttgatgt

SEQ ID NO: 9444620 - DNA, 22 bp, Homo sapiens
tctggccacccgaggcccctgc

SEQ ID NO: 9444621 - DNA, 22 bp, Homo sapiens
tctggccacccgaggcccctgc

SEQ ID NO: 9444622 - DNA, 22 bp, Homo sapiens
tctggccactaataggtctcac

SEQ ID NO: 9444623 - DNA, 22 bp, Homo sapiens
tctggcccaagttttcggtgag

SEQ ID NO: 9444624 - DNA, 22 bp, Homo sapiens
tctggcccagcccctgaggtca

SEQ ID NO: 9444625 - DNA, 22 bp, Homo sapiens
tctggcccagcccctgaggtca

SEQ ID NO: 9444626 - DNA, 22 bp, Homo sapiens
tctggcccatcttctgccacca

SEQ ID NO: 9444627 - DNA, 22 bp, Homo sapiens
tctggcccatcttctgccacca

SEQ ID NO: 9444628 - DNA, 22 bp, Homo sapiens
tctggcccatgatcctgctaac

SEQ ID NO: 9444629 - DNA, 22 bp, Homo sapiens
tctggcccagcccctgatccca

SEQ ID NO: 9444630 - DNA, 22 bp, Homo sapiens
tctggcccagcccctgatccca

SEQ ID NO: 9444631 - DNA, 22 bp, Homo sapiens
tctggcccagcccctgatccca

SEQ ID NO: 9444632 - DNA, 22 bp, Homo sapiens
tctggcccagcccctgaggtca

SEQ ID NO: 9444633 - DNA, 22 bp, Homo sapiens
tctgggcagccgccccatagga

SEQ ID NO: 9444634 - DNA, 22 bp, Homo sapiens
tctgggcagaagcagtgcaaag

SEQ ID NO: 9444635 - DNA, 22 bp, Homo sapiens
tctgggcagcagcagctagtag

SEQ ID NO: 9444636 - DNA, 22 bp, Homo sapiens
tctgggcagccatgtgcctggc

SEQ ID NO: 9444637 - DNA, 22 bp, Homo sapiens
tctgggcagcagcagctagtag

SEQ ID NO: 9444638 - DNA, 22 bp, Homo sapiens
tctgggcagaagcagtgcaaag

SEQ ID NO: 9444639 - DNA, 22 bp, Homo sapiens
tctgggcagaagcagtgcaaag

SEQ ID NO: 9444640 - DNA, 22 bp, Homo sapiens
tctgggcagcagcagctagtag

SEQ ID NO: 9444641 - DNA, 22 bp, Homo sapiens
tctgggcagcctcaggccaggg

SEQ ID NO: 9444642 - DNA, 22 bp, Homo sapiens
tctgggcagcctcaggccaggg

SEQ ID NO: 9444643 - DNA, 22 bp, Homo sapiens
tctgggcagcctcaggccaggg

SEQ ID NO: 9444644 - DNA, 22 bp, Homo sapiens
tctgggcagcctcaggccaggg

SEQ ID NO: 9444645 - DNA, 20 bp, Homo sapiens
tctgggcagggcacatggaa

SEQ ID NO: 9444646 - DNA, 20 bp, Homo sapiens
tctgggcagggcacatggaa

SEQ ID NO: 9444647 - DNA, 20 bp, Homo sapiens
tctgggcagggcacatggaa

SEQ ID NO: 9444648 - DNA, 19 bp, Homo sapiens
tctgggcagggccagcacc

SEQ ID NO: 9444649 - DNA, 22 bp, Homo sapiens
tctgggcagtacccctctccta

SEQ ID NO: 9444650 - DNA, 22 bp, Homo sapiens
tctgggcagtacccctctccta

SEQ ID NO: 9444651 - DNA, 19 bp, Homo sapiens
tctgggcagggccagcacc

SEQ ID NO: 9444652 - DNA, 22 bp, Homo sapiens
tctgggcagttcggatcctctg

SEQ ID NO: 9444653 - DNA, 22 bp, Homo sapiens
tctgggcagtacccctctccta

SEQ ID NO: 9444654 - DNA, 22 bp, Homo sapiens
tctgggcagttcggatcctctg

SEQ ID NO: 9444655 - DNA, 22 bp, Homo sapiens
tctgggatgaagccagaaactt

SEQ ID NO: 9444656 - DNA, 22 bp, Homo sapiens
tctgggataagaccacagattt

SEQ ID NO: 9444657 - DNA, 22 bp, Homo sapiens
tctgggatagggccagaacatg

SEQ ID NO: 9444658 - DNA, 22 bp, Homo sapiens
tctgggataagaccacagattt

SEQ ID NO: 9444659 - DNA, 22 bp, Homo sapiens
tctgggataagaccacagattt

SEQ ID NO: 9444660 - DNA, 22 bp, Homo sapiens
tctgggatgagatcagagacac

SEQ ID NO: 9444661 - DNA, 22 bp, Homo sapiens
tctgggatgcaaacagaatctg

SEQ ID NO: 9444662 - DNA, 22 bp, Homo sapiens
tctgggcaatggatgcactcac

SEQ ID NO: 9444663 - DNA, 22 bp, Homo sapiens
tctgggcacacaccatgcccac

SEQ ID NO: 9444664 - DNA, 22 bp, Homo sapiens
tctgggcacacaccatgcccac

SEQ ID NO: 9444665 - DNA, 22 bp, Homo sapiens
tctgggcaatggatgcactcac

SEQ ID NO: 9444666 - DNA, 22 bp, Homo sapiens
tctgggcactgctgagcctgta

SEQ ID NO: 9444667 - DNA, 22 bp, Homo sapiens
tctgggcactgctgagcctgta

SEQ ID NO: 9444668 - DNA, 22 bp, Homo sapiens
tctgggcactgctgagcctgta

SEQ ID NO: 9444669 - DNA, 22 bp, Homo sapiens
tctgggctcttagtgtaccctc

SEQ ID NO: 9444670 - DNA, 22 bp, Homo sapiens
tctgggccctaaaccagctcta

SEQ ID NO: 9444671 - DNA, 21 bp, Homo sapiens
tctgggcccatgctgcctcac

SEQ ID NO: 9444672 - DNA, 23 bp, Homo sapiens
tctgggccacttgtctgcacttc

SEQ ID NO: 9444673 - DNA, 23 bp, Homo sapiens
tctgggcatatctagtcacatcg

SEQ ID NO: 9444674 - DNA, 22 bp, Homo sapiens
tctgggcatgtctgtgaacacg

SEQ ID NO: 9444675 - DNA, 22 bp, Homo sapiens
tctgggccaacccttccatggg

SEQ ID NO: 9444676 - DNA, 23 bp, Homo sapiens
tctgggccacttgtctgcacttc

SEQ ID NO: 9444677 - DNA, 22 bp, Homo sapiens
tctgggctgctgtgcagtgacc

SEQ ID NO: 9444678 - DNA, 23 bp, Homo sapiens
tctgggctgcttaaggatcaagg

SEQ ID NO: 9444679 - DNA, 21 bp, Homo sapiens
tctgggctgctgctgcccatc

SEQ ID NO: 9444680 - DNA, 22 bp, Homo sapiens
tctgggctgctgtgcagtgacc

SEQ ID NO: 9444681 - DNA, 21 bp, Homo sapiens
tctgggctgctgctgcccatc

SEQ ID NO: 9444682 - DNA, 22 bp, Homo sapiens
tctgggctgctatgaggcagag

SEQ ID NO: 9444683 - DNA, 22 bp, Homo sapiens
tctgggctgctatgaggcagag

SEQ ID NO: 9444684 - DNA, 23 bp, Homo sapiens
tctgggctgagacttggaaggtc

SEQ ID NO: 9444685 - DNA, 23 bp, Homo sapiens
tctgggctgagacttggaaggtc

SEQ ID NO: 9444686 - DNA, 23 bp, Homo sapiens
tctgggctgagacttggaaggtc

SEQ ID NO: 9444687 - DNA, 22 bp, Homo sapiens
tctgggctgaaatgaaggcctt

SEQ ID NO: 9444688 - DNA, 22 bp, Homo sapiens
tctgggctgctatgaggcagag

SEQ ID NO: 9444689 - DNA, 22 bp, Homo sapiens
tctgggctgctatgaggcagag

SEQ ID NO: 9444690 - DNA, 23 bp, Homo sapiens
tctgggctgagctcgagtgtaga

SEQ ID NO: 9444691 - DNA, 23 bp, Homo sapiens
tctgggctgagctcgagtgtaga

SEQ ID NO: 9444692 - DNA, 22 bp, Homo sapiens
tctgggaagttggcagccagct

SEQ ID NO: 9444693 - DNA, 22 bp, Homo sapiens
tctgggaataaaactagggact

SEQ ID NO: 9444694 - DNA, 22 bp, Homo sapiens
tctgggaagtcctctgtcatgc

SEQ ID NO: 9444695 - DNA, 22 bp, Homo sapiens
tctgggaagtgagatgctgtgt

SEQ ID NO: 9444696 - DNA, 23 bp, Homo sapiens
tctgggaattggctgtccacagg

SEQ ID NO: 9444697 - DNA, 19 bp, Homo sapiens
tctgggaatgatgccagca

SEQ ID NO: 9444698 - DNA, 21 bp, Homo sapiens
tctgggacagggcctgaggag

SEQ ID NO: 9444699 - DNA, 22 bp, Homo sapiens
tctgggacattctctccatagt

SEQ ID NO: 9444700 - DNA, 22 bp, Homo sapiens
tctgggaatttattggcacttt

SEQ ID NO: 9444701 - DNA, 22 bp, Homo sapiens
tctgggacattctctccatagt

SEQ ID NO: 9444702 - DNA, 23 bp, Homo sapiens
tctgggaccactcaacaagtcag

SEQ ID NO: 9444703 - DNA, 22 bp, Homo sapiens
tctgggagaagctgatgtgaag

SEQ ID NO: 9444704 - DNA, 22 bp, Homo sapiens
tctgggagacgtgtgttgtcag

SEQ ID NO: 9444705 - DNA, 22 bp, Homo sapiens
tctgggagagcacgtggctgac

SEQ ID NO: 9444706 - DNA, 22 bp, Homo sapiens
tctgggagagctgctgtcagag

SEQ ID NO: 9444707 - DNA, 22 bp, Homo sapiens
tctgggagagcacgtggctgac

SEQ ID NO: 9444708 - DNA, 22 bp, Homo sapiens
tctgggagagctgctgtcagag

SEQ ID NO: 9444709 - DNA, 22 bp, Homo sapiens
tctgggagtgtgtctggccatc

SEQ ID NO: 9444710 - DNA, 22 bp, Homo sapiens
tctgggagttagaatacatggg

SEQ ID NO: 9444711 - DNA, 22 bp, Homo sapiens
tctgggaggtggcagggtgcat

SEQ ID NO: 9444712 - DNA, 22 bp, Homo sapiens
tctgggagtaaggcctaggcat

SEQ ID NO: 9444713 - DNA, 22 bp, Homo sapiens
tctgggagtaaggcctaggcat

SEQ ID NO: 9444714 - DNA, 22 bp, Homo sapiens
tctgggaggtaaccatgctgat

SEQ ID NO: 9444715 - DNA, 22 bp, Homo sapiens
tctgggaggtaaccatgctgat

SEQ ID NO: 9444716 - DNA, 22 bp, Homo sapiens
tctgggaggtaaccatgctgat

SEQ ID NO: 9444717 - DNA, 22 bp, Homo sapiens
tctgggaggggctgccattgct

SEQ ID NO: 9444718 - DNA, 22 bp, Homo sapiens
tctgggaggggctgccattgct

SEQ ID NO: 9444719 - DNA, 22 bp, Homo sapiens
tctgggagagtcacaggcattg

SEQ ID NO: 9444720 - DNA, 22 bp, Homo sapiens
tctgggagggagcctcagaatc

SEQ ID NO: 9444721 - DNA, 22 bp, Homo sapiens
tctgggagagtcacaggcattg

SEQ ID NO: 9444722 - DNA, 22 bp, Homo sapiens
tctgggaagcctgtatgcagaa

SEQ ID NO: 9444723 - DNA, 22 bp, Homo sapiens
tctgggaagcaaatatgtaaga

SEQ ID NO: 9444724 - DNA, 22 bp, Homo sapiens
tctgggaagctgcgtgcctgtt

SEQ ID NO: 9444725 - DNA, 22 bp, Homo sapiens
tctgggaagctgcgtgcctgtt

SEQ ID NO: 9444726 - DNA, 22 bp, Homo sapiens
tctgggaacgaaggctaatatg

SEQ ID NO: 9444727 - DNA, 21 bp, Homo sapiens
tctgggaaattgggaaagaag

SEQ ID NO: 9444728 - DNA, 22 bp, Homo sapiens
tctgggaacacacgtcacttca

SEQ ID NO: 9444729 - DNA, 22 bp, Homo sapiens
tctgggaacatggcttggaatc

SEQ ID NO: 9444730 - DNA, 22 bp, Homo sapiens
tctgggaaagtaaatgtaaagg

SEQ ID NO: 9444731 - DNA, 18 bp, Homo sapiens
tctggctttgttccttgt

SEQ ID NO: 9444732 - DNA, 22 bp, Homo sapiens
tctggcttttattcagttggca

SEQ ID NO: 9444733 - DNA, 22 bp, Homo sapiens
tctggctgacatcctgtatgag

SEQ ID NO: 9444734 - DNA, 22 bp, Homo sapiens
tctggctgccaccatcctcccc

SEQ ID NO: 9444735 - DNA, 22 bp, Homo sapiens
tctggctgccaccatcctcccc

SEQ ID NO: 9444736 - DNA, 22 bp, Homo sapiens
tctggctgattccctgggactg

SEQ ID NO: 9444737 - DNA, 22 bp, Homo sapiens
tctggctgctgcgtgagtgctt

SEQ ID NO: 9444738 - DNA, 23 bp, Homo sapiens
tctggctgctcctttcaatgctc

SEQ ID NO: 9444739 - DNA, 22 bp, Homo sapiens
tctggctgctgcgtgagtgctt

SEQ ID NO: 9444740 - DNA, 23 bp, Homo sapiens
tctggctgctcctttcaatgctc

SEQ ID NO: 9444741 - DNA, 22 bp, Homo sapiens
tctggctgttaggcctgacctt

SEQ ID NO: 9444742 - DNA, 21 bp, Homo sapiens
tctggctttcattccccttct

SEQ ID NO: 9444743 - DNA, 22 bp, Homo sapiens
tctggctttcatttgtttaaag

SEQ ID NO: 9444744 - DNA, 22 bp, Homo sapiens
tctggctttcctggagcaagaa

SEQ ID NO: 9444745 - DNA, 22 bp, Homo sapiens
tctggctttctgactctacaac

SEQ ID NO: 9444746 - DNA, 22 bp, Homo sapiens
tctggctttctcagcatggcat

SEQ ID NO: 9444747 - DNA, 23 bp, Homo sapiens
tctggctgtaatatgaaagttag

SEQ ID NO: 9444748 - DNA, 22 bp, Homo sapiens
tctggctgggctgacattgaac

SEQ ID NO: 9444749 - DNA, 22 bp, Homo sapiens
tctggctgtgtaaggtagcacc

SEQ ID NO: 9444750 - DNA, 22 bp, Homo sapiens
tctggctgtgtaaggtagcacc

SEQ ID NO: 9444751 - DNA, 22 bp, Homo sapiens
tctggctcctgagtccatgctc

SEQ ID NO: 9444752 - DNA, 19 bp, Homo sapiens
tctggctcctgccaggctg

SEQ ID NO: 9444753 - DNA, 22 bp, Homo sapiens
tctggctcctggctccactgcc

SEQ ID NO: 9444754 - DNA, 22 bp, Homo sapiens
tctggctcctggctccactgcc

SEQ ID NO: 9444755 - DNA, 22 bp, Homo sapiens
tctggctcctggctccactgcc

SEQ ID NO: 9444756 - DNA, 22 bp, Homo sapiens
tctggctctaactaggcatcag

SEQ ID NO: 9444757 - DNA, 22 bp, Homo sapiens
tctggctcggatttgtctagca

SEQ ID NO: 9444758 - DNA, 22 bp, Homo sapiens
tctggctcggatttgtctagca

SEQ ID NO: 9444759 - DNA, 23 bp, Homo sapiens
tctggctctatgtgacagctctc

SEQ ID NO: 9444760 - DNA, 22 bp, Homo sapiens
tctggctctataactcctagct

SEQ ID NO: 9444761 - DNA, 22 bp, Homo sapiens
tctggctctaactaggcatcag

SEQ ID NO: 9444762 - DNA, 22 bp, Homo sapiens
tctggctctcatactcgccagt

SEQ ID NO: 9444763 - DNA, 22 bp, Homo sapiens
tctggctctcatactcgccagt

SEQ ID NO: 9444764 - DNA, 22 bp, Homo sapiens
tctggctctcaacaaatattta

SEQ ID NO: 9444765 - DNA, 22 bp, Homo sapiens
tctggctctcatactcgccagt

SEQ ID NO: 9444766 - DNA, 22 bp, Homo sapiens
tctggctctggagtccacctgc

SEQ ID NO: 9444767 - DNA, 22 bp, Homo sapiens
tctggctctccagtgctcttag

SEQ ID NO: 9444768 - DNA, 22 bp, Homo sapiens
tctggctctctcatcacccaat

SEQ ID NO: 9444769 - DNA, 22 bp, Homo sapiens
tctggctctctcatcacccaat

SEQ ID NO: 9444770 - DNA, 22 bp, Homo sapiens
tctggctctgacactactgtta

SEQ ID NO: 9444771 - DNA, 22 bp, Homo sapiens
tctggctctgacactactgtta

SEQ ID NO: 9444772 - DNA, 22 bp, Homo sapiens
tctggctctgaattcacttctg

SEQ ID NO: 9444773 - DNA, 22 bp, Homo sapiens
tctggctgaattagccttgggt

SEQ ID NO: 9444774 - DNA, 22 bp, Homo sapiens
tctggctgaaaggggctgtgcc

SEQ ID NO: 9444775 - DNA, 22 bp, Homo sapiens
tctggctctttgggtgattgta

SEQ ID NO: 9444776 - DNA, 22 bp, Homo sapiens
tctggctctttgggtgattgta

SEQ ID NO: 9444777 - DNA, 20 bp, Homo sapiens
tctggctctttgctcctccc

SEQ ID NO: 9444778 - DNA, 22 bp, Homo sapiens
tctggctcccagcctgctctca

SEQ ID NO: 9444779 - DNA, 22 bp, Homo sapiens
tctggctccctggagctccaca

SEQ ID NO: 9444780 - DNA, 23 bp, Homo sapiens
tctggctccatccttggggatcc

SEQ ID NO: 9444781 - DNA, 22 bp, Homo sapiens
tctggccctatggcatgtacct

SEQ ID NO: 9444782 - DNA, 21 bp, Homo sapiens
tctggccctcacagtcacacc

SEQ ID NO: 9444783 - DNA, 21 bp, Homo sapiens
tctggccctcacagtcacacc

SEQ ID NO: 9444784 - DNA, 21 bp, Homo sapiens
tctggccctcacagtcacacc

SEQ ID NO: 9444785 - DNA, 21 bp, Homo sapiens
tctggccctcacagtcacacc

SEQ ID NO: 9444786 - DNA, 22 bp, Homo sapiens
tctggctccacacctcactgca

SEQ ID NO: 9444787 - DNA, 22 bp, Homo sapiens
tctggctccactttcttcattt

SEQ ID NO: 9444788 - DNA, 22 bp, Homo sapiens
tctggctccaggaccgggcaca

SEQ ID NO: 9444789 - DNA, 22 bp, Homo sapiens
tctggctccactctgtgcatgc

SEQ ID NO: 9444790 - DNA, 22 bp, Homo sapiens
tctggctccacacctcactgca

SEQ ID NO: 9444791 - DNA, 22 bp, Homo sapiens
tctggcccctggcagtcctgga

SEQ ID NO: 9444792 - DNA, 22 bp, Homo sapiens
tctggcccctatggcggtggag

SEQ ID NO: 9444793 - DNA, 22 bp, Homo sapiens
tctggcccctggcagtcctgga

SEQ ID NO: 9444794 - DNA, 22 bp, Homo sapiens
tctggcccctggtctctggtgt

SEQ ID NO: 9444795 - DNA, 22 bp, Homo sapiens
tctggcccctggtctctggtgt

SEQ ID NO: 9444796 - DNA, 22 bp, Homo sapiens
tctggcccctggtctctggtgt

SEQ ID NO: 9444797 - DNA, 22 bp, Homo sapiens
tctggccctatggcatgtacct

SEQ ID NO: 9444798 - DNA, 22 bp, Homo sapiens
tctggccctatggcatgtacct

SEQ ID NO: 9444799 - DNA, 22 bp, Homo sapiens
tctggccctatggcatgtacct

SEQ ID NO: 9444800 - DNA, 21 bp, Homo sapiens
tctggccctaggttgggcctc

SEQ ID NO: 9444801 - DNA, 20 bp, Homo sapiens
tctggccccttcctgtcctg

SEQ ID NO: 9444802 - DNA, 20 bp, Homo sapiens
tctggccccttcctgtcctg

SEQ ID NO: 9444803 - DNA, 22 bp, Homo sapiens
tctggccccggtcttcacagct

SEQ ID NO: 9444804 - DNA, 22 bp, Homo sapiens
tctggccccggtcttcacagct

SEQ ID NO: 9444805 - DNA, 22 bp, Homo sapiens
tctggccccggtcttcacagct

SEQ ID NO: 9444806 - DNA, 22 bp, Homo sapiens
tctggccccggtcttcacagct

SEQ ID NO: 9444807 - DNA, 22 bp, Homo sapiens
tctggccccggtcttcacagct

SEQ ID NO: 9444808 - DNA, 22 bp, Homo sapiens
tctggcccatgatcctgctaac

SEQ ID NO: 9444809 - DNA, 23 bp, Homo sapiens
tctggccccattctttcccatgt

SEQ ID NO: 9444810 - DNA, 22 bp, Homo sapiens
tctggccccgcatgcactttat

SEQ ID NO: 9444811 - DNA, 22 bp, Homo sapiens
tctggccccgcatgcactttat

SEQ ID NO: 9444812 - DNA, 23 bp, Homo sapiens
tctgtggctccttcaggctgctg

SEQ ID NO: 9444813 - DNA, 19 bp, Homo sapiens
tctgtggctgtggggagga

SEQ ID NO: 9444814 - DNA, 22 bp, Homo sapiens
tctgtggctgtctttccagagg

SEQ ID NO: 9444815 - DNA, 22 bp, Homo sapiens
tctgtggactcaagggatcaca

SEQ ID NO: 9444816 - DNA, 19 bp, Homo sapiens
tctgtggagctcagagtag

SEQ ID NO: 9444817 - DNA, 22 bp, Homo sapiens
tctgtgctttccctgccttctt

SEQ ID NO: 9444818 - DNA, 21 bp, Homo sapiens
tctgtgcttttttggctccta

SEQ ID NO: 9444819 - DNA, 21 bp, Homo sapiens
tctgtgctgccgtcaacatcc

SEQ ID NO: 9444820 - DNA, 22 bp, Homo sapiens
tctgtgctgagctctgagatgt

SEQ ID NO: 9444821 - DNA, 23 bp, Homo sapiens
tctgtgctacaaatcgcgtctgt

SEQ ID NO: 9444822 - DNA, 22 bp, Homo sapiens
tctgtgctagaggagttggcca

SEQ ID NO: 9444823 - DNA, 22 bp, Homo sapiens
tctgtgctagcacgcagcaagg

SEQ ID NO: 9444824 - DNA, 22 bp, Homo sapiens
tctgtgctcattcagtcattca

SEQ ID NO: 9444825 - DNA, 22 bp, Homo sapiens
tctgtgctaggcagcctggccc

SEQ ID NO: 9444826 - DNA, 22 bp, Homo sapiens
tctgtgctcaagttctgcctct

SEQ ID NO: 9444827 - DNA, 22 bp, Homo sapiens
tctgtgggtttcagggggctgt

SEQ ID NO: 9444828 - DNA, 22 bp, Homo sapiens
tctgtgggtagagtgagtactt

SEQ ID NO: 9444829 - DNA, 21 bp, Homo sapiens
tctgtggtatggccatcttcc

SEQ ID NO: 9444830 - DNA, 22 bp, Homo sapiens
tctgtggctttcgtgtaagatg

SEQ ID NO: 9444831 - DNA, 22 bp, Homo sapiens
tctgtggcttgggcctgcctgt

SEQ ID NO: 9444832 - DNA, 22 bp, Homo sapiens
tctgtggcttcctatttcttgg

SEQ ID NO: 9444833 - DNA, 18 bp, Homo sapiens
tctgtgggatcagtgagg

SEQ ID NO: 9444834 - DNA, 23 bp, Homo sapiens
tctgtgtctccacccaaatctca

SEQ ID NO: 9444835 - DNA, 22 bp, Homo sapiens
tctgtgtctgcagaagttcagc

SEQ ID NO: 9444836 - DNA, 22 bp, Homo sapiens
tctgtgtctggttgggccagta

SEQ ID NO: 9444837 - DNA, 22 bp, Homo sapiens
tctgtgtctgttacttcactgc

SEQ ID NO: 9444838 - DNA, 22 bp, Homo sapiens
tctgtgtcctgctagctgtctt

SEQ ID NO: 9444839 - DNA, 22 bp, Homo sapiens
tctgtgtcctgctagctgtctt

SEQ ID NO: 9444840 - DNA, 23 bp, Homo sapiens
tctgtgtcctcctggaccacaga

SEQ ID NO: 9444841 - DNA, 22 bp, Homo sapiens
tctgtgacttacaagaagggac

SEQ ID NO: 9444842 - DNA, 22 bp, Homo sapiens
tctgtgagaaccagtgccaggg

SEQ ID NO: 9444843 - DNA, 22 bp, Homo sapiens
tctgtgaaatcacccaggttta

SEQ ID NO: 9444844 - DNA, 22 bp, Homo sapiens
tctgtgaaatcacccaggttta

SEQ ID NO: 9444845 - DNA, 22 bp, Homo sapiens
tctgtgaaaggaaagaactgac

SEQ ID NO: 9444846 - DNA, 22 bp, Homo sapiens
tctgtgaaaggaaagaactgac

SEQ ID NO: 9444847 - DNA, 22 bp, Homo sapiens
tctgtgatagtttttcagctat

SEQ ID NO: 9444848 - DNA, 20 bp, Homo sapiens
tctgtgcacctgctacaagg

SEQ ID NO: 9444849 - DNA, 22 bp, Homo sapiens
tctgtgcaccttctaatgagta

SEQ ID NO: 9444850 - DNA, 22 bp, Homo sapiens
tctgtgcaccagaatgatattt

SEQ ID NO: 9444851 - DNA, 22 bp, Homo sapiens
tctgtctgccttgtgagggcac

SEQ ID NO: 9444852 - DNA, 22 bp, Homo sapiens
tctgtctgccttgtgagggcac

SEQ ID NO: 9444853 - DNA, 22 bp, Homo sapiens
tctgtctgccttgtgagggcac

SEQ ID NO: 9444854 - DNA, 22 bp, Homo sapiens
tctgtctgcctgtgtccccacc

SEQ ID NO: 9444855 - DNA, 22 bp, Homo sapiens
tctgtctgccccagcaagtcac

SEQ ID NO: 9444856 - DNA, 22 bp, Homo sapiens
tctgtctgccccagcaagtcac

SEQ ID NO: 9444857 - DNA, 22 bp, Homo sapiens
tctgtctgagggagtgacattt

SEQ ID NO: 9444858 - DNA, 22 bp, Homo sapiens
tctgtctgagggagtgacattt

SEQ ID NO: 9444859 - DNA, 22 bp, Homo sapiens
tctgtctgaggagtttttgacc

SEQ ID NO: 9444860 - DNA, 22 bp, Homo sapiens
tctgtctgaggagtttttgacc

SEQ ID NO: 9444861 - DNA, 22 bp, Homo sapiens
tctgtctgaggagtttttgacc

SEQ ID NO: 9444862 - DNA, 22 bp, Homo sapiens
tctgtctgagtggtgttagagt

SEQ ID NO: 9444863 - DNA, 22 bp, Homo sapiens
tctgtctgcacctaagcacagt

SEQ ID NO: 9444864 - DNA, 22 bp, Homo sapiens
tctgtctgcacctaagcacagt

SEQ ID NO: 9444865 - DNA, 22 bp, Homo sapiens
tctgtctgcacctaagcacagt

SEQ ID NO: 9444866 - DNA, 22 bp, Homo sapiens
tctgtctgagtggtgttagagt

SEQ ID NO: 9444867 - DNA, 22 bp, Homo sapiens
tctgtctgcttcacttgcattt

SEQ ID NO: 9444868 - DNA, 22 bp, Homo sapiens
tctgtctgcttcacttgcattt

SEQ ID NO: 9444869 - DNA, 22 bp, Homo sapiens
tctgtctgctcatttacctcag

SEQ ID NO: 9444870 - DNA, 22 bp, Homo sapiens
tctgtctgcgcttgccctggtg

SEQ ID NO: 9444871 - DNA, 22 bp, Homo sapiens
tctgtctttgagatctcagcct

SEQ ID NO: 9444872 - DNA, 22 bp, Homo sapiens
tctgtctttgagatctcagcct

SEQ ID NO: 9444873 - DNA, 22 bp, Homo sapiens
tctgtgaaacagctctggcatg

SEQ ID NO: 9444874 - DNA, 22 bp, Homo sapiens
tctgtgccgcgccggagaccct

SEQ ID NO: 9444875 - DNA, 22 bp, Homo sapiens
tctgtgccctcggtgctgggcc

SEQ ID NO: 9444876 - DNA, 22 bp, Homo sapiens
tctgtgccatgcccgtctacca

SEQ ID NO: 9444877 - DNA, 22 bp, Homo sapiens
tctgtgccatcagtctccagag

SEQ ID NO: 9444878 - DNA, 22 bp, Homo sapiens
tctgtgccagcagcctcctgga

SEQ ID NO: 9444879 - DNA, 22 bp, Homo sapiens
tctgtgccacctctccagtgtc

SEQ ID NO: 9444880 - DNA, 22 bp, Homo sapiens
tctgtgccacctctccagtgtc

SEQ ID NO: 9444881 - DNA, 22 bp, Homo sapiens
tctgtgccaagcttatatctgt

SEQ ID NO: 9444882 - DNA, 23 bp, Homo sapiens
tctgtgccagtttccatgtctgt

SEQ ID NO: 9444883 - DNA, 23 bp, Homo sapiens
tctgtgccagtttccatgtctgt

SEQ ID NO: 9444884 - DNA, 23 bp, Homo sapiens
tctgtgccagtttccatgtctgt

SEQ ID NO: 9444885 - DNA, 22 bp, Homo sapiens
tctgtgctaatgcttcacaata

SEQ ID NO: 9444886 - DNA, 22 bp, Homo sapiens
tctgtgcctttaagaagctcat

SEQ ID NO: 9444887 - DNA, 22 bp, Homo sapiens
tctgtgcctttaagaagctcat

SEQ ID NO: 9444888 - DNA, 22 bp, Homo sapiens
tctgtgcggtctgtgttatgaa

SEQ ID NO: 9444889 - DNA, 22 bp, Homo sapiens
tctgtgcctttaagaagctcat

SEQ ID NO: 9444890 - DNA, 22 bp, Homo sapiens
tctgtgcctcatctggttcagg

SEQ ID NO: 9444891 - DNA, 22 bp, Homo sapiens
tctgtgcctcatctggttcagg

SEQ ID NO: 9444892 - DNA, 21 bp, Homo sapiens
tctgtgcctcaaccctcatct

SEQ ID NO: 9444893 - DNA, 22 bp, Homo sapiens
tctgtgccttctcccagactta

SEQ ID NO: 9444894 - DNA, 22 bp, Homo sapiens
tctgtgcctccgtaacacacca

SEQ ID NO: 9444895 - DNA, 22 bp, Homo sapiens
tctgtgcctgcttccccaccca

SEQ ID NO: 9444896 - DNA, 20 bp, Homo sapiens
tctgtgcattgcctgctggt

SEQ ID NO: 9444897 - DNA, 20 bp, Homo sapiens
tctgtgcagtttaggaaggc

SEQ ID NO: 9444898 - DNA, 22 bp, Homo sapiens
tctgtgcagggaccccaagagt

SEQ ID NO: 9444899 - DNA, 22 bp, Homo sapiens
tctgtgcagtcagggctcagtc

SEQ ID NO: 9444900 - DNA, 22 bp, Homo sapiens
tctgtgcagacatggggaagcc

SEQ ID NO: 9444901 - DNA, 22 bp, Homo sapiens
tctgtgcagatgtagaccagtt

SEQ ID NO: 9444902 - DNA, 22 bp, Homo sapiens
tctgtgcaggaagtcattatga

SEQ ID NO: 9444903 - DNA, 22 bp, Homo sapiens
tctgtgcaggatttgaggaacc

SEQ ID NO: 9444904 - DNA, 22 bp, Homo sapiens
tctgtgcagaatcaaggagctt

SEQ ID NO: 9444905 - DNA, 22 bp, Homo sapiens
tctgtgcagaactcacagaagg

SEQ ID NO: 9444906 - DNA, 22 bp, Homo sapiens
tctgtgcactgtgtcattaggt

SEQ ID NO: 9444907 - DNA, 22 bp, Homo sapiens
tctgtgcactaacattcctggt

SEQ ID NO: 9444908 - DNA, 22 bp, Homo sapiens
tctgttttagataagaaaggct

SEQ ID NO: 9444909 - DNA, 22 bp, Homo sapiens
tctgttttagataagaaaggct

SEQ ID NO: 9444910 - DNA, 22 bp, Homo sapiens
tctgttttcatttgtcttgaga

SEQ ID NO: 9444911 - DNA, 22 bp, Homo sapiens
tctgtttcctcttgtgtaaagt

SEQ ID NO: 9444912 - DNA, 22 bp, Homo sapiens
tctgtttcctcttgtgtaaagt

SEQ ID NO: 9444913 - DNA, 22 bp, Homo sapiens
tctgtttattcaatttctatat

SEQ ID NO: 9444914 - DNA, 22 bp, Homo sapiens
tctgtttctccaacattgtgag

SEQ ID NO: 9444915 - DNA, 22 bp, Homo sapiens
tctgttttgtaccagatacagc

SEQ ID NO: 9444916 - DNA, 22 bp, Homo sapiens
tctgttttgtaccagatacagc

SEQ ID NO: 9444917 - DNA, 22 bp, Homo sapiens
tctgttttgtaccagatacagc

SEQ ID NO: 9444918 - DNA, 22 bp, Homo sapiens
tcttaaaagtatgccaattgga

SEQ ID NO: 9444919 - DNA, 22 bp, Homo sapiens
tcttaaactttgctgtaattct

SEQ ID NO: 9444920 - DNA, 22 bp, Homo sapiens
tcttaaagagcgcaatttgagg

SEQ ID NO: 9444921 - DNA, 22 bp, Homo sapiens
tcttaaaagtatgccaattgga

SEQ ID NO: 9444922 - DNA, 22 bp, Homo sapiens
tcttaaaagtatgccaattgga

SEQ ID NO: 9444923 - DNA, 22 bp, Homo sapiens
tcttaaaagtatgccaattgga

SEQ ID NO: 9444924 - DNA, 22 bp, Homo sapiens
tcttaaaagtatgccaattgga

SEQ ID NO: 9444925 - DNA, 22 bp, Homo sapiens
tcttaaagccaagcataaacca

SEQ ID NO: 9444926 - DNA, 22 bp, Homo sapiens
tcttaaagcagcttgtaaaatg

SEQ ID NO: 9444927 - DNA, 22 bp, Homo sapiens
tcttaaagcttacttcaattgt

SEQ ID NO: 9444928 - DNA, 22 bp, Homo sapiens
tcttaaaggcacatagtgtcta

SEQ ID NO: 9444929 - DNA, 22 bp, Homo sapiens
tcttaaaggcacatagtgtcta

SEQ ID NO: 9444930 - DNA, 22 bp, Homo sapiens
tcttaaaggcatgttagggtcc

SEQ ID NO: 9444931 - DNA, 22 bp, Homo sapiens
tcttatgaaaagcacttagaac

SEQ ID NO: 9444932 - DNA, 22 bp, Homo sapiens
tcttatatgcacatacattggg

SEQ ID NO: 9444933 - DNA, 22 bp, Homo sapiens
tcttatatgcacatacattggg

SEQ ID NO: 9444934 - DNA, 22 bp, Homo sapiens
tcttatacagaagatgtttaat

SEQ ID NO: 9444935 - DNA, 22 bp, Homo sapiens
tcttagttgtttgctgtctaac

SEQ ID NO: 9444936 - DNA, 16 bp, Homo sapiens
tcttagttgtgtggta

SEQ ID NO: 9444937 - DNA, 22 bp, Homo sapiens
tcttataaaaggactcccattt

SEQ ID NO: 9444938 - DNA, 22 bp, Homo sapiens
tcttagcaaattttctttgcct

SEQ ID NO: 9444939 - DNA, 22 bp, Homo sapiens
tcttagcaaatactacttagaa

SEQ ID NO: 9444940 - DNA, 22 bp, Homo sapiens
tcttaacatattattttagcac

SEQ ID NO: 9444941 - DNA, 22 bp, Homo sapiens
tcttaactatcatttgaacacc

SEQ ID NO: 9444942 - DNA, 22 bp, Homo sapiens
tcttaacagtgctacagagcag

SEQ ID NO: 9444943 - DNA, 22 bp, Homo sapiens
tcttaaatgactgataagagga

SEQ ID NO: 9444944 - DNA, 22 bp, Homo sapiens
tcttaacaagctcctcagtgct

SEQ ID NO: 9444945 - DNA, 20 bp, Homo sapiens
tcttaaatccccagggccat

SEQ ID NO: 9444946 - DNA, 20 bp, Homo sapiens
tcttaaatccccagggccat

SEQ ID NO: 9444947 - DNA, 22 bp, Homo sapiens
tcttaaatgactgataagagga

SEQ ID NO: 9444948 - DNA, 22 bp, Homo sapiens
tcttaaatgactgataagagga

SEQ ID NO: 9444949 - DNA, 22 bp, Homo sapiens
tcttagatgaataaaaagttat

SEQ ID NO: 9444950 - DNA, 22 bp, Homo sapiens
tcttagaattgaagtcagaggg

SEQ ID NO: 9444951 - DNA, 22 bp, Homo sapiens
tcttaatgaaagtgaaatatca

SEQ ID NO: 9444952 - DNA, 22 bp, Homo sapiens
tcttaatgaaagtgaaatatca

SEQ ID NO: 9444953 - DNA, 22 bp, Homo sapiens
tcttaagaaagtgacaaatagg

SEQ ID NO: 9444954 - DNA, 22 bp, Homo sapiens
tcttaagcagagaagaagttga

SEQ ID NO: 9444955 - DNA, 22 bp, Homo sapiens
tcttaactgacagtttaatggg

SEQ ID NO: 9444956 - DNA, 22 bp, Homo sapiens
tcttaagaaagtgacaaatagg

SEQ ID NO: 9444957 - DNA, 22 bp, Homo sapiens
tctgtgtgaccataagccagct

SEQ ID NO: 9444958 - DNA, 22 bp, Homo sapiens
tctgtgtgatttcagggaagtc

SEQ ID NO: 9444959 - DNA, 22 bp, Homo sapiens
tctgtgtgatttcagggaagtc

SEQ ID NO: 9444960 - DNA, 22 bp, Homo sapiens
tctgtgtgaccataagccagct

SEQ ID NO: 9444961 - DNA, 22 bp, Homo sapiens
tctgtgtgcccacctgacacct

SEQ ID NO: 9444962 - DNA, 20 bp, Homo sapiens
tctgtgtgccatcacctaac

SEQ ID NO: 9444963 - DNA, 22 bp, Homo sapiens
tctgtgtgcccacctgacacct

SEQ ID NO: 9444964 - DNA, 20 bp, Homo sapiens
tctgtgtgccatcacctaac

SEQ ID NO: 9444965 - DNA, 22 bp, Homo sapiens
tctgtgtgggatagtttgagga

SEQ ID NO: 9444966 - DNA, 22 bp, Homo sapiens
tctgtgtgggatagtttgagga

SEQ ID NO: 9444967 - DNA, 22 bp, Homo sapiens
tctgtgtgccctaaagcctgct

SEQ ID NO: 9444968 - DNA, 22 bp, Homo sapiens
tctgtgtggtagtttcagtgaa

SEQ ID NO: 9444969 - DNA, 22 bp, Homo sapiens
tctgtgtgttgtcaggaggatt

SEQ ID NO: 9444970 - DNA, 22 bp, Homo sapiens
tctgttatatagataatgtgtg

SEQ ID NO: 9444971 - DNA, 22 bp, Homo sapiens
tctgttataaatcacactgcat

SEQ ID NO: 9444972 - DNA, 22 bp, Homo sapiens
tctgttatatgttttttctaaa

SEQ ID NO: 9444973 - DNA, 22 bp, Homo sapiens
tctgttatatagataatgtgtg

SEQ ID NO: 9444974 - DNA, 22 bp, Homo sapiens
tctgttagctgtcaaagtgttt

SEQ ID NO: 9444975 - DNA, 22 bp, Homo sapiens
tctgttaacctggtcttggctt

SEQ ID NO: 9444976 - DNA, 22 bp, Homo sapiens
tctgttagagaggtagttcttg

SEQ ID NO: 9444977 - DNA, 20 bp, Homo sapiens
tctgtgtttcagctgcttga

SEQ ID NO: 9444978 - DNA, 22 bp, Homo sapiens
tctgtgtttaaaagatatgtcc

SEQ ID NO: 9444979 - DNA, 22 bp, Homo sapiens
tctgtgttttaaacagtagaaa

SEQ ID NO: 9444980 - DNA, 22 bp, Homo sapiens
tctgtgttttgtgcctactgct

SEQ ID NO: 9444981 - DNA, 22 bp, Homo sapiens
tctgtgtgttgtcaggaggatt

SEQ ID NO: 9444982 - DNA, 22 bp, Homo sapiens
tctgtgttgataattttggaga

SEQ ID NO: 9444983 - DNA, 22 bp, Homo sapiens
tctgtgttgagaaggatcatga

SEQ ID NO: 9444984 - DNA, 22 bp, Homo sapiens
tctgtttaatgggaatgatact

SEQ ID NO: 9444985 - DNA, 22 bp, Homo sapiens
tctgtttaatgggaatgatact

SEQ ID NO: 9444986 - DNA, 22 bp, Homo sapiens
tctgttggacattcatctgcag

SEQ ID NO: 9444987 - DNA, 22 bp, Homo sapiens
tctgttgcaatgtgcatggtga

SEQ ID NO: 9444988 - DNA, 22 bp, Homo sapiens
tctgttgcaatgtgcatggtga

SEQ ID NO: 9444989 - DNA, 22 bp, Homo sapiens
tctgttgcaatgtgcatggtga

SEQ ID NO: 9444990 - DNA, 22 bp, Homo sapiens
tctgtttagatgctttatctgt

SEQ ID NO: 9444991 - DNA, 22 bp, Homo sapiens
tctgtttatatttcaaaccttc

SEQ ID NO: 9444992 - DNA, 22 bp, Homo sapiens
tctgtttatgtgtctaaataaa

SEQ ID NO: 9444993 - DNA, 22 bp, Homo sapiens
tctgtttatgtgtctaaataaa

SEQ ID NO: 9444994 - DNA, 20 bp, Homo sapiens
tctgttattattacattgcc

SEQ ID NO: 9444995 - DNA, 22 bp, Homo sapiens
tctgttatgcataagcatcagt

SEQ ID NO: 9444996 - DNA, 22 bp, Homo sapiens
tctgttatggaagtttcctttt

SEQ ID NO: 9444997 - DNA, 22 bp, Homo sapiens
tctgttcttgtccccacttcag

SEQ ID NO: 9444998 - DNA, 22 bp, Homo sapiens
tctgttcttgtccccacttcag

SEQ ID NO: 9444999 - DNA, 22 bp, Homo sapiens
tctgttcttgtccccacttcag

SEQ ID NO: 9445000 - DNA, 22 bp, Homo sapiens
tctgttctttagcctgcttgag

SEQ ID NO: 9445001 - DNA, 22 bp, Homo sapiens
tctgttcttggtgcagctggga

SEQ ID NO: 9445002 - DNA, 22 bp, Homo sapiens
tctgttctttccaacaagacag

SEQ ID NO: 9445003 - DNA, 22 bp, Homo sapiens
tctgttctttccaacaagacag

SEQ ID NO: 9445004 - DNA, 22 bp, Homo sapiens
tctgttctttagcctgcttgag

SEQ ID NO: 9445005 - DNA, 22 bp, Homo sapiens
tctgttctttagcctgcttgag

SEQ ID NO: 9445006 - DNA, 23 bp, Homo sapiens
tctgttcttttagctgatcattt

SEQ ID NO: 9445007 - DNA, 23 bp, Homo sapiens
tctgttcttttagctgatcattt

SEQ ID NO: 9445008 - DNA, 22 bp, Homo sapiens
tctgttgactcctagcagccat

SEQ ID NO: 9445009 - DNA, 22 bp, Homo sapiens
tctgttgcaatgtgcatggtga

SEQ ID NO: 9445010 - DNA, 22 bp, Homo sapiens
tctgttgactcctagcagccat

SEQ ID NO: 9445011 - DNA, 22 bp, Homo sapiens
tctgttgactcctagcagccat

SEQ ID NO: 9445012 - DNA, 22 bp, Homo sapiens
tctgttgactcctagcagccat

SEQ ID NO: 9445013 - DNA, 22 bp, Homo sapiens
tctgtacagtaccagatagtaa

SEQ ID NO: 9445014 - DNA, 22 bp, Homo sapiens
tctgtacagtaccagatagtaa

SEQ ID NO: 9445015 - DNA, 23 bp, Homo sapiens
tctgtacacatcagcatctccca

SEQ ID NO: 9445016 - DNA, 22 bp, Homo sapiens
tctgtaatcttccccagctcag

SEQ ID NO: 9445017 - DNA, 22 bp, Homo sapiens
tctgtaatcaagatatttgaga

SEQ ID NO: 9445018 - DNA, 19 bp, Homo sapiens
tctgtaacactctagcctt

SEQ ID NO: 9445019 - DNA, 20 bp, Homo sapiens
tctgtaaagactccagaagc

SEQ ID NO: 9445020 - DNA, 22 bp, Homo sapiens
tctgtaaagtctgtgtaaagtc

SEQ ID NO: 9445021 - DNA, 22 bp, Homo sapiens
tctgtaaagccctggtacctgg

SEQ ID NO: 9445022 - DNA, 22 bp, Homo sapiens
tctgtaaagactccaaaagcca

SEQ ID NO: 9445023 - DNA, 22 bp, Homo sapiens
tctgtaaagactccaaaagcca

SEQ ID NO: 9445024 - DNA, 22 bp, Homo sapiens
tctgtaaagactccaaaagcca

SEQ ID NO: 9445025 - DNA, 22 bp, Homo sapiens
tctgtcacaagtaatccttttc

SEQ ID NO: 9445026 - DNA, 22 bp, Homo sapiens
tctgtattttaagatgctgttt

SEQ ID NO: 9445027 - DNA, 22 bp, Homo sapiens
tctgtcacccagagtgcagtgg

SEQ ID NO: 9445028 - DNA, 22 bp, Homo sapiens
tctgtcaccattcagcttgaat

SEQ ID NO: 9445029 - DNA, 22 bp, Homo sapiens
tctgtcacaatttgcttactct

SEQ ID NO: 9445030 - DNA, 22 bp, Homo sapiens
tctgtcacatacacttttcagg

SEQ ID NO: 9445031 - DNA, 22 bp, Homo sapiens
tctgtcaccattcagcttgaat

SEQ ID NO: 9445032 - DNA, 22 bp, Homo sapiens
tctgtcacccaggctggagtgc

SEQ ID NO: 9445033 - DNA, 22 bp, Homo sapiens
tctgtcacccaggctggagtgc

SEQ ID NO: 9445034 - DNA, 22 bp, Homo sapiens
tctgtataaggacaaacattta

SEQ ID NO: 9445035 - DNA, 22 bp, Homo sapiens
tctgtataaggacaaacattta

SEQ ID NO: 9445036 - DNA, 22 bp, Homo sapiens
tctgtattgagaaagccggaca

SEQ ID NO: 9445037 - DNA, 22 bp, Homo sapiens
tctgtattgattctgttaggca

SEQ ID NO: 9445038 - DNA, 22 bp, Homo sapiens
tctgtattgagaaagccggaca

SEQ ID NO: 9445039 - DNA, 20 bp, Homo sapiens
tctgtaggcaagttagcagg

SEQ ID NO: 9445040 - DNA, 22 bp, Homo sapiens
tctgtaggacagagaaatgggg

SEQ ID NO: 9445041 - DNA, 22 bp, Homo sapiens
tctgtagtaggttgtagttctt

SEQ ID NO: 9445042 - DNA, 22 bp, Homo sapiens
tctgtagtaggttgtagttctt

SEQ ID NO: 9445043 - DNA, 22 bp, Homo sapiens
tctgtagggtagtagtggagat

SEQ ID NO: 9445044 - DNA, 22 bp, Homo sapiens
tctgtacttcctttaaacttta

SEQ ID NO: 9445045 - DNA, 22 bp, Homo sapiens
tctgtacttcctttaaacttta

SEQ ID NO: 9445046 - DNA, 23 bp, Homo sapiens
tctgtacttagactggggcagaa

SEQ ID NO: 9445047 - DNA, 22 bp, Homo sapiens
tctgtctgacagggtatgaact

SEQ ID NO: 9445048 - DNA, 22 bp, Homo sapiens
tctgtctgactaccatgaggca

SEQ ID NO: 9445049 - DNA, 22 bp, Homo sapiens
tctgtctgactaccatgaggca

SEQ ID NO: 9445050 - DNA, 22 bp, Homo sapiens
tctgtctgactaccatgaggca

SEQ ID NO: 9445051 - DNA, 22 bp, Homo sapiens
tctgtctgactaccatgaggca

SEQ ID NO: 9445052 - DNA, 22 bp, Homo sapiens
tctgtctctttgttctgtgagt

SEQ ID NO: 9445053 - DNA, 23 bp, Homo sapiens
tctgtctgaataatttactcttt

SEQ ID NO: 9445054 - DNA, 18 bp, Homo sapiens
tctgtctctgtccttgct

SEQ ID NO: 9445055 - DNA, 18 bp, Homo sapiens
tctgtctctgtccttgct

SEQ ID NO: 9445056 - DNA, 20 bp, Homo sapiens
tctgtctctgagctagactt

SEQ ID NO: 9445057 - DNA, 22 bp, Homo sapiens
tctgtctctcaagggccgtcct

SEQ ID NO: 9445058 - DNA, 22 bp, Homo sapiens
tctgtctctcaagggccgtcct

SEQ ID NO: 9445059 - DNA, 21 bp, Homo sapiens
tctgtctctccactgccctgc

SEQ ID NO: 9445060 - DNA, 21 bp, Homo sapiens
tctgtctctccactgccctgc

SEQ ID NO: 9445061 - DNA, 21 bp, Homo sapiens
tctgtctctccactgccctgc

SEQ ID NO: 9445062 - DNA, 22 bp, Homo sapiens
tctgtctcctctgaggtgccag

SEQ ID NO: 9445063 - DNA, 22 bp, Homo sapiens
tctgtctcctgccagtgcctct

SEQ ID NO: 9445064 - DNA, 22 bp, Homo sapiens
tctgtctcctgccagtgcctct

SEQ ID NO: 9445065 - DNA, 22 bp, Homo sapiens
tctgtctcctgccagtgcctct

SEQ ID NO: 9445066 - DNA, 22 bp, Homo sapiens
tctgtcctgtttcctcctgaca

SEQ ID NO: 9445067 - DNA, 22 bp, Homo sapiens
tctgtcctgtttcctcctgaca

SEQ ID NO: 9445068 - DNA, 22 bp, Homo sapiens
tctgtcctgtttcctcctgaca

SEQ ID NO: 9445069 - DNA, 18 bp, Homo sapiens
tctgtccttccattcttc

SEQ ID NO: 9445070 - DNA, 22 bp, Homo sapiens
tctgtctcaagttcttgcactc

SEQ ID NO: 9445071 - DNA, 22 bp, Homo sapiens
tctgtctcctctgaggtgccag

SEQ ID NO: 9445072 - DNA, 22 bp, Homo sapiens
tctgtctcctcagatgactcca

SEQ ID NO: 9445073 - DNA, 22 bp, Homo sapiens
tctgtctcctctgaggtgccag

SEQ ID NO: 9445074 - DNA, 22 bp, Homo sapiens
tctgtctcctcagatgactcca

SEQ ID NO: 9445075 - DNA, 22 bp, Homo sapiens
tctgtctcaagttcttgcactc

SEQ ID NO: 9445076 - DNA, 22 bp, Homo sapiens
tctgtccctgagagctcaggag

SEQ ID NO: 9445077 - DNA, 22 bp, Homo sapiens
tctgtcctccggagctcccagt

SEQ ID NO: 9445078 - DNA, 22 bp, Homo sapiens
tctgtcctccggagctcccagt

SEQ ID NO: 9445079 - DNA, 22 bp, Homo sapiens
tctgtcctccggagctcccagt

SEQ ID NO: 9445080 - DNA, 22 bp, Homo sapiens
tctgtcatttcaatatggttaa

SEQ ID NO: 9445081 - DNA, 22 bp, Homo sapiens
tctgtcacccaggctggagtgc

SEQ ID NO: 9445082 - DNA, 22 bp, Homo sapiens
tctgtcatctctaaaatagaaa

SEQ ID NO: 9445083 - DNA, 22 bp, Homo sapiens
tctgtcatctgttcagtgctca

SEQ ID NO: 9445084 - DNA, 22 bp, Homo sapiens
tctgtccaacactctctagaca

SEQ ID NO: 9445085 - DNA, 20 bp, Homo sapiens
tctgggcttcccccagctcc

SEQ ID NO: 9445086 - DNA, 20 bp, Homo sapiens
tctgggcttcccccagctcc

SEQ ID NO: 9445087 - DNA, 17 bp, Homo sapiens
tctgggcttcagtggtc

SEQ ID NO: 9445088 - DNA, 17 bp, Homo sapiens
tctgggcttcagtggtc

SEQ ID NO: 9445089 - DNA, 22 bp, Homo sapiens
tctgggctgtggttccactccg

SEQ ID NO: 9445090 - DNA, 22 bp, Homo sapiens
tctgggctgtgggaattcaaca

SEQ ID NO: 9445091 - DNA, 22 bp, Homo sapiens
tctgggctgtgccaaagctctt

SEQ ID NO: 9445092 - DNA, 22 bp, Homo sapiens
tctgggctgtgccaaagctctt

SEQ ID NO: 9445093 - DNA, 22 bp, Homo sapiens
tctgggctgtggttccactccg

SEQ ID NO: 9445094 - DNA, 22 bp, Homo sapiens
tctgggcttgcctggttgtgca

SEQ ID NO: 9445095 - DNA, 22 bp, Homo sapiens
tctgggcttgcctggttgtgca

SEQ ID NO: 9445096 - DNA, 22 bp, Homo sapiens
tctgggcttggattggctctgc

SEQ ID NO: 9445097 - DNA, 18 bp, Homo sapiens
tctgggcttcccgaggct

SEQ ID NO: 9445098 - DNA, 20 bp, Homo sapiens
tctgggcttcccccagctcc

SEQ ID NO: 9445099 - DNA, 18 bp, Homo sapiens
tctgggcttcccgaggct

SEQ ID NO: 9445100 - DNA, 15 bp, Homo sapiens
tctgggctgtgagca

SEQ ID NO: 9445101 - DNA, 15 bp, Homo sapiens
tctgggctgtgagca

SEQ ID NO: 9445102 - DNA, 22 bp, Homo sapiens
tctgggctgtctacaggttggc

SEQ ID NO: 9445103 - DNA, 22 bp, Homo sapiens
tctgggctgtctacaggttggc

SEQ ID NO: 9445104 - DNA, 22 bp, Homo sapiens
tctgggctgtctacaggttggc

SEQ ID NO: 9445105 - DNA, 22 bp, Homo sapiens
tctgggctggtgctcatgaatt

SEQ ID NO: 9445106 - DNA, 22 bp, Homo sapiens
tctgggctggtgctcatgaatt

SEQ ID NO: 9445107 - DNA, 22 bp, Homo sapiens
tctgggctggttgtgcttgctt

SEQ ID NO: 9445108 - DNA, 22 bp, Homo sapiens
tctgggctgggcttaggaaccc

SEQ ID NO: 9445109 - DNA, 22 bp, Homo sapiens
tctgggctgggagcgtgtggac

SEQ ID NO: 9445110 - DNA, 22 bp, Homo sapiens
tctgggctgggagcgtgtggac

SEQ ID NO: 9445111 - DNA, 22 bp, Homo sapiens
tctgggctggctttatgctgac

SEQ ID NO: 9445112 - DNA, 22 bp, Homo sapiens
tctgggctggctttatgctgac

SEQ ID NO: 9445113 - DNA, 23 bp, Homo sapiens
tctgggctgcttaaggatcaagg

SEQ ID NO: 9445114 - DNA, 22 bp, Homo sapiens
tctgggctgcttcagccttcgc

SEQ ID NO: 9445115 - DNA, 22 bp, Homo sapiens
tctgggcttgggtagaaatcac

SEQ ID NO: 9445116 - DNA, 22 bp, Homo sapiens
tctgggcttggttagggctgtt

SEQ ID NO: 9445117 - DNA, 22 bp, Homo sapiens
tctgggctttaagaactctgtt

SEQ ID NO: 9445118 - DNA, 22 bp, Homo sapiens
tctgggctttaagaactctgtt

SEQ ID NO: 9445119 - DNA, 22 bp, Homo sapiens
tctgggctttgtaatgggaggt

SEQ ID NO: 9445120 - DNA, 22 bp, Homo sapiens
tctgggctttgtaatgggaggt

SEQ ID NO: 9445121 - DNA, 22 bp, Homo sapiens
tctgggctttgtaatgggaggt

SEQ ID NO: 9445122 - DNA, 21 bp, Homo sapiens
tctgggctttcttataaggca

SEQ ID NO: 9445123 - DNA, 21 bp, Homo sapiens
tctgggctttcttataaggca

SEQ ID NO: 9445124 - DNA, 22 bp, Homo sapiens
tctgggctttagtttgttatct

SEQ ID NO: 9445125 - DNA, 22 bp, Homo sapiens
tctgggctttacactgtgctta

SEQ ID NO: 9445126 - DNA, 22 bp, Homo sapiens
tctggggatgagtgatgtcgta

SEQ ID NO: 9445127 - DNA, 22 bp, Homo sapiens
tctggggcagttactggggcct

SEQ ID NO: 9445128 - DNA, 20 bp, Homo sapiens
tctggggatgaggtctagga

SEQ ID NO: 9445129 - DNA, 20 bp, Homo sapiens
tctggggatgaggtctagga

SEQ ID NO: 9445130 - DNA, 20 bp, Homo sapiens
tctggggatgaggtctagga

SEQ ID NO: 9445131 - DNA, 22 bp, Homo sapiens
tctgggggaggaggcatggccc

SEQ ID NO: 9445132 - DNA, 22 bp, Homo sapiens
tctgggtcggaagccccaggga

SEQ ID NO: 9445133 - DNA, 22 bp, Homo sapiens
tctgggtccgggactgtggatg

SEQ ID NO: 9445134 - DNA, 22 bp, Homo sapiens
tctgggtctatcccatgccttt

SEQ ID NO: 9445135 - DNA, 22 bp, Homo sapiens
tctgggtctatgatctcacttc

SEQ ID NO: 9445136 - DNA, 22 bp, Homo sapiens
tctgggtctatcccatgccttt

SEQ ID NO: 9445137 - DNA, 22 bp, Homo sapiens
tctgggtctatgatctcacttc

SEQ ID NO: 9445138 - DNA, 22 bp, Homo sapiens
tctgggtctttacccatggaat

SEQ ID NO: 9445139 - DNA, 22 bp, Homo sapiens
tctgggtctggctgctggtgca

SEQ ID NO: 9445140 - DNA, 22 bp, Homo sapiens
tctgggtctcagagtgaccatg

SEQ ID NO: 9445141 - DNA, 22 bp, Homo sapiens
tctgggtctcagagtgaccatg

SEQ ID NO: 9445142 - DNA, 22 bp, Homo sapiens
tctgggtctggctgctggtgca

SEQ ID NO: 9445143 - DNA, 22 bp, Homo sapiens
tctggggttgagtctgggtcag

SEQ ID NO: 9445144 - DNA, 22 bp, Homo sapiens
tctggggttaagcccaggaatg

SEQ ID NO: 9445145 - DNA, 22 bp, Homo sapiens
tctggggttggtgcttacacca

SEQ ID NO: 9445146 - DNA, 22 bp, Homo sapiens
tctgggtaatcagggctgggag

SEQ ID NO: 9445147 - DNA, 22 bp, Homo sapiens
tctgggtcactgtgggagggca

SEQ ID NO: 9445148 - DNA, 22 bp, Homo sapiens
tctgggtcatgactcagcgtga

SEQ ID NO: 9445149 - DNA, 22 bp, Homo sapiens
tctgggtccccgaggaaggaga

SEQ ID NO: 9445150 - DNA, 22 bp, Homo sapiens
tctggggtgcagcctggacata

SEQ ID NO: 9445151 - DNA, 22 bp, Homo sapiens
tctggggtgcagcctaggcatc

SEQ ID NO: 9445152 - DNA, 18 bp, Homo sapiens
tctggggtgtgctgtgta

SEQ ID NO: 9445153 - DNA, 22 bp, Homo sapiens
tctggggtgtgacctgagcatg

SEQ ID NO: 9445154 - DNA, 22 bp, Homo sapiens
tctggggtgtgacctgagcatg

SEQ ID NO: 9445155 - DNA, 22 bp, Homo sapiens
tctgggggttaagtgaggacaa

SEQ ID NO: 9445156 - DNA, 22 bp, Homo sapiens
tctgtaaaacttctttgtaaat

SEQ ID NO: 9445157 - DNA, 22 bp, Homo sapiens
tctgtaaaacttctttgtaaat

SEQ ID NO: 9445158 - DNA, 22 bp, Homo sapiens
tctgtaaacaccatgttagagt

SEQ ID NO: 9445159 - DNA, 22 bp, Homo sapiens
tctgtaaacaccatgttagagt

SEQ ID NO: 9445160 - DNA, 22 bp, Homo sapiens
tctgtaaaattagtataattgt

SEQ ID NO: 9445161 - DNA, 22 bp, Homo sapiens
tctgtaaaacaatattgtattc

SEQ ID NO: 9445162 - DNA, 22 bp, Homo sapiens
tctgtaaaacaatattgtattc

SEQ ID NO: 9445163 - DNA, 22 bp, Homo sapiens
tctgggtggtgtcttccaagac

SEQ ID NO: 9445164 - DNA, 22 bp, Homo sapiens
tctgggtggctgccaatctgcc

SEQ ID NO: 9445165 - DNA, 22 bp, Homo sapiens
tctgggtggcagtgatggcgtg

SEQ ID NO: 9445166 - DNA, 21 bp, Homo sapiens
tctgggtgctagtgtttgctt

SEQ ID NO: 9445167 - DNA, 22 bp, Homo sapiens
tctgggtgccactgtctgtaca

SEQ ID NO: 9445168 - DNA, 22 bp, Homo sapiens
tctgggtgagctgcctcgggtc

SEQ ID NO: 9445169 - DNA, 22 bp, Homo sapiens
tcttcatgccaaatgagttttg

SEQ ID NO: 9445170 - DNA, 18 bp, Homo sapiens
tcttcatctcctgagctg

SEQ ID NO: 9445171 - DNA, 22 bp, Homo sapiens
tcttcatgcacctcacagctag

SEQ ID NO: 9445172 - DNA, 22 bp, Homo sapiens
tcttcatctcagattaacagga

SEQ ID NO: 9445173 - DNA, 22 bp, Homo sapiens
tcttcatatataaagtggaata

SEQ ID NO: 9445174 - DNA, 22 bp, Homo sapiens
tcttcatatataaagtggaata

SEQ ID NO: 9445175 - DNA, 22 bp, Homo sapiens
tcttcatactcatcacataggt

SEQ ID NO: 9445176 - DNA, 22 bp, Homo sapiens
tcttcatactcatcacataggt

SEQ ID NO: 9445177 - DNA, 22 bp, Homo sapiens
tcttcatactcatcacataggt

SEQ ID NO: 9445178 - DNA, 22 bp, Homo sapiens
tcttcatacaatttcagacatc

SEQ ID NO: 9445179 - DNA, 22 bp, Homo sapiens
tcttcatacaatttcagacatc

SEQ ID NO: 9445180 - DNA, 22 bp, Homo sapiens
tcttcatacaatttcagacatc

SEQ ID NO: 9445181 - DNA, 22 bp, Homo sapiens
tcttcagtgcatgttacctata

SEQ ID NO: 9445182 - DNA, 22 bp, Homo sapiens
tcttcagtgcacctgatgtctt

SEQ ID NO: 9445183 - DNA, 22 bp, Homo sapiens
tcttcagttgtcatactgcctt

SEQ ID NO: 9445184 - DNA, 22 bp, Homo sapiens
tcttcagttgtaaaagtgttgg

SEQ ID NO: 9445185 - DNA, 22 bp, Homo sapiens
tcttcagtgcatgttacctata

SEQ ID NO: 9445186 - DNA, 22 bp, Homo sapiens
tcttcagtcaatccagatgttt

SEQ ID NO: 9445187 - DNA, 22 bp, Homo sapiens
tcttcagtcaatccagatgttt

SEQ ID NO: 9445188 - DNA, 22 bp, Homo sapiens
tcttcagtatttggataacatt

SEQ ID NO: 9445189 - DNA, 22 bp, Homo sapiens
tcttcagctgtagtcattgttc

SEQ ID NO: 9445190 - DNA, 22 bp, Homo sapiens
tcttcagctctgaggctctggc

SEQ ID NO: 9445191 - DNA, 22 bp, Homo sapiens
tcttcagcagggcctctctgag

SEQ ID NO: 9445192 - DNA, 22 bp, Homo sapiens
tcttcagcagagaattatgatg

SEQ ID NO: 9445193 - DNA, 22 bp, Homo sapiens
tcttcaggaagggaaatcatcc

SEQ ID NO: 9445194 - DNA, 22 bp, Homo sapiens
tcttcaggaagggaaatcatcc

SEQ ID NO: 9445195 - DNA, 22 bp, Homo sapiens
tcttcaggaagggaaatcatcc

SEQ ID NO: 9445196 - DNA, 22 bp, Homo sapiens
tcttcaggaagggaaatcatcc

SEQ ID NO: 9445197 - DNA, 22 bp, Homo sapiens
tcttcaggctctggctgccttt

SEQ ID NO: 9445198 - DNA, 22 bp, Homo sapiens
tcttcagggtctgccccagggg

SEQ ID NO: 9445199 - DNA, 22 bp, Homo sapiens
tcttccaatggtttctagattt

SEQ ID NO: 9445200 - DNA, 22 bp, Homo sapiens
tcttccaatacctagattttgg

SEQ ID NO: 9445201 - DNA, 18 bp, Homo sapiens
tcttccaacactgacacc

SEQ ID NO: 9445202 - DNA, 21 bp, Homo sapiens
tcttccaagggctgctgagac

SEQ ID NO: 9445203 - DNA, 22 bp, Homo sapiens
tcttccaaggtgcagatcttct

SEQ ID NO: 9445204 - DNA, 22 bp, Homo sapiens
tcttcatgttgcttattctggg

SEQ ID NO: 9445205 - DNA, 22 bp, Homo sapiens
tcttcatgttgcttattctggg

SEQ ID NO: 9445206 - DNA, 22 bp, Homo sapiens
tcttcattccgtagatatttat

SEQ ID NO: 9445207 - DNA, 22 bp, Homo sapiens
tcttcatgtcatggtatattga

SEQ ID NO: 9445208 - DNA, 22 bp, Homo sapiens
tcttccaaatgaatatggtttt

SEQ ID NO: 9445209 - DNA, 22 bp, Homo sapiens
tcttccaaaattagtctcagtt

SEQ ID NO: 9445210 - DNA, 22 bp, Homo sapiens
tcttccagcaatgtgaaatcac

SEQ ID NO: 9445211 - DNA, 22 bp, Homo sapiens
tcttccagaatgcattctcttt

SEQ ID NO: 9445212 - DNA, 22 bp, Homo sapiens
tcttccagaagtgttttcagaa

SEQ ID NO: 9445213 - DNA, 22 bp, Homo sapiens
tcttccagatacttcctgactt

SEQ ID NO: 9445214 - DNA, 19 bp, Homo sapiens
tcttattgagcagctgagg

SEQ ID NO: 9445215 - DNA, 22 bp, Homo sapiens
tcttattgtctagattgagatg

SEQ ID NO: 9445216 - DNA, 22 bp, Homo sapiens
tcttattggtaatgatggcatt

SEQ ID NO: 9445217 - DNA, 22 bp, Homo sapiens
tcttattattgttgtaaaagca

SEQ ID NO: 9445218 - DNA, 22 bp, Homo sapiens
tcttatgtcaagaatgaatatt

SEQ ID NO: 9445219 - DNA, 22 bp, Homo sapiens
tcttatgcatattcataacaca

SEQ ID NO: 9445220 - DNA, 22 bp, Homo sapiens
tcttattgtgatgatgaagaac

SEQ ID NO: 9445221 - DNA, 22 bp, Homo sapiens
tcttattgtttaaaagtacaca

SEQ ID NO: 9445222 - DNA, 22 bp, Homo sapiens
tcttatttagagaggactagag

SEQ ID NO: 9445223 - DNA, 22 bp, Homo sapiens
tcttatttgcaactggctcaga

SEQ ID NO: 9445224 - DNA, 22 bp, Homo sapiens
tcttattttttaatgacagaga

SEQ ID NO: 9445225 - DNA, 22 bp, Homo sapiens
tcttattttgttagatgctgta

SEQ ID NO: 9445226 - DNA, 22 bp, Homo sapiens
tcttatttgcaactggctcaga

SEQ ID NO: 9445227 - DNA, 22 bp, Homo sapiens
tcttcaaatacagtcatattga

SEQ ID NO: 9445228 - DNA, 22 bp, Homo sapiens
tcttcaaagcatatgcaggcat

SEQ ID NO: 9445229 - DNA, 22 bp, Homo sapiens
tcttcaaagaattttagtaatt

SEQ ID NO: 9445230 - DNA, 22 bp, Homo sapiens
tcttcaaagaattttagtaatt

SEQ ID NO: 9445231 - DNA, 22 bp, Homo sapiens
tcttcaaagaattttagtaatt

SEQ ID NO: 9445232 - DNA, 22 bp, Homo sapiens
tcttcaaagaagccttggatta

SEQ ID NO: 9445233 - DNA, 22 bp, Homo sapiens
tcttcaaactgaaaatttagaa

SEQ ID NO: 9445234 - DNA, 22 bp, Homo sapiens
tcttcaaagaattttagtaatt

SEQ ID NO: 9445235 - DNA, 22 bp, Homo sapiens
tcttcaaagaagccttggatta

SEQ ID NO: 9445236 - DNA, 22 bp, Homo sapiens
tcttcaaaccctggttttgtga

SEQ ID NO: 9445237 - DNA, 22 bp, Homo sapiens
tcttcaaactgaaaatttagaa

SEQ ID NO: 9445238 - DNA, 22 bp, Homo sapiens
tcttattttttaatgacagaga

SEQ ID NO: 9445239 - DNA, 22 bp, Homo sapiens
tcttcaaaaactgcaccttgct

SEQ ID NO: 9445240 - DNA, 22 bp, Homo sapiens
tcttcaaaaatacaggttttca

SEQ ID NO: 9445241 - DNA, 22 bp, Homo sapiens
tcttcaaaaaatatccatcagt

SEQ ID NO: 9445242 - DNA, 22 bp, Homo sapiens
tcttcaaaaaatatccatcagt

SEQ ID NO: 9445243 - DNA, 22 bp, Homo sapiens
tcttcaaaaaatatccatcagt

SEQ ID NO: 9445244 - DNA, 22 bp, Homo sapiens
tcttcaaaaatacaggttttca

SEQ ID NO: 9445245 - DNA, 22 bp, Homo sapiens
tcttcaaaatattccatccatt

SEQ ID NO: 9445246 - DNA, 22 bp, Homo sapiens
tcttcaaaatattccatccatt

SEQ ID NO: 9445247 - DNA, 22 bp, Homo sapiens
tcttcaaaaatacaggttttca

SEQ ID NO: 9445248 - DNA, 22 bp, Homo sapiens
tcttcaaaaactgcaccttgct

SEQ ID NO: 9445249 - DNA, 22 bp, Homo sapiens
tcttcaaaccctggctcttcct

SEQ ID NO: 9445250 - DNA, 22 bp, Homo sapiens
tcttcaaaattgattggagaag

SEQ ID NO: 9445251 - DNA, 22 bp, Homo sapiens
tcttcaaactgaaaatttagaa

SEQ ID NO: 9445252 - DNA, 22 bp, Homo sapiens
tcttcaattagatttaccaatt

SEQ ID NO: 9445253 - DNA, 22 bp, Homo sapiens
tcttcaattagatttaccaatt

SEQ ID NO: 9445254 - DNA, 22 bp, Homo sapiens
tcttcaatatgtgtttaatatt

SEQ ID NO: 9445255 - DNA, 22 bp, Homo sapiens
tcttcacacacagtcctctttc

SEQ ID NO: 9445256 - DNA, 22 bp, Homo sapiens
tcttcaatttagaatggattta

SEQ ID NO: 9445257 - DNA, 22 bp, Homo sapiens
tcttcacaccgggcagcaggaa

SEQ ID NO: 9445258 - DNA, 22 bp, Homo sapiens
tcttcacaccgggcagcaggaa

SEQ ID NO: 9445259 - DNA, 22 bp, Homo sapiens
tcttcaaatgctagtaatatca

SEQ ID NO: 9445260 - DNA, 22 bp, Homo sapiens
tcttcaaatcctacagtgtctg

SEQ ID NO: 9445261 - DNA, 22 bp, Homo sapiens
tcttcaaatgagtgtggattat

SEQ ID NO: 9445262 - DNA, 22 bp, Homo sapiens
tcttcaaatgctagtaatatca

SEQ ID NO: 9445263 - DNA, 22 bp, Homo sapiens
tcttcaaatacagtcatattga

SEQ ID NO: 9445264 - DNA, 22 bp, Homo sapiens
tcttcaaatcctacagtgtctg

SEQ ID NO: 9445265 - DNA, 22 bp, Homo sapiens
tcttcaaatacagtcatattga

SEQ ID NO: 9445266 - DNA, 22 bp, Homo sapiens
tcttcacatcatgttttttaat

SEQ ID NO: 9445267 - DNA, 22 bp, Homo sapiens
tcttcacatgaccttcatgtct

SEQ ID NO: 9445268 - DNA, 22 bp, Homo sapiens
tcttcacatgaccttcatgtct

SEQ ID NO: 9445269 - DNA, 22 bp, Homo sapiens
tcttcacatggaacatgaagct

SEQ ID NO: 9445270 - DNA, 22 bp, Homo sapiens
tcttcacatggaacatgaagct

SEQ ID NO: 9445271 - DNA, 22 bp, Homo sapiens
tcttcagattgcactgagcaag

SEQ ID NO: 9445272 - DNA, 22 bp, Homo sapiens
tcttcagcaactccccaatctg

SEQ ID NO: 9445273 - DNA, 22 bp, Homo sapiens
tcttcacagtcctggtcagtgg

SEQ ID NO: 9445274 - DNA, 22 bp, Homo sapiens
tcttcacatattccttgagcta

SEQ ID NO: 9445275 - DNA, 22 bp, Homo sapiens
tcttcacatattccttgagcta

SEQ ID NO: 9445276 - DNA, 22 bp, Homo sapiens
tcttcacaggagcctgcctgcc

SEQ ID NO: 9445277 - DNA, 23 bp, Homo sapiens
tcttcacagggcttcccatgtgc

SEQ ID NO: 9445278 - DNA, 22 bp, Homo sapiens
tcttcacagatgcatatacttc

SEQ ID NO: 9445279 - DNA, 22 bp, Homo sapiens
tcttcacagatgcatatacttc

SEQ ID NO: 9445280 - DNA, 22 bp, Homo sapiens
tcttcacagatgcatatacttc

SEQ ID NO: 9445281 - DNA, 22 bp, Homo sapiens
tcttcacagatgcatatacttc

SEQ ID NO: 9445282 - DNA, 22 bp, Homo sapiens
tcttcacagctttgtccagaag

SEQ ID NO: 9445283 - DNA, 22 bp, Homo sapiens
tcttcacagctttgtccagaag

SEQ ID NO: 9445284 - DNA, 22 bp, Homo sapiens
tcttctccagtgcttctgcaca

SEQ ID NO: 9445285 - DNA, 22 bp, Homo sapiens
tcttctccagttcatcctacca

SEQ ID NO: 9445286 - DNA, 22 bp, Homo sapiens
tcttctccataatcaacactct

SEQ ID NO: 9445287 - DNA, 22 bp, Homo sapiens
tcttctccagtgcttctgcaca

SEQ ID NO: 9445288 - DNA, 22 bp, Homo sapiens
tcttctccagtgcttctgcaca

SEQ ID NO: 9445289 - DNA, 22 bp, Homo sapiens
tcttctcccatcggccgcaggg

SEQ ID NO: 9445290 - DNA, 22 bp, Homo sapiens
tcttctcccatctccaggcagg

SEQ ID NO: 9445291 - DNA, 22 bp, Homo sapiens
tcttctcccagggtcgcccaag

SEQ ID NO: 9445292 - DNA, 22 bp, Homo sapiens
tcttctcccatcggccgcaggg

SEQ ID NO: 9445293 - DNA, 22 bp, Homo sapiens
tcttctccataatcaacactct

SEQ ID NO: 9445294 - DNA, 22 bp, Homo sapiens
tcttctccataatcaacactct

SEQ ID NO: 9445295 - DNA, 22 bp, Homo sapiens
tcttctgtgagaattcaagcaa

SEQ ID NO: 9445296 - DNA, 22 bp, Homo sapiens
tcttctgtgagaattcaagcaa

SEQ ID NO: 9445297 - DNA, 22 bp, Homo sapiens
tcttctgtattgttaactcagg

SEQ ID NO: 9445298 - DNA, 22 bp, Homo sapiens
tcttctgtcctaagtcaaagca

SEQ ID NO: 9445299 - DNA, 22 bp, Homo sapiens
tcttctgtattgttaactcagg

SEQ ID NO: 9445300 - DNA, 22 bp, Homo sapiens
tcttctgtgatctatgtgtttt

SEQ ID NO: 9445301 - DNA, 22 bp, Homo sapiens
tcttctgtgatctatgtgtttt

SEQ ID NO: 9445302 - DNA, 22 bp, Homo sapiens
tcttctgttaccacagcgatga

SEQ ID NO: 9445303 - DNA, 22 bp, Homo sapiens
tcttctgtggctctcaccaccc

SEQ ID NO: 9445304 - DNA, 22 bp, Homo sapiens
tcttctgtggctctcaccaccc

SEQ ID NO: 9445305 - DNA, 22 bp, Homo sapiens
tcttctctcatgtaggagggaa

SEQ ID NO: 9445306 - DNA, 22 bp, Homo sapiens
tcttctctcatgtaggagggaa

SEQ ID NO: 9445307 - DNA, 22 bp, Homo sapiens
tcttctggatgagagcggaggc

SEQ ID NO: 9445308 - DNA, 20 bp, Homo sapiens
tcttctggatttcctttagg

SEQ ID NO: 9445309 - DNA, 22 bp, Homo sapiens
tcttctcctttgccatgtgttt

SEQ ID NO: 9445310 - DNA, 22 bp, Homo sapiens
tcttctctacaccagcagcccc

SEQ ID NO: 9445311 - DNA, 22 bp, Homo sapiens
tcttgaaacatatgagtaagtg

SEQ ID NO: 9445312 - DNA, 22 bp, Homo sapiens
tcttgaaacatatgagtaagtg

SEQ ID NO: 9445313 - DNA, 21 bp, Homo sapiens
tcttgaaaattgtagcagttt

SEQ ID NO: 9445314 - DNA, 22 bp, Homo sapiens
tcttgaaagcatgagatggaca

SEQ ID NO: 9445315 - DNA, 22 bp, Homo sapiens
tcttgaaagcatgagatggaca

SEQ ID NO: 9445316 - DNA, 22 bp, Homo sapiens
tcttgaaagcattttcttcatc

SEQ ID NO: 9445317 - DNA, 22 bp, Homo sapiens
tcttgaaagcattttcttcatc

SEQ ID NO: 9445318 - DNA, 22 bp, Homo sapiens
tcttgaaagcattttcttcatc

SEQ ID NO: 9445319 - DNA, 21 bp, Homo sapiens
tcttgaaaagttagattctct

SEQ ID NO: 9445320 - DNA, 21 bp, Homo sapiens
tcttgaaaattgtagcagttt

SEQ ID NO: 9445321 - DNA, 22 bp, Homo sapiens
tcttgaaaattgaggttgaagg

SEQ ID NO: 9445322 - DNA, 21 bp, Homo sapiens
tcttgaaaagttagattctct

SEQ ID NO: 9445323 - DNA, 22 bp, Homo sapiens
tcttctttggatgaaagaatat

SEQ ID NO: 9445324 - DNA, 22 bp, Homo sapiens
tcttctttggatgaaagaatat

SEQ ID NO: 9445325 - DNA, 22 bp, Homo sapiens
tcttctttggatgaaagaatat

SEQ ID NO: 9445326 - DNA, 22 bp, Homo sapiens
tcttcttttatttcaagggtgt

SEQ ID NO: 9445327 - DNA, 22 bp, Homo sapiens
tcttctttttgtcccacagaat

SEQ ID NO: 9445328 - DNA, 22 bp, Homo sapiens
tcttctttttgtcccacagaat

SEQ ID NO: 9445329 - DNA, 22 bp, Homo sapiens
tcttctgttaccacagcgatga

SEQ ID NO: 9445330 - DNA, 20 bp, Homo sapiens
tcttctgttgccttgttctg

SEQ ID NO: 9445331 - DNA, 20 bp, Homo sapiens
tcttctgttgccttgttctg

SEQ ID NO: 9445332 - DNA, 20 bp, Homo sapiens
tcttctgttgccttgttctg

SEQ ID NO: 9445333 - DNA, 22 bp, Homo sapiens
tcttcttaaagtatgttctctt

SEQ ID NO: 9445334 - DNA, 22 bp, Homo sapiens
tcttcttaaagtatgttctctt

SEQ ID NO: 9445335 - DNA, 22 bp, Homo sapiens
tcttcttatgtgccattatctc

SEQ ID NO: 9445336 - DNA, 22 bp, Homo sapiens
tcttcttatgtgccattatctc

SEQ ID NO: 9445337 - DNA, 22 bp, Homo sapiens
tcttctgttttagattgcatac

SEQ ID NO: 9445338 - DNA, 22 bp, Homo sapiens
tcttcttcccatccctcaaatg

SEQ ID NO: 9445339 - DNA, 22 bp, Homo sapiens
tcttcttatgtgccattatctc

SEQ ID NO: 9445340 - DNA, 22 bp, Homo sapiens
tcttcttatgtgccattatctc

SEQ ID NO: 9445341 - DNA, 22 bp, Homo sapiens
tcttccttttgtaccttctgaa

SEQ ID NO: 9445342 - DNA, 16 bp, Homo sapiens
tcttccttttgatttt

SEQ ID NO: 9445343 - DNA, 16 bp, Homo sapiens
tcttccttttgatttt

SEQ ID NO: 9445344 - DNA, 23 bp, Homo sapiens
tcttcgggctcactatttcctcc

SEQ ID NO: 9445345 - DNA, 22 bp, Homo sapiens
tcttcgtagcatcgtgctggct

SEQ ID NO: 9445346 - DNA, 22 bp, Homo sapiens
tcttctactataataattttct

SEQ ID NO: 9445347 - DNA, 22 bp, Homo sapiens
tcttccttgccttgcttcatca

SEQ ID NO: 9445348 - DNA, 22 bp, Homo sapiens
tcttcctttcattcatgtgtta

SEQ ID NO: 9445349 - DNA, 22 bp, Homo sapiens
tcttcctttcattcatgtgtta

SEQ ID NO: 9445350 - DNA, 22 bp, Homo sapiens
tcttcctttcattcatgtgtta

SEQ ID NO: 9445351 - DNA, 21 bp, Homo sapiens
tcttcctgctccacactcccc

SEQ ID NO: 9445352 - DNA, 21 bp, Homo sapiens
tcttcctgctccacactcccc

SEQ ID NO: 9445353 - DNA, 21 bp, Homo sapiens
tcttcctgctccacactcccc

SEQ ID NO: 9445354 - DNA, 22 bp, Homo sapiens
tcttcctgcttggtgtgtctgg

SEQ ID NO: 9445355 - DNA, 22 bp, Homo sapiens
tcttcctgctttggtgaggctt

SEQ ID NO: 9445356 - DNA, 22 bp, Homo sapiens
tcttcctggtttctgggccatc

SEQ ID NO: 9445357 - DNA, 22 bp, Homo sapiens
tcttcctgtcaatgagaattaa

SEQ ID NO: 9445358 - DNA, 22 bp, Homo sapiens
tcttccttctttgatgacaagg

SEQ ID NO: 9445359 - DNA, 22 bp, Homo sapiens
tcttccttctttgatgacaagg

SEQ ID NO: 9445360 - DNA, 22 bp, Homo sapiens
tcttccttctttgatgacaagg

SEQ ID NO: 9445361 - DNA, 22 bp, Homo sapiens
tcttccaggagggcatttcttt

SEQ ID NO: 9445362 - DNA, 22 bp, Homo sapiens
tcttccaggccctgccacagct

SEQ ID NO: 9445363 - DNA, 22 bp, Homo sapiens
tcttcctccctacagagctcag

SEQ ID NO: 9445364 - DNA, 23 bp, Homo sapiens
tcttcctgaactatcaggcacat

SEQ ID NO: 9445365 - DNA, 23 bp, Homo sapiens
tcttcctgaactatcaggcacat

SEQ ID NO: 9445366 - DNA, 23 bp, Homo sapiens
tcttcctgaactatcaggcacat

SEQ ID NO: 9445367 - DNA, 21 bp, Homo sapiens
tcttcctgacatatgcaaggc

SEQ ID NO: 9445368 - DNA, 22 bp, Homo sapiens
tcttcctctctaattgatcaga

SEQ ID NO: 9445369 - DNA, 22 bp, Homo sapiens
tcttcctctctaattgatcaga

SEQ ID NO: 9445370 - DNA, 22 bp, Homo sapiens
tcttcctctagatctgaggccc

SEQ ID NO: 9445371 - DNA, 22 bp, Homo sapiens
tcttcctccctacagagctcag

SEQ ID NO: 9445372 - DNA, 22 bp, Homo sapiens
tctttatcaagtctgttctttg

SEQ ID NO: 9445373 - DNA, 22 bp, Homo sapiens
tctttatctggctcagagacac

SEQ ID NO: 9445374 - DNA, 22 bp, Homo sapiens
tctttatcaggtgaagagggac

SEQ ID NO: 9445375 - DNA, 22 bp, Homo sapiens
tctttatctggctcagagacac

SEQ ID NO: 9445376 - DNA, 22 bp, Homo sapiens
tctttataaaagtcattatgtc

SEQ ID NO: 9445377 - DNA, 22 bp, Homo sapiens
tctttataaaagtcattatgtc

SEQ ID NO: 9445378 - DNA, 22 bp, Homo sapiens
tctttataaaagtcattatgtc

SEQ ID NO: 9445379 - DNA, 22 bp, Homo sapiens
tctttatgtttgaaagtacaat

SEQ ID NO: 9445380 - DNA, 22 bp, Homo sapiens
tctttatgagaaaaagattgta

SEQ ID NO: 9445381 - DNA, 22 bp, Homo sapiens
tctttatgcctacctgggaaga

SEQ ID NO: 9445382 - DNA, 19 bp, Homo sapiens
tctttagccagagctctgg

SEQ ID NO: 9445383 - DNA, 22 bp, Homo sapiens
tctttagctagaaatactctaa

SEQ ID NO: 9445384 - DNA, 22 bp, Homo sapiens
tctttagccagtatcataatga

SEQ ID NO: 9445385 - DNA, 22 bp, Homo sapiens
tctttagtattgagttatggta

SEQ ID NO: 9445386 - DNA, 22 bp, Homo sapiens
tctttagtgaccatctcattct

SEQ ID NO: 9445387 - DNA, 20 bp, Homo sapiens
tctttagttcctggcccttt

SEQ ID NO: 9445388 - DNA, 22 bp, Homo sapiens
tctttagagcacgggaaaaaca

SEQ ID NO: 9445389 - DNA, 22 bp, Homo sapiens
tctttagagctcagaaatacag

SEQ ID NO: 9445390 - DNA, 22 bp, Homo sapiens
tctttcattctagtctgaggtt

SEQ ID NO: 9445391 - DNA, 22 bp, Homo sapiens
tctttcatgtatatgcaaccta

SEQ ID NO: 9445392 - DNA, 22 bp, Homo sapiens
tctttcaatgtgaaaccatgta

SEQ ID NO: 9445393 - DNA, 22 bp, Homo sapiens
tctttcaatgtgaaaccatgta

SEQ ID NO: 9445394 - DNA, 22 bp, Homo sapiens
tctttcagccacttacctgtct

SEQ ID NO: 9445395 - DNA, 22 bp, Homo sapiens
tctttattgctactggtttgtc

SEQ ID NO: 9445396 - DNA, 22 bp, Homo sapiens
tctttatttaagtctgttgtaa

SEQ ID NO: 9445397 - DNA, 22 bp, Homo sapiens
tctttattgctactggtttgtc

SEQ ID NO: 9445398 - DNA, 22 bp, Homo sapiens
tctttattgctactggtttgtc

SEQ ID NO: 9445399 - DNA, 22 bp, Homo sapiens
tctttccacagcatgtccatgc

SEQ ID NO: 9445400 - DNA, 22 bp, Homo sapiens
tctttccacattctctgtttag

SEQ ID NO: 9445401 - DNA, 22 bp, Homo sapiens
tctttccagaggaatttttaga

SEQ ID NO: 9445402 - DNA, 22 bp, Homo sapiens
tctttccaagtaatacttccca

SEQ ID NO: 9445403 - DNA, 21 bp, Homo sapiens
tctttccaatattcatgtctc

SEQ ID NO: 9445404 - DNA, 22 bp, Homo sapiens
tctttccagaggaatttttaga

SEQ ID NO: 9445405 - DNA, 22 bp, Homo sapiens
tctttccatggccacacagtct

SEQ ID NO: 9445406 - DNA, 22 bp, Homo sapiens
tctttcccagtagctctcccag

SEQ ID NO: 9445407 - DNA, 22 bp, Homo sapiens
tctttcccgccagagcatgagt

SEQ ID NO: 9445408 - DNA, 22 bp, Homo sapiens
tctttcctagaggctgatgagt

SEQ ID NO: 9445409 - DNA, 22 bp, Homo sapiens
tctttcctagaggctgatgagt

SEQ ID NO: 9445410 - DNA, 22 bp, Homo sapiens
tctttcctagaggctgatgagt

SEQ ID NO: 9445411 - DNA, 23 bp, Homo sapiens
tctttcctcagcacacaccaaga

SEQ ID NO: 9445412 - DNA, 22 bp, Homo sapiens
tctttcctaggtgatatgcaat

SEQ ID NO: 9445413 - DNA, 22 bp, Homo sapiens
tctttcctaggtgatatgcaat

SEQ ID NO: 9445414 - DNA, 23 bp, Homo sapiens
tctttcctaatgaaacagtgaaa

SEQ ID NO: 9445415 - DNA, 22 bp, Homo sapiens
tctttcctactttattgtgaac

SEQ ID NO: 9445416 - DNA, 22 bp, Homo sapiens
tctttcctactttattgtgaac

SEQ ID NO: 9445417 - DNA, 23 bp, Homo sapiens
tctttcctaatgaaacagtgaaa

SEQ ID NO: 9445418 - DNA, 23 bp, Homo sapiens
tctttcctaatgaaacagtgaaa

SEQ ID NO: 9445419 - DNA, 17 bp, Homo sapiens
tctttccctgggagatg

SEQ ID NO: 9445420 - DNA, 22 bp, Homo sapiens
tctttccctgtgttagcctgta

SEQ ID NO: 9445421 - DNA, 22 bp, Homo sapiens
tctttcggccatagcgatgatt

SEQ ID NO: 9445422 - DNA, 22 bp, Homo sapiens
tctttctacattttatatgctt

SEQ ID NO: 9445423 - DNA, 22 bp, Homo sapiens
tctttcctgtaactgctgttca

SEQ ID NO: 9445424 - DNA, 22 bp, Homo sapiens
tctttcctgtaactgctgttca

SEQ ID NO: 9445425 - DNA, 22 bp, Homo sapiens
tctttcctgtaactgctgttca

SEQ ID NO: 9445426 - DNA, 17 bp, Homo sapiens
tctttcctgccatgctc

SEQ ID NO: 9445427 - DNA, 21 bp, Homo sapiens
tctttcctgcccagttgccct

SEQ ID NO: 9445428 - DNA, 17 bp, Homo sapiens
tctttcctgccatgctc

SEQ ID NO: 9445429 - DNA, 21 bp, Homo sapiens
tctttcctgcccagttgccct

SEQ ID NO: 9445430 - DNA, 22 bp, Homo sapiens
tctttcctctgagctcctgtag

SEQ ID NO: 9445431 - DNA, 23 bp, Homo sapiens
tctttcctcagcacacaccaaga

SEQ ID NO: 9445432 - DNA, 22 bp, Homo sapiens
tctttcctctgagctcctgtag

SEQ ID NO: 9445433 - DNA, 22 bp, Homo sapiens
tctttctgaatatttgacctca

SEQ ID NO: 9445434 - DNA, 21 bp, Homo sapiens
tctttctgaaatctcagtctg

SEQ ID NO: 9445435 - DNA, 22 bp, Homo sapiens
tctttctgcacttagtggggct

SEQ ID NO: 9445436 - DNA, 22 bp, Homo sapiens
tctttctgcagcacaggggcag

SEQ ID NO: 9445437 - DNA, 22 bp, Homo sapiens
tctttctgatgggaagggtcaa

SEQ ID NO: 9445438 - DNA, 22 bp, Homo sapiens
tctttctggttatgtatagaga

SEQ ID NO: 9445439 - DNA, 22 bp, Homo sapiens
tctttctggtctcgccttattc

SEQ ID NO: 9445440 - DNA, 22 bp, Homo sapiens
tctttgaacttggctgatctct

SEQ ID NO: 9445441 - DNA, 22 bp, Homo sapiens
tctttctgtaagctccatggaa

SEQ ID NO: 9445442 - DNA, 22 bp, Homo sapiens
tctttctggttatgtatagaga

SEQ ID NO: 9445443 - DNA, 22 bp, Homo sapiens
tctttcttaaataggtggattg

SEQ ID NO: 9445444 - DNA, 22 bp, Homo sapiens
tctttgatcagcctttcactga

SEQ ID NO: 9445445 - DNA, 22 bp, Homo sapiens
tctttgatacagatgtaagctg

SEQ ID NO: 9445446 - DNA, 22 bp, Homo sapiens
tctttgatgcttctgaaggtgt

SEQ ID NO: 9445447 - DNA, 22 bp, Homo sapiens
tctttgatttgacaatatcttg

SEQ ID NO: 9445448 - DNA, 22 bp, Homo sapiens
tctttgatttaaaacagtcaaa

SEQ ID NO: 9445449 - DNA, 22 bp, Homo sapiens
tctttgatgtggttaattatga

SEQ ID NO: 9445450 - DNA, 22 bp, Homo sapiens
tctttgatgtggttaattatga

SEQ ID NO: 9445451 - DNA, 22 bp, Homo sapiens
tctttgatgggagatctgagag

SEQ ID NO: 9445452 - DNA, 22 bp, Homo sapiens
tctttgatgggagatctgagag

SEQ ID NO: 9445453 - DNA, 22 bp, Homo sapiens
tctttgaatttctgactgtctt

SEQ ID NO: 9445454 - DNA, 22 bp, Homo sapiens
tctttgaatcctttacatctga

SEQ ID NO: 9445455 - DNA, 20 bp, Homo sapiens
tcttgagaacaatttctggc

SEQ ID NO: 9445456 - DNA, 22 bp, Homo sapiens
tcttgagaagcggctgtctcag

SEQ ID NO: 9445457 - DNA, 22 bp, Homo sapiens
tcttgagaaataattaaacatg

SEQ ID NO: 9445458 - DNA, 22 bp, Homo sapiens
tcttgaataagtttcatgagct

SEQ ID NO: 9445459 - DNA, 22 bp, Homo sapiens
tcttgaattgtactcccataag

SEQ ID NO: 9445460 - DNA, 22 bp, Homo sapiens
tcttgaattgtactcccataag

SEQ ID NO: 9445461 - DNA, 22 bp, Homo sapiens
tcttgaaagtatcttattttgt

SEQ ID NO: 9445462 - DNA, 22 bp, Homo sapiens
tcttgaaaggagattggaggca

SEQ ID NO: 9445463 - DNA, 22 bp, Homo sapiens
tcttgaaagtatcttattttgt

SEQ ID NO: 9445464 - DNA, 22 bp, Homo sapiens
tcttgaagaggaagtggagtag

SEQ ID NO: 9445465 - DNA, 22 bp, Homo sapiens
tcttgaaggggggcagtgttga

SEQ ID NO: 9445466 - DNA, 22 bp, Homo sapiens
tcttgaagtcacacagaaagtg

SEQ ID NO: 9445467 - DNA, 22 bp, Homo sapiens
tcttgagagatatactactgaa

SEQ ID NO: 9445468 - DNA, 22 bp, Homo sapiens
tcttgaggtcatcatctgaaac

SEQ ID NO: 9445469 - DNA, 22 bp, Homo sapiens
tcttgaggtcatcatctgaaac

SEQ ID NO: 9445470 - DNA, 22 bp, Homo sapiens
tcttgctgtgccccagcagggc

SEQ ID NO: 9445471 - DNA, 22 bp, Homo sapiens
tcttggaaccctatgtgatttc

SEQ ID NO: 9445472 - DNA, 20 bp, Homo sapiens
tcttggaaaaagttcagaat

SEQ ID NO: 9445473 - DNA, 22 bp, Homo sapiens
tcttgctaaagaccaacacatt

SEQ ID NO: 9445474 - DNA, 22 bp, Homo sapiens
tcttgctgaaaacaaatctctt

SEQ ID NO: 9445475 - DNA, 22 bp, Homo sapiens
tcttgctgagactggcaagttt

SEQ ID NO: 9445476 - DNA, 22 bp, Homo sapiens
tcttgctgctgtccacacagta

SEQ ID NO: 9445477 - DNA, 22 bp, Homo sapiens
tcttggagactcttgtatattt

SEQ ID NO: 9445478 - DNA, 22 bp, Homo sapiens
tcttggagatgaccaggcatgc

SEQ ID NO: 9445479 - DNA, 18 bp, Homo sapiens
tcttggagtaatgatcaa

SEQ ID NO: 9445480 - DNA, 22 bp, Homo sapiens
tcttggaatctccatagagtga

SEQ ID NO: 9445481 - DNA, 22 bp, Homo sapiens
tcttggactcaaaattgcctta

SEQ ID NO: 9445482 - DNA, 22 bp, Homo sapiens
tcttggaacttattattgtaga

SEQ ID NO: 9445483 - DNA, 22 bp, Homo sapiens
tcttggaagtagaacacagtct

SEQ ID NO: 9445484 - DNA, 22 bp, Homo sapiens
tcttggaagtagaacacagtct

SEQ ID NO: 9445485 - DNA, 22 bp, Homo sapiens
tcttggaagggttgtgggatga

SEQ ID NO: 9445486 - DNA, 22 bp, Homo sapiens
tcttggccaggtgtggtgcctc

SEQ ID NO: 9445487 - DNA, 22 bp, Homo sapiens
tcttggctagtaccttcctgcc

SEQ ID NO: 9445488 - DNA, 22 bp, Homo sapiens
tcttggctatccaagttatcca

SEQ ID NO: 9445489 - DNA, 22 bp, Homo sapiens
tcttggctactttcctgtctgc

SEQ ID NO: 9445490 - DNA, 22 bp, Homo sapiens
tcttggctactttcctgtctgc

SEQ ID NO: 9445491 - DNA, 22 bp, Homo sapiens
tcttggctacttaggaggattc

SEQ ID NO: 9445492 - DNA, 22 bp, Homo sapiens
tcttggccactaccacctggag

SEQ ID NO: 9445493 - DNA, 18 bp, Homo sapiens
tcttggcagcatctggca

SEQ ID NO: 9445494 - DNA, 22 bp, Homo sapiens
tcttggctgcgtcctggctgtg

SEQ ID NO: 9445495 - DNA, 22 bp, Homo sapiens
tcttggctgctgccaatttact

SEQ ID NO: 9445496 - DNA, 22 bp, Homo sapiens
tcttggctgctgccaatttact

SEQ ID NO: 9445497 - DNA, 21 bp, Homo sapiens
tcttggctctgccacttatta

SEQ ID NO: 9445498 - DNA, 21 bp, Homo sapiens
tcttggctctgccacttatta

SEQ ID NO: 9445499 - DNA, 22 bp, Homo sapiens
tcttggctgcagagccggcaag

SEQ ID NO: 9445500 - DNA, 22 bp, Homo sapiens
tcttggctctgccactaattag

SEQ ID NO: 9445501 - DNA, 22 bp, Homo sapiens
tcttggctctgccactaattag

SEQ ID NO: 9445502 - DNA, 22 bp, Homo sapiens
tcttggctcctgttgtcatcag

SEQ ID NO: 9445503 - DNA, 22 bp, Homo sapiens
tcttggctcctgttgtcatcag

SEQ ID NO: 9445504 - DNA, 22 bp, Homo sapiens
tcttggctcctcacagcatcag

SEQ ID NO: 9445505 - DNA, 22 bp, Homo sapiens
tcttggctcccttgtaggccct

SEQ ID NO: 9445506 - DNA, 22 bp, Homo sapiens
tcttggctatccaagttatcca

SEQ ID NO: 9445507 - DNA, 22 bp, Homo sapiens
tcttggctattcttgaattctg

SEQ ID NO: 9445508 - DNA, 22 bp, Homo sapiens
tcttggctgtctttgaagttag

SEQ ID NO: 9445509 - DNA, 22 bp, Homo sapiens
tcttggctgtaccattgactag

SEQ ID NO: 9445510 - DNA, 22 bp, Homo sapiens
tcttggctggtttcacattacc

SEQ ID NO: 9445511 - DNA, 22 bp, Homo sapiens
tcttggctggtcatttaaaatc

SEQ ID NO: 9445512 - DNA, 23 bp, Homo sapiens
tcttggctggacaagtcactcac

SEQ ID NO: 9445513 - DNA, 22 bp, Homo sapiens
tcttggctgtgcatgcatcttc

SEQ ID NO: 9445514 - DNA, 20 bp, Homo sapiens
tcttggctgtgtgaggacac

SEQ ID NO: 9445515 - DNA, 22 bp, Homo sapiens
tcttggcttctgtatttcctgt

SEQ ID NO: 9445516 - DNA, 22 bp, Homo sapiens
tcttggctttctcctagggatg

SEQ ID NO: 9445517 - DNA, 22 bp, Homo sapiens
tcttgggagtcccaggacatag

SEQ ID NO: 9445518 - DNA, 22 bp, Homo sapiens
tcttggcttttcccctatggtc

SEQ ID NO: 9445519 - DNA, 19 bp, Homo sapiens
tcttggctttgtctactgt

SEQ ID NO: 9445520 - DNA, 22 bp, Homo sapiens
tcttgggcatgtgtttgatttc

SEQ ID NO: 9445521 - DNA, 22 bp, Homo sapiens
tctttaatgtactttctttcac

SEQ ID NO: 9445522 - DNA, 22 bp, Homo sapiens
tctttaatgtactttctttcac

SEQ ID NO: 9445523 - DNA, 22 bp, Homo sapiens
tctttaatatctgccccagagc

SEQ ID NO: 9445524 - DNA, 22 bp, Homo sapiens
tctttacaagtcacattttctg

SEQ ID NO: 9445525 - DNA, 22 bp, Homo sapiens
tctttacacaagacaagaataa

SEQ ID NO: 9445526 - DNA, 22 bp, Homo sapiens
tctttaatgtgattgtaattat

SEQ ID NO: 9445527 - DNA, 22 bp, Homo sapiens
tctttaattgtggaagagcagc

SEQ ID NO: 9445528 - DNA, 22 bp, Homo sapiens
tctttacatcacaattgtatgg

SEQ ID NO: 9445529 - DNA, 23 bp, Homo sapiens
tctttagaagaacatcagaaatg

SEQ ID NO: 9445530 - DNA, 22 bp, Homo sapiens
tctttacatcacaattgtatgg

SEQ ID NO: 9445531 - DNA, 22 bp, Homo sapiens
tctttacatcacaattgtatgg

SEQ ID NO: 9445532 - DNA, 22 bp, Homo sapiens
tctttacacaagacaagaataa

SEQ ID NO: 9445533 - DNA, 22 bp, Homo sapiens
tctttacacaagacaagaataa

SEQ ID NO: 9445534 - DNA, 22 bp, Homo sapiens
ttccaggaaaacagttggaagt

SEQ ID NO: 9445535 - DNA, 22 bp, Homo sapiens
aatatgcatgtatacatgtgta

SEQ ID NO: 9445536 - DNA, 22 bp, Homo sapiens
aatatgtctctggctagacatt

SEQ ID NO: 9445537 - DNA, 18 bp, Homo sapiens
aatatgtctagttacagc

SEQ ID NO: 9445538 - DNA, 22 bp, Homo sapiens
aatatgtgaggtatgttcagtg

SEQ ID NO: 9445539 - DNA, 22 bp, Homo sapiens
aatatgtctgctaattgtttct

SEQ ID NO: 9445540 - DNA, 22 bp, Homo sapiens
aatatgtctctgtggttaagta

SEQ ID NO: 9445541 - DNA, 22 bp, Homo sapiens
aatatgcagcatgatgaagtaa

SEQ ID NO: 9445542 - DNA, 22 bp, Homo sapiens
aatatgcactctgatttagcag

SEQ ID NO: 9445543 - DNA, 22 bp, Homo sapiens
aatatgcaagcttccaggtaga

SEQ ID NO: 9445544 - DNA, 22 bp, Homo sapiens
aatatgatgccaaattgctaca

SEQ ID NO: 9445545 - DNA, 22 bp, Homo sapiens
aatatgcaaagcgtgttatctg

SEQ ID NO: 9445546 - DNA, 22 bp, Homo sapiens
aatatgttccacttaaagctgg

SEQ ID NO: 9445547 - DNA, 22 bp, Homo sapiens
aatatgttcaaaatagatcact

SEQ ID NO: 9445548 - DNA, 22 bp, Homo sapiens
aatatgttccacttaaagctgg

SEQ ID NO: 9445549 - DNA, 22 bp, Homo sapiens
aatatgttccacttaaagctgg

SEQ ID NO: 9445550 - DNA, 22 bp, Homo sapiens
aatatgttccacttaaagctgg

SEQ ID NO: 9445551 - DNA, 22 bp, Homo sapiens
aatatgttccacttaaagctgg

SEQ ID NO: 9445552 - DNA, 22 bp, Homo sapiens
aatatgtttataagatatcttc

SEQ ID NO: 9445553 - DNA, 22 bp, Homo sapiens
aatattaatagaaggggttcta

SEQ ID NO: 9445554 - DNA, 22 bp, Homo sapiens
aatattaatagaaggggttcta

SEQ ID NO: 9445555 - DNA, 22 bp, Homo sapiens
aatattagtttctcaagagaga

SEQ ID NO: 9445556 - DNA, 22 bp, Homo sapiens
aatattcaagttattctttctt

SEQ ID NO: 9445557 - DNA, 22 bp, Homo sapiens
aatattcaagttattctttctt

SEQ ID NO: 9445558 - DNA, 22 bp, Homo sapiens
agaaaatattcattgagaggct

SEQ ID NO: 9445559 - DNA, 22 bp, Homo sapiens
agaaaatattcattgagaggct

SEQ ID NO: 9445560 - DNA, 22 bp, Homo sapiens
agaaaatattcattgagaggct

SEQ ID NO: 9445561 - DNA, 22 bp, Homo sapiens
agaaaatattcattgagaggct

SEQ ID NO: 9445562 - DNA, 22 bp, Homo sapiens
agaaaataatttcttggctggt

SEQ ID NO: 9445563 - DNA, 22 bp, Homo sapiens
aatattcatttgcagaagaagt

SEQ ID NO: 9445564 - DNA, 22 bp, Homo sapiens
agaaaactggagcctggggttg

SEQ ID NO: 9445565 - DNA, 22 bp, Homo sapiens
agaaaactggagcctggggttg

SEQ ID NO: 9445566 - DNA, 22 bp, Homo sapiens
aatattcaagttattctttctt

SEQ ID NO: 9445567 - DNA, 22 bp, Homo sapiens
aatattcatttgcagaagaagt

SEQ ID NO: 9445568 - DNA, 22 bp, Homo sapiens
agaaaataatttcttggctggt

SEQ ID NO: 9445569 - DNA, 22 bp, Homo sapiens
agaaaactgggaggagagcttc

SEQ ID NO: 9445570 - DNA, 22 bp, Homo sapiens
agaaaccagggcttaccagtgc

SEQ ID NO: 9445571 - DNA, 22 bp, Homo sapiens
agaaaccatctttatatatctg

SEQ ID NO: 9445572 - DNA, 20 bp, Homo sapiens
agaaacatttcttgagaact

SEQ ID NO: 9445573 - DNA, 23 bp, Homo sapiens
agaaaccactgaagagatccagt

SEQ ID NO: 9445574 - DNA, 23 bp, Homo sapiens
agaaaccactgaagagatccagt

SEQ ID NO: 9445575 - DNA, 22 bp, Homo sapiens
agaaaccagacttggcccattt

SEQ ID NO: 9445576 - DNA, 22 bp, Homo sapiens
agaaaattactccagagacaag

SEQ ID NO: 9445577 - DNA, 20 bp, Homo sapiens
agaaaatgttttcagctgga

SEQ ID NO: 9445578 - DNA, 22 bp, Homo sapiens
agaaactacttggaggaaagat

SEQ ID NO: 9445579 - DNA, 22 bp, Homo sapiens
agaaacgcctgtgaaattatct

SEQ ID NO: 9445580 - DNA, 22 bp, Homo sapiens
agaaacgcctgtgaaattatct

SEQ ID NO: 9445581 - DNA, 22 bp, Homo sapiens
agaaacgcctgtgaaattatct

SEQ ID NO: 9445582 - DNA, 22 bp, Homo sapiens
agaaactaaagccaagggctct

SEQ ID NO: 9445583 - DNA, 22 bp, Homo sapiens
agaaactaaagccaagggctct

SEQ ID NO: 9445584 - DNA, 22 bp, Homo sapiens
agaaacgcctgtgaaattatct

SEQ ID NO: 9445585 - DNA, 22 bp, Homo sapiens
agaaactgaacacaagagtcgg

SEQ ID NO: 9445586 - DNA, 22 bp, Homo sapiens
agaaactctggaagaactttta

SEQ ID NO: 9445587 - DNA, 22 bp, Homo sapiens
aatctatatgcttttcacatac

SEQ ID NO: 9445588 - DNA, 22 bp, Homo sapiens
agaaactattatggtaaacaaa

SEQ ID NO: 9445589 - DNA, 22 bp, Homo sapiens
agaaactctaggtcaattgagg

SEQ ID NO: 9445590 - DNA, 22 bp, Homo sapiens
agaaactctggaagaactttta

SEQ ID NO: 9445591 - DNA, 22 bp, Homo sapiens
agaaactcacctttccagccat

SEQ ID NO: 9445592 - DNA, 22 bp, Homo sapiens
aatcttaaagaatattctacca

SEQ ID NO: 9445593 - DNA, 22 bp, Homo sapiens
aatcttaaagaatattctacca

SEQ ID NO: 9445594 - DNA, 22 bp, Homo sapiens
aatcttaagctgaattctctcc

SEQ ID NO: 9445595 - DNA, 22 bp, Homo sapiens
aatcttaaagaatattctacca

SEQ ID NO: 9445596 - DNA, 22 bp, Homo sapiens
aatcttaaagaatattctacca

SEQ ID NO: 9445597 - DNA, 22 bp, Homo sapiens
aatcttaaagaatattctacca

SEQ ID NO: 9445598 - DNA, 22 bp, Homo sapiens
aatctgtttccatgttttattg

SEQ ID NO: 9445599 - DNA, 22 bp, Homo sapiens
aatctgtttgatgcttgtgata

SEQ ID NO: 9445600 - DNA, 22 bp, Homo sapiens
aatctgtcagaatttctaagtt

SEQ ID NO: 9445601 - DNA, 22 bp, Homo sapiens
aatctgtcgtgttgatagttct

SEQ ID NO: 9445602 - DNA, 22 bp, Homo sapiens
aatctgtattgttaacaagtaa

SEQ ID NO: 9445603 - DNA, 22 bp, Homo sapiens
aatctcaaagatggccagaaga

SEQ ID NO: 9445604 - DNA, 22 bp, Homo sapiens
aatctgtattgctcatacttga

SEQ ID NO: 9445605 - DNA, 17 bp, Homo sapiens
aatctgtttacagtcag

SEQ ID NO: 9445606 - DNA, 22 bp, Homo sapiens
aatcttaagctgaattctctcc

SEQ ID NO: 9445607 - DNA, 22 bp, Homo sapiens
aatcttaagctgaattctctcc

SEQ ID NO: 9445608 - DNA, 22 bp, Homo sapiens
aatcttacttatgatttttcgg

SEQ ID NO: 9445609 - DNA, 22 bp, Homo sapiens
aatcttcaaaaacaattgaggg

SEQ ID NO: 9445610 - DNA, 22 bp, Homo sapiens
aatcttaggtttggcttcatct

SEQ ID NO: 9445611 - DNA, 22 bp, Homo sapiens
aatcttcaaaatgttctgcttg

SEQ ID NO: 9445612 - DNA, 22 bp, Homo sapiens
aatcttcaacagaatggtagga

SEQ ID NO: 9445613 - DNA, 22 bp, Homo sapiens
aatcttcaacagaatggtagga

SEQ ID NO: 9445614 - DNA, 22 bp, Homo sapiens
aatcttcacagaaaaatgtctg

SEQ ID NO: 9445615 - DNA, 22 bp, Homo sapiens
aatcttcacagagaaaattagg

SEQ ID NO: 9445616 - DNA, 22 bp, Homo sapiens
aatcttcagagaccatggagcc

SEQ ID NO: 9445617 - DNA, 22 bp, Homo sapiens
aatcttcactcttaactgtgca

SEQ ID NO: 9445618 - DNA, 22 bp, Homo sapiens
aatcttcactcttaactgtgca

SEQ ID NO: 9445619 - DNA, 22 bp, Homo sapiens
aatcttcactcattcagagttg

SEQ ID NO: 9445620 - DNA, 22 bp, Homo sapiens
aatcttcactaaaatggacaag

SEQ ID NO: 9445621 - DNA, 22 bp, Homo sapiens
aatcttcactcattcagagttg

SEQ ID NO: 9445622 - DNA, 22 bp, Homo sapiens
aatcttcactcattcagagttg

SEQ ID NO: 9445623 - DNA, 22 bp, Homo sapiens
aatcttcagtgtctaaaaagca

SEQ ID NO: 9445624 - DNA, 22 bp, Homo sapiens
aatcttcagcactccagagact

SEQ ID NO: 9445625 - DNA, 22 bp, Homo sapiens
aatcttcagggtcctggggctc

SEQ ID NO: 9445626 - DNA, 22 bp, Homo sapiens
aatcttcataaaaatctagtag

SEQ ID NO: 9445627 - DNA, 22 bp, Homo sapiens
aatcttcagtgtctaaaaagca

SEQ ID NO: 9445628 - DNA, 22 bp, Homo sapiens
aatcttcataaaaatctagtag

SEQ ID NO: 9445629 - DNA, 22 bp, Homo sapiens
aatctttctagattccagcggt

SEQ ID NO: 9445630 - DNA, 22 bp, Homo sapiens
aatcttttaggggatcctgagg

SEQ ID NO: 9445631 - DNA, 22 bp, Homo sapiens
aatctttttcacaagaaagcac

SEQ ID NO: 9445632 - DNA, 22 bp, Homo sapiens
aatcttcattttgacaagattc

SEQ ID NO: 9445633 - DNA, 22 bp, Homo sapiens
aatcttcattttgacaagattc

SEQ ID NO: 9445634 - DNA, 22 bp, Homo sapiens
aatcttcatgtcctctctaatt

SEQ ID NO: 9445635 - DNA, 22 bp, Homo sapiens
aatcttcatgtcctctctaatt

SEQ ID NO: 9445636 - DNA, 22 bp, Homo sapiens
aatcttggcaaatgtagcttcc

SEQ ID NO: 9445637 - DNA, 22 bp, Homo sapiens
aatcttggaggtgacattccat

SEQ ID NO: 9445638 - DNA, 22 bp, Homo sapiens
aatcttggaagtgtccactggt

SEQ ID NO: 9445639 - DNA, 22 bp, Homo sapiens
aatcttggcaaatgtagcttcc

SEQ ID NO: 9445640 - DNA, 22 bp, Homo sapiens
aatctttaaggactcagtctct

SEQ ID NO: 9445641 - DNA, 22 bp, Homo sapiens
actgtgggagcgcagtggcagc

SEQ ID NO: 9445642 - DNA, 22 bp, Homo sapiens
aatactgtctttcacagatatt

SEQ ID NO: 9445643 - DNA, 22 bp, Homo sapiens
aatactgtctttcacagatatt

SEQ ID NO: 9445644 - DNA, 22 bp, Homo sapiens
aatactggctgtcaaagatgga

SEQ ID NO: 9445645 - DNA, 22 bp, Homo sapiens
aatacttgtcagatgaataaga

SEQ ID NO: 9445646 - DNA, 22 bp, Homo sapiens
aatacttgaatttcatgtcagg

SEQ ID NO: 9445647 - DNA, 22 bp, Homo sapiens
aatacttgggctgagatttttg

SEQ ID NO: 9445648 - DNA, 17 bp, Homo sapiens
aatacttccaactagtg

SEQ ID NO: 9445649 - DNA, 22 bp, Homo sapiens
aatacttatgtgacctcatttt

SEQ ID NO: 9445650 - DNA, 22 bp, Homo sapiens
aatacttatgtgacctcatttt

SEQ ID NO: 9445651 - DNA, 22 bp, Homo sapiens
aatacttatgtgacctcatttt

SEQ ID NO: 9445652 - DNA, 17 bp, Homo sapiens
aatacttccaactagtg

SEQ ID NO: 9445653 - DNA, 22 bp, Homo sapiens
aatactttcctatataaggtgc

SEQ ID NO: 9445654 - DNA, 22 bp, Homo sapiens
aatactttgccaagttcgaaga

SEQ ID NO: 9445655 - DNA, 22 bp, Homo sapiens
aatactttcctatataaggtgc

SEQ ID NO: 9445656 - DNA, 22 bp, Homo sapiens
aatactttcctatataaggtgc

SEQ ID NO: 9445657 - DNA, 22 bp, Homo sapiens
aatactttgccaagttcgaaga

SEQ ID NO: 9445658 - DNA, 22 bp, Homo sapiens
aatagaaaggaggggctcttgt

SEQ ID NO: 9445659 - DNA, 22 bp, Homo sapiens
actgtggatgccaaaggggagg

SEQ ID NO: 9445660 - DNA, 22 bp, Homo sapiens
actgtggataagtcagagatgt

SEQ ID NO: 9445661 - DNA, 22 bp, Homo sapiens
actgtgctggcaatgactcagg

SEQ ID NO: 9445662 - DNA, 22 bp, Homo sapiens
actgtggagcagtggctaggga

SEQ ID NO: 9445663 - DNA, 22 bp, Homo sapiens
actgtgggaaccactgaatcag

SEQ ID NO: 9445664 - DNA, 22 bp, Homo sapiens
aataactggcacatatcacata

SEQ ID NO: 9445665 - DNA, 22 bp, Homo sapiens
aataactggcacatatcacata

SEQ ID NO: 9445666 - DNA, 22 bp, Homo sapiens
actgtctgcacccgaggaggcc

SEQ ID NO: 9445667 - DNA, 18 bp, Homo sapiens
actgtctgccagattggg

SEQ ID NO: 9445668 - DNA, 22 bp, Homo sapiens
actgtctgccctgagatgccag

SEQ ID NO: 9445669 - DNA, 19 bp, Homo sapiens
actgtgctcgggaaccact

SEQ ID NO: 9445670 - DNA, 22 bp, Homo sapiens
aataacaggctcatcagatgct

SEQ ID NO: 9445671 - DNA, 22 bp, Homo sapiens
aataacagggttgatttgcaat

SEQ ID NO: 9445672 - DNA, 22 bp, Homo sapiens
aataacagggttgatttgcaat

SEQ ID NO: 9445673 - DNA, 21 bp, Homo sapiens
aataaccactaatatagtggc

SEQ ID NO: 9445674 - DNA, 22 bp, Homo sapiens
aataactgcacttgttgaatgc

SEQ ID NO: 9445675 - DNA, 22 bp, Homo sapiens
acttccagctgccctgtgtgct

SEQ ID NO: 9445676 - DNA, 22 bp, Homo sapiens
acttatttattcattcagctca

SEQ ID NO: 9445677 - DNA, 22 bp, Homo sapiens
acttatgaggagaaaatatata

SEQ ID NO: 9445678 - DNA, 22 bp, Homo sapiens
acttattagctgtgtgaccttg

SEQ ID NO: 9445679 - DNA, 22 bp, Homo sapiens
acttattctgagattatgatca

SEQ ID NO: 9445680 - DNA, 22 bp, Homo sapiens
acttatcacacactaaattagg

SEQ ID NO: 9445681 - DNA, 22 bp, Homo sapiens
acttatatttgctttatgcttc

SEQ ID NO: 9445682 - DNA, 22 bp, Homo sapiens
acttatgaatgtcattataatg

SEQ ID NO: 9445683 - DNA, 22 bp, Homo sapiens
acttataagagtgctatgggga

SEQ ID NO: 9445684 - DNA, 22 bp, Homo sapiens
acttagtgccctggcccttaca

SEQ ID NO: 9445685 - DNA, 22 bp, Homo sapiens
acttagtggctatgtgacctta

SEQ ID NO: 9445686 - DNA, 22 bp, Homo sapiens
acttagcaggtactttcatatt

SEQ ID NO: 9445687 - DNA, 22 bp, Homo sapiens
actgttgaagtgccagcttgat

SEQ ID NO: 9445688 - DNA, 22 bp, Homo sapiens
actgttgaagtgccagcttgat

SEQ ID NO: 9445689 - DNA, 22 bp, Homo sapiens
aatagaacaataattgtaaact

SEQ ID NO: 9445690 - DNA, 22 bp, Homo sapiens
aatagaaaggaggggctcttgt

SEQ ID NO: 9445691 - DNA, 22 bp, Homo sapiens
acttagcacgaacatttacttt

SEQ ID NO: 9445692 - DNA, 22 bp, Homo sapiens
acttagaattaaatatttttgg

SEQ ID NO: 9445693 - DNA, 23 bp, Homo sapiens
acttccagttataggaactcttc

SEQ ID NO: 9445694 - DNA, 22 bp, Homo sapiens
acttcccacaccctgttttctc

SEQ ID NO: 9445695 - DNA, 22 bp, Homo sapiens
acttcccaacgtgggcctccca

SEQ ID NO: 9445696 - DNA, 22 bp, Homo sapiens
acttcccaggtggtgtggagtt

SEQ ID NO: 9445697 - DNA, 18 bp, Homo sapiens
acttcccagatgagggga

SEQ ID NO: 9445698 - DNA, 21 bp, Homo sapiens
acttcccaggacctactcaga

SEQ ID NO: 9445699 - DNA, 22 bp, Homo sapiens
acttccctgtgggcaggtagtg

SEQ ID NO: 9445700 - DNA, 22 bp, Homo sapiens
acttcctgaatggggctaatta

SEQ ID NO: 9445701 - DNA, 22 bp, Homo sapiens
aatatgaattattgttacaagt

SEQ ID NO: 9445702 - DNA, 22 bp, Homo sapiens
aatatgaattattgttacaagt

SEQ ID NO: 9445703 - DNA, 22 bp, Homo sapiens
aatatcttctaaggatagaact

SEQ ID NO: 9445704 - DNA, 22 bp, Homo sapiens
aatatcttctaaggatagaact

SEQ ID NO: 9445705 - DNA, 22 bp, Homo sapiens
aatatcttctaaggatagaact

SEQ ID NO: 9445706 - DNA, 22 bp, Homo sapiens
aatatgaattattgttacaagt

SEQ ID NO: 9445707 - DNA, 22 bp, Homo sapiens
aatatcttggcccaactccaga

SEQ ID NO: 9445708 - DNA, 22 bp, Homo sapiens
aatatcttggcccaactccaga

SEQ ID NO: 9445709 - DNA, 22 bp, Homo sapiens
aatatcttggcccaactccaga

SEQ ID NO: 9445710 - DNA, 22 bp, Homo sapiens
aatatcttctaaggatagaact

SEQ ID NO: 9445711 - DNA, 22 bp, Homo sapiens
aatatcttctaaggatagaact

SEQ ID NO: 9445712 - DNA, 22 bp, Homo sapiens
aatatcttctaaggatagaact

SEQ ID NO: 9445713 - DNA, 22 bp, Homo sapiens
aatatcagctctgtcacttact

SEQ ID NO: 9445714 - DNA, 22 bp, Homo sapiens
actgagaagctcgcagtgatgc

SEQ ID NO: 9445715 - DNA, 22 bp, Homo sapiens
actgagaagattctcactctta

SEQ ID NO: 9445716 - DNA, 22 bp, Homo sapiens
actgagaagattctcactctta

SEQ ID NO: 9445717 - DNA, 22 bp, Homo sapiens
actgagaacttggggacagagg

SEQ ID NO: 9445718 - DNA, 22 bp, Homo sapiens
actgagaacttggggacagagg

SEQ ID NO: 9445719 - DNA, 22 bp, Homo sapiens
actgagaagattctcactctta

SEQ ID NO: 9445720 - DNA, 22 bp, Homo sapiens
actgagaactcaagagaaaagg

SEQ ID NO: 9445721 - DNA, 22 bp, Homo sapiens
actgagaacttgccaaggactg

SEQ ID NO: 9445722 - DNA, 20 bp, Homo sapiens
actgagaccaataagtagaa

SEQ ID NO: 9445723 - DNA, 22 bp, Homo sapiens
actgagacaactgtgtttctaa

SEQ ID NO: 9445724 - DNA, 22 bp, Homo sapiens
actgagactgaatctgaatgat

SEQ ID NO: 9445725 - DNA, 22 bp, Homo sapiens
actgagactgcccctgtaacaa

SEQ ID NO: 9445726 - DNA, 22 bp, Homo sapiens
aataaaatggtcagttttctca

SEQ ID NO: 9445727 - DNA, 22 bp, Homo sapiens
aataaaatggtcagttttctca

SEQ ID NO: 9445728 - DNA, 22 bp, Homo sapiens
aataaacttccactgtgttttt

SEQ ID NO: 9445729 - DNA, 22 bp, Homo sapiens
aataaagaatggatgagatcgt

SEQ ID NO: 9445730 - DNA, 22 bp, Homo sapiens
aataaacttccactgtgttttt

SEQ ID NO: 9445731 - DNA, 22 bp, Homo sapiens
aataaacttccactgtgttttt

SEQ ID NO: 9445732 - DNA, 22 bp, Homo sapiens
actgacaccaccaatatgttca

SEQ ID NO: 9445733 - DNA, 20 bp, Homo sapiens
actgacagggaactaaggct

SEQ ID NO: 9445734 - DNA, 22 bp, Homo sapiens
actgagaaatttccagacttgc

SEQ ID NO: 9445735 - DNA, 22 bp, Homo sapiens
actgagaaatttccagacttgc

SEQ ID NO: 9445736 - DNA, 22 bp, Homo sapiens
actgagaaagaccacatggaga

SEQ ID NO: 9445737 - DNA, 22 bp, Homo sapiens
aagttttattggaacatagcca

SEQ ID NO: 9445738 - DNA, 21 bp, Homo sapiens
aagttttatgttgccatttgt

SEQ ID NO: 9445739 - DNA, 22 bp, Homo sapiens
aagttttatgggaagatgtgca

SEQ ID NO: 9445740 - DNA, 22 bp, Homo sapiens
aagttttatgggaagatgtgca

SEQ ID NO: 9445741 - DNA, 22 bp, Homo sapiens
aagttttattggctatagcact

SEQ ID NO: 9445742 - DNA, 22 bp, Homo sapiens
aagttttattggctatagcact

SEQ ID NO: 9445743 - DNA, 22 bp, Homo sapiens
actgacaccaccaatatgttca

SEQ ID NO: 9445744 - DNA, 22 bp, Homo sapiens
aagttttattggaacatagcca

SEQ ID NO: 9445745 - DNA, 22 bp, Homo sapiens
aagttttattggctatagcact

SEQ ID NO: 9445746 - DNA, 22 bp, Homo sapiens
aataacagaaacttgagcatca

SEQ ID NO: 9445747 - DNA, 22 bp, Homo sapiens
aataaatgtttgttggatgttt

SEQ ID NO: 9445748 - DNA, 22 bp, Homo sapiens
aataaatgtttgttggatgttt

SEQ ID NO: 9445749 - DNA, 22 bp, Homo sapiens
aataacagagaagggtggcttc

SEQ ID NO: 9445750 - DNA, 22 bp, Homo sapiens
aataaatgaacaaagcaggttg

SEQ ID NO: 9445751 - DNA, 22 bp, Homo sapiens
aataaatgaacaaagcaggttg

SEQ ID NO: 9445752 - DNA, 22 bp, Homo sapiens
aataaatgaacaaagcaggttg

SEQ ID NO: 9445753 - DNA, 22 bp, Homo sapiens
aataaatgaacaaagcaggttg

SEQ ID NO: 9445754 - DNA, 22 bp, Homo sapiens
aataaatgttaagattgtctca

SEQ ID NO: 9445755 - DNA, 22 bp, Homo sapiens
aataaatgttaagattgtctca

SEQ ID NO: 9445756 - DNA, 22 bp, Homo sapiens
aataaatgttaagattgtctca

SEQ ID NO: 9445757 - DNA, 22 bp, Homo sapiens
aataaatgttaagattgtctca

SEQ ID NO: 9445758 - DNA, 22 bp, Homo sapiens
aataaatgttaagattgtctca

SEQ ID NO: 9445759 - DNA, 22 bp, Homo sapiens
aataaatgttaagattgtctca

SEQ ID NO: 9445760 - DNA, 22 bp, Homo sapiens
aataaagacaaacaggggagcc

SEQ ID NO: 9445761 - DNA, 22 bp, Homo sapiens
aataaagcatgaggcatttatc

SEQ ID NO: 9445762 - DNA, 22 bp, Homo sapiens
aataaagcagggtccttgcact

SEQ ID NO: 9445763 - DNA, 22 bp, Homo sapiens
aataaagtgtattctttgtcat

SEQ ID NO: 9445764 - DNA, 22 bp, Homo sapiens
aataaagtagcgtttaaggtgc

SEQ ID NO: 9445765 - DNA, 22 bp, Homo sapiens
aataaagtgtattctttgtcat

SEQ ID NO: 9445766 - DNA, 22 bp, Homo sapiens
aataaatcaatcctattggtag

SEQ ID NO: 9445767 - DNA, 22 bp, Homo sapiens
aataaaggcaccataaggcaaa

SEQ ID NO: 9445768 - DNA, 20 bp, Homo sapiens
aagtggatccctaagaacag

SEQ ID NO: 9445769 - DNA, 22 bp, Homo sapiens
aagtggagctataggctcagat

SEQ ID NO: 9445770 - DNA, 22 bp, Homo sapiens
actcatgtcctaggagtaaagc

SEQ ID NO: 9445771 - DNA, 22 bp, Homo sapiens
aagtggagtccctacaaccagc

SEQ ID NO: 9445772 - DNA, 22 bp, Homo sapiens
aagtggaggccgagttcacgca

SEQ ID NO: 9445773 - DNA, 22 bp, Homo sapiens
actcatctttgaattttcagta

SEQ ID NO: 9445774 - DNA, 22 bp, Homo sapiens
actcatggtagcacaggctgtg

SEQ ID NO: 9445775 - DNA, 22 bp, Homo sapiens
actcatgatatgcctataagat

SEQ ID NO: 9445776 - DNA, 22 bp, Homo sapiens
actcatggtagcacaggctgtg

SEQ ID NO: 9445777 - DNA, 22 bp, Homo sapiens
actcatgtaagcggaatgtagt

SEQ ID NO: 9445778 - DNA, 22 bp, Homo sapiens
actcagtacatctggagttggc

SEQ ID NO: 9445779 - DNA, 22 bp, Homo sapiens
actcagagcagagcagcctgag

SEQ ID NO: 9445780 - DNA, 23 bp, Homo sapiens
actcagtgagggccttgggctgc

SEQ ID NO: 9445781 - DNA, 22 bp, Homo sapiens
actcagtgaattttcatcaaat

SEQ ID NO: 9445782 - DNA, 22 bp, Homo sapiens
actcagtacatctggagttggc

SEQ ID NO: 9445783 - DNA, 22 bp, Homo sapiens
actcagagcagagcagcctgag

SEQ ID NO: 9445784 - DNA, 22 bp, Homo sapiens
actcagtggcactttggaattt

SEQ ID NO: 9445785 - DNA, 22 bp, Homo sapiens
actcatatactgttgtttttaa

SEQ ID NO: 9445786 - DNA, 22 bp, Homo sapiens
aagttttactgaggacacatgt

SEQ ID NO: 9445787 - DNA, 22 bp, Homo sapiens
aagttttaacaagtacttacta

SEQ ID NO: 9445788 - DNA, 22 bp, Homo sapiens
aagtttgtcgaaattatcagca

SEQ ID NO: 9445789 - DNA, 22 bp, Homo sapiens
aagtttgtggttatacttgatt

SEQ ID NO: 9445790 - DNA, 22 bp, Homo sapiens
aagtttgttcattcattcatcc

SEQ ID NO: 9445791 - DNA, 22 bp, Homo sapiens
aagtttgttcagggcttacatt

SEQ ID NO: 9445792 - DNA, 22 bp, Homo sapiens
aagtttggggagaatttcattt

SEQ ID NO: 9445793 - DNA, 22 bp, Homo sapiens
aagtttctgaatttgaaaggat

SEQ ID NO: 9445794 - DNA, 22 bp, Homo sapiens
aagtgggaatagaaatgaaggt

SEQ ID NO: 9445795 - DNA, 22 bp, Homo sapiens
aagtggcagaatagtggcagga

SEQ ID NO: 9445796 - DNA, 22 bp, Homo sapiens
aagtggcagaatagtggcagga

SEQ ID NO: 9445797 - DNA, 22 bp, Homo sapiens
aagtggctaacagtccttgcct

SEQ ID NO: 9445798 - DNA, 22 bp, Homo sapiens
aagtggctgctatcaactcctt

SEQ ID NO: 9445799 - DNA, 22 bp, Homo sapiens
aagtggctttgagcttctgcca

SEQ ID NO: 9445800 - DNA, 22 bp, Homo sapiens
aagtggccctaggccaagggga

SEQ ID NO: 9445801 - DNA, 22 bp, Homo sapiens
aagtggcagttcaggaagcaga

SEQ ID NO: 9445802 - DNA, 22 bp, Homo sapiens
aagtggcagttcaggaagcaga

SEQ ID NO: 9445803 - DNA, 22 bp, Homo sapiens
aagtgaatagcctatttactag

SEQ ID NO: 9445804 - DNA, 22 bp, Homo sapiens
aagtgaatgtagcaaacttgaa

SEQ ID NO: 9445805 - DNA, 22 bp, Homo sapiens
aagtgaatggggcagacttcag

SEQ ID NO: 9445806 - DNA, 22 bp, Homo sapiens
aagtgaatttcattccaattct

SEQ ID NO: 9445807 - DNA, 22 bp, Homo sapiens
aagtgacctcatggtttctcct

SEQ ID NO: 9445808 - DNA, 22 bp, Homo sapiens
aagtgacacatttgtgatgaat

SEQ ID NO: 9445809 - DNA, 22 bp, Homo sapiens
aagtgacagtttacaattctta

SEQ ID NO: 9445810 - DNA, 20 bp, Homo sapiens
accttgggtgagtgacggtc

SEQ ID NO: 9445811 - DNA, 20 bp, Homo sapiens
accttgggtgagtgacggtc

SEQ ID NO: 9445812 - DNA, 22 bp, Homo sapiens
accttgttgtaggtacaaaaga

SEQ ID NO: 9445813 - DNA, 21 bp, Homo sapiens
acctttaattcaagcatcagg

SEQ ID NO: 9445814 - DNA, 21 bp, Homo sapiens
acctttaattcaagcatcagg

SEQ ID NO: 9445815 - DNA, 21 bp, Homo sapiens
acctttaattcaagcatcagg

SEQ ID NO: 9445816 - DNA, 22 bp, Homo sapiens
acctttatagctgattatgaca

SEQ ID NO: 9445817 - DNA, 22 bp, Homo sapiens
aagtctcttttcttcctgtatt

SEQ ID NO: 9445818 - DNA, 22 bp, Homo sapiens
aagtctctttgggtactttatt

SEQ ID NO: 9445819 - DNA, 22 bp, Homo sapiens
aagtgaagaaatacatgagaat

SEQ ID NO: 9445820 - DNA, 22 bp, Homo sapiens
aagtgaagaaatacatgagaat

SEQ ID NO: 9445821 - DNA, 22 bp, Homo sapiens
aagtgatgctacgactttgaca

SEQ ID NO: 9445822 - DNA, 22 bp, Homo sapiens
aagtgatgctacgactttgaca

SEQ ID NO: 9445823 - DNA, 22 bp, Homo sapiens
aagtgaggtttctgctttcaga

SEQ ID NO: 9445824 - DNA, 22 bp, Homo sapiens
aagtgagtgaaaatgcagaata

SEQ ID NO: 9445825 - DNA, 22 bp, Homo sapiens
aagtgagttcagcattcactcg

SEQ ID NO: 9445826 - DNA, 22 bp, Homo sapiens
aagtgactatttgagtacatca

SEQ ID NO: 9445827 - DNA, 22 bp, Homo sapiens
aagtgactatttgagtacatca

SEQ ID NO: 9445828 - DNA, 22 bp, Homo sapiens
aagtgactatttgagtacatca

SEQ ID NO: 9445829 - DNA, 22 bp, Homo sapiens
aagtgacttaatctcctctcag

SEQ ID NO: 9445830 - DNA, 22 bp, Homo sapiens
aagtgattttcctacttgctaa

SEQ ID NO: 9445831 - DNA, 22 bp, Homo sapiens
aagtgatttagtcttataaagg

SEQ ID NO: 9445832 - DNA, 23 bp, Homo sapiens
aagtgcaagtgaaaggcacagtt

SEQ ID NO: 9445833 - DNA, 22 bp, Homo sapiens
aagtgcaatgaatagctgcaat

SEQ ID NO: 9445834 - DNA, 22 bp, Homo sapiens
aagtgcaaatttaagaaggcat

SEQ ID NO: 9445835 - DNA, 22 bp, Homo sapiens
aagtgcaagcaggacttagttt

SEQ ID NO: 9445836 - DNA, 22 bp, Homo sapiens
accttggaaatgcccattgcct

SEQ ID NO: 9445837 - DNA, 22 bp, Homo sapiens
accttggaactgaagtgttttt

SEQ ID NO: 9445838 - DNA, 23 bp, Homo sapiens
accttggacttcccagcttccag

SEQ ID NO: 9445839 - DNA, 22 bp, Homo sapiens
accttgggcaacctgctcctgc

SEQ ID NO: 9445840 - DNA, 22 bp, Homo sapiens
accttgggcaacctgctcctgc

SEQ ID NO: 9445841 - DNA, 22 bp, Homo sapiens
accttctgaccagttatcttga

SEQ ID NO: 9445842 - DNA, 22 bp, Homo sapiens
accttctggtctgcctgacagc

SEQ ID NO: 9445843 - DNA, 22 bp, Homo sapiens
acctgggcattttggatgatta

SEQ ID NO: 9445844 - DNA, 20 bp, Homo sapiens
acctggggttgcctgtgctc

SEQ ID NO: 9445845 - DNA, 22 bp, Homo sapiens
acctgggtctggtgttgggacg

SEQ ID NO: 9445846 - DNA, 22 bp, Homo sapiens
acctgggagagaggagccggcg

SEQ ID NO: 9445847 - DNA, 22 bp, Homo sapiens
acctggctttggggataggctt

SEQ ID NO: 9445848 - DNA, 22 bp, Homo sapiens
acctggctttggggataggctt

SEQ ID NO: 9445849 - DNA, 22 bp, Homo sapiens
acctggcttctaatcatggctc

SEQ ID NO: 9445850 - DNA, 22 bp, Homo sapiens
acctgggatggggccaggttta

SEQ ID NO: 9445851 - DNA, 22 bp, Homo sapiens
aagtaaacattgagagacaaga

SEQ ID NO: 9445852 - DNA, 22 bp, Homo sapiens
aagtaaaccacagagaagccac

SEQ ID NO: 9445853 - DNA, 22 bp, Homo sapiens
aagtaaaattcaatcttcactg

SEQ ID NO: 9445854 - DNA, 22 bp, Homo sapiens
aagtaaacattgagagacaaga

SEQ ID NO: 9445855 - DNA, 22 bp, Homo sapiens
aagtaaacagataagaaatctg

SEQ ID NO: 9445856 - DNA, 22 bp, Homo sapiens
aagtaaatatctgtttatagca

SEQ ID NO: 9445857 - DNA, 22 bp, Homo sapiens
aagtaaatatctgtttatagca

SEQ ID NO: 9445858 - DNA, 22 bp, Homo sapiens
aagtaaatatctgtttatagca

SEQ ID NO: 9445859 - DNA, 22 bp, Homo sapiens
aagtaaatatctgtttatagca

SEQ ID NO: 9445860 - DNA, 22 bp, Homo sapiens
aagtaaacttacacatagtaaa

SEQ ID NO: 9445861 - DNA, 22 bp, Homo sapiens
aagtaaacttacacatagtaaa

SEQ ID NO: 9445862 - DNA, 22 bp, Homo sapiens
aagtaaatatctgtagtcttta

SEQ ID NO: 9445863 - DNA, 21 bp, Homo sapiens
aagtaaatcagagaaataacc

SEQ ID NO: 9445864 - DNA, 21 bp, Homo sapiens
aagtaaatcagagaaataacc

SEQ ID NO: 9445865 - DNA, 21 bp, Homo sapiens
aagtaaatcagagaaataacc

SEQ ID NO: 9445866 - DNA, 21 bp, Homo sapiens
aagtaaatcagagaaataacc

SEQ ID NO: 9445867 - DNA, 21 bp, Homo sapiens
aagtaaatcagagaaataacc

SEQ ID NO: 9445868 - DNA, 21 bp, Homo sapiens
aagtaaatcagagaaataacc

SEQ ID NO: 9445869 - DNA, 22 bp, Homo sapiens
aagtaaatgttggagctcaaat

SEQ ID NO: 9445870 - DNA, 22 bp, Homo sapiens
aagtaaatgttggagctcaaat

SEQ ID NO: 9445871 - DNA, 22 bp, Homo sapiens
aagtaaatgttggagctcaaat

SEQ ID NO: 9445872 - DNA, 21 bp, Homo sapiens
aagtaaatcagagaaataacc

SEQ ID NO: 9445873 - DNA, 21 bp, Homo sapiens
aagtaaatcagagaaataacc

SEQ ID NO: 9445874 - DNA, 21 bp, Homo sapiens
aagtaaatcagagaaataacc

SEQ ID NO: 9445875 - DNA, 21 bp, Homo sapiens
aagtaaatcagagaaataacc

SEQ ID NO: 9445876 - DNA, 21 bp, Homo sapiens
aagtaaatcagagaaataacc

SEQ ID NO: 9445877 - DNA, 20 bp, Homo sapiens
acctggcttcctcttggcat

SEQ ID NO: 9445878 - DNA, 22 bp, Homo sapiens
acctggcttccaatctaggagc

SEQ ID NO: 9445879 - DNA, 18 bp, Homo sapiens
acctgcctgttcttctct

SEQ ID NO: 9445880 - DNA, 18 bp, Homo sapiens
aagtaacagaagagcaca

SEQ ID NO: 9445881 - DNA, 18 bp, Homo sapiens
aagtaacagaagagcaca

SEQ ID NO: 9445882 - DNA, 22 bp, Homo sapiens
aagtaacacggaacttgaagca

SEQ ID NO: 9445883 - DNA, 18 bp, Homo sapiens
aagtaacagaagagcaca

SEQ ID NO: 9445884 - DNA, 18 bp, Homo sapiens
aagtaacagaagagcaca

SEQ ID NO: 9445885 - DNA, 22 bp, Homo sapiens
aagtaacacatgttacttctgc

SEQ ID NO: 9445886 - DNA, 22 bp, Homo sapiens
aagtaacacatgttacttctgc

SEQ ID NO: 9445887 - DNA, 22 bp, Homo sapiens
acataacaatcataggacatag

SEQ ID NO: 9445888 - DNA, 22 bp, Homo sapiens
acagtttactggccttgccgtt

SEQ ID NO: 9445889 - DNA, 22 bp, Homo sapiens
acagtgtcatcagtttctcaac

SEQ ID NO: 9445890 - DNA, 22 bp, Homo sapiens
acagtgtcatgtcgtgttcccc

SEQ ID NO: 9445891 - DNA, 22 bp, Homo sapiens
acagtgtccttgtggtccctgt

SEQ ID NO: 9445892 - DNA, 22 bp, Homo sapiens
acagtgtccccagctctgtgag

SEQ ID NO: 9445893 - DNA, 22 bp, Homo sapiens
acagtgtaattcatggctgaaa

SEQ ID NO: 9445894 - DNA, 22 bp, Homo sapiens
acagtgtagcatggtagcaatg

SEQ ID NO: 9445895 - DNA, 22 bp, Homo sapiens
acagtgtagtgtgatgtcaaaa

SEQ ID NO: 9445896 - DNA, 22 bp, Homo sapiens
acagtgtataaaatcttaaaga

SEQ ID NO: 9445897 - DNA, 22 bp, Homo sapiens
acagtgtatgatatttcacagt

SEQ ID NO: 9445898 - DNA, 22 bp, Homo sapiens
acagtgtaatatgggagtcagt

SEQ ID NO: 9445899 - DNA, 18 bp, Homo sapiens
acagtggtttgatgtgct

SEQ ID NO: 9445900 - DNA, 22 bp, Homo sapiens
acagtgtaatatgggagtcagt

SEQ ID NO: 9445901 - DNA, 22 bp, Homo sapiens
acagtggtaggataactgtttt

SEQ ID NO: 9445902 - DNA, 22 bp, Homo sapiens
acagtggtgagtgactgatagg

SEQ ID NO: 9445903 - DNA, 18 bp, Homo sapiens
acagtgctgtcactgctt

SEQ ID NO: 9445904 - DNA, 22 bp, Homo sapiens
acagtgctgtctatctcactaa

SEQ ID NO: 9445905 - DNA, 20 bp, Homo sapiens
acagtgggtggggagcactg

SEQ ID NO: 9445906 - DNA, 20 bp, Homo sapiens
acagtgggtggggagcactg

SEQ ID NO: 9445907 - DNA, 22 bp, Homo sapiens
acagtggtaggataactgtttt

SEQ ID NO: 9445908 - DNA, 22 bp, Homo sapiens
acagtgctgtcaaatatgtttt

SEQ ID NO: 9445909 - DNA, 22 bp, Homo sapiens
acagtgctgaacgacatggaag

SEQ ID NO: 9445910 - DNA, 22 bp, Homo sapiens
acagtgctgatctagactgacc

SEQ ID NO: 9445911 - DNA, 22 bp, Homo sapiens
acagtgctcatgtgacatggtg

SEQ ID NO: 9445912 - DNA, 22 bp, Homo sapiens
acagtgctaaacacttcttgaa

SEQ ID NO: 9445913 - DNA, 22 bp, Homo sapiens
acaggtgtgagaacatgccttg

SEQ ID NO: 9445914 - DNA, 22 bp, Homo sapiens
acaggtgtaggtacatttgcat

SEQ ID NO: 9445915 - DNA, 22 bp, Homo sapiens
acaggtgtagcaggagcatcaa

SEQ ID NO: 9445916 - DNA, 22 bp, Homo sapiens
acaggtgattcaggctctggga

SEQ ID NO: 9445917 - DNA, 18 bp, Homo sapiens
acaggtgatatcttgaga

SEQ ID NO: 9445918 - DNA, 18 bp, Homo sapiens
acaggtgatatcttgaga

SEQ ID NO: 9445919 - DNA, 20 bp, Homo sapiens
acagtgcatggggggacagc

SEQ ID NO: 9445920 - DNA, 19 bp, Homo sapiens
acagtgcatgggacctggt

SEQ ID NO: 9445921 - DNA, 19 bp, Homo sapiens
acagtgcatgggacctggt

SEQ ID NO: 9445922 - DNA, 22 bp, Homo sapiens
acagtgctaaacacttcttgaa

SEQ ID NO: 9445923 - DNA, 22 bp, Homo sapiens
acagtgccctatgaacagctct

SEQ ID NO: 9445924 - DNA, 22 bp, Homo sapiens
acagtgcattattgctgaatgc

SEQ ID NO: 9445925 - DNA, 22 bp, Homo sapiens
acagtgcaggtctcaacaatta

SEQ ID NO: 9445926 - DNA, 22 bp, Homo sapiens
acagtctttctacattctgtgc

SEQ ID NO: 9445927 - DNA, 22 bp, Homo sapiens
acagtctttctacattctgtgc

SEQ ID NO: 9445928 - DNA, 22 bp, Homo sapiens
acagtctttgcagaagcaatat

SEQ ID NO: 9445929 - DNA, 22 bp, Homo sapiens
acagtgcagtgtgatgagtatt

SEQ ID NO: 9445930 - DNA, 22 bp, Homo sapiens
acagtgcagtgtgatgagtatt

SEQ ID NO: 9445931 - DNA, 22 bp, Homo sapiens
acagtgcataaaaacaactttt

SEQ ID NO: 9445932 - DNA, 22 bp, Homo sapiens
acaggtcctcaagtcagctggg

SEQ ID NO: 9445933 - DNA, 22 bp, Homo sapiens
acaggtcagataaaggctggtg

SEQ ID NO: 9445934 - DNA, 22 bp, Homo sapiens
acaggtcagataaaggctggtg

SEQ ID NO: 9445935 - DNA, 22 bp, Homo sapiens
acaggtccttataagagcactc

SEQ ID NO: 9445936 - DNA, 22 bp, Homo sapiens
acaggtctactggcaagcagtg

SEQ ID NO: 9445937 - DNA, 22 bp, Homo sapiens
acaggtccttataagagcactc

SEQ ID NO: 9445938 - DNA, 22 bp, Homo sapiens
acaggtctgcagtaactgggaa

SEQ ID NO: 9445939 - DNA, 22 bp, Homo sapiens
acaggtctccagagtgagagga

SEQ ID NO: 9445940 - DNA, 22 bp, Homo sapiens
acaggtctccagagtgagagga

SEQ ID NO: 9445941 - DNA, 22 bp, Homo sapiens
acaggtgagggagctttgtgcc

SEQ ID NO: 9445942 - DNA, 22 bp, Homo sapiens
acaggtgagggagctttgtgcc

SEQ ID NO: 9445943 - DNA, 22 bp, Homo sapiens
acaggtgaggatctgagcctca

SEQ ID NO: 9445944 - DNA, 22 bp, Homo sapiens
acaggtgacttgcattttcaca

SEQ ID NO: 9445945 - DNA, 22 bp, Homo sapiens
acaggtgaagtattacactaag

SEQ ID NO: 9445946 - DNA, 22 bp, Homo sapiens
acaggtctggtctgggtgggac

SEQ ID NO: 9445947 - DNA, 22 bp, Homo sapiens
acaggtctgtgtgcacagtgct

SEQ ID NO: 9445948 - DNA, 23 bp, Homo sapiens
acagggcttatctgtcactcatc

SEQ ID NO: 9445949 - DNA, 21 bp, Homo sapiens
acagggcttcagggagggtta

SEQ ID NO: 9445950 - DNA, 22 bp, Homo sapiens
acaggcttttacggatatcttt

SEQ ID NO: 9445951 - DNA, 21 bp, Homo sapiens
acaggctttagaaaatgactc

SEQ ID NO: 9445952 - DNA, 21 bp, Homo sapiens
acaggctttagaaaatgactc

SEQ ID NO: 9445953 - DNA, 20 bp, Homo sapiens
acaggctttctgaggctggc

SEQ ID NO: 9445954 - DNA, 22 bp, Homo sapiens
acaggcttcttttgaaatcaga

SEQ ID NO: 9445955 - DNA, 22 bp, Homo sapiens
acaggcttcttttgaaatcaga

SEQ ID NO: 9445956 - DNA, 22 bp, Homo sapiens
acaggcttggcagctatcattt

SEQ ID NO: 9445957 - DNA, 22 bp, Homo sapiens
acaggcttggggctcagacaga

SEQ ID NO: 9445958 - DNA, 22 bp, Homo sapiens
acaggcttggggctcagacaga

SEQ ID NO: 9445959 - DNA, 22 bp, Homo sapiens
acaggctttaaatttaaaacca

SEQ ID NO: 9445960 - DNA, 22 bp, Homo sapiens
acaggcttagggcaggctgacc

SEQ ID NO: 9445961 - DNA, 22 bp, Homo sapiens
acaggcttcattacttcagcgt

SEQ ID NO: 9445962 - DNA, 22 bp, Homo sapiens
acaggctgttggggtccagggt

SEQ ID NO: 9445963 - DNA, 22 bp, Homo sapiens
acaggctgccacttgcatccaa

SEQ ID NO: 9445964 - DNA, 22 bp, Homo sapiens
acaggctgccacttgcatccaa

SEQ ID NO: 9445965 - DNA, 22 bp, Homo sapiens
acaggctgttggggtccagggt

SEQ ID NO: 9445966 - DNA, 22 bp, Homo sapiens
acaggctgaaagttaagttctg

SEQ ID NO: 9445967 - DNA, 22 bp, Homo sapiens
acaggctgacttcctgccatgt

SEQ ID NO: 9445968 - DNA, 22 bp, Homo sapiens
acaggctgacttcctgccatgt

SEQ ID NO: 9445969 - DNA, 22 bp, Homo sapiens
acaggctgaaagttaagttctg

SEQ ID NO: 9445970 - DNA, 23 bp, Homo sapiens
acaggctcttaatcagtgctcct

SEQ ID NO: 9445971 - DNA, 22 bp, Homo sapiens
acaggctgagcgtccatcttca

SEQ ID NO: 9445972 - DNA, 22 bp, Homo sapiens
acaggctgacttcctgccatgt

SEQ ID NO: 9445973 - DNA, 22 bp, Homo sapiens
acaggctgagcgtccatcttca

SEQ ID NO: 9445974 - DNA, 22 bp, Homo sapiens
acaggctgaggatgattgcatc

SEQ ID NO: 9445975 - DNA, 22 bp, Homo sapiens
acaggctgagcgtccatcttca

SEQ ID NO: 9445976 - DNA, 22 bp, Homo sapiens
acaggctgaggatgattgcatc

SEQ ID NO: 9445977 - DNA, 22 bp, Homo sapiens
acaggagcaacagactaagaca

SEQ ID NO: 9445978 - DNA, 20 bp, Homo sapiens
acaggagatctgaggaaagg

SEQ ID NO: 9445979 - DNA, 20 bp, Homo sapiens
acaggagatctgaggaaagg

SEQ ID NO: 9445980 - DNA, 22 bp, Homo sapiens
acaggaggagcagctgtgtgcc

SEQ ID NO: 9445981 - DNA, 22 bp, Homo sapiens
acaggaggagcagctgtgtgcc

SEQ ID NO: 9445982 - DNA, 22 bp, Homo sapiens
acaggaggagcagctgtgtgcc

SEQ ID NO: 9445983 - DNA, 22 bp, Homo sapiens
acaggagctctagggacagcac

SEQ ID NO: 9445984 - DNA, 22 bp, Homo sapiens
acaggcagagaactcagccaga

SEQ ID NO: 9445985 - DNA, 22 bp, Homo sapiens
acaggcagagaactcagccaga

SEQ ID NO: 9445986 - DNA, 19 bp, Homo sapiens
acaggcagaattgggtgtg

SEQ ID NO: 9445987 - DNA, 19 bp, Homo sapiens
acaggcagaattgggtgtg

SEQ ID NO: 9445988 - DNA, 22 bp, Homo sapiens
acaggcactttgacatgccatc

SEQ ID NO: 9445989 - DNA, 22 bp, Homo sapiens
acaggcactttgacatgccatc

SEQ ID NO: 9445990 - DNA, 22 bp, Homo sapiens
acaggcactctcattaaaatag

SEQ ID NO: 9445991 - DNA, 22 bp, Homo sapiens
acaggcactctcattaaaatag

SEQ ID NO: 9445992 - DNA, 22 bp, Homo sapiens
acaggcacctgccaccacatct

SEQ ID NO: 9445993 - DNA, 22 bp, Homo sapiens
acaggcacctgccaccacatct

SEQ ID NO: 9445994 - DNA, 22 bp, Homo sapiens
acaggcactttgacatgccatc

SEQ ID NO: 9445995 - DNA, 22 bp, Homo sapiens
acaggcactttgacatgccatc

SEQ ID NO: 9445996 - DNA, 22 bp, Homo sapiens
acaggcactttgacatgccatc

SEQ ID NO: 9445997 - DNA, 22 bp, Homo sapiens
acaggcactgtcaagtcatgaa

SEQ ID NO: 9445998 - DNA, 22 bp, Homo sapiens
acaggcactgtcaagtcatgaa

SEQ ID NO: 9445999 - DNA, 22 bp, Homo sapiens
acaggcagagaactcagccaga

SEQ ID NO: 9446000 - DNA, 22 bp, Homo sapiens
acaggcagagagtggcggactc

SEQ ID NO: 9446001 - DNA, 22 bp, Homo sapiens
acaggcagagagtggcggactc

SEQ ID NO: 9446002 - DNA, 22 bp, Homo sapiens
aagccctgacctgagagtccgt

SEQ ID NO: 9446003 - DNA, 22 bp, Homo sapiens
acaggcagagtcaggttgggtt

SEQ ID NO: 9446004 - DNA, 22 bp, Homo sapiens
acaggcagagtcaggttgggtt

SEQ ID NO: 9446005 - DNA, 22 bp, Homo sapiens
acaggcagagagtggcggactc

SEQ ID NO: 9446006 - DNA, 22 bp, Homo sapiens
acaggcagagagtggcggactc

SEQ ID NO: 9446007 - DNA, 22 bp, Homo sapiens
aagccctgcagtctctgccaca

SEQ ID NO: 9446008 - DNA, 22 bp, Homo sapiens
aagccctgccacccattcactg

SEQ ID NO: 9446009 - DNA, 22 bp, Homo sapiens
aagccctgccacccattcactg

SEQ ID NO: 9446010 - DNA, 22 bp, Homo sapiens
aagccctgcagtctctgccaca

SEQ ID NO: 9446011 - DNA, 22 bp, Homo sapiens
aagccctgcagtctctgccaca

SEQ ID NO: 9446012 - DNA, 22 bp, Homo sapiens
aagccctgagcactgcagagaa

SEQ ID NO: 9446013 - DNA, 22 bp, Homo sapiens
aagccctgataggaaaatgctg

SEQ ID NO: 9446014 - DNA, 22 bp, Homo sapiens
aagccctgagcactgcagagaa

SEQ ID NO: 9446015 - DNA, 22 bp, Homo sapiens
aagccctgagcactgcagagaa

SEQ ID NO: 9446016 - DNA, 22 bp, Homo sapiens
aagccctgactatgaagacata

SEQ ID NO: 9446017 - DNA, 22 bp, Homo sapiens
aagccctgactatgaagacata

SEQ ID NO: 9446018 - DNA, 22 bp, Homo sapiens
aagccctgacctgagagtccgt

SEQ ID NO: 9446019 - DNA, 22 bp, Homo sapiens
aagccctgactatgaagacata

SEQ ID NO: 9446020 - DNA, 22 bp, Homo sapiens
acaggccagcctggggtaaggt

SEQ ID NO: 9446021 - DNA, 22 bp, Homo sapiens
aagccctggcgggtggagggcc

SEQ ID NO: 9446022 - DNA, 22 bp, Homo sapiens
aagccctggctcagctcaccag

SEQ ID NO: 9446023 - DNA, 22 bp, Homo sapiens
aagccctggctcagctcaccag

SEQ ID NO: 9446024 - DNA, 22 bp, Homo sapiens
aagccctggcaatgtcagatga

SEQ ID NO: 9446025 - DNA, 22 bp, Homo sapiens
aagccctggcccaaccttgatt

SEQ ID NO: 9446026 - DNA, 22 bp, Homo sapiens
aagccctggcgggtggagggcc

SEQ ID NO: 9446027 - DNA, 22 bp, Homo sapiens
aagccctggcccaaccttgatt

SEQ ID NO: 9446028 - DNA, 22 bp, Homo sapiens
aagccctggacggcccttcccc

SEQ ID NO: 9446029 - DNA, 22 bp, Homo sapiens
aagccctggaactttcctagcc

SEQ ID NO: 9446030 - DNA, 22 bp, Homo sapiens
aagccctggatagagagaactg

SEQ ID NO: 9446031 - DNA, 22 bp, Homo sapiens
aagccctgccacccattcactg

SEQ ID NO: 9446032 - DNA, 22 bp, Homo sapiens
aagccctggaactttcctagcc

SEQ ID NO: 9446033 - DNA, 22 bp, Homo sapiens
aagccctggaactttcctagcc

SEQ ID NO: 9446034 - DNA, 22 bp, Homo sapiens
aagccctggattaaagatgcca

SEQ ID NO: 9446035 - DNA, 22 bp, Homo sapiens
aagccctggcaatgtcagatga

SEQ ID NO: 9446036 - DNA, 22 bp, Homo sapiens
aagccctggatagagagaactg

SEQ ID NO: 9446037 - DNA, 22 bp, Homo sapiens
aagccctggattaaagatgcca

SEQ ID NO: 9446038 - DNA, 22 bp, Homo sapiens
aagccctggattaaagatgcca

SEQ ID NO: 9446039 - DNA, 22 bp, Homo sapiens
acaggagaattatctggaacaa

SEQ ID NO: 9446040 - DNA, 22 bp, Homo sapiens
acaggaacccagaaacatttct

SEQ ID NO: 9446041 - DNA, 22 bp, Homo sapiens
acaggagaccctgctggttctg

SEQ ID NO: 9446042 - DNA, 22 bp, Homo sapiens
acaggagaccctgctggttctg

SEQ ID NO: 9446043 - DNA, 20 bp, Homo sapiens
acaggagatctgaggaaagg

SEQ ID NO: 9446044 - DNA, 21 bp, Homo sapiens
acaggagaccgcctggcagtc

SEQ ID NO: 9446045 - DNA, 21 bp, Homo sapiens
acaggagaccgcctggcagtc

SEQ ID NO: 9446046 - DNA, 21 bp, Homo sapiens
acaggagaccgcctggcagtc

SEQ ID NO: 9446047 - DNA, 21 bp, Homo sapiens
acaggagaccgcctggcagtc

SEQ ID NO: 9446048 - DNA, 22 bp, Homo sapiens
acaggaaatgaaatggtatcta

SEQ ID NO: 9446049 - DNA, 22 bp, Homo sapiens
acaggaaatgaaatggtatcta

SEQ ID NO: 9446050 - DNA, 22 bp, Homo sapiens
acaggaaatgaaatggtatcta

SEQ ID NO: 9446051 - DNA, 22 bp, Homo sapiens
acaggaaattggcatatcagtt

SEQ ID NO: 9446052 - DNA, 22 bp, Homo sapiens
acaggaaattggcatatcagtt

SEQ ID NO: 9446053 - DNA, 22 bp, Homo sapiens
acaggaaattggcatatcagtt

SEQ ID NO: 9446054 - DNA, 22 bp, Homo sapiens
acaggaaattggcatatcagtt

SEQ ID NO: 9446055 - DNA, 22 bp, Homo sapiens
acaggaacagcttgatggcatc

SEQ ID NO: 9446056 - DNA, 22 bp, Homo sapiens
acaggaacagcttgatggcatc

SEQ ID NO: 9446057 - DNA, 22 bp, Homo sapiens
acaggaaccaggcaggtcgatt

SEQ ID NO: 9446058 - DNA, 22 bp, Homo sapiens
acaggaaccaggcaggtcgatt

SEQ ID NO: 9446059 - DNA, 22 bp, Homo sapiens
acagctttgggcaatgctatga

SEQ ID NO: 9446060 - DNA, 22 bp, Homo sapiens
acaggaaagagctaggcatagg

SEQ ID NO: 9446061 - DNA, 22 bp, Homo sapiens
acaggaaagagctaggcatagg

SEQ ID NO: 9446062 - DNA, 22 bp, Homo sapiens
acagctttttactaatagattg

SEQ ID NO: 9446063 - DNA, 22 bp, Homo sapiens
acagctttttactaatagattg

SEQ ID NO: 9446064 - DNA, 22 bp, Homo sapiens
acagcttttcaattctgctgag

SEQ ID NO: 9446065 - DNA, 22 bp, Homo sapiens
acagcttttgaaaaattactgg

SEQ ID NO: 9446066 - DNA, 22 bp, Homo sapiens
acagcttttgaaaaattactgg

SEQ ID NO: 9446067 - DNA, 22 bp, Homo sapiens
acagattttaaatttgtagttg

SEQ ID NO: 9446068 - DNA, 21 bp, Homo sapiens
acagattttatatctctgctg

SEQ ID NO: 9446069 - DNA, 21 bp, Homo sapiens
acagattttatatctctgctg

SEQ ID NO: 9446070 - DNA, 21 bp, Homo sapiens
acagattttatatctctgctg

SEQ ID NO: 9446071 - DNA, 21 bp, Homo sapiens
acagattttatatctctgctg

SEQ ID NO: 9446072 - DNA, 22 bp, Homo sapiens
acagatttgttcttttgggcta

SEQ ID NO: 9446073 - DNA, 22 bp, Homo sapiens
acagattttaaatttgtagttg

SEQ ID NO: 9446074 - DNA, 22 bp, Homo sapiens
acagattttaaatttgtagttg

SEQ ID NO: 9446075 - DNA, 22 bp, Homo sapiens
acagattttggtatttgcaatg

SEQ ID NO: 9446076 - DNA, 22 bp, Homo sapiens
acagatttttcagctcctgtgt

SEQ ID NO: 9446077 - DNA, 22 bp, Homo sapiens
acagatttttcagctcctgtgt

SEQ ID NO: 9446078 - DNA, 22 bp, Homo sapiens
acagatttttcagctcctgtgt

SEQ ID NO: 9446079 - DNA, 22 bp, Homo sapiens
acagattttggtatttgcaatg

SEQ ID NO: 9446080 - DNA, 22 bp, Homo sapiens
acagattttggtatttgcaatg

SEQ ID NO: 9446081 - DNA, 22 bp, Homo sapiens
acagctggagtgttggtgaggt

SEQ ID NO: 9446082 - DNA, 22 bp, Homo sapiens
acagcttgcatgcagaggcact

SEQ ID NO: 9446083 - DNA, 22 bp, Homo sapiens
acagatttttcagctcctgtgt

SEQ ID NO: 9446084 - DNA, 22 bp, Homo sapiens
acagatttttggtaaataattt

SEQ ID NO: 9446085 - DNA, 22 bp, Homo sapiens
acagatttttggtaaataattt

SEQ ID NO: 9446086 - DNA, 22 bp, Homo sapiens
acagatttttggtaaataattt

SEQ ID NO: 9446087 - DNA, 22 bp, Homo sapiens
acagatttttggtaaataattt

SEQ ID NO: 9446088 - DNA, 22 bp, Homo sapiens
acagatgaggaagagtcagcca

SEQ ID NO: 9446089 - DNA, 20 bp, Homo sapiens
acagatgaggaaaatgaagt

SEQ ID NO: 9446090 - DNA, 22 bp, Homo sapiens
acagatgaggaaacagggtcag

SEQ ID NO: 9446091 - DNA, 22 bp, Homo sapiens
acagattttaaatgacactccc

SEQ ID NO: 9446092 - DNA, 22 bp, Homo sapiens
acagatttgttcttttgggcta

SEQ ID NO: 9446093 - DNA, 22 bp, Homo sapiens
acagatttgttcttttgggcta

SEQ ID NO: 9446094 - DNA, 22 bp, Homo sapiens
acagatttggcccagccaatgc

SEQ ID NO: 9446095 - DNA, 22 bp, Homo sapiens
acagatttggcccagccaatgc

SEQ ID NO: 9446096 - DNA, 22 bp, Homo sapiens
acagatttggcccagccaatgc

SEQ ID NO: 9446097 - DNA, 22 bp, Homo sapiens
acagatttgatctgagaacaaa

SEQ ID NO: 9446098 - DNA, 22 bp, Homo sapiens
acagatttggaggcctcacccc

SEQ ID NO: 9446099 - DNA, 22 bp, Homo sapiens
acagatttattgaagctgctgc

SEQ ID NO: 9446100 - DNA, 22 bp, Homo sapiens
acagatttattgaagctgctgc

SEQ ID NO: 9446101 - DNA, 22 bp, Homo sapiens
acagatttgactggtacctggc

SEQ ID NO: 9446102 - DNA, 22 bp, Homo sapiens
acattacataagattgtaacct

SEQ ID NO: 9446103 - DNA, 22 bp, Homo sapiens
acattagcaggtgcataaacac

SEQ ID NO: 9446104 - DNA, 22 bp, Homo sapiens
acattatagttgctacagagta

SEQ ID NO: 9446105 - DNA, 22 bp, Homo sapiens
acattatgagcccactggtgaa

SEQ ID NO: 9446106 - DNA, 22 bp, Homo sapiens
acattcaaaaagcatctgtcac

SEQ ID NO: 9446107 - DNA, 22 bp, Homo sapiens
acattctgaatgcctgacagta

SEQ ID NO: 9446108 - DNA, 22 bp, Homo sapiens
acattctggatgtctgatgaga

SEQ ID NO: 9446109 - DNA, 22 bp, Homo sapiens
acattctgtatcatctgtctca

SEQ ID NO: 9446110 - DNA, 22 bp, Homo sapiens
acattctgaaaaacagtgtttt

SEQ ID NO: 9446111 - DNA, 22 bp, Homo sapiens
acattctctccatgtcttcttt

SEQ ID NO: 9446112 - DNA, 22 bp, Homo sapiens
acattcaacatggctggtctag

SEQ ID NO: 9446113 - DNA, 22 bp, Homo sapiens
acattctatttcatcatgtcta

SEQ ID NO: 9446114 - DNA, 22 bp, Homo sapiens
acattcaagatgcattcactta

SEQ ID NO: 9446115 - DNA, 22 bp, Homo sapiens
acattctattctgcaggacaag

SEQ ID NO: 9446116 - DNA, 22 bp, Homo sapiens
acattctattctgcaggacaag

SEQ ID NO: 9446117 - DNA, 22 bp, Homo sapiens
acattacctggcatttgatctt

SEQ ID NO: 9446118 - DNA, 22 bp, Homo sapiens
aaggccaggcctagcacggagg

SEQ ID NO: 9446119 - DNA, 22 bp, Homo sapiens
aaggccagggatgccagctcgg

SEQ ID NO: 9446120 - DNA, 22 bp, Homo sapiens
aaggccaggcctagcacggagg

SEQ ID NO: 9446121 - DNA, 22 bp, Homo sapiens
aaggccaggccagatgacagtc

SEQ ID NO: 9446122 - DNA, 22 bp, Homo sapiens
aaggccaggcagggagctgtga

SEQ ID NO: 9446123 - DNA, 22 bp, Homo sapiens
acatggtatttctattataatt

SEQ ID NO: 9446124 - DNA, 22 bp, Homo sapiens
acatgtaaaaattaaggtaaga

SEQ ID NO: 9446125 - DNA, 22 bp, Homo sapiens
acatgtaaaagataaattaaca

SEQ ID NO: 9446126 - DNA, 22 bp, Homo sapiens
aaggccagcgcagaccattgtc

SEQ ID NO: 9446127 - DNA, 22 bp, Homo sapiens
aaggccagcgcagaccattgtc

SEQ ID NO: 9446128 - DNA, 22 bp, Homo sapiens
aaggccagcttgtagggctggt

SEQ ID NO: 9446129 - DNA, 22 bp, Homo sapiens
aaggccagcttgtagggctggt

SEQ ID NO: 9446130 - DNA, 22 bp, Homo sapiens
aaggccagctggagggatgagg

SEQ ID NO: 9446131 - DNA, 22 bp, Homo sapiens
aaggccaggaaattatccctat

SEQ ID NO: 9446132 - DNA, 22 bp, Homo sapiens
aaggccagcttgtagggctggt

SEQ ID NO: 9446133 - DNA, 22 bp, Homo sapiens
acatactttagcactgcattgt

SEQ ID NO: 9446134 - DNA, 22 bp, Homo sapiens
acatacttagagtaaacaagta

SEQ ID NO: 9446135 - DNA, 22 bp, Homo sapiens
acatactttttaaaagattgct

SEQ ID NO: 9446136 - DNA, 22 bp, Homo sapiens
acatgggttattgtgaggttaa

SEQ ID NO: 9446137 - DNA, 22 bp, Homo sapiens
acatggtaaattggtaaaggac

SEQ ID NO: 9446138 - DNA, 22 bp, Homo sapiens
acatggtatgtattttaagaga

SEQ ID NO: 9446139 - DNA, 17 bp, Homo sapiens
acatgggctgagactcc

SEQ ID NO: 9446140 - DNA, 22 bp, Homo sapiens
acatggggcccaaagagaggtc

SEQ ID NO: 9446141 - DNA, 22 bp, Homo sapiens
acatgggatcaatgaggcaggc

SEQ ID NO: 9446142 - DNA, 22 bp, Homo sapiens
acatggctcagtctcatgacag

SEQ ID NO: 9446143 - DNA, 23 bp, Homo sapiens
acatgggagggacatggaggctg

SEQ ID NO: 9446144 - DNA, 21 bp, Homo sapiens
acatgggacctgcgaaaggaa

SEQ ID NO: 9446145 - DNA, 18 bp, Homo sapiens
acatacattctgtctgca

SEQ ID NO: 9446146 - DNA, 18 bp, Homo sapiens
acatacattctgtctgca

SEQ ID NO: 9446147 - DNA, 18 bp, Homo sapiens
acatacattctgtctgca

SEQ ID NO: 9446148 - DNA, 22 bp, Homo sapiens
acataatggacaataatgcatc

SEQ ID NO: 9446149 - DNA, 22 bp, Homo sapiens
acatactatgaatacatgtgtc

SEQ ID NO: 9446150 - DNA, 22 bp, Homo sapiens
acatactatgaatacatgtgtc

SEQ ID NO: 9446151 - DNA, 22 bp, Homo sapiens
acatacattgcctcattggtaa

SEQ ID NO: 9446152 - DNA, 22 bp, Homo sapiens
acataataggtgcctgaatatt

SEQ ID NO: 9446153 - DNA, 22 bp, Homo sapiens
acataataggtgcctgaatatt

SEQ ID NO: 9446154 - DNA, 22 bp, Homo sapiens
acataatggacaataatgcatc

SEQ ID NO: 9446155 - DNA, 22 bp, Homo sapiens
acataattataaatggtgggct

SEQ ID NO: 9446156 - DNA, 22 bp, Homo sapiens
acataatgagctctttataaat

SEQ ID NO: 9446157 - DNA, 22 bp, Homo sapiens
acataatgagctctttataaat

SEQ ID NO: 9446158 - DNA, 22 bp, Homo sapiens
acataacatagttgacattttt

SEQ ID NO: 9446159 - DNA, 22 bp, Homo sapiens
acataacaatcataggacatag

SEQ ID NO: 9446160 - DNA, 22 bp, Homo sapiens
acataacactcttctctagtga

SEQ ID NO: 9446161 - DNA, 22 bp, Homo sapiens
acataagcttctgaagggatgg

SEQ ID NO: 9446162 - DNA, 22 bp, Homo sapiens
acataagtgcacaataaatatt

SEQ ID NO: 9446163 - DNA, 22 bp, Homo sapiens
acataacatgtcaatcacccga

SEQ ID NO: 9446164 - DNA, 22 bp, Homo sapiens
acataagtgcacaataaatatt

SEQ ID NO: 9446165 - DNA, 22 bp, Homo sapiens
acataagtgcacaataaatatt

SEQ ID NO: 9446166 - DNA, 22 bp, Homo sapiens
acataagttatggataaaatgt

SEQ ID NO: 9446167 - DNA, 22 bp, Homo sapiens
acataagttatggataaaatgt

SEQ ID NO: 9446168 - DNA, 22 bp, Homo sapiens
acataataaaaataacagctca

SEQ ID NO: 9446169 - DNA, 22 bp, Homo sapiens
acataatacctaggacagtttg

SEQ ID NO: 9446170 - DNA, 22 bp, Homo sapiens
acataataggtacctgaataat

SEQ ID NO: 9446171 - DNA, 22 bp, Homo sapiens
acataataggtacctgaataat

SEQ ID NO: 9446172 - DNA, 22 bp, Homo sapiens
acataatagcatttctaatttg

SEQ ID NO: 9446173 - DNA, 22 bp, Homo sapiens
acataatacctaggacagtttg

SEQ ID NO: 9446174 - DNA, 22 bp, Homo sapiens
accagctggcccatgagcacgt

SEQ ID NO: 9446175 - DNA, 22 bp, Homo sapiens
accaggaaaaacactgtgttgg

SEQ ID NO: 9446176 - DNA, 22 bp, Homo sapiens
accaggagttttgaccaggggc

SEQ ID NO: 9446177 - DNA, 22 bp, Homo sapiens
accaggaaatttggcaacaaag

SEQ ID NO: 9446178 - DNA, 22 bp, Homo sapiens
accaggcagtcaccgtccagga

SEQ ID NO: 9446179 - DNA, 22 bp, Homo sapiens
accaggcagtatggtgctgcaa

SEQ ID NO: 9446180 - DNA, 22 bp, Homo sapiens
accaggcactcttgtggcagtg

SEQ ID NO: 9446181 - DNA, 22 bp, Homo sapiens
accaggcactcttgtggcagtg

SEQ ID NO: 9446182 - DNA, 22 bp, Homo sapiens
aaggttcctctctccacccagc

SEQ ID NO: 9446183 - DNA, 22 bp, Homo sapiens
aaggttccctctctggaagcct

SEQ ID NO: 9446184 - DNA, 22 bp, Homo sapiens
aaggtttattaaaagttgatgg

SEQ ID NO: 9446185 - DNA, 22 bp, Homo sapiens
aaggttgtctctttattatctt

SEQ ID NO: 9446186 - DNA, 22 bp, Homo sapiens
aaggtgtcactgggacaggaaa

SEQ ID NO: 9446187 - DNA, 22 bp, Homo sapiens
accaggccaacagctaagttaa

SEQ ID NO: 9446188 - DNA, 22 bp, Homo sapiens
accaggcatgatgtggagcaca

SEQ ID NO: 9446189 - DNA, 22 bp, Homo sapiens
accaggcatgatgtggagcaca

SEQ ID NO: 9446190 - DNA, 22 bp, Homo sapiens
accaggccaaaatcatatttac

SEQ ID NO: 9446191 - DNA, 22 bp, Homo sapiens
accaggccaaaatcatatttac

SEQ ID NO: 9446192 - DNA, 22 bp, Homo sapiens
aaggtttctccgaggctatttt

SEQ ID NO: 9446193 - DNA, 22 bp, Homo sapiens
aaggtttccagtgatattgtgg

SEQ ID NO: 9446194 - DNA, 22 bp, Homo sapiens
aagtaaaacacacagtccaccg

SEQ ID NO: 9446195 - DNA, 22 bp, Homo sapiens
aagtaaaacacacagtccaccg

SEQ ID NO: 9446196 - DNA, 22 bp, Homo sapiens
aaggtttttttccagtatctct

SEQ ID NO: 9446197 - DNA, 22 bp, Homo sapiens
aagtaaaagcaggtgtgctggg

SEQ ID NO: 9446198 - DNA, 22 bp, Homo sapiens
aagtaaaacacacagtccaccg

SEQ ID NO: 9446199 - DNA, 22 bp, Homo sapiens
aagtaaaacacacagtccaccg

SEQ ID NO: 9446200 - DNA, 22 bp, Homo sapiens
aagtaaaattcaatcttcactg

SEQ ID NO: 9446201 - DNA, 22 bp, Homo sapiens
aagtaaaattcaatcttcactg

SEQ ID NO: 9446202 - DNA, 22 bp, Homo sapiens
aagtaaaatgtttcctttatta

SEQ ID NO: 9446203 - DNA, 22 bp, Homo sapiens
aagtaaaatgtttcctttatta

SEQ ID NO: 9446204 - DNA, 22 bp, Homo sapiens
aagtaaaattcaatcttcactg

SEQ ID NO: 9446205 - DNA, 22 bp, Homo sapiens
aagtaaaatgtttcctttatta

SEQ ID NO: 9446206 - DNA, 22 bp, Homo sapiens
aagtaaaatgtttcctttatta

SEQ ID NO: 9446207 - DNA, 22 bp, Homo sapiens
aagtaaaagctttaccatgcgc

SEQ ID NO: 9446208 - DNA, 22 bp, Homo sapiens
aagggcagcctgactcacggtc

SEQ ID NO: 9446209 - DNA, 22 bp, Homo sapiens
aagggcagctattatcgtcatc

SEQ ID NO: 9446210 - DNA, 22 bp, Homo sapiens
aagggcagcctgactcacggtc

SEQ ID NO: 9446211 - DNA, 22 bp, Homo sapiens
aagggcagcctgactcacggtc

SEQ ID NO: 9446212 - DNA, 22 bp, Homo sapiens
aagggcagcctgactcacggtc

SEQ ID NO: 9446213 - DNA, 22 bp, Homo sapiens
aagggcagctgacagatgctta

SEQ ID NO: 9446214 - DNA, 22 bp, Homo sapiens
aagggcagctattatcgtcatc

SEQ ID NO: 9446215 - DNA, 22 bp, Homo sapiens
aagggcagctattatcgtcatc

SEQ ID NO: 9446216 - DNA, 22 bp, Homo sapiens
aagggcagctattatcgtcatc

SEQ ID NO: 9446217 - DNA, 22 bp, Homo sapiens
aagggcagctgacagatgctta

SEQ ID NO: 9446218 - DNA, 22 bp, Homo sapiens
aagggcagctgacagatgctta

SEQ ID NO: 9446219 - DNA, 22 bp, Homo sapiens
aagggcagctattatcgtcatc

SEQ ID NO: 9446220 - DNA, 17 bp, Homo sapiens
accacctctcaccagca

SEQ ID NO: 9446221 - DNA, 17 bp, Homo sapiens
accacctctcaccagca

SEQ ID NO: 9446222 - DNA, 23 bp, Homo sapiens
accactgagtgtcttgcctgctt

SEQ ID NO: 9446223 - DNA, 22 bp, Homo sapiens
aagggcagagggaatcccacat

SEQ ID NO: 9446224 - DNA, 22 bp, Homo sapiens
aagggcagagggaatcccacat

SEQ ID NO: 9446225 - DNA, 22 bp, Homo sapiens
aagggcagagggaatcccacat

SEQ ID NO: 9446226 - DNA, 22 bp, Homo sapiens
aagggcagagggaatcccacat

SEQ ID NO: 9446227 - DNA, 22 bp, Homo sapiens
aagggcagcctgactcacggtc

SEQ ID NO: 9446228 - DNA, 22 bp, Homo sapiens
accagcacggattagaatgctt

SEQ ID NO: 9446229 - DNA, 22 bp, Homo sapiens
accagcacttccagaggtcagg

SEQ ID NO: 9446230 - DNA, 22 bp, Homo sapiens
accagcacttccagaggtcagg

SEQ ID NO: 9446231 - DNA, 22 bp, Homo sapiens
aagggcagcttaaattggtagc

SEQ ID NO: 9446232 - DNA, 22 bp, Homo sapiens
aagggcagcttaaattggtagc

SEQ ID NO: 9446233 - DNA, 22 bp, Homo sapiens
aagggcagcttaaattggtagc

SEQ ID NO: 9446234 - DNA, 22 bp, Homo sapiens
aagggcagctgacagatgctta

SEQ ID NO: 9446235 - DNA, 22 bp, Homo sapiens
aagggcagctgacagatgctta

SEQ ID NO: 9446236 - DNA, 22 bp, Homo sapiens
aagggcagctgacagatgctta

SEQ ID NO: 9446237 - DNA, 22 bp, Homo sapiens
aagggcagcttaaattggtagc

SEQ ID NO: 9446238 - DNA, 22 bp, Homo sapiens
aagggcagcttaaattggtagc

SEQ ID NO: 9446239 - DNA, 22 bp, Homo sapiens
accagctgccaagggctacact

SEQ ID NO: 9446240 - DNA, 22 bp, Homo sapiens
accagcagagttgaggaggaca

SEQ ID NO: 9446241 - DNA, 22 bp, Homo sapiens
accagcagagttgaggaggaca

SEQ ID NO: 9446242 - DNA, 22 bp, Homo sapiens
accagctgccaagggctacact

SEQ ID NO: 9446243 - DNA, 22 bp, Homo sapiens
acattctgtcaacagtgagcag

SEQ ID NO: 9446244 - DNA, 22 bp, Homo sapiens
acattctgtcaacagtgagcag

SEQ ID NO: 9446245 - DNA, 22 bp, Homo sapiens
acattctgtttccccaaagaga

SEQ ID NO: 9446246 - DNA, 22 bp, Homo sapiens
acattctgtgagtcatgtttta

SEQ ID NO: 9446247 - DNA, 22 bp, Homo sapiens
acattctgtttccccaaagaga

SEQ ID NO: 9446248 - DNA, 22 bp, Homo sapiens
acattcttaacagttaaaaact

SEQ ID NO: 9446249 - DNA, 22 bp, Homo sapiens
acattctgtttccccaaagaga

SEQ ID NO: 9446250 - DNA, 22 bp, Homo sapiens
accacaggaggatggctgctgg

SEQ ID NO: 9446251 - DNA, 22 bp, Homo sapiens
accacaggacccatgagtcagt

SEQ ID NO: 9446252 - DNA, 22 bp, Homo sapiens
acattttgcccttatttgctga

SEQ ID NO: 9446253 - DNA, 22 bp, Homo sapiens
acattttgcccttatttgctga

SEQ ID NO: 9446254 - DNA, 22 bp, Homo sapiens
acattcttaacagttaaaaact

SEQ ID NO: 9446255 - DNA, 22 bp, Homo sapiens
acattcttcagctttgtcaggc

SEQ ID NO: 9446256 - DNA, 22 bp, Homo sapiens
accaccccagaatttttcaagg

SEQ ID NO: 9446257 - DNA, 22 bp, Homo sapiens
accacatttctgaatagcataa

SEQ ID NO: 9446258 - DNA, 22 bp, Homo sapiens
accaccaggggattttcagaac

SEQ ID NO: 9446259 - DNA, 22 bp, Homo sapiens
accacccacctcacagcatagt

SEQ ID NO: 9446260 - DNA, 22 bp, Homo sapiens
accaccaggggattttcagaac

SEQ ID NO: 9446261 - DNA, 22 bp, Homo sapiens
accaccccaaatgaacctctgt

SEQ ID NO: 9446262 - DNA, 22 bp, Homo sapiens
accacaggggaggaatgatgcc

SEQ ID NO: 9446263 - DNA, 22 bp, Homo sapiens
accacagggtaaagttagatat

SEQ ID NO: 9446264 - DNA, 22 bp, Homo sapiens
accacagtatgaaatctgaaat

SEQ ID NO: 9446265 - DNA, 22 bp, Homo sapiens
accacagtctcgaagcactgca

SEQ ID NO: 9446266 - DNA, 22 bp, Homo sapiens
accacagtttagtccaatgaca

SEQ ID NO: 9446267 - DNA, 22 bp, Homo sapiens
accacatagctttgctttttgt

SEQ ID NO: 9446268 - DNA, 22 bp, Homo sapiens
accacagtttagtccaatgaca

SEQ ID NO: 9446269 - DNA, 22 bp, Homo sapiens
accacagtttcattcatgcagg

SEQ ID NO: 9446270 - DNA, 22 bp, Homo sapiens
acagacatcatcaacatcttcc

SEQ ID NO: 9446271 - DNA, 22 bp, Homo sapiens
acagacatatttggcccatagc

SEQ ID NO: 9446272 - DNA, 21 bp, Homo sapiens
acagacagtccagagaaaaga

SEQ ID NO: 9446273 - DNA, 21 bp, Homo sapiens
acagacagtccagagaaaaga

SEQ ID NO: 9446274 - DNA, 22 bp, Homo sapiens
acagacagtaaatagtgtggct

SEQ ID NO: 9446275 - DNA, 22 bp, Homo sapiens
acagacagtaaatagtgtggct

SEQ ID NO: 9446276 - DNA, 22 bp, Homo sapiens
acagacagtaaatagtgtggct

SEQ ID NO: 9446277 - DNA, 22 bp, Homo sapiens
acagacagtatggtggggctga

SEQ ID NO: 9446278 - DNA, 22 bp, Homo sapiens
acagacagtatggtggggctga

SEQ ID NO: 9446279 - DNA, 22 bp, Homo sapiens
acagacagtaaatagtgtggct

SEQ ID NO: 9446280 - DNA, 22 bp, Homo sapiens
acagacagtaaatagtgtggct

SEQ ID NO: 9446281 - DNA, 22 bp, Homo sapiens
agcccaggtgactcatacaccc

SEQ ID NO: 9446282 - DNA, 22 bp, Homo sapiens
agcccaggtgaggggttcgaaa

SEQ ID NO: 9446283 - DNA, 22 bp, Homo sapiens
agcccaggtgaggggttcgaaa

SEQ ID NO: 9446284 - DNA, 22 bp, Homo sapiens
agcccaggtggagtgtgtgggg

SEQ ID NO: 9446285 - DNA, 22 bp, Homo sapiens
agcccaggtggagtgtgtgggg

SEQ ID NO: 9446286 - DNA, 22 bp, Homo sapiens
agcccaggtctggcccagcctg

SEQ ID NO: 9446287 - DNA, 22 bp, Homo sapiens
agcccaggtctggcccagcctg

SEQ ID NO: 9446288 - DNA, 22 bp, Homo sapiens
agcccaggtgactcatacaccc

SEQ ID NO: 9446289 - DNA, 22 bp, Homo sapiens
agcccaggtctcaaagtacagg

SEQ ID NO: 9446290 - DNA, 22 bp, Homo sapiens
agcccaggtctcaaagtacagg

SEQ ID NO: 9446291 - DNA, 22 bp, Homo sapiens
agcccaggtctggcccagcctg

SEQ ID NO: 9446292 - DNA, 22 bp, Homo sapiens
agcccaggtctggcccagcctg

SEQ ID NO: 9446293 - DNA, 22 bp, Homo sapiens
agcccaggtctcaaagtacagg

SEQ ID NO: 9446294 - DNA, 22 bp, Homo sapiens
agcccaggtctcaaagtacagg

SEQ ID NO: 9446295 - DNA, 22 bp, Homo sapiens
agcccaggtctcaaagtacagg

SEQ ID NO: 9446296 - DNA, 22 bp, Homo sapiens
agcccaggtctcaaagtacagg

SEQ ID NO: 9446297 - DNA, 20 bp, Homo sapiens
acagaactgagaacagtctc

SEQ ID NO: 9446298 - DNA, 22 bp, Homo sapiens
acagaactgcaggaggaaaagc

SEQ ID NO: 9446299 - DNA, 22 bp, Homo sapiens
acagaacaggctgagaaaaaca

SEQ ID NO: 9446300 - DNA, 22 bp, Homo sapiens
acagaacaggctgagaaaaaca

SEQ ID NO: 9446301 - DNA, 22 bp, Homo sapiens
acagaacaggctgagaaaaaca

SEQ ID NO: 9446302 - DNA, 22 bp, Homo sapiens
acagaacaggctgagaaaaaca

SEQ ID NO: 9446303 - DNA, 22 bp, Homo sapiens
acagaacatattgcttctctca

SEQ ID NO: 9446304 - DNA, 22 bp, Homo sapiens
acagaacatattgcttctctca

SEQ ID NO: 9446305 - DNA, 22 bp, Homo sapiens
acagaacatattgcttctctca

SEQ ID NO: 9446306 - DNA, 22 bp, Homo sapiens
acagaacatattgcttctctca

SEQ ID NO: 9446307 - DNA, 22 bp, Homo sapiens
acagaactgggggcacagatag

SEQ ID NO: 9446308 - DNA, 22 bp, Homo sapiens
agcccagctttgaaccatatca

SEQ ID NO: 9446309 - DNA, 22 bp, Homo sapiens
agcccagggagttgattagcat

SEQ ID NO: 9446310 - DNA, 22 bp, Homo sapiens
agcccagggctaataggaacca

SEQ ID NO: 9446311 - DNA, 22 bp, Homo sapiens
agcccagggctaataggaacca

SEQ ID NO: 9446312 - DNA, 22 bp, Homo sapiens
agcccagggctaataggaacca

SEQ ID NO: 9446313 - DNA, 22 bp, Homo sapiens
agcccaggtccagttcactgca

SEQ ID NO: 9446314 - DNA, 22 bp, Homo sapiens
agcccaggtccagttcactgca

SEQ ID NO: 9446315 - DNA, 22 bp, Homo sapiens
agccaggaatgcatgctctgct

SEQ ID NO: 9446316 - DNA, 22 bp, Homo sapiens
agccaggacagggcagctcgct

SEQ ID NO: 9446317 - DNA, 22 bp, Homo sapiens
agccaggaattggacaacacat

SEQ ID NO: 9446318 - DNA, 22 bp, Homo sapiens
agccaggcggggcaggtttcct

SEQ ID NO: 9446319 - DNA, 22 bp, Homo sapiens
agccaggcgcagtggcttatgc

SEQ ID NO: 9446320 - DNA, 22 bp, Homo sapiens
agccaggcgcagtggcttatgc

SEQ ID NO: 9446321 - DNA, 22 bp, Homo sapiens
agcattgtctccaagcaggtct

SEQ ID NO: 9446322 - DNA, 22 bp, Homo sapiens
agcatttaatcctacatagatc

SEQ ID NO: 9446323 - DNA, 22 bp, Homo sapiens
agcatttaatcctacatagatc

SEQ ID NO: 9446324 - DNA, 22 bp, Homo sapiens
agccaggctaaatgagccatga

SEQ ID NO: 9446325 - DNA, 22 bp, Homo sapiens
agccaggcgggtctttgctcct

SEQ ID NO: 9446326 - DNA, 22 bp, Homo sapiens
agccaggcgggtctttgctcct

SEQ ID NO: 9446327 - DNA, 22 bp, Homo sapiens
agccaggcgggtctttgctcct

SEQ ID NO: 9446328 - DNA, 22 bp, Homo sapiens
agccaggcggggcaggtttcct

SEQ ID NO: 9446329 - DNA, 22 bp, Homo sapiens
agccaggcggggcaggtttcct

SEQ ID NO: 9446330 - DNA, 22 bp, Homo sapiens
agccaggctaaatgagccatga

SEQ ID NO: 9446331 - DNA, 22 bp, Homo sapiens
agccaggctaaatgagccatga

SEQ ID NO: 9446332 - DNA, 22 bp, Homo sapiens
agccaggctactccttgctgac

SEQ ID NO: 9446333 - DNA, 22 bp, Homo sapiens
agccaggctactccttgctgac

SEQ ID NO: 9446334 - DNA, 22 bp, Homo sapiens
agccaggctactccttgctgac

SEQ ID NO: 9446335 - DNA, 20 bp, Homo sapiens
agccaggctcaagctccccc

SEQ ID NO: 9446336 - DNA, 20 bp, Homo sapiens
agccaggctcaagctccccc

SEQ ID NO: 9446337 - DNA, 22 bp, Homo sapiens
agccaggctcaaggcctgctcc

SEQ ID NO: 9446338 - DNA, 20 bp, Homo sapiens
agccaggctcaagctccccc

SEQ ID NO: 9446339 - DNA, 20 bp, Homo sapiens
agccaggctcaagctccccc

SEQ ID NO: 9446340 - DNA, 20 bp, Homo sapiens
agccaggctcaagctccccc

SEQ ID NO: 9446341 - DNA, 22 bp, Homo sapiens
agcattctcagaatgtcatttt

SEQ ID NO: 9446342 - DNA, 23 bp, Homo sapiens
agcattctctccaacatttaaca

SEQ ID NO: 9446343 - DNA, 23 bp, Homo sapiens
agcattctctccaacatttaaca

SEQ ID NO: 9446344 - DNA, 21 bp, Homo sapiens
agcattcttggccagtccacc

SEQ ID NO: 9446345 - DNA, 22 bp, Homo sapiens
agcattccacactgaagtctgc

SEQ ID NO: 9446346 - DNA, 22 bp, Homo sapiens
agcattccacactgaagtctgc

SEQ ID NO: 9446347 - DNA, 22 bp, Homo sapiens
agcattcattgctagaatgtaa

SEQ ID NO: 9446348 - DNA, 22 bp, Homo sapiens
agcattcatgatgacaacagga

SEQ ID NO: 9446349 - DNA, 22 bp, Homo sapiens
agcatgaaaacatgaaacagca

SEQ ID NO: 9446350 - DNA, 22 bp, Homo sapiens
agcatcttcaacaggcatttta

SEQ ID NO: 9446351 - DNA, 22 bp, Homo sapiens
agcatctgttaagtgccttcaa

SEQ ID NO: 9446352 - DNA, 22 bp, Homo sapiens
agcatctgttaagtgccttcaa

SEQ ID NO: 9446353 - DNA, 22 bp, Homo sapiens
agcatctgttgaatataatatt

SEQ ID NO: 9446354 - DNA, 22 bp, Homo sapiens
agcatctggtgagggcctagtt

SEQ ID NO: 9446355 - DNA, 22 bp, Homo sapiens
agcatctggtcatgagtgagaa

SEQ ID NO: 9446356 - DNA, 22 bp, Homo sapiens
agcatctggtgagggcctagtt

SEQ ID NO: 9446357 - DNA, 22 bp, Homo sapiens
agcatctgcttaatggcttaac

SEQ ID NO: 9446358 - DNA, 22 bp, Homo sapiens
agcatctggatggaaagcaagg

SEQ ID NO: 9446359 - DNA, 22 bp, Homo sapiens
agcatctggcagaaagtcagaa

SEQ ID NO: 9446360 - DNA, 22 bp, Homo sapiens
agcatctggatggaaagcaagg

SEQ ID NO: 9446361 - DNA, 23 bp, Homo sapiens
agcatctggcttcccctggatgg

SEQ ID NO: 9446362 - DNA, 23 bp, Homo sapiens
agcatctggcttcccctggatgg

SEQ ID NO: 9446363 - DNA, 22 bp, Homo sapiens
agcatctggcctggttactttt

SEQ ID NO: 9446364 - DNA, 19 bp, Homo sapiens
agcatctccctgatcattc

SEQ ID NO: 9446365 - DNA, 22 bp, Homo sapiens
agcatcccatgactctggagga

SEQ ID NO: 9446366 - DNA, 22 bp, Homo sapiens
agcatcccatgactctggagga

SEQ ID NO: 9446367 - DNA, 21 bp, Homo sapiens
agcatctgaggcagtttccta

SEQ ID NO: 9446368 - DNA, 21 bp, Homo sapiens
agcatctgaggcagtttccta

SEQ ID NO: 9446369 - DNA, 22 bp, Homo sapiens
agcatctgcataatgccttccc

SEQ ID NO: 9446370 - DNA, 22 bp, Homo sapiens
agcatctgcataatgccttccc

SEQ ID NO: 9446371 - DNA, 22 bp, Homo sapiens
agcatctgcatattgggagacc

SEQ ID NO: 9446372 - DNA, 22 bp, Homo sapiens
agcatctgcttaatggcttaac

SEQ ID NO: 9446373 - DNA, 22 bp, Homo sapiens
agccctgcgatcgtgatttctt

SEQ ID NO: 9446374 - DNA, 22 bp, Homo sapiens
agccctgcgctcacgttctgca

SEQ ID NO: 9446375 - DNA, 22 bp, Homo sapiens
agccctggggctggtgcttacc

SEQ ID NO: 9446376 - DNA, 22 bp, Homo sapiens
agccctggggctggtgcttacc

SEQ ID NO: 9446377 - DNA, 22 bp, Homo sapiens
agccctggggctggtcttggaa

SEQ ID NO: 9446378 - DNA, 22 bp, Homo sapiens
agccctggggctggtcttggaa

SEQ ID NO: 9446379 - DNA, 22 bp, Homo sapiens
agccctggggctggtcttggaa

SEQ ID NO: 9446380 - DNA, 22 bp, Homo sapiens
agccctgccctgccatgtggca

SEQ ID NO: 9446381 - DNA, 22 bp, Homo sapiens
agccctgccattctctggagct

SEQ ID NO: 9446382 - DNA, 22 bp, Homo sapiens
agccctgcaggaggtgggagag

SEQ ID NO: 9446383 - DNA, 22 bp, Homo sapiens
agccctgcacagttcgggagga

SEQ ID NO: 9446384 - DNA, 22 bp, Homo sapiens
agccctgcataaatcagttggt

SEQ ID NO: 9446385 - DNA, 22 bp, Homo sapiens
agcccctgtcctctctgatgac

SEQ ID NO: 9446386 - DNA, 22 bp, Homo sapiens
agcccctgtttttccagtcaga

SEQ ID NO: 9446387 - DNA, 22 bp, Homo sapiens
agcccctgtcctctctgatgac

SEQ ID NO: 9446388 - DNA, 22 bp, Homo sapiens
agccctgcacaggtctgtggct

SEQ ID NO: 9446389 - DNA, 22 bp, Homo sapiens
agccctgttaactgttttgaag

SEQ ID NO: 9446390 - DNA, 22 bp, Homo sapiens
agccctgtgtgcttgtgttcct

SEQ ID NO: 9446391 - DNA, 22 bp, Homo sapiens
agcctgctgggaagggaggctt

SEQ ID NO: 9446392 - DNA, 22 bp, Homo sapiens
agcctggccactcagggcctga

SEQ ID NO: 9446393 - DNA, 22 bp, Homo sapiens
agcctggccaggcctgcccagg

SEQ ID NO: 9446394 - DNA, 22 bp, Homo sapiens
agcctggccaggcctgcccagg

SEQ ID NO: 9446395 - DNA, 22 bp, Homo sapiens
agcctggccaggcctgcccagg

SEQ ID NO: 9446396 - DNA, 22 bp, Homo sapiens
agcctggccctgctgaactctg

SEQ ID NO: 9446397 - DNA, 22 bp, Homo sapiens
agcctggccctgctgaactctg

SEQ ID NO: 9446398 - DNA, 22 bp, Homo sapiens
agcctggcctgggcaggcacat

SEQ ID NO: 9446399 - DNA, 22 bp, Homo sapiens
agcctggcctgggcaggcacat

SEQ ID NO: 9446400 - DNA, 22 bp, Homo sapiens
agcctggcggtcgtcggtcagg

SEQ ID NO: 9446401 - DNA, 22 bp, Homo sapiens
agccctgggttagggtgggagc

SEQ ID NO: 9446402 - DNA, 22 bp, Homo sapiens
agccctgggtcccagtcctggc

SEQ ID NO: 9446403 - DNA, 22 bp, Homo sapiens
agccctgggtcccagtcctggc

SEQ ID NO: 9446404 - DNA, 22 bp, Homo sapiens
agccctgggttagggtgggagc

SEQ ID NO: 9446405 - DNA, 22 bp, Homo sapiens
agccctgggtcccagtcctggc

SEQ ID NO: 9446406 - DNA, 22 bp, Homo sapiens
agccctgggtcccagtcctggc

SEQ ID NO: 9446407 - DNA, 22 bp, Homo sapiens
agccctggggtgcagaaccatg

SEQ ID NO: 9446408 - DNA, 22 bp, Homo sapiens
agccctggtagcctgctgccat

SEQ ID NO: 9446409 - DNA, 22 bp, Homo sapiens
agccctggtagcctgctgccat

SEQ ID NO: 9446410 - DNA, 22 bp, Homo sapiens
agccctggtagcctgctgccat

SEQ ID NO: 9446411 - DNA, 22 bp, Homo sapiens
agccctggtagcctgctgccat

SEQ ID NO: 9446412 - DNA, 22 bp, Homo sapiens
agccctggtttgcagcatttgc

SEQ ID NO: 9446413 - DNA, 20 bp, Homo sapiens
agccctgtaaatcccctgga

SEQ ID NO: 9446414 - DNA, 22 bp, Homo sapiens
agccctgtctctcactccaggt

SEQ ID NO: 9446415 - DNA, 22 bp, Homo sapiens
agccctgtgggccttgtggcac

SEQ ID NO: 9446416 - DNA, 22 bp, Homo sapiens
agcctgtgtcctcatctgcagc

SEQ ID NO: 9446417 - DNA, 22 bp, Homo sapiens
agcctgtgtgaagccctcagag

SEQ ID NO: 9446418 - DNA, 22 bp, Homo sapiens
agcctgtggatccctgcactgg

SEQ ID NO: 9446419 - DNA, 22 bp, Homo sapiens
agcctgtgtgctttggacaggg

SEQ ID NO: 9446420 - DNA, 22 bp, Homo sapiens
agcctgtgtgctttggacaggg

SEQ ID NO: 9446421 - DNA, 22 bp, Homo sapiens
agcctgtgttgctctggcgata

SEQ ID NO: 9446422 - DNA, 22 bp, Homo sapiens
agcctggctgtaacctcatggt

SEQ ID NO: 9446423 - DNA, 22 bp, Homo sapiens
agcctggctgtaacctcatggt

SEQ ID NO: 9446424 - DNA, 22 bp, Homo sapiens
agcctggctgtaacctcatggt

SEQ ID NO: 9446425 - DNA, 22 bp, Homo sapiens
agcctggctaaattctcccatg

SEQ ID NO: 9446426 - DNA, 22 bp, Homo sapiens
agcctggctgggaagagcctct

SEQ ID NO: 9446427 - DNA, 22 bp, Homo sapiens
agcctggcggtcgtcggtcagg

SEQ ID NO: 9446428 - DNA, 22 bp, Homo sapiens
agcctgtgagggatgctgcagt

SEQ ID NO: 9446429 - DNA, 22 bp, Homo sapiens
agcctgtgagggatgctgcagt

SEQ ID NO: 9446430 - DNA, 22 bp, Homo sapiens
agcctgtgagggatgctgcagt

SEQ ID NO: 9446431 - DNA, 22 bp, Homo sapiens
agcctgtgaaatctctgccact

SEQ ID NO: 9446432 - DNA, 22 bp, Homo sapiens
agcctggctgggaagagcctct

SEQ ID NO: 9446433 - DNA, 22 bp, Homo sapiens
agcctggcttaatcctcctttt

SEQ ID NO: 9446434 - DNA, 22 bp, Homo sapiens
agctcaggccggagctacaggc

SEQ ID NO: 9446435 - DNA, 22 bp, Homo sapiens
agctcaggccggagctacaggc

SEQ ID NO: 9446436 - DNA, 22 bp, Homo sapiens
agctcaggccggagctacaggc

SEQ ID NO: 9446437 - DNA, 22 bp, Homo sapiens
agctcaggccggagctacaggc

SEQ ID NO: 9446438 - DNA, 22 bp, Homo sapiens
agctcaagctacacacagagtc

SEQ ID NO: 9446439 - DNA, 22 bp, Homo sapiens
agctcaagtgcagttgggggat

SEQ ID NO: 9446440 - DNA, 22 bp, Homo sapiens
agctcaagtatttgggatttgt

SEQ ID NO: 9446441 - DNA, 22 bp, Homo sapiens
agctcagggcgatctgtctcgg

SEQ ID NO: 9446442 - DNA, 22 bp, Homo sapiens
agctcagggcgatctgtctcgg

SEQ ID NO: 9446443 - DNA, 22 bp, Homo sapiens
agctcagggctccaggaccgct

SEQ ID NO: 9446444 - DNA, 22 bp, Homo sapiens
agctcaggctctgcagggacta

SEQ ID NO: 9446445 - DNA, 22 bp, Homo sapiens
agctcaggctctgcagggacta

SEQ ID NO: 9446446 - DNA, 22 bp, Homo sapiens
agctcaggctctgcagggacta

SEQ ID NO: 9446447 - DNA, 22 bp, Homo sapiens
agctcaggctctgcagggacta

SEQ ID NO: 9446448 - DNA, 22 bp, Homo sapiens
agctcaggtagactcagcatct

SEQ ID NO: 9446449 - DNA, 22 bp, Homo sapiens
agctcaggtcattccagggatg

SEQ ID NO: 9446450 - DNA, 22 bp, Homo sapiens
agctcaggtctcaggaggtgtc

SEQ ID NO: 9446451 - DNA, 22 bp, Homo sapiens
agctccactccctgcctgtttc

SEQ ID NO: 9446452 - DNA, 22 bp, Homo sapiens
agctccactaaacagaatactc

SEQ ID NO: 9446453 - DNA, 22 bp, Homo sapiens
agctccaaggttgaggagtgag

SEQ ID NO: 9446454 - DNA, 22 bp, Homo sapiens
agctccaggtcagtgcacccct

SEQ ID NO: 9446455 - DNA, 22 bp, Homo sapiens
agctccaggtcagtgcacccct

SEQ ID NO: 9446456 - DNA, 22 bp, Homo sapiens
agctccaggtcagtgcacccct

SEQ ID NO: 9446457 - DNA, 22 bp, Homo sapiens
agctccaggtcagtgcacccct

SEQ ID NO: 9446458 - DNA, 22 bp, Homo sapiens
agctccaggtagtgccttatcg

SEQ ID NO: 9446459 - DNA, 22 bp, Homo sapiens
agatttgtcagctcagtcttta

SEQ ID NO: 9446460 - DNA, 22 bp, Homo sapiens
agatttgtcagctcagtcttta

SEQ ID NO: 9446461 - DNA, 22 bp, Homo sapiens
agatttgtcttggtctcatctg

SEQ ID NO: 9446462 - DNA, 22 bp, Homo sapiens
agatttgttgtgagcaggaata

SEQ ID NO: 9446463 - DNA, 22 bp, Homo sapiens
agattttagtgtagaggacttg

SEQ ID NO: 9446464 - DNA, 22 bp, Homo sapiens
agattttatagataatttccca

SEQ ID NO: 9446465 - DNA, 22 bp, Homo sapiens
agattttatagataatttccca

SEQ ID NO: 9446466 - DNA, 22 bp, Homo sapiens
acacacagaaggaagccccact

SEQ ID NO: 9446467 - DNA, 22 bp, Homo sapiens
acacacatgcctttcctaagta

SEQ ID NO: 9446468 - DNA, 22 bp, Homo sapiens
agatttctgtggtcatgtaatg

SEQ ID NO: 9446469 - DNA, 22 bp, Homo sapiens
agatttgccatggatgttcttt

SEQ ID NO: 9446470 - DNA, 23 bp, Homo sapiens
agatttggaaagctgagtggcgt

SEQ ID NO: 9446471 - DNA, 22 bp, Homo sapiens
agatttgggggctagggctggt

SEQ ID NO: 9446472 - DNA, 22 bp, Homo sapiens
agatttgggggctagggctggt

SEQ ID NO: 9446473 - DNA, 22 bp, Homo sapiens
agatttggtgtctggttgatat

SEQ ID NO: 9446474 - DNA, 22 bp, Homo sapiens
agatttgtatagatgtggttga

SEQ ID NO: 9446475 - DNA, 22 bp, Homo sapiens
agatttgtatgtctaaatgtaa

SEQ ID NO: 9446476 - DNA, 22 bp, Homo sapiens
agatttgtatgtctaaatgtaa

SEQ ID NO: 9446477 - DNA, 22 bp, Homo sapiens
agatttgtatgtctaaatgtaa

SEQ ID NO: 9446478 - DNA, 22 bp, Homo sapiens
agatttctgtcaccttctatgc

SEQ ID NO: 9446479 - DNA, 22 bp, Homo sapiens
agatttctgtggtcatgtaatg

SEQ ID NO: 9446480 - DNA, 22 bp, Homo sapiens
agatttctgggcttcaccacct

SEQ ID NO: 9446481 - DNA, 22 bp, Homo sapiens
agatttctgtcaccttctatgc

SEQ ID NO: 9446482 - DNA, 22 bp, Homo sapiens
agattcaggactggccacagcc

SEQ ID NO: 9446483 - DNA, 21 bp, Homo sapiens
agattcaggacagcagtcact

SEQ ID NO: 9446484 - DNA, 21 bp, Homo sapiens
agattcaggacagcagtcact

SEQ ID NO: 9446485 - DNA, 22 bp, Homo sapiens
acacactgagtgccataggacc

SEQ ID NO: 9446486 - DNA, 22 bp, Homo sapiens
acacactgaattttgtggaaac

SEQ ID NO: 9446487 - DNA, 22 bp, Homo sapiens
acacactcaattgcataagcac

SEQ ID NO: 9446488 - DNA, 21 bp, Homo sapiens
acacactacacattcctagtt

SEQ ID NO: 9446489 - DNA, 22 bp, Homo sapiens
acacaccatgatttatttaccc

SEQ ID NO: 9446490 - DNA, 22 bp, Homo sapiens
acacactggcaggagctataaa

SEQ ID NO: 9446491 - DNA, 22 bp, Homo sapiens
agcacttctcatgggatcaggt

SEQ ID NO: 9446492 - DNA, 20 bp, Homo sapiens
agcacttgctgtgtgccata

SEQ ID NO: 9446493 - DNA, 20 bp, Homo sapiens
agcacttgctgtgtgccata

SEQ ID NO: 9446494 - DNA, 21 bp, Homo sapiens
acacactgagttttccactgt

SEQ ID NO: 9446495 - DNA, 22 bp, Homo sapiens
acacactgctcgctcagattaa

SEQ ID NO: 9446496 - DNA, 22 bp, Homo sapiens
agcagaaaactttcatgctctg

SEQ ID NO: 9446497 - DNA, 22 bp, Homo sapiens
agcagaaaattggaaatgacaa

SEQ ID NO: 9446498 - DNA, 22 bp, Homo sapiens
agcagaaaattggaaatgacaa

SEQ ID NO: 9446499 - DNA, 22 bp, Homo sapiens
agcagaaaattggaaatgacaa

SEQ ID NO: 9446500 - DNA, 22 bp, Homo sapiens
agcagaaacagccagtctggac

SEQ ID NO: 9446501 - DNA, 22 bp, Homo sapiens
agcagaaatagaagtcaatgat

SEQ ID NO: 9446502 - DNA, 22 bp, Homo sapiens
agcagaaatagaagtcaatgat

SEQ ID NO: 9446503 - DNA, 22 bp, Homo sapiens
agcacttgtagactagaatttt

SEQ ID NO: 9446504 - DNA, 22 bp, Homo sapiens
agcacttgtcaggcagctctat

SEQ ID NO: 9446505 - DNA, 22 bp, Homo sapiens
acacactggcaggagctataaa

SEQ ID NO: 9446506 - DNA, 22 bp, Homo sapiens
acacactggcaggagctataaa

SEQ ID NO: 9446507 - DNA, 22 bp, Homo sapiens
agcagcagctcattcttcctgt

SEQ ID NO: 9446508 - DNA, 22 bp, Homo sapiens
agcagcagctcattcttcctgt

SEQ ID NO: 9446509 - DNA, 22 bp, Homo sapiens
acacactgtaaggactatcact

SEQ ID NO: 9446510 - DNA, 22 bp, Homo sapiens
acacactgtaaggactatcact

SEQ ID NO: 9446511 - DNA, 22 bp, Homo sapiens
acacactgtaaggactatcact

SEQ ID NO: 9446512 - DNA, 22 bp, Homo sapiens
acacactggcccccagtactga

SEQ ID NO: 9446513 - DNA, 22 bp, Homo sapiens
acacactggcccccagtactga

SEQ ID NO: 9446514 - DNA, 22 bp, Homo sapiens
acacactgtaaggactatcact

SEQ ID NO: 9446515 - DNA, 22 bp, Homo sapiens
acacactgtaaggactatcact

SEQ ID NO: 9446516 - DNA, 22 bp, Homo sapiens
acacactgttgctcatccaggc

SEQ ID NO: 9446517 - DNA, 22 bp, Homo sapiens
acacacttcagatgtaatttgt

SEQ ID NO: 9446518 - DNA, 22 bp, Homo sapiens
agcagccagagtctgaacatta

SEQ ID NO: 9446519 - DNA, 23 bp, Homo sapiens
agcagccagagatcctcggccct

SEQ ID NO: 9446520 - DNA, 22 bp, Homo sapiens
agcagccagagaatgatgcagt

SEQ ID NO: 9446521 - DNA, 22 bp, Homo sapiens
agcagccagagtctgaacatta

SEQ ID NO: 9446522 - DNA, 16 bp, Homo sapiens
agcagccagcactgga

SEQ ID NO: 9446523 - DNA, 22 bp, Homo sapiens
agcagccaggaatctgcagagc

SEQ ID NO: 9446524 - DNA, 22 bp, Homo sapiens
agcagcatacacatcatgttga

SEQ ID NO: 9446525 - DNA, 23 bp, Homo sapiens
acacagaagaagacccaaggaag

SEQ ID NO: 9446526 - DNA, 22 bp, Homo sapiens
acacagaacctcatagcctctc

SEQ ID NO: 9446527 - DNA, 23 bp, Homo sapiens
acacagaagaagacccaaggaag

SEQ ID NO: 9446528 - DNA, 23 bp, Homo sapiens
acacagaagaagacccaaggaag

SEQ ID NO: 9446529 - DNA, 22 bp, Homo sapiens
acacagaacctcatagcctctc

SEQ ID NO: 9446530 - DNA, 21 bp, Homo sapiens
agcagcagcagtggggcttct

SEQ ID NO: 9446531 - DNA, 23 bp, Homo sapiens
agcagcagcaattaagtggatat

SEQ ID NO: 9446532 - DNA, 19 bp, Homo sapiens
agcagcagcaccagggatt

SEQ ID NO: 9446533 - DNA, 21 bp, Homo sapiens
agcagcagcagtggggcttct

SEQ ID NO: 9446534 - DNA, 19 bp, Homo sapiens
agcagcagcaccagggatt

SEQ ID NO: 9446535 - DNA, 22 bp, Homo sapiens
agcagcagattcagcaggaatg

SEQ ID NO: 9446536 - DNA, 22 bp, Homo sapiens
agcagcagattcagcaggaatg

SEQ ID NO: 9446537 - DNA, 22 bp, Homo sapiens
agcagcagattcagcaggaatg

SEQ ID NO: 9446538 - DNA, 22 bp, Homo sapiens
agcagcagattcagcaggaatg

SEQ ID NO: 9446539 - DNA, 22 bp, Homo sapiens
agcagcagattatggtctacat

SEQ ID NO: 9446540 - DNA, 22 bp, Homo sapiens
agcagcaactgctagagtggca

SEQ ID NO: 9446541 - DNA, 22 bp, Homo sapiens
agcagcagattatggtctacat

SEQ ID NO: 9446542 - DNA, 22 bp, Homo sapiens
agcagcagattatggtctacat

SEQ ID NO: 9446543 - DNA, 22 bp, Homo sapiens
agcagcaaagccaggggatggg

SEQ ID NO: 9446544 - DNA, 22 bp, Homo sapiens
agcagcaaagtattgggcaaga

SEQ ID NO: 9446545 - DNA, 22 bp, Homo sapiens
agcagaaccacagcactgttga

SEQ ID NO: 9446546 - DNA, 22 bp, Homo sapiens
agcagcaactgctagagtggca

SEQ ID NO: 9446547 - DNA, 22 bp, Homo sapiens
agcagcaactgctagagtggca

SEQ ID NO: 9446548 - DNA, 22 bp, Homo sapiens
agcagaacagtcttctagttct

SEQ ID NO: 9446549 - DNA, 22 bp, Homo sapiens
agcagaacattatctaggtctt

SEQ ID NO: 9446550 - DNA, 22 bp, Homo sapiens
agcagaaatgatggtatgggac

SEQ ID NO: 9446551 - DNA, 21 bp, Homo sapiens
agcagaacagtcgagcactgc

SEQ ID NO: 9446552 - DNA, 22 bp, Homo sapiens
agcatccactcactgggagagg

SEQ ID NO: 9446553 - DNA, 22 bp, Homo sapiens
agcatccagaaaactctcagaa

SEQ ID NO: 9446554 - DNA, 22 bp, Homo sapiens
agcatcagcctctgtcctggag

SEQ ID NO: 9446555 - DNA, 22 bp, Homo sapiens
agcatccagatgcctgatgtca

SEQ ID NO: 9446556 - DNA, 22 bp, Homo sapiens
agcatccagcatcctatagaaa

SEQ ID NO: 9446557 - DNA, 22 bp, Homo sapiens
agcatccagatgcctgatgtca

SEQ ID NO: 9446558 - DNA, 22 bp, Homo sapiens
agcatccaggccaggttgggca

SEQ ID NO: 9446559 - DNA, 20 bp, Homo sapiens
agcaggtgacggggcctgct

SEQ ID NO: 9446560 - DNA, 22 bp, Homo sapiens
agcaggtgagcacagccaggct

SEQ ID NO: 9446561 - DNA, 22 bp, Homo sapiens
agcaggtgagcacagccaggct

SEQ ID NO: 9446562 - DNA, 22 bp, Homo sapiens
agcaggtgagcacagccaggct

SEQ ID NO: 9446563 - DNA, 22 bp, Homo sapiens
agcagttatattgaaataaaaa

SEQ ID NO: 9446564 - DNA, 22 bp, Homo sapiens
agcagggctttgtctctgtgaa

SEQ ID NO: 9446565 - DNA, 21 bp, Homo sapiens
agcaggtgaacctccagtaca

SEQ ID NO: 9446566 - DNA, 21 bp, Homo sapiens
agcaggtgaacctccagtaca

SEQ ID NO: 9446567 - DNA, 22 bp, Homo sapiens
agcaggtgacccaagcaggctg

SEQ ID NO: 9446568 - DNA, 22 bp, Homo sapiens
agcaggtgacccaagcaggctg

SEQ ID NO: 9446569 - DNA, 22 bp, Homo sapiens
agcaggtgacccaagcaggctg

SEQ ID NO: 9446570 - DNA, 22 bp, Homo sapiens
agcaggtgacccaagcaggctg

SEQ ID NO: 9446571 - DNA, 22 bp, Homo sapiens
agcaggtgacccaagcaggctg

SEQ ID NO: 9446572 - DNA, 22 bp, Homo sapiens
agcaggtgacccaagcaggctg

SEQ ID NO: 9446573 - DNA, 22 bp, Homo sapiens
agcaggtgacagggctgtggtg

SEQ ID NO: 9446574 - DNA, 22 bp, Homo sapiens
agcagggctgtgctccttccga

SEQ ID NO: 9446575 - DNA, 22 bp, Homo sapiens
agcagggctgtgtaggtaatga

SEQ ID NO: 9446576 - DNA, 22 bp, Homo sapiens
agcagggcttctgtgcctgtgc

SEQ ID NO: 9446577 - DNA, 22 bp, Homo sapiens
agcagggctgtgtaggtaatga

SEQ ID NO: 9446578 - DNA, 22 bp, Homo sapiens
agcagggctgtgtaggtaatga

SEQ ID NO: 9446579 - DNA, 22 bp, Homo sapiens
agcagggctttgcagacttggg

SEQ ID NO: 9446580 - DNA, 22 bp, Homo sapiens
agcagggcttctgtgcctgtgc

SEQ ID NO: 9446581 - DNA, 22 bp, Homo sapiens
agcagggcttgccgcttgtcct

SEQ ID NO: 9446582 - DNA, 22 bp, Homo sapiens
agcagggcttgccgcttgtcct

SEQ ID NO: 9446583 - DNA, 22 bp, Homo sapiens
agcagggcccactaggggagat

SEQ ID NO: 9446584 - DNA, 19 bp, Homo sapiens
agcaggccacagggccagc

SEQ ID NO: 9446585 - DNA, 23 bp, Homo sapiens
agcaggcatctgtggcacaaggc

SEQ ID NO: 9446586 - DNA, 23 bp, Homo sapiens
agcaggcatctgtggcacaaggc

SEQ ID NO: 9446587 - DNA, 23 bp, Homo sapiens
agcaggcatctgtggcacaaggc

SEQ ID NO: 9446588 - DNA, 23 bp, Homo sapiens
agcaggcatctgtggcacaaggc

SEQ ID NO: 9446589 - DNA, 23 bp, Homo sapiens
agcaggcatctgtggcacaaggc

SEQ ID NO: 9446590 - DNA, 23 bp, Homo sapiens
agcaggcatctgtggcacaaggc

SEQ ID NO: 9446591 - DNA, 22 bp, Homo sapiens
agcaggcatagagtagcactca

SEQ ID NO: 9446592 - DNA, 22 bp, Homo sapiens
agcaggcatagagtagcactca

SEQ ID NO: 9446593 - DNA, 21 bp, Homo sapiens
agcaggcagtgggctggattt

SEQ ID NO: 9446594 - DNA, 19 bp, Homo sapiens
agcaggcaggtggcccagg

SEQ ID NO: 9446595 - DNA, 19 bp, Homo sapiens
agcaggcaggtggcccagg

SEQ ID NO: 9446596 - DNA, 22 bp, Homo sapiens
agcagctcctgccatgagtgct

SEQ ID NO: 9446597 - DNA, 22 bp, Homo sapiens
agcagctctgagaggccagcac

SEQ ID NO: 9446598 - DNA, 22 bp, Homo sapiens
agcagctctggcactgtagcat

SEQ ID NO: 9446599 - DNA, 22 bp, Homo sapiens
agcagctgaccagtgagtcctg

SEQ ID NO: 9446600 - DNA, 22 bp, Homo sapiens
agcagctgaccagtgagtcctg

SEQ ID NO: 9446601 - DNA, 17 bp, Homo sapiens
agcagctgaagcagcca

SEQ ID NO: 9446602 - DNA, 17 bp, Homo sapiens
agcagctgaagcagcca

SEQ ID NO: 9446603 - DNA, 17 bp, Homo sapiens
agcagctgaagcagcca

SEQ ID NO: 9446604 - DNA, 22 bp, Homo sapiens
agcagctgaaaggcaaacttct

SEQ ID NO: 9446605 - DNA, 17 bp, Homo sapiens
agcagctgaagcagcca

SEQ ID NO: 9446606 - DNA, 22 bp, Homo sapiens
agcagctgaaaggcaaacttct

SEQ ID NO: 9446607 - DNA, 19 bp, Homo sapiens
agcagccatcgaccatgga

SEQ ID NO: 9446608 - DNA, 19 bp, Homo sapiens
agcagccatcgaccatgga

SEQ ID NO: 9446609 - DNA, 21 bp, Homo sapiens
agcagccatggatggtatgta

SEQ ID NO: 9446610 - DNA, 21 bp, Homo sapiens
agcagccatttcacagagact

SEQ ID NO: 9446611 - DNA, 21 bp, Homo sapiens
agcagccatttcacagagact

SEQ ID NO: 9446612 - DNA, 22 bp, Homo sapiens
agcagccagttctctgtggtag

SEQ ID NO: 9446613 - DNA, 22 bp, Homo sapiens
agcagccagtgggagtgataca

SEQ ID NO: 9446614 - DNA, 22 bp, Homo sapiens
agcagccagtgggagtgataca

SEQ ID NO: 9446615 - DNA, 22 bp, Homo sapiens
agcagccatagatagcatgcaa

SEQ ID NO: 9446616 - DNA, 19 bp, Homo sapiens
agcagccatagacaatatg

SEQ ID NO: 9446617 - DNA, 23 bp, Homo sapiens
agcagccatagggaagcaataca

SEQ ID NO: 9446618 - DNA, 21 bp, Homo sapiens
agcaggaggcagtcacagctc

SEQ ID NO: 9446619 - DNA, 22 bp, Homo sapiens
agcaggaggagagcctggcggt

SEQ ID NO: 9446620 - DNA, 22 bp, Homo sapiens
agcaggaggagagcctggcggt

SEQ ID NO: 9446621 - DNA, 22 bp, Homo sapiens
agcaggaggagagcctggcggt

SEQ ID NO: 9446622 - DNA, 22 bp, Homo sapiens
agcaggagctgtgggaagatgg

SEQ ID NO: 9446623 - DNA, 22 bp, Homo sapiens
agcaggagctgtgggaagatgg

SEQ ID NO: 9446624 - DNA, 22 bp, Homo sapiens
agcaggagctgtgggaagatgg

SEQ ID NO: 9446625 - DNA, 22 bp, Homo sapiens
agcagctgagatggtaagattc

SEQ ID NO: 9446626 - DNA, 22 bp, Homo sapiens
agcagctgagatggtaagattc

SEQ ID NO: 9446627 - DNA, 22 bp, Homo sapiens
agcaggaaagaaaaatctgtgt

SEQ ID NO: 9446628 - DNA, 22 bp, Homo sapiens
agcaggaacgagttcatgggga

SEQ ID NO: 9446629 - DNA, 22 bp, Homo sapiens
agcaggagcccttatcaccagg

SEQ ID NO: 9446630 - DNA, 22 bp, Homo sapiens
agcaggagcccttatcaccagg

SEQ ID NO: 9446631 - DNA, 22 bp, Homo sapiens
agcaggagcccttatcaccagg

SEQ ID NO: 9446632 - DNA, 22 bp, Homo sapiens
agcaggagctgtgggaagatgg

SEQ ID NO: 9446633 - DNA, 22 bp, Homo sapiens
agcaggagggttttgtagagtc

SEQ ID NO: 9446634 - DNA, 22 bp, Homo sapiens
agcaggagggttttgtagagtc

SEQ ID NO: 9446635 - DNA, 22 bp, Homo sapiens
agcaggagggttttgtagagtc

SEQ ID NO: 9446636 - DNA, 22 bp, Homo sapiens
agcaggagtgtcccctggctgt

SEQ ID NO: 9446637 - DNA, 22 bp, Homo sapiens
agcaggcaggctgccagtgaat

SEQ ID NO: 9446638 - DNA, 22 bp, Homo sapiens
agcaggcaggctgccagtgaat

SEQ ID NO: 9446639 - DNA, 22 bp, Homo sapiens
agcaggagggttttgtagagtc

SEQ ID NO: 9446640 - DNA, 22 bp, Homo sapiens
agcaggagggttttgtagagtc

SEQ ID NO: 9446641 - DNA, 22 bp, Homo sapiens
agcaggagggttttgtagagtc

SEQ ID NO: 9446642 - DNA, 22 bp, Homo sapiens
agcaggagggttttgtagagtc

SEQ ID NO: 9446643 - DNA, 21 bp, Homo sapiens
agcaggaggcagtcacagctc

SEQ ID NO: 9446644 - DNA, 22 bp, Homo sapiens
agcaggagggttttgtagagtc

SEQ ID NO: 9446645 - DNA, 21 bp, Homo sapiens
agcaggaggcagtcacagctc

SEQ ID NO: 9446646 - DNA, 22 bp, Homo sapiens
agagtactgcctcagttatgaa

SEQ ID NO: 9446647 - DNA, 22 bp, Homo sapiens
agagtacattcagagctaccta

SEQ ID NO: 9446648 - DNA, 22 bp, Homo sapiens
agagtctgcatttctacaagct

SEQ ID NO: 9446649 - DNA, 21 bp, Homo sapiens
agagtctgcatttctgacaag

SEQ ID NO: 9446650 - DNA, 22 bp, Homo sapiens
agagtctgatttggtaagacca

SEQ ID NO: 9446651 - DNA, 22 bp, Homo sapiens
agatatacacccatatcacata

SEQ ID NO: 9446652 - DNA, 22 bp, Homo sapiens
agatataataatttacaagtgt

SEQ ID NO: 9446653 - DNA, 22 bp, Homo sapiens
agatataataatttacaagtgt

SEQ ID NO: 9446654 - DNA, 22 bp, Homo sapiens
agatataataatttacaagtgt

SEQ ID NO: 9446655 - DNA, 22 bp, Homo sapiens
agataatgttctgatccatttc

SEQ ID NO: 9446656 - DNA, 22 bp, Homo sapiens
agataatgttctgatccatttc

SEQ ID NO: 9446657 - DNA, 22 bp, Homo sapiens
agagtgaaggttgacacttcac

SEQ ID NO: 9446658 - DNA, 22 bp, Homo sapiens
agagtgaaaagctagagcagta

SEQ ID NO: 9446659 - DNA, 22 bp, Homo sapiens
agagtgaaaagctagagcagta

SEQ ID NO: 9446660 - DNA, 22 bp, Homo sapiens
agagtctgttacttgtccccta

SEQ ID NO: 9446661 - DNA, 22 bp, Homo sapiens
agagtctgtgctttcatcagga

SEQ ID NO: 9446662 - DNA, 20 bp, Homo sapiens
agagtaactggcacataggg

SEQ ID NO: 9446663 - DNA, 20 bp, Homo sapiens
agaggttcagtctggagaag

SEQ ID NO: 9446664 - DNA, 22 bp, Homo sapiens
agaggttcagagaaggcgatct

SEQ ID NO: 9446665 - DNA, 22 bp, Homo sapiens
agaggttcagagaaggcgatct

SEQ ID NO: 9446666 - DNA, 22 bp, Homo sapiens
agaggtggccatgggcgctgga

SEQ ID NO: 9446667 - DNA, 22 bp, Homo sapiens
agaggtgtggccaggactcaag

SEQ ID NO: 9446668 - DNA, 22 bp, Homo sapiens
agaggtgggagcctggtcacat

SEQ ID NO: 9446669 - DNA, 22 bp, Homo sapiens
aattttgttcttggaaatcagg

SEQ ID NO: 9446670 - DNA, 22 bp, Homo sapiens
aattttgttttagtggaggctg

SEQ ID NO: 9446671 - DNA, 22 bp, Homo sapiens
acaaaaaccgtggattcagcat

SEQ ID NO: 9446672 - DNA, 22 bp, Homo sapiens
acaaaaaccgtggattcagcat

SEQ ID NO: 9446673 - DNA, 22 bp, Homo sapiens
acaaaaaccgtggattcagcat

SEQ ID NO: 9446674 - DNA, 22 bp, Homo sapiens
acaaaaaccgtggattcagcat

SEQ ID NO: 9446675 - DNA, 22 bp, Homo sapiens
agaggggttaagtgctagtccg

SEQ ID NO: 9446676 - DNA, 22 bp, Homo sapiens
acaaaaagctccattactgtcc

SEQ ID NO: 9446677 - DNA, 22 bp, Homo sapiens
acaaaaagctccattactgtcc

SEQ ID NO: 9446678 - DNA, 22 bp, Homo sapiens
acaaaaaccgtggattcagcat

SEQ ID NO: 9446679 - DNA, 22 bp, Homo sapiens
acaaaaagctccattactgtcc

SEQ ID NO: 9446680 - DNA, 22 bp, Homo sapiens
agagggtaacaagaggcctgga

SEQ ID NO: 9446681 - DNA, 22 bp, Homo sapiens
agaggtggccatgggcgctgga

SEQ ID NO: 9446682 - DNA, 22 bp, Homo sapiens
agaggtggccatgggcgctgga

SEQ ID NO: 9446683 - DNA, 22 bp, Homo sapiens
agaggtggagctcttggcatca

SEQ ID NO: 9446684 - DNA, 22 bp, Homo sapiens
agatcctgccaatggaagcagg

SEQ ID NO: 9446685 - DNA, 22 bp, Homo sapiens
agatcctgccaatggaagcagg

SEQ ID NO: 9446686 - DNA, 21 bp, Homo sapiens
agatccctgaggagagcatcc

SEQ ID NO: 9446687 - DNA, 21 bp, Homo sapiens
agatcctggggtctggggagg

SEQ ID NO: 9446688 - DNA, 22 bp, Homo sapiens
agatccagtggtgaacaaaaga

SEQ ID NO: 9446689 - DNA, 22 bp, Homo sapiens
agatccattttggtgtcaactc

SEQ ID NO: 9446690 - DNA, 22 bp, Homo sapiens
agatcccaaatcacctgcttat

SEQ ID NO: 9446691 - DNA, 22 bp, Homo sapiens
agatcccaaatcacctgcttat

SEQ ID NO: 9446692 - DNA, 22 bp, Homo sapiens
agatccagttaatagcttcatt

SEQ ID NO: 9446693 - DNA, 22 bp, Homo sapiens
agatccagttaatagcttcatt

SEQ ID NO: 9446694 - DNA, 22 bp, Homo sapiens
agatccatgtgatttggagttc

SEQ ID NO: 9446695 - DNA, 22 bp, Homo sapiens
agatccatcatcatattttcta

SEQ ID NO: 9446696 - DNA, 22 bp, Homo sapiens
agatatgtttgtatatatttgt

SEQ ID NO: 9446697 - DNA, 21 bp, Homo sapiens
agatccagtgccataaggccc

SEQ ID NO: 9446698 - DNA, 22 bp, Homo sapiens
agatccagttaatagcttcatt

SEQ ID NO: 9446699 - DNA, 21 bp, Homo sapiens
agatccagtgccataaggccc

SEQ ID NO: 9446700 - DNA, 22 bp, Homo sapiens
agatatctgcaatataatttaa

SEQ ID NO: 9446701 - DNA, 22 bp, Homo sapiens
agatatgactagaagctcattt

SEQ ID NO: 9446702 - DNA, 22 bp, Homo sapiens
agatatggcctcatacagacat

SEQ ID NO: 9446703 - DNA, 18 bp, Homo sapiens
agatatggagggggtggg

SEQ ID NO: 9446704 - DNA, 22 bp, Homo sapiens
agatatggtttgcataaataag

SEQ ID NO: 9446705 - DNA, 22 bp, Homo sapiens
agatatggttttctcttctcct

SEQ ID NO: 9446706 - DNA, 22 bp, Homo sapiens
agatatatttaaggtaataagt

SEQ ID NO: 9446707 - DNA, 22 bp, Homo sapiens
agatatatttaaggtaataagt

SEQ ID NO: 9446708 - DNA, 22 bp, Homo sapiens
agatatacacccatatcacata

SEQ ID NO: 9446709 - DNA, 22 bp, Homo sapiens
agatatacagagaattattcac

SEQ ID NO: 9446710 - DNA, 22 bp, Homo sapiens
agatatagttgttgagaagaac

SEQ ID NO: 9446711 - DNA, 22 bp, Homo sapiens
agattacagcatgggaatggga

SEQ ID NO: 9446712 - DNA, 22 bp, Homo sapiens
agattacaaatcctctgtgttt

SEQ ID NO: 9446713 - DNA, 22 bp, Homo sapiens
agattacagaagaataagtaga

SEQ ID NO: 9446714 - DNA, 22 bp, Homo sapiens
agattaggtatggtttaagtag

SEQ ID NO: 9446715 - DNA, 19 bp, Homo sapiens
agattattgcacattcatg

SEQ ID NO: 9446716 - DNA, 22 bp, Homo sapiens
agattatttaagacaggaacca

SEQ ID NO: 9446717 - DNA, 22 bp, Homo sapiens
agattcagaaatgaggagggcc

SEQ ID NO: 9446718 - DNA, 22 bp, Homo sapiens
agattcagaaatgaggagggcc

SEQ ID NO: 9446719 - DNA, 22 bp, Homo sapiens
agattcagaaaattctctgttc

SEQ ID NO: 9446720 - DNA, 22 bp, Homo sapiens
agattcagaaatgaggagggcc

SEQ ID NO: 9446721 - DNA, 22 bp, Homo sapiens
agattcagaaaattctctgttc

SEQ ID NO: 9446722 - DNA, 22 bp, Homo sapiens
agattatttccagactaatgaa

SEQ ID NO: 9446723 - DNA, 22 bp, Homo sapiens
agatgttttagagtttgacttg

SEQ ID NO: 9446724 - DNA, 22 bp, Homo sapiens
agatgttttggagacactaacc

SEQ ID NO: 9446725 - DNA, 21 bp, Homo sapiens
agattaaaatctgtgagaagg

SEQ ID NO: 9446726 - DNA, 22 bp, Homo sapiens
agatgttttgtgtatttcatca

SEQ ID NO: 9446727 - DNA, 22 bp, Homo sapiens
agatgttttgtgtatttcatca

SEQ ID NO: 9446728 - DNA, 20 bp, Homo sapiens
agatgggttaaagctatggg

SEQ ID NO: 9446729 - DNA, 22 bp, Homo sapiens
agatctggttggagtcctgaca

SEQ ID NO: 9446730 - DNA, 22 bp, Homo sapiens
agatctggaaaatcacaggtgc

SEQ ID NO: 9446731 - DNA, 22 bp, Homo sapiens
agatctggaactgaggtttatt

SEQ ID NO: 9446732 - DNA, 22 bp, Homo sapiens
agatctggaaaatcacaggtgc

SEQ ID NO: 9446733 - DNA, 22 bp, Homo sapiens
agatctggaactgaggtttatt

SEQ ID NO: 9446734 - DNA, 22 bp, Homo sapiens
agatctggttggagtcctgaca

SEQ ID NO: 9446735 - DNA, 22 bp, Homo sapiens
agatctggccctcagcttgatt

SEQ ID NO: 9446736 - DNA, 22 bp, Homo sapiens
agagcagcgtttgtggaacact

SEQ ID NO: 9446737 - DNA, 22 bp, Homo sapiens
agagcagcgtttgtggaacact

SEQ ID NO: 9446738 - DNA, 22 bp, Homo sapiens
agagcagctcgctacctctcta

SEQ ID NO: 9446739 - DNA, 22 bp, Homo sapiens
agagcagcgtttgtggaacact

SEQ ID NO: 9446740 - DNA, 18 bp, Homo sapiens
agagcagcggcatcacac

SEQ ID NO: 9446741 - DNA, 22 bp, Homo sapiens
agagcagctgacagcctgccat

SEQ ID NO: 9446742 - DNA, 22 bp, Homo sapiens
agagcagctgcattcagcacct

SEQ ID NO: 9446743 - DNA, 22 bp, Homo sapiens
aattcatactctatattgcttt

SEQ ID NO: 9446744 - DNA, 22 bp, Homo sapiens
aattcatactctatattgcttt

SEQ ID NO: 9446745 - DNA, 22 bp, Homo sapiens
aattcatactctatattgcttt

SEQ ID NO: 9446746 - DNA, 22 bp, Homo sapiens
aattcagtgtctggcactgctg

SEQ ID NO: 9446747 - DNA, 22 bp, Homo sapiens
aattcagttgacagctaatgcc

SEQ ID NO: 9446748 - DNA, 22 bp, Homo sapiens
aattcagtaatcattaatgatg

SEQ ID NO: 9446749 - DNA, 22 bp, Homo sapiens
aattcagtggtttctgcaacaa

SEQ ID NO: 9446750 - DNA, 22 bp, Homo sapiens
aattcagatggaagattctggc

SEQ ID NO: 9446751 - DNA, 22 bp, Homo sapiens
aattcagagacatgaagtgaca

SEQ ID NO: 9446752 - DNA, 22 bp, Homo sapiens
aattcactgaacttctctgaga

SEQ ID NO: 9446753 - DNA, 22 bp, Homo sapiens
aattcacatgcatgtctgtgca

SEQ ID NO: 9446754 - DNA, 22 bp, Homo sapiens
aattcacatgttgaagtcctaa

SEQ ID NO: 9446755 - DNA, 22 bp, Homo sapiens
aattcacatgttgaagtcctaa

SEQ ID NO: 9446756 - DNA, 22 bp, Homo sapiens
aattcacatgcatgtctgtgca

SEQ ID NO: 9446757 - DNA, 22 bp, Homo sapiens
aattcacatccgaccaggtcaa

SEQ ID NO: 9446758 - DNA, 22 bp, Homo sapiens
aattcacaggatcacaggagag

SEQ ID NO: 9446759 - DNA, 22 bp, Homo sapiens
aattcacagttctgcaccttac

SEQ ID NO: 9446760 - DNA, 22 bp, Homo sapiens
aattcacatatacattattcct

SEQ ID NO: 9446761 - DNA, 22 bp, Homo sapiens
aattcacatatacattattcct

SEQ ID NO: 9446762 - DNA, 22 bp, Homo sapiens
aattcacatatacattattcct

SEQ ID NO: 9446763 - DNA, 22 bp, Homo sapiens
aattcacagcatttgcccatct

SEQ ID NO: 9446764 - DNA, 22 bp, Homo sapiens
aattcacaggatcacaggagag

SEQ ID NO: 9446765 - DNA, 22 bp, Homo sapiens
aattcacaggaggtatttgtcc

SEQ ID NO: 9446766 - DNA, 23 bp, Homo sapiens
agaggccaacttcttgcccctcc

SEQ ID NO: 9446767 - DNA, 23 bp, Homo sapiens
agaggccaacttcttgcccctcc

SEQ ID NO: 9446768 - DNA, 22 bp, Homo sapiens
agaggccaagccagactgtgca

SEQ ID NO: 9446769 - DNA, 22 bp, Homo sapiens
agaggccaagccagactgtgca

SEQ ID NO: 9446770 - DNA, 22 bp, Homo sapiens
agaggccaaagaatctacaaga

SEQ ID NO: 9446771 - DNA, 23 bp, Homo sapiens
agaggccaacttcttgcccctcc

SEQ ID NO: 9446772 - DNA, 22 bp, Homo sapiens
agaggccaaagaatctacaaga

SEQ ID NO: 9446773 - DNA, 19 bp, Homo sapiens
agaggcagtctccaacagg

SEQ ID NO: 9446774 - DNA, 19 bp, Homo sapiens
agaggcagtctccaacagg

SEQ ID NO: 9446775 - DNA, 22 bp, Homo sapiens
agagcaggggcaatgtgttgca

SEQ ID NO: 9446776 - DNA, 22 bp, Homo sapiens
agagcaggggcaatgtgttgca

SEQ ID NO: 9446777 - DNA, 22 bp, Homo sapiens
agagcaggggcaatgtgttgca

SEQ ID NO: 9446778 - DNA, 22 bp, Homo sapiens
agagcaggcataaagctttgaa

SEQ ID NO: 9446779 - DNA, 22 bp, Homo sapiens
agagcaggcataaagctttgaa

SEQ ID NO: 9446780 - DNA, 22 bp, Homo sapiens
agaggcaacatggggaacagat

SEQ ID NO: 9446781 - DNA, 22 bp, Homo sapiens
agagcaggtggcaactctggga

SEQ ID NO: 9446782 - DNA, 22 bp, Homo sapiens
agaggcaacatggggaacagat

SEQ ID NO: 9446783 - DNA, 23 bp, Homo sapiens
agaggcaggagtggcttgcccgg

SEQ ID NO: 9446784 - DNA, 22 bp, Homo sapiens
agaggcaacatggggaacagat

SEQ ID NO: 9446785 - DNA, 22 bp, Homo sapiens
agagcagctggggcagagacca

SEQ ID NO: 9446786 - DNA, 22 bp, Homo sapiens
agagcagctggctgcatctaga

SEQ ID NO: 9446787 - DNA, 22 bp, Homo sapiens
agagcagctggctgcatctaga

SEQ ID NO: 9446788 - DNA, 22 bp, Homo sapiens
agagcagctggggcagagacca

SEQ ID NO: 9446789 - DNA, 22 bp, Homo sapiens
agagcagcttttcggaaccact

SEQ ID NO: 9446790 - DNA, 22 bp, Homo sapiens
agagcagctggggcagagacca

SEQ ID NO: 9446791 - DNA, 22 bp, Homo sapiens
agagcagctgtgacatggacag

SEQ ID NO: 9446792 - DNA, 22 bp, Homo sapiens
agagcagctgtgacatggacag

SEQ ID NO: 9446793 - DNA, 21 bp, Homo sapiens
agaggccaagtcatcatttcc

SEQ ID NO: 9446794 - DNA, 22 bp, Homo sapiens
agaggccaagccagactgtgca

SEQ ID NO: 9446795 - DNA, 21 bp, Homo sapiens
agaggccaagtcatcatttcc

SEQ ID NO: 9446796 - DNA, 22 bp, Homo sapiens
agaggccaagccagactgtgca

SEQ ID NO: 9446797 - DNA, 22 bp, Homo sapiens
agaggccaatagtaggtggcat

SEQ ID NO: 9446798 - DNA, 22 bp, Homo sapiens
agaggccaatagtaggtggcat

SEQ ID NO: 9446799 - DNA, 22 bp, Homo sapiens
agaggccaatagtaggtggcat

SEQ ID NO: 9446800 - DNA, 22 bp, Homo sapiens
agaggccaatagtaggtggcat

SEQ ID NO: 9446801 - DNA, 22 bp, Homo sapiens
agaggccaatagtaggtggcat

SEQ ID NO: 9446802 - DNA, 22 bp, Homo sapiens
agaggccacaccagcctcccgt

SEQ ID NO: 9446803 - DNA, 22 bp, Homo sapiens
aatttatatgtaattaggcaca

SEQ ID NO: 9446804 - DNA, 22 bp, Homo sapiens
aatttatggccttcgtcttgat

SEQ ID NO: 9446805 - DNA, 22 bp, Homo sapiens
aatttatttcctgccagtacac

SEQ ID NO: 9446806 - DNA, 22 bp, Homo sapiens
aatttcaaactaataggaacca

SEQ ID NO: 9446807 - DNA, 22 bp, Homo sapiens
aatttcaaagctcactggcata

SEQ ID NO: 9446808 - DNA, 22 bp, Homo sapiens
aatttcaaagctcactggcata

SEQ ID NO: 9446809 - DNA, 22 bp, Homo sapiens
aatttcaagtggcatctttgat

SEQ ID NO: 9446810 - DNA, 22 bp, Homo sapiens
aatttcaatgcactcatggttg

SEQ ID NO: 9446811 - DNA, 22 bp, Homo sapiens
agagggcataaaatagagcacg

SEQ ID NO: 9446812 - DNA, 22 bp, Homo sapiens
agaggcttggcctcagttctgt

SEQ ID NO: 9446813 - DNA, 22 bp, Homo sapiens
agagggcattaactctgtcttg

SEQ ID NO: 9446814 - DNA, 22 bp, Homo sapiens
agagggccataggtgcatagtt

SEQ ID NO: 9446815 - DNA, 22 bp, Homo sapiens
agagggcccatgttgggctgct

SEQ ID NO: 9446816 - DNA, 22 bp, Homo sapiens
agagggccataggtgcatagtt

SEQ ID NO: 9446817 - DNA, 22 bp, Homo sapiens
agagggcataaaatagagcacg

SEQ ID NO: 9446818 - DNA, 22 bp, Homo sapiens
agagggcccatgttgggctgct

SEQ ID NO: 9446819 - DNA, 22 bp, Homo sapiens
agagggcccatgttgggctgct

SEQ ID NO: 9446820 - DNA, 22 bp, Homo sapiens
agagggccccagctgatctgag

SEQ ID NO: 9446821 - DNA, 22 bp, Homo sapiens
agagggctaactgggaagcagg

SEQ ID NO: 9446822 - DNA, 22 bp, Homo sapiens
agagggctaactgggaagcagg

SEQ ID NO: 9446823 - DNA, 22 bp, Homo sapiens
agagggctaaggtttgggagat

SEQ ID NO: 9446824 - DNA, 17 bp, Homo sapiens
agagggctcaaggcatc

SEQ ID NO: 9446825 - DNA, 17 bp, Homo sapiens
agagggctcaaggcatc

SEQ ID NO: 9446826 - DNA, 22 bp, Homo sapiens
agagggctgcctcagtcagcta

SEQ ID NO: 9446827 - DNA, 22 bp, Homo sapiens
aattttctggtgtgtaatgaag

SEQ ID NO: 9446828 - DNA, 22 bp, Homo sapiens
agagggctggacgcaggttgga

SEQ ID NO: 9446829 - DNA, 22 bp, Homo sapiens
agagggctgctgcacagtgctc

SEQ ID NO: 9446830 - DNA, 22 bp, Homo sapiens
agagggctgcctcagtcagcta

SEQ ID NO: 9446831 - DNA, 22 bp, Homo sapiens
aattttgtgtgggatcaaagga

SEQ ID NO: 9446832 - DNA, 21 bp, Homo sapiens
aattttgaaggaagattaagg

SEQ ID NO: 9446833 - DNA, 21 bp, Homo sapiens
aattttgaaggaagattaagg

SEQ ID NO: 9446834 - DNA, 21 bp, Homo sapiens
aattttgaaggaagattaagg

SEQ ID NO: 9446835 - DNA, 22 bp, Homo sapiens
agagagcaggacttcactgagc

SEQ ID NO: 9446836 - DNA, 20 bp, Homo sapiens
agagagcacaggcaggaaag

SEQ ID NO: 9446837 - DNA, 23 bp, Homo sapiens
agagagagtttgtgtcaggtacc

SEQ ID NO: 9446838 - DNA, 23 bp, Homo sapiens
agagagagtttgtgtcaggtacc

SEQ ID NO: 9446839 - DNA, 23 bp, Homo sapiens
agagagagtttgtgtcaggtacc

SEQ ID NO: 9446840 - DNA, 23 bp, Homo sapiens
agagagagtttgtgtcaggtacc

SEQ ID NO: 9446841 - DNA, 22 bp, Homo sapiens
agagatagtgtattagttgggc

SEQ ID NO: 9446842 - DNA, 22 bp, Homo sapiens
agagatatggatgtcagaaact

SEQ ID NO: 9446843 - DNA, 22 bp, Homo sapiens
agagatatgagtagttgtgaca

SEQ ID NO: 9446844 - DNA, 22 bp, Homo sapiens
agagatacttttctttggatgc

SEQ ID NO: 9446845 - DNA, 21 bp, Homo sapiens
agagatagactagaattgatg

SEQ ID NO: 9446846 - DNA, 22 bp, Homo sapiens
agagataattaggttaaatgag

SEQ ID NO: 9446847 - DNA, 22 bp, Homo sapiens
agagagtttaagtgacttgccg

SEQ ID NO: 9446848 - DNA, 22 bp, Homo sapiens
agagatctctgaagctgctgct

SEQ ID NO: 9446849 - DNA, 22 bp, Homo sapiens
agagatccttcaatctagtttt

SEQ ID NO: 9446850 - DNA, 22 bp, Homo sapiens
agagatctagcacctgctggtc

SEQ ID NO: 9446851 - DNA, 22 bp, Homo sapiens
agagatcccttctgcctgggga

SEQ ID NO: 9446852 - DNA, 19 bp, Homo sapiens
agagatccagcttctagct

SEQ ID NO: 9446853 - DNA, 22 bp, Homo sapiens
agagatcagttaaaatcttttt

SEQ ID NO: 9446854 - DNA, 22 bp, Homo sapiens
agagatcaaagcttgccaagta

SEQ ID NO: 9446855 - DNA, 21 bp, Homo sapiens
agagatctgaagaaccattag

SEQ ID NO: 9446856 - DNA, 22 bp, Homo sapiens
aattatgtggaagaggattaaa

SEQ ID NO: 9446857 - DNA, 22 bp, Homo sapiens
aattcacaattatgttgggaga

SEQ ID NO: 9446858 - DNA, 22 bp, Homo sapiens
aattcacaattatgttgggaga

SEQ ID NO: 9446859 - DNA, 22 bp, Homo sapiens
aattcacacctccggtttttct

SEQ ID NO: 9446860 - DNA, 22 bp, Homo sapiens
aattcacagaaccatggtgctc

SEQ ID NO: 9446861 - DNA, 22 bp, Homo sapiens
agagagaggcagcagtgctcac

SEQ ID NO: 9446862 - DNA, 22 bp, Homo sapiens
agagagaggggcgagcaaacac

SEQ ID NO: 9446863 - DNA, 20 bp, Homo sapiens
agagagaggtaaattgagca

SEQ ID NO: 9446864 - DNA, 20 bp, Homo sapiens
agagagaggtaaattgagca

SEQ ID NO: 9446865 - DNA, 20 bp, Homo sapiens
agagagaggtaaattgagca

SEQ ID NO: 9446866 - DNA, 17 bp, Homo sapiens
agagagagcatgccacc

SEQ ID NO: 9446867 - DNA, 17 bp, Homo sapiens
agagagagcatgccacc

SEQ ID NO: 9446868 - DNA, 17 bp, Homo sapiens
agagagagcatgccacc

SEQ ID NO: 9446869 - DNA, 22 bp, Homo sapiens
agagagaggcagcagtgctcac

SEQ ID NO: 9446870 - DNA, 22 bp, Homo sapiens
agagagaggcagcagtgctcac

SEQ ID NO: 9446871 - DNA, 22 bp, Homo sapiens
agagagaggcagcagtgctcac

SEQ ID NO: 9446872 - DNA, 21 bp, Homo sapiens
agagaaagtcatggctgtggc

SEQ ID NO: 9446873 - DNA, 22 bp, Homo sapiens
agagaaagtaaagattctacct

SEQ ID NO: 9446874 - DNA, 22 bp, Homo sapiens
agagaaagtaaagattctacct

SEQ ID NO: 9446875 - DNA, 22 bp, Homo sapiens
agagaaagtaaagattctacct

SEQ ID NO: 9446876 - DNA, 22 bp, Homo sapiens
agagaaatagattggtccagaa

SEQ ID NO: 9446877 - DNA, 22 bp, Homo sapiens
agagaaatatttaggaaaggag

SEQ ID NO: 9446878 - DNA, 22 bp, Homo sapiens
agagagaattggataaattggt

SEQ ID NO: 9446879 - DNA, 22 bp, Homo sapiens
agactctggtcctcttgaattt

SEQ ID NO: 9446880 - DNA, 17 bp, Homo sapiens
agactctgtcccatgta

SEQ ID NO: 9446881 - DNA, 22 bp, Homo sapiens
agactctggggctccctccacc

SEQ ID NO: 9446882 - DNA, 17 bp, Homo sapiens
agactctgtcccatgta

SEQ ID NO: 9446883 - DNA, 17 bp, Homo sapiens
agactctgtcccatgta

SEQ ID NO: 9446884 - DNA, 17 bp, Homo sapiens
agactctgtcccatgta

SEQ ID NO: 9446885 - DNA, 22 bp, Homo sapiens
agactctgtgctccttgctttc

SEQ ID NO: 9446886 - DNA, 22 bp, Homo sapiens
agactctggagtcagctaggat

SEQ ID NO: 9446887 - DNA, 21 bp, Homo sapiens
agactctggggatctctgtcc

SEQ ID NO: 9446888 - DNA, 22 bp, Homo sapiens
agacctctgctcccttcatggt

SEQ ID NO: 9446889 - DNA, 22 bp, Homo sapiens
agacctctgctcccttcatggt

SEQ ID NO: 9446890 - DNA, 22 bp, Homo sapiens
agacctctacgtgcgtctcatc

SEQ ID NO: 9446891 - DNA, 22 bp, Homo sapiens
agacctctggatagatgtgagg

SEQ ID NO: 9446892 - DNA, 22 bp, Homo sapiens
agacactggcactggggaagcc

SEQ ID NO: 9446893 - DNA, 22 bp, Homo sapiens
agacactggtgaagaaatcagg

SEQ ID NO: 9446894 - DNA, 22 bp, Homo sapiens
agacactggtgaagaaatcagg

SEQ ID NO: 9446895 - DNA, 20 bp, Homo sapiens
agacaccccctgacagggaa

SEQ ID NO: 9446896 - DNA, 20 bp, Homo sapiens
agacaccccctgacagggaa

SEQ ID NO: 9446897 - DNA, 22 bp, Homo sapiens
aatgtataaccataggaaattt

SEQ ID NO: 9446898 - DNA, 22 bp, Homo sapiens
aatgtataaccataggaaattt

SEQ ID NO: 9446899 - DNA, 21 bp, Homo sapiens
aatgtataacagagcccatca

SEQ ID NO: 9446900 - DNA, 22 bp, Homo sapiens
agacactgaaatgtattgaaga

SEQ ID NO: 9446901 - DNA, 22 bp, Homo sapiens
agacacctgccacccagagctc

SEQ ID NO: 9446902 - DNA, 22 bp, Homo sapiens
agacactgaatcagagggacat

SEQ ID NO: 9446903 - DNA, 22 bp, Homo sapiens
agacactgaatgtttggtggtc

SEQ ID NO: 9446904 - DNA, 22 bp, Homo sapiens
agacactgccacttctgttccc

SEQ ID NO: 9446905 - DNA, 22 bp, Homo sapiens
agacactgatgttcagctcaat

SEQ ID NO: 9446906 - DNA, 22 bp, Homo sapiens
agacactgcggaggtcgggtgg

SEQ ID NO: 9446907 - DNA, 19 bp, Homo sapiens
agacactggatggaaaatg

SEQ ID NO: 9446908 - DNA, 17 bp, Homo sapiens
agacactgagccaagta

SEQ ID NO: 9446909 - DNA, 22 bp, Homo sapiens
agacactgagcattttcctagc

SEQ ID NO: 9446910 - DNA, 17 bp, Homo sapiens
agacactgagccaagta

SEQ ID NO: 9446911 - DNA, 17 bp, Homo sapiens
agacactgagccaagta

SEQ ID NO: 9446912 - DNA, 18 bp, Homo sapiens
agagaaagaccaaagcat

SEQ ID NO: 9446913 - DNA, 18 bp, Homo sapiens
agagaaagaccaaagcat

SEQ ID NO: 9446914 - DNA, 22 bp, Homo sapiens
agagaaactgatgtcctttgaa

SEQ ID NO: 9446915 - DNA, 23 bp, Homo sapiens
agagaaagggataacacgttgaa

SEQ ID NO: 9446916 - DNA, 18 bp, Homo sapiens
agagaaagaccaaagcat

SEQ ID NO: 9446917 - DNA, 22 bp, Homo sapiens
agactggggttctggcaaggag

SEQ ID NO: 9446918 - DNA, 23 bp, Homo sapiens
agactggggcataagaagatggc

SEQ ID NO: 9446919 - DNA, 22 bp, Homo sapiens
agagaaacccttcagtgttttg

SEQ ID NO: 9446920 - DNA, 22 bp, Homo sapiens
agagaaacaggtcagctgggag

SEQ ID NO: 9446921 - DNA, 19 bp, Homo sapiens
agactctgtgtgagacttt

SEQ ID NO: 9446922 - DNA, 22 bp, Homo sapiens
agactgaaccctctgctgcact

SEQ ID NO: 9446923 - DNA, 22 bp, Homo sapiens
agactgaagcaattcaaccagt

SEQ ID NO: 9446924 - DNA, 22 bp, Homo sapiens
agactgaagcaattcaaccagt

SEQ ID NO: 9446925 - DNA, 22 bp, Homo sapiens
agactgcagcaaccccttcagc

SEQ ID NO: 9446926 - DNA, 22 bp, Homo sapiens
agactgagactggggaaagaca

SEQ ID NO: 9446927 - DNA, 17 bp, Homo sapiens
agactgaggacacagga

SEQ ID NO: 9446928 - DNA, 23 bp, Homo sapiens
agactgaggctgccagggtcaga

SEQ ID NO: 9446929 - DNA, 22 bp, Homo sapiens
agactgggattctccctgatca

SEQ ID NO: 9446930 - DNA, 22 bp, Homo sapiens
agactgggccatttccccagct

SEQ ID NO: 9446931 - DNA, 22 bp, Homo sapiens
agactgggccatttccccagct

SEQ ID NO: 9446932 - DNA, 22 bp, Homo sapiens
agaataatactgaaatgctgaa

SEQ ID NO: 9446933 - DNA, 22 bp, Homo sapiens
agaataatcactgaagttcaaa

SEQ ID NO: 9446934 - DNA, 22 bp, Homo sapiens
agaataatcactgaagttcaaa

SEQ ID NO: 9446935 - DNA, 22 bp, Homo sapiens
agaataaaatagtctgaagatg

SEQ ID NO: 9446936 - DNA, 22 bp, Homo sapiens
agaataagcctgacgaaaccta

SEQ ID NO: 9446937 - DNA, 22 bp, Homo sapiens
agaataaccagtgtttcacagt

SEQ ID NO: 9446938 - DNA, 22 bp, Homo sapiens
agaataaatgttggacttagga

SEQ ID NO: 9446939 - DNA, 22 bp, Homo sapiens
agaataaatgttggacttagga

SEQ ID NO: 9446940 - DNA, 22 bp, Homo sapiens
agaatcagtgctggctattagc

SEQ ID NO: 9446941 - DNA, 22 bp, Homo sapiens
agaatcagtgagcagttgtgat

SEQ ID NO: 9446942 - DNA, 22 bp, Homo sapiens
agaatcattatatttattaagc

SEQ ID NO: 9446943 - DNA, 22 bp, Homo sapiens
agaatcattatatttattaagc

SEQ ID NO: 9446944 - DNA, 22 bp, Homo sapiens
agaatcaggacctgtggctgtc

SEQ ID NO: 9446945 - DNA, 22 bp, Homo sapiens
agaatcaggacctgtggctgtc

SEQ ID NO: 9446946 - DNA, 22 bp, Homo sapiens
agaataatcactgaagttcaaa

SEQ ID NO: 9446947 - DNA, 19 bp, Homo sapiens
agaatcaggtcaggtgaca

SEQ ID NO: 9446948 - DNA, 22 bp, Homo sapiens
agaatcagtgagcagttgtgat

SEQ ID NO: 9446949 - DNA, 22 bp, Homo sapiens
agaataaatcaaatgtcctgag

SEQ ID NO: 9446950 - DNA, 22 bp, Homo sapiens
agaataaatcaaatgtcctgag

SEQ ID NO: 9446951 - DNA, 22 bp, Homo sapiens
agaataaatcaaatgtcctgag

SEQ ID NO: 9446952 - DNA, 22 bp, Homo sapiens
agaataaatgctacctatcaca

SEQ ID NO: 9446953 - DNA, 22 bp, Homo sapiens
agaataaatgctacctatcaca

SEQ ID NO: 9446954 - DNA, 22 bp, Homo sapiens
agaataaatgctacctatcaca

SEQ ID NO: 9446955 - DNA, 22 bp, Homo sapiens
agaataaaatagtctgaagatg

SEQ ID NO: 9446956 - DNA, 22 bp, Homo sapiens
agaataaaatagtctgaagatg

SEQ ID NO: 9446957 - DNA, 22 bp, Homo sapiens
agaataaaatagtctgaagatg

SEQ ID NO: 9446958 - DNA, 22 bp, Homo sapiens
agaagtttgttatgtaaacaaa

SEQ ID NO: 9446959 - DNA, 22 bp, Homo sapiens
aatggagaccctaaggaagagg

SEQ ID NO: 9446960 - DNA, 22 bp, Homo sapiens
agaagttttgggaaatactgat

SEQ ID NO: 9446961 - DNA, 22 bp, Homo sapiens
aatggaatacctaggtggccca

SEQ ID NO: 9446962 - DNA, 22 bp, Homo sapiens
aatggaatacctaggtggccca

SEQ ID NO: 9446963 - DNA, 22 bp, Homo sapiens
aatggaatacctaggtggccca

SEQ ID NO: 9446964 - DNA, 22 bp, Homo sapiens
aatggaatacctaggtggccca

SEQ ID NO: 9446965 - DNA, 21 bp, Homo sapiens
aatggaagtttaaaggtatcc

SEQ ID NO: 9446966 - DNA, 22 bp, Homo sapiens
aatggaattctccattagatgt

SEQ ID NO: 9446967 - DNA, 19 bp, Homo sapiens
aatggacaggcaatagtct

SEQ ID NO: 9446968 - DNA, 22 bp, Homo sapiens
aatgctttttgcgaaatgtgca

SEQ ID NO: 9446969 - DNA, 22 bp, Homo sapiens
aatgctttttgcgaaatgtgca

SEQ ID NO: 9446970 - DNA, 18 bp, Homo sapiens
aatggaaggggtgctgtt

SEQ ID NO: 9446971 - DNA, 21 bp, Homo sapiens
aatggaagtttaaaggtatcc

SEQ ID NO: 9446972 - DNA, 22 bp, Homo sapiens
aatgcttttgctgtcattgctt

SEQ ID NO: 9446973 - DNA, 22 bp, Homo sapiens
aatgcttttgctgtcattgctt

SEQ ID NO: 9446974 - DNA, 22 bp, Homo sapiens
aatgcttttacgacatgtacct

SEQ ID NO: 9446975 - DNA, 22 bp, Homo sapiens
aatgcttttacgacatgtacct

SEQ ID NO: 9446976 - DNA, 22 bp, Homo sapiens
aatgctttgtctgctccagact

SEQ ID NO: 9446977 - DNA, 22 bp, Homo sapiens
aatgcttttacgacatgtacct

SEQ ID NO: 9446978 - DNA, 22 bp, Homo sapiens
aatgcttttacgacatgtacct

SEQ ID NO: 9446979 - DNA, 22 bp, Homo sapiens
aatgaaaattggaccctagaac

SEQ ID NO: 9446980 - DNA, 22 bp, Homo sapiens
aatgaaaattggaccctagaac

SEQ ID NO: 9446981 - DNA, 22 bp, Homo sapiens
aatgaaaattggaccctagaac

SEQ ID NO: 9446982 - DNA, 22 bp, Homo sapiens
aatgaaacatatttaggaataa

SEQ ID NO: 9446983 - DNA, 22 bp, Homo sapiens
aatgaaaattggaccctagaac

SEQ ID NO: 9446984 - DNA, 22 bp, Homo sapiens
aatgaaacaattagctgtaata

SEQ ID NO: 9446985 - DNA, 23 bp, Homo sapiens
aatgctggaaattcaggcatgat

SEQ ID NO: 9446986 - DNA, 22 bp, Homo sapiens
aatgctgtaatgaacgtgagag

SEQ ID NO: 9446987 - DNA, 22 bp, Homo sapiens
aatgctttgattgattaaaaca

SEQ ID NO: 9446988 - DNA, 22 bp, Homo sapiens
aatgctttgattgattaaaaca

SEQ ID NO: 9446989 - DNA, 22 bp, Homo sapiens
aatgctttgattgattaaaaca

SEQ ID NO: 9446990 - DNA, 22 bp, Homo sapiens
aatgctttgagggaagatgaaa

SEQ ID NO: 9446991 - DNA, 22 bp, Homo sapiens
aatgctttgagggaagatgaaa

SEQ ID NO: 9446992 - DNA, 22 bp, Homo sapiens
aatgctttgagggaagatgaaa

SEQ ID NO: 9446993 - DNA, 22 bp, Homo sapiens
aatgctttgagggaagatgaaa

SEQ ID NO: 9446994 - DNA, 22 bp, Homo sapiens
aatgctttgagggaagatgaaa

SEQ ID NO: 9446995 - DNA, 22 bp, Homo sapiens
aatgctttgagggaagatgaaa

SEQ ID NO: 9446996 - DNA, 22 bp, Homo sapiens
aatgctttgactatatctataa

SEQ ID NO: 9446997 - DNA, 22 bp, Homo sapiens
aatgctttcttataaccactgc

SEQ ID NO: 9446998 - DNA, 22 bp, Homo sapiens
aatgctttgactatatctataa

SEQ ID NO: 9446999 - DNA, 22 bp, Homo sapiens
aatgctttgactatatctataa

SEQ ID NO: 9447000 - DNA, 19 bp, Homo sapiens
agaattgttttgagacccc

SEQ ID NO: 9447001 - DNA, 22 bp, Homo sapiens
agaatttaggatgcatgtgaat

SEQ ID NO: 9447002 - DNA, 22 bp, Homo sapiens
agaatttatgacaacgatagcc

SEQ ID NO: 9447003 - DNA, 22 bp, Homo sapiens
agaatttatgacaacgatagcc

SEQ ID NO: 9447004 - DNA, 22 bp, Homo sapiens
agaattgtaagcaatttgatta

SEQ ID NO: 9447005 - DNA, 22 bp, Homo sapiens
agaattgtaagcaatttgatta

SEQ ID NO: 9447006 - DNA, 19 bp, Homo sapiens
agaattgttttatgtcttc

SEQ ID NO: 9447007 - DNA, 22 bp, Homo sapiens
agaattgtaataataatagcat

SEQ ID NO: 9447008 - DNA, 22 bp, Homo sapiens
agaattgtaataataatagcat

SEQ ID NO: 9447009 - DNA, 22 bp, Homo sapiens
agaattgttctgtagcttggct

SEQ ID NO: 9447010 - DNA, 22 bp, Homo sapiens
agaatctgaaggcacctctggt

SEQ ID NO: 9447011 - DNA, 22 bp, Homo sapiens
agaatctctactcaagtacttg

SEQ ID NO: 9447012 - DNA, 22 bp, Homo sapiens
agaatctctactcaagtacttg

SEQ ID NO: 9447013 - DNA, 22 bp, Homo sapiens
aatgtacaccgtgggtttttta

SEQ ID NO: 9447014 - DNA, 22 bp, Homo sapiens
aatgtacaccgtgggtttttta

SEQ ID NO: 9447015 - DNA, 22 bp, Homo sapiens
aatgtaaaatatcttgtacttg

SEQ ID NO: 9447016 - DNA, 22 bp, Homo sapiens
aatgtacaccgtgggtttttta

SEQ ID NO: 9447017 - DNA, 22 bp, Homo sapiens
aatgtacactgaaagcctatca

SEQ ID NO: 9447018 - DNA, 22 bp, Homo sapiens
aatgtacactgaaagcctatca

SEQ ID NO: 9447019 - DNA, 22 bp, Homo sapiens
aatgtaaacagcaagagaaggg

SEQ ID NO: 9447020 - DNA, 22 bp, Homo sapiens
aatgtaaacagcaagagaaggg

SEQ ID NO: 9447021 - DNA, 22 bp, Homo sapiens
agaatttcaaatggaagtttta

SEQ ID NO: 9447022 - DNA, 22 bp, Homo sapiens
agaatttggtagttatttttgg

SEQ ID NO: 9447023 - DNA, 22 bp, Homo sapiens
agaatttgtaaaagataagaca

SEQ ID NO: 9447024 - DNA, 22 bp, Homo sapiens
agaatttgagtgctttctgtgt

SEQ ID NO: 9447025 - DNA, 22 bp, Homo sapiens
agaatttgagtgctttctgtgt

SEQ ID NO: 9447026 - DNA, 22 bp, Homo sapiens
agaatttttgattatctactcg

SEQ ID NO: 9447027 - DNA, 22 bp, Homo sapiens
aatgtacactgaaagcctatca

SEQ ID NO: 9447028 - DNA, 22 bp, Homo sapiens
aatgtacactgaaagcctatca

SEQ ID NO: 9447029 - DNA, 22 bp, Homo sapiens
aatgtacagctgctgctgaagg

SEQ ID NO: 9447030 - DNA, 22 bp, Homo sapiens
aatgtacagctgctgctgaagg

SEQ ID NO: 9447031 - DNA, 22 bp, Homo sapiens
aatgtacagctgtctttcctcc

SEQ ID NO: 9447032 - DNA, 22 bp, Homo sapiens
aatgtacagctgctgctgaagg

SEQ ID NO: 9447033 - DNA, 22 bp, Homo sapiens
aatgtacagctgtctttcctcc

SEQ ID NO: 9447034 - DNA, 22 bp, Homo sapiens
aatgtacatctcagtgtagtac

SEQ ID NO: 9447035 - DNA, 22 bp, Homo sapiens
aatgtacatctcagtgtagtac

SEQ ID NO: 9447036 - DNA, 22 bp, Homo sapiens
aatgtacagctgtctttcctcc

SEQ ID NO: 9447037 - DNA, 22 bp, Homo sapiens
aatgtacaggctggctatgggg

SEQ ID NO: 9447038 - DNA, 22 bp, Homo sapiens
aatgtacaggctggctatgggg

SEQ ID NO: 9447039 - DNA, 22 bp, Homo sapiens
aatgtacaggctggctatgggg

SEQ ID NO: 9447040 - DNA, 22 bp, Homo sapiens
aatgtataaagtgttaataact

SEQ ID NO: 9447041 - DNA, 22 bp, Homo sapiens
aatgtataaagtgttaataact

SEQ ID NO: 9447042 - DNA, 22 bp, Homo sapiens
aatgtataaagtgttaataact

SEQ ID NO: 9447043 - DNA, 22 bp, Homo sapiens
aatgtataaagtgttaataact

SEQ ID NO: 9447044 - DNA, 22 bp, Homo sapiens
acagatgaatctgtgattgctg

SEQ ID NO: 9447045 - DNA, 22 bp, Homo sapiens
acagatgaatttatggatggaa

SEQ ID NO: 9447046 - DNA, 22 bp, Homo sapiens
acagatgagactccaggacctt

SEQ ID NO: 9447047 - DNA, 22 bp, Homo sapiens
acagatgagactccaggacctt

SEQ ID NO: 9447048 - DNA, 22 bp, Homo sapiens
acagatgagaagctgcattcaa

SEQ ID NO: 9447049 - DNA, 22 bp, Homo sapiens
acagatatttggggaaagacgt

SEQ ID NO: 9447050 - DNA, 22 bp, Homo sapiens
acagatctacattgtctgaccc

SEQ ID NO: 9447051 - DNA, 22 bp, Homo sapiens
acagatgaaaaagcttgtggat

SEQ ID NO: 9447052 - DNA, 20 bp, Homo sapiens
aagcacatttctacaataat

SEQ ID NO: 9447053 - DNA, 20 bp, Homo sapiens
aagcacatttctacaataat

SEQ ID NO: 9447054 - DNA, 22 bp, Homo sapiens
aagcacatttggaaaacatgga

SEQ ID NO: 9447055 - DNA, 22 bp, Homo sapiens
aagcacattgtacatttgtgct

SEQ ID NO: 9447056 - DNA, 22 bp, Homo sapiens
aagcacattgtacatttgtgct

SEQ ID NO: 9447057 - DNA, 22 bp, Homo sapiens
aagcacattgtacatttgtgct

SEQ ID NO: 9447058 - DNA, 22 bp, Homo sapiens
aagcacattgcctggcacatag

SEQ ID NO: 9447059 - DNA, 22 bp, Homo sapiens
aagcacattatagctatctagg

SEQ ID NO: 9447060 - DNA, 22 bp, Homo sapiens
aagcacatctcctgtgcagaac

SEQ ID NO: 9447061 - DNA, 22 bp, Homo sapiens
aagcacatctcaaacttcatct

SEQ ID NO: 9447062 - DNA, 22 bp, Homo sapiens
aagcacatctcaaacttcatct

SEQ ID NO: 9447063 - DNA, 22 bp, Homo sapiens
aagcacatgagctattcatgct

SEQ ID NO: 9447064 - DNA, 22 bp, Homo sapiens
aagcacatgagctattcatgct

SEQ ID NO: 9447065 - DNA, 22 bp, Homo sapiens
aagcacatgagctattcatgct

SEQ ID NO: 9447066 - DNA, 22 bp, Homo sapiens
aagcacattaaggaacattgaa

SEQ ID NO: 9447067 - DNA, 22 bp, Homo sapiens
acagaggacaactaggcgctca

SEQ ID NO: 9447068 - DNA, 22 bp, Homo sapiens
acagaggacaactaggcgctca

SEQ ID NO: 9447069 - DNA, 22 bp, Homo sapiens
acagaggacaactaggcgctca

SEQ ID NO: 9447070 - DNA, 22 bp, Homo sapiens
acagaggacaactaggcgctca

SEQ ID NO: 9447071 - DNA, 22 bp, Homo sapiens
acagaggaaggctgagctgccc

SEQ ID NO: 9447072 - DNA, 22 bp, Homo sapiens
acagaggaaggctgagctgccc

SEQ ID NO: 9447073 - DNA, 18 bp, Homo sapiens
acagaggcagacatgtat

SEQ ID NO: 9447074 - DNA, 18 bp, Homo sapiens
acagaggcagacatgtat

SEQ ID NO: 9447075 - DNA, 22 bp, Homo sapiens
acagaggacaactaggcgctca

SEQ ID NO: 9447076 - DNA, 22 bp, Homo sapiens
aagcacatacataataaagtcc

SEQ ID NO: 9447077 - DNA, 22 bp, Homo sapiens
aagcacatacataataaagtcc

SEQ ID NO: 9447078 - DNA, 22 bp, Homo sapiens
aagcacatacataataaagtcc

SEQ ID NO: 9447079 - DNA, 22 bp, Homo sapiens
aagcacagttcttagagttaca

SEQ ID NO: 9447080 - DNA, 22 bp, Homo sapiens
aagcacagttcttagagttaca

SEQ ID NO: 9447081 - DNA, 17 bp, Homo sapiens
acagagcacatcaagat

SEQ ID NO: 9447082 - DNA, 22 bp, Homo sapiens
acagagctgtacatgtgccatg

SEQ ID NO: 9447083 - DNA, 22 bp, Homo sapiens
acagagctgtacatgtgccatg

SEQ ID NO: 9447084 - DNA, 22 bp, Homo sapiens
aagcaaagacagtttgagtgga

SEQ ID NO: 9447085 - DNA, 22 bp, Homo sapiens
aagcaaagacagtttgagtgga

SEQ ID NO: 9447086 - DNA, 22 bp, Homo sapiens
aagcaaacaggagaagagctgt

SEQ ID NO: 9447087 - DNA, 22 bp, Homo sapiens
aagcaaacaggagaagagctgt

SEQ ID NO: 9447088 - DNA, 22 bp, Homo sapiens
acagagcttaattcaggagctt

SEQ ID NO: 9447089 - DNA, 22 bp, Homo sapiens
acagagctgtactacttactga

SEQ ID NO: 9447090 - DNA, 22 bp, Homo sapiens
acagagctgtacatgtgccatg

SEQ ID NO: 9447091 - DNA, 22 bp, Homo sapiens
acagagcttaattcaggagctt

SEQ ID NO: 9447092 - DNA, 22 bp, Homo sapiens
acagagcttaggatgactccca

SEQ ID NO: 9447093 - DNA, 22 bp, Homo sapiens
acagaggaagcatatagcacaa

SEQ ID NO: 9447094 - DNA, 22 bp, Homo sapiens
acagagcttcccagcctgagca

SEQ ID NO: 9447095 - DNA, 22 bp, Homo sapiens
acagaggaagcatatagcacaa

SEQ ID NO: 9447096 - DNA, 22 bp, Homo sapiens
aagatacatcattcaggagtga

SEQ ID NO: 9447097 - DNA, 22 bp, Homo sapiens
aagatacatcattcaggagtga

SEQ ID NO: 9447098 - DNA, 22 bp, Homo sapiens
aagatacatcaaagcaaattgg

SEQ ID NO: 9447099 - DNA, 22 bp, Homo sapiens
aagatacattatgtctctctga

SEQ ID NO: 9447100 - DNA, 22 bp, Homo sapiens
aagatacatgttaggagcaacc

SEQ ID NO: 9447101 - DNA, 22 bp, Homo sapiens
aagatacattgtttttggtagt

SEQ ID NO: 9447102 - DNA, 22 bp, Homo sapiens
aagatacattgtttttggtagt

SEQ ID NO: 9447103 - DNA, 22 bp, Homo sapiens
aagatacattttcttcagagaa

SEQ ID NO: 9447104 - DNA, 22 bp, Homo sapiens
aagatactcagtggatatgcat

SEQ ID NO: 9447105 - DNA, 20 bp, Homo sapiens
aagatactccagaaattaaa

SEQ ID NO: 9447106 - DNA, 22 bp, Homo sapiens
aagatactgatgatgtaggcta

SEQ ID NO: 9447107 - DNA, 22 bp, Homo sapiens
aagatacttcacttgccgaaat

SEQ ID NO: 9447108 - DNA, 20 bp, Homo sapiens
aagatagaatcctaactttg

SEQ ID NO: 9447109 - DNA, 22 bp, Homo sapiens
aagatagatgtcatcagcatat

SEQ ID NO: 9447110 - DNA, 22 bp, Homo sapiens
aagatagatgtcatcagcatat

SEQ ID NO: 9447111 - DNA, 22 bp, Homo sapiens
aagatatactattaagtaccat

SEQ ID NO: 9447112 - DNA, 22 bp, Homo sapiens
aagatatactattaagtaccat

SEQ ID NO: 9447113 - DNA, 22 bp, Homo sapiens
aagatatagataaaactatgca

SEQ ID NO: 9447114 - DNA, 22 bp, Homo sapiens
aagatatagataaaactatgca

SEQ ID NO: 9447115 - DNA, 22 bp, Homo sapiens
aagatatactattaagtaccat

SEQ ID NO: 9447116 - DNA, 19 bp, Homo sapiens
acagaaatgtaagtgagac

SEQ ID NO: 9447117 - DNA, 19 bp, Homo sapiens
acagaaatgtaagtgagac

SEQ ID NO: 9447118 - DNA, 22 bp, Homo sapiens
acagaagacagagtgttcatct

SEQ ID NO: 9447119 - DNA, 22 bp, Homo sapiens
acagaagaaagggaggttttgc

SEQ ID NO: 9447120 - DNA, 22 bp, Homo sapiens
acagaagaccaagaaagcttcc

SEQ ID NO: 9447121 - DNA, 22 bp, Homo sapiens
acagaagacagagtgttcatct

SEQ ID NO: 9447122 - DNA, 22 bp, Homo sapiens
aagattttctcaactgtatttg

SEQ ID NO: 9447123 - DNA, 22 bp, Homo sapiens
aagatttttttccacagactca

SEQ ID NO: 9447124 - DNA, 22 bp, Homo sapiens
aagcaaaaggttacacttctgg

SEQ ID NO: 9447125 - DNA, 22 bp, Homo sapiens
aagcaaaacgtgctctaggagg

SEQ ID NO: 9447126 - DNA, 22 bp, Homo sapiens
aagcaaaacgtgctctaggagg

SEQ ID NO: 9447127 - DNA, 22 bp, Homo sapiens
aagatttgtggatttaaggata

SEQ ID NO: 9447128 - DNA, 19 bp, Homo sapiens
aagatttggtcattgataa

SEQ ID NO: 9447129 - DNA, 22 bp, Homo sapiens
aagatttgtggatttaaggata

SEQ ID NO: 9447130 - DNA, 19 bp, Homo sapiens
aagatttggtcattgataa

SEQ ID NO: 9447131 - DNA, 22 bp, Homo sapiens
aagatttggtatcagaagacct

SEQ ID NO: 9447132 - DNA, 22 bp, Homo sapiens
acagaagagcacatttagtatg

SEQ ID NO: 9447133 - DNA, 22 bp, Homo sapiens
acagaagataatgctgccttgg

SEQ ID NO: 9447134 - DNA, 22 bp, Homo sapiens
acagaagataactgggaccaga

SEQ ID NO: 9447135 - DNA, 22 bp, Homo sapiens
acagaagcagccgtcacagata

SEQ ID NO: 9447136 - DNA, 22 bp, Homo sapiens
acagaagcagcgcggctcttct

SEQ ID NO: 9447137 - DNA, 22 bp, Homo sapiens
aagatttgactctgattagcat

SEQ ID NO: 9447138 - DNA, 22 bp, Homo sapiens
aagatttggtatcagaagacct

SEQ ID NO: 9447139 - DNA, 22 bp, Homo sapiens
aagatttggtatcagaagacct

SEQ ID NO: 9447140 - DNA, 22 bp, Homo sapiens
acagaagataatgctgccttgg

SEQ ID NO: 9447141 - DNA, 22 bp, Homo sapiens
acagaagcaaaagcaggatctt

SEQ ID NO: 9447142 - DNA, 21 bp, Homo sapiens
aagaggcatcactatttgtgt

SEQ ID NO: 9447143 - DNA, 22 bp, Homo sapiens
aagaggcatctcagcttcctct

SEQ ID NO: 9447144 - DNA, 22 bp, Homo sapiens
acacacagaaggaagccccact

SEQ ID NO: 9447145 - DNA, 21 bp, Homo sapiens
aagaggcatcactatttgtgt

SEQ ID NO: 9447146 - DNA, 22 bp, Homo sapiens
acacacagcgcctaccatgtgc

SEQ ID NO: 9447147 - DNA, 22 bp, Homo sapiens
acacacaggtaaaggagcctgg

SEQ ID NO: 9447148 - DNA, 22 bp, Homo sapiens
acacacagcgcctaccatgtgc

SEQ ID NO: 9447149 - DNA, 22 bp, Homo sapiens
acacacagcgcctaccatgtgc

SEQ ID NO: 9447150 - DNA, 19 bp, Homo sapiens
aagagggaaagtgctatgc

SEQ ID NO: 9447151 - DNA, 22 bp, Homo sapiens
aagaggtagcagtcacaaaaga

SEQ ID NO: 9447152 - DNA, 19 bp, Homo sapiens
aagagggaaagtgctatgc

SEQ ID NO: 9447153 - DNA, 22 bp, Homo sapiens
aagaggtgccaggggttttgta

SEQ ID NO: 9447154 - DNA, 22 bp, Homo sapiens
aagaggtggaacagcaattcgt

SEQ ID NO: 9447155 - DNA, 22 bp, Homo sapiens
aagaggtgggttggacagatac

SEQ ID NO: 9447156 - DNA, 22 bp, Homo sapiens
aagaggtgggttggacagatac

SEQ ID NO: 9447157 - DNA, 22 bp, Homo sapiens
aagaggtgagaagctacactta

SEQ ID NO: 9447158 - DNA, 20 bp, Homo sapiens
aagaggtgataacaggtgag

SEQ ID NO: 9447159 - DNA, 20 bp, Homo sapiens
aagaggtgataacaggtgag

SEQ ID NO: 9447160 - DNA, 19 bp, Homo sapiens
aagaggcaaccctcgagcc

SEQ ID NO: 9447161 - DNA, 22 bp, Homo sapiens
aagaggagtagatgtggttggt

SEQ ID NO: 9447162 - DNA, 22 bp, Homo sapiens
aagaggagggcagattcaaggc

SEQ ID NO: 9447163 - DNA, 22 bp, Homo sapiens
aagaggagggcagattcaaggc

SEQ ID NO: 9447164 - DNA, 22 bp, Homo sapiens
aagaggagtagatgtggttggt

SEQ ID NO: 9447165 - DNA, 22 bp, Homo sapiens
aagaggcagcccgctgaggctg

SEQ ID NO: 9447166 - DNA, 22 bp, Homo sapiens
aagaggcagcccgctgaggctg

SEQ ID NO: 9447167 - DNA, 19 bp, Homo sapiens
aagaggcaaccctcgagcc

SEQ ID NO: 9447168 - DNA, 22 bp, Homo sapiens
aagaggcagaaatatcgctgaa

SEQ ID NO: 9447169 - DNA, 22 bp, Homo sapiens
aagaggcagaaatatcgctgaa

SEQ ID NO: 9447170 - DNA, 22 bp, Homo sapiens
aagaggcataaaatttatatgg

SEQ ID NO: 9447171 - DNA, 22 bp, Homo sapiens
aagaggcataaaatttatatgg

SEQ ID NO: 9447172 - DNA, 22 bp, Homo sapiens
aagaggcagtggtgatgaatgg

SEQ ID NO: 9447173 - DNA, 22 bp, Homo sapiens
aagaggcagcccgctgaggctg

SEQ ID NO: 9447174 - DNA, 22 bp, Homo sapiens
aagacatttatttgaatcaatt

SEQ ID NO: 9447175 - DNA, 22 bp, Homo sapiens
aagacattgtcattttataatt

SEQ ID NO: 9447176 - DNA, 22 bp, Homo sapiens
aagacattgtcattttataatt

SEQ ID NO: 9447177 - DNA, 22 bp, Homo sapiens
aagacatttatgaaaagtgctg

SEQ ID NO: 9447178 - DNA, 22 bp, Homo sapiens
aagacattttgaaattggaagc

SEQ ID NO: 9447179 - DNA, 22 bp, Homo sapiens
aagaccagggtgggtacgttcc

SEQ ID NO: 9447180 - DNA, 22 bp, Homo sapiens
aagaggaggattgatgtgggag

SEQ ID NO: 9447181 - DNA, 22 bp, Homo sapiens
aagaggaggattgatgtgggag

SEQ ID NO: 9447182 - DNA, 22 bp, Homo sapiens
aagagtggagctggaaagtggg

SEQ ID NO: 9447183 - DNA, 20 bp, Homo sapiens
aagagtctttactgagctaa

SEQ ID NO: 9447184 - DNA, 20 bp, Homo sapiens
aagagtctttactgagctaa

SEQ ID NO: 9447185 - DNA, 22 bp, Homo sapiens
aagagttagctcaataacttga

SEQ ID NO: 9447186 - DNA, 22 bp, Homo sapiens
aagagtttaattttgtctagac

SEQ ID NO: 9447187 - DNA, 22 bp, Homo sapiens
aagagtttaattttgtctagac

SEQ ID NO: 9447188 - DNA, 22 bp, Homo sapiens
aagagtttaccagtgctgcttc

SEQ ID NO: 9447189 - DNA, 22 bp, Homo sapiens
aagaggttgtctgtgatgagtt

SEQ ID NO: 9447190 - DNA, 22 bp, Homo sapiens
aagaggttgtctgtgatgagtt

SEQ ID NO: 9447191 - DNA, 22 bp, Homo sapiens
aagaggtttcatgattttctta

SEQ ID NO: 9447192 - DNA, 22 bp, Homo sapiens
aagaggttgtctgtgatgagtt

SEQ ID NO: 9447193 - DNA, 22 bp, Homo sapiens
aagaggttgtctgtgatgagtt

SEQ ID NO: 9447194 - DNA, 22 bp, Homo sapiens
aagagtctattggaactagaca

SEQ ID NO: 9447195 - DNA, 22 bp, Homo sapiens
aagagtcctgttacacatgagt

SEQ ID NO: 9447196 - DNA, 22 bp, Homo sapiens
aagagtcatagagacattgatt

SEQ ID NO: 9447197 - DNA, 22 bp, Homo sapiens
aagagtcagcttctgtatgggt

SEQ ID NO: 9447198 - DNA, 19 bp, Homo sapiens
aagagtcacaggcagccct

SEQ ID NO: 9447199 - DNA, 22 bp, Homo sapiens
aagagtacttgcagccagggcc

SEQ ID NO: 9447200 - DNA, 22 bp, Homo sapiens
aagagtaaatgtctaattagga

SEQ ID NO: 9447201 - DNA, 22 bp, Homo sapiens
aagagtaaattcaggactttaa

SEQ ID NO: 9447202 - DNA, 22 bp, Homo sapiens
aagagtttatgatataacatgt

SEQ ID NO: 9447203 - DNA, 23 bp, Homo sapiens
aagagtttagagtcttgcagagt

SEQ ID NO: 9447204 - DNA, 22 bp, Homo sapiens
acacatttctctttttgtaagt

SEQ ID NO: 9447205 - DNA, 22 bp, Homo sapiens
acaccccaccagtaactgaggg

SEQ ID NO: 9447206 - DNA, 22 bp, Homo sapiens
acacccaggctggcgtgcagtg

SEQ ID NO: 9447207 - DNA, 22 bp, Homo sapiens
acacctttgtgaagtgatgatg

SEQ ID NO: 9447208 - DNA, 22 bp, Homo sapiens
acacctggtctttgcatgagca

SEQ ID NO: 9447209 - DNA, 22 bp, Homo sapiens
acacctgggtcagtgtgacagt

SEQ ID NO: 9447210 - DNA, 23 bp, Homo sapiens
acacctgtgctgtagtcactaca

SEQ ID NO: 9447211 - DNA, 22 bp, Homo sapiens
acacctggtctttgcatgagca

SEQ ID NO: 9447212 - DNA, 22 bp, Homo sapiens
acactaaatgagtctacagtac

SEQ ID NO: 9447213 - DNA, 22 bp, Homo sapiens
acactaaggttggagtcacagt

SEQ ID NO: 9447214 - DNA, 23 bp, Homo sapiens
acactaaatgtgaaggagcaaag

SEQ ID NO: 9447215 - DNA, 22 bp, Homo sapiens
acacggaaaaggagacagaggg

SEQ ID NO: 9447216 - DNA, 22 bp, Homo sapiens
acacggcactttaggaaggggc

SEQ ID NO: 9447217 - DNA, 22 bp, Homo sapiens
acactagagagcaggcattccc

SEQ ID NO: 9447218 - DNA, 22 bp, Homo sapiens
acactacagggagaagactcac

SEQ ID NO: 9447219 - DNA, 22 bp, Homo sapiens
acactacagggagaagactcac

SEQ ID NO: 9447220 - DNA, 22 bp, Homo sapiens
acactacaatctcagaactata

SEQ ID NO: 9447221 - DNA, 22 bp, Homo sapiens
acactacaacagcagaggtgag

SEQ ID NO: 9447222 - DNA, 22 bp, Homo sapiens
acactaattaagctgctttact

SEQ ID NO: 9447223 - DNA, 22 bp, Homo sapiens
acaagaatgtagattagttaag

SEQ ID NO: 9447224 - DNA, 22 bp, Homo sapiens
acaagaataaggataagagatt

SEQ ID NO: 9447225 - DNA, 22 bp, Homo sapiens
aagacattgctgcttttaattg

SEQ ID NO: 9447226 - DNA, 22 bp, Homo sapiens
aagacattgctgcttttaattg

SEQ ID NO: 9447227 - DNA, 22 bp, Homo sapiens
acaagaaccaaagaaggatatt

SEQ ID NO: 9447228 - DNA, 22 bp, Homo sapiens
acaagaaccaaagaaggatatt

SEQ ID NO: 9447229 - DNA, 22 bp, Homo sapiens
acaactttgtagcaattccacg

SEQ ID NO: 9447230 - DNA, 22 bp, Homo sapiens
acaacttttctatcatgtggaa

SEQ ID NO: 9447231 - DNA, 22 bp, Homo sapiens
acaagaaaggtaggattcaggt

SEQ ID NO: 9447232 - DNA, 22 bp, Homo sapiens
acaacttctcacagataaattt

SEQ ID NO: 9447233 - DNA, 22 bp, Homo sapiens
acaactgttggaggaacacagg

SEQ ID NO: 9447234 - DNA, 23 bp, Homo sapiens
acaactttacagatacattttgt

SEQ ID NO: 9447235 - DNA, 22 bp, Homo sapiens
acaactttagtctggagggaaa

SEQ ID NO: 9447236 - DNA, 22 bp, Homo sapiens
aagacacacacatatgctgagt

SEQ ID NO: 9447237 - DNA, 22 bp, Homo sapiens
acaacaaaatgaggaagtggtc

SEQ ID NO: 9447238 - DNA, 22 bp, Homo sapiens
acaactagcaggtattaatttt

SEQ ID NO: 9447239 - DNA, 22 bp, Homo sapiens
acaacaaaatgaggaagtggtc

SEQ ID NO: 9447240 - DNA, 22 bp, Homo sapiens
aagacacacacatatgctgagt

SEQ ID NO: 9447241 - DNA, 22 bp, Homo sapiens
aagacacacacatatgctgagt

SEQ ID NO: 9447242 - DNA, 22 bp, Homo sapiens
aagacacaatgtagcccagcac

SEQ ID NO: 9447243 - DNA, 22 bp, Homo sapiens
aagacacaatgtagcccagcac

SEQ ID NO: 9447244 - DNA, 22 bp, Homo sapiens
acaactgtcagtaaagaatatt

SEQ ID NO: 9447245 - DNA, 22 bp, Homo sapiens
acaactgttggaggaacacagg

SEQ ID NO: 9447246 - DNA, 22 bp, Homo sapiens
acaactgttagacacttctaag

SEQ ID NO: 9447247 - DNA, 22 bp, Homo sapiens
acaactgttagacacttctaag

SEQ ID NO: 9447248 - DNA, 22 bp, Homo sapiens
acaactgtcagtaaagaatatt

SEQ ID NO: 9447249 - DNA, 22 bp, Homo sapiens
acaactgtcagtaaagaatatt

SEQ ID NO: 9447250 - DNA, 22 bp, Homo sapiens
acaactgtcttcttcatgctcc

SEQ ID NO: 9447251 - DNA, 22 bp, Homo sapiens
aagacacaaagcttcccttttc

SEQ ID NO: 9447252 - DNA, 22 bp, Homo sapiens
aagacacaatgtagcccagcac

SEQ ID NO: 9447253 - DNA, 22 bp, Homo sapiens
aagacacaaagcttcccttttc

SEQ ID NO: 9447254 - DNA, 22 bp, Homo sapiens
aagacaattttgagtatgcaca

SEQ ID NO: 9447255 - DNA, 22 bp, Homo sapiens
aagacaattttgagtatgcaca

SEQ ID NO: 9447256 - DNA, 22 bp, Homo sapiens
aagacaatgcattactaagaag

SEQ ID NO: 9447257 - DNA, 22 bp, Homo sapiens
aagacaatgtttctgatagata

SEQ ID NO: 9447258 - DNA, 22 bp, Homo sapiens
aattcaaattacaatagttgtt

SEQ ID NO: 9447259 - DNA, 22 bp, Homo sapiens
aattcaaagccgcttgggaatc

SEQ ID NO: 9447260 - DNA, 22 bp, Homo sapiens
aattcaaagactagaattttgc

SEQ ID NO: 9447261 - DNA, 23 bp, Homo sapiens
aattcaaattcagtgtgactagg

SEQ ID NO: 9447262 - DNA, 22 bp, Homo sapiens
aattcaatctaagaaatgatca

SEQ ID NO: 9447263 - DNA, 22 bp, Homo sapiens
aattcaaatttgagtttgtgat

SEQ ID NO: 9447264 - DNA, 22 bp, Homo sapiens
aattcaatctaagaaatgatca

SEQ ID NO: 9447265 - DNA, 22 bp, Homo sapiens
aattcaatctaagaaatgatca

SEQ ID NO: 9447266 - DNA, 22 bp, Homo sapiens
aattcaatctaagaaatgatca

SEQ ID NO: 9447267 - DNA, 22 bp, Homo sapiens
aattcaatctaagaaatgatca

SEQ ID NO: 9447268 - DNA, 22 bp, Homo sapiens
aattcaatctaagaaatgatca

SEQ ID NO: 9447269 - DNA, 22 bp, Homo sapiens
aattcaatctaagaaatgatca

SEQ ID NO: 9447270 - DNA, 22 bp, Homo sapiens
aattcaatggtttttaggatat

SEQ ID NO: 9447271 - DNA, 22 bp, Homo sapiens
aattcaatctgtagattgtgat

SEQ ID NO: 9447272 - DNA, 22 bp, Homo sapiens
aattagaagctgttagcaaaat

SEQ ID NO: 9447273 - DNA, 22 bp, Homo sapiens
aattagaagctgttagcaaaat

SEQ ID NO: 9447274 - DNA, 22 bp, Homo sapiens
aattagaagctgttagcaaaat

SEQ ID NO: 9447275 - DNA, 22 bp, Homo sapiens
aattagaagctgttagcaaaat

SEQ ID NO: 9447276 - DNA, 22 bp, Homo sapiens
aattagaagctgttagcaaaat

SEQ ID NO: 9447277 - DNA, 22 bp, Homo sapiens
aattagaagctgttagcaaaat

SEQ ID NO: 9447278 - DNA, 22 bp, Homo sapiens
aattagaagggagttattgata

SEQ ID NO: 9447279 - DNA, 22 bp, Homo sapiens
aattagaagggagttattgata

SEQ ID NO: 9447280 - DNA, 22 bp, Homo sapiens
aattagaatcttatttggggaa

SEQ ID NO: 9447281 - DNA, 20 bp, Homo sapiens
aattagatgtttaatcaata

SEQ ID NO: 9447282 - DNA, 20 bp, Homo sapiens
aattagatgtttaatcaata

SEQ ID NO: 9447283 - DNA, 20 bp, Homo sapiens
aattagatgtttaatcaata

SEQ ID NO: 9447284 - DNA, 22 bp, Homo sapiens
aattagcatttcccatataaat

SEQ ID NO: 9447285 - DNA, 22 bp, Homo sapiens
aagaattttccagcatgtcagt

SEQ ID NO: 9447286 - DNA, 22 bp, Homo sapiens
aagaattttccagcatgtcagt

SEQ ID NO: 9447287 - DNA, 22 bp, Homo sapiens
aagaattttccagcatgtcagt

SEQ ID NO: 9447288 - DNA, 22 bp, Homo sapiens
aagaattttccagcatgtcagt

SEQ ID NO: 9447289 - DNA, 22 bp, Homo sapiens
aagaattttccagcatgtcagt

SEQ ID NO: 9447290 - DNA, 22 bp, Homo sapiens
aagacaacagagatgacagact

SEQ ID NO: 9447291 - DNA, 17 bp, Homo sapiens
aagacaagacaaatgca

SEQ ID NO: 9447292 - DNA, 17 bp, Homo sapiens
aagacaagacaaatgca

SEQ ID NO: 9447293 - DNA, 22 bp, Homo sapiens
aagacaatattgctgtgaacgt

SEQ ID NO: 9447294 - DNA, 22 bp, Homo sapiens
aagacaatcctggacagtcagc

SEQ ID NO: 9447295 - DNA, 22 bp, Homo sapiens
aagaattatctgaaagctgtgt

SEQ ID NO: 9447296 - DNA, 22 bp, Homo sapiens
aagaattattgcaatactagat

SEQ ID NO: 9447297 - DNA, 22 bp, Homo sapiens
aagaatgaaggatttagctgtt

SEQ ID NO: 9447298 - DNA, 22 bp, Homo sapiens
aagaatgaaggatttagctgtt

SEQ ID NO: 9447299 - DNA, 22 bp, Homo sapiens
aagaattcactggtagagtcaa

SEQ ID NO: 9447300 - DNA, 22 bp, Homo sapiens
aagaattgcctttcaattgttt

SEQ ID NO: 9447301 - DNA, 22 bp, Homo sapiens
aagaattgcctttcaattgttt

SEQ ID NO: 9447302 - DNA, 22 bp, Homo sapiens
aattcacaaaaccagattgctt

SEQ ID NO: 9447303 - DNA, 22 bp, Homo sapiens
aattcacaaaaccagattgctt

SEQ ID NO: 9447304 - DNA, 22 bp, Homo sapiens
aattcacaaaagttagatccat

SEQ ID NO: 9447305 - DNA, 22 bp, Homo sapiens
aattcaatggtttttaggatat

SEQ ID NO: 9447306 - DNA, 22 bp, Homo sapiens
aattcacaaaaccagattgctt

SEQ ID NO: 9447307 - DNA, 22 bp, Homo sapiens
aattcacaaaaccagattgctt

SEQ ID NO: 9447308 - DNA, 22 bp, Homo sapiens
aagaatctgttgattccccact

SEQ ID NO: 9447309 - DNA, 22 bp, Homo sapiens
aattcacaaaagttagatccat

SEQ ID NO: 9447310 - DNA, 22 bp, Homo sapiens
aattcacaaaagttagatccat

SEQ ID NO: 9447311 - DNA, 22 bp, Homo sapiens
aagaatcttaatccagaaacct

SEQ ID NO: 9447312 - DNA, 22 bp, Homo sapiens
aagaatcttaatccagaaacct

SEQ ID NO: 9447313 - DNA, 22 bp, Homo sapiens
aactctggaagggtgaggctgt

SEQ ID NO: 9447314 - DNA, 23 bp, Homo sapiens
aactctggctagcatagaataga

SEQ ID NO: 9447315 - DNA, 22 bp, Homo sapiens
aactctggctgcttcccaggtc

SEQ ID NO: 9447316 - DNA, 22 bp, Homo sapiens
aactctcagaacttttggtggg

SEQ ID NO: 9447317 - DNA, 22 bp, Homo sapiens
aactctgccaggtttcaggagc

SEQ ID NO: 9447318 - DNA, 22 bp, Homo sapiens
aactctgcaacctatgtagacc

SEQ ID NO: 9447319 - DNA, 22 bp, Homo sapiens
aactctgcaacctatgtagacc

SEQ ID NO: 9447320 - DNA, 22 bp, Homo sapiens
aactctctctggctcccagcaa

SEQ ID NO: 9447321 - DNA, 22 bp, Homo sapiens
aactctacttgggactcctctg

SEQ ID NO: 9447322 - DNA, 22 bp, Homo sapiens
aactcctgttctatgacaagag

SEQ ID NO: 9447323 - DNA, 22 bp, Homo sapiens
aactctatttaccctactaaac

SEQ ID NO: 9447324 - DNA, 20 bp, Homo sapiens
aactcctagcctcaagtgat

SEQ ID NO: 9447325 - DNA, 20 bp, Homo sapiens
aactcctagcctcaagtgat

SEQ ID NO: 9447326 - DNA, 20 bp, Homo sapiens
aactcctagcctcaagtgat

SEQ ID NO: 9447327 - DNA, 22 bp, Homo sapiens
aatgtattctctttataagata

SEQ ID NO: 9447328 - DNA, 22 bp, Homo sapiens
aatgtacaataagacaaagagg

SEQ ID NO: 9447329 - DNA, 22 bp, Homo sapiens
aatgtacaataagacaaagagg

SEQ ID NO: 9447330 - DNA, 22 bp, Homo sapiens
aatgtacaataagacaaagagg

SEQ ID NO: 9447331 - DNA, 22 bp, Homo sapiens
aactctttgaacagtgaggcta

SEQ ID NO: 9447332 - DNA, 22 bp, Homo sapiens
aactctttctgaggattgggag

SEQ ID NO: 9447333 - DNA, 22 bp, Homo sapiens
aactgaaaccaaacactttagg

SEQ ID NO: 9447334 - DNA, 22 bp, Homo sapiens
aactctttttttaagtgtagcc

SEQ ID NO: 9447335 - DNA, 22 bp, Homo sapiens
aactcttaattttcatgaaatg

SEQ ID NO: 9447336 - DNA, 22 bp, Homo sapiens
aactcttaaaattttggcttgc

SEQ ID NO: 9447337 - DNA, 22 bp, Homo sapiens
aactctttccctttggtgccac

SEQ ID NO: 9447338 - DNA, 22 bp, Homo sapiens
aactctttcatctgtggcctgg

SEQ ID NO: 9447339 - DNA, 22 bp, Homo sapiens
aatgtcaacacaagagaaatgc

SEQ ID NO: 9447340 - DNA, 22 bp, Homo sapiens
aatgtcaacacaagagaaatgc

SEQ ID NO: 9447341 - DNA, 22 bp, Homo sapiens
aatgtcaaaggctatacattca

SEQ ID NO: 9447342 - DNA, 22 bp, Homo sapiens
aatgtcaaagtgctttgcaaac

SEQ ID NO: 9447343 - DNA, 22 bp, Homo sapiens
aatgtcaaagtgctttgcaaac

SEQ ID NO: 9447344 - DNA, 22 bp, Homo sapiens
aatgtcaaaatggaatgagact

SEQ ID NO: 9447345 - DNA, 22 bp, Homo sapiens
aatgtcaaaatggaatgagact

SEQ ID NO: 9447346 - DNA, 22 bp, Homo sapiens
aatgtcaaacagagcagagcta

SEQ ID NO: 9447347 - DNA, 22 bp, Homo sapiens
aatgtcaaaggctatacattca

SEQ ID NO: 9447348 - DNA, 22 bp, Homo sapiens
aatgtcaaaggctatacattca

SEQ ID NO: 9447349 - DNA, 22 bp, Homo sapiens
aatgtcaaaatggaatgagact

SEQ ID NO: 9447350 - DNA, 22 bp, Homo sapiens
aatgtattttgggagtttcttt

SEQ ID NO: 9447351 - DNA, 22 bp, Homo sapiens
aatgtattttgggagtttcttt

SEQ ID NO: 9447352 - DNA, 22 bp, Homo sapiens
aatgtatttgatgtattagcct

SEQ ID NO: 9447353 - DNA, 22 bp, Homo sapiens
aatgtatttgatgtattagcct

SEQ ID NO: 9447354 - DNA, 20 bp, Homo sapiens
aatgtcttgagacatttcag

SEQ ID NO: 9447355 - DNA, 20 bp, Homo sapiens
aatgtcttgagacatttcag

SEQ ID NO: 9447356 - DNA, 22 bp, Homo sapiens
aatgtcttcttcagctgaataa

SEQ ID NO: 9447357 - DNA, 22 bp, Homo sapiens
aatgtcaagggaagcaggaaat

SEQ ID NO: 9447358 - DNA, 22 bp, Homo sapiens
aatgtcaataactttatccctc

SEQ ID NO: 9447359 - DNA, 22 bp, Homo sapiens
aatgtcaataactttatccctc

SEQ ID NO: 9447360 - DNA, 22 bp, Homo sapiens
aatgtcaagtagccaatgcttc

SEQ ID NO: 9447361 - DNA, 22 bp, Homo sapiens
aatgtcaacacaagagaaatgc

SEQ ID NO: 9447362 - DNA, 22 bp, Homo sapiens
aatgtcaagggaagcaggaaat

SEQ ID NO: 9447363 - DNA, 22 bp, Homo sapiens
aatgtctttaaagtgcaataga

SEQ ID NO: 9447364 - DNA, 22 bp, Homo sapiens
aatgtctttacttttgtgggca

SEQ ID NO: 9447365 - DNA, 22 bp, Homo sapiens
aatgtctttaaagtgcaataga

SEQ ID NO: 9447366 - DNA, 22 bp, Homo sapiens
aatgtctttctcataacagata

SEQ ID NO: 9447367 - DNA, 22 bp, Homo sapiens
aatgttatgtggttcaacttaa

SEQ ID NO: 9447368 - DNA, 22 bp, Homo sapiens
aactttatcggaacaggtactc

SEQ ID NO: 9447369 - DNA, 22 bp, Homo sapiens
aactttcagcaagtaattctgg

SEQ ID NO: 9447370 - DNA, 22 bp, Homo sapiens
aactttcagcaagtaattctgg

SEQ ID NO: 9447371 - DNA, 22 bp, Homo sapiens
aactttctataggttgggattt

SEQ ID NO: 9447372 - DNA, 22 bp, Homo sapiens
aactttctagagatgagttcgg

SEQ ID NO: 9447373 - DNA, 22 bp, Homo sapiens
aactttctgaaaagcttgatca

SEQ ID NO: 9447374 - DNA, 22 bp, Homo sapiens
aatgttttgcattagttttcta

SEQ ID NO: 9447375 - DNA, 22 bp, Homo sapiens
aatgttttgcattagttttcta

SEQ ID NO: 9447376 - DNA, 22 bp, Homo sapiens
aactttctctggatggcttcct

SEQ ID NO: 9447377 - DNA, 22 bp, Homo sapiens
aactttctctacggcatttgtt

SEQ ID NO: 9447378 - DNA, 20 bp, Homo sapiens
aactttctcccattggactg

SEQ ID NO: 9447379 - DNA, 22 bp, Homo sapiens
aactttctataggttgggattt

SEQ ID NO: 9447380 - DNA, 22 bp, Homo sapiens
aattagaaccagaagccatatt

SEQ ID NO: 9447381 - DNA, 22 bp, Homo sapiens
aattagaaccagaagccatatt

SEQ ID NO: 9447382 - DNA, 22 bp, Homo sapiens
aattagaaccagaagccatatt

SEQ ID NO: 9447383 - DNA, 22 bp, Homo sapiens
aattagaaccagaagccatatt

SEQ ID NO: 9447384 - DNA, 22 bp, Homo sapiens
aattacttaagagaaactttga

SEQ ID NO: 9447385 - DNA, 22 bp, Homo sapiens
aatgttttttggtctgatgaat

SEQ ID NO: 9447386 - DNA, 22 bp, Homo sapiens
aatgttttttggtctgatgaat

SEQ ID NO: 9447387 - DNA, 22 bp, Homo sapiens
aattactgtaattttctacagc

SEQ ID NO: 9447388 - DNA, 22 bp, Homo sapiens
aatgttagattcctccacctag

SEQ ID NO: 9447389 - DNA, 22 bp, Homo sapiens
aatgttagattcctccacctag

SEQ ID NO: 9447390 - DNA, 22 bp, Homo sapiens
aatgttagtaacttgagtattt

SEQ ID NO: 9447391 - DNA, 22 bp, Homo sapiens
aatgttacgatcaacaacacat

SEQ ID NO: 9447392 - DNA, 22 bp, Homo sapiens
aatgttacgatcaacaacacat

SEQ ID NO: 9447393 - DNA, 22 bp, Homo sapiens
aatgttacgatcaacaacacat

SEQ ID NO: 9447394 - DNA, 22 bp, Homo sapiens
aatgttacagttttaattctga

SEQ ID NO: 9447395 - DNA, 22 bp, Homo sapiens
aatgttacacaggtataatcag

SEQ ID NO: 9447396 - DNA, 22 bp, Homo sapiens
aatgttacataacccattgtcc

SEQ ID NO: 9447397 - DNA, 22 bp, Homo sapiens
aatgttacagttttaattctga

SEQ ID NO: 9447398 - DNA, 22 bp, Homo sapiens
aatgttaatgtgtttgcttatg

SEQ ID NO: 9447399 - DNA, 22 bp, Homo sapiens
aatgttaatttactgtcttcat

SEQ ID NO: 9447400 - DNA, 22 bp, Homo sapiens
aatgttaattcacagccaaata

SEQ ID NO: 9447401 - DNA, 22 bp, Homo sapiens
aatgttaattcacagccaaata

SEQ ID NO: 9447402 - DNA, 22 bp, Homo sapiens
aatgttaaaaccttcagtgctt

SEQ ID NO: 9447403 - DNA, 22 bp, Homo sapiens
aatgttaaaaccttcagtgctt

SEQ ID NO: 9447404 - DNA, 22 bp, Homo sapiens
aatgtgaaaccgcacagaataa

SEQ ID NO: 9447405 - DNA, 22 bp, Homo sapiens
aatgtgaaaccgcacagaataa

SEQ ID NO: 9447406 - DNA, 22 bp, Homo sapiens
aatgtgaactttgtcatgtaac

SEQ ID NO: 9447407 - DNA, 22 bp, Homo sapiens
aatgtgaaaccgcacagaataa

SEQ ID NO: 9447408 - DNA, 22 bp, Homo sapiens
aatgtgaaaccgcacagaataa

SEQ ID NO: 9447409 - DNA, 21 bp, Homo sapiens
aatgtctttgtccatgctctg

SEQ ID NO: 9447410 - DNA, 22 bp, Homo sapiens
aatgtctttctgttctatgaga

SEQ ID NO: 9447411 - DNA, 22 bp, Homo sapiens
aatgtctttcttggttctggtt

SEQ ID NO: 9447412 - DNA, 21 bp, Homo sapiens
aatgtctttgtccatgctctg

SEQ ID NO: 9447413 - DNA, 22 bp, Homo sapiens
aatgtcttttaaatgttgaggt

SEQ ID NO: 9447414 - DNA, 22 bp, Homo sapiens
aatgtcttttgatacaagttac

SEQ ID NO: 9447415 - DNA, 22 bp, Homo sapiens
aatgtcttttcccttactttcc

SEQ ID NO: 9447416 - DNA, 22 bp, Homo sapiens
aatgtcttttaacctctggact

SEQ ID NO: 9447417 - DNA, 22 bp, Homo sapiens
aatgtcttttaacctctggact

SEQ ID NO: 9447418 - DNA, 22 bp, Homo sapiens
aatgtcttttgatacaagttac

SEQ ID NO: 9447419 - DNA, 22 bp, Homo sapiens
aaggggaatagagtgggttgtg

SEQ ID NO: 9447420 - DNA, 22 bp, Homo sapiens
aaggggagttagtgataaaacc

SEQ ID NO: 9447421 - DNA, 22 bp, Homo sapiens
aaggggaatagagtgggttgtg

SEQ ID NO: 9447422 - DNA, 22 bp, Homo sapiens
aaggggaatagagtgggttgtg

SEQ ID NO: 9447423 - DNA, 22 bp, Homo sapiens
aaggggaagtagcaccagaggt

SEQ ID NO: 9447424 - DNA, 22 bp, Homo sapiens
aaggggaagtagcaccagaggt

SEQ ID NO: 9447425 - DNA, 22 bp, Homo sapiens
aaggggaagtagcaccagaggt

SEQ ID NO: 9447426 - DNA, 22 bp, Homo sapiens
aaggggaagtagcaccagaggt

SEQ ID NO: 9447427 - DNA, 22 bp, Homo sapiens
aaggggatttaaggtaagaaga

SEQ ID NO: 9447428 - DNA, 21 bp, Homo sapiens
aaggggcaaacccaggacacc

SEQ ID NO: 9447429 - DNA, 21 bp, Homo sapiens
aaggggcaaacccaggacacc

SEQ ID NO: 9447430 - DNA, 22 bp, Homo sapiens
aaggggcacaattgtacccaag

SEQ ID NO: 9447431 - DNA, 22 bp, Homo sapiens
aaggggcatgcttttgccagga

SEQ ID NO: 9447432 - DNA, 22 bp, Homo sapiens
aaggggcctcacagatgggctt

SEQ ID NO: 9447433 - DNA, 22 bp, Homo sapiens
aagggagaggagggtcttgttg

SEQ ID NO: 9447434 - DNA, 22 bp, Homo sapiens
aagggagaggagggtcttgttg

SEQ ID NO: 9447435 - DNA, 22 bp, Homo sapiens
aagggagcggggagaccctatg

SEQ ID NO: 9447436 - DNA, 22 bp, Homo sapiens
aagggagccaagaaagcagggc

SEQ ID NO: 9447437 - DNA, 22 bp, Homo sapiens
aagggagatagttcgccatggg

SEQ ID NO: 9447438 - DNA, 22 bp, Homo sapiens
aagggctggagactgggtcttc

SEQ ID NO: 9447439 - DNA, 22 bp, Homo sapiens
aaggggaagtagcaccagaggt

SEQ ID NO: 9447440 - DNA, 22 bp, Homo sapiens
aagggaggccagaggttttgca

SEQ ID NO: 9447441 - DNA, 22 bp, Homo sapiens
aagggaggaggatttattgtac

SEQ ID NO: 9447442 - DNA, 22 bp, Homo sapiens
aagggaggaggatttattgtac

SEQ ID NO: 9447443 - DNA, 22 bp, Homo sapiens
aagggagcttaggagatcaggc

SEQ ID NO: 9447444 - DNA, 22 bp, Homo sapiens
aagggagcttaggagatcaggc

SEQ ID NO: 9447445 - DNA, 22 bp, Homo sapiens
aacaataggctatatgctaggc

SEQ ID NO: 9447446 - DNA, 22 bp, Homo sapiens
aacaatcaagtttctaaatgac

SEQ ID NO: 9447447 - DNA, 22 bp, Homo sapiens
aacaataggctatatgctaggc

SEQ ID NO: 9447448 - DNA, 22 bp, Homo sapiens
aacaataggagtgatgcagtat

SEQ ID NO: 9447449 - DNA, 22 bp, Homo sapiens
aacaataggacctttatgttct

SEQ ID NO: 9447450 - DNA, 23 bp, Homo sapiens
aacaatagagataaagtgagatc

SEQ ID NO: 9447451 - DNA, 22 bp, Homo sapiens
aacaataattgcggttctctat

SEQ ID NO: 9447452 - DNA, 22 bp, Homo sapiens
aaggggcctcacagatgggctt

SEQ ID NO: 9447453 - DNA, 22 bp, Homo sapiens
aagggggagaggtgtttggatg

SEQ ID NO: 9447454 - DNA, 20 bp, Homo sapiens
aacaatctagaagctattct

SEQ ID NO: 9447455 - DNA, 22 bp, Homo sapiens
aacaatcaagtttctaaatgac

SEQ ID NO: 9447456 - DNA, 22 bp, Homo sapiens
aacaatgaccacacaatgtact

SEQ ID NO: 9447457 - DNA, 22 bp, Homo sapiens
aacaatctgttcgatagaaaat

SEQ ID NO: 9447458 - DNA, 22 bp, Homo sapiens
aacaatgaccacacaatgtact

SEQ ID NO: 9447459 - DNA, 22 bp, Homo sapiens
aacaatctgttcgatagaaaat

SEQ ID NO: 9447460 - DNA, 22 bp, Homo sapiens
aacaatgccacattaagtgtat

SEQ ID NO: 9447461 - DNA, 16 bp, Homo sapiens
aacaatgccaatccag

SEQ ID NO: 9447462 - DNA, 22 bp, Homo sapiens
aagtacaatctttctgtaaagg

SEQ ID NO: 9447463 - DNA, 22 bp, Homo sapiens
aacaatgctgaactgaggaaag

SEQ ID NO: 9447464 - DNA, 22 bp, Homo sapiens
aacaatgcctgatgacctcctg

SEQ ID NO: 9447465 - DNA, 22 bp, Homo sapiens
aacaatgatatagggattggca

SEQ ID NO: 9447466 - DNA, 22 bp, Homo sapiens
aacaatgagtcctctgaggtta

SEQ ID NO: 9447467 - DNA, 22 bp, Homo sapiens
aacaatgaggatctgttctgag

SEQ ID NO: 9447468 - DNA, 22 bp, Homo sapiens
aacaatgccaacagcatgctgg

SEQ ID NO: 9447469 - DNA, 22 bp, Homo sapiens
aacaatgcagttaatgggaaga

SEQ ID NO: 9447470 - DNA, 22 bp, Homo sapiens
aacaatgcactatcgtaagtgg

SEQ ID NO: 9447471 - DNA, 22 bp, Homo sapiens
aagtatgtctttgggtattatt

SEQ ID NO: 9447472 - DNA, 22 bp, Homo sapiens
aagtatgtgtgggatgctggga

SEQ ID NO: 9447473 - DNA, 22 bp, Homo sapiens
aagtatgacatttaagacaatt

SEQ ID NO: 9447474 - DNA, 22 bp, Homo sapiens
aagtacagaaggagcgaacaat

SEQ ID NO: 9447475 - DNA, 22 bp, Homo sapiens
aagtacacatcgttggccccga

SEQ ID NO: 9447476 - DNA, 22 bp, Homo sapiens
aagtacacctttggagtccacg

SEQ ID NO: 9447477 - DNA, 22 bp, Homo sapiens
aagtacaatctttctgtaaagg

SEQ ID NO: 9447478 - DNA, 22 bp, Homo sapiens
aacaatgaccacacaatgtact

SEQ ID NO: 9447479 - DNA, 19 bp, Homo sapiens
aacaagtaggaatggaaga

SEQ ID NO: 9447480 - DNA, 22 bp, Homo sapiens
aacaagtgatgctcatgattca

SEQ ID NO: 9447481 - DNA, 22 bp, Homo sapiens
aacaagttactcttaaagtata

SEQ ID NO: 9447482 - DNA, 22 bp, Homo sapiens
aacaaatgtgttttgtaattaa

SEQ ID NO: 9447483 - DNA, 22 bp, Homo sapiens
aacaagatgttttgatatatgt

SEQ ID NO: 9447484 - DNA, 22 bp, Homo sapiens
aacaaggcacaagctggctgtt

SEQ ID NO: 9447485 - DNA, 22 bp, Homo sapiens
aacaaggctggtatcttaaaga

SEQ ID NO: 9447486 - DNA, 22 bp, Homo sapiens
aacaaggctggtatcttaaaga

SEQ ID NO: 9447487 - DNA, 22 bp, Homo sapiens
aacaaggcacaagctggctgtt

SEQ ID NO: 9447488 - DNA, 22 bp, Homo sapiens
aacaagtaagtttatatatatt

SEQ ID NO: 9447489 - DNA, 22 bp, Homo sapiens
aacaaggcaagtctgtgagcat

SEQ ID NO: 9447490 - DNA, 22 bp, Homo sapiens
aacaagcagatgcaatgcactt

SEQ ID NO: 9447491 - DNA, 22 bp, Homo sapiens
aacaataactagacatgccatg

SEQ ID NO: 9447492 - DNA, 22 bp, Homo sapiens
aacaataattgcggttctctat

SEQ ID NO: 9447493 - DNA, 22 bp, Homo sapiens
aagggagacagttgtgtgagga

SEQ ID NO: 9447494 - DNA, 22 bp, Homo sapiens
aagggagacagttgtgtgagga

SEQ ID NO: 9447495 - DNA, 22 bp, Homo sapiens
aagggagacagttgtgtgagga

SEQ ID NO: 9447496 - DNA, 22 bp, Homo sapiens
aagggagacagttgtgtgagga

SEQ ID NO: 9447497 - DNA, 22 bp, Homo sapiens
aacaataactagacatgccatg

SEQ ID NO: 9447498 - DNA, 22 bp, Homo sapiens
aacaataactagacatgccatg

SEQ ID NO: 9447499 - DNA, 22 bp, Homo sapiens
aacaagttgttgaaaataatta

SEQ ID NO: 9447500 - DNA, 22 bp, Homo sapiens
aacaataactagacatgccatg

SEQ ID NO: 9447501 - DNA, 22 bp, Homo sapiens
aacaagttgttgaaaataatta

SEQ ID NO: 9447502 - DNA, 22 bp, Homo sapiens
aacaagttactcttaaagtata

SEQ ID NO: 9447503 - DNA, 22 bp, Homo sapiens
aacaagttactcttaaagtata

SEQ ID NO: 9447504 - DNA, 22 bp, Homo sapiens
aaggccaactaggatgagctag

SEQ ID NO: 9447505 - DNA, 22 bp, Homo sapiens
aaggccaaagttttcaggctaa

SEQ ID NO: 9447506 - DNA, 22 bp, Homo sapiens
aaggccaaagacacctacacag

SEQ ID NO: 9447507 - DNA, 22 bp, Homo sapiens
aaatttctaagcagccacttcc

SEQ ID NO: 9447508 - DNA, 22 bp, Homo sapiens
aaatttcagttggaatgagctc

SEQ ID NO: 9447509 - DNA, 22 bp, Homo sapiens
aaggcattggactagtatcaga

SEQ ID NO: 9447510 - DNA, 22 bp, Homo sapiens
aaatttctaagcagccacttcc

SEQ ID NO: 9447511 - DNA, 20 bp, Homo sapiens
aaatttaggaaattttacgc

SEQ ID NO: 9447512 - DNA, 22 bp, Homo sapiens
aaatttcaagcaaagtagctat

SEQ ID NO: 9447513 - DNA, 22 bp, Homo sapiens
aaatttcaagcaaagtagctat

SEQ ID NO: 9447514 - DNA, 22 bp, Homo sapiens
aaatttcaagcaaagtagctat

SEQ ID NO: 9447515 - DNA, 22 bp, Homo sapiens
aaatttcaagcaaagtagctat

SEQ ID NO: 9447516 - DNA, 22 bp, Homo sapiens
aaatttcagttacctttacgtt

SEQ ID NO: 9447517 - DNA, 22 bp, Homo sapiens
aaatttcagttggaatgagctc

SEQ ID NO: 9447518 - DNA, 22 bp, Homo sapiens
aaggccagacaggaccacatct

SEQ ID NO: 9447519 - DNA, 22 bp, Homo sapiens
aacaaatgtgtggcagtgtggg

SEQ ID NO: 9447520 - DNA, 23 bp, Homo sapiens
aaggccagaatttcaatggtgcc

SEQ ID NO: 9447521 - DNA, 22 bp, Homo sapiens
aaggccactttaccttaaatcc

SEQ ID NO: 9447522 - DNA, 22 bp, Homo sapiens
aaggccacagagcctcagagag

SEQ ID NO: 9447523 - DNA, 22 bp, Homo sapiens
aaggccacacttgctggccagc

SEQ ID NO: 9447524 - DNA, 22 bp, Homo sapiens
aaggccacacttgctggccagc

SEQ ID NO: 9447525 - DNA, 22 bp, Homo sapiens
aaggccaaggctgcagtgagcc

SEQ ID NO: 9447526 - DNA, 22 bp, Homo sapiens
aaggccaaggctgcagtgagcc

SEQ ID NO: 9447527 - DNA, 22 bp, Homo sapiens
aaggccaccaccagcgaggggg

SEQ ID NO: 9447528 - DNA, 22 bp, Homo sapiens
aaggccactgaagaaatcacaa

SEQ ID NO: 9447529 - DNA, 22 bp, Homo sapiens
aaggccacgtctccttccagag

SEQ ID NO: 9447530 - DNA, 22 bp, Homo sapiens
aaggccaccaccagcgaggggg

SEQ ID NO: 9447531 - DNA, 22 bp, Homo sapiens
aaggccaccaccagcgaggggg

SEQ ID NO: 9447532 - DNA, 22 bp, Homo sapiens
aaggccacagagcctcagagag

SEQ ID NO: 9447533 - DNA, 22 bp, Homo sapiens
aaggacctatattgtcagagga

SEQ ID NO: 9447534 - DNA, 22 bp, Homo sapiens
aaggacctatattgtcagagga

SEQ ID NO: 9447535 - DNA, 22 bp, Homo sapiens
aaggagaaatggtagatgtgca

SEQ ID NO: 9447536 - DNA, 22 bp, Homo sapiens
aaggagaaatggtagatgtgca

SEQ ID NO: 9447537 - DNA, 22 bp, Homo sapiens
aaggagaaatggtagatgtgca

SEQ ID NO: 9447538 - DNA, 22 bp, Homo sapiens
aaggactgctaggaagccgtgt

SEQ ID NO: 9447539 - DNA, 22 bp, Homo sapiens
aaggactgaataattctctttc

SEQ ID NO: 9447540 - DNA, 22 bp, Homo sapiens
aaggactgacaaatgtcttcct

SEQ ID NO: 9447541 - DNA, 22 bp, Homo sapiens
aaattgcattgagctgcttatt

SEQ ID NO: 9447542 - DNA, 22 bp, Homo sapiens
aaggagaaggcatcattcaagt

SEQ ID NO: 9447543 - DNA, 22 bp, Homo sapiens
aaggagaaggcatcattcaagt

SEQ ID NO: 9447544 - DNA, 22 bp, Homo sapiens
aaggagaaggcatcattcaagt

SEQ ID NO: 9447545 - DNA, 22 bp, Homo sapiens
aaatttaaaaagcagcattgca

SEQ ID NO: 9447546 - DNA, 22 bp, Homo sapiens
aaattgcattgagctgcttatt

SEQ ID NO: 9447547 - DNA, 22 bp, Homo sapiens
aaattgctaaggatctcatgtg

SEQ ID NO: 9447548 - DNA, 22 bp, Homo sapiens
aaatttaaaaagcagcattgca

SEQ ID NO: 9447549 - DNA, 22 bp, Homo sapiens
aaatttaaaaagcagcattgca

SEQ ID NO: 9447550 - DNA, 22 bp, Homo sapiens
aaatttaaggaggtgctcactt

SEQ ID NO: 9447551 - DNA, 22 bp, Homo sapiens
aaatttaaggaggtgctcactt

SEQ ID NO: 9447552 - DNA, 22 bp, Homo sapiens
aaattattacaagctagttggc

SEQ ID NO: 9447553 - DNA, 22 bp, Homo sapiens
aaattattacaagctagttggc

SEQ ID NO: 9447554 - DNA, 22 bp, Homo sapiens
aaattattacaagctagttggc

SEQ ID NO: 9447555 - DNA, 22 bp, Homo sapiens
aaattattataggcagagctga

SEQ ID NO: 9447556 - DNA, 22 bp, Homo sapiens
aaattattagttaagttgggca

SEQ ID NO: 9447557 - DNA, 22 bp, Homo sapiens
aaattattagttaagttgggca

SEQ ID NO: 9447558 - DNA, 22 bp, Homo sapiens
aaattattacaagctagttggc

SEQ ID NO: 9447559 - DNA, 22 bp, Homo sapiens
aaattattaaacagtgggatgc

SEQ ID NO: 9447560 - DNA, 22 bp, Homo sapiens
aaattattaaacagtgggatgc

SEQ ID NO: 9447561 - DNA, 22 bp, Homo sapiens
aaattatcatgggggagaaaca

SEQ ID NO: 9447562 - DNA, 22 bp, Homo sapiens
aaattattataggcagagctga

SEQ ID NO: 9447563 - DNA, 22 bp, Homo sapiens
aaattattataggcagagctga

SEQ ID NO: 9447564 - DNA, 22 bp, Homo sapiens
aaattattatgcccctctataa

SEQ ID NO: 9447565 - DNA, 22 bp, Homo sapiens
aaattattatgcccctctataa

SEQ ID NO: 9447566 - DNA, 22 bp, Homo sapiens
aaggacagggatggttgattgt

SEQ ID NO: 9447567 - DNA, 22 bp, Homo sapiens
aaattattatgcccctctataa

SEQ ID NO: 9447568 - DNA, 22 bp, Homo sapiens
aaggacagggatggttgattgt

SEQ ID NO: 9447569 - DNA, 22 bp, Homo sapiens
aaggacatttctgactaatgca

SEQ ID NO: 9447570 - DNA, 22 bp, Homo sapiens
aaggacatttctgactaatgca

SEQ ID NO: 9447571 - DNA, 22 bp, Homo sapiens
aaggacaggttggggcttcagg

SEQ ID NO: 9447572 - DNA, 22 bp, Homo sapiens
aaggacaggttggggcttcagg

SEQ ID NO: 9447573 - DNA, 22 bp, Homo sapiens
aaattagtcatgttgtattact

SEQ ID NO: 9447574 - DNA, 22 bp, Homo sapiens
aaattagtcatgttgtattact

SEQ ID NO: 9447575 - DNA, 22 bp, Homo sapiens
aaattagtcggtttaggaattt

SEQ ID NO: 9447576 - DNA, 22 bp, Homo sapiens
aaattagtgcaccaggttgaag

SEQ ID NO: 9447577 - DNA, 22 bp, Homo sapiens
aaattataggtgccaccttgga

SEQ ID NO: 9447578 - DNA, 22 bp, Homo sapiens
aaattataggtgccaccttgga

SEQ ID NO: 9447579 - DNA, 22 bp, Homo sapiens
aaattagtacattgcaaagtcc

SEQ ID NO: 9447580 - DNA, 22 bp, Homo sapiens
aaattagtacattgcaaagtcc

SEQ ID NO: 9447581 - DNA, 22 bp, Homo sapiens
aaattagtacattgcaaagtcc

SEQ ID NO: 9447582 - DNA, 22 bp, Homo sapiens
aaggaaacactgaactttgtag

SEQ ID NO: 9447583 - DNA, 22 bp, Homo sapiens
aaattaactatcacttttgtga

SEQ ID NO: 9447584 - DNA, 18 bp, Homo sapiens
aagctgggaaggagacag

SEQ ID NO: 9447585 - DNA, 22 bp, Homo sapiens
aagctgggacttagcgcagata

SEQ ID NO: 9447586 - DNA, 20 bp, Homo sapiens
aagctgggtaggagaggagc

SEQ ID NO: 9447587 - DNA, 22 bp, Homo sapiens
aagctgtacttagcattgactc

SEQ ID NO: 9447588 - DNA, 22 bp, Homo sapiens
aagctgtgaaatagattacaca

SEQ ID NO: 9447589 - DNA, 22 bp, Homo sapiens
aagctgtgaaatagattacaca

SEQ ID NO: 9447590 - DNA, 22 bp, Homo sapiens
aagctgtgaaatctctagtgca

SEQ ID NO: 9447591 - DNA, 22 bp, Homo sapiens
aagctgtcaggaggttaccttt

SEQ ID NO: 9447592 - DNA, 22 bp, Homo sapiens
aagctgtcaatgtatctagtct

SEQ ID NO: 9447593 - DNA, 22 bp, Homo sapiens
aagctgtagaggcagtacattt

SEQ ID NO: 9447594 - DNA, 22 bp, Homo sapiens
aagctgtagcttttcaaaacgt

SEQ ID NO: 9447595 - DNA, 22 bp, Homo sapiens
aagctttggaagggcagggttg

SEQ ID NO: 9447596 - DNA, 22 bp, Homo sapiens
aagctttggaagggcagggttg

SEQ ID NO: 9447597 - DNA, 22 bp, Homo sapiens
aagctttgcaatgcttcattat

SEQ ID NO: 9447598 - DNA, 19 bp, Homo sapiens
aagctttcccattaacccc

SEQ ID NO: 9447599 - DNA, 22 bp, Homo sapiens
aagcttttctcagtgtccttgg

SEQ ID NO: 9447600 - DNA, 22 bp, Homo sapiens
aagcttttattaaaatcttgcc

SEQ ID NO: 9447601 - DNA, 22 bp, Homo sapiens
aagcttttctctgtattacctg

SEQ ID NO: 9447602 - DNA, 22 bp, Homo sapiens
aagctttttggatttgcttcag

SEQ ID NO: 9447603 - DNA, 22 bp, Homo sapiens
aagctttttggatttgcttcag

SEQ ID NO: 9447604 - DNA, 21 bp, Homo sapiens
aaggaaaagcttggtctctga

SEQ ID NO: 9447605 - DNA, 22 bp, Homo sapiens
aagccatttcctgatacaccta

SEQ ID NO: 9447606 - DNA, 22 bp, Homo sapiens
aagcccagatgagatccctgga

SEQ ID NO: 9447607 - DNA, 22 bp, Homo sapiens
aagcccagatgagatccctgga

SEQ ID NO: 9447608 - DNA, 22 bp, Homo sapiens
aagctggcatgtcacctgagaa

SEQ ID NO: 9447609 - DNA, 22 bp, Homo sapiens
aagctggcctcaaactcctagc

SEQ ID NO: 9447610 - DNA, 22 bp, Homo sapiens
aagccagtgtttttgagagttg

SEQ ID NO: 9447611 - DNA, 22 bp, Homo sapiens
aagccatatggtaggtatatgt

SEQ ID NO: 9447612 - DNA, 22 bp, Homo sapiens
aagccatcgaactgtacactta

SEQ ID NO: 9447613 - DNA, 22 bp, Homo sapiens
aagccattcatctaatgtcctg

SEQ ID NO: 9447614 - DNA, 22 bp, Homo sapiens
aagccatgcaagccacaaggtg

SEQ ID NO: 9447615 - DNA, 22 bp, Homo sapiens
aagccatggcatgccaggatca

SEQ ID NO: 9447616 - DNA, 22 bp, Homo sapiens
aagccatggctgcatcagcctg

SEQ ID NO: 9447617 - DNA, 22 bp, Homo sapiens
aagccagtcctctactgggcac

SEQ ID NO: 9447618 - DNA, 22 bp, Homo sapiens
aagccagtgtccagaatgggca

SEQ ID NO: 9447619 - DNA, 22 bp, Homo sapiens
aataaactgctcaattgcatca

SEQ ID NO: 9447620 - DNA, 22 bp, Homo sapiens
aataaactgctcaattgcatca

SEQ ID NO: 9447621 - DNA, 22 bp, Homo sapiens
aataaactgctcaattgcatca

SEQ ID NO: 9447622 - DNA, 22 bp, Homo sapiens
aataaactgctcaattgcatca

SEQ ID NO: 9447623 - DNA, 22 bp, Homo sapiens
aataaactgctcaattgcatca

SEQ ID NO: 9447624 - DNA, 20 bp, Homo sapiens
aataaactactgagagatgt

SEQ ID NO: 9447625 - DNA, 20 bp, Homo sapiens
aataaactactgagagatgt

SEQ ID NO: 9447626 - DNA, 20 bp, Homo sapiens
aataaactactgagagatgt

SEQ ID NO: 9447627 - DNA, 22 bp, Homo sapiens
aataaacaaatctttcctgtgg

SEQ ID NO: 9447628 - DNA, 22 bp, Homo sapiens
aataaacaaatctttcctgtgg

SEQ ID NO: 9447629 - DNA, 22 bp, Homo sapiens
aataaacaaatctttcctgtgg

SEQ ID NO: 9447630 - DNA, 22 bp, Homo sapiens
aataaacaaatctttcctgtgg

SEQ ID NO: 9447631 - DNA, 22 bp, Homo sapiens
aataaacaaaggacaaggaggt

SEQ ID NO: 9447632 - DNA, 22 bp, Homo sapiens
aataaacaaatccttccttccc

SEQ ID NO: 9447633 - DNA, 22 bp, Homo sapiens
aataaacaaatccttccttccc

SEQ ID NO: 9447634 - DNA, 22 bp, Homo sapiens
aataaacaaatccttccttccc

SEQ ID NO: 9447635 - DNA, 22 bp, Homo sapiens
aacagtttatgataaattctta

SEQ ID NO: 9447636 - DNA, 22 bp, Homo sapiens
aacagtttcctgactcctatga

SEQ ID NO: 9447637 - DNA, 22 bp, Homo sapiens
aacagtttcagttactgatgag

SEQ ID NO: 9447638 - DNA, 22 bp, Homo sapiens
aacagtttgagctttgaatttc

SEQ ID NO: 9447639 - DNA, 22 bp, Homo sapiens
aacagtttgagctttgaatttc

SEQ ID NO: 9447640 - DNA, 22 bp, Homo sapiens
aagtttctgatattgttaaagc

SEQ ID NO: 9447641 - DNA, 22 bp, Homo sapiens
aagtttctgggcaagacaaggc

SEQ ID NO: 9447642 - DNA, 20 bp, Homo sapiens
aagtttctggtttatatctt

SEQ ID NO: 9447643 - DNA, 22 bp, Homo sapiens
aagtttctgggcaagacaaggc

SEQ ID NO: 9447644 - DNA, 22 bp, Homo sapiens
aagtttctgggcaagacaaggc

SEQ ID NO: 9447645 - DNA, 22 bp, Homo sapiens
aagtttgctaacccttgctcta

SEQ ID NO: 9447646 - DNA, 21 bp, Homo sapiens
aagtttgggattcagtttcca

SEQ ID NO: 9447647 - DNA, 22 bp, Homo sapiens
aagtttgcggggaaagaacaca

SEQ ID NO: 9447648 - DNA, 22 bp, Homo sapiens
aagtttgatgagtttctggagg

SEQ ID NO: 9447649 - DNA, 22 bp, Homo sapiens
aagtttgggatgctccttggac

SEQ ID NO: 9447650 - DNA, 22 bp, Homo sapiens
aataaaatggtcagttttctca

SEQ ID NO: 9447651 - DNA, 22 bp, Homo sapiens
aataaaatggtcagttttctca

SEQ ID NO: 9447652 - DNA, 22 bp, Homo sapiens
aataaaatggtcagttttctca

SEQ ID NO: 9447653 - DNA, 22 bp, Homo sapiens
aataaaatggtcagttttctca

SEQ ID NO: 9447654 - DNA, 22 bp, Homo sapiens
aataaaatggtcagttttctca

SEQ ID NO: 9447655 - DNA, 22 bp, Homo sapiens
aataaacaaaggacaaggaggt

SEQ ID NO: 9447656 - DNA, 22 bp, Homo sapiens
aataaacaaaggacaaggaggt

SEQ ID NO: 9447657 - DNA, 22 bp, Homo sapiens
aagttgaatcagtaacacagtt

SEQ ID NO: 9447658 - DNA, 22 bp, Homo sapiens
aagttgagatgtcataggagac

SEQ ID NO: 9447659 - DNA, 22 bp, Homo sapiens
aagttcttagacaagcttgtgg

SEQ ID NO: 9447660 - DNA, 22 bp, Homo sapiens
aagttcttggaggatgaagagt

SEQ ID NO: 9447661 - DNA, 22 bp, Homo sapiens
aacactgtaacagcatcatttt

SEQ ID NO: 9447662 - DNA, 22 bp, Homo sapiens
aacactgtaacagcatcatttt

SEQ ID NO: 9447663 - DNA, 22 bp, Homo sapiens
aacactgtaacagcatcatttt

SEQ ID NO: 9447664 - DNA, 22 bp, Homo sapiens
aacactgtaacagcatcatttt

SEQ ID NO: 9447665 - DNA, 22 bp, Homo sapiens
aacactgtaacagcatcatttt

SEQ ID NO: 9447666 - DNA, 17 bp, Homo sapiens
aacactgggtgagcctc

SEQ ID NO: 9447667 - DNA, 22 bp, Homo sapiens
aacactgggataggtgatagac

SEQ ID NO: 9447668 - DNA, 22 bp, Homo sapiens
aacactggttctgactacacag

SEQ ID NO: 9447669 - DNA, 22 bp, Homo sapiens
aacactggtttggcattagatg

SEQ ID NO: 9447670 - DNA, 20 bp, Homo sapiens
aagttacattgtattgtacc

SEQ ID NO: 9447671 - DNA, 20 bp, Homo sapiens
aagttacattgtattgtacc

SEQ ID NO: 9447672 - DNA, 22 bp, Homo sapiens
aacactgtactggaagatggac

SEQ ID NO: 9447673 - DNA, 20 bp, Homo sapiens
aagttacattgtattgtacc

SEQ ID NO: 9447674 - DNA, 20 bp, Homo sapiens
aagttacattgtattgtacc

SEQ ID NO: 9447675 - DNA, 22 bp, Homo sapiens
aagttctatagtctttctacta

SEQ ID NO: 9447676 - DNA, 22 bp, Homo sapiens
aagttctgaagggttctgcaga

SEQ ID NO: 9447677 - DNA, 22 bp, Homo sapiens
aagttctgccaggctgtggcag

SEQ ID NO: 9447678 - DNA, 22 bp, Homo sapiens
aagtcaaagctttcagaggaaa

SEQ ID NO: 9447679 - DNA, 20 bp, Homo sapiens
aacactgaggcctactcttc

SEQ ID NO: 9447680 - DNA, 22 bp, Homo sapiens
aacactgagggaaaagagatag

SEQ ID NO: 9447681 - DNA, 22 bp, Homo sapiens
aacactgagggaaaagagatag

SEQ ID NO: 9447682 - DNA, 20 bp, Homo sapiens
aacactgagggctactcttc

SEQ ID NO: 9447683 - DNA, 22 bp, Homo sapiens
aacactgagggaaaagagatag

SEQ ID NO: 9447684 - DNA, 22 bp, Homo sapiens
aacactggaagggacatcaagt

SEQ ID NO: 9447685 - DNA, 20 bp, Homo sapiens
aacactgcttctatattttc

SEQ ID NO: 9447686 - DNA, 22 bp, Homo sapiens
aacactgctgctgggttctgtg

SEQ ID NO: 9447687 - DNA, 22 bp, Homo sapiens
aacactgctgctgggttctgtg

SEQ ID NO: 9447688 - DNA, 22 bp, Homo sapiens
aacactggaagggacatcaagt

SEQ ID NO: 9447689 - DNA, 22 bp, Homo sapiens
aacactggacaggaggctaggt

SEQ ID NO: 9447690 - DNA, 22 bp, Homo sapiens
aacactgagtatcagagttggg

SEQ ID NO: 9447691 - DNA, 22 bp, Homo sapiens
aacactgatggaaagtatgttt

SEQ ID NO: 9447692 - DNA, 22 bp, Homo sapiens
aagtatttcgttctgaaaaagt

SEQ ID NO: 9447693 - DNA, 22 bp, Homo sapiens
aagtatttcgttctgaaaaagt

SEQ ID NO: 9447694 - DNA, 22 bp, Homo sapiens
aagtatttcgttctgaaaaagt

SEQ ID NO: 9447695 - DNA, 22 bp, Homo sapiens
aagtatttctggcctgtgaaag

SEQ ID NO: 9447696 - DNA, 22 bp, Homo sapiens
aagtcaaaccttgctcacagga

SEQ ID NO: 9447697 - DNA, 22 bp, Homo sapiens
aagtattctggcagtcattcag

SEQ ID NO: 9447698 - DNA, 22 bp, Homo sapiens
aagtattctacaaagaaattga

SEQ ID NO: 9447699 - DNA, 22 bp, Homo sapiens
aagtattctacaaagaaattga

SEQ ID NO: 9447700 - DNA, 22 bp, Homo sapiens
aagtattatttaacaaatttgt

SEQ ID NO: 9447701 - DNA, 22 bp, Homo sapiens
aagtattcataaggacatatgt

SEQ ID NO: 9447702 - DNA, 22 bp, Homo sapiens
aagtattcataaggacatatgt

SEQ ID NO: 9447703 - DNA, 22 bp, Homo sapiens
aagtatttcagcggttctttgt

SEQ ID NO: 9447704 - DNA, 19 bp, Homo sapiens
aagtattctttgttagcag

SEQ ID NO: 9447705 - DNA, 22 bp, Homo sapiens
aagtattctggcagtcattcag

SEQ ID NO: 9447706 - DNA, 19 bp, Homo sapiens
aagtattctttgttagcag

SEQ ID NO: 9447707 - DNA, 22 bp, Homo sapiens
aacatgttgctttaataatatt

SEQ ID NO: 9447708 - DNA, 22 bp, Homo sapiens
aacataaatttgaagtggcaaa

SEQ ID NO: 9447709 - DNA, 22 bp, Homo sapiens
aacataaatttgaagtggcaaa

SEQ ID NO: 9447710 - DNA, 22 bp, Homo sapiens
aacagtttctatgttagtggtt

SEQ ID NO: 9447711 - DNA, 22 bp, Homo sapiens
aacattctgtcaattgatgacc

SEQ ID NO: 9447712 - DNA, 22 bp, Homo sapiens
aacattctggttctaaaaacct

SEQ ID NO: 9447713 - DNA, 22 bp, Homo sapiens
aacattaagatggcggaacagt

SEQ ID NO: 9447714 - DNA, 22 bp, Homo sapiens
aacattaagatggcggaacagt

SEQ ID NO: 9447715 - DNA, 22 bp, Homo sapiens
aacattcttcaaatatcactct

SEQ ID NO: 9447716 - DNA, 22 bp, Homo sapiens
aacattcttaagatttgtgtct

SEQ ID NO: 9447717 - DNA, 22 bp, Homo sapiens
aacattctttagctcttcctgc

SEQ ID NO: 9447718 - DNA, 22 bp, Homo sapiens
aacattcttcaaatatcactct

SEQ ID NO: 9447719 - DNA, 22 bp, Homo sapiens
aacattctttagctcttcctgc

SEQ ID NO: 9447720 - DNA, 22 bp, Homo sapiens
aacattcttcaaatatcactct

SEQ ID NO: 9447721 - DNA, 22 bp, Homo sapiens
aacatttacaaatccttctgca

SEQ ID NO: 9447722 - DNA, 22 bp, Homo sapiens
aacatttacaaatccttctgca

SEQ ID NO: 9447723 - DNA, 22 bp, Homo sapiens
aacattgttttccctatatcca

SEQ ID NO: 9447724 - DNA, 20 bp, Homo sapiens
aacattgcttcaatgtaacc

SEQ ID NO: 9447725 - DNA, 22 bp, Homo sapiens
aacattgcagcttaattgcagg

SEQ ID NO: 9447726 - DNA, 20 bp, Homo sapiens
aacattgaaagtctagaaga

SEQ ID NO: 9447727 - DNA, 20 bp, Homo sapiens
aacattgaaagtctagaaga

SEQ ID NO: 9447728 - DNA, 22 bp, Homo sapiens
aacattgaacttggcacaccca

SEQ ID NO: 9447729 - DNA, 22 bp, Homo sapiens
aacattctttggaggattattc

SEQ ID NO: 9447730 - DNA, 20 bp, Homo sapiens
aacattgaaagtctagaaga

SEQ ID NO: 9447731 - DNA, 22 bp, Homo sapiens
aacattgaatttaaaatacagt

SEQ ID NO: 9447732 - DNA, 22 bp, Homo sapiens
aacattgagttctacttccatt

SEQ ID NO: 9447733 - DNA, 22 bp, Homo sapiens
aacatttatggtagtcattgca

SEQ ID NO: 9447734 - DNA, 22 bp, Homo sapiens
aacatttatgattgaggtaaat

SEQ ID NO: 9447735 - DNA, 22 bp, Homo sapiens
aacatttatggtagtcattgca

SEQ ID NO: 9447736 - DNA, 22 bp, Homo sapiens
aacatttatggtagtcattgca

SEQ ID NO: 9447737 - DNA, 22 bp, Homo sapiens
aacatttatggtagtcattgca

SEQ ID NO: 9447738 - DNA, 22 bp, Homo sapiens
aacatttatggtagtcattgca

SEQ ID NO: 9447739 - DNA, 22 bp, Homo sapiens
aacatttattctaattctggga

SEQ ID NO: 9447740 - DNA, 22 bp, Homo sapiens
aacatttattctaattctggga

SEQ ID NO: 9447741 - DNA, 22 bp, Homo sapiens
aacatttattgagcacctactg

SEQ ID NO: 9447742 - DNA, 22 bp, Homo sapiens
aacatttattctaattctggga

SEQ ID NO: 9447743 - DNA, 22 bp, Homo sapiens
aacatttatgattgaggtaaat

SEQ ID NO: 9447744 - DNA, 22 bp, Homo sapiens
aacatttatgattgaggtaaat

SEQ ID NO: 9447745 - DNA, 22 bp, Homo sapiens
aacatttatatgggttcatgaa

SEQ ID NO: 9447746 - DNA, 22 bp, Homo sapiens
aacatttatatgggttcatgaa

SEQ ID NO: 9447747 - DNA, 22 bp, Homo sapiens
aacatttatatgggttcatgaa

SEQ ID NO: 9447748 - DNA, 22 bp, Homo sapiens
aacatttatatgggttcatgaa

SEQ ID NO: 9447749 - DNA, 22 bp, Homo sapiens
aacatttacaaatccttctgca

SEQ ID NO: 9447750 - DNA, 22 bp, Homo sapiens
aacatttacaaatccttctgca

SEQ ID NO: 9447751 - DNA, 22 bp, Homo sapiens
aacatttacaaatccttctgca

SEQ ID NO: 9447752 - DNA, 22 bp, Homo sapiens
aacatttaggaaggacctcctc

SEQ ID NO: 9447753 - DNA, 22 bp, Homo sapiens
aacatttaggaaggacctcctc

SEQ ID NO: 9447754 - DNA, 22 bp, Homo sapiens
aatatttgttagtgttttaatg

SEQ ID NO: 9447755 - DNA, 22 bp, Homo sapiens
aatatttgcatcattagctatt

SEQ ID NO: 9447756 - DNA, 22 bp, Homo sapiens
aatcacatgcagggcctccacc

SEQ ID NO: 9447757 - DNA, 22 bp, Homo sapiens
aatatttgaacagtcactgagt

SEQ ID NO: 9447758 - DNA, 22 bp, Homo sapiens
aatcacattaagccctgttcag

SEQ ID NO: 9447759 - DNA, 22 bp, Homo sapiens
aatcacatgtgctcaattttaa

SEQ ID NO: 9447760 - DNA, 22 bp, Homo sapiens
aatcacatgtgctcaattttaa

SEQ ID NO: 9447761 - DNA, 22 bp, Homo sapiens
aacatttcagcacctgattcct

SEQ ID NO: 9447762 - DNA, 22 bp, Homo sapiens
aacatttcagcaaataagaaca

SEQ ID NO: 9447763 - DNA, 21 bp, Homo sapiens
aacatttcaggatccaaattg

SEQ ID NO: 9447764 - DNA, 22 bp, Homo sapiens
aacatttattgagcacctactg

SEQ ID NO: 9447765 - DNA, 22 bp, Homo sapiens
aacatttattgagcacctactg

SEQ ID NO: 9447766 - DNA, 22 bp, Homo sapiens
aacatttcagcaaataagaaca

SEQ ID NO: 9447767 - DNA, 22 bp, Homo sapiens
aacatttattgagcacctactg

SEQ ID NO: 9447768 - DNA, 22 bp, Homo sapiens
aatcactttgcactcttatttg

SEQ ID NO: 9447769 - DNA, 20 bp, Homo sapiens
aatcactttgtacaggaagc

SEQ ID NO: 9447770 - DNA, 22 bp, Homo sapiens
aatcagaaaattcagtggaatt

SEQ ID NO: 9447771 - DNA, 22 bp, Homo sapiens
aatcagaaaattcagtggaatt

SEQ ID NO: 9447772 - DNA, 22 bp, Homo sapiens
aaccagctaaactttgctcgaa

SEQ ID NO: 9447773 - DNA, 22 bp, Homo sapiens
aaccagcactgctggggcctgc

SEQ ID NO: 9447774 - DNA, 22 bp, Homo sapiens
aaccagatggtgcggcaggaca

SEQ ID NO: 9447775 - DNA, 22 bp, Homo sapiens
aaccagatgctttgtggagtta

SEQ ID NO: 9447776 - DNA, 22 bp, Homo sapiens
aaccagatggtgcggcaggaca

SEQ ID NO: 9447777 - DNA, 22 bp, Homo sapiens
aaccagatctgggatgtagcta

SEQ ID NO: 9447778 - DNA, 22 bp, Homo sapiens
aaccagatgcttccccagatgc

SEQ ID NO: 9447779 - DNA, 22 bp, Homo sapiens
aaccagatgctttgtggagtta

SEQ ID NO: 9447780 - DNA, 22 bp, Homo sapiens
aaccagctccagcctccattca

SEQ ID NO: 9447781 - DNA, 22 bp, Homo sapiens
aaccagctaacatgtggaatga

SEQ ID NO: 9447782 - DNA, 22 bp, Homo sapiens
aaccagatcgactgttaacagc

SEQ ID NO: 9447783 - DNA, 22 bp, Homo sapiens
aaccagatctgggatgtagcta

SEQ ID NO: 9447784 - DNA, 22 bp, Homo sapiens
aaccagatattatgaccatgga

SEQ ID NO: 9447785 - DNA, 23 bp, Homo sapiens
aaccagataaatggctccagggc

SEQ ID NO: 9447786 - DNA, 22 bp, Homo sapiens
aaccagatattatgaccatgga

SEQ ID NO: 9447787 - DNA, 22 bp, Homo sapiens
aaccaggaattgcagggctgca

SEQ ID NO: 9447788 - DNA, 19 bp, Homo sapiens
aaccaggaactaaagcaga

SEQ ID NO: 9447789 - DNA, 22 bp, Homo sapiens
aaccaggaaaagttatgaatag

SEQ ID NO: 9447790 - DNA, 22 bp, Homo sapiens
aaccaggaacttttgtgagagc

SEQ ID NO: 9447791 - DNA, 22 bp, Homo sapiens
aaccaggaagggcgcaaattat

SEQ ID NO: 9447792 - DNA, 22 bp, Homo sapiens
aaccaggaattgcagggctgca

SEQ ID NO: 9447793 - DNA, 19 bp, Homo sapiens
aaccaggacaaggggctgg

SEQ ID NO: 9447794 - DNA, 19 bp, Homo sapiens
aaccaggacaaggggctgg

SEQ ID NO: 9447795 - DNA, 22 bp, Homo sapiens
aaccagctctgcaaaatgtcat

SEQ ID NO: 9447796 - DNA, 22 bp, Homo sapiens
aaccagctcctcaccccattgt

SEQ ID NO: 9447797 - DNA, 22 bp, Homo sapiens
aaccagctccagcctccattca

SEQ ID NO: 9447798 - DNA, 22 bp, Homo sapiens
aaccagctttgatacgcattat

SEQ ID NO: 9447799 - DNA, 22 bp, Homo sapiens
aaccagctttgatacgcattat

SEQ ID NO: 9447800 - DNA, 17 bp, Homo sapiens
aaccagctgtcccctcc

SEQ ID NO: 9447801 - DNA, 22 bp, Homo sapiens
aaccagctgagaatgcttctgc

SEQ ID NO: 9447802 - DNA, 22 bp, Homo sapiens
aatcacattacagcatatctgt

SEQ ID NO: 9447803 - DNA, 22 bp, Homo sapiens
aatcacattagtgaaacactga

SEQ ID NO: 9447804 - DNA, 22 bp, Homo sapiens
aatcacatttacattgctaatt

SEQ ID NO: 9447805 - DNA, 22 bp, Homo sapiens
aatcacattgaatctgctacct

SEQ ID NO: 9447806 - DNA, 22 bp, Homo sapiens
aatcacatttacattgctaatt

SEQ ID NO: 9447807 - DNA, 22 bp, Homo sapiens
aatcacattagtgaaacactga

SEQ ID NO: 9447808 - DNA, 22 bp, Homo sapiens
aatcacattagtgaaacactga

SEQ ID NO: 9447809 - DNA, 22 bp, Homo sapiens
aatcacttcagtttttggacag

SEQ ID NO: 9447810 - DNA, 23 bp, Homo sapiens
aatcacttccctccaaatggatt

SEQ ID NO: 9447811 - DNA, 23 bp, Homo sapiens
aatcacttccctccaaatggatt

SEQ ID NO: 9447812 - DNA, 22 bp, Homo sapiens
aatcacttgtgccatgggtacc

SEQ ID NO: 9447813 - DNA, 22 bp, Homo sapiens
aatcacttgtaaggaattcaat

SEQ ID NO: 9447814 - DNA, 22 bp, Homo sapiens
aatcacttgtaaggaattcaat

SEQ ID NO: 9447815 - DNA, 22 bp, Homo sapiens
aatcacatttgcccccatattc

SEQ ID NO: 9447816 - DNA, 22 bp, Homo sapiens
aactccatttccctgcctcctg

SEQ ID NO: 9447817 - DNA, 21 bp, Homo sapiens
aactcccagtgccttcccagc

SEQ ID NO: 9447818 - DNA, 21 bp, Homo sapiens
aactcccagtgccttcccagc

SEQ ID NO: 9447819 - DNA, 20 bp, Homo sapiens
aactcctagcctcaagtgat

SEQ ID NO: 9447820 - DNA, 22 bp, Homo sapiens
aactccagggggtcaatattta

SEQ ID NO: 9447821 - DNA, 22 bp, Homo sapiens
aactccagggggtcaatattta

SEQ ID NO: 9447822 - DNA, 22 bp, Homo sapiens
aactccagggtcaccattcaca

SEQ ID NO: 9447823 - DNA, 22 bp, Homo sapiens
aactccatggttctcagattct

SEQ ID NO: 9447824 - DNA, 22 bp, Homo sapiens
aactccatggttctcagattct

SEQ ID NO: 9447825 - DNA, 22 bp, Homo sapiens
aactcattctaagtataccaaa

SEQ ID NO: 9447826 - DNA, 22 bp, Homo sapiens
aactccagctcacacagtgacc

SEQ ID NO: 9447827 - DNA, 22 bp, Homo sapiens
aactccaggcagggaggccact

SEQ ID NO: 9447828 - DNA, 22 bp, Homo sapiens
aactccaggcagggaggccact

SEQ ID NO: 9447829 - DNA, 22 bp, Homo sapiens
aactcagttacatattagaata

SEQ ID NO: 9447830 - DNA, 22 bp, Homo sapiens
aactcagttacatattagaata

SEQ ID NO: 9447831 - DNA, 22 bp, Homo sapiens
aactcagttacatattagaata

SEQ ID NO: 9447832 - DNA, 22 bp, Homo sapiens
aaccattagtcaatcagcaaga

SEQ ID NO: 9447833 - DNA, 22 bp, Homo sapiens
aaccattcacagtgtagccaaa

SEQ ID NO: 9447834 - DNA, 22 bp, Homo sapiens
aactataatggggttaggaaat

SEQ ID NO: 9447835 - DNA, 22 bp, Homo sapiens
aaccatgtactttattctgttt

SEQ ID NO: 9447836 - DNA, 22 bp, Homo sapiens
aaccattagtcaatcagcaaga

SEQ ID NO: 9447837 - DNA, 22 bp, Homo sapiens
aaccaggtgactcatggtgagc

SEQ ID NO: 9447838 - DNA, 22 bp, Homo sapiens
aaccagtactttacacagctct

SEQ ID NO: 9447839 - DNA, 22 bp, Homo sapiens
aaccaggtgactcatggtgagc

SEQ ID NO: 9447840 - DNA, 22 bp, Homo sapiens
aaccaggatttaagattctaga

SEQ ID NO: 9447841 - DNA, 22 bp, Homo sapiens
aaccaggagattaaagaaaggt

SEQ ID NO: 9447842 - DNA, 22 bp, Homo sapiens
aaccaggagattaaagaaaggt

SEQ ID NO: 9447843 - DNA, 22 bp, Homo sapiens
aaccaggagattaaagaaaggt

SEQ ID NO: 9447844 - DNA, 22 bp, Homo sapiens
aaccagtcccagtgagatgaac

SEQ ID NO: 9447845 - DNA, 22 bp, Homo sapiens
aaccagtttagtcatgctgtaa

SEQ ID NO: 9447846 - DNA, 22 bp, Homo sapiens
aaccagtttagtcatgctgtaa

SEQ ID NO: 9447847 - DNA, 22 bp, Homo sapiens
aaccatgaatgggttctggtgt

SEQ ID NO: 9447848 - DNA, 22 bp, Homo sapiens
aaaggccacttgaaggattttt

SEQ ID NO: 9447849 - DNA, 21 bp, Homo sapiens
aaaggccataatcacggagca

SEQ ID NO: 9447850 - DNA, 22 bp, Homo sapiens
aaaggccaccaacatgaagcat

SEQ ID NO: 9447851 - DNA, 22 bp, Homo sapiens
aaaggccactgcaagggaaggt

SEQ ID NO: 9447852 - DNA, 22 bp, Homo sapiens
aaaggccactgcaagggaaggt

SEQ ID NO: 9447853 - DNA, 22 bp, Homo sapiens
aaaggccaccaacatgaagcat

SEQ ID NO: 9447854 - DNA, 22 bp, Homo sapiens
aaaggccacactgctctttctc

SEQ ID NO: 9447855 - DNA, 22 bp, Homo sapiens
aaaggccacactgctctttctc

SEQ ID NO: 9447856 - DNA, 22 bp, Homo sapiens
aaacactgatggatatttttcc

SEQ ID NO: 9447857 - DNA, 22 bp, Homo sapiens
aaacactgatggatatttttcc

SEQ ID NO: 9447858 - DNA, 22 bp, Homo sapiens
aaaggctagtggattcattgat

SEQ ID NO: 9447859 - DNA, 22 bp, Homo sapiens
aaaggctacgggggccgtgtgc

SEQ ID NO: 9447860 - DNA, 22 bp, Homo sapiens
aaaggctacgggggccgtgtgc

SEQ ID NO: 9447861 - DNA, 22 bp, Homo sapiens
aaaggctaattaaccacctggt

SEQ ID NO: 9447862 - DNA, 22 bp, Homo sapiens
aaaggccattacttgcttttag

SEQ ID NO: 9447863 - DNA, 22 bp, Homo sapiens
aaaggcccacagtcagtctacc

SEQ ID NO: 9447864 - DNA, 22 bp, Homo sapiens
aaaggcccacagtcagtctacc

SEQ ID NO: 9447865 - DNA, 22 bp, Homo sapiens
aaaggcatgtgggctggttgta

SEQ ID NO: 9447866 - DNA, 22 bp, Homo sapiens
aaaggcatgtgcaactacaaat

SEQ ID NO: 9447867 - DNA, 22 bp, Homo sapiens
aaaggcattttaattctaaaga

SEQ ID NO: 9447868 - DNA, 22 bp, Homo sapiens
aaaggccaataaagacaagctg

SEQ ID NO: 9447869 - DNA, 22 bp, Homo sapiens
aaaggccaagcatgaggtggac

SEQ ID NO: 9447870 - DNA, 22 bp, Homo sapiens
aaaggccaataaagacaagctg

SEQ ID NO: 9447871 - DNA, 22 bp, Homo sapiens
aaaggccaataaagacaagctg

SEQ ID NO: 9447872 - DNA, 22 bp, Homo sapiens
aaaggccacacagagcagggag

SEQ ID NO: 9447873 - DNA, 22 bp, Homo sapiens
aaaggccaataaagacaagctg

SEQ ID NO: 9447874 - DNA, 22 bp, Homo sapiens
aaaggccacacagagcagggag

SEQ ID NO: 9447875 - DNA, 22 bp, Homo sapiens
aaaggcatgctgctgaatgatg

SEQ ID NO: 9447876 - DNA, 22 bp, Homo sapiens
aaaggaggaatggagagatgct

SEQ ID NO: 9447877 - DNA, 22 bp, Homo sapiens
aaaggaggaatggagagatgct

SEQ ID NO: 9447878 - DNA, 22 bp, Homo sapiens
aaagcaatgcttgtggaatgta

SEQ ID NO: 9447879 - DNA, 22 bp, Homo sapiens
aaagcaatgcttgtggaatgta

SEQ ID NO: 9447880 - DNA, 22 bp, Homo sapiens
aaagcaatggatgagaatctgt

SEQ ID NO: 9447881 - DNA, 22 bp, Homo sapiens
aaagcaatcagattcagatgtc

SEQ ID NO: 9447882 - DNA, 22 bp, Homo sapiens
aaagcaatagtaatggtaatag

SEQ ID NO: 9447883 - DNA, 22 bp, Homo sapiens
aaagcaatcagattcagatgtc

SEQ ID NO: 9447884 - DNA, 22 bp, Homo sapiens
aaagcaatagtaatggtaatag

SEQ ID NO: 9447885 - DNA, 22 bp, Homo sapiens
aaagcaatcagattcagatgtc

SEQ ID NO: 9447886 - DNA, 22 bp, Homo sapiens
aaagcaatctagttccaattct

SEQ ID NO: 9447887 - DNA, 22 bp, Homo sapiens
aaagcaatcagattcagatgtc

SEQ ID NO: 9447888 - DNA, 22 bp, Homo sapiens
aaagcaatcagattcagatgtc

SEQ ID NO: 9447889 - DNA, 22 bp, Homo sapiens
aaagcaatgcttgtggaatgta

SEQ ID NO: 9447890 - DNA, 22 bp, Homo sapiens
aaagcaatgcccgttcattatc

SEQ ID NO: 9447891 - DNA, 22 bp, Homo sapiens
aaagcaatctagttccaattct

SEQ ID NO: 9447892 - DNA, 22 bp, Homo sapiens
aaagcaatgatggtagacacgt

SEQ ID NO: 9447893 - DNA, 22 bp, Homo sapiens
aaagatgtcatacacattaaga

SEQ ID NO: 9447894 - DNA, 22 bp, Homo sapiens
aaagatgtcatacacattaaga

SEQ ID NO: 9447895 - DNA, 22 bp, Homo sapiens
aaagatgtccaagtaaagttaa

SEQ ID NO: 9447896 - DNA, 22 bp, Homo sapiens
aaagatgtccaagtaaagttaa

SEQ ID NO: 9447897 - DNA, 22 bp, Homo sapiens
aaagatgtcagtttgaaataac

SEQ ID NO: 9447898 - DNA, 22 bp, Homo sapiens
aaagatgtcagtttgaaataac

SEQ ID NO: 9447899 - DNA, 22 bp, Homo sapiens
aaagatgtcagtttgaaataac

SEQ ID NO: 9447900 - DNA, 22 bp, Homo sapiens
aaagatgtcagtttgaaataac

SEQ ID NO: 9447901 - DNA, 22 bp, Homo sapiens
aaagatgtcagtttgaaataac

SEQ ID NO: 9447902 - DNA, 22 bp, Homo sapiens
aaagcaataggttaggtcaaga

SEQ ID NO: 9447903 - DNA, 22 bp, Homo sapiens
aaagatgtgtaagaaataaaca

SEQ ID NO: 9447904 - DNA, 22 bp, Homo sapiens
aaagcaataggttaggtcaaga

SEQ ID NO: 9447905 - DNA, 22 bp, Homo sapiens
aaagatgtccaagtaaagttaa

SEQ ID NO: 9447906 - DNA, 23 bp, Homo sapiens
aaagatgtgagtattcatatggc

SEQ ID NO: 9447907 - DNA, 19 bp, Homo sapiens
aaagatgtccttttgggct

SEQ ID NO: 9447908 - DNA, 22 bp, Homo sapiens
aaagatgtgcctgtttcatagt

SEQ ID NO: 9447909 - DNA, 22 bp, Homo sapiens
aaagatgtgcctgtttcatagt

SEQ ID NO: 9447910 - DNA, 22 bp, Homo sapiens
aaagatgtgcctgtttcatagt

SEQ ID NO: 9447911 - DNA, 22 bp, Homo sapiens
aaacatcataggcatgcatgat

SEQ ID NO: 9447912 - DNA, 22 bp, Homo sapiens
aaacatcataggcatgcatgat

SEQ ID NO: 9447913 - DNA, 22 bp, Homo sapiens
aaacatcataggcatgcatgat

SEQ ID NO: 9447914 - DNA, 20 bp, Homo sapiens
aaacatagtggataccacag

SEQ ID NO: 9447915 - DNA, 22 bp, Homo sapiens
aaacatcaccattttacctaat

SEQ ID NO: 9447916 - DNA, 22 bp, Homo sapiens
aaacatcaccattttacctaat

SEQ ID NO: 9447917 - DNA, 22 bp, Homo sapiens
aaacatcaccattttacctaat

SEQ ID NO: 9447918 - DNA, 22 bp, Homo sapiens
aaacatcaccattttacctaat

SEQ ID NO: 9447919 - DNA, 22 bp, Homo sapiens
aaacatagataatagatagatg

SEQ ID NO: 9447920 - DNA, 22 bp, Homo sapiens
aaacatagataatagatagatg

SEQ ID NO: 9447921 - DNA, 22 bp, Homo sapiens
aaacatagcacacacagctctt

SEQ ID NO: 9447922 - DNA, 20 bp, Homo sapiens
aaacatagtggataccacag

SEQ ID NO: 9447923 - DNA, 22 bp, Homo sapiens
aaacatagataatagatagatg

SEQ ID NO: 9447924 - DNA, 22 bp, Homo sapiens
aaacatagataatagatagatg

SEQ ID NO: 9447925 - DNA, 22 bp, Homo sapiens
aaacatagataatagatagatg

SEQ ID NO: 9447926 - DNA, 22 bp, Homo sapiens
aaagtgctgaagacctagctgt

SEQ ID NO: 9447927 - DNA, 22 bp, Homo sapiens
aaagtgctgagattacaagcgt

SEQ ID NO: 9447928 - DNA, 22 bp, Homo sapiens
aaagtgctgagattacaagcgt

SEQ ID NO: 9447929 - DNA, 22 bp, Homo sapiens
aaagtgctgagattacaagcgt

SEQ ID NO: 9447930 - DNA, 22 bp, Homo sapiens
aaagtgctgggattacaagtgt

SEQ ID NO: 9447931 - DNA, 22 bp, Homo sapiens
aaagtgctgggattacaagcgt

SEQ ID NO: 9447932 - DNA, 22 bp, Homo sapiens
aaagtgctgggattacaagcgt

SEQ ID NO: 9447933 - DNA, 22 bp, Homo sapiens
aaagtgctgggattacaagtgt

SEQ ID NO: 9447934 - DNA, 22 bp, Homo sapiens
aaagtgctgggattacaagcgt

SEQ ID NO: 9447935 - DNA, 22 bp, Homo sapiens
aaagtgctgaagacctagctgt

SEQ ID NO: 9447936 - DNA, 22 bp, Homo sapiens
aaagtgctgaaattacaggtgt

SEQ ID NO: 9447937 - DNA, 22 bp, Homo sapiens
aaagtgctgaaattacaggggt

SEQ ID NO: 9447938 - DNA, 22 bp, Homo sapiens
aaagtgctcggattacaggtat

SEQ ID NO: 9447939 - DNA, 22 bp, Homo sapiens
aaagtgctaggattacaagcgt

SEQ ID NO: 9447940 - DNA, 22 bp, Homo sapiens
aaagtgctaggattacaagcgt

SEQ ID NO: 9447941 - DNA, 22 bp, Homo sapiens
aaagtgctaggattacaagcgt

SEQ ID NO: 9447942 - DNA, 22 bp, Homo sapiens
aaagtgctaagtcacccagcta

SEQ ID NO: 9447943 - DNA, 22 bp, Homo sapiens
aaagtgctgggattataggcat

SEQ ID NO: 9447944 - DNA, 22 bp, Homo sapiens
aaagtgctgggattacaggtgt

SEQ ID NO: 9447945 - DNA, 22 bp, Homo sapiens
aaagtgctgggattataggcat

SEQ ID NO: 9447946 - DNA, 22 bp, Homo sapiens
aaagtgctgggattccaggcgt

SEQ ID NO: 9447947 - DNA, 22 bp, Homo sapiens
aaagtgctgggattacaggcat

SEQ ID NO: 9447948 - DNA, 22 bp, Homo sapiens
aaagtgctgggattacaggcat

SEQ ID NO: 9447949 - DNA, 22 bp, Homo sapiens
aaagtgctgggattacaggcct

SEQ ID NO: 9447950 - DNA, 22 bp, Homo sapiens
aaagtgctgggattacaggcct

SEQ ID NO: 9447951 - DNA, 22 bp, Homo sapiens
aaagtgctgggattacaggcgt

SEQ ID NO: 9447952 - DNA, 22 bp, Homo sapiens
aaagtgctgggattacaggcgt

SEQ ID NO: 9447953 - DNA, 22 bp, Homo sapiens
aaagtgctgggattacaggctt

SEQ ID NO: 9447954 - DNA, 22 bp, Homo sapiens
aaagtgctgggattacaggctt

SEQ ID NO: 9447955 - DNA, 22 bp, Homo sapiens
aaacagttttgccaaaaggaca

SEQ ID NO: 9447956 - DNA, 22 bp, Homo sapiens
aaacagttttgccaaaaggaca

SEQ ID NO: 9447957 - DNA, 22 bp, Homo sapiens
aaacagttttctcatttagtgt

SEQ ID NO: 9447958 - DNA, 22 bp, Homo sapiens
aaacagttttctcatttagtgt

SEQ ID NO: 9447959 - DNA, 22 bp, Homo sapiens
aaagtgctaaataagccctgaa

SEQ ID NO: 9447960 - DNA, 22 bp, Homo sapiens
aaagtgccccagacaagacccc

SEQ ID NO: 9447961 - DNA, 22 bp, Homo sapiens
aaagtgcattgtttgtgttcct

SEQ ID NO: 9447962 - DNA, 22 bp, Homo sapiens
aaagtgccacaactggacaacc

SEQ ID NO: 9447963 - DNA, 23 bp, Homo sapiens
aaagtgcagttgaggaatcatag

SEQ ID NO: 9447964 - DNA, 22 bp, Homo sapiens
aaagtgcatcaaatgacttccc

SEQ ID NO: 9447965 - DNA, 22 bp, Homo sapiens
aaagtgcagtccatgaaattaa

SEQ ID NO: 9447966 - DNA, 22 bp, Homo sapiens
aaagtgcagtccatgaaattaa

SEQ ID NO: 9447967 - DNA, 23 bp, Homo sapiens
aaagtgcagttgaggaatcatag

SEQ ID NO: 9447968 - DNA, 22 bp, Homo sapiens
aaagtcattttccagaccagta

SEQ ID NO: 9447969 - DNA, 22 bp, Homo sapiens
aaacactgtctctggtattgaa

SEQ ID NO: 9447970 - DNA, 22 bp, Homo sapiens
aaacactgtctctggtattgaa

SEQ ID NO: 9447971 - DNA, 22 bp, Homo sapiens
aaacactggcaatttcatgcac

SEQ ID NO: 9447972 - DNA, 22 bp, Homo sapiens
aaacactggcaatttcatgcac

SEQ ID NO: 9447973 - DNA, 22 bp, Homo sapiens
aaacactggcaatttcatgcac

SEQ ID NO: 9447974 - DNA, 22 bp, Homo sapiens
aaacactgcagggtttacttga

SEQ ID NO: 9447975 - DNA, 22 bp, Homo sapiens
aaacactgcagggtttacttga

SEQ ID NO: 9447976 - DNA, 22 bp, Homo sapiens
aaacactgcgtggtggcaactc

SEQ ID NO: 9447977 - DNA, 22 bp, Homo sapiens
aaacactgcgtggtggcaactc

SEQ ID NO: 9447978 - DNA, 22 bp, Homo sapiens
aaacactggtatgatgtatagt

SEQ ID NO: 9447979 - DNA, 22 bp, Homo sapiens
aaacactggtatgatgtatagt

SEQ ID NO: 9447980 - DNA, 22 bp, Homo sapiens
aaacactggtatgatgtatagt

SEQ ID NO: 9447981 - DNA, 20 bp, Homo sapiens
aaacactggctggggcacag

SEQ ID NO: 9447982 - DNA, 22 bp, Homo sapiens
aaacactggtatgatgtatagt

SEQ ID NO: 9447983 - DNA, 22 bp, Homo sapiens
aaacactggtatgatgtatagt

SEQ ID NO: 9447984 - DNA, 22 bp, Homo sapiens
aaacactgtacaatctgcaggg

SEQ ID NO: 9447985 - DNA, 22 bp, Homo sapiens
aaacactgtacaatctgcaggg

SEQ ID NO: 9447986 - DNA, 22 bp, Homo sapiens
aaatactgtgaataaaggtttt

SEQ ID NO: 9447987 - DNA, 22 bp, Homo sapiens
aaatactgtgaataaaggtttt

SEQ ID NO: 9447988 - DNA, 22 bp, Homo sapiens
aaatactgtgaataaaggtttt

SEQ ID NO: 9447989 - DNA, 22 bp, Homo sapiens
aaatactgtagataatagagtt

SEQ ID NO: 9447990 - DNA, 22 bp, Homo sapiens
aaatacagattctgactcagag

SEQ ID NO: 9447991 - DNA, 22 bp, Homo sapiens
aaatagaaaccaacaaggtcag

SEQ ID NO: 9447992 - DNA, 22 bp, Homo sapiens
aaatagaaaccaacaaggtcag

SEQ ID NO: 9447993 - DNA, 22 bp, Homo sapiens
aaatagaaaccaacaaggtcag

SEQ ID NO: 9447994 - DNA, 22 bp, Homo sapiens
aaatactgttttattccatgat

SEQ ID NO: 9447995 - DNA, 22 bp, Homo sapiens
aaatactgttttattccatgat

SEQ ID NO: 9447996 - DNA, 22 bp, Homo sapiens
aaatactgttgaatgaagtaag

SEQ ID NO: 9447997 - DNA, 22 bp, Homo sapiens
aaatactgttgaatgaagtaag

SEQ ID NO: 9447998 - DNA, 22 bp, Homo sapiens
aaatactgttttattccatgat

SEQ ID NO: 9447999 - DNA, 22 bp, Homo sapiens
aaatactgttgaatgaagtaag

SEQ ID NO: 9448000 - DNA, 20 bp, Homo sapiens
aaacgagccatcattctggt

SEQ ID NO: 9448001 - DNA, 20 bp, Homo sapiens
aaacgagccatcattctggt

SEQ ID NO: 9448002 - DNA, 22 bp, Homo sapiens
aaacggaatgagtaagagtatc

SEQ ID NO: 9448003 - DNA, 22 bp, Homo sapiens
aaacggttgctcatagttacat

SEQ ID NO: 9448004 - DNA, 22 bp, Homo sapiens
aaatagaattggaagcagagtt

SEQ ID NO: 9448005 - DNA, 22 bp, Homo sapiens
aaatagaattggaagcagagtt

SEQ ID NO: 9448006 - DNA, 22 bp, Homo sapiens
aaatagaattggaagcagagtt

SEQ ID NO: 9448007 - DNA, 22 bp, Homo sapiens
aaatagaattaactagctactg

SEQ ID NO: 9448008 - DNA, 22 bp, Homo sapiens
aaatagaattggaagcagagtt

SEQ ID NO: 9448009 - DNA, 22 bp, Homo sapiens
aaatagaattggaagcagagtt

SEQ ID NO: 9448010 - DNA, 22 bp, Homo sapiens
aaatagaaaccaacaaggtcag

SEQ ID NO: 9448011 - DNA, 22 bp, Homo sapiens
aaatagaaaccaacaaggtcag

SEQ ID NO: 9448012 - DNA, 22 bp, Homo sapiens
aaatatgtgatcagtgaataaa

SEQ ID NO: 9448013 - DNA, 22 bp, Homo sapiens
aaatatgtgatcagtgaataaa

SEQ ID NO: 9448014 - DNA, 22 bp, Homo sapiens
aaatatgtaagattagcactag

SEQ ID NO: 9448015 - DNA, 22 bp, Homo sapiens
aaatatgtatggagttcatgaa

SEQ ID NO: 9448016 - DNA, 22 bp, Homo sapiens
aaatatgtatggagttcatgaa

SEQ ID NO: 9448017 - DNA, 22 bp, Homo sapiens
aaatatgtaaccaaggtgaagt

SEQ ID NO: 9448018 - DNA, 22 bp, Homo sapiens
aaatatgtaaccaaggtgaagt

SEQ ID NO: 9448019 - DNA, 22 bp, Homo sapiens
aaatatgtaagattagcactag

SEQ ID NO: 9448020 - DNA, 22 bp, Homo sapiens
aaatatgagggtgatgcccaga

SEQ ID NO: 9448021 - DNA, 22 bp, Homo sapiens
aaatatgagggtgatgcccaga

SEQ ID NO: 9448022 - DNA, 22 bp, Homo sapiens
aaactaatgaagtgaagacgct

SEQ ID NO: 9448023 - DNA, 22 bp, Homo sapiens
aaactaatgaagtgaagacgct

SEQ ID NO: 9448024 - DNA, 20 bp, Homo sapiens
aaactaaaggtgtttggttt

SEQ ID NO: 9448025 - DNA, 22 bp, Homo sapiens
aaactaagactaatgaagaact

SEQ ID NO: 9448026 - DNA, 23 bp, Homo sapiens
aaactacatttatagtttttctc

SEQ ID NO: 9448027 - DNA, 22 bp, Homo sapiens
aaactactatgggaatgtactt

SEQ ID NO: 9448028 - DNA, 22 bp, Homo sapiens
aaactactgatgcctgggccct

SEQ ID NO: 9448029 - DNA, 22 bp, Homo sapiens
aaactactggattagtaactta

SEQ ID NO: 9448030 - DNA, 22 bp, Homo sapiens
aaatgcctatttgttccttcag

SEQ ID NO: 9448031 - DNA, 22 bp, Homo sapiens
aaatgcctatttgttccttcag

SEQ ID NO: 9448032 - DNA, 22 bp, Homo sapiens
aaatgcctcattttctctcact

SEQ ID NO: 9448033 - DNA, 22 bp, Homo sapiens
aaatgcctctgggttattctag

SEQ ID NO: 9448034 - DNA, 22 bp, Homo sapiens
aaatgcctcccattctactgac

SEQ ID NO: 9448035 - DNA, 22 bp, Homo sapiens
aaatgctacatacacatcaggg

SEQ ID NO: 9448036 - DNA, 18 bp, Homo sapiens
aaatgctaggctacatga

SEQ ID NO: 9448037 - DNA, 22 bp, Homo sapiens
aaatgctagaacattttaaagg

SEQ ID NO: 9448038 - DNA, 22 bp, Homo sapiens
aaatgctacacaggaattctca

SEQ ID NO: 9448039 - DNA, 22 bp, Homo sapiens
aaatgctacacaggaattctca

SEQ ID NO: 9448040 - DNA, 22 bp, Homo sapiens
aaatgctaacaaggaatgctgc

SEQ ID NO: 9448041 - DNA, 22 bp, Homo sapiens
aaatgctaacaaggaatgctgc

SEQ ID NO: 9448042 - DNA, 22 bp, Homo sapiens
aaatgcctgaatggtatttggt

SEQ ID NO: 9448043 - DNA, 18 bp, Homo sapiens
aaatgctaggctacatga

SEQ ID NO: 9448044 - DNA, 18 bp, Homo sapiens
aaatgctaggctacatga

SEQ ID NO: 9448045 - DNA, 22 bp, Homo sapiens
aaatgctagggagaaactctcc

SEQ ID NO: 9448046 - DNA, 22 bp, Homo sapiens
aaatgctatttgggaacaacat

SEQ ID NO: 9448047 - DNA, 22 bp, Homo sapiens
aaatgctctccaaaatgaaagt

SEQ ID NO: 9448048 - DNA, 22 bp, Homo sapiens
aaatgctcaccacagggatgtg

SEQ ID NO: 9448049 - DNA, 22 bp, Homo sapiens
aaatgctctggggataagactg

SEQ ID NO: 9448050 - DNA, 22 bp, Homo sapiens
aaatgctctggggataagactg

SEQ ID NO: 9448051 - DNA, 22 bp, Homo sapiens
aaatgctctctaatgtaataca

SEQ ID NO: 9448052 - DNA, 22 bp, Homo sapiens
aaatgctctctaatgtaataca

SEQ ID NO: 9448053 - DNA, 22 bp, Homo sapiens
aaatgctctgcatctgatagac

SEQ ID NO: 9448054 - DNA, 22 bp, Homo sapiens
aaatggcagtagaaaagaatcc

SEQ ID NO: 9448055 - DNA, 22 bp, Homo sapiens
aaatgctgagtgtttagagatc

SEQ ID NO: 9448056 - DNA, 22 bp, Homo sapiens
aaatggcaggctctttgctagt

SEQ ID NO: 9448057 - DNA, 22 bp, Homo sapiens
aaatggcaggctctttgctagt

SEQ ID NO: 9448058 - DNA, 22 bp, Homo sapiens
aaatggcagtagaaaagaatcc

SEQ ID NO: 9448059 - DNA, 22 bp, Homo sapiens
aaatgctctggggataagactg

SEQ ID NO: 9448060 - DNA, 22 bp, Homo sapiens
aaatcatggtggaagaaacaga

SEQ ID NO: 9448061 - DNA, 22 bp, Homo sapiens
aaatcatggtggaagaaacaga

SEQ ID NO: 9448062 - DNA, 22 bp, Homo sapiens
aaatcatggtggaagaaacaga

SEQ ID NO: 9448063 - DNA, 22 bp, Homo sapiens
aaatcatgaggacattatgcca

SEQ ID NO: 9448064 - DNA, 22 bp, Homo sapiens
aaatcatagcccccatccgatt

SEQ ID NO: 9448065 - DNA, 22 bp, Homo sapiens
aaatcatagcccccatccgatt

SEQ ID NO: 9448066 - DNA, 22 bp, Homo sapiens
aaatcatgttggcacaataaaa

SEQ ID NO: 9448067 - DNA, 22 bp, Homo sapiens
aaatcatgttggcacaataaaa

SEQ ID NO: 9448068 - DNA, 22 bp, Homo sapiens
aaatcattatttacagttctga

SEQ ID NO: 9448069 - DNA, 22 bp, Homo sapiens
aaatcatgtgcagagatcagga

SEQ ID NO: 9448070 - DNA, 22 bp, Homo sapiens
aaatcatgtgcagagatcagga

SEQ ID NO: 9448071 - DNA, 22 bp, Homo sapiens
aaatcatggtggaagaaacaga

SEQ ID NO: 9448072 - DNA, 22 bp, Homo sapiens
aaatcatggtggaagaaacaga

SEQ ID NO: 9448073 - DNA, 22 bp, Homo sapiens
aaatccaacgacaggtgtactt

SEQ ID NO: 9448074 - DNA, 22 bp, Homo sapiens
aaatccagctacggggcaacat

SEQ ID NO: 9448075 - DNA, 22 bp, Homo sapiens
aaatcattatttacagttctga

SEQ ID NO: 9448076 - DNA, 22 bp, Homo sapiens
aaatcattatttacagttctga

SEQ ID NO: 9448077 - DNA, 22 bp, Homo sapiens
aaatcattatttacagttctga

SEQ ID NO: 9448078 - DNA, 21 bp, Homo sapiens
aaatccaaacactagtccaca

SEQ ID NO: 9448079 - DNA, 22 bp, Homo sapiens
aaatgcagctgggcatgagagg

SEQ ID NO: 9448080 - DNA, 22 bp, Homo sapiens
aaatgcagcctagctcagtttt

SEQ ID NO: 9448081 - DNA, 22 bp, Homo sapiens
aaatccaggagaatttccactt

SEQ ID NO: 9448082 - DNA, 22 bp, Homo sapiens
aaatcagtaaatgttcattaac

SEQ ID NO: 9448083 - DNA, 22 bp, Homo sapiens
aaatcagtaaatgttcattaac

SEQ ID NO: 9448084 - DNA, 22 bp, Homo sapiens
aaatcagtaaatgttcattaac

SEQ ID NO: 9448085 - DNA, 22 bp, Homo sapiens
aaatcagttagtggtaggattg

SEQ ID NO: 9448086 - DNA, 22 bp, Homo sapiens
aaatcagttggaacacaagcag

SEQ ID NO: 9448087 - DNA, 22 bp, Homo sapiens
aaatcagttggaacacaagcag

SEQ ID NO: 9448088 - DNA, 22 bp, Homo sapiens
aaatattagggagaacagggac

SEQ ID NO: 9448089 - DNA, 22 bp, Homo sapiens
aaatatgttttccagttgtcat

SEQ ID NO: 9448090 - DNA, 22 bp, Homo sapiens
aaatattattgcttaaggggag

SEQ ID NO: 9448091 - DNA, 22 bp, Homo sapiens
aaatatgtgatcagtgaataaa

SEQ ID NO: 9448092 - DNA, 22 bp, Homo sapiens
aaatatgtgatcagtgaataaa

SEQ ID NO: 9448093 - DNA, 22 bp, Homo sapiens
aaatatgttttccagttgtcat

SEQ ID NO: 9448094 - DNA, 22 bp, Homo sapiens
aaagatgcctaactcagaagat

SEQ ID NO: 9448095 - DNA, 22 bp, Homo sapiens
aaagatggcccatgatctcttg

SEQ ID NO: 9448096 - DNA, 22 bp, Homo sapiens
aaagatgtcagtcagataggat

SEQ ID NO: 9448097 - DNA, 22 bp, Homo sapiens
aaagatggcccatgatctcttg

SEQ ID NO: 9448098 - DNA, 22 bp, Homo sapiens
aaagatgtcacaagatgtgatg

SEQ ID NO: 9448099 - DNA, 22 bp, Homo sapiens
aaagatgatctacaagttcatt

SEQ ID NO: 9448100 - DNA, 22 bp, Homo sapiens
aaagatgatctacaagttcatt

SEQ ID NO: 9448101 - DNA, 21 bp, Homo sapiens
aaagatgagaactggatggct

SEQ ID NO: 9448102 - DNA, 22 bp, Homo sapiens
aaagatgaccgtatgtcagagc

SEQ ID NO: 9448103 - DNA, 22 bp, Homo sapiens
aaagagctttagaaatctcaga

SEQ ID NO: 9448104 - DNA, 22 bp, Homo sapiens
aaagagctttagaaatctcaga

SEQ ID NO: 9448105 - DNA, 22 bp, Homo sapiens
aaagagctttagaaatctcaga

SEQ ID NO: 9448106 - DNA, 22 bp, Homo sapiens
aaagatcattctctggtccaga

SEQ ID NO: 9448107 - DNA, 22 bp, Homo sapiens
aaagatctccccttcaaagagt

SEQ ID NO: 9448108 - DNA, 22 bp, Homo sapiens
aaagaagagctggaaggagtct

SEQ ID NO: 9448109 - DNA, 22 bp, Homo sapiens
aaagaagagctggaaggagtct

SEQ ID NO: 9448110 - DNA, 22 bp, Homo sapiens
aaagaagcataggctagacttc

SEQ ID NO: 9448111 - DNA, 17 bp, Homo sapiens
aaagagcttggagtgtt

SEQ ID NO: 9448112 - DNA, 18 bp, Homo sapiens
aaagaaggattggagagc

SEQ ID NO: 9448113 - DNA, 22 bp, Homo sapiens
aaagaagcataggctagacttc

SEQ ID NO: 9448114 - DNA, 22 bp, Homo sapiens
aaagaaggacctggaggaggat

SEQ ID NO: 9448115 - DNA, 22 bp, Homo sapiens
aaacttctggctacaagcaata

SEQ ID NO: 9448116 - DNA, 22 bp, Homo sapiens
aaacttgagccaagggcttggg

SEQ ID NO: 9448117 - DNA, 22 bp, Homo sapiens
aaacttgacagtagacagatta

SEQ ID NO: 9448118 - DNA, 22 bp, Homo sapiens
aaacttgacagtagacagatta

SEQ ID NO: 9448119 - DNA, 23 bp, Homo sapiens
aaacttgctatggctgaaatcat

SEQ ID NO: 9448120 - DNA, 23 bp, Homo sapiens
aaacttgctatggctgaaatcat

SEQ ID NO: 9448121 - DNA, 23 bp, Homo sapiens
aaacttgctatggctgaaatcat

SEQ ID NO: 9448122 - DNA, 23 bp, Homo sapiens
aaacttgctatggctgaaatcat

SEQ ID NO: 9448123 - DNA, 22 bp, Homo sapiens
aaacttgagtcacttctcttcc

SEQ ID NO: 9448124 - DNA, 20 bp, Homo sapiens
aaacttgatggcatagaata

SEQ ID NO: 9448125 - DNA, 22 bp, Homo sapiens
aaacttgatttagaactaaggc

SEQ ID NO: 9448126 - DNA, 22 bp, Homo sapiens
aaacttgggtgaccctgagcaa

SEQ ID NO: 9448127 - DNA, 22 bp, Homo sapiens
aaactttaaatttgtacctctg

SEQ ID NO: 9448128 - DNA, 22 bp, Homo sapiens
aaagaacttatcctagaatttg

SEQ ID NO: 9448129 - DNA, 22 bp, Homo sapiens
aaagaactcagagaggatttta

SEQ ID NO: 9448130 - DNA, 22 bp, Homo sapiens
aaagaactacctgtatgatatt

SEQ ID NO: 9448131 - DNA, 22 bp, Homo sapiens
aaagaactacctgtatgatatt

SEQ ID NO: 9448132 - DNA, 22 bp, Homo sapiens
aaactttaggaaggaatttaca

SEQ ID NO: 9448133 - DNA, 22 bp, Homo sapiens
aaacacagggatatatattcca

SEQ ID NO: 9448134 - DNA, 22 bp, Homo sapiens
aaacacagggatatatattcca

SEQ ID NO: 9448135 - DNA, 22 bp, Homo sapiens
aaacacagggatatatattcca

SEQ ID NO: 9448136 - DNA, 20 bp, Homo sapiens
aaacacagcctctctttaca

SEQ ID NO: 9448137 - DNA, 20 bp, Homo sapiens
aaacacagcctctctttaca

SEQ ID NO: 9448138 - DNA, 20 bp, Homo sapiens
aaacacagcctctctttaca

SEQ ID NO: 9448139 - DNA, 20 bp, Homo sapiens
aaacacagcctctctttaca

SEQ ID NO: 9448140 - DNA, 22 bp, Homo sapiens
aaacacagcatgtccttgggga

SEQ ID NO: 9448141 - DNA, 22 bp, Homo sapiens
aaacacagcatgtccttgggga

SEQ ID NO: 9448142 - DNA, 22 bp, Homo sapiens
aaacacagatttctttgtccca

SEQ ID NO: 9448143 - DNA, 22 bp, Homo sapiens
aaacacagatttctttgtccca

SEQ ID NO: 9448144 - DNA, 22 bp, Homo sapiens
aaacacagatttctttgtccca

SEQ ID NO: 9448145 - DNA, 19 bp, Homo sapiens
aaacacagatttcttacca

SEQ ID NO: 9448146 - DNA, 22 bp, Homo sapiens
aaacacagatttctttgtccca

SEQ ID NO: 9448147 - DNA, 19 bp, Homo sapiens
aaacacagatttcttacca

SEQ ID NO: 9448148 - DNA, 19 bp, Homo sapiens
aaacacagatttcttacca

SEQ ID NO: 9448149 - DNA, 19 bp, Homo sapiens
aaacacagatttcttacca

SEQ ID NO: 9448150 - DNA, 19 bp, Homo sapiens
aaacacagatttcttacca

SEQ ID NO: 9448151 - DNA, 22 bp, Homo sapiens
aaacagtctgatgccatctgcc

SEQ ID NO: 9448152 - DNA, 22 bp, Homo sapiens
aaacagtcgtcttaatagtatt

SEQ ID NO: 9448153 - DNA, 22 bp, Homo sapiens
aaacacagggatatatattcca

SEQ ID NO: 9448154 - DNA, 22 bp, Homo sapiens
aaacacagggatatatattcca

SEQ ID NO: 9448155 - DNA, 22 bp, Homo sapiens
aaacacagggatatatattcca

SEQ ID NO: 9448156 - DNA, 22 bp, Homo sapiens
aaacagtcctctttatttagtc

SEQ ID NO: 9448157 - DNA, 22 bp, Homo sapiens
aaacagtcctctttatttagtc

SEQ ID NO: 9448158 - DNA, 22 bp, Homo sapiens
aaacacaggtactgcagaagtg

SEQ ID NO: 9448159 - DNA, 22 bp, Homo sapiens
aaacacaggtactgcagaagtg

SEQ ID NO: 9448160 - DNA, 22 bp, Homo sapiens
aaacacaggtactgcagaagtg

SEQ ID NO: 9448161 - DNA, 22 bp, Homo sapiens
aaacatgagcatctcttcaagc

SEQ ID NO: 9448162 - DNA, 22 bp, Homo sapiens
aaacatgagcacttgcttcata

SEQ ID NO: 9448163 - DNA, 22 bp, Homo sapiens
aaacatgagcacttgcttcata

SEQ ID NO: 9448164 - DNA, 22 bp, Homo sapiens
aaacatgaatagatattaaaca

SEQ ID NO: 9448165 - DNA, 22 bp, Homo sapiens
aaacatcttctcttgattcttt

SEQ ID NO: 9448166 - DNA, 22 bp, Homo sapiens
aaaccacacttagcagtttcgt

SEQ ID NO: 9448167 - DNA, 22 bp, Homo sapiens
aaaccaaacatttgcggtggtg

SEQ ID NO: 9448168 - DNA, 22 bp, Homo sapiens
aaaccaaacatttgcggtggtg

SEQ ID NO: 9448169 - DNA, 22 bp, Homo sapiens
aaaccacagttcagtgcttttg

SEQ ID NO: 9448170 - DNA, 22 bp, Homo sapiens
aaaccacatgccttcaaatgct

SEQ ID NO: 9448171 - DNA, 22 bp, Homo sapiens
aaaccacttatatcgtgatttg

SEQ ID NO: 9448172 - DNA, 22 bp, Homo sapiens
aaaccactcctgattcacttca

SEQ ID NO: 9448173 - DNA, 22 bp, Homo sapiens
aaaccagtgatagactagacac

SEQ ID NO: 9448174 - DNA, 22 bp, Homo sapiens
aaaccattaggttttatctact

SEQ ID NO: 9448175 - DNA, 22 bp, Homo sapiens
aaactgtaaacacagcagtaca

SEQ ID NO: 9448176 - DNA, 22 bp, Homo sapiens
aaaccatttgaattattactga

SEQ ID NO: 9448177 - DNA, 22 bp, Homo sapiens
aaaccattgcatctttcttaat

SEQ ID NO: 9448178 - DNA, 22 bp, Homo sapiens
aaacatgagttaaaagtaactg

SEQ ID NO: 9448179 - DNA, 22 bp, Homo sapiens
aaacatgagttaaaagtaactg

SEQ ID NO: 9448180 - DNA, 22 bp, Homo sapiens
aaacatgagcatctcttcaagc

SEQ ID NO: 9448181 - DNA, 22 bp, Homo sapiens
aaacatgagcatctcttcaagc

SEQ ID NO: 9448182 - DNA, 22 bp, Homo sapiens
aaacatgagcatctcttcaagc

SEQ ID NO: 9448183 - DNA, 22 bp, Homo sapiens
aaacatgagttaaaagtaactg

SEQ ID NO: 9448184 - DNA, 23 bp, Homo sapiens
aaacatttctcttttcctgcctc

SEQ ID NO: 9448185 - DNA, 22 bp, Homo sapiens
aaacatttgcaactcggtttgg

SEQ ID NO: 9448186 - DNA, 22 bp, Homo sapiens
aaacatttttctaggtcttggt

SEQ ID NO: 9448187 - DNA, 22 bp, Homo sapiens
aaaaactggtaactattcccca

SEQ ID NO: 9448188 - DNA, 20 bp, Homo sapiens
aaaaagacaaaacgagttgg

SEQ ID NO: 9448189 - DNA, 19 bp, Homo sapiens
aaaaacttagtccagaaag

SEQ ID NO: 9448190 - DNA, 19 bp, Homo sapiens
aaaaacttagtccagaaag

SEQ ID NO: 9448191 - DNA, 22 bp, Homo sapiens
aaaaagactagtcgagtgcagt

SEQ ID NO: 9448192 - DNA, 22 bp, Homo sapiens
aaaaagacttccaactcaggag

SEQ ID NO: 9448193 - DNA, 22 bp, Homo sapiens
aaaaagacttccaactcaggag

SEQ ID NO: 9448194 - DNA, 22 bp, Homo sapiens
aaaaagacagaggatgaggcag

SEQ ID NO: 9448195 - DNA, 20 bp, Homo sapiens
aaaaagacaaaacgagttgg

SEQ ID NO: 9448196 - DNA, 22 bp, Homo sapiens
aaaaatgaaacggctggttggc

SEQ ID NO: 9448197 - DNA, 22 bp, Homo sapiens
aaaaatgaaacggctggttggc

SEQ ID NO: 9448198 - DNA, 22 bp, Homo sapiens
aaaaatgaaacggctggttggc

SEQ ID NO: 9448199 - DNA, 21 bp, Homo sapiens
aaaaatgaagttgttcaggaa

SEQ ID NO: 9448200 - DNA, 21 bp, Homo sapiens
aaaaatgaagttgttcaggaa

SEQ ID NO: 9448201 - DNA, 21 bp, Homo sapiens
aaaaatgaagttgttcaggaa

SEQ ID NO: 9448202 - DNA, 21 bp, Homo sapiens
aaaaatgaagttgttcaggaa

SEQ ID NO: 9448203 - DNA, 22 bp, Homo sapiens
aaaaatgaattcttcagtggca

SEQ ID NO: 9448204 - DNA, 22 bp, Homo sapiens
aaaaatgaattcttcagtggca

SEQ ID NO: 9448205 - DNA, 22 bp, Homo sapiens
aaaaatgaattcttcagtggca

SEQ ID NO: 9448206 - DNA, 22 bp, Homo sapiens
aaaaagatgtcctgaagtttag

SEQ ID NO: 9448207 - DNA, 22 bp, Homo sapiens
aaaaagatagcattgtgctcct

SEQ ID NO: 9448208 - DNA, 22 bp, Homo sapiens
aaaagtctctctgagtaaaagt

SEQ ID NO: 9448209 - DNA, 22 bp, Homo sapiens
aaaagtctctctgagtaaaagt

SEQ ID NO: 9448210 - DNA, 22 bp, Homo sapiens
aaaagtctctctgagtaaaagt

SEQ ID NO: 9448211 - DNA, 22 bp, Homo sapiens
aaaagtctctctgagtaaaagt

SEQ ID NO: 9448212 - DNA, 19 bp, Homo sapiens
aaaagtctattcaattaca

SEQ ID NO: 9448213 - DNA, 19 bp, Homo sapiens
aaaagtctattcaattaca

SEQ ID NO: 9448214 - DNA, 19 bp, Homo sapiens
aaaagtctattcaattaca

SEQ ID NO: 9448215 - DNA, 19 bp, Homo sapiens
aaaagtctattcaattaca

SEQ ID NO: 9448216 - DNA, 22 bp, Homo sapiens
aaaagtctgctctcatttcaga

SEQ ID NO: 9448217 - DNA, 22 bp, Homo sapiens
aaaagtctgctctcatttcaga

SEQ ID NO: 9448218 - DNA, 22 bp, Homo sapiens
aaaagtattttggatctcagat

SEQ ID NO: 9448219 - DNA, 22 bp, Homo sapiens
aaaagggactactctcagctcc

SEQ ID NO: 9448220 - DNA, 22 bp, Homo sapiens
aaaagggaaagcagaatgactt

SEQ ID NO: 9448221 - DNA, 22 bp, Homo sapiens
aaaagtctacaagcttcaacaa

SEQ ID NO: 9448222 - DNA, 22 bp, Homo sapiens
aaaagtcagtctctcctagctc

SEQ ID NO: 9448223 - DNA, 22 bp, Homo sapiens
aaaagtattttggatctcagat

SEQ ID NO: 9448224 - DNA, 22 bp, Homo sapiens
aaaaggcttggaacctttccct

SEQ ID NO: 9448225 - DNA, 22 bp, Homo sapiens
aaaagggaaagcagaatgactt

SEQ ID NO: 9448226 - DNA, 22 bp, Homo sapiens
aaaaatgtcattatggaactga

SEQ ID NO: 9448227 - DNA, 22 bp, Homo sapiens
aaaaatgcttggacttaataaa

SEQ ID NO: 9448228 - DNA, 22 bp, Homo sapiens
aaaaatgcttggacttaataaa

SEQ ID NO: 9448229 - DNA, 22 bp, Homo sapiens
aaaaatgcttggacttaataaa

SEQ ID NO: 9448230 - DNA, 22 bp, Homo sapiens
aaaaatgcttggacttaataaa

SEQ ID NO: 9448231 - DNA, 22 bp, Homo sapiens
aaaaatgcttggacttaataaa

SEQ ID NO: 9448232 - DNA, 22 bp, Homo sapiens
aaaaatgcttggacttaataaa

SEQ ID NO: 9448233 - DNA, 22 bp, Homo sapiens
aaaaatgctgtggtagctgtgt

SEQ ID NO: 9448234 - DNA, 22 bp, Homo sapiens
aaaaatgaattcttcagtggca

SEQ ID NO: 9448235 - DNA, 22 bp, Homo sapiens
aaaagtgatgggatggcacttc

SEQ ID NO: 9448236 - DNA, 22 bp, Homo sapiens
aaaagtgtccagattatgaaga

SEQ ID NO: 9448237 - DNA, 22 bp, Homo sapiens
aaaatactgtggagtgttgaaa

SEQ ID NO: 9448238 - DNA, 22 bp, Homo sapiens
aaaagtcttggggaaggccagg

SEQ ID NO: 9448239 - DNA, 22 bp, Homo sapiens
aaaagtctgctttctattatca

SEQ ID NO: 9448240 - DNA, 22 bp, Homo sapiens
aaaagtctgctttctattatca

SEQ ID NO: 9448241 - DNA, 22 bp, Homo sapiens
aaaagtcttggggaaggccagg

SEQ ID NO: 9448242 - DNA, 22 bp, Homo sapiens
aaaagtgaggcagcccaaggga

SEQ ID NO: 9448243 - DNA, 22 bp, Homo sapiens
aaaatagattctaggatgtctt

SEQ ID NO: 9448244 - DNA, 22 bp, Homo sapiens
aaaatagattctaggatgtctt

SEQ ID NO: 9448245 - DNA, 22 bp, Homo sapiens
aaaatagattctaggatgtctt

SEQ ID NO: 9448246 - DNA, 22 bp, Homo sapiens
aaaatagataatgccagggtca

SEQ ID NO: 9448247 - DNA, 22 bp, Homo sapiens
aaaatagatgaaaggaagtctg

SEQ ID NO: 9448248 - DNA, 22 bp, Homo sapiens
aaaatagatgaaaggaagtctg

SEQ ID NO: 9448249 - DNA, 22 bp, Homo sapiens
aaaatagatgaaaggaagtctg

SEQ ID NO: 9448250 - DNA, 22 bp, Homo sapiens
aaaatagatgaaaggaagtctg

SEQ ID NO: 9448251 - DNA, 22 bp, Homo sapiens
aaaatagctatggaatgtcact

SEQ ID NO: 9448252 - DNA, 22 bp, Homo sapiens
aaaatagcctcacataattgct

SEQ ID NO: 9448253 - DNA, 22 bp, Homo sapiens
aaaatagcctcacataattgct

SEQ ID NO: 9448254 - DNA, 22 bp, Homo sapiens
aaaatagcctcacataattgct

SEQ ID NO: 9448255 - DNA, 22 bp, Homo sapiens
aaaatagcctcacataattgct

SEQ ID NO: 9448256 - DNA, 22 bp, Homo sapiens
aaaatagcatattgctttcttt

SEQ ID NO: 9448257 - DNA, 22 bp, Homo sapiens
aaaatagcagggatgtgggaaa

SEQ ID NO: 9448258 - DNA, 22 bp, Homo sapiens
aaaattcatggcttgggaaaag

SEQ ID NO: 9448259 - DNA, 22 bp, Homo sapiens
aaaattcatggcttgggaaaag

SEQ ID NO: 9448260 - DNA, 22 bp, Homo sapiens
aaaatagctatggaatgtcact

SEQ ID NO: 9448261 - DNA, 22 bp, Homo sapiens
aaaatagctatggaatgtcact

SEQ ID NO: 9448262 - DNA, 22 bp, Homo sapiens
aaacaactcggcaactgctttt

SEQ ID NO: 9448263 - DNA, 22 bp, Homo sapiens
aaacaactcggcaactgctttt

SEQ ID NO: 9448264 - DNA, 22 bp, Homo sapiens
aaacacaagatggcctcttctg

SEQ ID NO: 9448265 - DNA, 22 bp, Homo sapiens
aaacacaatgtttctttgttct

SEQ ID NO: 9448266 - DNA, 22 bp, Homo sapiens
aaacacaatgtttctttgttct

SEQ ID NO: 9448267 - DNA, 22 bp, Homo sapiens
aaacacacagaaatgaatgagg

SEQ ID NO: 9448268 - DNA, 22 bp, Homo sapiens
aaacacacagaaatgaatgagg

SEQ ID NO: 9448269 - DNA, 22 bp, Homo sapiens
aaacacacagaaatgaatgagg

SEQ ID NO: 9448270 - DNA, 22 bp, Homo sapiens
aaacacacctttggaactgtga

SEQ ID NO: 9448271 - DNA, 22 bp, Homo sapiens
aaacacacctttggaactgtga

SEQ ID NO: 9448272 - DNA, 19 bp, Homo sapiens
aaacacagatttcttacca

SEQ ID NO: 9448273 - DNA, 19 bp, Homo sapiens
aaacacagatttcttacca

SEQ ID NO: 9448274 - DNA, 19 bp, Homo sapiens
aaacacagatttcttacca

SEQ ID NO: 9448275 - DNA, 22 bp, Homo sapiens
aaacaaatagtgcatgggaatt

SEQ ID NO: 9448276 - DNA, 22 bp, Homo sapiens
aaacaaagccagggaagttatg

SEQ ID NO: 9448277 - DNA, 22 bp, Homo sapiens
aaacaaatttcaagctgtgaca

SEQ ID NO: 9448278 - DNA, 22 bp, Homo sapiens
aaacaaacataggtttgaaagt

SEQ ID NO: 9448279 - DNA, 22 bp, Homo sapiens
aaacaaacataggtttgaaagt

SEQ ID NO: 9448280 - DNA, 22 bp, Homo sapiens
aaacaaacataggtttgaaagt

SEQ ID NO: 9448281 - DNA, 17 bp, Homo sapiens
aagacagaagccatgag

SEQ ID NO: 9448282 - DNA, 22 bp, Homo sapiens
aagacactttctaaatagaagt

SEQ ID NO: 9448283 - DNA, 22 bp, Homo sapiens
aagacactttctaaatagaagt

SEQ ID NO: 9448284 - DNA, 22 bp, Homo sapiens
aagacactgggttaggcacgtg

SEQ ID NO: 9448285 - DNA, 22 bp, Homo sapiens
aagacactgatactctgtgatt

SEQ ID NO: 9448286 - DNA, 22 bp, Homo sapiens
aagacactcattatcactggtt

SEQ ID NO: 9448287 - DNA, 22 bp, Homo sapiens
aagacactgggggctgcagcca

SEQ ID NO: 9448288 - DNA, 22 bp, Homo sapiens
aagaattatctgaaagctgtgt

SEQ ID NO: 9448289 - DNA, 22 bp, Homo sapiens
aagacactaagctttcaggata

SEQ ID NO: 9448290 - DNA, 22 bp, Homo sapiens
aagacactaagctttcaggata

SEQ ID NO: 9448291 - DNA, 22 bp, Homo sapiens
aagaatgttcttgtagtcatga

SEQ ID NO: 9448292 - DNA, 22 bp, Homo sapiens
aagaatgttagtttctgataca

SEQ ID NO: 9448293 - DNA, 22 bp, Homo sapiens
aagaatgttcaacgcttttttg

SEQ ID NO: 9448294 - DNA, 22 bp, Homo sapiens
aagacagaccacgtgacagggc

SEQ ID NO: 9448295 - DNA, 17 bp, Homo sapiens
aagacagaagccatgag

SEQ ID NO: 9448296 - DNA, 20 bp, Homo sapiens
aagagaggaagttatactag

SEQ ID NO: 9448297 - DNA, 22 bp, Homo sapiens
aagagcagtgttttactcagct

SEQ ID NO: 9448298 - DNA, 20 bp, Homo sapiens
aagagcatagtacaggaaga

SEQ ID NO: 9448299 - DNA, 22 bp, Homo sapiens
aagagccagtgggaaagtcttg

SEQ ID NO: 9448300 - DNA, 22 bp, Homo sapiens
aagagccaggacagatccagct

SEQ ID NO: 9448301 - DNA, 22 bp, Homo sapiens
aagagccagctagtgaagaggc

SEQ ID NO: 9448302 - DNA, 22 bp, Homo sapiens
aagagccaagcagtcatcaata

SEQ ID NO: 9448303 - DNA, 22 bp, Homo sapiens
aagagccagctagtgaagaggc

SEQ ID NO: 9448304 - DNA, 22 bp, Homo sapiens
aagagcattttgtaaaatcctt

SEQ ID NO: 9448305 - DNA, 22 bp, Homo sapiens
aagagcatttccactggcactg

SEQ ID NO: 9448306 - DNA, 22 bp, Homo sapiens
aagagcatattaatagtggaga

SEQ ID NO: 9448307 - DNA, 22 bp, Homo sapiens
aagaggacttgtgaagatgtac

SEQ ID NO: 9448308 - DNA, 22 bp, Homo sapiens
aagaggacttgtgaagatgtac

SEQ ID NO: 9448309 - DNA, 22 bp, Homo sapiens
aagaggaagtctccatggagag

SEQ ID NO: 9448310 - DNA, 22 bp, Homo sapiens
aagaggaccagtagataaattt

SEQ ID NO: 9448311 - DNA, 22 bp, Homo sapiens
aagaggacagtattcaatatga

SEQ ID NO: 9448312 - DNA, 20 bp, Homo sapiens
aagagcccgcagggcagtgc

SEQ ID NO: 9448313 - DNA, 22 bp, Homo sapiens
aagagccatatatgcagctaga

SEQ ID NO: 9448314 - DNA, 22 bp, Homo sapiens
aagagccatatatgcagctaga

SEQ ID NO: 9448315 - DNA, 22 bp, Homo sapiens
aagaggaagtctccatggagag

SEQ ID NO: 9448316 - DNA, 22 bp, Homo sapiens
aagagcctggctgctaggctca

SEQ ID NO: 9448317 - DNA, 22 bp, Homo sapiens
aagagcctccctagaggtgaag

SEQ ID NO: 9448318 - DNA, 22 bp, Homo sapiens
aagaaagggctattgttctcca

SEQ ID NO: 9448319 - DNA, 22 bp, Homo sapiens
aagaaagggctattgttctcca

SEQ ID NO: 9448320 - DNA, 22 bp, Homo sapiens
aagaaaggtgtgtttgcagatg

SEQ ID NO: 9448321 - DNA, 22 bp, Homo sapiens
aagaaaggtgtgtttgcagatg

SEQ ID NO: 9448322 - DNA, 22 bp, Homo sapiens
aagaaaggtctctgcccgctat

SEQ ID NO: 9448323 - DNA, 22 bp, Homo sapiens
aagaaagtgggtaatatgattt

SEQ ID NO: 9448324 - DNA, 22 bp, Homo sapiens
aagaagttaggtgtaacaatat

SEQ ID NO: 9448325 - DNA, 22 bp, Homo sapiens
aagaagttctgcctaagggaca

SEQ ID NO: 9448326 - DNA, 22 bp, Homo sapiens
aagaagttaggtgtaacaatat

SEQ ID NO: 9448327 - DNA, 22 bp, Homo sapiens
aagaatgagctcaaagatctta

SEQ ID NO: 9448328 - DNA, 22 bp, Homo sapiens
aagaatgagctcaaagatctta

SEQ ID NO: 9448329 - DNA, 22 bp, Homo sapiens
aagaatgattacaaagcaacga

SEQ ID NO: 9448330 - DNA, 22 bp, Homo sapiens
aagaatgattacaaagcaacga

SEQ ID NO: 9448331 - DNA, 22 bp, Homo sapiens
aagaatgattacaaagcaacga

SEQ ID NO: 9448332 - DNA, 22 bp, Homo sapiens
aagaatgattacaaagcaacga

SEQ ID NO: 9448333 - DNA, 22 bp, Homo sapiens
aagaatgattacaaagcaacga

SEQ ID NO: 9448334 - DNA, 22 bp, Homo sapiens
aagaatgagctcaaagatctta

SEQ ID NO: 9448335 - DNA, 22 bp, Homo sapiens
aagaatgagctcaaagatctta

SEQ ID NO: 9448336 - DNA, 22 bp, Homo sapiens
aagaatgagctcaaagatctta

SEQ ID NO: 9448337 - DNA, 22 bp, Homo sapiens
aagaatgtcgttggtattttaa

SEQ ID NO: 9448338 - DNA, 22 bp, Homo sapiens
aagaatgcatcaaaagtcagag

SEQ ID NO: 9448339 - DNA, 22 bp, Homo sapiens
aagaatgtgctaatgaaaactt

SEQ ID NO: 9448340 - DNA, 22 bp, Homo sapiens
aagaatgtggcatttatttata

SEQ ID NO: 9448341 - DNA, 22 bp, Homo sapiens
aagaatgtgggtggatatgatg

SEQ ID NO: 9448342 - DNA, 22 bp, Homo sapiens
aagaatgtgggtggatatgatg

SEQ ID NO: 9448343 - DNA, 22 bp, Homo sapiens
aacttttcattgaatcatgtca

SEQ ID NO: 9448344 - DNA, 22 bp, Homo sapiens
aacttttcattccaaaggtgct

SEQ ID NO: 9448345 - DNA, 22 bp, Homo sapiens
aacttttcattgaatcatgtca

SEQ ID NO: 9448346 - DNA, 22 bp, Homo sapiens
aacttttcataagggcaaattt

SEQ ID NO: 9448347 - DNA, 22 bp, Homo sapiens
aacttttcataagggcaaattt

SEQ ID NO: 9448348 - DNA, 22 bp, Homo sapiens
aacttttcataagggcaaattt

SEQ ID NO: 9448349 - DNA, 22 bp, Homo sapiens
aacttttcacaggctagctctt

SEQ ID NO: 9448350 - DNA, 22 bp, Homo sapiens
aacttttcacaggctagctctt

SEQ ID NO: 9448351 - DNA, 22 bp, Homo sapiens
aacttttacaaattgtcatcat

SEQ ID NO: 9448352 - DNA, 22 bp, Homo sapiens
aacttttacaaattgtcatcat

SEQ ID NO: 9448353 - DNA, 22 bp, Homo sapiens
aacttttacaaattgtcatcat

SEQ ID NO: 9448354 - DNA, 22 bp, Homo sapiens
aacttttaaaatacacagacaa

SEQ ID NO: 9448355 - DNA, 23 bp, Homo sapiens
aacttttagagtttaacagtgtt

SEQ ID NO: 9448356 - DNA, 22 bp, Homo sapiens
aacttttagacttgggtataaa

SEQ ID NO: 9448357 - DNA, 22 bp, Homo sapiens
aagaaagggagaaggatggtgt

SEQ ID NO: 9448358 - DNA, 22 bp, Homo sapiens
aagaaaggatatatgggaggta

SEQ ID NO: 9448359 - DNA, 22 bp, Homo sapiens
aacttttctgtgttgtccggga

SEQ ID NO: 9448360 - DNA, 22 bp, Homo sapiens
aacttttgtccgatctcctgga

SEQ ID NO: 9448361 - DNA, 22 bp, Homo sapiens
aagaaagccaaagttcatacct

SEQ ID NO: 9448362 - DNA, 22 bp, Homo sapiens
aagaaagctgaatattctgtgt

SEQ ID NO: 9448363 - DNA, 22 bp, Homo sapiens
aactttggcaagtcagacttct

SEQ ID NO: 9448364 - DNA, 22 bp, Homo sapiens
aactttgctggaaaattggagc

SEQ ID NO: 9448365 - DNA, 22 bp, Homo sapiens
aactttgcttttgtgggtaaag

SEQ ID NO: 9448366 - DNA, 22 bp, Homo sapiens
aactttgcttgggtcaaactca

SEQ ID NO: 9448367 - DNA, 22 bp, Homo sapiens
aactttggtattcgacagctct

SEQ ID NO: 9448368 - DNA, 22 bp, Homo sapiens
aactttggtcagagaaattgtg

SEQ ID NO: 9448369 - DNA, 22 bp, Homo sapiens
aactttgttttattcactgctg

SEQ ID NO: 9448370 - DNA, 22 bp, Homo sapiens
aactttgttttattcactgctg

SEQ ID NO: 9448371 - DNA, 22 bp, Homo sapiens
aactttcttgtgacatttgggg

SEQ ID NO: 9448372 - DNA, 19 bp, Homo sapiens
aacttgctttaaaaccata

SEQ ID NO: 9448373 - DNA, 22 bp, Homo sapiens
aactttcttgtgacatttgggg

SEQ ID NO: 9448374 - DNA, 20 bp, Homo sapiens
aactttgcattttattctcc

SEQ ID NO: 9448375 - DNA, 20 bp, Homo sapiens
aactttgcattttattctcc

SEQ ID NO: 9448376 - DNA, 22 bp, Homo sapiens
aactttgcataactaactacag

SEQ ID NO: 9448377 - DNA, 22 bp, Homo sapiens
aactttgagtcattgcctcttt

SEQ ID NO: 9448378 - DNA, 18 bp, Homo sapiens
aagaggaggaaacccagg

SEQ ID NO: 9448379 - DNA, 22 bp, Homo sapiens
aagaggagacttcagcaacttg

SEQ ID NO: 9448380 - DNA, 18 bp, Homo sapiens
aagaggaggagcaggttg

SEQ ID NO: 9448381 - DNA, 22 bp, Homo sapiens
aagcaaagagataaccttttgg

SEQ ID NO: 9448382 - DNA, 22 bp, Homo sapiens
aagattctgaaaggggtggggc

SEQ ID NO: 9448383 - DNA, 22 bp, Homo sapiens
aagattctccctgagatattta

SEQ ID NO: 9448384 - DNA, 22 bp, Homo sapiens
aagattctccctgagatattta

SEQ ID NO: 9448385 - DNA, 22 bp, Homo sapiens
aagattctcagagtgaaagaat

SEQ ID NO: 9448386 - DNA, 22 bp, Homo sapiens
aagattctcagaaaaaggctat

SEQ ID NO: 9448387 - DNA, 22 bp, Homo sapiens
aagattctcagagtgaaagaat

SEQ ID NO: 9448388 - DNA, 22 bp, Homo sapiens
aagcaaaggcaggagcttgtga

SEQ ID NO: 9448389 - DNA, 22 bp, Homo sapiens
aagcaaagagataaccttttgg

SEQ ID NO: 9448390 - DNA, 22 bp, Homo sapiens
aagcaaagagtttagtgggtga

SEQ ID NO: 9448391 - DNA, 22 bp, Homo sapiens
aagcaaagagtttagtgggtga

SEQ ID NO: 9448392 - DNA, 22 bp, Homo sapiens
aagcaaaggaaagctgactttt

SEQ ID NO: 9448393 - DNA, 22 bp, Homo sapiens
aagcaaaggcaggagcttgtga

SEQ ID NO: 9448394 - DNA, 22 bp, Homo sapiens
aagcaaaggcaggagcttgtga

SEQ ID NO: 9448395 - DNA, 22 bp, Homo sapiens
aagcaaaggcaggagcttgtga

SEQ ID NO: 9448396 - DNA, 22 bp, Homo sapiens
aagcaaagtgaattttgccaag

SEQ ID NO: 9448397 - DNA, 22 bp, Homo sapiens
aagcaaagtgaattttgccaag

SEQ ID NO: 9448398 - DNA, 22 bp, Homo sapiens
aagcaaagtgctttgcctccag

SEQ ID NO: 9448399 - DNA, 22 bp, Homo sapiens
aagcaaattctggaggtgaggt

SEQ ID NO: 9448400 - DNA, 22 bp, Homo sapiens
aagcaacagaaacattctaata

SEQ ID NO: 9448401 - DNA, 22 bp, Homo sapiens
aagcaacagaaacattctaata

SEQ ID NO: 9448402 - DNA, 22 bp, Homo sapiens
aagcaaatatttctagagactg

SEQ ID NO: 9448403 - DNA, 22 bp, Homo sapiens
aagcaaatgaaccagaggtaat

SEQ ID NO: 9448404 - DNA, 22 bp, Homo sapiens
aagcaaatgtgggtgcagaatt

SEQ ID NO: 9448405 - DNA, 22 bp, Homo sapiens
aagcacctgggttatatcttag

SEQ ID NO: 9448406 - DNA, 22 bp, Homo sapiens
aagcacagctggaacagcagga

SEQ ID NO: 9448407 - DNA, 22 bp, Homo sapiens
aaatatgaatgataagagttat

SEQ ID NO: 9448408 - DNA, 22 bp, Homo sapiens
aaatatgaatgataagagttat

SEQ ID NO: 9448409 - DNA, 22 bp, Homo sapiens
aaatatcttaggagtatatgag

SEQ ID NO: 9448410 - DNA, 22 bp, Homo sapiens
aaatatcttaggagtatatgag

SEQ ID NO: 9448411 - DNA, 22 bp, Homo sapiens
aaatatcttaggagtatatgag

SEQ ID NO: 9448412 - DNA, 22 bp, Homo sapiens
aaatatcctcagggcagaggtg

SEQ ID NO: 9448413 - DNA, 22 bp, Homo sapiens
aaatatcatttataacttttaa

SEQ ID NO: 9448414 - DNA, 22 bp, Homo sapiens
aaatatcatttataacttttaa

SEQ ID NO: 9448415 - DNA, 22 bp, Homo sapiens
aaatatcattctggtgcacaga

SEQ ID NO: 9448416 - DNA, 22 bp, Homo sapiens
aaatatcattctggtgcacaga

SEQ ID NO: 9448417 - DNA, 19 bp, Homo sapiens
aaatatcagagagatgata

SEQ ID NO: 9448418 - DNA, 19 bp, Homo sapiens
aaatatcagagagatgata

SEQ ID NO: 9448419 - DNA, 22 bp, Homo sapiens
aagcaactgttgaattggacta

SEQ ID NO: 9448420 - DNA, 22 bp, Homo sapiens
aagcaactcctaggaggaaagg

SEQ ID NO: 9448421 - DNA, 22 bp, Homo sapiens
aagcaaatgaaccagaggtaat

SEQ ID NO: 9448422 - DNA, 22 bp, Homo sapiens
aagcaacattctctgtggcatt

SEQ ID NO: 9448423 - DNA, 22 bp, Homo sapiens
aagcaacattctctgtggcatt

SEQ ID NO: 9448424 - DNA, 22 bp, Homo sapiens
aagcaactccctcctcattttt

SEQ ID NO: 9448425 - DNA, 20 bp, Homo sapiens
aagcactgtggtggcatgga

SEQ ID NO: 9448426 - DNA, 22 bp, Homo sapiens
aagcactgggtatagcaatgat

SEQ ID NO: 9448427 - DNA, 22 bp, Homo sapiens
aagcactggggccacagacacg

SEQ ID NO: 9448428 - DNA, 22 bp, Homo sapiens
aagcactgggtatagcaatgat

SEQ ID NO: 9448429 - DNA, 22 bp, Homo sapiens
aagcactgtgcctcatatctga

SEQ ID NO: 9448430 - DNA, 22 bp, Homo sapiens
aagcactgtacaaatgtcactt

SEQ ID NO: 9448431 - DNA, 22 bp, Homo sapiens
aagcactgagcacagtggctga

SEQ ID NO: 9448432 - DNA, 22 bp, Homo sapiens
aagcactgagcacagtggctga

SEQ ID NO: 9448433 - DNA, 22 bp, Homo sapiens
aagcactgggaggaggctgaga

SEQ ID NO: 9448434 - DNA, 22 bp, Homo sapiens
aagcactggagatgccagagtg

SEQ ID NO: 9448435 - DNA, 22 bp, Homo sapiens
aagcactgaggaaaaatttgat

SEQ ID NO: 9448436 - DNA, 22 bp, Homo sapiens
aagcactgaggaaaaatttgat

SEQ ID NO: 9448437 - DNA, 22 bp, Homo sapiens
aagcactggagatgccagagtg

SEQ ID NO: 9448438 - DNA, 22 bp, Homo sapiens
aagcagatgccaagatttacca

SEQ ID NO: 9448439 - DNA, 22 bp, Homo sapiens
aagcagatgggactccaaggca

SEQ ID NO: 9448440 - DNA, 22 bp, Homo sapiens
aagcagatgcagctaataaagc

SEQ ID NO: 9448441 - DNA, 22 bp, Homo sapiens
aagcagaaagaacaactgagtg

SEQ ID NO: 9448442 - DNA, 22 bp, Homo sapiens
aagcagaaagaacaactgagtg

SEQ ID NO: 9448443 - DNA, 22 bp, Homo sapiens
aagcagaaagaacaactgagtg

SEQ ID NO: 9448444 - DNA, 22 bp, Homo sapiens
aagcagaaaaactgagctccaa

SEQ ID NO: 9448445 - DNA, 22 bp, Homo sapiens
aagcagaaaaactgagctccaa

SEQ ID NO: 9448446 - DNA, 22 bp, Homo sapiens
aagcagaactgggaagtagtgg

SEQ ID NO: 9448447 - DNA, 22 bp, Homo sapiens
aagcagagtgatataaacatgg

SEQ ID NO: 9448448 - DNA, 22 bp, Homo sapiens
aagcagagttagcttgtcacct

SEQ ID NO: 9448449 - DNA, 22 bp, Homo sapiens
aagccagattccttaagcacag

SEQ ID NO: 9448450 - DNA, 22 bp, Homo sapiens
aagccagattccttaagcacag

SEQ ID NO: 9448451 - DNA, 22 bp, Homo sapiens
aagccagattccttaagcacag

SEQ ID NO: 9448452 - DNA, 22 bp, Homo sapiens
aagccagagtttttgagaactt

SEQ ID NO: 9448453 - DNA, 22 bp, Homo sapiens
aagccagagtttttgagaactt

SEQ ID NO: 9448454 - DNA, 18 bp, Homo sapiens
aagccagagaccactgcc

SEQ ID NO: 9448455 - DNA, 22 bp, Homo sapiens
aagccactgttttggagtgctt

SEQ ID NO: 9448456 - DNA, 22 bp, Homo sapiens
aagccacttggggaaagatgga

SEQ ID NO: 9448457 - DNA, 22 bp, Homo sapiens
aagccacaatctgcatcagcat

SEQ ID NO: 9448458 - DNA, 22 bp, Homo sapiens
aagccactatggtgattctcaa

SEQ ID NO: 9448459 - DNA, 22 bp, Homo sapiens
aagccacaatctgcatcagcat

SEQ ID NO: 9448460 - DNA, 22 bp, Homo sapiens
aagccactgagatttcactgca

SEQ ID NO: 9448461 - DNA, 22 bp, Homo sapiens
aagcatggtggatgatacagtg

SEQ ID NO: 9448462 - DNA, 22 bp, Homo sapiens
aacacatatttatatatgcaca

SEQ ID NO: 9448463 - DNA, 22 bp, Homo sapiens
aacacatatttatatatgcaca

SEQ ID NO: 9448464 - DNA, 22 bp, Homo sapiens
aacacataggcagagcatgaca

SEQ ID NO: 9448465 - DNA, 22 bp, Homo sapiens
aacacatatttatatatgcaca

SEQ ID NO: 9448466 - DNA, 22 bp, Homo sapiens
aacacatatttatatatgcaca

SEQ ID NO: 9448467 - DNA, 22 bp, Homo sapiens
aacacatgccttaagaataagt

SEQ ID NO: 9448468 - DNA, 22 bp, Homo sapiens
aacacatggcaagagcaggaaa

SEQ ID NO: 9448469 - DNA, 22 bp, Homo sapiens
aacacatgggtgtttattgtac

SEQ ID NO: 9448470 - DNA, 22 bp, Homo sapiens
aacacattgccagagatcagca

SEQ ID NO: 9448471 - DNA, 23 bp, Homo sapiens
aacacattgctaattacattcaa

SEQ ID NO: 9448472 - DNA, 23 bp, Homo sapiens
aacacattgctaattacattcaa

SEQ ID NO: 9448473 - DNA, 22 bp, Homo sapiens
aacacatgggtgtttattgtac

SEQ ID NO: 9448474 - DNA, 22 bp, Homo sapiens
aacagcagcatgacagctgggt

SEQ ID NO: 9448475 - DNA, 22 bp, Homo sapiens
aacagcagctgaggagctgggc

SEQ ID NO: 9448476 - DNA, 22 bp, Homo sapiens
aacagcagcatgacagctgggt

SEQ ID NO: 9448477 - DNA, 22 bp, Homo sapiens
aacagcagcatgacagctgggt

SEQ ID NO: 9448478 - DNA, 22 bp, Homo sapiens
aacagctttagaggataatagt

SEQ ID NO: 9448479 - DNA, 22 bp, Homo sapiens
aacagcttgctgcaccttaata

SEQ ID NO: 9448480 - DNA, 22 bp, Homo sapiens
aacagctttgagcagttctgta

SEQ ID NO: 9448481 - DNA, 22 bp, Homo sapiens
aacagctttgagcagttctgta

SEQ ID NO: 9448482 - DNA, 22 bp, Homo sapiens
aacagctttgcttctggagaca

SEQ ID NO: 9448483 - DNA, 22 bp, Homo sapiens
aacagctttgtatacagtaact

SEQ ID NO: 9448484 - DNA, 22 bp, Homo sapiens
aacagctttgcttctggagaca

SEQ ID NO: 9448485 - DNA, 22 bp, Homo sapiens
aacagcttttttggtcagcatt

SEQ ID NO: 9448486 - DNA, 22 bp, Homo sapiens
aacagctttgtgctcagatttg

SEQ ID NO: 9448487 - DNA, 22 bp, Homo sapiens
aacacaaagaagctgcaggatc

SEQ ID NO: 9448488 - DNA, 22 bp, Homo sapiens
aacacaaagaagctgcaggatc

SEQ ID NO: 9448489 - DNA, 22 bp, Homo sapiens
aacacaaaaattctcaggggca

SEQ ID NO: 9448490 - DNA, 22 bp, Homo sapiens
aacacaaaaattctcaggggca

SEQ ID NO: 9448491 - DNA, 22 bp, Homo sapiens
aacacaaaaattctcaggggca

SEQ ID NO: 9448492 - DNA, 22 bp, Homo sapiens
aacacaaaaattctcaggggca

SEQ ID NO: 9448493 - DNA, 22 bp, Homo sapiens
aacaattgacacttcattgtga

SEQ ID NO: 9448494 - DNA, 22 bp, Homo sapiens
aacacaaaaattctcaggggca

SEQ ID NO: 9448495 - DNA, 22 bp, Homo sapiens
aacaattatcatatacattgca

SEQ ID NO: 9448496 - DNA, 22 bp, Homo sapiens
aacaattatcatatacattgca

SEQ ID NO: 9448497 - DNA, 22 bp, Homo sapiens
aacaattatcatatacattgca

SEQ ID NO: 9448498 - DNA, 22 bp, Homo sapiens
aacacataggcagagcatgaca

SEQ ID NO: 9448499 - DNA, 23 bp, Homo sapiens
aacacaaagctgattccagtggc

SEQ ID NO: 9448500 - DNA, 23 bp, Homo sapiens
aacacaaagctgattccagtggc

SEQ ID NO: 9448501 - DNA, 23 bp, Homo sapiens
aacacaaagctgattccagtggc

SEQ ID NO: 9448502 - DNA, 22 bp, Homo sapiens
aacacaaagaagctgcaggatc

SEQ ID NO: 9448503 - DNA, 23 bp, Homo sapiens
aacacaaagctgattccagtggc

SEQ ID NO: 9448504 - DNA, 23 bp, Homo sapiens
aacacaaagctgattccagtggc

SEQ ID NO: 9448505 - DNA, 22 bp, Homo sapiens
aacacaaagaagctgcaggatc

SEQ ID NO: 9448506 - DNA, 22 bp, Homo sapiens
aacaattactaccaaggcctgt

SEQ ID NO: 9448507 - DNA, 22 bp, Homo sapiens
aacaattactaccaaggcctgt

SEQ ID NO: 9448508 - DNA, 22 bp, Homo sapiens
aacaattagactgacggtatta

SEQ ID NO: 9448509 - DNA, 22 bp, Homo sapiens
aacaatgttcttttagcttgaa

SEQ ID NO: 9448510 - DNA, 22 bp, Homo sapiens
aacaattactaccaaggcctgt

SEQ ID NO: 9448511 - DNA, 22 bp, Homo sapiens
aacaatgtgattgaagctagaa

SEQ ID NO: 9448512 - DNA, 22 bp, Homo sapiens
aacaagaagggaaggcatgatt

SEQ ID NO: 9448513 - DNA, 22 bp, Homo sapiens
aacaagaataagtggtttctgg

SEQ ID NO: 9448514 - DNA, 22 bp, Homo sapiens
aacaagaataagtggtttctgg

SEQ ID NO: 9448515 - DNA, 22 bp, Homo sapiens
aacaagaagggaaggcatgatt

SEQ ID NO: 9448516 - DNA, 22 bp, Homo sapiens
aacaacttgcgttcagagatgt

SEQ ID NO: 9448517 - DNA, 22 bp, Homo sapiens
aacaagaacacctacagttcta

SEQ ID NO: 9448518 - DNA, 22 bp, Homo sapiens
aacaagaacacctacagttcta

SEQ ID NO: 9448519 - DNA, 22 bp, Homo sapiens
aacaaattagttgcaagactgg

SEQ ID NO: 9448520 - DNA, 22 bp, Homo sapiens
aacaaattagttgcaagactgg

SEQ ID NO: 9448521 - DNA, 22 bp, Homo sapiens
aacaacaacggagaaagggttg

SEQ ID NO: 9448522 - DNA, 22 bp, Homo sapiens
aacaaatttagctctgagtgct

SEQ ID NO: 9448523 - DNA, 22 bp, Homo sapiens
aacaacaacggagaaagggttg

SEQ ID NO: 9448524 - DNA, 22 bp, Homo sapiens
aacaacagctgctaaagagttg

SEQ ID NO: 9448525 - DNA, 22 bp, Homo sapiens
aacaacagctgctaaagagttg

SEQ ID NO: 9448526 - DNA, 22 bp, Homo sapiens
aacaacagtgagtgctgggagg

SEQ ID NO: 9448527 - DNA, 22 bp, Homo sapiens
aaagcactatagccaaatagcc

SEQ ID NO: 9448528 - DNA, 22 bp, Homo sapiens
aaagcacatgagtagtgtagta

SEQ ID NO: 9448529 - DNA, 22 bp, Homo sapiens
aaagcacagagctcccacagga

SEQ ID NO: 9448530 - DNA, 22 bp, Homo sapiens
aaagcaatttaatggaccatga

SEQ ID NO: 9448531 - DNA, 22 bp, Homo sapiens
aaagcacagggtgctagagagt

SEQ ID NO: 9448532 - DNA, 22 bp, Homo sapiens
aaagcacagggtgctagagagt

SEQ ID NO: 9448533 - DNA, 22 bp, Homo sapiens
aaagcacagggtgctagagagt

SEQ ID NO: 9448534 - DNA, 22 bp, Homo sapiens
aaatggtaagacaacacattat

SEQ ID NO: 9448535 - DNA, 22 bp, Homo sapiens
aaatggtccatcctaaagaagt

SEQ ID NO: 9448536 - DNA, 22 bp, Homo sapiens
aaatggtatgaaaagagatttc

SEQ ID NO: 9448537 - DNA, 22 bp, Homo sapiens
aaatggtataatgtcatgtatt

SEQ ID NO: 9448538 - DNA, 22 bp, Homo sapiens
aaatggtataatgtcatgtatt

SEQ ID NO: 9448539 - DNA, 22 bp, Homo sapiens
aaatgggcctggaaagaggatg

SEQ ID NO: 9448540 - DNA, 19 bp, Homo sapiens
aaatggctttctacttaat

SEQ ID NO: 9448541 - DNA, 22 bp, Homo sapiens
aaatggctacaagatgtgctct

SEQ ID NO: 9448542 - DNA, 18 bp, Homo sapiens
aaatggctacctttgtca

SEQ ID NO: 9448543 - DNA, 22 bp, Homo sapiens
aaatggtccatcctaaagaagt

SEQ ID NO: 9448544 - DNA, 22 bp, Homo sapiens
aaagcaagtctctacaaagtac

SEQ ID NO: 9448545 - DNA, 22 bp, Homo sapiens
aaagcaagtctctacaaagtac

SEQ ID NO: 9448546 - DNA, 22 bp, Homo sapiens
aaagcaatgggtctaaggtaaa

SEQ ID NO: 9448547 - DNA, 22 bp, Homo sapiens
aaagcaatgggtctaaggtaaa

SEQ ID NO: 9448548 - DNA, 22 bp, Homo sapiens
aaagcaatagagggtaagactg

SEQ ID NO: 9448549 - DNA, 22 bp, Homo sapiens
aaagcaatggcacatgatggta

SEQ ID NO: 9448550 - DNA, 22 bp, Homo sapiens
aaagcaatagagggtaagactg

SEQ ID NO: 9448551 - DNA, 22 bp, Homo sapiens
aaagcaatagagggtaagactg

SEQ ID NO: 9448552 - DNA, 22 bp, Homo sapiens
aaagcaattgtggtttttgcca

SEQ ID NO: 9448553 - DNA, 22 bp, Homo sapiens
aaagcaattgtggtttttgtca

SEQ ID NO: 9448554 - DNA, 22 bp, Homo sapiens
aaagcaattgtggtttttgtca

SEQ ID NO: 9448555 - DNA, 22 bp, Homo sapiens
aaagcaattacaaaagggataa

SEQ ID NO: 9448556 - DNA, 22 bp, Homo sapiens
aaagcaatgggtctaaggtaaa

SEQ ID NO: 9448557 - DNA, 22 bp, Homo sapiens
aaagcaatgtctctgcctggtt

SEQ ID NO: 9448558 - DNA, 22 bp, Homo sapiens
aacattcaaaacccagttcagt

SEQ ID NO: 9448559 - DNA, 22 bp, Homo sapiens
aacattcaaaacccagttcagt

SEQ ID NO: 9448560 - DNA, 22 bp, Homo sapiens
aacattcaaaacccagttcagt

SEQ ID NO: 9448561 - DNA, 22 bp, Homo sapiens
aacattcaagttctggtttatg

SEQ ID NO: 9448562 - DNA, 22 bp, Homo sapiens
aacattcacctctacctccttc

SEQ ID NO: 9448563 - DNA, 22 bp, Homo sapiens
aacattcacctctacctccttc

SEQ ID NO: 9448564 - DNA, 22 bp, Homo sapiens
aacattcaagttctggtttatg

SEQ ID NO: 9448565 - DNA, 22 bp, Homo sapiens
aacattcaattgaggaagttaa

SEQ ID NO: 9448566 - DNA, 22 bp, Homo sapiens
aacattagatttgtttttctag

SEQ ID NO: 9448567 - DNA, 22 bp, Homo sapiens
aacatgcaaagctatgatgtat

SEQ ID NO: 9448568 - DNA, 22 bp, Homo sapiens
aacattaagatggcggaacagt

SEQ ID NO: 9448569 - DNA, 22 bp, Homo sapiens
aacattctatgtgcattcagaa

SEQ ID NO: 9448570 - DNA, 22 bp, Homo sapiens
aacattctatgtgcattcagaa

SEQ ID NO: 9448571 - DNA, 22 bp, Homo sapiens
aacatttcataacttgactttt

SEQ ID NO: 9448572 - DNA, 22 bp, Homo sapiens
aacattctattttgctaaaaca

SEQ ID NO: 9448573 - DNA, 22 bp, Homo sapiens
aacattcagctgggtggagcag

SEQ ID NO: 9448574 - DNA, 22 bp, Homo sapiens
aacattcagctgggtggagcag

SEQ ID NO: 9448575 - DNA, 22 bp, Homo sapiens
aacattcagctgatgggtcata

SEQ ID NO: 9448576 - DNA, 22 bp, Homo sapiens
aacattcagctgggtggagcag

SEQ ID NO: 9448577 - DNA, 22 bp, Homo sapiens
aacattctactgtactgcattg

SEQ ID NO: 9448578 - DNA, 16 bp, Homo sapiens
aacattcatatgagtg

SEQ ID NO: 9448579 - DNA, 22 bp, Homo sapiens
aacattctactgtactgcattg

SEQ ID NO: 9448580 - DNA, 22 bp, Homo sapiens
aacatttctgagaatatcagtt

SEQ ID NO: 9448581 - DNA, 21 bp, Homo sapiens
aacatttctgggagaactcac

SEQ ID NO: 9448582 - DNA, 21 bp, Homo sapiens
aacatttctgggagaactcac

SEQ ID NO: 9448583 - DNA, 22 bp, Homo sapiens
aacatttcttctgaaactgagt

SEQ ID NO: 9448584 - DNA, 22 bp, Homo sapiens
aacattctcattgggatatgtg

SEQ ID NO: 9448585 - DNA, 22 bp, Homo sapiens
aacatttccggccttttgttct

SEQ ID NO: 9448586 - DNA, 22 bp, Homo sapiens
aacagtcacattgttcaacttt

SEQ ID NO: 9448587 - DNA, 20 bp, Homo sapiens
aacagtcaaatgttgattgc

SEQ ID NO: 9448588 - DNA, 19 bp, Homo sapiens
aacagtctgggaagcacag

SEQ ID NO: 9448589 - DNA, 22 bp, Homo sapiens
aacagtcttacagaagtagcca

SEQ ID NO: 9448590 - DNA, 22 bp, Homo sapiens
aacagtcttggaagtcttgtta

SEQ ID NO: 9448591 - DNA, 22 bp, Homo sapiens
aacagtattggttgaactcaag

SEQ ID NO: 9448592 - DNA, 22 bp, Homo sapiens
aacagtatggaagccattagga

SEQ ID NO: 9448593 - DNA, 22 bp, Homo sapiens
aacagtatgtgagatttacaca

SEQ ID NO: 9448594 - DNA, 22 bp, Homo sapiens
aacagtatgtgagatttacaca

SEQ ID NO: 9448595 - DNA, 22 bp, Homo sapiens
aacagtatcttttatcagaaat

SEQ ID NO: 9448596 - DNA, 22 bp, Homo sapiens
aacagtatcttttatcagaaat

SEQ ID NO: 9448597 - DNA, 22 bp, Homo sapiens
aacaggaaaacagcacaatagc

SEQ ID NO: 9448598 - DNA, 22 bp, Homo sapiens
aacaggaaaacagcacaatagc

SEQ ID NO: 9448599 - DNA, 22 bp, Homo sapiens
aacaggaaaacagcacaatagc

SEQ ID NO: 9448600 - DNA, 22 bp, Homo sapiens
aacaggaaacaagttgttagga

SEQ ID NO: 9448601 - DNA, 22 bp, Homo sapiens
aacaggaaacaagttgttagga

SEQ ID NO: 9448602 - DNA, 22 bp, Homo sapiens
aacaggaaacaagttgttagga

SEQ ID NO: 9448603 - DNA, 22 bp, Homo sapiens
aacaggaaatacttatgaggta

SEQ ID NO: 9448604 - DNA, 22 bp, Homo sapiens
aacaggaaatacttatgaggta

SEQ ID NO: 9448605 - DNA, 22 bp, Homo sapiens
aacaggaactatttgtattcca

SEQ ID NO: 9448606 - DNA, 22 bp, Homo sapiens
aacagtaatggcattgccatga

SEQ ID NO: 9448607 - DNA, 20 bp, Homo sapiens
aacagtaccccccttgttct

SEQ ID NO: 9448608 - DNA, 22 bp, Homo sapiens
aacagtagtggtcaatatgcca

SEQ ID NO: 9448609 - DNA, 23 bp, Homo sapiens
aactgagataatgtatgtaaagc

SEQ ID NO: 9448610 - DNA, 22 bp, Homo sapiens
aactgagattacaagagacatt

SEQ ID NO: 9448611 - DNA, 20 bp, Homo sapiens
aactgagagttcaggaggag

SEQ ID NO: 9448612 - DNA, 21 bp, Homo sapiens
aactgagaccagctaaagtgg

SEQ ID NO: 9448613 - DNA, 22 bp, Homo sapiens
aactgagggccctgctgaagca

SEQ ID NO: 9448614 - DNA, 22 bp, Homo sapiens
aactgatgctagaagagacgtt

SEQ ID NO: 9448615 - DNA, 22 bp, Homo sapiens
aactgattgttggatgatagtg

SEQ ID NO: 9448616 - DNA, 22 bp, Homo sapiens
aacttgatcctgctgggtacta

SEQ ID NO: 9448617 - DNA, 22 bp, Homo sapiens
aactgatttcaagttcagtttc

SEQ ID NO: 9448618 - DNA, 22 bp, Homo sapiens
aacttgcagggatgttctgaat

SEQ ID NO: 9448619 - DNA, 22 bp, Homo sapiens
aacttgcagggatgttctgaat

SEQ ID NO: 9448620 - DNA, 22 bp, Homo sapiens
aactgagacacgaactatgatt

SEQ ID NO: 9448621 - DNA, 21 bp, Homo sapiens
aactgagaccagctaaagtgg

SEQ ID NO: 9448622 - DNA, 22 bp, Homo sapiens
aactgaattttaaatacaggcc

SEQ ID NO: 9448623 - DNA, 22 bp, Homo sapiens
aactgaaagtttcacctgaggt

SEQ ID NO: 9448624 - DNA, 22 bp, Homo sapiens
aactgaaatcaatcagtgattc

SEQ ID NO: 9448625 - DNA, 22 bp, Homo sapiens
aactgaaatcaatcagtgattc

SEQ ID NO: 9448626 - DNA, 22 bp, Homo sapiens
aactcagcatcagtgtccagaa

SEQ ID NO: 9448627 - DNA, 22 bp, Homo sapiens
aactcagcatcctgcacagaga

SEQ ID NO: 9448628 - DNA, 22 bp, Homo sapiens
aactcagcatcagtgtccagaa

SEQ ID NO: 9448629 - DNA, 22 bp, Homo sapiens
aactcaggagtttaaggctgca

SEQ ID NO: 9448630 - DNA, 22 bp, Homo sapiens
aactcaggagaatggagggtat

SEQ ID NO: 9448631 - DNA, 22 bp, Homo sapiens
aactcagtgtgtttcttagtat

SEQ ID NO: 9448632 - DNA, 22 bp, Homo sapiens
aactcactttgtggcttctgaa

SEQ ID NO: 9448633 - DNA, 22 bp, Homo sapiens
aacatttcttctgaaactgagt

SEQ ID NO: 9448634 - DNA, 22 bp, Homo sapiens
aacatttgcagaggaaagctat

SEQ ID NO: 9448635 - DNA, 22 bp, Homo sapiens
aacatttgtactaaagaagttc

SEQ ID NO: 9448636 - DNA, 22 bp, Homo sapiens
aactaatacattaatacatgtg

SEQ ID NO: 9448637 - DNA, 22 bp, Homo sapiens
aactaatacattaatacatgtg

SEQ ID NO: 9448638 - DNA, 22 bp, Homo sapiens
aactaatacattaatacatgtg

SEQ ID NO: 9448639 - DNA, 22 bp, Homo sapiens
aactaagttgcccagtccctgg

SEQ ID NO: 9448640 - DNA, 22 bp, Homo sapiens
aactaatacattaatacatgtg

SEQ ID NO: 9448641 - DNA, 22 bp, Homo sapiens
aactcacagctgtttggattag

SEQ ID NO: 9448642 - DNA, 22 bp, Homo sapiens
aactcacacaagtattgcctgc

SEQ ID NO: 9448643 - DNA, 22 bp, Homo sapiens
aactcacacaagtattgcctgc

SEQ ID NO: 9448644 - DNA, 22 bp, Homo sapiens
aactatgttaataagtttcatt

SEQ ID NO: 9448645 - DNA, 22 bp, Homo sapiens
aactatgttaataagtttcatt

SEQ ID NO: 9448646 - DNA, 22 bp, Homo sapiens
aactattctgtggactcttata

SEQ ID NO: 9448647 - DNA, 22 bp, Homo sapiens
aactatttttggagctaactct

SEQ ID NO: 9448648 - DNA, 22 bp, Homo sapiens
aactatgttaataagtttcatt

SEQ ID NO: 9448649 - DNA, 22 bp, Homo sapiens
aactatggtattctgatgtttc

SEQ ID NO: 9448650 - DNA, 22 bp, Homo sapiens
cacagcaagagctaaatgacca

SEQ ID NO: 9448651 - DNA, 17 bp, Homo sapiens
agcaggaccccagagca

SEQ ID NO: 9448652 - DNA, 22 bp, Homo sapiens
agcaggaccaagaaggggaaaa

SEQ ID NO: 9448653 - DNA, 17 bp, Homo sapiens
agcaggaccccagagca

SEQ ID NO: 9448654 - DNA, 22 bp, Homo sapiens
cacagcaagagctaaatgacca

SEQ ID NO: 9448655 - DNA, 22 bp, Homo sapiens
cacagcaagagctaaatgacca

SEQ ID NO: 9448656 - DNA, 22 bp, Homo sapiens
cacagcaatagctaactgatac

SEQ ID NO: 9448657 - DNA, 22 bp, Homo sapiens
cacagcaatagctaactgatac

SEQ ID NO: 9448658 - DNA, 22 bp, Homo sapiens
agcaggacaatatgggatcagg

SEQ ID NO: 9448659 - DNA, 22 bp, Homo sapiens
agcaggacaatatgggatcagg

SEQ ID NO: 9448660 - DNA, 22 bp, Homo sapiens
agcaggaccaagaaggggaaaa

SEQ ID NO: 9448661 - DNA, 22 bp, Homo sapiens
agcaggacacgatgcggcagga

SEQ ID NO: 9448662 - DNA, 22 bp, Homo sapiens
agcaggacacgatgcggcagga

SEQ ID NO: 9448663 - DNA, 22 bp, Homo sapiens
agcaggaagtcctctcaggaga

SEQ ID NO: 9448664 - DNA, 22 bp, Homo sapiens
agcaggaaggtctgtgtgagtc

SEQ ID NO: 9448665 - DNA, 22 bp, Homo sapiens
agcaggaaggtctgtgtgagtc

SEQ ID NO: 9448666 - DNA, 22 bp, Homo sapiens
agcaggaaggtctgttagtcca

SEQ ID NO: 9448667 - DNA, 22 bp, Homo sapiens
agcaggaaggtctgtgtgagtc

SEQ ID NO: 9448668 - DNA, 22 bp, Homo sapiens
agcaggaaggggcctagcctgg

SEQ ID NO: 9448669 - DNA, 22 bp, Homo sapiens
agcaggaactcagggagttctc

SEQ ID NO: 9448670 - DNA, 22 bp, Homo sapiens
agcaggaaggctttgggggttc

SEQ ID NO: 9448671 - DNA, 22 bp, Homo sapiens
agcaggaactgacaccaagcca

SEQ ID NO: 9448672 - DNA, 22 bp, Homo sapiens
agcagcttgagctggggctggc

SEQ ID NO: 9448673 - DNA, 22 bp, Homo sapiens
agcaggaacgagttcatgggga

SEQ ID NO: 9448674 - DNA, 22 bp, Homo sapiens
agcagcttgaggctggattcca

SEQ ID NO: 9448675 - DNA, 21 bp, Homo sapiens
agcagctgggcaacatggagg

SEQ ID NO: 9448676 - DNA, 21 bp, Homo sapiens
agcagctgggcaacatggagg

SEQ ID NO: 9448677 - DNA, 22 bp, Homo sapiens
cacagcagacagggaggcggct

SEQ ID NO: 9448678 - DNA, 22 bp, Homo sapiens
cacagcagacagggaggcggct

SEQ ID NO: 9448679 - DNA, 22 bp, Homo sapiens
cacagcagagggagccattgaa

SEQ ID NO: 9448680 - DNA, 22 bp, Homo sapiens
cacagcagagggagccattgaa

SEQ ID NO: 9448681 - DNA, 22 bp, Homo sapiens
cacagcagagggagccattgaa

SEQ ID NO: 9448682 - DNA, 22 bp, Homo sapiens
agcaggctgggcaatatgggca

SEQ ID NO: 9448683 - DNA, 22 bp, Homo sapiens
cacagcagatccaggggttgtg

SEQ ID NO: 9448684 - DNA, 22 bp, Homo sapiens
cacagcagaaatatgaaggcag

SEQ ID NO: 9448685 - DNA, 22 bp, Homo sapiens
cacagcagaacttaatttcaaa

SEQ ID NO: 9448686 - DNA, 22 bp, Homo sapiens
cacagcagaacttaatttcaaa

SEQ ID NO: 9448687 - DNA, 22 bp, Homo sapiens
cacagcagaacttaatttcaaa

SEQ ID NO: 9448688 - DNA, 22 bp, Homo sapiens
cacagcagaaagtgtaggagga

SEQ ID NO: 9448689 - DNA, 22 bp, Homo sapiens
cacagcaatagctaactgatac

SEQ ID NO: 9448690 - DNA, 22 bp, Homo sapiens
cacagcagaaagtgtaggagga

SEQ ID NO: 9448691 - DNA, 22 bp, Homo sapiens
agcagggaggcggtgtgctggc

SEQ ID NO: 9448692 - DNA, 22 bp, Homo sapiens
agcagggaggcggtgtgctggc

SEQ ID NO: 9448693 - DNA, 22 bp, Homo sapiens
agcagggaggcggtgtgctggc

SEQ ID NO: 9448694 - DNA, 17 bp, Homo sapiens
agcagggagtcaaggga

SEQ ID NO: 9448695 - DNA, 22 bp, Homo sapiens
agcagggaggtctagcacgtgg

SEQ ID NO: 9448696 - DNA, 22 bp, Homo sapiens
agcagggaggtctagcacgtgg

SEQ ID NO: 9448697 - DNA, 22 bp, Homo sapiens
agcagggaggcccagggcactg

SEQ ID NO: 9448698 - DNA, 22 bp, Homo sapiens
agcagggaggcggtgtgctggc

SEQ ID NO: 9448699 - DNA, 22 bp, Homo sapiens
agcagggaggcccagggcactg

SEQ ID NO: 9448700 - DNA, 22 bp, Homo sapiens
agcagggaggcccagggcactg

SEQ ID NO: 9448701 - DNA, 22 bp, Homo sapiens
agcagggaggcccagggcactg

SEQ ID NO: 9448702 - DNA, 22 bp, Homo sapiens
agcaggcttactttctgattag

SEQ ID NO: 9448703 - DNA, 22 bp, Homo sapiens
agcagggagaccatctcttcct

SEQ ID NO: 9448704 - DNA, 22 bp, Homo sapiens
caccactgtatccctagcactt

SEQ ID NO: 9448705 - DNA, 22 bp, Homo sapiens
cacatttaatcctttataagta

SEQ ID NO: 9448706 - DNA, 22 bp, Homo sapiens
cacatttaatcctttataagta

SEQ ID NO: 9448707 - DNA, 22 bp, Homo sapiens
agcagggcagtgatcagaaagg

SEQ ID NO: 9448708 - DNA, 22 bp, Homo sapiens
cacatttaatcctttataagta

SEQ ID NO: 9448709 - DNA, 22 bp, Homo sapiens
agcagggcagtgatcagaaagg

SEQ ID NO: 9448710 - DNA, 22 bp, Homo sapiens
agcagggcagtgatcagaaagg

SEQ ID NO: 9448711 - DNA, 22 bp, Homo sapiens
agcagggcagctgatgcgcacg

SEQ ID NO: 9448712 - DNA, 22 bp, Homo sapiens
agcagggcagctgatgcgcacg

SEQ ID NO: 9448713 - DNA, 22 bp, Homo sapiens
agcagggcagcttttttcagaa

SEQ ID NO: 9448714 - DNA, 22 bp, Homo sapiens
agcagggcagcttttttcagaa

SEQ ID NO: 9448715 - DNA, 22 bp, Homo sapiens
agcagggcaggtaaggatcaga

SEQ ID NO: 9448716 - DNA, 22 bp, Homo sapiens
agcagggcaggtaaggatcaga

SEQ ID NO: 9448717 - DNA, 22 bp, Homo sapiens
agcagggcaggtaaggatcaga

SEQ ID NO: 9448718 - DNA, 22 bp, Homo sapiens
agcagggcaggtaaggatcaga

SEQ ID NO: 9448719 - DNA, 22 bp, Homo sapiens
agcagggcaggtaaggatcaga

SEQ ID NO: 9448720 - DNA, 22 bp, Homo sapiens
agcagggcaaagtcaggctaac

SEQ ID NO: 9448721 - DNA, 22 bp, Homo sapiens
agcagggcaaagtcaggctaac

SEQ ID NO: 9448722 - DNA, 22 bp, Homo sapiens
agcagggcaaagtcaggctaac

SEQ ID NO: 9448723 - DNA, 17 bp, Homo sapiens
agcagggagtcaaggga

SEQ ID NO: 9448724 - DNA, 17 bp, Homo sapiens
agcagggagtcaaggga

SEQ ID NO: 9448725 - DNA, 19 bp, Homo sapiens
agcagggagtggttgtggg

SEQ ID NO: 9448726 - DNA, 19 bp, Homo sapiens
agcagggagtggttgtggg

SEQ ID NO: 9448727 - DNA, 22 bp, Homo sapiens
agcagggcactggaaggcactg

SEQ ID NO: 9448728 - DNA, 22 bp, Homo sapiens
agcagggcagctgatgcgcacg

SEQ ID NO: 9448729 - DNA, 22 bp, Homo sapiens
agcagggcagctgatgcgcacg

SEQ ID NO: 9448730 - DNA, 22 bp, Homo sapiens
agcagggcaaagtcaggctaac

SEQ ID NO: 9448731 - DNA, 22 bp, Homo sapiens
agcagggcactggaaggcactg

SEQ ID NO: 9448732 - DNA, 22 bp, Homo sapiens
agcagggcactggaaggcactg

SEQ ID NO: 9448733 - DNA, 22 bp, Homo sapiens
caccagaacaagacaggagaat

SEQ ID NO: 9448734 - DNA, 23 bp, Homo sapiens
caccactttctccttctccttgg

SEQ ID NO: 9448735 - DNA, 22 bp, Homo sapiens
caccagaacaagacaggagaat

SEQ ID NO: 9448736 - DNA, 23 bp, Homo sapiens
caccactttctccttctccttgg

SEQ ID NO: 9448737 - DNA, 22 bp, Homo sapiens
caccagagtgggtgagggtgat

SEQ ID NO: 9448738 - DNA, 22 bp, Homo sapiens
caccagagtgagtggactgtcg

SEQ ID NO: 9448739 - DNA, 22 bp, Homo sapiens
caccagagttgtccaaatgatt

SEQ ID NO: 9448740 - DNA, 22 bp, Homo sapiens
caccagcaccagctctgtgcct

SEQ ID NO: 9448741 - DNA, 22 bp, Homo sapiens
caccagatgaaaggacatatca

SEQ ID NO: 9448742 - DNA, 22 bp, Homo sapiens
caccagatgaatgtttgatgct

SEQ ID NO: 9448743 - DNA, 22 bp, Homo sapiens
caccagatgagggatgtgctca

SEQ ID NO: 9448744 - DNA, 20 bp, Homo sapiens
caccagcagcagctgccacc

SEQ ID NO: 9448745 - DNA, 20 bp, Homo sapiens
caccagcagcagctgccacc

SEQ ID NO: 9448746 - DNA, 22 bp, Homo sapiens
agcagggctgcagtgtgtcttt

SEQ ID NO: 9448747 - DNA, 22 bp, Homo sapiens
agcagggctctgtggagggtgg

SEQ ID NO: 9448748 - DNA, 22 bp, Homo sapiens
agcagggctctgtggagggtgg

SEQ ID NO: 9448749 - DNA, 22 bp, Homo sapiens
agcagggctctgccatgggccc

SEQ ID NO: 9448750 - DNA, 22 bp, Homo sapiens
caccagctacagactactgtgt

SEQ ID NO: 9448751 - DNA, 22 bp, Homo sapiens
agcagggctctgccatgggccc

SEQ ID NO: 9448752 - DNA, 22 bp, Homo sapiens
caccagccccctcacgctgtca

SEQ ID NO: 9448753 - DNA, 22 bp, Homo sapiens
caccagccagagtgacagctcc

SEQ ID NO: 9448754 - DNA, 22 bp, Homo sapiens
caccagctaattaaaacagcag

SEQ ID NO: 9448755 - DNA, 22 bp, Homo sapiens
caccagccccctcacgctgtca

SEQ ID NO: 9448756 - DNA, 22 bp, Homo sapiens
agcagggctggggcacgagcca

SEQ ID NO: 9448757 - DNA, 22 bp, Homo sapiens
agcagggctgcggccccaccac

SEQ ID NO: 9448758 - DNA, 22 bp, Homo sapiens
agcaggtgggcatgaaagctga

SEQ ID NO: 9448759 - DNA, 22 bp, Homo sapiens
agcagggctggggcacgagcca

SEQ ID NO: 9448760 - DNA, 22 bp, Homo sapiens
agcaggtgttggctgggccatc

SEQ ID NO: 9448761 - DNA, 22 bp, Homo sapiens
agcaggtgtttgtatcataagg

SEQ ID NO: 9448762 - DNA, 22 bp, Homo sapiens
agcaggtgttggctgggccatc

SEQ ID NO: 9448763 - DNA, 22 bp, Homo sapiens
agcaggtgttagggatccaatg

SEQ ID NO: 9448764 - DNA, 18 bp, Homo sapiens
agcaggtgtgcagaatgt

SEQ ID NO: 9448765 - DNA, 22 bp, Homo sapiens
agcaggtgtcggcgagggtctt

SEQ ID NO: 9448766 - DNA, 22 bp, Homo sapiens
agcaggtgtcggcgagggtctt

SEQ ID NO: 9448767 - DNA, 19 bp, Homo sapiens
agcaggtgggtaagaaaat

SEQ ID NO: 9448768 - DNA, 22 bp, Homo sapiens
agcaggttaaaccaaaatataa

SEQ ID NO: 9448769 - DNA, 22 bp, Homo sapiens
agcaggttaaaccaaaatataa

SEQ ID NO: 9448770 - DNA, 22 bp, Homo sapiens
agcaggttgttttgtggccagg

SEQ ID NO: 9448771 - DNA, 22 bp, Homo sapiens
agcaggtttgttttcttctgag

SEQ ID NO: 9448772 - DNA, 18 bp, Homo sapiens
agcagtagcgccaggtgc

SEQ ID NO: 9448773 - DNA, 22 bp, Homo sapiens
agcagtcaggcctcagagccgt

SEQ ID NO: 9448774 - DNA, 22 bp, Homo sapiens
agcagtagtgatggcccctgag

SEQ ID NO: 9448775 - DNA, 22 bp, Homo sapiens
agcagtcattttaggtcatgca

SEQ ID NO: 9448776 - DNA, 20 bp, Homo sapiens
agcagtccaaaagggcagac

SEQ ID NO: 9448777 - DNA, 22 bp, Homo sapiens
agcagtcattttaggtcatgca

SEQ ID NO: 9448778 - DNA, 22 bp, Homo sapiens
agcagtctggaacaagatatga

SEQ ID NO: 9448779 - DNA, 22 bp, Homo sapiens
agcagtggcctggggctctgtg

SEQ ID NO: 9448780 - DNA, 22 bp, Homo sapiens
agcatattgtatgtctatatgt

SEQ ID NO: 9448781 - DNA, 22 bp, Homo sapiens
agcatattcatgccagactact

SEQ ID NO: 9448782 - DNA, 22 bp, Homo sapiens
agcatgaaagcataggacagtc

SEQ ID NO: 9448783 - DNA, 22 bp, Homo sapiens
agcatattgtatgtctatatgt

SEQ ID NO: 9448784 - DNA, 18 bp, Homo sapiens
agcatgagtcaggggtgc

SEQ ID NO: 9448785 - DNA, 22 bp, Homo sapiens
agcatgaaaggcgtgccaactt

SEQ ID NO: 9448786 - DNA, 22 bp, Homo sapiens
agcatgaaagcataggacagtc

SEQ ID NO: 9448787 - DNA, 22 bp, Homo sapiens
agcatgaagacttcagagctag

SEQ ID NO: 9448788 - DNA, 22 bp, Homo sapiens
agcagtgcccattctgccccct

SEQ ID NO: 9448789 - DNA, 22 bp, Homo sapiens
agcagtgccgcatcttgtgacc

SEQ ID NO: 9448790 - DNA, 22 bp, Homo sapiens
agcagtgcctggcacatgtaag

SEQ ID NO: 9448791 - DNA, 22 bp, Homo sapiens
agcagtggacctcagtgctatt

SEQ ID NO: 9448792 - DNA, 19 bp, Homo sapiens
agcagtggagccatgcctg

SEQ ID NO: 9448793 - DNA, 22 bp, Homo sapiens
agcagtgagtgggaggaccatg

SEQ ID NO: 9448794 - DNA, 23 bp, Homo sapiens
agcagtgagtaaacagataggat

SEQ ID NO: 9448795 - DNA, 23 bp, Homo sapiens
agcagtgagtaaacagataggat

SEQ ID NO: 9448796 - DNA, 22 bp, Homo sapiens
agcagtgagtaacacagaccag

SEQ ID NO: 9448797 - DNA, 22 bp, Homo sapiens
agcagtgacttgctttgtttcc

SEQ ID NO: 9448798 - DNA, 22 bp, Homo sapiens
agcagtgaaacagctgcatatg

SEQ ID NO: 9448799 - DNA, 22 bp, Homo sapiens
cactgtttttatgtaatcagtg

SEQ ID NO: 9448800 - DNA, 22 bp, Homo sapiens
cactgtttttatgtaatcagtg

SEQ ID NO: 9448801 - DNA, 22 bp, Homo sapiens
cacttaaaactcctggaattgt

SEQ ID NO: 9448802 - DNA, 22 bp, Homo sapiens
cactgtgtctggagtgagctgg

SEQ ID NO: 9448803 - DNA, 23 bp, Homo sapiens
cactgtgttacatgttgaagatg

SEQ ID NO: 9448804 - DNA, 22 bp, Homo sapiens
cactgttattactactatacat

SEQ ID NO: 9448805 - DNA, 22 bp, Homo sapiens
cactgttattactactatacat

SEQ ID NO: 9448806 - DNA, 22 bp, Homo sapiens
cactgtttaataatattgttaa

SEQ ID NO: 9448807 - DNA, 22 bp, Homo sapiens
cactgttctttttgtagtccaa

SEQ ID NO: 9448808 - DNA, 22 bp, Homo sapiens
cactgttcatcaaaactgctct

SEQ ID NO: 9448809 - DNA, 22 bp, Homo sapiens
cactgttcatcaaaactgctct

SEQ ID NO: 9448810 - DNA, 22 bp, Homo sapiens
cactgtgtcagtttggttagac

SEQ ID NO: 9448811 - DNA, 22 bp, Homo sapiens
cactgtggttattatcactgtt

SEQ ID NO: 9448812 - DNA, 22 bp, Homo sapiens
cactgtggtgtgagggctgatg

SEQ ID NO: 9448813 - DNA, 22 bp, Homo sapiens
cactggtgacttctgagctgga

SEQ ID NO: 9448814 - DNA, 22 bp, Homo sapiens
cactgtggcttaccaaagctaa

SEQ ID NO: 9448815 - DNA, 22 bp, Homo sapiens
agcattaataagaaatggctcc

SEQ ID NO: 9448816 - DNA, 22 bp, Homo sapiens
agcattaataagaaatggctcc

SEQ ID NO: 9448817 - DNA, 22 bp, Homo sapiens
agcatggggcaatgcatgtgct

SEQ ID NO: 9448818 - DNA, 22 bp, Homo sapiens
agcatggggcaatgcatgtgct

SEQ ID NO: 9448819 - DNA, 22 bp, Homo sapiens
agcatggtctgatcaggtggct

SEQ ID NO: 9448820 - DNA, 22 bp, Homo sapiens
agcatgtctaactcttcagggt

SEQ ID NO: 9448821 - DNA, 22 bp, Homo sapiens
agcatggggcaatgcatgtgct

SEQ ID NO: 9448822 - DNA, 22 bp, Homo sapiens
agcattaagagagactgaactg

SEQ ID NO: 9448823 - DNA, 22 bp, Homo sapiens
agcattaagcctggctcagagg

SEQ ID NO: 9448824 - DNA, 22 bp, Homo sapiens
agcatgtgtggagaaatatttt

SEQ ID NO: 9448825 - DNA, 21 bp, Homo sapiens
agcatgtctcagtcaacaagg

SEQ ID NO: 9448826 - DNA, 18 bp, Homo sapiens
agcatggcacaggctccc

SEQ ID NO: 9448827 - DNA, 18 bp, Homo sapiens
agcatggcacaggctccc

SEQ ID NO: 9448828 - DNA, 22 bp, Homo sapiens
agcatggacagtggcagcagtg

SEQ ID NO: 9448829 - DNA, 23 bp, Homo sapiens
agcatggaagaagctggactcct

SEQ ID NO: 9448830 - DNA, 19 bp, Homo sapiens
agcatggaagctggtgcca

SEQ ID NO: 9448831 - DNA, 23 bp, Homo sapiens
agcatggaataggaaagaggcag

SEQ ID NO: 9448832 - DNA, 23 bp, Homo sapiens
agcatggaataggaaagaggcag

SEQ ID NO: 9448833 - DNA, 22 bp, Homo sapiens
agcatgcatgaagattcagcaa

SEQ ID NO: 9448834 - DNA, 21 bp, Homo sapiens
agcatgcactacttcatctta

SEQ ID NO: 9448835 - DNA, 22 bp, Homo sapiens
agcatgcttggcatttgtcaga

SEQ ID NO: 9448836 - DNA, 22 bp, Homo sapiens
agcatgctgggtcatttttgcc

SEQ ID NO: 9448837 - DNA, 22 bp, Homo sapiens
agcagagctgggatcctgggtc

SEQ ID NO: 9448838 - DNA, 22 bp, Homo sapiens
agcagaggacagttcttaggaa

SEQ ID NO: 9448839 - DNA, 21 bp, Homo sapiens
agcagaggcagaatgtatgca

SEQ ID NO: 9448840 - DNA, 21 bp, Homo sapiens
agcagaggcagaatgtatgca

SEQ ID NO: 9448841 - DNA, 21 bp, Homo sapiens
agcagaggctgcctggtgact

SEQ ID NO: 9448842 - DNA, 21 bp, Homo sapiens
agcagaggcagaatgtatgca

SEQ ID NO: 9448843 - DNA, 21 bp, Homo sapiens
agcagaggcagaatgtatgca

SEQ ID NO: 9448844 - DNA, 22 bp, Homo sapiens
agcagagcctgggctaggggtg

SEQ ID NO: 9448845 - DNA, 22 bp, Homo sapiens
agcagagaggaggtggccctgt

SEQ ID NO: 9448846 - DNA, 22 bp, Homo sapiens
agcagagaccatatagcccaga

SEQ ID NO: 9448847 - DNA, 22 bp, Homo sapiens
agcagagacctggttttgttga

SEQ ID NO: 9448848 - DNA, 22 bp, Homo sapiens
agcactgtggggaactcacaga

SEQ ID NO: 9448849 - DNA, 22 bp, Homo sapiens
agcactgtggggaactcacaga

SEQ ID NO: 9448850 - DNA, 22 bp, Homo sapiens
agcagagaccatatagcccaga

SEQ ID NO: 9448851 - DNA, 22 bp, Homo sapiens
agcactgtgatttataacattt

SEQ ID NO: 9448852 - DNA, 22 bp, Homo sapiens
agcactgtgatttataacattt

SEQ ID NO: 9448853 - DNA, 22 bp, Homo sapiens
agcagagctgcagtggcctgct

SEQ ID NO: 9448854 - DNA, 22 bp, Homo sapiens
agcagagcgcctgctcagaggg

SEQ ID NO: 9448855 - DNA, 22 bp, Homo sapiens
agcagagcgcctgctcagaggg

SEQ ID NO: 9448856 - DNA, 21 bp, Homo sapiens
agcagaggggacatgtttgat

SEQ ID NO: 9448857 - DNA, 22 bp, Homo sapiens
agcagaggtgtttattatggga

SEQ ID NO: 9448858 - DNA, 20 bp, Homo sapiens
agcagagtgcccatcccgga

SEQ ID NO: 9448859 - DNA, 22 bp, Homo sapiens
agcagagtcttcaagggcaggc

SEQ ID NO: 9448860 - DNA, 20 bp, Homo sapiens
agcagagtgcccatcccgga

SEQ ID NO: 9448861 - DNA, 22 bp, Homo sapiens
agcagagtcttcaagggcaggc

SEQ ID NO: 9448862 - DNA, 22 bp, Homo sapiens
caagtgagtgaccagagttggt

SEQ ID NO: 9448863 - DNA, 22 bp, Homo sapiens
caagtgagtgaccagagttggt

SEQ ID NO: 9448864 - DNA, 22 bp, Homo sapiens
caataatatcctgtgctgtttg

SEQ ID NO: 9448865 - DNA, 22 bp, Homo sapiens
caataatatcctgtgctgtttg

SEQ ID NO: 9448866 - DNA, 22 bp, Homo sapiens
caataatatcctgtgctgtttg

SEQ ID NO: 9448867 - DNA, 22 bp, Homo sapiens
caagtgactgtgctggcaacat

SEQ ID NO: 9448868 - DNA, 22 bp, Homo sapiens
caagtgagcctcctctttttaa

SEQ ID NO: 9448869 - DNA, 20 bp, Homo sapiens
agcagagtgcccatcccgga

SEQ ID NO: 9448870 - DNA, 22 bp, Homo sapiens
caatacaattaccagttaatca

SEQ ID NO: 9448871 - DNA, 20 bp, Homo sapiens
caataatttacttccctatt

SEQ ID NO: 9448872 - DNA, 20 bp, Homo sapiens
caataatttacttccctatt

SEQ ID NO: 9448873 - DNA, 22 bp, Homo sapiens
caataatttacattggatacca

SEQ ID NO: 9448874 - DNA, 22 bp, Homo sapiens
caataattgctttccagagtta

SEQ ID NO: 9448875 - DNA, 22 bp, Homo sapiens
caataattgctttccagagtta

SEQ ID NO: 9448876 - DNA, 22 bp, Homo sapiens
agcactgggaacgcatggggcc

SEQ ID NO: 9448877 - DNA, 22 bp, Homo sapiens
agcactgggaacgcatggggcc

SEQ ID NO: 9448878 - DNA, 22 bp, Homo sapiens
agcactgtagttatagctaaca

SEQ ID NO: 9448879 - DNA, 22 bp, Homo sapiens
agcactggagtttagtgggatt

SEQ ID NO: 9448880 - DNA, 22 bp, Homo sapiens
agcactctaagtgcaagacact

SEQ ID NO: 9448881 - DNA, 22 bp, Homo sapiens
agcactgattttgttgcactta

SEQ ID NO: 9448882 - DNA, 22 bp, Homo sapiens
agcactgattttgttgcactta

SEQ ID NO: 9448883 - DNA, 22 bp, Homo sapiens
agcactgatttaaactggattt

SEQ ID NO: 9448884 - DNA, 22 bp, Homo sapiens
agcactctggagtaggagtggg

SEQ ID NO: 9448885 - DNA, 22 bp, Homo sapiens
agcactctggagtaggagtggg

SEQ ID NO: 9448886 - DNA, 22 bp, Homo sapiens
agcactcttctgtgatagttgt

SEQ ID NO: 9448887 - DNA, 22 bp, Homo sapiens
agcactcctgtctttccccttt

SEQ ID NO: 9448888 - DNA, 22 bp, Homo sapiens
agcactagctttaagcattctg

SEQ ID NO: 9448889 - DNA, 22 bp, Homo sapiens
agcactagcctgttttgctgtg

SEQ ID NO: 9448890 - DNA, 22 bp, Homo sapiens
agcactagctttaagcattctg

SEQ ID NO: 9448891 - DNA, 23 bp, Homo sapiens
agcactcatgctgcagaagtcat

SEQ ID NO: 9448892 - DNA, 22 bp, Homo sapiens
agcacctgtgttcatgcctcat

SEQ ID NO: 9448893 - DNA, 22 bp, Homo sapiens
agcacctgtgtggtagggaggt

SEQ ID NO: 9448894 - DNA, 22 bp, Homo sapiens
agcacctgtgtgagctagatgt

SEQ ID NO: 9448895 - DNA, 22 bp, Homo sapiens
agcacctgtgttcatgcctcat

SEQ ID NO: 9448896 - DNA, 22 bp, Homo sapiens
agcacctgttgcacttcataat

SEQ ID NO: 9448897 - DNA, 22 bp, Homo sapiens
agcacctgttgcacttcataat

SEQ ID NO: 9448898 - DNA, 22 bp, Homo sapiens
agcacctgtgccctgatggaga

SEQ ID NO: 9448899 - DNA, 19 bp, Homo sapiens
agcacctgtgagagcctgg

SEQ ID NO: 9448900 - DNA, 22 bp, Homo sapiens
agcacctgtggctcatgctcgt

SEQ ID NO: 9448901 - DNA, 22 bp, Homo sapiens
agcacctgtggctcatgctcgt

SEQ ID NO: 9448902 - DNA, 20 bp, Homo sapiens
agcacctgtgtagaagcatc

SEQ ID NO: 9448903 - DNA, 20 bp, Homo sapiens
agcacctgtgtagaagcatc

SEQ ID NO: 9448904 - DNA, 22 bp, Homo sapiens
agcaccttcacaggctctcagg

SEQ ID NO: 9448905 - DNA, 20 bp, Homo sapiens
agcacctgtgtagaagcatc

SEQ ID NO: 9448906 - DNA, 22 bp, Homo sapiens
agcaccttgatcttggacttcc

SEQ ID NO: 9448907 - DNA, 22 bp, Homo sapiens
agcacgttcttcattacttcac

SEQ ID NO: 9448908 - DNA, 17 bp, Homo sapiens
agcactaaaatgcttcc

SEQ ID NO: 9448909 - DNA, 22 bp, Homo sapiens
agcactagacatgtaagtgagc

SEQ ID NO: 9448910 - DNA, 22 bp, Homo sapiens
agcaccaggtcgctggcacgct

SEQ ID NO: 9448911 - DNA, 18 bp, Homo sapiens
agcaccagtcactaacag

SEQ ID NO: 9448912 - DNA, 22 bp, Homo sapiens
agcacctgcttaatgtgcagtg

SEQ ID NO: 9448913 - DNA, 22 bp, Homo sapiens
agcacctggatttgatagtcag

SEQ ID NO: 9448914 - DNA, 22 bp, Homo sapiens
agcacctggagggctgggacct

SEQ ID NO: 9448915 - DNA, 22 bp, Homo sapiens
agcacctggagggctgggacct

SEQ ID NO: 9448916 - DNA, 22 bp, Homo sapiens
agcacctgcttgtgactaggga

SEQ ID NO: 9448917 - DNA, 22 bp, Homo sapiens
agcacctgcttaatgtgcagtg

SEQ ID NO: 9448918 - DNA, 22 bp, Homo sapiens
agcacctgcttaatgtgcagtg

SEQ ID NO: 9448919 - DNA, 22 bp, Homo sapiens
agcacctgtcaagtccaggctg

SEQ ID NO: 9448920 - DNA, 22 bp, Homo sapiens
agcacctgtcaagtccaggctg

SEQ ID NO: 9448921 - DNA, 22 bp, Homo sapiens
agcacctgtcacaagcagaagg

SEQ ID NO: 9448922 - DNA, 22 bp, Homo sapiens
agcacctggtctcctggcgctg

SEQ ID NO: 9448923 - DNA, 22 bp, Homo sapiens
agcacctgggaagctattctca

SEQ ID NO: 9448924 - DNA, 22 bp, Homo sapiens
agcacctgggctggaagacccc

SEQ ID NO: 9448925 - DNA, 17 bp, Homo sapiens
agcacctgtccagtccc

SEQ ID NO: 9448926 - DNA, 23 bp, Homo sapiens
agcacctgtgatttcctagctct

SEQ ID NO: 9448927 - DNA, 23 bp, Homo sapiens
agcacctgtgatttcctagctct

SEQ ID NO: 9448928 - DNA, 17 bp, Homo sapiens
agcacctgtccagtccc

SEQ ID NO: 9448929 - DNA, 17 bp, Homo sapiens
agcacctgtccagtccc

SEQ ID NO: 9448930 - DNA, 19 bp, Homo sapiens
agcacctgtgagagcctgg

SEQ ID NO: 9448931 - DNA, 22 bp, Homo sapiens
caaaggctgccactgtggctgt

SEQ ID NO: 9448932 - DNA, 22 bp, Homo sapiens
caaaggctcagtaaatctttgt

SEQ ID NO: 9448933 - DNA, 22 bp, Homo sapiens
caaaggctggtagaatgagcca

SEQ ID NO: 9448934 - DNA, 22 bp, Homo sapiens
caaaggcagttactgaatgaag

SEQ ID NO: 9448935 - DNA, 22 bp, Homo sapiens
caaaggcagttactgaatgaag

SEQ ID NO: 9448936 - DNA, 22 bp, Homo sapiens
caaaggcagttactgaatgaag

SEQ ID NO: 9448937 - DNA, 22 bp, Homo sapiens
caaaggcatcggcaattaggga

SEQ ID NO: 9448938 - DNA, 22 bp, Homo sapiens
caaaggcatgtgagtatatgtg

SEQ ID NO: 9448939 - DNA, 22 bp, Homo sapiens
caaaggcatgtgagtatatgtg

SEQ ID NO: 9448940 - DNA, 22 bp, Homo sapiens
caaagggaaacgcagtgtcaag

SEQ ID NO: 9448941 - DNA, 22 bp, Homo sapiens
caaagggaaaagccatgtgggc

SEQ ID NO: 9448942 - DNA, 22 bp, Homo sapiens
caaagggaaacgcagtgtcaag

SEQ ID NO: 9448943 - DNA, 22 bp, Homo sapiens
caaaggcttcatctcagagcag

SEQ ID NO: 9448944 - DNA, 22 bp, Homo sapiens
caaaggcttccactgcatcctt

SEQ ID NO: 9448945 - DNA, 22 bp, Homo sapiens
caaaggctttgctatgatgcat

SEQ ID NO: 9448946 - DNA, 22 bp, Homo sapiens
caaagggaaaagccatgtgggc

SEQ ID NO: 9448947 - DNA, 22 bp, Homo sapiens
agcagccttaggtattgtgatt

SEQ ID NO: 9448948 - DNA, 22 bp, Homo sapiens
agcagccttaggtattgtgatt

SEQ ID NO: 9448949 - DNA, 22 bp, Homo sapiens
agcagccttgcaggggtcgcac

SEQ ID NO: 9448950 - DNA, 22 bp, Homo sapiens
agcagcctggtctctcgccaat

SEQ ID NO: 9448951 - DNA, 22 bp, Homo sapiens
agcagcctggacttggatgtgg

SEQ ID NO: 9448952 - DNA, 22 bp, Homo sapiens
agcagcctggacttggatgtgg

SEQ ID NO: 9448953 - DNA, 22 bp, Homo sapiens
agcagcctctgtagaggtctcc

SEQ ID NO: 9448954 - DNA, 22 bp, Homo sapiens
agcagcctctgtagaggtctcc

SEQ ID NO: 9448955 - DNA, 22 bp, Homo sapiens
agcagcctcccagggagcagcc

SEQ ID NO: 9448956 - DNA, 22 bp, Homo sapiens
agcagcctattcttctcttgga

SEQ ID NO: 9448957 - DNA, 22 bp, Homo sapiens
agcagcctattcttctcttgga

SEQ ID NO: 9448958 - DNA, 22 bp, Homo sapiens
agcagcctcccagggagcagcc

SEQ ID NO: 9448959 - DNA, 22 bp, Homo sapiens
agcagcctcccagggagcagcc

SEQ ID NO: 9448960 - DNA, 22 bp, Homo sapiens
agcagcctcccagggagcagcc

SEQ ID NO: 9448961 - DNA, 22 bp, Homo sapiens
agcagcctattcttctcttgga

SEQ ID NO: 9448962 - DNA, 23 bp, Homo sapiens
agcagccctgggacctggcctgc

SEQ ID NO: 9448963 - DNA, 23 bp, Homo sapiens
agcagccctgggacctggcctgc

SEQ ID NO: 9448964 - DNA, 22 bp, Homo sapiens
agcagccagagaatgatgcagt

SEQ ID NO: 9448965 - DNA, 22 bp, Homo sapiens
agcagccagagaatgatgcagt

SEQ ID NO: 9448966 - DNA, 22 bp, Homo sapiens
agcagccagaaatccagaggtg

SEQ ID NO: 9448967 - DNA, 21 bp, Homo sapiens
agcagcagatctggtgagggc

SEQ ID NO: 9448968 - DNA, 21 bp, Homo sapiens
agcagcagatctggtgagggc

SEQ ID NO: 9448969 - DNA, 22 bp, Homo sapiens
agcagcccctcggcgggtgcgc

SEQ ID NO: 9448970 - DNA, 22 bp, Homo sapiens
agcagcccctcggcgggtgcgc

SEQ ID NO: 9448971 - DNA, 22 bp, Homo sapiens
caatacatcaggtcaaaatgtg

SEQ ID NO: 9448972 - DNA, 22 bp, Homo sapiens
caatacatcaggtcaaaatgtg

SEQ ID NO: 9448973 - DNA, 22 bp, Homo sapiens
caatacaattaccagttaatca

SEQ ID NO: 9448974 - DNA, 22 bp, Homo sapiens
caatacaattaccagttaatca

SEQ ID NO: 9448975 - DNA, 22 bp, Homo sapiens
caatactattcggaccatctct

SEQ ID NO: 9448976 - DNA, 22 bp, Homo sapiens
caatactgagtttacattcatc

SEQ ID NO: 9448977 - DNA, 22 bp, Homo sapiens
caatactgagtttacattcatc

SEQ ID NO: 9448978 - DNA, 19 bp, Homo sapiens
agcagcagaagtgtgcctt

SEQ ID NO: 9448979 - DNA, 19 bp, Homo sapiens
agcagcagaagtgtgcctt

SEQ ID NO: 9448980 - DNA, 19 bp, Homo sapiens
agcagcagaagtgtgcctt

SEQ ID NO: 9448981 - DNA, 22 bp, Homo sapiens
agcagcagaggtcagaaaggta

SEQ ID NO: 9448982 - DNA, 22 bp, Homo sapiens
agcagcagagctctggtctgca

SEQ ID NO: 9448983 - DNA, 19 bp, Homo sapiens
agcagcagaagtgtgcctt

SEQ ID NO: 9448984 - DNA, 22 bp, Homo sapiens
agcagcagatcaaacaggcttg

SEQ ID NO: 9448985 - DNA, 22 bp, Homo sapiens
agcagcagatccaaaaaatgtg

SEQ ID NO: 9448986 - DNA, 21 bp, Homo sapiens
agcagcagatctggtgagggc

SEQ ID NO: 9448987 - DNA, 22 bp, Homo sapiens
agcagcagatcaaacaggcttg

SEQ ID NO: 9448988 - DNA, 22 bp, Homo sapiens
agcagcagatccaaaaaatgtg

SEQ ID NO: 9448989 - DNA, 22 bp, Homo sapiens
agcagctggaacatatgaagaa

SEQ ID NO: 9448990 - DNA, 22 bp, Homo sapiens
agcagctggaacatatgaagaa

SEQ ID NO: 9448991 - DNA, 22 bp, Homo sapiens
agcagctggaacatatgaagaa

SEQ ID NO: 9448992 - DNA, 22 bp, Homo sapiens
agcagctggaacatatgaagaa

SEQ ID NO: 9448993 - DNA, 22 bp, Homo sapiens
agcagctggaacatatgaagaa

SEQ ID NO: 9448994 - DNA, 22 bp, Homo sapiens
agcagctgcttttcttcattgg

SEQ ID NO: 9448995 - DNA, 22 bp, Homo sapiens
cacagagctcaagtcttagaaa

SEQ ID NO: 9448996 - DNA, 22 bp, Homo sapiens
agcagctgctccacttgcttaa

SEQ ID NO: 9448997 - DNA, 22 bp, Homo sapiens
agcagctgcttttcttcattgg

SEQ ID NO: 9448998 - DNA, 22 bp, Homo sapiens
cacagagattagaattagacta

SEQ ID NO: 9448999 - DNA, 22 bp, Homo sapiens
cacagagattagaattagacta

SEQ ID NO: 9449000 - DNA, 22 bp, Homo sapiens
cacagagattagaattagacta

SEQ ID NO: 9449001 - DNA, 22 bp, Homo sapiens
cacagagatggtctggcaggtg

SEQ ID NO: 9449002 - DNA, 22 bp, Homo sapiens
cacagagatggtctggcaggtg

SEQ ID NO: 9449003 - DNA, 22 bp, Homo sapiens
cacagagatggccagggcacat

SEQ ID NO: 9449004 - DNA, 22 bp, Homo sapiens
cacagagatggccagggcacat

SEQ ID NO: 9449005 - DNA, 22 bp, Homo sapiens
cacagagatggtctggcaggtg

SEQ ID NO: 9449006 - DNA, 22 bp, Homo sapiens
cacagagatggtctggcaggtg

SEQ ID NO: 9449007 - DNA, 22 bp, Homo sapiens
agcagctggaactaatagtggt

SEQ ID NO: 9449008 - DNA, 22 bp, Homo sapiens
agcagctggaactaatagtggt

SEQ ID NO: 9449009 - DNA, 19 bp, Homo sapiens
agcagctggaggtggagtg

SEQ ID NO: 9449010 - DNA, 19 bp, Homo sapiens
agcagctggaggtggagtg

SEQ ID NO: 9449011 - DNA, 19 bp, Homo sapiens
agcagctggaggtggagtg

SEQ ID NO: 9449012 - DNA, 19 bp, Homo sapiens
agcagctggaggtggagtg

SEQ ID NO: 9449013 - DNA, 21 bp, Homo sapiens
agcagctgggcaacatggagg

SEQ ID NO: 9449014 - DNA, 22 bp, Homo sapiens
agcagctggcagcttcttctct

SEQ ID NO: 9449015 - DNA, 17 bp, Homo sapiens
agcagctggcacaggag

SEQ ID NO: 9449016 - DNA, 17 bp, Homo sapiens
agcagctggcacaggag

SEQ ID NO: 9449017 - DNA, 17 bp, Homo sapiens
agcagctggcacaggag

SEQ ID NO: 9449018 - DNA, 17 bp, Homo sapiens
agcagctggcacaggag

SEQ ID NO: 9449019 - DNA, 22 bp, Homo sapiens
agcagctcccctcatgctccac

SEQ ID NO: 9449020 - DNA, 22 bp, Homo sapiens
agcagctcccctcatgctccac

SEQ ID NO: 9449021 - DNA, 22 bp, Homo sapiens
cacagagaggcttgtctccaag

SEQ ID NO: 9449022 - DNA, 22 bp, Homo sapiens
cacagagaggcttgtctccaag

SEQ ID NO: 9449023 - DNA, 21 bp, Homo sapiens
cacagagatattggtgagcct

SEQ ID NO: 9449024 - DNA, 22 bp, Homo sapiens
cacagagagctacgtgcagcgt

SEQ ID NO: 9449025 - DNA, 22 bp, Homo sapiens
cacagagagctacgtgcagcgt

SEQ ID NO: 9449026 - DNA, 22 bp, Homo sapiens
cacagagatcggaacagaagta

SEQ ID NO: 9449027 - DNA, 22 bp, Homo sapiens
cacagagatcggaacagaagta

SEQ ID NO: 9449028 - DNA, 22 bp, Homo sapiens
cacagagatcggaacagaagta

SEQ ID NO: 9449029 - DNA, 21 bp, Homo sapiens
cacagagatattggtgagcct

SEQ ID NO: 9449030 - DNA, 21 bp, Homo sapiens
cacagagatattggtgagcct

SEQ ID NO: 9449031 - DNA, 21 bp, Homo sapiens
cacagagatattggtgagcct

SEQ ID NO: 9449032 - DNA, 22 bp, Homo sapiens
cacagagatcggaacagaagta

SEQ ID NO: 9449033 - DNA, 22 bp, Homo sapiens
agcagctacttaaccttgtaca

SEQ ID NO: 9449034 - DNA, 22 bp, Homo sapiens
agcagcctttgatcatctggga

SEQ ID NO: 9449035 - DNA, 22 bp, Homo sapiens
agcagctagaatagtgcctggt

SEQ ID NO: 9449036 - DNA, 22 bp, Homo sapiens
agcagcctttgatcatctggga

SEQ ID NO: 9449037 - DNA, 22 bp, Homo sapiens
agcagcctttgatcatctggga

SEQ ID NO: 9449038 - DNA, 22 bp, Homo sapiens
agcagcctttgatcatctggga

SEQ ID NO: 9449039 - DNA, 22 bp, Homo sapiens
agcagctcatggagtaggcact

SEQ ID NO: 9449040 - DNA, 22 bp, Homo sapiens
agcagctcatggagtaggcact

SEQ ID NO: 9449041 - DNA, 22 bp, Homo sapiens
agcagctcagaggcaccagggc

SEQ ID NO: 9449042 - DNA, 22 bp, Homo sapiens
agcagctcaaagcctgcaagga

SEQ ID NO: 9449043 - DNA, 22 bp, Homo sapiens
agcagctcaacagtgtctctat

SEQ ID NO: 9449044 - DNA, 22 bp, Homo sapiens
agcagctcaacagtgtctctat

SEQ ID NO: 9449045 - DNA, 22 bp, Homo sapiens
agcagctcacaggattcctgaa

SEQ ID NO: 9449046 - DNA, 22 bp, Homo sapiens
agcagctcacaggattcctgaa

SEQ ID NO: 9449047 - DNA, 22 bp, Homo sapiens
agccccacgttgtctagcacct

SEQ ID NO: 9449048 - DNA, 22 bp, Homo sapiens
agccccagcccctctctcacaa

SEQ ID NO: 9449049 - DNA, 22 bp, Homo sapiens
agccccagcccctctctcacaa

SEQ ID NO: 9449050 - DNA, 22 bp, Homo sapiens
agccccagcccctctctcacaa

SEQ ID NO: 9449051 - DNA, 22 bp, Homo sapiens
agccccaggatgggccgcagga

SEQ ID NO: 9449052 - DNA, 22 bp, Homo sapiens
agccccaggatgggccgcagga

SEQ ID NO: 9449053 - DNA, 22 bp, Homo sapiens
agccccaggcccggacgcctct

SEQ ID NO: 9449054 - DNA, 22 bp, Homo sapiens
agccccacactctctctgagaa

SEQ ID NO: 9449055 - DNA, 22 bp, Homo sapiens
agccccacactctctctgagaa

SEQ ID NO: 9449056 - DNA, 22 bp, Homo sapiens
agcccaggttgaggctgcagtg

SEQ ID NO: 9449057 - DNA, 22 bp, Homo sapiens
agcccaggttgaggctgcagtg

SEQ ID NO: 9449058 - DNA, 22 bp, Homo sapiens
agcccaggttgaggctgcagtg

SEQ ID NO: 9449059 - DNA, 22 bp, Homo sapiens
agcccaggttgaggctgcagtg

SEQ ID NO: 9449060 - DNA, 22 bp, Homo sapiens
agcccaggttgaggctgcagtg

SEQ ID NO: 9449061 - DNA, 22 bp, Homo sapiens
agcccaggttgaggctgcagtg

SEQ ID NO: 9449062 - DNA, 22 bp, Homo sapiens
agcccagtgggccgaggcgggg

SEQ ID NO: 9449063 - DNA, 22 bp, Homo sapiens
agccagtttaagcaggaggggt

SEQ ID NO: 9449064 - DNA, 22 bp, Homo sapiens
agccagtttaagcaggaggggt

SEQ ID NO: 9449065 - DNA, 19 bp, Homo sapiens
agccagttggtaagaggct

SEQ ID NO: 9449066 - DNA, 22 bp, Homo sapiens
agccagttggctatgaggagga

SEQ ID NO: 9449067 - DNA, 22 bp, Homo sapiens
agccagttggctatgaggagga

SEQ ID NO: 9449068 - DNA, 22 bp, Homo sapiens
agccagttggctatgaggagga

SEQ ID NO: 9449069 - DNA, 22 bp, Homo sapiens
agcccaggttctaaagccaaac

SEQ ID NO: 9449070 - DNA, 22 bp, Homo sapiens
agcccaggttctaaagccaaac

SEQ ID NO: 9449071 - DNA, 22 bp, Homo sapiens
agcccaggttgaggctgcagtg

SEQ ID NO: 9449072 - DNA, 22 bp, Homo sapiens
agcccaggttgaggctgcagtg

SEQ ID NO: 9449073 - DNA, 22 bp, Homo sapiens
agcccaggttctaaagccaaac

SEQ ID NO: 9449074 - DNA, 22 bp, Homo sapiens
agcccaggttctaaagccaaac

SEQ ID NO: 9449075 - DNA, 22 bp, Homo sapiens
agcccagggagttgattagcat

SEQ ID NO: 9449076 - DNA, 22 bp, Homo sapiens
agcccagggacagggcggatgt

SEQ ID NO: 9449077 - DNA, 22 bp, Homo sapiens
agcccagggacagggcggatgt

SEQ ID NO: 9449078 - DNA, 19 bp, Homo sapiens
agccagttctagacaatgg

SEQ ID NO: 9449079 - DNA, 22 bp, Homo sapiens
agccagttcaagttatggcgtt

SEQ ID NO: 9449080 - DNA, 22 bp, Homo sapiens
agccagtgttaagtgactggtt

SEQ ID NO: 9449081 - DNA, 22 bp, Homo sapiens
agccagtgttaagtgactggtt

SEQ ID NO: 9449082 - DNA, 22 bp, Homo sapiens
agccagtgtcgtgtgacatgag

SEQ ID NO: 9449083 - DNA, 22 bp, Homo sapiens
agccagtgggattagagcctct

SEQ ID NO: 9449084 - DNA, 22 bp, Homo sapiens
agccagtgggattagagcctct

SEQ ID NO: 9449085 - DNA, 22 bp, Homo sapiens
agccagtgggattagagcctct

SEQ ID NO: 9449086 - DNA, 22 bp, Homo sapiens
cagagctctgacagctacagcc

SEQ ID NO: 9449087 - DNA, 22 bp, Homo sapiens
cagagctctctttgctactaca

SEQ ID NO: 9449088 - DNA, 22 bp, Homo sapiens
cagagctctatgttcatggagg

SEQ ID NO: 9449089 - DNA, 22 bp, Homo sapiens
cagagctctatgttcatggagg

SEQ ID NO: 9449090 - DNA, 22 bp, Homo sapiens
cagagctctgacagctacagcc

SEQ ID NO: 9449091 - DNA, 22 bp, Homo sapiens
agccctggatggacagtttccc

SEQ ID NO: 9449092 - DNA, 22 bp, Homo sapiens
agccctggagcaaaggtgtctt

SEQ ID NO: 9449093 - DNA, 22 bp, Homo sapiens
agccctggatggacagtttccc

SEQ ID NO: 9449094 - DNA, 22 bp, Homo sapiens
agccctggattctgaggtccaa

SEQ ID NO: 9449095 - DNA, 22 bp, Homo sapiens
agccctggcagagccaggtagt

SEQ ID NO: 9449096 - DNA, 22 bp, Homo sapiens
agccctggcagagccaggtagt

SEQ ID NO: 9449097 - DNA, 22 bp, Homo sapiens
agccctggaagccacagtccta

SEQ ID NO: 9449098 - DNA, 22 bp, Homo sapiens
agccctggaagccacagtccta

SEQ ID NO: 9449099 - DNA, 22 bp, Homo sapiens
agccctggaagccacagtccta

SEQ ID NO: 9449100 - DNA, 22 bp, Homo sapiens
agccctggagcaaaggtgtctt

SEQ ID NO: 9449101 - DNA, 22 bp, Homo sapiens
agccctggaccttagcccccac

SEQ ID NO: 9449102 - DNA, 22 bp, Homo sapiens
agccctggaccttagcccccac

SEQ ID NO: 9449103 - DNA, 22 bp, Homo sapiens
agccctggagcaaaggtgtctt

SEQ ID NO: 9449104 - DNA, 22 bp, Homo sapiens
agccctggagcaaaggtgtctt

SEQ ID NO: 9449105 - DNA, 22 bp, Homo sapiens
agccctgagctggcctgggctt

SEQ ID NO: 9449106 - DNA, 22 bp, Homo sapiens
agccctgagccagcctggtcag

SEQ ID NO: 9449107 - DNA, 22 bp, Homo sapiens
agccccagttccctggaagtct

SEQ ID NO: 9449108 - DNA, 22 bp, Homo sapiens
agccccagttccctggaagtct

SEQ ID NO: 9449109 - DNA, 22 bp, Homo sapiens
agccctgctgcctgaattagct

SEQ ID NO: 9449110 - DNA, 23 bp, Homo sapiens
agccctgctgagacccagctccc

SEQ ID NO: 9449111 - DNA, 22 bp, Homo sapiens
agccctgattaaccttggcttt

SEQ ID NO: 9449112 - DNA, 22 bp, Homo sapiens
agccctggcccggctgtgcttt

SEQ ID NO: 9449113 - DNA, 22 bp, Homo sapiens
agccctggcccggctgtgcttt

SEQ ID NO: 9449114 - DNA, 22 bp, Homo sapiens
agccctggcccggctgtgcttt

SEQ ID NO: 9449115 - DNA, 22 bp, Homo sapiens
agccctggctcccagcagcgct

SEQ ID NO: 9449116 - DNA, 22 bp, Homo sapiens
agccctggctcccagcagcgct

SEQ ID NO: 9449117 - DNA, 22 bp, Homo sapiens
agccctggctcccagcagcgct

SEQ ID NO: 9449118 - DNA, 22 bp, Homo sapiens
agccctgggaggccagcttgta

SEQ ID NO: 9449119 - DNA, 22 bp, Homo sapiens
agccctgggaggccagcttgta

SEQ ID NO: 9449120 - DNA, 22 bp, Homo sapiens
agccctgggaggccagcttgta

SEQ ID NO: 9449121 - DNA, 22 bp, Homo sapiens
agccctggctcccagcagcgct

SEQ ID NO: 9449122 - DNA, 22 bp, Homo sapiens
agccctgggcacctgtgagggg

SEQ ID NO: 9449123 - DNA, 22 bp, Homo sapiens
agccctgggatacagtaaaagc

SEQ ID NO: 9449124 - DNA, 22 bp, Homo sapiens
agccctgggaggccagcttgta

SEQ ID NO: 9449125 - DNA, 22 bp, Homo sapiens
agccctgggcacctgtgagggg

SEQ ID NO: 9449126 - DNA, 20 bp, Homo sapiens
cagatggcacgtcagggcat

SEQ ID NO: 9449127 - DNA, 22 bp, Homo sapiens
cagatgaagatcatagaatagt

SEQ ID NO: 9449128 - DNA, 22 bp, Homo sapiens
agccctgggctgtagataagca

SEQ ID NO: 9449129 - DNA, 22 bp, Homo sapiens
agccctgggcgttactgggatg

SEQ ID NO: 9449130 - DNA, 22 bp, Homo sapiens
agccctgggcgttactgggatg

SEQ ID NO: 9449131 - DNA, 22 bp, Homo sapiens
agccctgggcagccaaggaagc

SEQ ID NO: 9449132 - DNA, 22 bp, Homo sapiens
cagatggcatttcctttctggc

SEQ ID NO: 9449133 - DNA, 20 bp, Homo sapiens
cagatggcacgtcagggcat

SEQ ID NO: 9449134 - DNA, 22 bp, Homo sapiens
cagatggctgccttcttgctgt

SEQ ID NO: 9449135 - DNA, 22 bp, Homo sapiens
cagatggctgccttcttgctgt

SEQ ID NO: 9449136 - DNA, 22 bp, Homo sapiens
cagatggctgccaagatgggct

SEQ ID NO: 9449137 - DNA, 22 bp, Homo sapiens
cagatggccagaggcagctgca

SEQ ID NO: 9449138 - DNA, 22 bp, Homo sapiens
cagatggccagaggcagctgca

SEQ ID NO: 9449139 - DNA, 22 bp, Homo sapiens
cagatggctgccaagatgggct

SEQ ID NO: 9449140 - DNA, 22 bp, Homo sapiens
cagatggctgccaagatgggct

SEQ ID NO: 9449141 - DNA, 22 bp, Homo sapiens
agccagccagttcactaggaaa

SEQ ID NO: 9449142 - DNA, 20 bp, Homo sapiens
agccagccacttcctgctcc

SEQ ID NO: 9449143 - DNA, 22 bp, Homo sapiens
agccagcatgaagacagaggcc

SEQ ID NO: 9449144 - DNA, 22 bp, Homo sapiens
agccagcatgaagacagaggcc

SEQ ID NO: 9449145 - DNA, 22 bp, Homo sapiens
agccagcatgaagacagaggcc

SEQ ID NO: 9449146 - DNA, 22 bp, Homo sapiens
agccagcatcccttcagtctcc

SEQ ID NO: 9449147 - DNA, 22 bp, Homo sapiens
agccagcatcccttcagtctcc

SEQ ID NO: 9449148 - DNA, 22 bp, Homo sapiens
agccagcctgatctcttcttgc

SEQ ID NO: 9449149 - DNA, 22 bp, Homo sapiens
agccagctaccggggctcctgg

SEQ ID NO: 9449150 - DNA, 22 bp, Homo sapiens
agccagctaccggggctcctgg

SEQ ID NO: 9449151 - DNA, 22 bp, Homo sapiens
agccagctaccggggctcctgg

SEQ ID NO: 9449152 - DNA, 22 bp, Homo sapiens
agccagccgggggaccacagtg

SEQ ID NO: 9449153 - DNA, 22 bp, Homo sapiens
agccagccgggggaccacagtg

SEQ ID NO: 9449154 - DNA, 22 bp, Homo sapiens
agccagcccctgactgtgtcct

SEQ ID NO: 9449155 - DNA, 22 bp, Homo sapiens
agccagccagttcactaggaaa

SEQ ID NO: 9449156 - DNA, 19 bp, Homo sapiens
agccagccagcaggtatgc

SEQ ID NO: 9449157 - DNA, 22 bp, Homo sapiens
agccagcagggcttagaggaca

SEQ ID NO: 9449158 - DNA, 22 bp, Homo sapiens
agccagcaggtgagtgcagcct

SEQ ID NO: 9449159 - DNA, 22 bp, Homo sapiens
agccagcagggcttagaggaca

SEQ ID NO: 9449160 - DNA, 22 bp, Homo sapiens
agccagcagggcttagaggaca

SEQ ID NO: 9449161 - DNA, 19 bp, Homo sapiens
agccagcaggcctctgagc

SEQ ID NO: 9449162 - DNA, 22 bp, Homo sapiens
agccagcaggaacgtctaggtt

SEQ ID NO: 9449163 - DNA, 22 bp, Homo sapiens
agccagcaggaacgtctaggtt

SEQ ID NO: 9449164 - DNA, 22 bp, Homo sapiens
agccagcaggaacgtctaggtt

SEQ ID NO: 9449165 - DNA, 22 bp, Homo sapiens
agccagcaggaacgtctaggtt

SEQ ID NO: 9449166 - DNA, 22 bp, Homo sapiens
agccagcatcccttcagtctcc

SEQ ID NO: 9449167 - DNA, 22 bp, Homo sapiens
agccagcaggtgcagaattcca

SEQ ID NO: 9449168 - DNA, 22 bp, Homo sapiens
agccagcaggtgcagaattcca

SEQ ID NO: 9449169 - DNA, 22 bp, Homo sapiens
agccagcaggtgagtgcagcct

SEQ ID NO: 9449170 - DNA, 22 bp, Homo sapiens
cactttatgggaagcaaaaatt

SEQ ID NO: 9449171 - DNA, 22 bp, Homo sapiens
cactttattataaatttgagag

SEQ ID NO: 9449172 - DNA, 22 bp, Homo sapiens
cactttctgtgtatcttccatt

SEQ ID NO: 9449173 - DNA, 22 bp, Homo sapiens
cactttctgtgttgtgcaaaaa

SEQ ID NO: 9449174 - DNA, 22 bp, Homo sapiens
cactttcaagtttcagaggata

SEQ ID NO: 9449175 - DNA, 22 bp, Homo sapiens
cactttctcatgaatttggccc

SEQ ID NO: 9449176 - DNA, 22 bp, Homo sapiens
cactttcaagtttcagaggata

SEQ ID NO: 9449177 - DNA, 19 bp, Homo sapiens
agccagagtggcccagggg

SEQ ID NO: 9449178 - DNA, 19 bp, Homo sapiens
agccagagtggcccagggg

SEQ ID NO: 9449179 - DNA, 22 bp, Homo sapiens
agccagagttgaatgtgagtct

SEQ ID NO: 9449180 - DNA, 22 bp, Homo sapiens
agccagatccaggagacagctc

SEQ ID NO: 9449181 - DNA, 22 bp, Homo sapiens
agccagagagtgttggagatgt

SEQ ID NO: 9449182 - DNA, 22 bp, Homo sapiens
agccagagagtgttggagatgt

SEQ ID NO: 9449183 - DNA, 22 bp, Homo sapiens
agccagcacggatttcccagga

SEQ ID NO: 9449184 - DNA, 22 bp, Homo sapiens
agccagcacggatttcccagga

SEQ ID NO: 9449185 - DNA, 21 bp, Homo sapiens
agccagcaacacagcatctcc

SEQ ID NO: 9449186 - DNA, 23 bp, Homo sapiens
agccagatttctttgcagggcag

SEQ ID NO: 9449187 - DNA, 22 bp, Homo sapiens
agccagatacttggaaagaccc

SEQ ID NO: 9449188 - DNA, 22 bp, Homo sapiens
agccagatgctattgctggaaa

SEQ ID NO: 9449189 - DNA, 22 bp, Homo sapiens
agccagcacggcgccatggagt

SEQ ID NO: 9449190 - DNA, 22 bp, Homo sapiens
agccagcacggcgccatggagt

SEQ ID NO: 9449191 - DNA, 22 bp, Homo sapiens
agccagcacggcgccatggagt

SEQ ID NO: 9449192 - DNA, 22 bp, Homo sapiens
cagagccttagttctcctagaa

SEQ ID NO: 9449193 - DNA, 19 bp, Homo sapiens
cagagccttcagtgactcc

SEQ ID NO: 9449194 - DNA, 19 bp, Homo sapiens
cagagccttcagtgactcc

SEQ ID NO: 9449195 - DNA, 22 bp, Homo sapiens
cagagctcagagcagggcactc

SEQ ID NO: 9449196 - DNA, 22 bp, Homo sapiens
cagagctcagagctgccaggca

SEQ ID NO: 9449197 - DNA, 22 bp, Homo sapiens
agccaggccttagggagaggca

SEQ ID NO: 9449198 - DNA, 20 bp, Homo sapiens
agccaggcctcaagttaagt

SEQ ID NO: 9449199 - DNA, 22 bp, Homo sapiens
agccaggccttagggagaggca

SEQ ID NO: 9449200 - DNA, 22 bp, Homo sapiens
agccaggccttagggagaggca

SEQ ID NO: 9449201 - DNA, 22 bp, Homo sapiens
agccaggccagctgtcttgagt

SEQ ID NO: 9449202 - DNA, 22 bp, Homo sapiens
agccaggccagactcacaccct

SEQ ID NO: 9449203 - DNA, 20 bp, Homo sapiens
agccaggcctcaagttaagt

SEQ ID NO: 9449204 - DNA, 22 bp, Homo sapiens
agccaggccagctgtcttgagt

SEQ ID NO: 9449205 - DNA, 22 bp, Homo sapiens
agccaggccttttctcaaggtt

SEQ ID NO: 9449206 - DNA, 22 bp, Homo sapiens
cagagccattatggagacttgc

SEQ ID NO: 9449207 - DNA, 22 bp, Homo sapiens
cagagcccagggcctacgtccc

SEQ ID NO: 9449208 - DNA, 22 bp, Homo sapiens
cagagcctggcgatgtcatgga

SEQ ID NO: 9449209 - DNA, 21 bp, Homo sapiens
cagagcctgtgttgacagttg

SEQ ID NO: 9449210 - DNA, 22 bp, Homo sapiens
agccaggcagggctctcgctct

SEQ ID NO: 9449211 - DNA, 22 bp, Homo sapiens
agccaggccagactcacaccct

SEQ ID NO: 9449212 - DNA, 22 bp, Homo sapiens
agccaggccagactcacaccct

SEQ ID NO: 9449213 - DNA, 22 bp, Homo sapiens
agccaggccagactcacaccct

SEQ ID NO: 9449214 - DNA, 17 bp, Homo sapiens
agccaggcatatgaagt

SEQ ID NO: 9449215 - DNA, 17 bp, Homo sapiens
agccaggcatatgaagt

SEQ ID NO: 9449216 - DNA, 22 bp, Homo sapiens
agccaggcagggctctcgctct

SEQ ID NO: 9449217 - DNA, 20 bp, Homo sapiens
cagagacccaggcttcagct

SEQ ID NO: 9449218 - DNA, 22 bp, Homo sapiens
cagagaccctaggcaggtgaca

SEQ ID NO: 9449219 - DNA, 21 bp, Homo sapiens
agccagctatcacacagcatt

SEQ ID NO: 9449220 - DNA, 22 bp, Homo sapiens
cagagacatgtggcctgcacgt

SEQ ID NO: 9449221 - DNA, 22 bp, Homo sapiens
cagagacatgtggcctgcacgt

SEQ ID NO: 9449222 - DNA, 22 bp, Homo sapiens
cagagacattaagtgccatgat

SEQ ID NO: 9449223 - DNA, 22 bp, Homo sapiens
cagagacattctccccattgga

SEQ ID NO: 9449224 - DNA, 22 bp, Homo sapiens
cagagacattctccccattgga

SEQ ID NO: 9449225 - DNA, 22 bp, Homo sapiens
cagagacattctccccattgga

SEQ ID NO: 9449226 - DNA, 22 bp, Homo sapiens
agctcttatctctaagcacagc

SEQ ID NO: 9449227 - DNA, 22 bp, Homo sapiens
agctctgggccaggaaccctaa

SEQ ID NO: 9449228 - DNA, 22 bp, Homo sapiens
agctctgtgaagccagcagttc

SEQ ID NO: 9449229 - DNA, 22 bp, Homo sapiens
agctctgtgaagccagcagttc

SEQ ID NO: 9449230 - DNA, 22 bp, Homo sapiens
agctctgtgttcacagcactaa

SEQ ID NO: 9449231 - DNA, 20 bp, Homo sapiens
agctcttaagaagaagatga

SEQ ID NO: 9449232 - DNA, 22 bp, Homo sapiens
agctcctgtggcagctcttctg

SEQ ID NO: 9449233 - DNA, 22 bp, Homo sapiens
agctcctgtctcaagggagcct

SEQ ID NO: 9449234 - DNA, 22 bp, Homo sapiens
agctcctgtggcagctcttctg

SEQ ID NO: 9449235 - DNA, 22 bp, Homo sapiens
agctcctgtggcagctcttctg

SEQ ID NO: 9449236 - DNA, 22 bp, Homo sapiens
agctctgggattctcaggccac

SEQ ID NO: 9449237 - DNA, 22 bp, Homo sapiens
agctctgggattctcaggccac

SEQ ID NO: 9449238 - DNA, 22 bp, Homo sapiens
agctcctgtgtgaagcctccct

SEQ ID NO: 9449239 - DNA, 22 bp, Homo sapiens
agctcctggcaaggtcatggtg

SEQ ID NO: 9449240 - DNA, 22 bp, Homo sapiens
agctcctggcaaggtcatggtg

SEQ ID NO: 9449241 - DNA, 22 bp, Homo sapiens
agctcctggcaaggtcatggtg

SEQ ID NO: 9449242 - DNA, 22 bp, Homo sapiens
agctcctggcaaggtcatggtg

SEQ ID NO: 9449243 - DNA, 22 bp, Homo sapiens
agctcctggcaaggtcatggtg

SEQ ID NO: 9449244 - DNA, 22 bp, Homo sapiens
agctcctggctttcctctcacc

SEQ ID NO: 9449245 - DNA, 22 bp, Homo sapiens
agctcctgggagcaggtggtac

SEQ ID NO: 9449246 - DNA, 22 bp, Homo sapiens
agctcctggctttcctctcacc

SEQ ID NO: 9449247 - DNA, 22 bp, Homo sapiens
agctcctgggccaagcccatgc

SEQ ID NO: 9449248 - DNA, 22 bp, Homo sapiens
agctcctgggcacctctttcac

SEQ ID NO: 9449249 - DNA, 22 bp, Homo sapiens
agctcctgggccaagcccatgc

SEQ ID NO: 9449250 - DNA, 19 bp, Homo sapiens
agctcctgggctctgggcc

SEQ ID NO: 9449251 - DNA, 19 bp, Homo sapiens
agctcctgggctctgggcc

SEQ ID NO: 9449252 - DNA, 19 bp, Homo sapiens
agctcctgggctctgggcc

SEQ ID NO: 9449253 - DNA, 22 bp, Homo sapiens
agctcctgggccatcacaacca

SEQ ID NO: 9449254 - DNA, 22 bp, Homo sapiens
agctcctgtagtacatattatt

SEQ ID NO: 9449255 - DNA, 23 bp, Homo sapiens
agctcctgtaaggtggtcgtcac

SEQ ID NO: 9449256 - DNA, 22 bp, Homo sapiens
agctcctggtgcctcagccgaa

SEQ ID NO: 9449257 - DNA, 22 bp, Homo sapiens
agctcctggtgcctcagccgaa

SEQ ID NO: 9449258 - DNA, 22 bp, Homo sapiens
agctcctggtctttgtccagag

SEQ ID NO: 9449259 - DNA, 22 bp, Homo sapiens
agctcctggtctttgtccagag

SEQ ID NO: 9449260 - DNA, 18 bp, Homo sapiens
agctcctggtctcaggga

SEQ ID NO: 9449261 - DNA, 18 bp, Homo sapiens
agctcctggtctcaggga

SEQ ID NO: 9449262 - DNA, 18 bp, Homo sapiens
agctcctggtctcaggga

SEQ ID NO: 9449263 - DNA, 18 bp, Homo sapiens
agctcctggtctcaggga

SEQ ID NO: 9449264 - DNA, 22 bp, Homo sapiens
agctcctgggggttccaagcag

SEQ ID NO: 9449265 - DNA, 17 bp, Homo sapiens
agctcctggggtcttta

SEQ ID NO: 9449266 - DNA, 22 bp, Homo sapiens
agctaggacaggtagagatggg

SEQ ID NO: 9449267 - DNA, 22 bp, Homo sapiens
agctaggaaattgaggctgaga

SEQ ID NO: 9449268 - DNA, 22 bp, Homo sapiens
agctagccatgtggctcctgtg

SEQ ID NO: 9449269 - DNA, 23 bp, Homo sapiens
agctagcataatgtctggctcct

SEQ ID NO: 9449270 - DNA, 22 bp, Homo sapiens
agctagcaggaagcagtttagt

SEQ ID NO: 9449271 - DNA, 22 bp, Homo sapiens
agctagcaaatagcatgtagga

SEQ ID NO: 9449272 - DNA, 22 bp, Homo sapiens
agctagcctaggcagagtgcat

SEQ ID NO: 9449273 - DNA, 19 bp, Homo sapiens
agctcaggcccatcgtccc

SEQ ID NO: 9449274 - DNA, 20 bp, Homo sapiens
agctaggagaaagcatggag

SEQ ID NO: 9449275 - DNA, 20 bp, Homo sapiens
agctaggagaaagcatggag

SEQ ID NO: 9449276 - DNA, 22 bp, Homo sapiens
agctccagccgctgatgggttt

SEQ ID NO: 9449277 - DNA, 22 bp, Homo sapiens
agctccagccgctgatgggttt

SEQ ID NO: 9449278 - DNA, 22 bp, Homo sapiens
agctccagccctagtacagctg

SEQ ID NO: 9449279 - DNA, 22 bp, Homo sapiens
agctccagcccatctgctcgtg

SEQ ID NO: 9449280 - DNA, 22 bp, Homo sapiens
agctccagaagcctgcaaggta

SEQ ID NO: 9449281 - DNA, 22 bp, Homo sapiens
agctccagagccacatccatca

SEQ ID NO: 9449282 - DNA, 22 bp, Homo sapiens
agctccaggataagacaggtgc

SEQ ID NO: 9449283 - DNA, 19 bp, Homo sapiens
agctccaggcctggatgct

SEQ ID NO: 9449284 - DNA, 19 bp, Homo sapiens
agctccaggcctggatgct

SEQ ID NO: 9449285 - DNA, 19 bp, Homo sapiens
agctccaggcctggatgct

SEQ ID NO: 9449286 - DNA, 22 bp, Homo sapiens
agctccagcggatggtcttata

SEQ ID NO: 9449287 - DNA, 22 bp, Homo sapiens
agctccagcctcttctggaggt

SEQ ID NO: 9449288 - DNA, 22 bp, Homo sapiens
agctcctggaggtgcgcactcg

SEQ ID NO: 9449289 - DNA, 22 bp, Homo sapiens
agctcctggaggtgcgcactcg

SEQ ID NO: 9449290 - DNA, 22 bp, Homo sapiens
agctcctggatgaggcttatgt

SEQ ID NO: 9449291 - DNA, 22 bp, Homo sapiens
agctcctgcttgacagaagagg

SEQ ID NO: 9449292 - DNA, 20 bp, Homo sapiens
agctcctggactagagagtg

SEQ ID NO: 9449293 - DNA, 22 bp, Homo sapiens
agctcctggacgaacagggagt

SEQ ID NO: 9449294 - DNA, 22 bp, Homo sapiens
agctcctggacgaacagggagt

SEQ ID NO: 9449295 - DNA, 22 bp, Homo sapiens
agctcctgattctcagagatag

SEQ ID NO: 9449296 - DNA, 22 bp, Homo sapiens
agctcctgattctcagagatag

SEQ ID NO: 9449297 - DNA, 22 bp, Homo sapiens
agctccaggccttgggccccgg

SEQ ID NO: 9449298 - DNA, 21 bp, Homo sapiens
agctccaggctcctggggttc

SEQ ID NO: 9449299 - DNA, 20 bp, Homo sapiens
cagcaactttggactgagtt

SEQ ID NO: 9449300 - DNA, 20 bp, Homo sapiens
cagcaactttggactgagtt

SEQ ID NO: 9449301 - DNA, 22 bp, Homo sapiens
cagcaacttaggcagaacatct

SEQ ID NO: 9449302 - DNA, 22 bp, Homo sapiens
cagcaactcctgtagcttatgc

SEQ ID NO: 9449303 - DNA, 22 bp, Homo sapiens
cagcaactctcctgtgctcaaa

SEQ ID NO: 9449304 - DNA, 22 bp, Homo sapiens
cagcaactctcctgtgctcaaa

SEQ ID NO: 9449305 - DNA, 22 bp, Homo sapiens
cagcaactgtgcctgacacaca

SEQ ID NO: 9449306 - DNA, 22 bp, Homo sapiens
cagcaactggtcattgctctcc

SEQ ID NO: 9449307 - DNA, 22 bp, Homo sapiens
cagcaaatgagtggcagggcag

SEQ ID NO: 9449308 - DNA, 21 bp, Homo sapiens
cagcaaatcattgggcagact

SEQ ID NO: 9449309 - DNA, 21 bp, Homo sapiens
cagcaaatcattgggcagact

SEQ ID NO: 9449310 - DNA, 22 bp, Homo sapiens
cagcaacatatatgaaactgtg

SEQ ID NO: 9449311 - DNA, 22 bp, Homo sapiens
cagcaacctaaatccactaact

SEQ ID NO: 9449312 - DNA, 22 bp, Homo sapiens
cagcaacccgggggacctttct

SEQ ID NO: 9449313 - DNA, 22 bp, Homo sapiens
cagcaacatgtggtagtgtagg

SEQ ID NO: 9449314 - DNA, 22 bp, Homo sapiens
cagatgtacatgaagggcaatg

SEQ ID NO: 9449315 - DNA, 22 bp, Homo sapiens
cagatgtaattactcaagtcaa

SEQ ID NO: 9449316 - DNA, 22 bp, Homo sapiens
cagatggggcaaggccatctgt

SEQ ID NO: 9449317 - DNA, 20 bp, Homo sapiens
cagatgggacgtggaggagt

SEQ ID NO: 9449318 - DNA, 22 bp, Homo sapiens
cagatgtgcatgatgggaaggg

SEQ ID NO: 9449319 - DNA, 22 bp, Homo sapiens
cagatgtgcatgatgggaaggg

SEQ ID NO: 9449320 - DNA, 22 bp, Homo sapiens
cagatgtagtagctttattgca

SEQ ID NO: 9449321 - DNA, 22 bp, Homo sapiens
cagatgtgagctggggagagtg

SEQ ID NO: 9449322 - DNA, 23 bp, Homo sapiens
cagatgtgcaactctaggcaatg

SEQ ID NO: 9449323 - DNA, 22 bp, Homo sapiens
agcctgggcaacaacacagcga

SEQ ID NO: 9449324 - DNA, 21 bp, Homo sapiens
agcctgggaggcggaggttgc

SEQ ID NO: 9449325 - DNA, 22 bp, Homo sapiens
agcctgggcaacaacacagcga

SEQ ID NO: 9449326 - DNA, 17 bp, Homo sapiens
agcctgggaaggagtga

SEQ ID NO: 9449327 - DNA, 22 bp, Homo sapiens
agcctgggaatttagagttcgg

SEQ ID NO: 9449328 - DNA, 19 bp, Homo sapiens
agcctggctttgctctgct

SEQ ID NO: 9449329 - DNA, 17 bp, Homo sapiens
agcctgggaaggagtga

SEQ ID NO: 9449330 - DNA, 19 bp, Homo sapiens
agcctggctttgctctgct

SEQ ID NO: 9449331 - DNA, 22 bp, Homo sapiens
agcctggcttagctctctcact

SEQ ID NO: 9449332 - DNA, 22 bp, Homo sapiens
cagcaagaaaattcacatgctc

SEQ ID NO: 9449333 - DNA, 22 bp, Homo sapiens
cagcaagaaaattcacatgctc

SEQ ID NO: 9449334 - DNA, 22 bp, Homo sapiens
agcctggcactgccccatccat

SEQ ID NO: 9449335 - DNA, 22 bp, Homo sapiens
cagcaagaacagcctgatgtgc

SEQ ID NO: 9449336 - DNA, 22 bp, Homo sapiens
agcctggcttaatcctcctttt

SEQ ID NO: 9449337 - DNA, 22 bp, Homo sapiens
agcctggccactcagggcctga

SEQ ID NO: 9449338 - DNA, 22 bp, Homo sapiens
agctacaacttttccatgagca

SEQ ID NO: 9449339 - DNA, 17 bp, Homo sapiens
agctacaaggcagttca

SEQ ID NO: 9449340 - DNA, 20 bp, Homo sapiens
agctacaatgcgaagctggc

SEQ ID NO: 9449341 - DNA, 22 bp, Homo sapiens
agctaagatttattaaaggccc

SEQ ID NO: 9449342 - DNA, 22 bp, Homo sapiens
agctaaggaactctgtaacacc

SEQ ID NO: 9449343 - DNA, 22 bp, Homo sapiens
agctaaggactggagggtttct

SEQ ID NO: 9449344 - DNA, 22 bp, Homo sapiens
agctaaggtgtcctggaggccc

SEQ ID NO: 9449345 - DNA, 22 bp, Homo sapiens
agctaatgatacatgctccaca

SEQ ID NO: 9449346 - DNA, 22 bp, Homo sapiens
agctaatgtatgttgaaagcac

SEQ ID NO: 9449347 - DNA, 22 bp, Homo sapiens
agctactctgcagtgcccatgg

SEQ ID NO: 9449348 - DNA, 22 bp, Homo sapiens
agctactggagaacacaaaacc

SEQ ID NO: 9449349 - DNA, 22 bp, Homo sapiens
agctagagaatgacagagtctg

SEQ ID NO: 9449350 - DNA, 22 bp, Homo sapiens
agctagaatattgatctgaaat

SEQ ID NO: 9449351 - DNA, 22 bp, Homo sapiens
agctagaatattgatctgaaat

SEQ ID NO: 9449352 - DNA, 18 bp, Homo sapiens
agctacgacatcaatgtt

SEQ ID NO: 9449353 - DNA, 22 bp, Homo sapiens
agctacctgatccttcttctga

SEQ ID NO: 9449354 - DNA, 22 bp, Homo sapiens
agctacatgaaattgctgatat

SEQ ID NO: 9449355 - DNA, 22 bp, Homo sapiens
agctacctgatccttcttctga

SEQ ID NO: 9449356 - DNA, 22 bp, Homo sapiens
agctaacatgactagaagcttc

SEQ ID NO: 9449357 - DNA, 22 bp, Homo sapiens
agctaacatggaggaaaaagtt

SEQ ID NO: 9449358 - DNA, 22 bp, Homo sapiens
agctaagacttagtgacttagt

SEQ ID NO: 9449359 - DNA, 23 bp, Homo sapiens
agctaacagatcgacaaagtata

SEQ ID NO: 9449360 - DNA, 23 bp, Homo sapiens
agctaacagatcgacaaagtata

SEQ ID NO: 9449361 - DNA, 22 bp, Homo sapiens
agcctggtgtggggctgcagag

SEQ ID NO: 9449362 - DNA, 22 bp, Homo sapiens
agcctgggttagggttcttccc

SEQ ID NO: 9449363 - DNA, 21 bp, Homo sapiens
agcctgggtatcctttgagga

SEQ ID NO: 9449364 - DNA, 22 bp, Homo sapiens
agcctggggtttcagtttgcac

SEQ ID NO: 9449365 - DNA, 22 bp, Homo sapiens
agcctggggcacttctccaaac

SEQ ID NO: 9449366 - DNA, 18 bp, Homo sapiens
agcctgggctctgcctgg

SEQ ID NO: 9449367 - DNA, 22 bp, Homo sapiens
agcctgggccctgcctcttctc

SEQ ID NO: 9449368 - DNA, 22 bp, Homo sapiens
agcctgggcatgggacgggagg

SEQ ID NO: 9449369 - DNA, 18 bp, Homo sapiens
agcctgggctctgcctgg

SEQ ID NO: 9449370 - DNA, 22 bp, Homo sapiens
agaggcaagttcagagctagga

SEQ ID NO: 9449371 - DNA, 22 bp, Homo sapiens
agaggcaatgaaagcagtctct

SEQ ID NO: 9449372 - DNA, 22 bp, Homo sapiens
agaggcacaaactggaaaggac

SEQ ID NO: 9449373 - DNA, 22 bp, Homo sapiens
agaggcaatgaaagcagtctct

SEQ ID NO: 9449374 - DNA, 22 bp, Homo sapiens
agaggcacagaggcagtcccct

SEQ ID NO: 9449375 - DNA, 22 bp, Homo sapiens
agaggcacatggagggtggaag

SEQ ID NO: 9449376 - DNA, 22 bp, Homo sapiens
agaggcacatggagggtggaag

SEQ ID NO: 9449377 - DNA, 22 bp, Homo sapiens
agaggcaaggcaggattcttct

SEQ ID NO: 9449378 - DNA, 22 bp, Homo sapiens
agaggcaaggcaggattcttct

SEQ ID NO: 9449379 - DNA, 22 bp, Homo sapiens
agaggcaaggcaggattcttct

SEQ ID NO: 9449380 - DNA, 22 bp, Homo sapiens
agaggcaagattatcagggcat

SEQ ID NO: 9449381 - DNA, 22 bp, Homo sapiens
agaggcaagggacctttctggg

SEQ ID NO: 9449382 - DNA, 19 bp, Homo sapiens
agaggcaagggctcatgac

SEQ ID NO: 9449383 - DNA, 19 bp, Homo sapiens
agaggcaagggtggaagta

SEQ ID NO: 9449384 - DNA, 22 bp, Homo sapiens
agaggcaagttcagagctagga

SEQ ID NO: 9449385 - DNA, 22 bp, Homo sapiens
agaggcaagttcagagctagga

SEQ ID NO: 9449386 - DNA, 19 bp, Homo sapiens
agaggcaagggtggaagta

SEQ ID NO: 9449387 - DNA, 19 bp, Homo sapiens
agaggcaagggtggaagta

SEQ ID NO: 9449388 - DNA, 19 bp, Homo sapiens
agaggcaagggctcatgac

SEQ ID NO: 9449389 - DNA, 19 bp, Homo sapiens
agaggcaagggctcatgac

SEQ ID NO: 9449390 - DNA, 20 bp, Homo sapiens
agagctgggaagctccctat

SEQ ID NO: 9449391 - DNA, 22 bp, Homo sapiens
agagctggctgtgggtgacttt

SEQ ID NO: 9449392 - DNA, 22 bp, Homo sapiens
agagctggctgtgggtgacttt

SEQ ID NO: 9449393 - DNA, 22 bp, Homo sapiens
agagctggctgtgggtgacttt

SEQ ID NO: 9449394 - DNA, 20 bp, Homo sapiens
agagctgggaagctccctat

SEQ ID NO: 9449395 - DNA, 20 bp, Homo sapiens
agagctgggaagctccctat

SEQ ID NO: 9449396 - DNA, 22 bp, Homo sapiens
agagctgggaccgtctggaagt

SEQ ID NO: 9449397 - DNA, 22 bp, Homo sapiens
agagctgggaccgtctggaagt

SEQ ID NO: 9449398 - DNA, 22 bp, Homo sapiens
agagctgggaccgtctggaagt

SEQ ID NO: 9449399 - DNA, 21 bp, Homo sapiens
agagctgggacttgcctgaga

SEQ ID NO: 9449400 - DNA, 22 bp, Homo sapiens
agaggaggctgggtccagataa

SEQ ID NO: 9449401 - DNA, 22 bp, Homo sapiens
agaggaggctgggtccagataa

SEQ ID NO: 9449402 - DNA, 22 bp, Homo sapiens
agaggcaagattatcagggcat

SEQ ID NO: 9449403 - DNA, 22 bp, Homo sapiens
agaggcaactgatttctgccag

SEQ ID NO: 9449404 - DNA, 22 bp, Homo sapiens
agaggcacggaggctgcatgga

SEQ ID NO: 9449405 - DNA, 22 bp, Homo sapiens
agaggcaccatctggaacagcc

SEQ ID NO: 9449406 - DNA, 22 bp, Homo sapiens
agaggcactaagggaagagcag

SEQ ID NO: 9449407 - DNA, 22 bp, Homo sapiens
agaggcactaagggaagagcag

SEQ ID NO: 9449408 - DNA, 22 bp, Homo sapiens
attacaatcgagagaaacaaat

SEQ ID NO: 9449409 - DNA, 22 bp, Homo sapiens
attacaatcgagagaaacaaat

SEQ ID NO: 9449410 - DNA, 22 bp, Homo sapiens
agaggcacccgcgcgcggccat

SEQ ID NO: 9449411 - DNA, 22 bp, Homo sapiens
agaggcaccgtctgcagcgtgc

SEQ ID NO: 9449412 - DNA, 23 bp, Homo sapiens
agaggcacctaaagtcaagttgt

SEQ ID NO: 9449413 - DNA, 22 bp, Homo sapiens
agaggcacccagttaagctgca

SEQ ID NO: 9449414 - DNA, 22 bp, Homo sapiens
agaggcacccagttaagctgca

SEQ ID NO: 9449415 - DNA, 22 bp, Homo sapiens
agaggcaccatctggaacagcc

SEQ ID NO: 9449416 - DNA, 22 bp, Homo sapiens
agaggcaccatctggaacagcc

SEQ ID NO: 9449417 - DNA, 22 bp, Homo sapiens
attacacagcggttactactag

SEQ ID NO: 9449418 - DNA, 22 bp, Homo sapiens
attacacagcggttactactag

SEQ ID NO: 9449419 - DNA, 22 bp, Homo sapiens
attacactaatgtgacaacaat

SEQ ID NO: 9449420 - DNA, 22 bp, Homo sapiens
attacagaatgcagttccttat

SEQ ID NO: 9449421 - DNA, 22 bp, Homo sapiens
attacagaaagcaatattgagt

SEQ ID NO: 9449422 - DNA, 22 bp, Homo sapiens
attacagtaacagctacaatgc

SEQ ID NO: 9449423 - DNA, 22 bp, Homo sapiens
attacagcttgctcagtttgca

SEQ ID NO: 9449424 - DNA, 22 bp, Homo sapiens
attacagtaacagctacaatgc

SEQ ID NO: 9449425 - DNA, 22 bp, Homo sapiens
agaggccaggcagcccaaggtg

SEQ ID NO: 9449426 - DNA, 22 bp, Homo sapiens
agaggccaggcagcccaaggtg

SEQ ID NO: 9449427 - DNA, 22 bp, Homo sapiens
agaggccagctagcgggccatc

SEQ ID NO: 9449428 - DNA, 22 bp, Homo sapiens
agaggccaggcagcccaaggtg

SEQ ID NO: 9449429 - DNA, 22 bp, Homo sapiens
agaggccagctagcgggccatc

SEQ ID NO: 9449430 - DNA, 22 bp, Homo sapiens
agaggccaggctgcagagggat

SEQ ID NO: 9449431 - DNA, 22 bp, Homo sapiens
agaggccaggctgcagagggat

SEQ ID NO: 9449432 - DNA, 22 bp, Homo sapiens
agaggccaggctgcagagggat

SEQ ID NO: 9449433 - DNA, 22 bp, Homo sapiens
agaggccaggctgcagagggat

SEQ ID NO: 9449434 - DNA, 22 bp, Homo sapiens
agaggccaggcagcccaaggtg

SEQ ID NO: 9449435 - DNA, 22 bp, Homo sapiens
agaggccaggctgcagagggat

SEQ ID NO: 9449436 - DNA, 22 bp, Homo sapiens
agaggctgcacttgctcatgat

SEQ ID NO: 9449437 - DNA, 18 bp, Homo sapiens
agaggctggacaggggat

SEQ ID NO: 9449438 - DNA, 22 bp, Homo sapiens
agaggctggattgagcatagac

SEQ ID NO: 9449439 - DNA, 22 bp, Homo sapiens
agaggctggattgagcatagac

SEQ ID NO: 9449440 - DNA, 22 bp, Homo sapiens
agaggctgcacttgctcatgat

SEQ ID NO: 9449441 - DNA, 22 bp, Homo sapiens
agaggctgcaggctggaaatca

SEQ ID NO: 9449442 - DNA, 22 bp, Homo sapiens
agaggctgcacttgctcatgat

SEQ ID NO: 9449443 - DNA, 18 bp, Homo sapiens
agaggctggacaggggat

SEQ ID NO: 9449444 - DNA, 22 bp, Homo sapiens
agaggccagcccaggccaccga

SEQ ID NO: 9449445 - DNA, 23 bp, Homo sapiens
agaggccagcctttggagacacc

SEQ ID NO: 9449446 - DNA, 23 bp, Homo sapiens
agaggccagcctttggagacacc

SEQ ID NO: 9449447 - DNA, 23 bp, Homo sapiens
agaggccagcctttggagacacc

SEQ ID NO: 9449448 - DNA, 23 bp, Homo sapiens
agaggccagcctttggagacacc

SEQ ID NO: 9449449 - DNA, 23 bp, Homo sapiens
agaggccagcctttggagacacc

SEQ ID NO: 9449450 - DNA, 22 bp, Homo sapiens
agaggccagcagtgcctatctg

SEQ ID NO: 9449451 - DNA, 22 bp, Homo sapiens
agaggccagcagtgcctatctg

SEQ ID NO: 9449452 - DNA, 22 bp, Homo sapiens
agaggccagcccaggccaccga

SEQ ID NO: 9449453 - DNA, 22 bp, Homo sapiens
agaggccagcccaggccaccga

SEQ ID NO: 9449454 - DNA, 22 bp, Homo sapiens
agaggccagcagtgcctatctg

SEQ ID NO: 9449455 - DNA, 22 bp, Homo sapiens
agaggccagcaaccacagtaaa

SEQ ID NO: 9449456 - DNA, 22 bp, Homo sapiens
agaggccagcaaccacagtaaa

SEQ ID NO: 9449457 - DNA, 22 bp, Homo sapiens
agaggccagatcatcatagatg

SEQ ID NO: 9449458 - DNA, 22 bp, Homo sapiens
agaggccagatcatcatagatg

SEQ ID NO: 9449459 - DNA, 22 bp, Homo sapiens
agaggccagcaaccacagtaaa

SEQ ID NO: 9449460 - DNA, 22 bp, Homo sapiens
agaggccagcaaccacagtaaa

SEQ ID NO: 9449461 - DNA, 22 bp, Homo sapiens
agaggccagatcatcatagatg

SEQ ID NO: 9449462 - DNA, 22 bp, Homo sapiens
agaggccagcactgcagggaag

SEQ ID NO: 9449463 - DNA, 22 bp, Homo sapiens
agaggccagcactgcagggaag

SEQ ID NO: 9449464 - DNA, 22 bp, Homo sapiens
agaggccagcaaccacagtaaa

SEQ ID NO: 9449465 - DNA, 22 bp, Homo sapiens
agaggccagcactgcagggaag

SEQ ID NO: 9449466 - DNA, 22 bp, Homo sapiens
agaggccagcactgcagggaag

SEQ ID NO: 9449467 - DNA, 22 bp, Homo sapiens
agaggccagcactgcagggaag

SEQ ID NO: 9449468 - DNA, 22 bp, Homo sapiens
agaggccagaaagtatgccacc

SEQ ID NO: 9449469 - DNA, 22 bp, Homo sapiens
agaggccagaaagtatgccacc

SEQ ID NO: 9449470 - DNA, 22 bp, Homo sapiens
agaggccagaaggcgcaccccg

SEQ ID NO: 9449471 - DNA, 22 bp, Homo sapiens
agaggccagaaggcgcaccccg

SEQ ID NO: 9449472 - DNA, 22 bp, Homo sapiens
agaggccactttgcctgtgatg

SEQ ID NO: 9449473 - DNA, 22 bp, Homo sapiens
agaggccactttgcctgtgatg

SEQ ID NO: 9449474 - DNA, 22 bp, Homo sapiens
agaggccaccttctcttgagaa

SEQ ID NO: 9449475 - DNA, 22 bp, Homo sapiens
agaggccaccttctcttgagaa

SEQ ID NO: 9449476 - DNA, 22 bp, Homo sapiens
agaggccaccttctcttgagaa

SEQ ID NO: 9449477 - DNA, 22 bp, Homo sapiens
agaggccaccactgtcagggac

SEQ ID NO: 9449478 - DNA, 22 bp, Homo sapiens
agaggccaccactgtcagggac

SEQ ID NO: 9449479 - DNA, 22 bp, Homo sapiens
agaggccaccagaggtggtgcc

SEQ ID NO: 9449480 - DNA, 22 bp, Homo sapiens
agaggccaccagaggtggtgcc

SEQ ID NO: 9449481 - DNA, 22 bp, Homo sapiens
agaggccaccagaggtggtgcc

SEQ ID NO: 9449482 - DNA, 22 bp, Homo sapiens
agaggccaccagaggtggtgcc

SEQ ID NO: 9449483 - DNA, 22 bp, Homo sapiens
agaggccaccttctcttgagaa

SEQ ID NO: 9449484 - DNA, 22 bp, Homo sapiens
agaggccacaccagcctcccgt

SEQ ID NO: 9449485 - DNA, 22 bp, Homo sapiens
agaggccacaccagcctcccgt

SEQ ID NO: 9449486 - DNA, 22 bp, Homo sapiens
agaggccaccactgtcagggac

SEQ ID NO: 9449487 - DNA, 16 bp, Homo sapiens
agaggccacagacaga

SEQ ID NO: 9449488 - DNA, 16 bp, Homo sapiens
agaggccacagacaga

SEQ ID NO: 9449489 - DNA, 16 bp, Homo sapiens
agaggccacagacaga

SEQ ID NO: 9449490 - DNA, 22 bp, Homo sapiens
agagtgcaaccgaaacaagcag

SEQ ID NO: 9449491 - DNA, 22 bp, Homo sapiens
agagtgcaaccgaaacaagcag

SEQ ID NO: 9449492 - DNA, 22 bp, Homo sapiens
agagtgcagaggtcaaagaaca

SEQ ID NO: 9449493 - DNA, 22 bp, Homo sapiens
agagtgcagaggtcaaagaaca

SEQ ID NO: 9449494 - DNA, 22 bp, Homo sapiens
agagtgatcctaattgatttgg

SEQ ID NO: 9449495 - DNA, 22 bp, Homo sapiens
agagtgcaaccgaaacaagcag

SEQ ID NO: 9449496 - DNA, 20 bp, Homo sapiens
agagtgagactccatctcag

SEQ ID NO: 9449497 - DNA, 22 bp, Homo sapiens
agagtgagggggcactgagacg

SEQ ID NO: 9449498 - DNA, 22 bp, Homo sapiens
agagtgcccaagcctggcaggg

SEQ ID NO: 9449499 - DNA, 22 bp, Homo sapiens
agagtgcttaaagctggctttg

SEQ ID NO: 9449500 - DNA, 20 bp, Homo sapiens
agagtgctggactgaggagc

SEQ ID NO: 9449501 - DNA, 22 bp, Homo sapiens
agagtgctagcctgagggaggt

SEQ ID NO: 9449502 - DNA, 22 bp, Homo sapiens
agagtgctaaaatcttatcttt

SEQ ID NO: 9449503 - DNA, 22 bp, Homo sapiens
agagtctgaggcagctgcagcc

SEQ ID NO: 9449504 - DNA, 22 bp, Homo sapiens
agagtctgatatttgtaccaga

SEQ ID NO: 9449505 - DNA, 22 bp, Homo sapiens
agagtctgaggaggaccaacag

SEQ ID NO: 9449506 - DNA, 22 bp, Homo sapiens
agagtctgaatgctcagagttg

SEQ ID NO: 9449507 - DNA, 22 bp, Homo sapiens
agagtccagaaaacagtgtgct

SEQ ID NO: 9449508 - DNA, 22 bp, Homo sapiens
agagtccagaaaacagtgtgct

SEQ ID NO: 9449509 - DNA, 22 bp, Homo sapiens
agagtccagaaaacagtgtgct

SEQ ID NO: 9449510 - DNA, 22 bp, Homo sapiens
agagtccatgaagacagctgag

SEQ ID NO: 9449511 - DNA, 22 bp, Homo sapiens
agagtccctcttcccaggaggc

SEQ ID NO: 9449512 - DNA, 22 bp, Homo sapiens
agagtccctcttcccaggaggc

SEQ ID NO: 9449513 - DNA, 22 bp, Homo sapiens
agagtatattgaagcagtcagg

SEQ ID NO: 9449514 - DNA, 22 bp, Homo sapiens
agagtcaagtagggcatgggct

SEQ ID NO: 9449515 - DNA, 22 bp, Homo sapiens
agagtcaagggtgcagaggaag

SEQ ID NO: 9449516 - DNA, 22 bp, Homo sapiens
agagtcaaggtggcatttagct

SEQ ID NO: 9449517 - DNA, 22 bp, Homo sapiens
agagtcaacatcgagccactgg

SEQ ID NO: 9449518 - DNA, 22 bp, Homo sapiens
agagtcaagggtgcagaggaag

SEQ ID NO: 9449519 - DNA, 22 bp, Homo sapiens
agagtactgctgctgggtactg

SEQ ID NO: 9449520 - DNA, 22 bp, Homo sapiens
agaggtgagtcattacctagtg

SEQ ID NO: 9449521 - DNA, 22 bp, Homo sapiens
agaggtgacataggagaggctc

SEQ ID NO: 9449522 - DNA, 22 bp, Homo sapiens
agaggtgacataggagaggctc

SEQ ID NO: 9449523 - DNA, 22 bp, Homo sapiens
agagtactgcctcagttatgaa

SEQ ID NO: 9449524 - DNA, 22 bp, Homo sapiens
agagtactgcctcagttatgaa

SEQ ID NO: 9449525 - DNA, 22 bp, Homo sapiens
agagtactgcctcagttatgaa

SEQ ID NO: 9449526 - DNA, 22 bp, Homo sapiens
agagtcagcttatgacacagtc

SEQ ID NO: 9449527 - DNA, 22 bp, Homo sapiens
agagtcagactaagccatggtg

SEQ ID NO: 9449528 - DNA, 22 bp, Homo sapiens
agagtcagaaagcagacagggg

SEQ ID NO: 9449529 - DNA, 22 bp, Homo sapiens
agagtcagaaagcagacagggg

SEQ ID NO: 9449530 - DNA, 22 bp, Homo sapiens
agagtcagcttatgacacagtc

SEQ ID NO: 9449531 - DNA, 22 bp, Homo sapiens
agagtcagttatgtcaagtgct

SEQ ID NO: 9449532 - DNA, 22 bp, Homo sapiens
agagtcagttatgtcaagtgct

SEQ ID NO: 9449533 - DNA, 22 bp, Homo sapiens
agagtcagtcactggcactttg

SEQ ID NO: 9449534 - DNA, 22 bp, Homo sapiens
agagtcagttagcgaatactta

SEQ ID NO: 9449535 - DNA, 22 bp, Homo sapiens
agagtccaccctggggtcaggc

SEQ ID NO: 9449536 - DNA, 22 bp, Homo sapiens
agagtccaaatgtgcagttatg

SEQ ID NO: 9449537 - DNA, 22 bp, Homo sapiens
agaggctgggtacgggccacct

SEQ ID NO: 9449538 - DNA, 22 bp, Homo sapiens
agaggctgggcaggacccacag

SEQ ID NO: 9449539 - DNA, 22 bp, Homo sapiens
agaggctgggaagggtccccgg

SEQ ID NO: 9449540 - DNA, 22 bp, Homo sapiens
agaggctgtcccttgctattcc

SEQ ID NO: 9449541 - DNA, 22 bp, Homo sapiens
agaggctgggtacgggccacct

SEQ ID NO: 9449542 - DNA, 22 bp, Homo sapiens
agagggctggacgcaggttgga

SEQ ID NO: 9449543 - DNA, 22 bp, Homo sapiens
agagggctgggatgtgctgtgt

SEQ ID NO: 9449544 - DNA, 22 bp, Homo sapiens
agagggcagtctcagattggga

SEQ ID NO: 9449545 - DNA, 22 bp, Homo sapiens
agagggcagggcggtaagtcct

SEQ ID NO: 9449546 - DNA, 22 bp, Homo sapiens
agaggggaaggatgtgatgtga

SEQ ID NO: 9449547 - DNA, 22 bp, Homo sapiens
agaggggaagtaatgaatgata

SEQ ID NO: 9449548 - DNA, 22 bp, Homo sapiens
agagggcttccctaggagtgag

SEQ ID NO: 9449549 - DNA, 22 bp, Homo sapiens
agagggctttgattctcagttc

SEQ ID NO: 9449550 - DNA, 22 bp, Homo sapiens
agaggggcaagtaaagagtctt

SEQ ID NO: 9449551 - DNA, 22 bp, Homo sapiens
agaggggcaagtaaagagtctt

SEQ ID NO: 9449552 - DNA, 22 bp, Homo sapiens
agaggggcagggtctccggatt

SEQ ID NO: 9449553 - DNA, 18 bp, Homo sapiens
agaggggaggtaagtctg

SEQ ID NO: 9449554 - DNA, 18 bp, Homo sapiens
agaggggaggtaagtctg

SEQ ID NO: 9449555 - DNA, 22 bp, Homo sapiens
agaggggagtcctaatctgatt

SEQ ID NO: 9449556 - DNA, 22 bp, Homo sapiens
agaggtgacataggagaggctc

SEQ ID NO: 9449557 - DNA, 22 bp, Homo sapiens
agaggggctcaagcagtggtct

SEQ ID NO: 9449558 - DNA, 22 bp, Homo sapiens
agaggggctcaagcagtggtct

SEQ ID NO: 9449559 - DNA, 22 bp, Homo sapiens
agaggggctcaagcagtggtct

SEQ ID NO: 9449560 - DNA, 22 bp, Homo sapiens
agaggggcagggtctccggatt

SEQ ID NO: 9449561 - DNA, 22 bp, Homo sapiens
agaggggcccggttctccgtct

SEQ ID NO: 9449562 - DNA, 22 bp, Homo sapiens
agaggggcgggaactcaacctc

SEQ ID NO: 9449563 - DNA, 22 bp, Homo sapiens
agaggggagagctaagcaattc

SEQ ID NO: 9449564 - DNA, 22 bp, Homo sapiens
agaggggagagctaagcaattc

SEQ ID NO: 9449565 - DNA, 22 bp, Homo sapiens
agaggggagagctaagcaattc

SEQ ID NO: 9449566 - DNA, 23 bp, Homo sapiens
agaggggagcatctgctggctga

SEQ ID NO: 9449567 - DNA, 22 bp, Homo sapiens
agaggggacagccacctgcccg

SEQ ID NO: 9449568 - DNA, 22 bp, Homo sapiens
agaggggaagtaatgaatgata

SEQ ID NO: 9449569 - DNA, 22 bp, Homo sapiens
agaggggaagtaatgaatgata

SEQ ID NO: 9449570 - DNA, 22 bp, Homo sapiens
agaggggaagtaatgaatgata

SEQ ID NO: 9449571 - DNA, 22 bp, Homo sapiens
agaggggacagccacctgcccg

SEQ ID NO: 9449572 - DNA, 22 bp, Homo sapiens
agaggggaggcgaaccagagtc

SEQ ID NO: 9449573 - DNA, 22 bp, Homo sapiens
agaggggaggcgaaccagagtc

SEQ ID NO: 9449574 - DNA, 22 bp, Homo sapiens
agaggggaggcgaaccagagtc

SEQ ID NO: 9449575 - DNA, 23 bp, Homo sapiens
agaggggagcatctgctggctga

SEQ ID NO: 9449576 - DNA, 22 bp, Homo sapiens
agaggggaggcgaaccagagtc

SEQ ID NO: 9449577 - DNA, 23 bp, Homo sapiens
agaggggagcatctgctggctga

SEQ ID NO: 9449578 - DNA, 23 bp, Homo sapiens
agaggggagcatctgctggctga

SEQ ID NO: 9449579 - DNA, 23 bp, Homo sapiens
agaggggagcatctgctggctga

SEQ ID NO: 9449580 - DNA, 22 bp, Homo sapiens
caaagataatcacagaataccc

SEQ ID NO: 9449581 - DNA, 22 bp, Homo sapiens
caaagataatcacagaataccc

SEQ ID NO: 9449582 - DNA, 22 bp, Homo sapiens
caaagagttttttcatataatg

SEQ ID NO: 9449583 - DNA, 22 bp, Homo sapiens
caaagagttttttcatataatg

SEQ ID NO: 9449584 - DNA, 22 bp, Homo sapiens
caaaccagtaggaagtctatta

SEQ ID NO: 9449585 - DNA, 22 bp, Homo sapiens
caaagataatcacagaataccc

SEQ ID NO: 9449586 - DNA, 22 bp, Homo sapiens
caaaccagtaggaagtctatta

SEQ ID NO: 9449587 - DNA, 17 bp, Homo sapiens
caaaccagtaagactgc

SEQ ID NO: 9449588 - DNA, 20 bp, Homo sapiens
agcaagagtaaggacagcga

SEQ ID NO: 9449589 - DNA, 22 bp, Homo sapiens
caaagatatgacatggaaaatg

SEQ ID NO: 9449590 - DNA, 23 bp, Homo sapiens
caaagatgattggaacatggctt

SEQ ID NO: 9449591 - DNA, 22 bp, Homo sapiens
caaagatatgacatggaaaatg

SEQ ID NO: 9449592 - DNA, 22 bp, Homo sapiens
caaagatatgacatggaaaatg

SEQ ID NO: 9449593 - DNA, 22 bp, Homo sapiens
caaagatatgacatggaaaatg

SEQ ID NO: 9449594 - DNA, 22 bp, Homo sapiens
caaagatgtcattggtaagaca

SEQ ID NO: 9449595 - DNA, 22 bp, Homo sapiens
caaagatgctgatgttggatca

SEQ ID NO: 9449596 - DNA, 22 bp, Homo sapiens
caaagatgccaaaaggaagaca

SEQ ID NO: 9449597 - DNA, 22 bp, Homo sapiens
caaagcaagggctgaagactcc

SEQ ID NO: 9449598 - DNA, 22 bp, Homo sapiens
caaagcaagggctgaagactcc

SEQ ID NO: 9449599 - DNA, 22 bp, Homo sapiens
caaagcaagggctgaagactcc

SEQ ID NO: 9449600 - DNA, 22 bp, Homo sapiens
caaagcaagggctgaagactcc

SEQ ID NO: 9449601 - DNA, 22 bp, Homo sapiens
caaagcaaggctcagtttgaac

SEQ ID NO: 9449602 - DNA, 22 bp, Homo sapiens
caaagcaaggctcagtttgaac

SEQ ID NO: 9449603 - DNA, 22 bp, Homo sapiens
caaagcaaggctcagtttgaac

SEQ ID NO: 9449604 - DNA, 22 bp, Homo sapiens
caaagcaaggctcagtttgaac

SEQ ID NO: 9449605 - DNA, 22 bp, Homo sapiens
caaagattttagaatttgcaat

SEQ ID NO: 9449606 - DNA, 22 bp, Homo sapiens
caaagcaaggctcagtttgaac

SEQ ID NO: 9449607 - DNA, 22 bp, Homo sapiens
caaagcagacctttacccttta

SEQ ID NO: 9449608 - DNA, 22 bp, Homo sapiens
caaagcagacctttacccttta

SEQ ID NO: 9449609 - DNA, 22 bp, Homo sapiens
caaagcagaaggttctgtggta

SEQ ID NO: 9449610 - DNA, 22 bp, Homo sapiens
caaagcaccacaaaccaggtga

SEQ ID NO: 9449611 - DNA, 22 bp, Homo sapiens
caaaggcaggtgctgaatattc

SEQ ID NO: 9449612 - DNA, 22 bp, Homo sapiens
caaaggcaggtgctgaatattc

SEQ ID NO: 9449613 - DNA, 22 bp, Homo sapiens
caaaggcaggtgctgaatattc

SEQ ID NO: 9449614 - DNA, 22 bp, Homo sapiens
caaaggcaggtcatggccactt

SEQ ID NO: 9449615 - DNA, 22 bp, Homo sapiens
caaaggcaggtcatggccactt

SEQ ID NO: 9449616 - DNA, 22 bp, Homo sapiens
caaaggcaggccccctgtgcag

SEQ ID NO: 9449617 - DNA, 20 bp, Homo sapiens
agcaagaaggttgtgggagc

SEQ ID NO: 9449618 - DNA, 22 bp, Homo sapiens
agcaagaagggcaaggaagttt

SEQ ID NO: 9449619 - DNA, 21 bp, Homo sapiens
agcaagaatcaggaaggctct

SEQ ID NO: 9449620 - DNA, 20 bp, Homo sapiens
agcaagagtaaggacagcga

SEQ ID NO: 9449621 - DNA, 20 bp, Homo sapiens
agcaagagtaaggacagcga

SEQ ID NO: 9449622 - DNA, 20 bp, Homo sapiens
agcaagagtaaggacagcga

SEQ ID NO: 9449623 - DNA, 22 bp, Homo sapiens
agcaacttttctagacatggtc

SEQ ID NO: 9449624 - DNA, 22 bp, Homo sapiens
agcaacttttctagacatggtc

SEQ ID NO: 9449625 - DNA, 22 bp, Homo sapiens
agcaagaaatcttcagtgttct

SEQ ID NO: 9449626 - DNA, 17 bp, Homo sapiens
agcaacttctcccacag

SEQ ID NO: 9449627 - DNA, 22 bp, Homo sapiens
agcaacttctacagatatagca

SEQ ID NO: 9449628 - DNA, 22 bp, Homo sapiens
agcaactttggatagttgcagg

SEQ ID NO: 9449629 - DNA, 22 bp, Homo sapiens
agcaactttgagatagacttag

SEQ ID NO: 9449630 - DNA, 22 bp, Homo sapiens
agcaactttattccactgggca

SEQ ID NO: 9449631 - DNA, 20 bp, Homo sapiens
agcaagaacgttctgaggga

SEQ ID NO: 9449632 - DNA, 22 bp, Homo sapiens
agcaagaagctttgctgtgata

SEQ ID NO: 9449633 - DNA, 18 bp, Homo sapiens
agcaacaggatcccaggg

SEQ ID NO: 9449634 - DNA, 22 bp, Homo sapiens
agcaacagggggatggccactg

SEQ ID NO: 9449635 - DNA, 23 bp, Homo sapiens
agcaacagtgggtgagtgttgct

SEQ ID NO: 9449636 - DNA, 23 bp, Homo sapiens
agcaacagtgggtgagtgttgct

SEQ ID NO: 9449637 - DNA, 23 bp, Homo sapiens
agcaacagtgggtgagtgttgct

SEQ ID NO: 9449638 - DNA, 22 bp, Homo sapiens
agcaacagggggatggccactg

SEQ ID NO: 9449639 - DNA, 22 bp, Homo sapiens
agcaacagggtggtcttcagaa

SEQ ID NO: 9449640 - DNA, 22 bp, Homo sapiens
agcaacagggtggtcttcagaa

SEQ ID NO: 9449641 - DNA, 22 bp, Homo sapiens
agcaacaggcataatgtgttga

SEQ ID NO: 9449642 - DNA, 22 bp, Homo sapiens
agcaacccgtccttgggggact

SEQ ID NO: 9449643 - DNA, 22 bp, Homo sapiens
agcaacatttttcaattaacat

SEQ ID NO: 9449644 - DNA, 22 bp, Homo sapiens
agcaacattgagactgcagttg

SEQ ID NO: 9449645 - DNA, 22 bp, Homo sapiens
agcaacatttttcaattaacat

SEQ ID NO: 9449646 - DNA, 22 bp, Homo sapiens
agcaacattgagactgcagttg

SEQ ID NO: 9449647 - DNA, 22 bp, Homo sapiens
agcaacatatatcaatgcctga

SEQ ID NO: 9449648 - DNA, 19 bp, Homo sapiens
agcaacaccgtttatttcc

SEQ ID NO: 9449649 - DNA, 19 bp, Homo sapiens
agcaacaccgtttatttcc

SEQ ID NO: 9449650 - DNA, 22 bp, Homo sapiens
agcaaattcagaagcagaatgg

SEQ ID NO: 9449651 - DNA, 22 bp, Homo sapiens
agcaaattcagaagcagaatgg

SEQ ID NO: 9449652 - DNA, 22 bp, Homo sapiens
agcaaatcagctgctcaggaaa

SEQ ID NO: 9449653 - DNA, 22 bp, Homo sapiens
agcaaattaggtcaaggagatg

SEQ ID NO: 9449654 - DNA, 22 bp, Homo sapiens
agcaaattcagaagcagaatgg

SEQ ID NO: 9449655 - DNA, 22 bp, Homo sapiens
agcaaattaggtcaaggagatg

SEQ ID NO: 9449656 - DNA, 22 bp, Homo sapiens
agcaacaggaaatagctgatta

SEQ ID NO: 9449657 - DNA, 22 bp, Homo sapiens
agcaacaggaatattatggcaa

SEQ ID NO: 9449658 - DNA, 22 bp, Homo sapiens
agcaacaggaatattatggcaa

SEQ ID NO: 9449659 - DNA, 22 bp, Homo sapiens
agcaacagccctgtttcattag

SEQ ID NO: 9449660 - DNA, 22 bp, Homo sapiens
agcaacagcaacgacatttctc

SEQ ID NO: 9449661 - DNA, 22 bp, Homo sapiens
agcaacagcaggtttgcactcc

SEQ ID NO: 9449662 - DNA, 22 bp, Homo sapiens
agcaacagcaacgacatttctc

SEQ ID NO: 9449663 - DNA, 22 bp, Homo sapiens
agcaacagcaggtttgcactcc

SEQ ID NO: 9449664 - DNA, 22 bp, Homo sapiens
agcaacagcaacgacatttctc

SEQ ID NO: 9449665 - DNA, 22 bp, Homo sapiens
agcaacagaagatagagtgaat

SEQ ID NO: 9449666 - DNA, 22 bp, Homo sapiens
agatgtttaaaaagatgactct

SEQ ID NO: 9449667 - DNA, 22 bp, Homo sapiens
agatgtgtttctagttcctgca

SEQ ID NO: 9449668 - DNA, 22 bp, Homo sapiens
agatgtgtttctagttcctgca

SEQ ID NO: 9449669 - DNA, 22 bp, Homo sapiens
agatgtgtttctagttcctgca

SEQ ID NO: 9449670 - DNA, 22 bp, Homo sapiens
agcaaatattttgttgaagtgc

SEQ ID NO: 9449671 - DNA, 22 bp, Homo sapiens
agcaaagctcatgacattacag

SEQ ID NO: 9449672 - DNA, 22 bp, Homo sapiens
agcaaagctcatgacattacag

SEQ ID NO: 9449673 - DNA, 22 bp, Homo sapiens
agcaaagctcatgacattacag

SEQ ID NO: 9449674 - DNA, 22 bp, Homo sapiens
agcaaagctatctctatggaga

SEQ ID NO: 9449675 - DNA, 22 bp, Homo sapiens
agatgtgggtgtcaggcagtga

SEQ ID NO: 9449676 - DNA, 22 bp, Homo sapiens
agatgtgggtgtcaggcagtga

SEQ ID NO: 9449677 - DNA, 22 bp, Homo sapiens
agatgtgtttctagttcctgca

SEQ ID NO: 9449678 - DNA, 22 bp, Homo sapiens
agatgtgggcaatggaatggag

SEQ ID NO: 9449679 - DNA, 22 bp, Homo sapiens
agatgtgggtgtcaggcagtga

SEQ ID NO: 9449680 - DNA, 22 bp, Homo sapiens
agatgtgggcaatggaatggag

SEQ ID NO: 9449681 - DNA, 22 bp, Homo sapiens
agatgtgggcaatggaatggag

SEQ ID NO: 9449682 - DNA, 22 bp, Homo sapiens
agatgtgggcaaaaggcttagc

SEQ ID NO: 9449683 - DNA, 22 bp, Homo sapiens
agatgtgggcaatggaatggag

SEQ ID NO: 9449684 - DNA, 22 bp, Homo sapiens
attttagcaaatgcaagatgga

SEQ ID NO: 9449685 - DNA, 22 bp, Homo sapiens
attttagatttaagaataaggt

SEQ ID NO: 9449686 - DNA, 22 bp, Homo sapiens
attttaaccctcttatatatac

SEQ ID NO: 9449687 - DNA, 22 bp, Homo sapiens
attttaaccctcttatatatac

SEQ ID NO: 9449688 - DNA, 22 bp, Homo sapiens
attttagtacctcaagtatcca

SEQ ID NO: 9449689 - DNA, 22 bp, Homo sapiens
attttagtacctcaagtatcca

SEQ ID NO: 9449690 - DNA, 22 bp, Homo sapiens
attttagtacctcaagtatcca

SEQ ID NO: 9449691 - DNA, 22 bp, Homo sapiens
attttagtacctcaagtatcca

SEQ ID NO: 9449692 - DNA, 22 bp, Homo sapiens
attttagttttagcatccatgc

SEQ ID NO: 9449693 - DNA, 22 bp, Homo sapiens
attttagttttagcatccatgc

SEQ ID NO: 9449694 - DNA, 22 bp, Homo sapiens
attttagttttagcatccatgc

SEQ ID NO: 9449695 - DNA, 22 bp, Homo sapiens
attttatccccactggattaca

SEQ ID NO: 9449696 - DNA, 22 bp, Homo sapiens
attttatccccactggattaca

SEQ ID NO: 9449697 - DNA, 22 bp, Homo sapiens
attttcaaaacatctgctgtgt

SEQ ID NO: 9449698 - DNA, 22 bp, Homo sapiens
attttcaaaacatctgctgtgt

SEQ ID NO: 9449699 - DNA, 22 bp, Homo sapiens
attttatgacacgattcttcca

SEQ ID NO: 9449700 - DNA, 22 bp, Homo sapiens
attttatgacacgattcttcca

SEQ ID NO: 9449701 - DNA, 22 bp, Homo sapiens
attttcaagggagaggcctctg

SEQ ID NO: 9449702 - DNA, 22 bp, Homo sapiens
attttatccccactggattaca

SEQ ID NO: 9449703 - DNA, 22 bp, Homo sapiens
agatgtggatcctagggtagaa

SEQ ID NO: 9449704 - DNA, 22 bp, Homo sapiens
attttcagaacattcattcact

SEQ ID NO: 9449705 - DNA, 22 bp, Homo sapiens
agatgtggcctttgggagatta

SEQ ID NO: 9449706 - DNA, 22 bp, Homo sapiens
agatgtggcctttgggagatta

SEQ ID NO: 9449707 - DNA, 22 bp, Homo sapiens
agatgtggcctttgggagatta

SEQ ID NO: 9449708 - DNA, 22 bp, Homo sapiens
agatgtggctgcacccaccgct

SEQ ID NO: 9449709 - DNA, 22 bp, Homo sapiens
agatgtggcctttgggagatta

SEQ ID NO: 9449710 - DNA, 22 bp, Homo sapiens
agatgtggccggctagggagag

SEQ ID NO: 9449711 - DNA, 22 bp, Homo sapiens
agatgtggccggctagggagag

SEQ ID NO: 9449712 - DNA, 22 bp, Homo sapiens
agatgtggccggctagggagag

SEQ ID NO: 9449713 - DNA, 22 bp, Homo sapiens
agatgtggccggctagggagag

SEQ ID NO: 9449714 - DNA, 22 bp, Homo sapiens
agatgtggccggctagggagag

SEQ ID NO: 9449715 - DNA, 22 bp, Homo sapiens
agatgtggatcctagggtagaa

SEQ ID NO: 9449716 - DNA, 22 bp, Homo sapiens
agatgtggatcctagggtagaa

SEQ ID NO: 9449717 - DNA, 22 bp, Homo sapiens
agatggcttccttctcactgtg

SEQ ID NO: 9449718 - DNA, 22 bp, Homo sapiens
agatggcttgtgagatgaacaa

SEQ ID NO: 9449719 - DNA, 22 bp, Homo sapiens
agatgggccttcgagcatgccc

SEQ ID NO: 9449720 - DNA, 22 bp, Homo sapiens
agatgggccttcgagcatgccc

SEQ ID NO: 9449721 - DNA, 22 bp, Homo sapiens
agatggctgggctcgtccgcag

SEQ ID NO: 9449722 - DNA, 20 bp, Homo sapiens
agatggctgtcatttctgtc

SEQ ID NO: 9449723 - DNA, 22 bp, Homo sapiens
agatggcttagcctggctccca

SEQ ID NO: 9449724 - DNA, 22 bp, Homo sapiens
agatggctgggagctctgtttg

SEQ ID NO: 9449725 - DNA, 22 bp, Homo sapiens
agatggctccagtgtccagagg

SEQ ID NO: 9449726 - DNA, 21 bp, Homo sapiens
agatggctcccaggtctctgg

SEQ ID NO: 9449727 - DNA, 22 bp, Homo sapiens
agatggctctcaagtctgatta

SEQ ID NO: 9449728 - DNA, 22 bp, Homo sapiens
agatggctctttgaaggggaat

SEQ ID NO: 9449729 - DNA, 22 bp, Homo sapiens
agatggctgattaactccatgg

SEQ ID NO: 9449730 - DNA, 22 bp, Homo sapiens
agatggcaggggtacctggaag

SEQ ID NO: 9449731 - DNA, 19 bp, Homo sapiens
agatggctaggatcaccct

SEQ ID NO: 9449732 - DNA, 22 bp, Homo sapiens
agatggctccagtgtccagagg

SEQ ID NO: 9449733 - DNA, 17 bp, Homo sapiens
agatggcaggaggcaga

SEQ ID NO: 9449734 - DNA, 17 bp, Homo sapiens
agatggcaggaggcaga

SEQ ID NO: 9449735 - DNA, 17 bp, Homo sapiens
agatggcaggaggcaga

SEQ ID NO: 9449736 - DNA, 22 bp, Homo sapiens
agatggcagcagaacaaacagg

SEQ ID NO: 9449737 - DNA, 17 bp, Homo sapiens
agatggcaggaggcaga

SEQ ID NO: 9449738 - DNA, 22 bp, Homo sapiens
agatggagttgtagcagtgact

SEQ ID NO: 9449739 - DNA, 22 bp, Homo sapiens
agatggagttgtagcagtgact

SEQ ID NO: 9449740 - DNA, 22 bp, Homo sapiens
agatggagttgtagcagtgact

SEQ ID NO: 9449741 - DNA, 19 bp, Homo sapiens
agatggcaaaatgcaaaga

SEQ ID NO: 9449742 - DNA, 19 bp, Homo sapiens
agatggcaaaatgcaaaga

SEQ ID NO: 9449743 - DNA, 22 bp, Homo sapiens
agatggagttagtaccagagtc

SEQ ID NO: 9449744 - DNA, 22 bp, Homo sapiens
agatggagtggagatgagtaaa

SEQ ID NO: 9449745 - DNA, 22 bp, Homo sapiens
agatggagtggagatgagtaaa

SEQ ID NO: 9449746 - DNA, 22 bp, Homo sapiens
agatggagtggagatgagtaaa

SEQ ID NO: 9449747 - DNA, 22 bp, Homo sapiens
agatggaggaaggctgaactca

SEQ ID NO: 9449748 - DNA, 22 bp, Homo sapiens
agatggagtctcactcttgttg

SEQ ID NO: 9449749 - DNA, 22 bp, Homo sapiens
agatggaggaaggctgaactca

SEQ ID NO: 9449750 - DNA, 22 bp, Homo sapiens
agatggagaccttggatgaact

SEQ ID NO: 9449751 - DNA, 22 bp, Homo sapiens
agatgctgtcttgctggctttg

SEQ ID NO: 9449752 - DNA, 22 bp, Homo sapiens
agatgctggggcccctcggatg

SEQ ID NO: 9449753 - DNA, 22 bp, Homo sapiens
agatgctgtcacacacactgtt

SEQ ID NO: 9449754 - DNA, 22 bp, Homo sapiens
agatgctgtcacacacactgtt

SEQ ID NO: 9449755 - DNA, 22 bp, Homo sapiens
agatggaaaatatagacagaga

SEQ ID NO: 9449756 - DNA, 22 bp, Homo sapiens
agatggagaccttggatgaact

SEQ ID NO: 9449757 - DNA, 22 bp, Homo sapiens
agatggaaaatatagacagaga

SEQ ID NO: 9449758 - DNA, 22 bp, Homo sapiens
agatgctttcctgatatttatg

SEQ ID NO: 9449759 - DNA, 22 bp, Homo sapiens
agatgcttcagtgtttaattta

SEQ ID NO: 9449760 - DNA, 22 bp, Homo sapiens
agatgcttaagttttcagtgta

SEQ ID NO: 9449761 - DNA, 22 bp, Homo sapiens
agatccactcgaatccaggaat

SEQ ID NO: 9449762 - DNA, 22 bp, Homo sapiens
agatccactcgaatccaggaat

SEQ ID NO: 9449763 - DNA, 22 bp, Homo sapiens
agatccagatccttcctggttg

SEQ ID NO: 9449764 - DNA, 22 bp, Homo sapiens
agatgattatgatagcactgtt

SEQ ID NO: 9449765 - DNA, 21 bp, Homo sapiens
agatcattcttctgagcactt

SEQ ID NO: 9449766 - DNA, 22 bp, Homo sapiens
agatccactatggtgctgatga

SEQ ID NO: 9449767 - DNA, 23 bp, Homo sapiens
agatccaacattgtccatttttt

SEQ ID NO: 9449768 - DNA, 22 bp, Homo sapiens
agatcagttagatagcttgatg

SEQ ID NO: 9449769 - DNA, 22 bp, Homo sapiens
agatcagtaagaggaagaatgg

SEQ ID NO: 9449770 - DNA, 22 bp, Homo sapiens
agatcagatctccttttgcatt

SEQ ID NO: 9449771 - DNA, 22 bp, Homo sapiens
agatcactttgatgctacctgg

SEQ ID NO: 9449772 - DNA, 22 bp, Homo sapiens
agatattttgtgtgatgtttca

SEQ ID NO: 9449773 - DNA, 22 bp, Homo sapiens
agatattttgtgtgatgtttca

SEQ ID NO: 9449774 - DNA, 22 bp, Homo sapiens
agatattttgtgtgatgtttca

SEQ ID NO: 9449775 - DNA, 22 bp, Homo sapiens
agatcaaatctgggatttctaa

SEQ ID NO: 9449776 - DNA, 22 bp, Homo sapiens
agatcaaaaacttaatggcttt

SEQ ID NO: 9449777 - DNA, 22 bp, Homo sapiens
agatcaaagccatgagagattt

SEQ ID NO: 9449778 - DNA, 22 bp, Homo sapiens
agatattttgtgtgatgtttca

SEQ ID NO: 9449779 - DNA, 22 bp, Homo sapiens
agatcacagtggcaactccctt

SEQ ID NO: 9449780 - DNA, 22 bp, Homo sapiens
agatcacataatttcctgtgac

SEQ ID NO: 9449781 - DNA, 22 bp, Homo sapiens
agatcactggttacttaatgaa

SEQ ID NO: 9449782 - DNA, 23 bp, Homo sapiens
agatcacatgctgatggaaaatg

SEQ ID NO: 9449783 - DNA, 22 bp, Homo sapiens
agatattaatcgtacataaggt

SEQ ID NO: 9449784 - DNA, 22 bp, Homo sapiens
agatattaatcgtacataaggt

SEQ ID NO: 9449785 - DNA, 22 bp, Homo sapiens
agatattaatcgtacataaggt

SEQ ID NO: 9449786 - DNA, 22 bp, Homo sapiens
agatattctagaacctagtaga

SEQ ID NO: 9449787 - DNA, 22 bp, Homo sapiens
agatattctgcctaacaggttt

SEQ ID NO: 9449788 - DNA, 22 bp, Homo sapiens
agatattaggaggattcataat

SEQ ID NO: 9449789 - DNA, 22 bp, Homo sapiens
agatattaggaggattcataat

SEQ ID NO: 9449790 - DNA, 22 bp, Homo sapiens
agatatttaaatcagacaaaga

SEQ ID NO: 9449791 - DNA, 22 bp, Homo sapiens
agatattgtgcatactgctgtt

SEQ ID NO: 9449792 - DNA, 22 bp, Homo sapiens
agatattgtttgtttcaccaat

SEQ ID NO: 9449793 - DNA, 22 bp, Homo sapiens
agatatttaaatcagacaaaga

SEQ ID NO: 9449794 - DNA, 22 bp, Homo sapiens
agatatttgtatcttgctattg

SEQ ID NO: 9449795 - DNA, 22 bp, Homo sapiens
agatatttgtatcttgctattg

SEQ ID NO: 9449796 - DNA, 22 bp, Homo sapiens
agatatttgtatcttgctattg

SEQ ID NO: 9449797 - DNA, 22 bp, Homo sapiens
agatatttgtatcttgctattg

SEQ ID NO: 9449798 - DNA, 22 bp, Homo sapiens
agagtggagagaaacaactctg

SEQ ID NO: 9449799 - DNA, 22 bp, Homo sapiens
agagtggagagaaacaactctg

SEQ ID NO: 9449800 - DNA, 22 bp, Homo sapiens
agagtgcttagtagtgacatgg

SEQ ID NO: 9449801 - DNA, 22 bp, Homo sapiens
attggctccttctaacatgtct

SEQ ID NO: 9449802 - DNA, 22 bp, Homo sapiens
attggccagacttatccttcag

SEQ ID NO: 9449803 - DNA, 21 bp, Homo sapiens
agatagttgggcatgcagctg

SEQ ID NO: 9449804 - DNA, 22 bp, Homo sapiens
attggtcataaattgagtgatt

SEQ ID NO: 9449805 - DNA, 22 bp, Homo sapiens
attggtccatttaccctctctt

SEQ ID NO: 9449806 - DNA, 18 bp, Homo sapiens
attggtcctgtccaccca

SEQ ID NO: 9449807 - DNA, 22 bp, Homo sapiens
attgggctggccttctggagag

SEQ ID NO: 9449808 - DNA, 22 bp, Homo sapiens
attgggatgccggctgataaga

SEQ ID NO: 9449809 - DNA, 22 bp, Homo sapiens
attgggatgccggctgataaga

SEQ ID NO: 9449810 - DNA, 22 bp, Homo sapiens
attgggatgccggctgataaga

SEQ ID NO: 9449811 - DNA, 22 bp, Homo sapiens
attggtaagcaagatggcaata

SEQ ID NO: 9449812 - DNA, 22 bp, Homo sapiens
attggtagttttgtatttctct

SEQ ID NO: 9449813 - DNA, 22 bp, Homo sapiens
attggtatgtattctgaaaact

SEQ ID NO: 9449814 - DNA, 22 bp, Homo sapiens
agagcaccccgggaagagcaag

SEQ ID NO: 9449815 - DNA, 22 bp, Homo sapiens
agagcagacatccttgtcttgt

SEQ ID NO: 9449816 - DNA, 22 bp, Homo sapiens
agagcagaggcatggccgtggg

SEQ ID NO: 9449817 - DNA, 22 bp, Homo sapiens
agagcagagggctctgggacaa

SEQ ID NO: 9449818 - DNA, 22 bp, Homo sapiens
agagcagagggctctgggacaa

SEQ ID NO: 9449819 - DNA, 22 bp, Homo sapiens
agagcagagtggctgtagcttg

SEQ ID NO: 9449820 - DNA, 22 bp, Homo sapiens
agagcagatggagctggaagag

SEQ ID NO: 9449821 - DNA, 22 bp, Homo sapiens
agagcagagtggctgtagcttg

SEQ ID NO: 9449822 - DNA, 22 bp, Homo sapiens
agagcacaggctctggagtcta

SEQ ID NO: 9449823 - DNA, 22 bp, Homo sapiens
agagaggtttgctggaagattc

SEQ ID NO: 9449824 - DNA, 22 bp, Homo sapiens
agagaggtttgctggaagattc

SEQ ID NO: 9449825 - DNA, 22 bp, Homo sapiens
agagagtctttctcttcctgtt

SEQ ID NO: 9449826 - DNA, 22 bp, Homo sapiens
agagagttgaggaagcaacact

SEQ ID NO: 9449827 - DNA, 22 bp, Homo sapiens
agagcacagtatctgcacatca

SEQ ID NO: 9449828 - DNA, 21 bp, Homo sapiens
agagcacaggtggacaatgct

SEQ ID NO: 9449829 - DNA, 21 bp, Homo sapiens
agagcacaggtggacaatgct

SEQ ID NO: 9449830 - DNA, 22 bp, Homo sapiens
agagcacagtgcaggatccccg

SEQ ID NO: 9449831 - DNA, 22 bp, Homo sapiens
agagcacagtatctgcacatca

SEQ ID NO: 9449832 - DNA, 22 bp, Homo sapiens
agagcacagggttttgtgccgg

SEQ ID NO: 9449833 - DNA, 22 bp, Homo sapiens
agagcagatggagctggaagag

SEQ ID NO: 9449834 - DNA, 22 bp, Homo sapiens
agagcagatggagctggaagag

SEQ ID NO: 9449835 - DNA, 22 bp, Homo sapiens
agagcagatggagctggaagag

SEQ ID NO: 9449836 - DNA, 22 bp, Homo sapiens
agagcagatggagctggaagag

SEQ ID NO: 9449837 - DNA, 22 bp, Homo sapiens
agagcagatggagctggaagag

SEQ ID NO: 9449838 - DNA, 22 bp, Homo sapiens
agagcagatggccagggggcct

SEQ ID NO: 9449839 - DNA, 22 bp, Homo sapiens
agagcagatggccagggggcct

SEQ ID NO: 9449840 - DNA, 22 bp, Homo sapiens
agagcagatttcaaatattggc

SEQ ID NO: 9449841 - DNA, 20 bp, Homo sapiens
agagcagcagttggtgaggt

SEQ ID NO: 9449842 - DNA, 20 bp, Homo sapiens
agagcagcagttggtgaggt

SEQ ID NO: 9449843 - DNA, 22 bp, Homo sapiens
agagcagcacgttgtccccaca

SEQ ID NO: 9449844 - DNA, 20 bp, Homo sapiens
agagcccagatgtctgtatt

SEQ ID NO: 9449845 - DNA, 22 bp, Homo sapiens
agagcccaggcaggcatccagg

SEQ ID NO: 9449846 - DNA, 22 bp, Homo sapiens
agagccaggccaggccggggca

SEQ ID NO: 9449847 - DNA, 22 bp, Homo sapiens
agagccaggcaggcaatgttga

SEQ ID NO: 9449848 - DNA, 20 bp, Homo sapiens
agagcagcagttggtgaggt

SEQ ID NO: 9449849 - DNA, 22 bp, Homo sapiens
agagcccctggtggagtgagaa

SEQ ID NO: 9449850 - DNA, 22 bp, Homo sapiens
agagcccatcagtggcagtgga

SEQ ID NO: 9449851 - DNA, 22 bp, Homo sapiens
agagcccctcggtggaggggtc

SEQ ID NO: 9449852 - DNA, 22 bp, Homo sapiens
agagcccctggtggagtgagaa

SEQ ID NO: 9449853 - DNA, 22 bp, Homo sapiens
agagcctgagcctgaaagccct

SEQ ID NO: 9449854 - DNA, 22 bp, Homo sapiens
agagcctgagcctgaaagccct

SEQ ID NO: 9449855 - DNA, 22 bp, Homo sapiens
agagcctgaggatgtcccagct

SEQ ID NO: 9449856 - DNA, 22 bp, Homo sapiens
agagcctgagaggataatgggg

SEQ ID NO: 9449857 - DNA, 22 bp, Homo sapiens
agagctctttgatttgcttctc

SEQ ID NO: 9449858 - DNA, 22 bp, Homo sapiens
agagccctgccaatggatgagg

SEQ ID NO: 9449859 - DNA, 22 bp, Homo sapiens
agagccctgcagttcttcagga

SEQ ID NO: 9449860 - DNA, 22 bp, Homo sapiens
agagccctgcagttcttcagga

SEQ ID NO: 9449861 - DNA, 22 bp, Homo sapiens
agagccctgcagttcttcagga

SEQ ID NO: 9449862 - DNA, 22 bp, Homo sapiens
agagcccttgccctcagtcacc

SEQ ID NO: 9449863 - DNA, 22 bp, Homo sapiens
agagcctctgtcatggagagaa

SEQ ID NO: 9449864 - DNA, 22 bp, Homo sapiens
agagccctttctccaggcacct

SEQ ID NO: 9449865 - DNA, 22 bp, Homo sapiens
agagcccttgccctcagtcacc

SEQ ID NO: 9449866 - DNA, 22 bp, Homo sapiens
agagccctttctccaggcacct

SEQ ID NO: 9449867 - DNA, 22 bp, Homo sapiens
agagccctctgcaatgcctcag

SEQ ID NO: 9449868 - DNA, 22 bp, Homo sapiens
agagccctgaagcagagctaaa

SEQ ID NO: 9449869 - DNA, 22 bp, Homo sapiens
agagccctaaaccctgccttgg

SEQ ID NO: 9449870 - DNA, 22 bp, Homo sapiens
agagccctgaagcagagctaaa

SEQ ID NO: 9449871 - DNA, 22 bp, Homo sapiens
agagccctgacggggacagatg

SEQ ID NO: 9449872 - DNA, 22 bp, Homo sapiens
agagccctgcagttcttcagga

SEQ ID NO: 9449873 - DNA, 22 bp, Homo sapiens
agagctggccagggatcactct

SEQ ID NO: 9449874 - DNA, 22 bp, Homo sapiens
agagctggccagggatcactct

SEQ ID NO: 9449875 - DNA, 22 bp, Homo sapiens
agagctggccagggatcactct

SEQ ID NO: 9449876 - DNA, 21 bp, Homo sapiens
agagctggcctgccaggccct

SEQ ID NO: 9449877 - DNA, 21 bp, Homo sapiens
agagctggcctgccaggccct

SEQ ID NO: 9449878 - DNA, 22 bp, Homo sapiens
agagctggctgtgggtgacttt

SEQ ID NO: 9449879 - DNA, 22 bp, Homo sapiens
agagctggctgctgcggtgctt

SEQ ID NO: 9449880 - DNA, 22 bp, Homo sapiens
agagctggctggtagccctgat

SEQ ID NO: 9449881 - DNA, 22 bp, Homo sapiens
agagctggaatcagacctcagg

SEQ ID NO: 9449882 - DNA, 22 bp, Homo sapiens
agagctggacgtctgagcccta

SEQ ID NO: 9449883 - DNA, 22 bp, Homo sapiens
agagctggagatgcaggtttcg

SEQ ID NO: 9449884 - DNA, 22 bp, Homo sapiens
agagctggagcagccccactgg

SEQ ID NO: 9449885 - DNA, 22 bp, Homo sapiens
agagctggatggtcaagatggc

SEQ ID NO: 9449886 - DNA, 22 bp, Homo sapiens
agagctggcagcagcttctcct

SEQ ID NO: 9449887 - DNA, 22 bp, Homo sapiens
agagctggcagcagcttctcct

SEQ ID NO: 9449888 - DNA, 22 bp, Homo sapiens
agagctggatggtcaagatggc

SEQ ID NO: 9449889 - DNA, 21 bp, Homo sapiens
agagagggagatgaaacatcc

SEQ ID NO: 9449890 - DNA, 22 bp, Homo sapiens
agagaggttggctaggatgttt

SEQ ID NO: 9449891 - DNA, 22 bp, Homo sapiens
agagaggtctcaggagaaacca

SEQ ID NO: 9449892 - DNA, 22 bp, Homo sapiens
agagagggaatatttggggtat

SEQ ID NO: 9449893 - DNA, 22 bp, Homo sapiens
agagagggaatatttggggtat

SEQ ID NO: 9449894 - DNA, 22 bp, Homo sapiens
agagagggaatatttggggtat

SEQ ID NO: 9449895 - DNA, 22 bp, Homo sapiens
agagaggctgggcgtagggctt

SEQ ID NO: 9449896 - DNA, 22 bp, Homo sapiens
agagaggatttgtttttctcct

SEQ ID NO: 9449897 - DNA, 22 bp, Homo sapiens
agagaggcattcggtgatccca

SEQ ID NO: 9449898 - DNA, 22 bp, Homo sapiens
agagagcttccattctagtgat

SEQ ID NO: 9449899 - DNA, 22 bp, Homo sapiens
agagaggcattcggtgatccca

SEQ ID NO: 9449900 - DNA, 22 bp, Homo sapiens
agagaggcgagttacctgtgct

SEQ ID NO: 9449901 - DNA, 22 bp, Homo sapiens
agagaggcgagttacctgtgct

SEQ ID NO: 9449902 - DNA, 22 bp, Homo sapiens
agagaggcgagttacctgtgct

SEQ ID NO: 9449903 - DNA, 22 bp, Homo sapiens
agagaggctgctggactatatg

SEQ ID NO: 9449904 - DNA, 22 bp, Homo sapiens
agagaggctgctggactatatg

SEQ ID NO: 9449905 - DNA, 22 bp, Homo sapiens
agagagctgactttggagtcag

SEQ ID NO: 9449906 - DNA, 22 bp, Homo sapiens
agagagctgactttggagtcag

SEQ ID NO: 9449907 - DNA, 22 bp, Homo sapiens
agagagctgtcctgggacaccc

SEQ ID NO: 9449908 - DNA, 22 bp, Homo sapiens
agagagctgtcctgggacaccc

SEQ ID NO: 9449909 - DNA, 22 bp, Homo sapiens
agagagctctggctgggtgacc

SEQ ID NO: 9449910 - DNA, 22 bp, Homo sapiens
agagagctctggctgggtgacc

SEQ ID NO: 9449911 - DNA, 22 bp, Homo sapiens
agagagctctgatgggaggtga

SEQ ID NO: 9449912 - DNA, 23 bp, Homo sapiens
agagagctcactatatagcattg

SEQ ID NO: 9449913 - DNA, 22 bp, Homo sapiens
agagagcccgggccagggcaca

SEQ ID NO: 9449914 - DNA, 22 bp, Homo sapiens
agagacaatgccaatgcacacg

SEQ ID NO: 9449915 - DNA, 22 bp, Homo sapiens
agagacaatgccaatgcacacg

SEQ ID NO: 9449916 - DNA, 22 bp, Homo sapiens
agagacaatgccaatgcacacg

SEQ ID NO: 9449917 - DNA, 22 bp, Homo sapiens
agagacaaacactgcaacttct

SEQ ID NO: 9449918 - DNA, 22 bp, Homo sapiens
agagacaaacactgcaacttct

SEQ ID NO: 9449919 - DNA, 22 bp, Homo sapiens
agagacaagaaatacctgggac

SEQ ID NO: 9449920 - DNA, 22 bp, Homo sapiens
agagacaagaaatacctgggac

SEQ ID NO: 9449921 - DNA, 22 bp, Homo sapiens
agagacaagggacctctggaga

SEQ ID NO: 9449922 - DNA, 22 bp, Homo sapiens
agagacaatgccaatgcacacg

SEQ ID NO: 9449923 - DNA, 22 bp, Homo sapiens
agagacaatgccaatgcacacg

SEQ ID NO: 9449924 - DNA, 22 bp, Homo sapiens
agagacaatgccaatgcacacg

SEQ ID NO: 9449925 - DNA, 22 bp, Homo sapiens
agagacaatgccaatgcacacg

SEQ ID NO: 9449926 - DNA, 22 bp, Homo sapiens
agagaattggagcagtgacagg

SEQ ID NO: 9449927 - DNA, 22 bp, Homo sapiens
agagaattttaaaagccttgaa

SEQ ID NO: 9449928 - DNA, 20 bp, Homo sapiens
agagaattccctttggagat

SEQ ID NO: 9449929 - DNA, 22 bp, Homo sapiens
agagaattacagaagaatgtca

SEQ ID NO: 9449930 - DNA, 22 bp, Homo sapiens
agagacagacacatcgggctgc

SEQ ID NO: 9449931 - DNA, 22 bp, Homo sapiens
agagacagacacatcgggctgc

SEQ ID NO: 9449932 - DNA, 21 bp, Homo sapiens
agagacagagaaagtaacatt

SEQ ID NO: 9449933 - DNA, 21 bp, Homo sapiens
agagacagagaaagtaacatt

SEQ ID NO: 9449934 - DNA, 22 bp, Homo sapiens
agagagcatggcacagaggggt

SEQ ID NO: 9449935 - DNA, 22 bp, Homo sapiens
agagagcatggcacagaggggt

SEQ ID NO: 9449936 - DNA, 22 bp, Homo sapiens
agagagcccgggccagggcaca

SEQ ID NO: 9449937 - DNA, 22 bp, Homo sapiens
agagaatacagggtaacaggaa

SEQ ID NO: 9449938 - DNA, 22 bp, Homo sapiens
agagaatacagggtaacaggaa

SEQ ID NO: 9449939 - DNA, 23 bp, Homo sapiens
agagaatcatggaaactctttct

SEQ ID NO: 9449940 - DNA, 22 bp, Homo sapiens
agagaatccccagacagagtta

SEQ ID NO: 9449941 - DNA, 22 bp, Homo sapiens
agagaatcctctacatgttttt

SEQ ID NO: 9449942 - DNA, 22 bp, Homo sapiens
agagaatctagaatgtttatac

SEQ ID NO: 9449943 - DNA, 22 bp, Homo sapiens
agagaatctgggaagatgttaa

SEQ ID NO: 9449944 - DNA, 22 bp, Homo sapiens
agagaaggtcactaaggaccca

SEQ ID NO: 9449945 - DNA, 22 bp, Homo sapiens
agagaagggtgtagcctgggcc

SEQ ID NO: 9449946 - DNA, 22 bp, Homo sapiens
agagaaggtcactaaggaccca

SEQ ID NO: 9449947 - DNA, 22 bp, Homo sapiens
agagaaggtcactaaggaccca

SEQ ID NO: 9449948 - DNA, 22 bp, Homo sapiens
agagaaggtcactaaggaccca

SEQ ID NO: 9449949 - DNA, 22 bp, Homo sapiens
agagaaggtcactaaggaccca

SEQ ID NO: 9449950 - DNA, 22 bp, Homo sapiens
agagaaggtcactaaggaccca

SEQ ID NO: 9449951 - DNA, 22 bp, Homo sapiens
agagaaggtcactaaggaccca

SEQ ID NO: 9449952 - DNA, 22 bp, Homo sapiens
agagaagggtgtagcctgggcc

SEQ ID NO: 9449953 - DNA, 22 bp, Homo sapiens
agagaaggtcactaaggaccca

SEQ ID NO: 9449954 - DNA, 22 bp, Homo sapiens
agagaagggtgtagcctgggcc

SEQ ID NO: 9449955 - DNA, 22 bp, Homo sapiens
agagaagggtgtagcctgggcc

SEQ ID NO: 9449956 - DNA, 22 bp, Homo sapiens
agagaagggtagcccattctcc

SEQ ID NO: 9449957 - DNA, 22 bp, Homo sapiens
agagaagggtagcccattctcc

SEQ ID NO: 9449958 - DNA, 22 bp, Homo sapiens
agagaagggtgtagcctgggcc

SEQ ID NO: 9449959 - DNA, 22 bp, Homo sapiens
agagaagggtagcccattctcc

SEQ ID NO: 9449960 - DNA, 19 bp, Homo sapiens
agagaaggatcctatggtt

SEQ ID NO: 9449961 - DNA, 19 bp, Homo sapiens
agagaaggatcctatggtt

SEQ ID NO: 9449962 - DNA, 19 bp, Homo sapiens
agagaaggatcctatggtt

SEQ ID NO: 9449963 - DNA, 22 bp, Homo sapiens
agagaaaagagttcaggctttg

SEQ ID NO: 9449964 - DNA, 22 bp, Homo sapiens
agagaaaagagttcaggctttg

SEQ ID NO: 9449965 - DNA, 22 bp, Homo sapiens
agagaaaagagttcaggctttg

SEQ ID NO: 9449966 - DNA, 23 bp, Homo sapiens
agagaaaaatatctgggcacatt

SEQ ID NO: 9449967 - DNA, 23 bp, Homo sapiens
agagaaaaatatctgggcacatt

SEQ ID NO: 9449968 - DNA, 23 bp, Homo sapiens
agagaaaaatatctgggcacatt

SEQ ID NO: 9449969 - DNA, 22 bp, Homo sapiens
agagaaaactcattgaggtgtc

SEQ ID NO: 9449970 - DNA, 22 bp, Homo sapiens
agagaaaactcattgaggtgtc

SEQ ID NO: 9449971 - DNA, 23 bp, Homo sapiens
agagaaaaatatctgggcacatt

SEQ ID NO: 9449972 - DNA, 23 bp, Homo sapiens
agagaaaaatatctgggcacatt

SEQ ID NO: 9449973 - DNA, 22 bp, Homo sapiens
agactgtgccacacatgggagt

SEQ ID NO: 9449974 - DNA, 22 bp, Homo sapiens
agactgtgagggagatacaggg

SEQ ID NO: 9449975 - DNA, 21 bp, Homo sapiens
agactgtggattttgacatgt

SEQ ID NO: 9449976 - DNA, 22 bp, Homo sapiens
agactgtagggatagaggtctt

SEQ ID NO: 9449977 - DNA, 23 bp, Homo sapiens
agacttctccaacaagcttggct

SEQ ID NO: 9449978 - DNA, 23 bp, Homo sapiens
agacttctccaacaagcttggct

SEQ ID NO: 9449979 - DNA, 21 bp, Homo sapiens
agacttctagaagtgagatag

SEQ ID NO: 9449980 - DNA, 22 bp, Homo sapiens
agacttctaaatagcagcttct

SEQ ID NO: 9449981 - DNA, 22 bp, Homo sapiens
agacttcacctacagcagtctc

SEQ ID NO: 9449982 - DNA, 22 bp, Homo sapiens
agacttctaaatagcagcttct

SEQ ID NO: 9449983 - DNA, 22 bp, Homo sapiens
agactttcgtgttatgttgcct

SEQ ID NO: 9449984 - DNA, 22 bp, Homo sapiens
agactttcttgacctagttaat

SEQ ID NO: 9449985 - DNA, 22 bp, Homo sapiens
agactttagggccatggtaggt

SEQ ID NO: 9449986 - DNA, 22 bp, Homo sapiens
agactttaatgtgcaaatgaaa

SEQ ID NO: 9449987 - DNA, 22 bp, Homo sapiens
agactttaatgtgcaaatgaaa

SEQ ID NO: 9449988 - DNA, 22 bp, Homo sapiens
agactttaacaatgggtatgaa

SEQ ID NO: 9449989 - DNA, 22 bp, Homo sapiens
agaccttgtaactagaggccca

SEQ ID NO: 9449990 - DNA, 22 bp, Homo sapiens
agacctttgctgcttcttatag

SEQ ID NO: 9449991 - DNA, 22 bp, Homo sapiens
agacctgttgggttcattggct

SEQ ID NO: 9449992 - DNA, 22 bp, Homo sapiens
agacctgtgatcacatggaatg

SEQ ID NO: 9449993 - DNA, 22 bp, Homo sapiens
agacctggtgatagctgtccta

SEQ ID NO: 9449994 - DNA, 22 bp, Homo sapiens
agacctggtaagcaggttgggc

SEQ ID NO: 9449995 - DNA, 22 bp, Homo sapiens
agacctggtttatcaccagcat

SEQ ID NO: 9449996 - DNA, 22 bp, Homo sapiens
agacctggtttatcaccagcat

SEQ ID NO: 9449997 - DNA, 22 bp, Homo sapiens
agacctggtttatcaccagcat

SEQ ID NO: 9449998 - DNA, 22 bp, Homo sapiens
agacctggatgtgagggaagta

SEQ ID NO: 9449999 - DNA, 22 bp, Homo sapiens
agacctggatgtgagggaagta

SEQ ID NO: 9450000 - DNA, 22 bp, Homo sapiens
agacctggagtggggcctcagg

SEQ ID NO: 9450001 - DNA, 22 bp, Homo sapiens
agacctggatgtgagggaagta

SEQ ID NO: 9450002 - DNA, 22 bp, Homo sapiens
agacctggagtggggcctcagg

SEQ ID NO: 9450003 - DNA, 22 bp, Homo sapiens
agacctgggttcgagtcctaac

SEQ ID NO: 9450004 - DNA, 22 bp, Homo sapiens
agacctgggttcgagtcctaac

SEQ ID NO: 9450005 - DNA, 22 bp, Homo sapiens
agacctgggtgccctgtgcttt

SEQ ID NO: 9450006 - DNA, 22 bp, Homo sapiens
agacctgggtgccctgtgcttt

SEQ ID NO: 9450007 - DNA, 22 bp, Homo sapiens
agacctgggtgccctgtgcttt

SEQ ID NO: 9450008 - DNA, 22 bp, Homo sapiens
agacctggagtgaagagttccc

SEQ ID NO: 9450009 - DNA, 22 bp, Homo sapiens
agacctggagtgaagagttccc

SEQ ID NO: 9450010 - DNA, 22 bp, Homo sapiens
agacctggaagttcaagagaaa

SEQ ID NO: 9450011 - DNA, 22 bp, Homo sapiens
agacctggaagttcaagagaaa

SEQ ID NO: 9450012 - DNA, 22 bp, Homo sapiens
agacctgaagagtatcttcaga

SEQ ID NO: 9450013 - DNA, 22 bp, Homo sapiens
agaccccatacctcagcaggta

SEQ ID NO: 9450014 - DNA, 22 bp, Homo sapiens
atgccaagctctatccctgacc

SEQ ID NO: 9450015 - DNA, 20 bp, Homo sapiens
atgccaagctatctagaatc

SEQ ID NO: 9450016 - DNA, 22 bp, Homo sapiens
atgccaagtacaggcactgctc

SEQ ID NO: 9450017 - DNA, 22 bp, Homo sapiens
atgccaagcttcagctgaaact

SEQ ID NO: 9450018 - DNA, 22 bp, Homo sapiens
atgccaagtacaggcactgctc

SEQ ID NO: 9450019 - DNA, 22 bp, Homo sapiens
atgccaagctctatccctgacc

SEQ ID NO: 9450020 - DNA, 22 bp, Homo sapiens
atgccaagcttcagctgaaact

SEQ ID NO: 9450021 - DNA, 22 bp, Homo sapiens
atgccaaatttctttctgttct

SEQ ID NO: 9450022 - DNA, 22 bp, Homo sapiens
atgccaagaatcatatgccagg

SEQ ID NO: 9450023 - DNA, 20 bp, Homo sapiens
atgccaagctatctagaatc

SEQ ID NO: 9450024 - DNA, 22 bp, Homo sapiens
atgccaagaatcatatgccagg

SEQ ID NO: 9450025 - DNA, 22 bp, Homo sapiens
atgccaagttgacaaggggtgg

SEQ ID NO: 9450026 - DNA, 21 bp, Homo sapiens
atgccaagtcttaatgagggc

SEQ ID NO: 9450027 - DNA, 22 bp, Homo sapiens
atgccaagtatgattcacatgt

SEQ ID NO: 9450028 - DNA, 22 bp, Homo sapiens
atgccaagtacaggcactgctc

SEQ ID NO: 9450029 - DNA, 22 bp, Homo sapiens
agacccagagggctgctgggag

SEQ ID NO: 9450030 - DNA, 22 bp, Homo sapiens
atgcctttgccacagattagga

SEQ ID NO: 9450031 - DNA, 22 bp, Homo sapiens
atgcgagtgatgcagagtggct

SEQ ID NO: 9450032 - DNA, 22 bp, Homo sapiens
atgcctttttatcatggatgat

SEQ ID NO: 9450033 - DNA, 22 bp, Homo sapiens
atgcctttggagaatccaacat

SEQ ID NO: 9450034 - DNA, 22 bp, Homo sapiens
agactctgattccctcatgtca

SEQ ID NO: 9450035 - DNA, 22 bp, Homo sapiens
agactctgattccctcatgtca

SEQ ID NO: 9450036 - DNA, 22 bp, Homo sapiens
agactctgcatttctaataagc

SEQ ID NO: 9450037 - DNA, 22 bp, Homo sapiens
agactgggtttgagacttagca

SEQ ID NO: 9450038 - DNA, 22 bp, Homo sapiens
agactggggttctggcaaggag

SEQ ID NO: 9450039 - DNA, 22 bp, Homo sapiens
agactggtttttaacttcacct

SEQ ID NO: 9450040 - DNA, 22 bp, Homo sapiens
atgcctggtatgaagcaaggaa

SEQ ID NO: 9450041 - DNA, 22 bp, Homo sapiens
atgcctggtatgaagcaaggaa

SEQ ID NO: 9450042 - DNA, 22 bp, Homo sapiens
agacgagggcccccaggacagc

SEQ ID NO: 9450043 - DNA, 22 bp, Homo sapiens
agacgagggcccccaggacagc

SEQ ID NO: 9450044 - DNA, 22 bp, Homo sapiens
atgcctggtatgaagcaaggaa

SEQ ID NO: 9450045 - DNA, 22 bp, Homo sapiens
atgcctggtcccacctctaggt

SEQ ID NO: 9450046 - DNA, 22 bp, Homo sapiens
atgcctggtcccacctctaggt

SEQ ID NO: 9450047 - DNA, 22 bp, Homo sapiens
atgcctgtaaaacagcacccag

SEQ ID NO: 9450048 - DNA, 22 bp, Homo sapiens
atgcctgtaatcccagcacttt

SEQ ID NO: 9450049 - DNA, 22 bp, Homo sapiens
atgcctgtaattccagcatttt

SEQ ID NO: 9450050 - DNA, 22 bp, Homo sapiens
atgcatattttctactatatcg

SEQ ID NO: 9450051 - DNA, 21 bp, Homo sapiens
atgcatattttaagttgtgtc

SEQ ID NO: 9450052 - DNA, 18 bp, Homo sapiens
atgcatattttaagttgt

SEQ ID NO: 9450053 - DNA, 22 bp, Homo sapiens
atgcatatttcatgaatctttg

SEQ ID NO: 9450054 - DNA, 22 bp, Homo sapiens
atgcatattgtcatttagtcct

SEQ ID NO: 9450055 - DNA, 22 bp, Homo sapiens
atgcatatttcttggagcacct

SEQ ID NO: 9450056 - DNA, 22 bp, Homo sapiens
atgcatatttcttgggcttacc

SEQ ID NO: 9450057 - DNA, 22 bp, Homo sapiens
atgcatattgattatagattca

SEQ ID NO: 9450058 - DNA, 22 bp, Homo sapiens
atgcatattcttagcccctcct

SEQ ID NO: 9450059 - DNA, 22 bp, Homo sapiens
atgcatattggattagcagcca

SEQ ID NO: 9450060 - DNA, 22 bp, Homo sapiens
atgcatattgattatagattca

SEQ ID NO: 9450061 - DNA, 22 bp, Homo sapiens
atgcatatgtacccatgttctg

SEQ ID NO: 9450062 - DNA, 22 bp, Homo sapiens
atgcatatgtacttgcatatgt

SEQ ID NO: 9450063 - DNA, 22 bp, Homo sapiens
atgcatatgtacttgcatatgt

SEQ ID NO: 9450064 - DNA, 22 bp, Homo sapiens
atgcatatgtgtgcacacgtgt

SEQ ID NO: 9450065 - DNA, 22 bp, Homo sapiens
atgcatattttctactatatcg

SEQ ID NO: 9450066 - DNA, 22 bp, Homo sapiens
atgcatattttctgttggtgac

SEQ ID NO: 9450067 - DNA, 22 bp, Homo sapiens
atgcatttgtaaaatataatcg

SEQ ID NO: 9450068 - DNA, 22 bp, Homo sapiens
atgcatttgtaaaatataatcg

SEQ ID NO: 9450069 - DNA, 22 bp, Homo sapiens
atgcatttgtaaaatataatcg

SEQ ID NO: 9450070 - DNA, 22 bp, Homo sapiens
atgccaaagcccaagttcatca

SEQ ID NO: 9450071 - DNA, 22 bp, Homo sapiens
atgccaaattctactttcagca

SEQ ID NO: 9450072 - DNA, 22 bp, Homo sapiens
atgccaaattctactttcagca

SEQ ID NO: 9450073 - DNA, 22 bp, Homo sapiens
atgccaaagggagcactttggg

SEQ ID NO: 9450074 - DNA, 22 bp, Homo sapiens
atgcatttttgagtatgaatga

SEQ ID NO: 9450075 - DNA, 22 bp, Homo sapiens
atgcatttttgagtatgaatga

SEQ ID NO: 9450076 - DNA, 22 bp, Homo sapiens
atgatacattgcaaaattttaa

SEQ ID NO: 9450077 - DNA, 22 bp, Homo sapiens
atgatacatcttgtttatttca

SEQ ID NO: 9450078 - DNA, 22 bp, Homo sapiens
atgatacatcttcatgtcagtg

SEQ ID NO: 9450079 - DNA, 22 bp, Homo sapiens
atgatacatcttcatgtcagtg

SEQ ID NO: 9450080 - DNA, 22 bp, Homo sapiens
agacagaatttgtcagataaat

SEQ ID NO: 9450081 - DNA, 22 bp, Homo sapiens
agacagacacatggtaacagat

SEQ ID NO: 9450082 - DNA, 22 bp, Homo sapiens
agacagaatttgtcagataaat

SEQ ID NO: 9450083 - DNA, 22 bp, Homo sapiens
agacagaacagaataattgttg

SEQ ID NO: 9450084 - DNA, 20 bp, Homo sapiens
agacagaatcagagataaag

SEQ ID NO: 9450085 - DNA, 22 bp, Homo sapiens
atgatactctaggtgatttaca

SEQ ID NO: 9450086 - DNA, 22 bp, Homo sapiens
atgatactctaggtgatttaca

SEQ ID NO: 9450087 - DNA, 22 bp, Homo sapiens
atgatatacttcctagaacagt

SEQ ID NO: 9450088 - DNA, 20 bp, Homo sapiens
atgatagtcagaaaactagc

SEQ ID NO: 9450089 - DNA, 22 bp, Homo sapiens
atgcaggttaaagtttgagaat

SEQ ID NO: 9450090 - DNA, 22 bp, Homo sapiens
atgcaggtaaccacacttcaca

SEQ ID NO: 9450091 - DNA, 22 bp, Homo sapiens
atgcaggtaacttttcagttta

SEQ ID NO: 9450092 - DNA, 22 bp, Homo sapiens
atgcaggtatattttattaaag

SEQ ID NO: 9450093 - DNA, 22 bp, Homo sapiens
atgcaggttgggcaagtgtggg

SEQ ID NO: 9450094 - DNA, 22 bp, Homo sapiens
atgcatatgtacccatgttctg

SEQ ID NO: 9450095 - DNA, 22 bp, Homo sapiens
atgcatatggcttgagggaata

SEQ ID NO: 9450096 - DNA, 22 bp, Homo sapiens
atgaacaatgactacatattga

SEQ ID NO: 9450097 - DNA, 22 bp, Homo sapiens
atgaacacaatacgtgcatgca

SEQ ID NO: 9450098 - DNA, 22 bp, Homo sapiens
atgaagcatctcacaatctagt

SEQ ID NO: 9450099 - DNA, 19 bp, Homo sapiens
atgaagcattgtttttgta

SEQ ID NO: 9450100 - DNA, 22 bp, Homo sapiens
atgaagcattacaggatgacag

SEQ ID NO: 9450101 - DNA, 22 bp, Homo sapiens
atgaagccagaagaagactggc

SEQ ID NO: 9450102 - DNA, 22 bp, Homo sapiens
atctgcttcctgggctccatga

SEQ ID NO: 9450103 - DNA, 22 bp, Homo sapiens
atctgcttgaaacttcttatac

SEQ ID NO: 9450104 - DNA, 22 bp, Homo sapiens
atctgcttgaatgagcaacagg

SEQ ID NO: 9450105 - DNA, 22 bp, Homo sapiens
atctgcttgagtttgaagtcag

SEQ ID NO: 9450106 - DNA, 22 bp, Homo sapiens
atgaacaatgactacatattga

SEQ ID NO: 9450107 - DNA, 19 bp, Homo sapiens
atctgccttagtgctgctg

SEQ ID NO: 9450108 - DNA, 22 bp, Homo sapiens
atctgcctgcttatgatgcctg

SEQ ID NO: 9450109 - DNA, 22 bp, Homo sapiens
atctgcctgcttatgatgcctg

SEQ ID NO: 9450110 - DNA, 22 bp, Homo sapiens
atctgcctcttcttcattgcga

SEQ ID NO: 9450111 - DNA, 22 bp, Homo sapiens
agaatataaagataattctgtt

SEQ ID NO: 9450112 - DNA, 22 bp, Homo sapiens
agaatataaagataattctgtt

SEQ ID NO: 9450113 - DNA, 22 bp, Homo sapiens
atgaagttctcaataatcatgt

SEQ ID NO: 9450114 - DNA, 22 bp, Homo sapiens
agaatatagttaccaaattctg

SEQ ID NO: 9450115 - DNA, 22 bp, Homo sapiens
agaatatagttaccaaattctg

SEQ ID NO: 9450116 - DNA, 22 bp, Homo sapiens
atgaagttccagtatatgcagt

SEQ ID NO: 9450117 - DNA, 22 bp, Homo sapiens
atgaagttccagtatatgcagt

SEQ ID NO: 9450118 - DNA, 22 bp, Homo sapiens
atgaagttctagtgagaaatgc

SEQ ID NO: 9450119 - DNA, 22 bp, Homo sapiens
atgaagttctagtgagaaatgc

SEQ ID NO: 9450120 - DNA, 22 bp, Homo sapiens
atgaagttctagtgagaaatgc

SEQ ID NO: 9450121 - DNA, 22 bp, Homo sapiens
atgaagttctcaataatcatgt

SEQ ID NO: 9450122 - DNA, 22 bp, Homo sapiens
atgaagttctcaataatcatgt

SEQ ID NO: 9450123 - DNA, 22 bp, Homo sapiens
agaatattcatctgtattctta

SEQ ID NO: 9450124 - DNA, 22 bp, Homo sapiens
agaatatatgactgcaagacta

SEQ ID NO: 9450125 - DNA, 22 bp, Homo sapiens
atgaagggtgtccctgtgagca

SEQ ID NO: 9450126 - DNA, 22 bp, Homo sapiens
atgaaggcagttttataagatt

SEQ ID NO: 9450127 - DNA, 22 bp, Homo sapiens
atgaaggcagttttataagatt

SEQ ID NO: 9450128 - DNA, 22 bp, Homo sapiens
atgaaggatagggcaaaatttt

SEQ ID NO: 9450129 - DNA, 22 bp, Homo sapiens
atgaagctctaaatgtacttag

SEQ ID NO: 9450130 - DNA, 22 bp, Homo sapiens
agaatcaattagattctatgag

SEQ ID NO: 9450131 - DNA, 22 bp, Homo sapiens
agaatcaattagattctatgag

SEQ ID NO: 9450132 - DNA, 22 bp, Homo sapiens
agaatcaaagagaaatactttg

SEQ ID NO: 9450133 - DNA, 22 bp, Homo sapiens
agaatcaactgaaaattggtga

SEQ ID NO: 9450134 - DNA, 22 bp, Homo sapiens
agaatcaaggtgaagcccacag

SEQ ID NO: 9450135 - DNA, 22 bp, Homo sapiens
agaatattgaaagttcttgaca

SEQ ID NO: 9450136 - DNA, 22 bp, Homo sapiens
agaatcaaagagaaatactttg

SEQ ID NO: 9450137 - DNA, 22 bp, Homo sapiens
atgaggccagggtgccatgaaa

SEQ ID NO: 9450138 - DNA, 22 bp, Homo sapiens
atgaggccagggtgccatgaaa

SEQ ID NO: 9450139 - DNA, 22 bp, Homo sapiens
atgaggccagggtgccatgaaa

SEQ ID NO: 9450140 - DNA, 20 bp, Homo sapiens
atgaggccagcagggctcag

SEQ ID NO: 9450141 - DNA, 20 bp, Homo sapiens
atgaggccagcagggctcag

SEQ ID NO: 9450142 - DNA, 22 bp, Homo sapiens
atgaggccagaccactctgcat

SEQ ID NO: 9450143 - DNA, 22 bp, Homo sapiens
atgaggccagaccactctgcat

SEQ ID NO: 9450144 - DNA, 22 bp, Homo sapiens
atgaggccagaccactctgcat

SEQ ID NO: 9450145 - DNA, 22 bp, Homo sapiens
atgaggcacttaaaagtgaaga

SEQ ID NO: 9450146 - DNA, 22 bp, Homo sapiens
atgaggcttaaactgctgcaac

SEQ ID NO: 9450147 - DNA, 22 bp, Homo sapiens
atgagggaggcaaggagatgct

SEQ ID NO: 9450148 - DNA, 22 bp, Homo sapiens
agacaaatttcctgcaatgaag

SEQ ID NO: 9450149 - DNA, 22 bp, Homo sapiens
atgaggcccaggaatctgtatt

SEQ ID NO: 9450150 - DNA, 22 bp, Homo sapiens
atgaggcccaaacattacaaat

SEQ ID NO: 9450151 - DNA, 22 bp, Homo sapiens
atgaggcccaggaatctgtatt

SEQ ID NO: 9450152 - DNA, 22 bp, Homo sapiens
atgaggccatggctgtcactaa

SEQ ID NO: 9450153 - DNA, 22 bp, Homo sapiens
atgaggccatggctgtcactaa

SEQ ID NO: 9450154 - DNA, 22 bp, Homo sapiens
atgaggccatggctgtcactaa

SEQ ID NO: 9450155 - DNA, 22 bp, Homo sapiens
atgaggcccaaacattacaaat

SEQ ID NO: 9450156 - DNA, 22 bp, Homo sapiens
atgaggcctatcttggcagagg

SEQ ID NO: 9450157 - DNA, 22 bp, Homo sapiens
atgaggcctatcttggcagagg

SEQ ID NO: 9450158 - DNA, 22 bp, Homo sapiens
atgaggcctttcttcacccttt

SEQ ID NO: 9450159 - DNA, 22 bp, Homo sapiens
agacaccagaatctgttgagca

SEQ ID NO: 9450160 - DNA, 22 bp, Homo sapiens
agacacccagtgattgagactt

SEQ ID NO: 9450161 - DNA, 22 bp, Homo sapiens
agacaagttctgtgggtcacct

SEQ ID NO: 9450162 - DNA, 22 bp, Homo sapiens
agacactttcagaagtgtttgc

SEQ ID NO: 9450163 - DNA, 22 bp, Homo sapiens
agacagaaataggagaaaccag

SEQ ID NO: 9450164 - DNA, 22 bp, Homo sapiens
agacagaacagaataattgttg

SEQ ID NO: 9450165 - DNA, 21 bp, Homo sapiens
agacagaacaactgctctcca

SEQ ID NO: 9450166 - DNA, 22 bp, Homo sapiens
agacacccagtgattgagactt

SEQ ID NO: 9450167 - DNA, 22 bp, Homo sapiens
agacactgttctcacatgcttg

SEQ ID NO: 9450168 - DNA, 22 bp, Homo sapiens
agacactgttctcacatgcttg

SEQ ID NO: 9450169 - DNA, 22 bp, Homo sapiens
agacactgtgtacagaaaaaga

SEQ ID NO: 9450170 - DNA, 22 bp, Homo sapiens
agacaaggcaaggcggccagat

SEQ ID NO: 9450171 - DNA, 22 bp, Homo sapiens
agacaagagctgaggacatatt

SEQ ID NO: 9450172 - DNA, 22 bp, Homo sapiens
agacaagactaggcagttgttg

SEQ ID NO: 9450173 - DNA, 22 bp, Homo sapiens
agacaactgcagagcaaagaat

SEQ ID NO: 9450174 - DNA, 22 bp, Homo sapiens
agacaactagaaaactagacag

SEQ ID NO: 9450175 - DNA, 22 bp, Homo sapiens
agacaactagaaaactagacag

SEQ ID NO: 9450176 - DNA, 22 bp, Homo sapiens
agacaacatcactaaagctgag

SEQ ID NO: 9450177 - DNA, 22 bp, Homo sapiens
actttgccacattctttaggcc

SEQ ID NO: 9450178 - DNA, 22 bp, Homo sapiens
actttgccatgttgtatgacta

SEQ ID NO: 9450179 - DNA, 22 bp, Homo sapiens
actttgccattgcaaatacaca

SEQ ID NO: 9450180 - DNA, 22 bp, Homo sapiens
actttgcccagaactgtcccag

SEQ ID NO: 9450181 - DNA, 22 bp, Homo sapiens
actttgccccaaagaagttggt

SEQ ID NO: 9450182 - DNA, 22 bp, Homo sapiens
actttgcctccttgatagtttc

SEQ ID NO: 9450183 - DNA, 22 bp, Homo sapiens
actttgccttcttactgtgttg

SEQ ID NO: 9450184 - DNA, 22 bp, Homo sapiens
actttgccccaggtctcatgac

SEQ ID NO: 9450185 - DNA, 22 bp, Homo sapiens
actttgccctacagcagctctg

SEQ ID NO: 9450186 - DNA, 22 bp, Homo sapiens
actttgcctacaagcccatggt

SEQ ID NO: 9450187 - DNA, 22 bp, Homo sapiens
actttgccctacagcagctctg

SEQ ID NO: 9450188 - DNA, 22 bp, Homo sapiens
actttgccctacagcagctctg

SEQ ID NO: 9450189 - DNA, 22 bp, Homo sapiens
actttggaaattgtctataaga

SEQ ID NO: 9450190 - DNA, 22 bp, Homo sapiens
actttggaagatggctgtattt

SEQ ID NO: 9450191 - DNA, 22 bp, Homo sapiens
actttggacaatttattactgt

SEQ ID NO: 9450192 - DNA, 22 bp, Homo sapiens
atacatcatttatggaataagg

SEQ ID NO: 9450193 - DNA, 22 bp, Homo sapiens
atacatcatgctccatatattt

SEQ ID NO: 9450194 - DNA, 22 bp, Homo sapiens
actttctgccttacaggagtcc

SEQ ID NO: 9450195 - DNA, 22 bp, Homo sapiens
actttctgccttacaggagtcc

SEQ ID NO: 9450196 - DNA, 22 bp, Homo sapiens
actttctgtcatctagacaagt

SEQ ID NO: 9450197 - DNA, 22 bp, Homo sapiens
atacatctagagtcataaaaac

SEQ ID NO: 9450198 - DNA, 22 bp, Homo sapiens
actttctgcagtgttggaaatg

SEQ ID NO: 9450199 - DNA, 22 bp, Homo sapiens
atagatacattaggtaacttgt

SEQ ID NO: 9450200 - DNA, 22 bp, Homo sapiens
atagatacattgttatatttgt

SEQ ID NO: 9450201 - DNA, 22 bp, Homo sapiens
atagagttttattttccaataa

SEQ ID NO: 9450202 - DNA, 22 bp, Homo sapiens
atagagtgatgtaaggtatgtg

SEQ ID NO: 9450203 - DNA, 22 bp, Homo sapiens
atagagtgatgtaaggtatgtg

SEQ ID NO: 9450204 - DNA, 22 bp, Homo sapiens
actttgggacccagccaaccct

SEQ ID NO: 9450205 - DNA, 19 bp, Homo sapiens
atagagtagagtatctgtt

SEQ ID NO: 9450206 - DNA, 22 bp, Homo sapiens
atagagtacagtctttgattat

SEQ ID NO: 9450207 - DNA, 22 bp, Homo sapiens
actttgggaagctgcaattgcc

SEQ ID NO: 9450208 - DNA, 22 bp, Homo sapiens
actttggcacagaacttccatt

SEQ ID NO: 9450209 - DNA, 22 bp, Homo sapiens
actttggatctgatgtaatcag

SEQ ID NO: 9450210 - DNA, 22 bp, Homo sapiens
actttggacgccatgctgtttg

SEQ ID NO: 9450211 - DNA, 22 bp, Homo sapiens
actttggacgccatgctgtttg

SEQ ID NO: 9450212 - DNA, 17 bp, Homo sapiens
actttggaggcagctgt

SEQ ID NO: 9450213 - DNA, 22 bp, Homo sapiens
atagatacttaactgaaatctt

SEQ ID NO: 9450214 - DNA, 20 bp, Homo sapiens
atagatatcatctttagaag

SEQ ID NO: 9450215 - DNA, 20 bp, Homo sapiens
atagatatcatctttagaag

SEQ ID NO: 9450216 - DNA, 22 bp, Homo sapiens
atagatatttgagttgtttcca

SEQ ID NO: 9450217 - DNA, 22 bp, Homo sapiens
atagatatttgagttgtttcca

SEQ ID NO: 9450218 - DNA, 22 bp, Homo sapiens
atagatattagcaaaattttat

SEQ ID NO: 9450219 - DNA, 22 bp, Homo sapiens
atagatattagcaaaattttat

SEQ ID NO: 9450220 - DNA, 22 bp, Homo sapiens
actttgttcctttcacaaagaa

SEQ ID NO: 9450221 - DNA, 22 bp, Homo sapiens
actttgtgcccaacagaaagaa

SEQ ID NO: 9450222 - DNA, 22 bp, Homo sapiens
actttgtataagacaataaaga

SEQ ID NO: 9450223 - DNA, 22 bp, Homo sapiens
acttggttgatgtcataaggtt

SEQ ID NO: 9450224 - DNA, 22 bp, Homo sapiens
acttggttgcaaatgaattatt

SEQ ID NO: 9450225 - DNA, 22 bp, Homo sapiens
actttaaaactgatcatcagag

SEQ ID NO: 9450226 - DNA, 22 bp, Homo sapiens
acttggttgcttctgaaatgac

SEQ ID NO: 9450227 - DNA, 22 bp, Homo sapiens
actttaaaactgatcatcagag

SEQ ID NO: 9450228 - DNA, 22 bp, Homo sapiens
actttaaaactgatcatcagag

SEQ ID NO: 9450229 - DNA, 22 bp, Homo sapiens
actttaaaactgatcatcagag

SEQ ID NO: 9450230 - DNA, 22 bp, Homo sapiens
actttaaaactgatcatcagag

SEQ ID NO: 9450231 - DNA, 22 bp, Homo sapiens
atacaaaatatatactggagac

SEQ ID NO: 9450232 - DNA, 22 bp, Homo sapiens
atacaaaatatatactggagac

SEQ ID NO: 9450233 - DNA, 22 bp, Homo sapiens
atacaaaatatatactggagac

SEQ ID NO: 9450234 - DNA, 22 bp, Homo sapiens
atacaaaatatatactggagac

SEQ ID NO: 9450235 - DNA, 22 bp, Homo sapiens
atacaaaatatatactggagac

SEQ ID NO: 9450236 - DNA, 22 bp, Homo sapiens
atacaaaatatatactggagac

SEQ ID NO: 9450237 - DNA, 22 bp, Homo sapiens
acttctctcattcagacatagc

SEQ ID NO: 9450238 - DNA, 22 bp, Homo sapiens
acttctctcattcagacatagc

SEQ ID NO: 9450239 - DNA, 22 bp, Homo sapiens
acttctctccacccaagtccct

SEQ ID NO: 9450240 - DNA, 22 bp, Homo sapiens
acttctctcattcagacatagc

SEQ ID NO: 9450241 - DNA, 22 bp, Homo sapiens
acttctctgctacctgcaaaga

SEQ ID NO: 9450242 - DNA, 22 bp, Homo sapiens
acttctctgctacctgcaaaga

SEQ ID NO: 9450243 - DNA, 22 bp, Homo sapiens
acttctctgctacctgcaaaga

SEQ ID NO: 9450244 - DNA, 22 bp, Homo sapiens
ataatttttgtttgatgtccaa

SEQ ID NO: 9450245 - DNA, 22 bp, Homo sapiens
acttctcttcataggtggcaat

SEQ ID NO: 9450246 - DNA, 22 bp, Homo sapiens
ataatttggcttcctagatgta

SEQ ID NO: 9450247 - DNA, 22 bp, Homo sapiens
acttctctggttgaggtccaat

SEQ ID NO: 9450248 - DNA, 22 bp, Homo sapiens
atacaaaaattagccgggagta

SEQ ID NO: 9450249 - DNA, 22 bp, Homo sapiens
atacaaaaattagccgggagta

SEQ ID NO: 9450250 - DNA, 22 bp, Homo sapiens
atacaaaaattagccgggagta

SEQ ID NO: 9450251 - DNA, 22 bp, Homo sapiens
atacaaaaattagccgggagta

SEQ ID NO: 9450252 - DNA, 22 bp, Homo sapiens
actttaattaatgaactgtggc

SEQ ID NO: 9450253 - DNA, 22 bp, Homo sapiens
actttaattaatgaactgtggc

SEQ ID NO: 9450254 - DNA, 22 bp, Homo sapiens
actttacaaactcctcactgtt

SEQ ID NO: 9450255 - DNA, 22 bp, Homo sapiens
actttacaagcttatagcctag

SEQ ID NO: 9450256 - DNA, 22 bp, Homo sapiens
actttacaatatcctgtgactt

SEQ ID NO: 9450257 - DNA, 21 bp, Homo sapiens
actttacaatttacatagtga

SEQ ID NO: 9450258 - DNA, 22 bp, Homo sapiens
actttaaagcagaatggctatg

SEQ ID NO: 9450259 - DNA, 22 bp, Homo sapiens
actttaaagcagaatggctatg

SEQ ID NO: 9450260 - DNA, 22 bp, Homo sapiens
actttaaagcagaatggctatg

SEQ ID NO: 9450261 - DNA, 22 bp, Homo sapiens
actttaaaactgatcatcagag

SEQ ID NO: 9450262 - DNA, 22 bp, Homo sapiens
actttaaagcagaatggctatg

SEQ ID NO: 9450263 - DNA, 22 bp, Homo sapiens
actttaaagcagaatggctatg

SEQ ID NO: 9450264 - DNA, 23 bp, Homo sapiens
actttaagagtatatgacttccc

SEQ ID NO: 9450265 - DNA, 21 bp, Homo sapiens
actttaatatacatgaggagg

SEQ ID NO: 9450266 - DNA, 22 bp, Homo sapiens
actttaattaatgaactgtggc

SEQ ID NO: 9450267 - DNA, 22 bp, Homo sapiens
atacatcaaggatgatggtgta

SEQ ID NO: 9450268 - DNA, 22 bp, Homo sapiens
atacatatccacaggagataaa

SEQ ID NO: 9450269 - DNA, 21 bp, Homo sapiens
actttacaatttacatagtga

SEQ ID NO: 9450270 - DNA, 22 bp, Homo sapiens
agttttaagatgcgcttctgtt

SEQ ID NO: 9450271 - DNA, 22 bp, Homo sapiens
agttttaagatgcgcttctgtt

SEQ ID NO: 9450272 - DNA, 22 bp, Homo sapiens
agttttaaatgatggtggtggt

SEQ ID NO: 9450273 - DNA, 22 bp, Homo sapiens
agtttctagcaaggattgttga

SEQ ID NO: 9450274 - DNA, 22 bp, Homo sapiens
agttttaaatgatggtggtggt

SEQ ID NO: 9450275 - DNA, 22 bp, Homo sapiens
agttttaagatgcgcttctgtt

SEQ ID NO: 9450276 - DNA, 22 bp, Homo sapiens
agttttaagatgcgcttctgtt

SEQ ID NO: 9450277 - DNA, 22 bp, Homo sapiens
agttttatatcttccattggtt

SEQ ID NO: 9450278 - DNA, 21 bp, Homo sapiens
agttttatattataagctaaa

SEQ ID NO: 9450279 - DNA, 21 bp, Homo sapiens
agttttatattataagctaaa

SEQ ID NO: 9450280 - DNA, 21 bp, Homo sapiens
agttttatattataagctaaa

SEQ ID NO: 9450281 - DNA, 22 bp, Homo sapiens
agttttatgcagtgttctgata

SEQ ID NO: 9450282 - DNA, 22 bp, Homo sapiens
actgggctcataatgtcataga

SEQ ID NO: 9450283 - DNA, 22 bp, Homo sapiens
actgggctccaaggacctggag

SEQ ID NO: 9450284 - DNA, 22 bp, Homo sapiens
actgggctccagatgtgatacg

SEQ ID NO: 9450285 - DNA, 22 bp, Homo sapiens
actgggctcccaggcttgtcat

SEQ ID NO: 9450286 - DNA, 22 bp, Homo sapiens
agtttctaccggtacattcagg

SEQ ID NO: 9450287 - DNA, 22 bp, Homo sapiens
agtttctaccggtacattcagg

SEQ ID NO: 9450288 - DNA, 22 bp, Homo sapiens
actgggctagagtggaagctgg

SEQ ID NO: 9450289 - DNA, 22 bp, Homo sapiens
actgggctagagtggaagctgg

SEQ ID NO: 9450290 - DNA, 22 bp, Homo sapiens
actgggctagagtggaagctgg

SEQ ID NO: 9450291 - DNA, 21 bp, Homo sapiens
actgggctagcctgacttctg

SEQ ID NO: 9450292 - DNA, 22 bp, Homo sapiens
actgggctcaagtgattgtcct

SEQ ID NO: 9450293 - DNA, 21 bp, Homo sapiens
actgggctagcctgacttctg

SEQ ID NO: 9450294 - DNA, 21 bp, Homo sapiens
actgggctagcctgacttctg

SEQ ID NO: 9450295 - DNA, 22 bp, Homo sapiens
actgggctaccccaccattacc

SEQ ID NO: 9450296 - DNA, 22 bp, Homo sapiens
actgggccttgtgtgtctcatc

SEQ ID NO: 9450297 - DNA, 23 bp, Homo sapiens
agtttttaatggtcatagctgag

SEQ ID NO: 9450298 - DNA, 22 bp, Homo sapiens
agttttatggctcaacctaata

SEQ ID NO: 9450299 - DNA, 22 bp, Homo sapiens
agttttatgtagacaattcatt

SEQ ID NO: 9450300 - DNA, 22 bp, Homo sapiens
agtttttcctgattttacagaa

SEQ ID NO: 9450301 - DNA, 21 bp, Homo sapiens
agtttttactcttaactgtgg

SEQ ID NO: 9450302 - DNA, 21 bp, Homo sapiens
agtttttactcttaactgtgg

SEQ ID NO: 9450303 - DNA, 22 bp, Homo sapiens
actgttatttgtaatccattat

SEQ ID NO: 9450304 - DNA, 22 bp, Homo sapiens
actgtttaaatatttgggctgg

SEQ ID NO: 9450305 - DNA, 22 bp, Homo sapiens
ataaaaactgacccatcctttg

SEQ ID NO: 9450306 - DNA, 22 bp, Homo sapiens
agtttttctcccctggcttcat

SEQ ID NO: 9450307 - DNA, 22 bp, Homo sapiens
agtttttcctgattttacagaa

SEQ ID NO: 9450308 - DNA, 23 bp, Homo sapiens
agtttttctgcatggttctgtat

SEQ ID NO: 9450309 - DNA, 22 bp, Homo sapiens
agtttttgagaatttactatgt

SEQ ID NO: 9450310 - DNA, 22 bp, Homo sapiens
agtttttgagaatttactatgt

SEQ ID NO: 9450311 - DNA, 22 bp, Homo sapiens
ataaagtctgggccaggcatgg

SEQ ID NO: 9450312 - DNA, 18 bp, Homo sapiens
ataaagtgctaataatgg

SEQ ID NO: 9450313 - DNA, 18 bp, Homo sapiens
ataaagtgctaataatgg

SEQ ID NO: 9450314 - DNA, 18 bp, Homo sapiens
ataaagtgctaataatgg

SEQ ID NO: 9450315 - DNA, 18 bp, Homo sapiens
ataaagtgctaataatgg

SEQ ID NO: 9450316 - DNA, 22 bp, Homo sapiens
ataaagtcatggcagctagaat

SEQ ID NO: 9450317 - DNA, 22 bp, Homo sapiens
ataaagtcatggcagctagaat

SEQ ID NO: 9450318 - DNA, 22 bp, Homo sapiens
acttaaaaagaatcttttcacg

SEQ ID NO: 9450319 - DNA, 22 bp, Homo sapiens
acttaaaaagaatcttttcacg

SEQ ID NO: 9450320 - DNA, 22 bp, Homo sapiens
acttaaaaccagacagcgtcat

SEQ ID NO: 9450321 - DNA, 22 bp, Homo sapiens
acttaaaaagaatcttttcacg

SEQ ID NO: 9450322 - DNA, 22 bp, Homo sapiens
acttaaaaagaatcttttcacg

SEQ ID NO: 9450323 - DNA, 22 bp, Homo sapiens
ataaagtagctttcagtgccaa

SEQ ID NO: 9450324 - DNA, 22 bp, Homo sapiens
ataaagtagccactggaaagct

SEQ ID NO: 9450325 - DNA, 22 bp, Homo sapiens
ataaagtcaaggcattttatga

SEQ ID NO: 9450326 - DNA, 22 bp, Homo sapiens
acttaaagaggctacttttggt

SEQ ID NO: 9450327 - DNA, 22 bp, Homo sapiens
acttaaagtagttttactgtgg

SEQ ID NO: 9450328 - DNA, 22 bp, Homo sapiens
actgtttatagttttgagctga

SEQ ID NO: 9450329 - DNA, 22 bp, Homo sapiens
actgtttcagtttctgaagttt

SEQ ID NO: 9450330 - DNA, 22 bp, Homo sapiens
actgtttgctgatagatattta

SEQ ID NO: 9450331 - DNA, 22 bp, Homo sapiens
actgttttctgtaaagggccag

SEQ ID NO: 9450332 - DNA, 22 bp, Homo sapiens
acttaaaaagaatcttttcacg

SEQ ID NO: 9450333 - DNA, 22 bp, Homo sapiens
acttaaaaagaatcttttcacg

SEQ ID NO: 9450334 - DNA, 22 bp, Homo sapiens
acttaaaaagaatcttttcacg

SEQ ID NO: 9450335 - DNA, 22 bp, Homo sapiens
acttaaaaacagatccagcagg

SEQ ID NO: 9450336 - DNA, 22 bp, Homo sapiens
acttaaaaacagatccagcagg

SEQ ID NO: 9450337 - DNA, 22 bp, Homo sapiens
actgttttgtgccttagtttcc

SEQ ID NO: 9450338 - DNA, 22 bp, Homo sapiens
acttcctggctgggtgacctgg

SEQ ID NO: 9450339 - DNA, 19 bp, Homo sapiens
ataaataaaaagtgggaga

SEQ ID NO: 9450340 - DNA, 19 bp, Homo sapiens
ataaataaaaagtgggaga

SEQ ID NO: 9450341 - DNA, 19 bp, Homo sapiens
ataaataaaaagtgggaga

SEQ ID NO: 9450342 - DNA, 22 bp, Homo sapiens
acttccagatggccccatctaa

SEQ ID NO: 9450343 - DNA, 22 bp, Homo sapiens
ataaagttctgctggcatatat

SEQ ID NO: 9450344 - DNA, 22 bp, Homo sapiens
ataaagtggaggtagtattcat

SEQ ID NO: 9450345 - DNA, 22 bp, Homo sapiens
ataaagtttaaaagtcaatagt

SEQ ID NO: 9450346 - DNA, 22 bp, Homo sapiens
ataaagtttaaaagtcaatagt

SEQ ID NO: 9450347 - DNA, 22 bp, Homo sapiens
ataaagtttaaaagtcaatagt

SEQ ID NO: 9450348 - DNA, 19 bp, Homo sapiens
ataaataaaaagtgggaga

SEQ ID NO: 9450349 - DNA, 19 bp, Homo sapiens
ataaataaaaagtgggaga

SEQ ID NO: 9450350 - DNA, 19 bp, Homo sapiens
ataaataaaaagtgggaga

SEQ ID NO: 9450351 - DNA, 21 bp, Homo sapiens
ataaagttttacaggaatgca

SEQ ID NO: 9450352 - DNA, 21 bp, Homo sapiens
ataaagttttacaggaatgca

SEQ ID NO: 9450353 - DNA, 22 bp, Homo sapiens
acttccttgtactgactccatt

SEQ ID NO: 9450354 - DNA, 22 bp, Homo sapiens
acttccttttgggaaactgttt

SEQ ID NO: 9450355 - DNA, 22 bp, Homo sapiens
acttccttttgggaaactgttt

SEQ ID NO: 9450356 - DNA, 22 bp, Homo sapiens
acttccttttcaaccatacagc

SEQ ID NO: 9450357 - DNA, 22 bp, Homo sapiens
acttccttttgggaaactgttt

SEQ ID NO: 9450358 - DNA, 22 bp, Homo sapiens
acttctaatcagaaggtctggt

SEQ ID NO: 9450359 - DNA, 18 bp, Homo sapiens
acttctcatttctctgca

SEQ ID NO: 9450360 - DNA, 22 bp, Homo sapiens
acttctctcattcagacatagc

SEQ ID NO: 9450361 - DNA, 22 bp, Homo sapiens
acttcctgtaaatagaattcca

SEQ ID NO: 9450362 - DNA, 22 bp, Homo sapiens
acttcctgggtgttgtaaggtc

SEQ ID NO: 9450363 - DNA, 22 bp, Homo sapiens
acttccttccaaacattcattt

SEQ ID NO: 9450364 - DNA, 22 bp, Homo sapiens
acttccttccaaacattcattt

SEQ ID NO: 9450365 - DNA, 22 bp, Homo sapiens
atcaggtgtggtccaatcagca

SEQ ID NO: 9450366 - DNA, 20 bp, Homo sapiens
atcaggtgtattccttatct

SEQ ID NO: 9450367 - DNA, 22 bp, Homo sapiens
atcagcaatctcgtgtattagg

SEQ ID NO: 9450368 - DNA, 22 bp, Homo sapiens
atcaggtgcattagattaatta

SEQ ID NO: 9450369 - DNA, 22 bp, Homo sapiens
atcaggtgggttttgaagaaac

SEQ ID NO: 9450370 - DNA, 22 bp, Homo sapiens
atcagcaatctcgtgtattagg

SEQ ID NO: 9450371 - DNA, 22 bp, Homo sapiens
atcagcaatcaaattgcagagt

SEQ ID NO: 9450372 - DNA, 22 bp, Homo sapiens
atcagcaagtcctgttaattct

SEQ ID NO: 9450373 - DNA, 22 bp, Homo sapiens
agaaagcccacccagaagatgt

SEQ ID NO: 9450374 - DNA, 22 bp, Homo sapiens
agaaagcccaggagaacagatt

SEQ ID NO: 9450375 - DNA, 22 bp, Homo sapiens
agaaagcctcaatcttcaggcc

SEQ ID NO: 9450376 - DNA, 22 bp, Homo sapiens
agaaagcctgagcagacggagc

SEQ ID NO: 9450377 - DNA, 22 bp, Homo sapiens
agaaagccttatgtacagaggc

SEQ ID NO: 9450378 - DNA, 22 bp, Homo sapiens
atcagcaagtcctgttaattct

SEQ ID NO: 9450379 - DNA, 22 bp, Homo sapiens
agaaagcatctccattgtaggt

SEQ ID NO: 9450380 - DNA, 22 bp, Homo sapiens
agaaagcagtcccttccgaccg

SEQ ID NO: 9450381 - DNA, 22 bp, Homo sapiens
agaaagcagcatttatgatctc

SEQ ID NO: 9450382 - DNA, 22 bp, Homo sapiens
agaaagcactctgtcttttacc

SEQ ID NO: 9450383 - DNA, 22 bp, Homo sapiens
atcaaaacttctttagagttta

SEQ ID NO: 9450384 - DNA, 22 bp, Homo sapiens
agaaagcactctgtcttttacc

SEQ ID NO: 9450385 - DNA, 22 bp, Homo sapiens
agaaagcaccctgcactttctg

SEQ ID NO: 9450386 - DNA, 22 bp, Homo sapiens
agaaagcaccctgcactttctg

SEQ ID NO: 9450387 - DNA, 22 bp, Homo sapiens
agaaagattttcaacaggaggt

SEQ ID NO: 9450388 - DNA, 22 bp, Homo sapiens
agaaagcacagcgggtccattt

SEQ ID NO: 9450389 - DNA, 17 bp, Homo sapiens
atcagtagcatatcaga

SEQ ID NO: 9450390 - DNA, 21 bp, Homo sapiens
atcagtaaggttggaggaaga

SEQ ID NO: 9450391 - DNA, 22 bp, Homo sapiens
atcagtcatatccaaattagca

SEQ ID NO: 9450392 - DNA, 17 bp, Homo sapiens
atcagtagcatatcaga

SEQ ID NO: 9450393 - DNA, 22 bp, Homo sapiens
atcagtgctaaagcaaatgccc

SEQ ID NO: 9450394 - DNA, 22 bp, Homo sapiens
atcagtgtaccttatggatttt

SEQ ID NO: 9450395 - DNA, 22 bp, Homo sapiens
atcagtgcttcatagccctggt

SEQ ID NO: 9450396 - DNA, 22 bp, Homo sapiens
atcagtgttccttgagactgcc

SEQ ID NO: 9450397 - DNA, 22 bp, Homo sapiens
atcagtgttgttgattggatag

SEQ ID NO: 9450398 - DNA, 22 bp, Homo sapiens
atcagtgtgtcaaaagcacaaa

SEQ ID NO: 9450399 - DNA, 22 bp, Homo sapiens
atcagtgtattcatagggaata

SEQ ID NO: 9450400 - DNA, 22 bp, Homo sapiens
agaaatcatgactaagagcagt

SEQ ID NO: 9450401 - DNA, 22 bp, Homo sapiens
agaaatcatgactaagagcagt

SEQ ID NO: 9450402 - DNA, 22 bp, Homo sapiens
agaaatcatgactaagagcagt

SEQ ID NO: 9450403 - DNA, 22 bp, Homo sapiens
agaaatcatgactaagagcagt

SEQ ID NO: 9450404 - DNA, 22 bp, Homo sapiens
agaaatcatgactaagagcagt

SEQ ID NO: 9450405 - DNA, 22 bp, Homo sapiens
agaaatcatgactaagagcagt

SEQ ID NO: 9450406 - DNA, 22 bp, Homo sapiens
agaaatcatgtcttatttctat

SEQ ID NO: 9450407 - DNA, 22 bp, Homo sapiens
agaaatcatgtcttatttctat

SEQ ID NO: 9450408 - DNA, 22 bp, Homo sapiens
agaaatcatgtcttatttctat

SEQ ID NO: 9450409 - DNA, 22 bp, Homo sapiens
agaaatcattcccaaacccata

SEQ ID NO: 9450410 - DNA, 22 bp, Homo sapiens
atcagttatttttaagctataa

SEQ ID NO: 9450411 - DNA, 22 bp, Homo sapiens
atcagtgtttgcatgggagctt

SEQ ID NO: 9450412 - DNA, 22 bp, Homo sapiens
atcagtgtttcaaatgtaatct

SEQ ID NO: 9450413 - DNA, 22 bp, Homo sapiens
atcagttatttttaagctataa

SEQ ID NO: 9450414 - DNA, 22 bp, Homo sapiens
atcagttatttttaagctataa

SEQ ID NO: 9450415 - DNA, 22 bp, Homo sapiens
atcagtttaaatgggctgttgg

SEQ ID NO: 9450416 - DNA, 22 bp, Homo sapiens
agaaatcaggaacagtaaggag

SEQ ID NO: 9450417 - DNA, 22 bp, Homo sapiens
agaaaaactaagagtgggtggt

SEQ ID NO: 9450418 - DNA, 22 bp, Homo sapiens
agaaaaactaagagtgggtggt

SEQ ID NO: 9450419 - DNA, 21 bp, Homo sapiens
agaaaaaccagcatgttttca

SEQ ID NO: 9450420 - DNA, 21 bp, Homo sapiens
agaaaaaccagcatgttttca

SEQ ID NO: 9450421 - DNA, 22 bp, Homo sapiens
agaaaaagtcaaggaattggac

SEQ ID NO: 9450422 - DNA, 19 bp, Homo sapiens
agaaaaactggtactgctg

SEQ ID NO: 9450423 - DNA, 19 bp, Homo sapiens
agaaaaactggtactgctg

SEQ ID NO: 9450424 - DNA, 22 bp, Homo sapiens
atattttggggtgatgtgcatc

SEQ ID NO: 9450425 - DNA, 22 bp, Homo sapiens
atattttggggtgatgtgcatc

SEQ ID NO: 9450426 - DNA, 22 bp, Homo sapiens
atattttggggtgatgtgcatc

SEQ ID NO: 9450427 - DNA, 22 bp, Homo sapiens
atattttggggtgatgtgcatc

SEQ ID NO: 9450428 - DNA, 22 bp, Homo sapiens
atatttctccaaatgttttcaa

SEQ ID NO: 9450429 - DNA, 22 bp, Homo sapiens
agaaaaagtcaaggaattggac

SEQ ID NO: 9450430 - DNA, 22 bp, Homo sapiens
agaaaaagtcaaggaattggac

SEQ ID NO: 9450431 - DNA, 22 bp, Homo sapiens
atattttgtaacttggaatagg

SEQ ID NO: 9450432 - DNA, 22 bp, Homo sapiens
atattttgtaacttggaatagg

SEQ ID NO: 9450433 - DNA, 22 bp, Homo sapiens
atattttggtagctctcaatga

SEQ ID NO: 9450434 - DNA, 22 bp, Homo sapiens
atattttggtagctctcaatga

SEQ ID NO: 9450435 - DNA, 22 bp, Homo sapiens
atattttggtagctctcaatga

SEQ ID NO: 9450436 - DNA, 22 bp, Homo sapiens
atatttttccatgtgggactct

SEQ ID NO: 9450437 - DNA, 22 bp, Homo sapiens
atatttttccatgtgggactct

SEQ ID NO: 9450438 - DNA, 21 bp, Homo sapiens
atatttttgtttggactgtca

SEQ ID NO: 9450439 - DNA, 21 bp, Homo sapiens
atatttttgtttggactgtca

SEQ ID NO: 9450440 - DNA, 22 bp, Homo sapiens
atcaaaaccttgacttttaatg

SEQ ID NO: 9450441 - DNA, 22 bp, Homo sapiens
atcaaaaccttgacttttaatg

SEQ ID NO: 9450442 - DNA, 22 bp, Homo sapiens
atcaaaaccttgacttttaatg

SEQ ID NO: 9450443 - DNA, 22 bp, Homo sapiens
acttttcttatcagaaaggcca

SEQ ID NO: 9450444 - DNA, 22 bp, Homo sapiens
acttttctgcagatgatctctt

SEQ ID NO: 9450445 - DNA, 22 bp, Homo sapiens
acttttctgcagatgatctctt

SEQ ID NO: 9450446 - DNA, 22 bp, Homo sapiens
acttttctgcagatgatctctt

SEQ ID NO: 9450447 - DNA, 22 bp, Homo sapiens
acttttgaacaaactcctctgt

SEQ ID NO: 9450448 - DNA, 22 bp, Homo sapiens
acttttgaggactttattgtat

SEQ ID NO: 9450449 - DNA, 22 bp, Homo sapiens
acttttgaagaattatgcaaaa

SEQ ID NO: 9450450 - DNA, 22 bp, Homo sapiens
acttttgtgcaggtctctccca

SEQ ID NO: 9450451 - DNA, 22 bp, Homo sapiens
actttttacagggtgtatacca

SEQ ID NO: 9450452 - DNA, 22 bp, Homo sapiens
actttttacagggtgtatacca

SEQ ID NO: 9450453 - DNA, 22 bp, Homo sapiens
acttttcccttggtagagttgc

SEQ ID NO: 9450454 - DNA, 22 bp, Homo sapiens
acttttcccttggtagagttgc

SEQ ID NO: 9450455 - DNA, 16 bp, Homo sapiens
acttttccaccttttt

SEQ ID NO: 9450456 - DNA, 16 bp, Homo sapiens
acttttccaccttttt

SEQ ID NO: 9450457 - DNA, 23 bp, Homo sapiens
acttttcaattagctatgcttaa

SEQ ID NO: 9450458 - DNA, 22 bp, Homo sapiens
acttttctccctcctgccttca

SEQ ID NO: 9450459 - DNA, 22 bp, Homo sapiens
acttttctgcagatgatctctt

SEQ ID NO: 9450460 - DNA, 22 bp, Homo sapiens
acttttctccctcctgccttca

SEQ ID NO: 9450461 - DNA, 22 bp, Homo sapiens
acttttctaagcaatggtcttg

SEQ ID NO: 9450462 - DNA, 22 bp, Homo sapiens
acttttctccctcctgccttca

SEQ ID NO: 9450463 - DNA, 22 bp, Homo sapiens
acttttctaagcaatggtcttg

SEQ ID NO: 9450464 - DNA, 22 bp, Homo sapiens
acttttctaagcaatggtcttg

SEQ ID NO: 9450465 - DNA, 21 bp, Homo sapiens
agaaaaacacgatataagccc

SEQ ID NO: 9450466 - DNA, 21 bp, Homo sapiens
agaaaaacacgatataagccc

SEQ ID NO: 9450467 - DNA, 21 bp, Homo sapiens
agaaaaacacgatataagccc

SEQ ID NO: 9450468 - DNA, 21 bp, Homo sapiens
agaaaaacacgatataagccc

SEQ ID NO: 9450469 - DNA, 21 bp, Homo sapiens
agaaaaacacgatataagccc

SEQ ID NO: 9450470 - DNA, 23 bp, Homo sapiens
agaaaaacaggattgtgttccta

SEQ ID NO: 9450471 - DNA, 23 bp, Homo sapiens
agaaaaacaggattgtgttccta

SEQ ID NO: 9450472 - DNA, 21 bp, Homo sapiens
agaaaaaccagcatgttttca

SEQ ID NO: 9450473 - DNA, 22 bp, Homo sapiens
acttttttataaggaagaagat

SEQ ID NO: 9450474 - DNA, 22 bp, Homo sapiens
acttttttataaggaagaagat

SEQ ID NO: 9450475 - DNA, 22 bp, Homo sapiens
acttttttataaggaagaagat

SEQ ID NO: 9450476 - DNA, 22 bp, Homo sapiens
acttttttataaggaagaagat

SEQ ID NO: 9450477 - DNA, 22 bp, Homo sapiens
agaaaaacacaatcgggcctcc

SEQ ID NO: 9450478 - DNA, 22 bp, Homo sapiens
actttttctcagaaggattggt

SEQ ID NO: 9450479 - DNA, 22 bp, Homo sapiens
atctctggttgttttgctccca

SEQ ID NO: 9450480 - DNA, 22 bp, Homo sapiens
atctctggtccaaatgttacct

SEQ ID NO: 9450481 - DNA, 22 bp, Homo sapiens
atctctgggtccatagaagaga

SEQ ID NO: 9450482 - DNA, 22 bp, Homo sapiens
atctctggcccctggggtccga

SEQ ID NO: 9450483 - DNA, 22 bp, Homo sapiens
atctctggcaatgcagcatcgt

SEQ ID NO: 9450484 - DNA, 22 bp, Homo sapiens
atctctgggctttgagtttgtt

SEQ ID NO: 9450485 - DNA, 22 bp, Homo sapiens
atctctggccttccttttccaa

SEQ ID NO: 9450486 - DNA, 22 bp, Homo sapiens
atctctggccttccttttccaa

SEQ ID NO: 9450487 - DNA, 22 bp, Homo sapiens
atctctttgatggctcctgtga

SEQ ID NO: 9450488 - DNA, 22 bp, Homo sapiens
atctcttatgtcacataaacca

SEQ ID NO: 9450489 - DNA, 22 bp, Homo sapiens
atctctgtaattacatgatatt

SEQ ID NO: 9450490 - DNA, 22 bp, Homo sapiens
atctcttagcagtctagtgacc

SEQ ID NO: 9450491 - DNA, 22 bp, Homo sapiens
atctcttagcagtctagtgacc

SEQ ID NO: 9450492 - DNA, 22 bp, Homo sapiens
atctctgtaattacatgatatt

SEQ ID NO: 9450493 - DNA, 22 bp, Homo sapiens
atctctgtaaaccataaattga

SEQ ID NO: 9450494 - DNA, 22 bp, Homo sapiens
agaagccaatccttgtctctct

SEQ ID NO: 9450495 - DNA, 22 bp, Homo sapiens
agaagccaattctgtgtgagtc

SEQ ID NO: 9450496 - DNA, 22 bp, Homo sapiens
agaagccaatccttgtctctct

SEQ ID NO: 9450497 - DNA, 22 bp, Homo sapiens
agaagccaatcagctctctgct

SEQ ID NO: 9450498 - DNA, 22 bp, Homo sapiens
agaagccaatccttgtctctct

SEQ ID NO: 9450499 - DNA, 22 bp, Homo sapiens
agaagccacaggcctcgtctgg

SEQ ID NO: 9450500 - DNA, 22 bp, Homo sapiens
agaagccaattctgtgtgagtc

SEQ ID NO: 9450501 - DNA, 22 bp, Homo sapiens
agaagccacaggaaagcagctt

SEQ ID NO: 9450502 - DNA, 22 bp, Homo sapiens
agaagccaatcagctctctgct

SEQ ID NO: 9450503 - DNA, 20 bp, Homo sapiens
agaagccaagtgacatgttt

SEQ ID NO: 9450504 - DNA, 20 bp, Homo sapiens
agaagccaagtgacatgttt

SEQ ID NO: 9450505 - DNA, 22 bp, Homo sapiens
agaagccaacagggcaggagag

SEQ ID NO: 9450506 - DNA, 22 bp, Homo sapiens
agaagccaacagggcaggagag

SEQ ID NO: 9450507 - DNA, 22 bp, Homo sapiens
atctctttgatggctcctgtga

SEQ ID NO: 9450508 - DNA, 22 bp, Homo sapiens
agaaggcaggttttaaaatgtc

SEQ ID NO: 9450509 - DNA, 22 bp, Homo sapiens
agaaggcaggttttaaaatgtc

SEQ ID NO: 9450510 - DNA, 22 bp, Homo sapiens
atctgcccatctgtcctgcttc

SEQ ID NO: 9450511 - DNA, 22 bp, Homo sapiens
atctgccaatgccatgagaaga

SEQ ID NO: 9450512 - DNA, 22 bp, Homo sapiens
agaaggcactcacactggcacg

SEQ ID NO: 9450513 - DNA, 22 bp, Homo sapiens
agaaggcactcacactggcacg

SEQ ID NO: 9450514 - DNA, 22 bp, Homo sapiens
agaaggcactcacactggcacg

SEQ ID NO: 9450515 - DNA, 22 bp, Homo sapiens
agaaggcagatgggacggagca

SEQ ID NO: 9450516 - DNA, 22 bp, Homo sapiens
agaaggcagatgggacggagca

SEQ ID NO: 9450517 - DNA, 22 bp, Homo sapiens
agaaggcagatgggacggagca

SEQ ID NO: 9450518 - DNA, 22 bp, Homo sapiens
agaaggagtgtacaggtcatgc

SEQ ID NO: 9450519 - DNA, 22 bp, Homo sapiens
agaaggcacagtgctgctaaga

SEQ ID NO: 9450520 - DNA, 22 bp, Homo sapiens
agaaggcacagtgctgctaaga

SEQ ID NO: 9450521 - DNA, 21 bp, Homo sapiens
agaaggcaccagcaaggactg

SEQ ID NO: 9450522 - DNA, 21 bp, Homo sapiens
agaaggcaccagcaaggactg

SEQ ID NO: 9450523 - DNA, 22 bp, Homo sapiens
agaaggcaccgtggccaatatt

SEQ ID NO: 9450524 - DNA, 22 bp, Homo sapiens
agaagccacaggcctcgtctgg

SEQ ID NO: 9450525 - DNA, 19 bp, Homo sapiens
agaagctgtgaaatgaagg

SEQ ID NO: 9450526 - DNA, 22 bp, Homo sapiens
agaaggagtgtacaggtcatgc

SEQ ID NO: 9450527 - DNA, 22 bp, Homo sapiens
agaaggagtgtacaggtcatgc

SEQ ID NO: 9450528 - DNA, 22 bp, Homo sapiens
agaacatatctgttttctaact

SEQ ID NO: 9450529 - DNA, 22 bp, Homo sapiens
agaacatatctgttttctaact

SEQ ID NO: 9450530 - DNA, 22 bp, Homo sapiens
agaacatatctgttttctaact

SEQ ID NO: 9450531 - DNA, 22 bp, Homo sapiens
agaacataattatcataaactg

SEQ ID NO: 9450532 - DNA, 22 bp, Homo sapiens
agaacataattatcataaactg

SEQ ID NO: 9450533 - DNA, 23 bp, Homo sapiens
agaacagtgactaatatagagag

SEQ ID NO: 9450534 - DNA, 22 bp, Homo sapiens
agaacagtgctgataaatcata

SEQ ID NO: 9450535 - DNA, 22 bp, Homo sapiens
atccccagaaaataggtgccta

SEQ ID NO: 9450536 - DNA, 22 bp, Homo sapiens
agaacagggactggaggcttca

SEQ ID NO: 9450537 - DNA, 22 bp, Homo sapiens
agaacagggactggaggcttca

SEQ ID NO: 9450538 - DNA, 22 bp, Homo sapiens
agaacaggttcagggtataaaa

SEQ ID NO: 9450539 - DNA, 22 bp, Homo sapiens
atccccagaaaataggtgccta

SEQ ID NO: 9450540 - DNA, 22 bp, Homo sapiens
atccccagaaaataggtgccta

SEQ ID NO: 9450541 - DNA, 22 bp, Homo sapiens
atcccatttcctgttttgtcaa

SEQ ID NO: 9450542 - DNA, 22 bp, Homo sapiens
atctcaggaggaccctgatgct

SEQ ID NO: 9450543 - DNA, 22 bp, Homo sapiens
atctcaggccctagtgacctca

SEQ ID NO: 9450544 - DNA, 22 bp, Homo sapiens
atctcaggaggttcctctgtcc

SEQ ID NO: 9450545 - DNA, 22 bp, Homo sapiens
agaaccctatctttctgaggtt

SEQ ID NO: 9450546 - DNA, 20 bp, Homo sapiens
agaacctaagttaaaacaca

SEQ ID NO: 9450547 - DNA, 22 bp, Homo sapiens
agaacctcaattatttttgcac

SEQ ID NO: 9450548 - DNA, 22 bp, Homo sapiens
atctctggcaatgcagcatcgt

SEQ ID NO: 9450549 - DNA, 22 bp, Homo sapiens
atctcagggctggagccctgga

SEQ ID NO: 9450550 - DNA, 19 bp, Homo sapiens
agaaccactgctctcttca

SEQ ID NO: 9450551 - DNA, 22 bp, Homo sapiens
agaaccagtttaagatttgggt

SEQ ID NO: 9450552 - DNA, 22 bp, Homo sapiens
agaaccctatctttctgaggtt

SEQ ID NO: 9450553 - DNA, 22 bp, Homo sapiens
agaaccctaatacaatggacat

SEQ ID NO: 9450554 - DNA, 21 bp, Homo sapiens
agaacccagcagcactgttct

SEQ ID NO: 9450555 - DNA, 22 bp, Homo sapiens
agaacattaatgcgaggtatta

SEQ ID NO: 9450556 - DNA, 22 bp, Homo sapiens
agaacatttgtcaaaaagccaa

SEQ ID NO: 9450557 - DNA, 22 bp, Homo sapiens
agaacatttgtcgatcaatttg

SEQ ID NO: 9450558 - DNA, 22 bp, Homo sapiens
agaacattaatgcgaggtatta

SEQ ID NO: 9450559 - DNA, 22 bp, Homo sapiens
atcccaggggttgtatcttccc

SEQ ID NO: 9450560 - DNA, 22 bp, Homo sapiens
atcccatttcctagtacatcat

SEQ ID NO: 9450561 - DNA, 22 bp, Homo sapiens
atcccaggcggcacaggttgca

SEQ ID NO: 9450562 - DNA, 22 bp, Homo sapiens
atcccaggaggctgcgcagtta

SEQ ID NO: 9450563 - DNA, 21 bp, Homo sapiens
atcccagcacccaggagtgca

SEQ ID NO: 9450564 - DNA, 22 bp, Homo sapiens
atcccagatagtgaccctcagg

SEQ ID NO: 9450565 - DNA, 22 bp, Homo sapiens
atcccagatggaggctggtcac

SEQ ID NO: 9450566 - DNA, 19 bp, Homo sapiens
atcccaaggagctgggact

SEQ ID NO: 9450567 - DNA, 22 bp, Homo sapiens
atccatttttgcaaagttgttc

SEQ ID NO: 9450568 - DNA, 22 bp, Homo sapiens
atccattttttcagaatgctct

SEQ ID NO: 9450569 - DNA, 22 bp, Homo sapiens
atccattttttcagaatgctct

SEQ ID NO: 9450570 - DNA, 22 bp, Homo sapiens
atcccacctcaatctgaagctc

SEQ ID NO: 9450571 - DNA, 22 bp, Homo sapiens
agaaatctattatttcagagtt

SEQ ID NO: 9450572 - DNA, 22 bp, Homo sapiens
agaaatctattatttcagagtt

SEQ ID NO: 9450573 - DNA, 22 bp, Homo sapiens
agaaatctaagatgctcaagga

SEQ ID NO: 9450574 - DNA, 22 bp, Homo sapiens
agaaatctatgttttggttaga

SEQ ID NO: 9450575 - DNA, 22 bp, Homo sapiens
atccattttccttggcagcagg

SEQ ID NO: 9450576 - DNA, 22 bp, Homo sapiens
atccattttctctctgtggggt

SEQ ID NO: 9450577 - DNA, 22 bp, Homo sapiens
atccattttaactgttagtgca

SEQ ID NO: 9450578 - DNA, 22 bp, Homo sapiens
atccattttaactgttagtgca

SEQ ID NO: 9450579 - DNA, 22 bp, Homo sapiens
atccatttgtttactgatggac

SEQ ID NO: 9450580 - DNA, 22 bp, Homo sapiens
agaaatctgactgctgtgcaca

SEQ ID NO: 9450581 - DNA, 22 bp, Homo sapiens
agaaatctgactgctgtgcaca

SEQ ID NO: 9450582 - DNA, 22 bp, Homo sapiens
agaaatcttatcaagaaatgcc

SEQ ID NO: 9450583 - DNA, 21 bp, Homo sapiens
aggtgggcaggtggagtggcc

SEQ ID NO: 9450584 - DNA, 22 bp, Homo sapiens
aggtgggcggattcatgaggtc

SEQ ID NO: 9450585 - DNA, 22 bp, Homo sapiens
aggtgggcggattcatgaggtc

SEQ ID NO: 9450586 - DNA, 22 bp, Homo sapiens
aggtggggaaaccagcgatccc

SEQ ID NO: 9450587 - DNA, 22 bp, Homo sapiens
aggtggggaaaccagcgatccc

SEQ ID NO: 9450588 - DNA, 22 bp, Homo sapiens
agtaataatagctgtaaagtgc

SEQ ID NO: 9450589 - DNA, 22 bp, Homo sapiens
aggtggggaaaccagcgatccc

SEQ ID NO: 9450590 - DNA, 23 bp, Homo sapiens
agtacattcgaaaaattctgtga

SEQ ID NO: 9450591 - DNA, 22 bp, Homo sapiens
agtacatttattaatggtaaaa

SEQ ID NO: 9450592 - DNA, 22 bp, Homo sapiens
agtaataatagctgtaaagtgc

SEQ ID NO: 9450593 - DNA, 22 bp, Homo sapiens
agtaataatagtagccggcatt

SEQ ID NO: 9450594 - DNA, 22 bp, Homo sapiens
agtaataatagctgtaaagtgc

SEQ ID NO: 9450595 - DNA, 22 bp, Homo sapiens
agtaccattactcacttatttt

SEQ ID NO: 9450596 - DNA, 22 bp, Homo sapiens
agtataattagatatcaaaagt

SEQ ID NO: 9450597 - DNA, 22 bp, Homo sapiens
agtataattagatatcaaaagt

SEQ ID NO: 9450598 - DNA, 22 bp, Homo sapiens
agtagtttttaagaggtataaa

SEQ ID NO: 9450599 - DNA, 21 bp, Homo sapiens
agtagtttagcacagggtttg

SEQ ID NO: 9450600 - DNA, 21 bp, Homo sapiens
agtagtttagcacagggtttg

SEQ ID NO: 9450601 - DNA, 22 bp, Homo sapiens
agtatacaaataaatgtgtaat

SEQ ID NO: 9450602 - DNA, 22 bp, Homo sapiens
agtatacaaataaatgtgtaat

SEQ ID NO: 9450603 - DNA, 22 bp, Homo sapiens
agtatacaaataaatgtgtaat

SEQ ID NO: 9450604 - DNA, 22 bp, Homo sapiens
agtatacagtaatgacatatct

SEQ ID NO: 9450605 - DNA, 22 bp, Homo sapiens
agtatacagtaatgacatatct

SEQ ID NO: 9450606 - DNA, 22 bp, Homo sapiens
actccaggggttgctatttaca

SEQ ID NO: 9450607 - DNA, 22 bp, Homo sapiens
agtatacatatattagccttcg

SEQ ID NO: 9450608 - DNA, 22 bp, Homo sapiens
agtagtcagcagataatatagg

SEQ ID NO: 9450609 - DNA, 22 bp, Homo sapiens
agtagtggggccagggtttgaa

SEQ ID NO: 9450610 - DNA, 22 bp, Homo sapiens
agtagtggcttcctggagtgct

SEQ ID NO: 9450611 - DNA, 22 bp, Homo sapiens
agtagaaagaaggcactgggcc

SEQ ID NO: 9450612 - DNA, 22 bp, Homo sapiens
agtagaaagttgcaggaggaat

SEQ ID NO: 9450613 - DNA, 22 bp, Homo sapiens
agtagaaagttgcaggaggaat

SEQ ID NO: 9450614 - DNA, 22 bp, Homo sapiens
agtactttgcactttgctcaga

SEQ ID NO: 9450615 - DNA, 22 bp, Homo sapiens
agtactttgcactttgctcaga

SEQ ID NO: 9450616 - DNA, 22 bp, Homo sapiens
agtactttttgttcaattgtgc

SEQ ID NO: 9450617 - DNA, 22 bp, Homo sapiens
agtactttacttcttacagttt

SEQ ID NO: 9450618 - DNA, 22 bp, Homo sapiens
agtacttagaaagttaatataa

SEQ ID NO: 9450619 - DNA, 22 bp, Homo sapiens
agtactttacttcttacagttt

SEQ ID NO: 9450620 - DNA, 22 bp, Homo sapiens
agtacttcagaggctgcccagg

SEQ ID NO: 9450621 - DNA, 20 bp, Homo sapiens
agtaccttttgtatgttacc

SEQ ID NO: 9450622 - DNA, 22 bp, Homo sapiens
agtacctttgcatggatttttt

SEQ ID NO: 9450623 - DNA, 22 bp, Homo sapiens
actctcccttggagcctcaggc

SEQ ID NO: 9450624 - DNA, 22 bp, Homo sapiens
actctcccttggagcctcaggc

SEQ ID NO: 9450625 - DNA, 22 bp, Homo sapiens
actctcccttggagcctcaggc

SEQ ID NO: 9450626 - DNA, 22 bp, Homo sapiens
actctctgagctaccaggtgag

SEQ ID NO: 9450627 - DNA, 22 bp, Homo sapiens
actctctggtgtagaaagacct

SEQ ID NO: 9450628 - DNA, 22 bp, Homo sapiens
actctctgtctaaatgcagttt

SEQ ID NO: 9450629 - DNA, 22 bp, Homo sapiens
actctcttgggggagagcagag

SEQ ID NO: 9450630 - DNA, 22 bp, Homo sapiens
actctctgtgatggaggccagc

SEQ ID NO: 9450631 - DNA, 22 bp, Homo sapiens
agtcactgctttgtccctgtgt

SEQ ID NO: 9450632 - DNA, 22 bp, Homo sapiens
agtcactgagatggtgaggcta

SEQ ID NO: 9450633 - DNA, 22 bp, Homo sapiens
agtcactgaataccttaatgtt

SEQ ID NO: 9450634 - DNA, 22 bp, Homo sapiens
agtcactgggctgcttcctata

SEQ ID NO: 9450635 - DNA, 22 bp, Homo sapiens
agtcactgctttgtccctgtgt

SEQ ID NO: 9450636 - DNA, 22 bp, Homo sapiens
agtcactgctttgtccctgtgt

SEQ ID NO: 9450637 - DNA, 22 bp, Homo sapiens
agtcactggttctgtaattaat

SEQ ID NO: 9450638 - DNA, 22 bp, Homo sapiens
agtcactggttctgtaattaat

SEQ ID NO: 9450639 - DNA, 22 bp, Homo sapiens
agtcactgtcaaagccacacac

SEQ ID NO: 9450640 - DNA, 22 bp, Homo sapiens
agtcactgtcttgcaaaggtca

SEQ ID NO: 9450641 - DNA, 22 bp, Homo sapiens
agtcactgttctgtcatgtcaa

SEQ ID NO: 9450642 - DNA, 22 bp, Homo sapiens
agtcactgtttaatctagctaa

SEQ ID NO: 9450643 - DNA, 22 bp, Homo sapiens
agtcactgttctgtcatgtcaa

SEQ ID NO: 9450644 - DNA, 22 bp, Homo sapiens
agtcactgtcttgcaaaggtca

SEQ ID NO: 9450645 - DNA, 22 bp, Homo sapiens
agtcacttaatctaagtctcag

SEQ ID NO: 9450646 - DNA, 22 bp, Homo sapiens
agtcacttccagacacctgcct

SEQ ID NO: 9450647 - DNA, 22 bp, Homo sapiens
agtcacttccagacacctgcct

SEQ ID NO: 9450648 - DNA, 22 bp, Homo sapiens
agtcacttcatggtttcttgga

SEQ ID NO: 9450649 - DNA, 22 bp, Homo sapiens
agtcacttccagctgtgtttca

SEQ ID NO: 9450650 - DNA, 22 bp, Homo sapiens
agtcacttccagacacctgcct

SEQ ID NO: 9450651 - DNA, 22 bp, Homo sapiens
actctaaaccccactctgctgg

SEQ ID NO: 9450652 - DNA, 22 bp, Homo sapiens
agtcactgtttcagaactgagt

SEQ ID NO: 9450653 - DNA, 22 bp, Homo sapiens
agtcactgtttaatctagctaa

SEQ ID NO: 9450654 - DNA, 22 bp, Homo sapiens
agtcacttaataggttcatctg

SEQ ID NO: 9450655 - DNA, 22 bp, Homo sapiens
agtcacttaacatttgctgcag

SEQ ID NO: 9450656 - DNA, 22 bp, Homo sapiens
agtcaccatctgtggcagcctg

SEQ ID NO: 9450657 - DNA, 22 bp, Homo sapiens
agtcactctgctacatgacagc

SEQ ID NO: 9450658 - DNA, 22 bp, Homo sapiens
agtcaccctccaactctccact

SEQ ID NO: 9450659 - DNA, 22 bp, Homo sapiens
agtcaccaggttttagagacct

SEQ ID NO: 9450660 - DNA, 22 bp, Homo sapiens
actcctgggtgctgaccagcgt

SEQ ID NO: 9450661 - DNA, 22 bp, Homo sapiens
actcctggggatccattccttt

SEQ ID NO: 9450662 - DNA, 21 bp, Homo sapiens
actccctgcataagtgattta

SEQ ID NO: 9450663 - DNA, 22 bp, Homo sapiens
actccctctctagtccttgcaa

SEQ ID NO: 9450664 - DNA, 22 bp, Homo sapiens
actccctccaaatctgcacagt

SEQ ID NO: 9450665 - DNA, 22 bp, Homo sapiens
actccctccaaatctgcacagt

SEQ ID NO: 9450666 - DNA, 22 bp, Homo sapiens
actccagggtgactctgtctga

SEQ ID NO: 9450667 - DNA, 22 bp, Homo sapiens
actccagggttttgcacctgga

SEQ ID NO: 9450668 - DNA, 22 bp, Homo sapiens
actcctcagccagcatcaggga

SEQ ID NO: 9450669 - DNA, 22 bp, Homo sapiens
actcctacatattagcattaac

SEQ ID NO: 9450670 - DNA, 22 bp, Homo sapiens
actcccttgtgaactcattctt

SEQ ID NO: 9450671 - DNA, 22 bp, Homo sapiens
actccctgtacttgcctctctt

SEQ ID NO: 9450672 - DNA, 22 bp, Homo sapiens
aggtatttcctttaaagaaact

SEQ ID NO: 9450673 - DNA, 19 bp, Homo sapiens
aggtatttgggagatatat

SEQ ID NO: 9450674 - DNA, 22 bp, Homo sapiens
aggtatttgttacagcagcacc

SEQ ID NO: 9450675 - DNA, 22 bp, Homo sapiens
aggtattttatagataagtaaa

SEQ ID NO: 9450676 - DNA, 22 bp, Homo sapiens
accctgtcttccctgggcatca

SEQ ID NO: 9450677 - DNA, 22 bp, Homo sapiens
acccttctgtgacctgcctgtc

SEQ ID NO: 9450678 - DNA, 22 bp, Homo sapiens
acccttcatagaggagaagctg

SEQ ID NO: 9450679 - DNA, 22 bp, Homo sapiens
accctgtgcagagaagtgagcg

SEQ ID NO: 9450680 - DNA, 22 bp, Homo sapiens
accctgtcttccctgggcatca

SEQ ID NO: 9450681 - DNA, 19 bp, Homo sapiens
aggtagctcagactcaaag

SEQ ID NO: 9450682 - DNA, 22 bp, Homo sapiens
accctttagaaggcatctcagt

SEQ ID NO: 9450683 - DNA, 22 bp, Homo sapiens
aggtcaaaatcaggcagggaag

SEQ ID NO: 9450684 - DNA, 22 bp, Homo sapiens
aggtcaaaagcaaggccaggtt

SEQ ID NO: 9450685 - DNA, 22 bp, Homo sapiens
aggtcaaggccaaaagagtggt

SEQ ID NO: 9450686 - DNA, 22 bp, Homo sapiens
aggtcaaggccaaaagagtggt

SEQ ID NO: 9450687 - DNA, 22 bp, Homo sapiens
aggtcaagagtaaatttgggta

SEQ ID NO: 9450688 - DNA, 22 bp, Homo sapiens
aggtcaagtttagatagagtta

SEQ ID NO: 9450689 - DNA, 22 bp, Homo sapiens
aggtcatttccttagaggcaga

SEQ ID NO: 9450690 - DNA, 22 bp, Homo sapiens
aggtcaaggctgcagtgagctg

SEQ ID NO: 9450691 - DNA, 22 bp, Homo sapiens
aggtcaagggcaagagtgaggt

SEQ ID NO: 9450692 - DNA, 22 bp, Homo sapiens
aggtcaaggttcacaggggatc

SEQ ID NO: 9450693 - DNA, 22 bp, Homo sapiens
aggtcaaggttcacaggggatc

SEQ ID NO: 9450694 - DNA, 22 bp, Homo sapiens
aggtcaagggcaagagtgaggt

SEQ ID NO: 9450695 - DNA, 19 bp, Homo sapiens
acctttcctttctcagatg

SEQ ID NO: 9450696 - DNA, 19 bp, Homo sapiens
acctttgagaagaaatgtc

SEQ ID NO: 9450697 - DNA, 22 bp, Homo sapiens
acctttgagtgtattgtctttc

SEQ ID NO: 9450698 - DNA, 22 bp, Homo sapiens
acctttccaagtatcaggtggt

SEQ ID NO: 9450699 - DNA, 22 bp, Homo sapiens
acctttcctggctgaccgagga

SEQ ID NO: 9450700 - DNA, 22 bp, Homo sapiens
acctttcattaaagtctgtagt

SEQ ID NO: 9450701 - DNA, 22 bp, Homo sapiens
acctttcacggtatcagacatc

SEQ ID NO: 9450702 - DNA, 22 bp, Homo sapiens
aggtccagtgctcttggtggtt

SEQ ID NO: 9450703 - DNA, 22 bp, Homo sapiens
acctttcaaagtggctatcact

SEQ ID NO: 9450704 - DNA, 20 bp, Homo sapiens
acctttcaaatgattcagca

SEQ ID NO: 9450705 - DNA, 22 bp, Homo sapiens
acctttatgtttgattacaatt

SEQ ID NO: 9450706 - DNA, 22 bp, Homo sapiens
aggtccaggcctcatgatggcc

SEQ ID NO: 9450707 - DNA, 22 bp, Homo sapiens
aggtccaggcatttgggttggg

SEQ ID NO: 9450708 - DNA, 22 bp, Homo sapiens
aggtccaggcatttgggttggg

SEQ ID NO: 9450709 - DNA, 22 bp, Homo sapiens
aggtccaggatttgtggggtct

SEQ ID NO: 9450710 - DNA, 22 bp, Homo sapiens
aggtccaggagatttggcaatt

SEQ ID NO: 9450711 - DNA, 22 bp, Homo sapiens
aggtccagctgttgcagcctcc

SEQ ID NO: 9450712 - DNA, 22 bp, Homo sapiens
aggtccagactgtgtaccctag

SEQ ID NO: 9450713 - DNA, 22 bp, Homo sapiens
aggtccacagttcagctgccca

SEQ ID NO: 9450714 - DNA, 20 bp, Homo sapiens
aggtccactgaggctgcctc

SEQ ID NO: 9450715 - DNA, 22 bp, Homo sapiens
aggtccagcctgccctctctcc

SEQ ID NO: 9450716 - DNA, 22 bp, Homo sapiens
aggtccagagttgagatacaga

SEQ ID NO: 9450717 - DNA, 22 bp, Homo sapiens
aggtccagaggttgaacggtgg

SEQ ID NO: 9450718 - DNA, 22 bp, Homo sapiens
aggtgactactattttaaaata

SEQ ID NO: 9450719 - DNA, 22 bp, Homo sapiens
aggtgactggtttatctggcag

SEQ ID NO: 9450720 - DNA, 22 bp, Homo sapiens
aggtgacatcccggcagcagag

SEQ ID NO: 9450721 - DNA, 22 bp, Homo sapiens
aggtgaacccaggtgcttcacg

SEQ ID NO: 9450722 - DNA, 22 bp, Homo sapiens
aggtgaagttgaggaggcagaa

SEQ ID NO: 9450723 - DNA, 22 bp, Homo sapiens
aggtgaagttgaggaggcagaa

SEQ ID NO: 9450724 - DNA, 22 bp, Homo sapiens
aggtgaagttgaggaggcagaa

SEQ ID NO: 9450725 - DNA, 22 bp, Homo sapiens
aggtgaagttgaggaggcagaa

SEQ ID NO: 9450726 - DNA, 22 bp, Homo sapiens
aggtgaagttaaaaaccagtct

SEQ ID NO: 9450727 - DNA, 22 bp, Homo sapiens
aggtgaagttgaggaggcagaa

SEQ ID NO: 9450728 - DNA, 22 bp, Homo sapiens
aggtgaagttaaaaaccagtct

SEQ ID NO: 9450729 - DNA, 22 bp, Homo sapiens
aggtgaagttaaaaaccagtct

SEQ ID NO: 9450730 - DNA, 22 bp, Homo sapiens
accttttacggtgtgactagca

SEQ ID NO: 9450731 - DNA, 22 bp, Homo sapiens
accttttcatctgaaactttta

SEQ ID NO: 9450732 - DNA, 22 bp, Homo sapiens
accttttcatctgaaactttta

SEQ ID NO: 9450733 - DNA, 22 bp, Homo sapiens
accttttccagcttctagaggc

SEQ ID NO: 9450734 - DNA, 22 bp, Homo sapiens
acctttttccaaagcttcttac

SEQ ID NO: 9450735 - DNA, 22 bp, Homo sapiens
accttttttcagaactctaaag

SEQ ID NO: 9450736 - DNA, 22 bp, Homo sapiens
accttttttcagaactctaaag

SEQ ID NO: 9450737 - DNA, 22 bp, Homo sapiens
acgagaggtccttagaatctgt

SEQ ID NO: 9450738 - DNA, 22 bp, Homo sapiens
acgatgatgaaagagaacattc

SEQ ID NO: 9450739 - DNA, 22 bp, Homo sapiens
aggtctgttagcatgttgacta

SEQ ID NO: 9450740 - DNA, 22 bp, Homo sapiens
aggtctgttggtaccagtgtgg

SEQ ID NO: 9450741 - DNA, 22 bp, Homo sapiens
aggtgggcactccgctcgaggt

SEQ ID NO: 9450742 - DNA, 22 bp, Homo sapiens
aggtgggcactccgctcgaggt

SEQ ID NO: 9450743 - DNA, 22 bp, Homo sapiens
actagaaagtttccagagttat

SEQ ID NO: 9450744 - DNA, 22 bp, Homo sapiens
aggtgggcacagatggagaagt

SEQ ID NO: 9450745 - DNA, 22 bp, Homo sapiens
actagaaaattcctagaaacta

SEQ ID NO: 9450746 - DNA, 22 bp, Homo sapiens
actagaaagcactaagctaggc

SEQ ID NO: 9450747 - DNA, 22 bp, Homo sapiens
aggtgactggtttatctggcag

SEQ ID NO: 9450748 - DNA, 22 bp, Homo sapiens
aggtgagaaaacgagggttgca

SEQ ID NO: 9450749 - DNA, 22 bp, Homo sapiens
actaaatatttgagaggtgtag

SEQ ID NO: 9450750 - DNA, 22 bp, Homo sapiens
actacagtactatatctatagg

SEQ ID NO: 9450751 - DNA, 22 bp, Homo sapiens
actacagtaagggaggcagcat

SEQ ID NO: 9450752 - DNA, 22 bp, Homo sapiens
actacagtccctcatatgttgg

SEQ ID NO: 9450753 - DNA, 22 bp, Homo sapiens
actacagtactatatctatagg

SEQ ID NO: 9450754 - DNA, 23 bp, Homo sapiens
actacagatactcctgctgtttg

SEQ ID NO: 9450755 - DNA, 22 bp, Homo sapiens
actactgaatattagttctgaa

SEQ ID NO: 9450756 - DNA, 22 bp, Homo sapiens
actactggaaactgtagataat

SEQ ID NO: 9450757 - DNA, 22 bp, Homo sapiens
actacattatgaggaaagagtg

SEQ ID NO: 9450758 - DNA, 22 bp, Homo sapiens
actactacaagtgagtacaaag

SEQ ID NO: 9450759 - DNA, 22 bp, Homo sapiens
agtgaacagtttggaacacatg

SEQ ID NO: 9450760 - DNA, 19 bp, Homo sapiens
agtgaactccatatcaggt

SEQ ID NO: 9450761 - DNA, 22 bp, Homo sapiens
agtgaacaaaggtagtgagcat

SEQ ID NO: 9450762 - DNA, 22 bp, Homo sapiens
agtgaacaaaggtagtgagcat

SEQ ID NO: 9450763 - DNA, 22 bp, Homo sapiens
agtgaacaaaggtagtgagcat

SEQ ID NO: 9450764 - DNA, 22 bp, Homo sapiens
agtgaaatttgtttagataggt

SEQ ID NO: 9450765 - DNA, 22 bp, Homo sapiens
agtgaacaagttaagaacacta

SEQ ID NO: 9450766 - DNA, 22 bp, Homo sapiens
actgagcataaatatgtgtcca

SEQ ID NO: 9450767 - DNA, 22 bp, Homo sapiens
actgagcctgtgccctcatcag

SEQ ID NO: 9450768 - DNA, 22 bp, Homo sapiens
agtgaaatttgtttagataggt

SEQ ID NO: 9450769 - DNA, 17 bp, Homo sapiens
agtgaaatttacattgc

SEQ ID NO: 9450770 - DNA, 22 bp, Homo sapiens
actgagagttgaaaagggagga

SEQ ID NO: 9450771 - DNA, 22 bp, Homo sapiens
actgagagttgtgcattcatgc

SEQ ID NO: 9450772 - DNA, 22 bp, Homo sapiens
actgagcataaatatgtgtcca

SEQ ID NO: 9450773 - DNA, 22 bp, Homo sapiens
actgagaggtgatagtgacatt

SEQ ID NO: 9450774 - DNA, 22 bp, Homo sapiens
actgagaggtgatagtgacatt

SEQ ID NO: 9450775 - DNA, 22 bp, Homo sapiens
actgagagtcttagaaacacat

SEQ ID NO: 9450776 - DNA, 22 bp, Homo sapiens
actgagagtcaagatagcatgg

SEQ ID NO: 9450777 - DNA, 22 bp, Homo sapiens
actgagagtcaagatagcatgg

SEQ ID NO: 9450778 - DNA, 22 bp, Homo sapiens
actgagagtcaagatagcatgg

SEQ ID NO: 9450779 - DNA, 22 bp, Homo sapiens
actgacaaatatagcttcgtct

SEQ ID NO: 9450780 - DNA, 21 bp, Homo sapiens
actgagagatgttggatcata

SEQ ID NO: 9450781 - DNA, 22 bp, Homo sapiens
actgagagggaggctgtccggt

SEQ ID NO: 9450782 - DNA, 22 bp, Homo sapiens
actgagaggaaattgagactat

SEQ ID NO: 9450783 - DNA, 22 bp, Homo sapiens
actgagagcgtgtacaaactta

SEQ ID NO: 9450784 - DNA, 22 bp, Homo sapiens
actgaattttaattagatctgc

SEQ ID NO: 9450785 - DNA, 22 bp, Homo sapiens
actgaattttaattagatctgc

SEQ ID NO: 9450786 - DNA, 22 bp, Homo sapiens
actctgagttcctacttgctcc

SEQ ID NO: 9450787 - DNA, 22 bp, Homo sapiens
actctgagttcctacttgctcc

SEQ ID NO: 9450788 - DNA, 22 bp, Homo sapiens
actctgagttcctacttgctcc

SEQ ID NO: 9450789 - DNA, 18 bp, Homo sapiens
actctgagtccacttaag

SEQ ID NO: 9450790 - DNA, 18 bp, Homo sapiens
actctgagtccacttaag

SEQ ID NO: 9450791 - DNA, 22 bp, Homo sapiens
actctgagaaaacactatgctg

SEQ ID NO: 9450792 - DNA, 22 bp, Homo sapiens
actctgagaaaacactatgctg

SEQ ID NO: 9450793 - DNA, 23 bp, Homo sapiens
actctgacttagttatagctatt

SEQ ID NO: 9450794 - DNA, 22 bp, Homo sapiens
actctgagaaaacactatgctg

SEQ ID NO: 9450795 - DNA, 22 bp, Homo sapiens
actctgactggagtgagagagg

SEQ ID NO: 9450796 - DNA, 22 bp, Homo sapiens
actctgacatttaaaaagcaat

SEQ ID NO: 9450797 - DNA, 22 bp, Homo sapiens
actctgacatttaaaaagcaat

SEQ ID NO: 9450798 - DNA, 22 bp, Homo sapiens
actctgagcatcccaagtctta

SEQ ID NO: 9450799 - DNA, 22 bp, Homo sapiens
actctgagaatccctggacttt

SEQ ID NO: 9450800 - DNA, 22 bp, Homo sapiens
actctgagaatccctggacttt

SEQ ID NO: 9450801 - DNA, 22 bp, Homo sapiens
actctgagaatccctggacttt

SEQ ID NO: 9450802 - DNA, 22 bp, Homo sapiens
actctgagaactgagattccct

SEQ ID NO: 9450803 - DNA, 19 bp, Homo sapiens
actctgaggctgagacaag

SEQ ID NO: 9450804 - DNA, 22 bp, Homo sapiens
actctgagtcatgcactccttg

SEQ ID NO: 9450805 - DNA, 22 bp, Homo sapiens
actctgagtcatgcactccttg

SEQ ID NO: 9450806 - DNA, 19 bp, Homo sapiens
actctgaggctgagacaag

SEQ ID NO: 9450807 - DNA, 22 bp, Homo sapiens
actctgaggagtgactagaggt

SEQ ID NO: 9450808 - DNA, 22 bp, Homo sapiens
actctgaggcaggtcagggcag

SEQ ID NO: 9450809 - DNA, 22 bp, Homo sapiens
actctgaggaatgtacaggacc

SEQ ID NO: 9450810 - DNA, 22 bp, Homo sapiens
actctgaggaatgtacaggacc

SEQ ID NO: 9450811 - DNA, 22 bp, Homo sapiens
actctgaggagtgactagaggt

SEQ ID NO: 9450812 - DNA, 22 bp, Homo sapiens
actctgagccaccagatcccca

SEQ ID NO: 9450813 - DNA, 19 bp, Homo sapiens
actctgagcttgctctatc

SEQ ID NO: 9450814 - DNA, 22 bp, Homo sapiens
actctgagccaccagatcccca

SEQ ID NO: 9450815 - DNA, 22 bp, Homo sapiens
actctgaaatagaggctggtgg

SEQ ID NO: 9450816 - DNA, 22 bp, Homo sapiens
actctgaaccagagatcatacc

SEQ ID NO: 9450817 - DNA, 22 bp, Homo sapiens
actctgaactccaggaggctca

SEQ ID NO: 9450818 - DNA, 22 bp, Homo sapiens
actctgaaccagagatcatacc

SEQ ID NO: 9450819 - DNA, 22 bp, Homo sapiens
actctgaatgtgcatgtaaatc

SEQ ID NO: 9450820 - DNA, 22 bp, Homo sapiens
agtgaatacatgtcactcagca

SEQ ID NO: 9450821 - DNA, 20 bp, Homo sapiens
agtgaatagagacattgccc

SEQ ID NO: 9450822 - DNA, 20 bp, Homo sapiens
agtgaatagagacattgccc

SEQ ID NO: 9450823 - DNA, 22 bp, Homo sapiens
agtgaagcggcagatattagaa

SEQ ID NO: 9450824 - DNA, 22 bp, Homo sapiens
agtgaagaggaagtggggcaca

SEQ ID NO: 9450825 - DNA, 22 bp, Homo sapiens
agtgaagctggagaaaggcagt

SEQ ID NO: 9450826 - DNA, 22 bp, Homo sapiens
agtgaaggtttacagggcccct

SEQ ID NO: 9450827 - DNA, 22 bp, Homo sapiens
actgcactcctgcctgggtaac

SEQ ID NO: 9450828 - DNA, 22 bp, Homo sapiens
actgcactcctgcctgggtaac

SEQ ID NO: 9450829 - DNA, 22 bp, Homo sapiens
actgcactcctgcctgggtaac

SEQ ID NO: 9450830 - DNA, 22 bp, Homo sapiens
actgcactcctgcctgggtaac

SEQ ID NO: 9450831 - DNA, 22 bp, Homo sapiens
actgcactcctgcctgggtaac

SEQ ID NO: 9450832 - DNA, 22 bp, Homo sapiens
actgcactccagcctgggtgat

SEQ ID NO: 9450833 - DNA, 22 bp, Homo sapiens
actgcactccagcctgggtgat

SEQ ID NO: 9450834 - DNA, 22 bp, Homo sapiens
actgcactccagcctgggtgat

SEQ ID NO: 9450835 - DNA, 22 bp, Homo sapiens
actgcactccagcctgggtgat

SEQ ID NO: 9450836 - DNA, 22 bp, Homo sapiens
actgcactccagcctgggtgat

SEQ ID NO: 9450837 - DNA, 22 bp, Homo sapiens
actgcactccagcctgggtgat

SEQ ID NO: 9450838 - DNA, 22 bp, Homo sapiens
actgcactccagcctgggtgat

SEQ ID NO: 9450839 - DNA, 22 bp, Homo sapiens
actgcactccagcctgggtgat

SEQ ID NO: 9450840 - DNA, 22 bp, Homo sapiens
actgcactccagcctgggtgat

SEQ ID NO: 9450841 - DNA, 22 bp, Homo sapiens
actgcacttcaccctgggtgac

SEQ ID NO: 9450842 - DNA, 22 bp, Homo sapiens
actgcacttcaccctgggtgac

SEQ ID NO: 9450843 - DNA, 22 bp, Homo sapiens
actgcacttcaccctgggtgac

SEQ ID NO: 9450844 - DNA, 22 bp, Homo sapiens
actgcacttcaccctgggtgac

SEQ ID NO: 9450845 - DNA, 22 bp, Homo sapiens
actgcacttcaccctgggtgac

SEQ ID NO: 9450846 - DNA, 22 bp, Homo sapiens
actgcacttcaccctgggtgac

SEQ ID NO: 9450847 - DNA, 22 bp, Homo sapiens
actgcacttcaccctgggtgac

SEQ ID NO: 9450848 - DNA, 22 bp, Homo sapiens
actgcacttcaccctgggtgac

SEQ ID NO: 9450849 - DNA, 22 bp, Homo sapiens
agtgctatcgagttctaatgct

SEQ ID NO: 9450850 - DNA, 22 bp, Homo sapiens
agtgctcactctccacagtgcc

SEQ ID NO: 9450851 - DNA, 22 bp, Homo sapiens
agtgctcactctccacagtgcc

SEQ ID NO: 9450852 - DNA, 22 bp, Homo sapiens
agtgctccaaaggttggtcatt

SEQ ID NO: 9450853 - DNA, 22 bp, Homo sapiens
agtgctcataaaaatgtgaaac

SEQ ID NO: 9450854 - DNA, 22 bp, Homo sapiens
agtgctcatgcacatttatagt

SEQ ID NO: 9450855 - DNA, 22 bp, Homo sapiens
agtgctccacattgcactattc

SEQ ID NO: 9450856 - DNA, 23 bp, Homo sapiens
agtgctcccaggacctggggcag

SEQ ID NO: 9450857 - DNA, 22 bp, Homo sapiens
actgcagcctagggaccacagt

SEQ ID NO: 9450858 - DNA, 22 bp, Homo sapiens
actgcagcaggtaagagcattt

SEQ ID NO: 9450859 - DNA, 22 bp, Homo sapiens
agtgctcctcagaagagttgga

SEQ ID NO: 9450860 - DNA, 22 bp, Homo sapiens
agtgctcctatggatcagttgt

SEQ ID NO: 9450861 - DNA, 22 bp, Homo sapiens
agtgctccctagagttgtgcaa

SEQ ID NO: 9450862 - DNA, 22 bp, Homo sapiens
agtgctcctgccagctttctgg

SEQ ID NO: 9450863 - DNA, 22 bp, Homo sapiens
agtgctcctgaagcttgaggca

SEQ ID NO: 9450864 - DNA, 22 bp, Homo sapiens
agtgctcctttcattgctgccc

SEQ ID NO: 9450865 - DNA, 22 bp, Homo sapiens
actggcttggcaggaggaagat

SEQ ID NO: 9450866 - DNA, 22 bp, Homo sapiens
agtgtcctggcaagggtttcag

SEQ ID NO: 9450867 - DNA, 22 bp, Homo sapiens
actggctgtgtaacctcaggca

SEQ ID NO: 9450868 - DNA, 21 bp, Homo sapiens
actggctggtggctaagaatc

SEQ ID NO: 9450869 - DNA, 21 bp, Homo sapiens
actggctggtggctaagaatc

SEQ ID NO: 9450870 - DNA, 22 bp, Homo sapiens
agtgtccttagttagctttggg

SEQ ID NO: 9450871 - DNA, 22 bp, Homo sapiens
agtgtcctgtgtcccagactgt

SEQ ID NO: 9450872 - DNA, 22 bp, Homo sapiens
agtgtccttgttattactgctc

SEQ ID NO: 9450873 - DNA, 22 bp, Homo sapiens
actgggcaccatcatgagatgg

SEQ ID NO: 9450874 - DNA, 22 bp, Homo sapiens
actgggcagggaaggagaccga

SEQ ID NO: 9450875 - DNA, 22 bp, Homo sapiens
actgggcagggaaggagaccga

SEQ ID NO: 9450876 - DNA, 22 bp, Homo sapiens
agtgtctcagccccaactagag

SEQ ID NO: 9450877 - DNA, 22 bp, Homo sapiens
actgggaggcaaagagcaagga

SEQ ID NO: 9450878 - DNA, 22 bp, Homo sapiens
actgggaggcaaagagcaagga

SEQ ID NO: 9450879 - DNA, 22 bp, Homo sapiens
actgggccagatcagagcaact

SEQ ID NO: 9450880 - DNA, 20 bp, Homo sapiens
actgggcatacctgtcctgt

SEQ ID NO: 9450881 - DNA, 22 bp, Homo sapiens
actgggccagatcagagcaact

SEQ ID NO: 9450882 - DNA, 22 bp, Homo sapiens
actgggccagacactgattccc

SEQ ID NO: 9450883 - DNA, 22 bp, Homo sapiens
actgggcctgtacagagaaaac

SEQ ID NO: 9450884 - DNA, 22 bp, Homo sapiens
actgggcctggattggcgtgtc

SEQ ID NO: 9450885 - DNA, 22 bp, Homo sapiens
actgggcctgtacagagaaaac

SEQ ID NO: 9450886 - DNA, 21 bp, Homo sapiens
actggccaccactggcagggg

SEQ ID NO: 9450887 - DNA, 22 bp, Homo sapiens
actggctgcctccaaagtgtgc

SEQ ID NO: 9450888 - DNA, 22 bp, Homo sapiens
actggctggagttgccaaggct

SEQ ID NO: 9450889 - DNA, 22 bp, Homo sapiens
actggctgcgttcctgtgagac

SEQ ID NO: 9450890 - DNA, 22 bp, Homo sapiens
actgcctgctcataacattgct

SEQ ID NO: 9450891 - DNA, 22 bp, Homo sapiens
actgcctgctcataacattgct

SEQ ID NO: 9450892 - DNA, 22 bp, Homo sapiens
actgcctgctcctggctccaca

SEQ ID NO: 9450893 - DNA, 22 bp, Homo sapiens
actgcctgctcataacattgct

SEQ ID NO: 9450894 - DNA, 22 bp, Homo sapiens
actgcctgctcctggctccaca

SEQ ID NO: 9450895 - DNA, 22 bp, Homo sapiens
actgcctggcagaggtttgcaa

SEQ ID NO: 9450896 - DNA, 22 bp, Homo sapiens
actgcctggcagaggtttgcaa

SEQ ID NO: 9450897 - DNA, 22 bp, Homo sapiens
actgcctggcctggcctcactg

SEQ ID NO: 9450898 - DNA, 22 bp, Homo sapiens
actgcctggcctggcctcactg

SEQ ID NO: 9450899 - DNA, 22 bp, Homo sapiens
actgcctggcctggcctcactg

SEQ ID NO: 9450900 - DNA, 22 bp, Homo sapiens
actgcctggcctggcctcactg

SEQ ID NO: 9450901 - DNA, 18 bp, Homo sapiens
actgcctggcgaagatag

SEQ ID NO: 9450902 - DNA, 21 bp, Homo sapiens
actgcctggggtgctggccaa

SEQ ID NO: 9450903 - DNA, 21 bp, Homo sapiens
actgcctggggtgctggccaa

SEQ ID NO: 9450904 - DNA, 21 bp, Homo sapiens
actgcctggggtgctggccaa

SEQ ID NO: 9450905 - DNA, 22 bp, Homo sapiens
actgcctgtagccctgagatgt

SEQ ID NO: 9450906 - DNA, 22 bp, Homo sapiens
actgcctgtagccctgagatgt

SEQ ID NO: 9450907 - DNA, 22 bp, Homo sapiens
actgcctgtagctcttcatctc

SEQ ID NO: 9450908 - DNA, 22 bp, Homo sapiens
actgcctgatgtggttctaaat

SEQ ID NO: 9450909 - DNA, 22 bp, Homo sapiens
actgcctgcatccttagggtag

SEQ ID NO: 9450910 - DNA, 19 bp, Homo sapiens
actgcctgcaggtgttggg

SEQ ID NO: 9450911 - DNA, 19 bp, Homo sapiens
actgcctgcaggtgttggg

SEQ ID NO: 9450912 - DNA, 22 bp, Homo sapiens
actgcctgatgtggttctaaat

SEQ ID NO: 9450913 - DNA, 19 bp, Homo sapiens
actgcctgaggctcacagg

SEQ ID NO: 9450914 - DNA, 19 bp, Homo sapiens
actgcctgaggctcacagg

SEQ ID NO: 9450915 - DNA, 23 bp, Homo sapiens
actgcctgctactatgcccacgg

SEQ ID NO: 9450916 - DNA, 23 bp, Homo sapiens
actgcctgctactatgcccacgg

SEQ ID NO: 9450917 - DNA, 23 bp, Homo sapiens
actgcctgctactatgcccacgg

SEQ ID NO: 9450918 - DNA, 23 bp, Homo sapiens
actgcctgctactatgcccacgg

SEQ ID NO: 9450919 - DNA, 22 bp, Homo sapiens
actgcctgccttccaggtactg

SEQ ID NO: 9450920 - DNA, 22 bp, Homo sapiens
actgcctgccttccaggtactg

SEQ ID NO: 9450921 - DNA, 22 bp, Homo sapiens
actgcctgcctctgattctgca

SEQ ID NO: 9450922 - DNA, 22 bp, Homo sapiens
actgccctgtaactgccaggta

SEQ ID NO: 9450923 - DNA, 22 bp, Homo sapiens
actgcccttgtcctggcacacc

SEQ ID NO: 9450924 - DNA, 22 bp, Homo sapiens
actgccctgtaactgccaggta

SEQ ID NO: 9450925 - DNA, 22 bp, Homo sapiens
actgccctggcaccacacatgc

SEQ ID NO: 9450926 - DNA, 22 bp, Homo sapiens
actgcctgagctattggaaaag

SEQ ID NO: 9450927 - DNA, 19 bp, Homo sapiens
actgcctgaggctcacagg

SEQ ID NO: 9450928 - DNA, 22 bp, Homo sapiens
actgcctgagctattggaaaag

SEQ ID NO: 9450929 - DNA, 22 bp, Homo sapiens
actgcctgagctattggaaaag

SEQ ID NO: 9450930 - DNA, 22 bp, Homo sapiens
actgcctcttggtgctgagaga

SEQ ID NO: 9450931 - DNA, 22 bp, Homo sapiens
actgccctcccatctattgcaa

SEQ ID NO: 9450932 - DNA, 22 bp, Homo sapiens
actgccctccagcctgggtgac

SEQ ID NO: 9450933 - DNA, 22 bp, Homo sapiens
actgccctggagacagcagagt

SEQ ID NO: 9450934 - DNA, 22 bp, Homo sapiens
actgcccattatggtagtcact

SEQ ID NO: 9450935 - DNA, 22 bp, Homo sapiens
actgcccattaaaggtgctttg

SEQ ID NO: 9450936 - DNA, 22 bp, Homo sapiens
actgccctccagcctgggtgac

SEQ ID NO: 9450937 - DNA, 22 bp, Homo sapiens
actgcccatgtgcatcaagtag

SEQ ID NO: 9450938 - DNA, 22 bp, Homo sapiens
actgcccagtgattggtggtta

SEQ ID NO: 9450939 - DNA, 22 bp, Homo sapiens
actgcccagaagagatgaaagt

SEQ ID NO: 9450940 - DNA, 22 bp, Homo sapiens
actgcccaggaatctcaaagaa

SEQ ID NO: 9450941 - DNA, 22 bp, Homo sapiens
actgccaatggtagtttgatgg

SEQ ID NO: 9450942 - DNA, 22 bp, Homo sapiens
actgccaatggtagtttgatgg

SEQ ID NO: 9450943 - DNA, 22 bp, Homo sapiens
actgccaatggtagtttgatgg

SEQ ID NO: 9450944 - DNA, 22 bp, Homo sapiens
actgccagaatcattcaaggaa

SEQ ID NO: 9450945 - DNA, 21 bp, Homo sapiens
actgcccaccagttaacgctg

SEQ ID NO: 9450946 - DNA, 22 bp, Homo sapiens
actgcccacatctctttccgct

SEQ ID NO: 9450947 - DNA, 22 bp, Homo sapiens
actgcccacagtgaatggttgg

SEQ ID NO: 9450948 - DNA, 22 bp, Homo sapiens
agctgctgggatacagtagtga

SEQ ID NO: 9450949 - DNA, 22 bp, Homo sapiens
agctgctgggatacagtagtga

SEQ ID NO: 9450950 - DNA, 22 bp, Homo sapiens
agctgcaggagtcgcctaggat

SEQ ID NO: 9450951 - DNA, 22 bp, Homo sapiens
agctgcaggattatggaatgga

SEQ ID NO: 9450952 - DNA, 22 bp, Homo sapiens
acagcccaagtcacctgcagga

SEQ ID NO: 9450953 - DNA, 23 bp, Homo sapiens
acagccagttcacctctccttgg

SEQ ID NO: 9450954 - DNA, 23 bp, Homo sapiens
acagccagttcacctctccttgg

SEQ ID NO: 9450955 - DNA, 22 bp, Homo sapiens
acagccagtgactggacaagct

SEQ ID NO: 9450956 - DNA, 22 bp, Homo sapiens
acagccagtgactggacaagct

SEQ ID NO: 9450957 - DNA, 22 bp, Homo sapiens
acagccagtgactgcagaccct

SEQ ID NO: 9450958 - DNA, 22 bp, Homo sapiens
acagccagtgactggacaagct

SEQ ID NO: 9450959 - DNA, 22 bp, Homo sapiens
acagccagtgctccgtgaggac

SEQ ID NO: 9450960 - DNA, 22 bp, Homo sapiens
acagccagtgctccgtgaggac

SEQ ID NO: 9450961 - DNA, 22 bp, Homo sapiens
acagccagtgctccgtgaggac

SEQ ID NO: 9450962 - DNA, 22 bp, Homo sapiens
agctgcagccctcctgcatggc

SEQ ID NO: 9450963 - DNA, 22 bp, Homo sapiens
acagccaggtaaaggcatggca

SEQ ID NO: 9450964 - DNA, 22 bp, Homo sapiens
acagccaggtaaaggcatggca

SEQ ID NO: 9450965 - DNA, 22 bp, Homo sapiens
acagccaggtaaaggcatggca

SEQ ID NO: 9450966 - DNA, 22 bp, Homo sapiens
acagccaggtaaaggcatggca

SEQ ID NO: 9450967 - DNA, 22 bp, Homo sapiens
acagccagtaaggaaagaccca

SEQ ID NO: 9450968 - DNA, 22 bp, Homo sapiens
acagccagggtctcaggaggcg

SEQ ID NO: 9450969 - DNA, 22 bp, Homo sapiens
acagccagggtctcaggaggcg

SEQ ID NO: 9450970 - DNA, 22 bp, Homo sapiens
acagccagaggtggtcctgggt

SEQ ID NO: 9450971 - DNA, 22 bp, Homo sapiens
acagccagaggtggtcctgggt

SEQ ID NO: 9450972 - DNA, 22 bp, Homo sapiens
acagccagtcatctcagcaggg

SEQ ID NO: 9450973 - DNA, 22 bp, Homo sapiens
acagccagtcatctcagcaggg

SEQ ID NO: 9450974 - DNA, 22 bp, Homo sapiens
acagccagtcctcccacagggt

SEQ ID NO: 9450975 - DNA, 22 bp, Homo sapiens
acagccagtaaggaaagaccca

SEQ ID NO: 9450976 - DNA, 22 bp, Homo sapiens
acagccagtaatctacccctgt

SEQ ID NO: 9450977 - DNA, 22 bp, Homo sapiens
acagccagtcatctcagcaggg

SEQ ID NO: 9450978 - DNA, 22 bp, Homo sapiens
agctccagttacttacctagag

SEQ ID NO: 9450979 - DNA, 22 bp, Homo sapiens
agctcccaattgacttgaacta

SEQ ID NO: 9450980 - DNA, 20 bp, Homo sapiens
acagccagaggaggcagaca

SEQ ID NO: 9450981 - DNA, 22 bp, Homo sapiens
agctcccagaagccagagtcgg

SEQ ID NO: 9450982 - DNA, 22 bp, Homo sapiens
agctcccagaagccagagtcgg

SEQ ID NO: 9450983 - DNA, 22 bp, Homo sapiens
agctccaggtgcaagtcatggt

SEQ ID NO: 9450984 - DNA, 22 bp, Homo sapiens
agctccaggtgcaagtcatggt

SEQ ID NO: 9450985 - DNA, 22 bp, Homo sapiens
agctgctgtggccacatctggc

SEQ ID NO: 9450986 - DNA, 22 bp, Homo sapiens
agctgctgtggccacatctggc

SEQ ID NO: 9450987 - DNA, 21 bp, Homo sapiens
agctgctgtggccagaatcca

SEQ ID NO: 9450988 - DNA, 21 bp, Homo sapiens
agctgctgtggccagaatcca

SEQ ID NO: 9450989 - DNA, 22 bp, Homo sapiens
agctgctgtggggctcggcctg

SEQ ID NO: 9450990 - DNA, 22 bp, Homo sapiens
agctgctgtggggctcggcctg

SEQ ID NO: 9450991 - DNA, 22 bp, Homo sapiens
agctgctgtttggtgagtcttg

SEQ ID NO: 9450992 - DNA, 22 bp, Homo sapiens
agctgctgtgtgctcaggcagg

SEQ ID NO: 9450993 - DNA, 22 bp, Homo sapiens
agctgctggggagggcagacac

SEQ ID NO: 9450994 - DNA, 23 bp, Homo sapiens
agctgctgggcctgccgtggcct

SEQ ID NO: 9450995 - DNA, 22 bp, Homo sapiens
agctgctggtttaagggatggg

SEQ ID NO: 9450996 - DNA, 22 bp, Homo sapiens
agctgctgtcctaggcactgta

SEQ ID NO: 9450997 - DNA, 22 bp, Homo sapiens
agctgctgtcctaggcactgta

SEQ ID NO: 9450998 - DNA, 22 bp, Homo sapiens
agctgcttgtacatgaccacat

SEQ ID NO: 9450999 - DNA, 22 bp, Homo sapiens
agctgcttgggaaccatcaatt

SEQ ID NO: 9451000 - DNA, 22 bp, Homo sapiens
acagcccagaaagcctaagggg

SEQ ID NO: 9451001 - DNA, 22 bp, Homo sapiens
acagcccagaaagcctaagggg

SEQ ID NO: 9451002 - DNA, 22 bp, Homo sapiens
agctgcttagagtctcttctta

SEQ ID NO: 9451003 - DNA, 22 bp, Homo sapiens
agctgcttagagtctcttctta

SEQ ID NO: 9451004 - DNA, 22 bp, Homo sapiens
acagcccgttctctggcacaca

SEQ ID NO: 9451005 - DNA, 22 bp, Homo sapiens
acagcccgtgtcatcagctgct

SEQ ID NO: 9451006 - DNA, 23 bp, Homo sapiens
acagccccatgcaggtgtgtttg

SEQ ID NO: 9451007 - DNA, 22 bp, Homo sapiens
acagccccccgctcagtttcca

SEQ ID NO: 9451008 - DNA, 22 bp, Homo sapiens
acagcccaggactccagtgggc

SEQ ID NO: 9451009 - DNA, 22 bp, Homo sapiens
acagccccagcgcggcggggtc

SEQ ID NO: 9451010 - DNA, 22 bp, Homo sapiens
acagcccaggactccagtgggc

SEQ ID NO: 9451011 - DNA, 22 bp, Homo sapiens
agctggctatacttgaaaagtc

SEQ ID NO: 9451012 - DNA, 22 bp, Homo sapiens
agctggctatacttgaaaagtc

SEQ ID NO: 9451013 - DNA, 22 bp, Homo sapiens
agctggctatacttgaaaagtc

SEQ ID NO: 9451014 - DNA, 21 bp, Homo sapiens
agctggctatagttagtgatg

SEQ ID NO: 9451015 - DNA, 22 bp, Homo sapiens
agctggccttagtgagcacctg

SEQ ID NO: 9451016 - DNA, 22 bp, Homo sapiens
agctggccttcggtgtcactgg

SEQ ID NO: 9451017 - DNA, 22 bp, Homo sapiens
agctggcctgttagagctgagt

SEQ ID NO: 9451018 - DNA, 22 bp, Homo sapiens
agctggctcagccgggtggtct

SEQ ID NO: 9451019 - DNA, 22 bp, Homo sapiens
agctggctatgccctgtgaacc

SEQ ID NO: 9451020 - DNA, 22 bp, Homo sapiens
agctggctatgccctgtgaacc

SEQ ID NO: 9451021 - DNA, 21 bp, Homo sapiens
agctggctctctctggagaga

SEQ ID NO: 9451022 - DNA, 21 bp, Homo sapiens
agctggctctctctggagaga

SEQ ID NO: 9451023 - DNA, 21 bp, Homo sapiens
agctggctctctctggagaga

SEQ ID NO: 9451024 - DNA, 19 bp, Homo sapiens
agctggcagcttccacttc

SEQ ID NO: 9451025 - DNA, 22 bp, Homo sapiens
agctggcaggggttcacactgc

SEQ ID NO: 9451026 - DNA, 22 bp, Homo sapiens
agctggcagctctcaggggtac

SEQ ID NO: 9451027 - DNA, 22 bp, Homo sapiens
acagcctgcagccccaggtcgc

SEQ ID NO: 9451028 - DNA, 22 bp, Homo sapiens
agctggcagctctcaggggtac

SEQ ID NO: 9451029 - DNA, 20 bp, Homo sapiens
agctggcctgtcctaggcct

SEQ ID NO: 9451030 - DNA, 22 bp, Homo sapiens
agctggcaggggttcacactgc

SEQ ID NO: 9451031 - DNA, 20 bp, Homo sapiens
agctggcctgtcctaggcct

SEQ ID NO: 9451032 - DNA, 22 bp, Homo sapiens
acagcctgatttatggagcagt

SEQ ID NO: 9451033 - DNA, 22 bp, Homo sapiens
acagcctgatttatggagcagt

SEQ ID NO: 9451034 - DNA, 22 bp, Homo sapiens
acagcctgatttatggagcagt

SEQ ID NO: 9451035 - DNA, 22 bp, Homo sapiens
acagcctgcagccccaggtcgc

SEQ ID NO: 9451036 - DNA, 22 bp, Homo sapiens
acagcctgacttttgttgtcac

SEQ ID NO: 9451037 - DNA, 22 bp, Homo sapiens
acagcctgagagtggagctggc

SEQ ID NO: 9451038 - DNA, 22 bp, Homo sapiens
acagcctgagagtggagctggc

SEQ ID NO: 9451039 - DNA, 22 bp, Homo sapiens
acagcctgacttttgttgtcac

SEQ ID NO: 9451040 - DNA, 22 bp, Homo sapiens
acagcctgacttttgttgtcac

SEQ ID NO: 9451041 - DNA, 22 bp, Homo sapiens
acagcctgacttttgttgtcac

SEQ ID NO: 9451042 - DNA, 22 bp, Homo sapiens
acagcctgacttttgttgtcac

SEQ ID NO: 9451043 - DNA, 22 bp, Homo sapiens
acagcctgacttttgttgtcac

SEQ ID NO: 9451044 - DNA, 22 bp, Homo sapiens
agctgtggttagatagagtcct

SEQ ID NO: 9451045 - DNA, 22 bp, Homo sapiens
agctgtggtgttttcaagccct

SEQ ID NO: 9451046 - DNA, 22 bp, Homo sapiens
agctgtggttctgggcagcgac

SEQ ID NO: 9451047 - DNA, 19 bp, Homo sapiens
agctgtggggcctagcacc

SEQ ID NO: 9451048 - DNA, 19 bp, Homo sapiens
agctgtggggcctagcacc

SEQ ID NO: 9451049 - DNA, 22 bp, Homo sapiens
agctgtggggcaggcagcgagg

SEQ ID NO: 9451050 - DNA, 22 bp, Homo sapiens
agctgtggggcaggcagcgagg

SEQ ID NO: 9451051 - DNA, 22 bp, Homo sapiens
agctgtggggaggaggctagca

SEQ ID NO: 9451052 - DNA, 22 bp, Homo sapiens
agctgtgggcctgggagagctg

SEQ ID NO: 9451053 - DNA, 22 bp, Homo sapiens
agctgtgggcctgggagagctg

SEQ ID NO: 9451054 - DNA, 22 bp, Homo sapiens
agcttattaatttttctgcatg

SEQ ID NO: 9451055 - DNA, 22 bp, Homo sapiens
agcttagtggttgtatgagtta

SEQ ID NO: 9451056 - DNA, 22 bp, Homo sapiens
agcttaggaggatgatgaacat

SEQ ID NO: 9451057 - DNA, 22 bp, Homo sapiens
agctgtgtagggaatcagagaa

SEQ ID NO: 9451058 - DNA, 22 bp, Homo sapiens
agcttcaaagctaggaagatct

SEQ ID NO: 9451059 - DNA, 20 bp, Homo sapiens
agcttcagccctaggattgc

SEQ ID NO: 9451060 - DNA, 22 bp, Homo sapiens
agcttcagatttatctttctgt

SEQ ID NO: 9451061 - DNA, 22 bp, Homo sapiens
agcttcaacttactaaaagata

SEQ ID NO: 9451062 - DNA, 22 bp, Homo sapiens
agcttcaaggttcaaggatgct

SEQ ID NO: 9451063 - DNA, 22 bp, Homo sapiens
agcttcagcttgcagctgtgat

SEQ ID NO: 9451064 - DNA, 22 bp, Homo sapiens
agctgtgggagaatctctgggt

SEQ ID NO: 9451065 - DNA, 22 bp, Homo sapiens
agctgtgggatttgggtgtgcc

SEQ ID NO: 9451066 - DNA, 22 bp, Homo sapiens
agctgtgggatttgggtgtgcc

SEQ ID NO: 9451067 - DNA, 22 bp, Homo sapiens
agctgtgggagaatctctgggt

SEQ ID NO: 9451068 - DNA, 22 bp, Homo sapiens
agctgggatgataacctcagtc

SEQ ID NO: 9451069 - DNA, 22 bp, Homo sapiens
agctggttcactaagcataata

SEQ ID NO: 9451070 - DNA, 22 bp, Homo sapiens
agctggttcactaagcataata

SEQ ID NO: 9451071 - DNA, 22 bp, Homo sapiens
agctgggaggtgggcagtgaga

SEQ ID NO: 9451072 - DNA, 22 bp, Homo sapiens
agctgggaggtgggcagtgaga

SEQ ID NO: 9451073 - DNA, 22 bp, Homo sapiens
agctgggaggtgggcagtgaga

SEQ ID NO: 9451074 - DNA, 22 bp, Homo sapiens
agctgggaggctcctctgtgac

SEQ ID NO: 9451075 - DNA, 22 bp, Homo sapiens
agctgggaggtgggcagtgaga

SEQ ID NO: 9451076 - DNA, 22 bp, Homo sapiens
agctgggaggctcctctgtgac

SEQ ID NO: 9451077 - DNA, 19 bp, Homo sapiens
agctggctcttctttgtct

SEQ ID NO: 9451078 - DNA, 22 bp, Homo sapiens
agctgggagcagagccacagcc

SEQ ID NO: 9451079 - DNA, 22 bp, Homo sapiens
agctgggagctgaaggctgatt

SEQ ID NO: 9451080 - DNA, 22 bp, Homo sapiens
agctgggagctgaaggctgatt

SEQ ID NO: 9451081 - DNA, 22 bp, Homo sapiens
agctgggagctgaaggctgatt

SEQ ID NO: 9451082 - DNA, 22 bp, Homo sapiens
agctttgtgactttgagctagt

SEQ ID NO: 9451083 - DNA, 22 bp, Homo sapiens
agctttgtttcacatacacctt

SEQ ID NO: 9451084 - DNA, 22 bp, Homo sapiens
agctttgtttgctcacccgccg

SEQ ID NO: 9451085 - DNA, 20 bp, Homo sapiens
agctttggttaagccagtgg

SEQ ID NO: 9451086 - DNA, 22 bp, Homo sapiens
agctttggttgaggggagtgtg

SEQ ID NO: 9451087 - DNA, 22 bp, Homo sapiens
agctttggttgccatgatctga

SEQ ID NO: 9451088 - DNA, 22 bp, Homo sapiens
agctttggtgctgtcacacaaa

SEQ ID NO: 9451089 - DNA, 20 bp, Homo sapiens
agctttggttaagccagtgg

SEQ ID NO: 9451090 - DNA, 22 bp, Homo sapiens
agcttcatgcctaaagacagcg

SEQ ID NO: 9451091 - DNA, 17 bp, Homo sapiens
agcttcagttgcaaaac

SEQ ID NO: 9451092 - DNA, 22 bp, Homo sapiens
agcttcaggtggtcttgtttct

SEQ ID NO: 9451093 - DNA, 19 bp, Homo sapiens
agcttttactaacagcaga

SEQ ID NO: 9451094 - DNA, 22 bp, Homo sapiens
agcttttagctcctggttgcaa

SEQ ID NO: 9451095 - DNA, 21 bp, Homo sapiens
agcttttctgttttatatcta

SEQ ID NO: 9451096 - DNA, 22 bp, Homo sapiens
aggaaaaaagtctgtgattata

SEQ ID NO: 9451097 - DNA, 22 bp, Homo sapiens
agcttttattggctgtcatttg

SEQ ID NO: 9451098 - DNA, 22 bp, Homo sapiens
aggaaaaagagttgctgccttc

SEQ ID NO: 9451099 - DNA, 22 bp, Homo sapiens
aggaaaaacctgttaatggtag

SEQ ID NO: 9451100 - DNA, 22 bp, Homo sapiens
aggaaaaacctgttaatggtag

SEQ ID NO: 9451101 - DNA, 22 bp, Homo sapiens
aggaaaaacctgttaatggtag

SEQ ID NO: 9451102 - DNA, 22 bp, Homo sapiens
aggaaaaaagtctgtgattata

SEQ ID NO: 9451103 - DNA, 22 bp, Homo sapiens
aggaaaaacctgttaatggtag

SEQ ID NO: 9451104 - DNA, 22 bp, Homo sapiens
aggaaactctgagcggaccagc

SEQ ID NO: 9451105 - DNA, 22 bp, Homo sapiens
aggaaactgaagcccagagagg

SEQ ID NO: 9451106 - DNA, 23 bp, Homo sapiens
aggaaactgaaggggccctctat

SEQ ID NO: 9451107 - DNA, 22 bp, Homo sapiens
aggaaactgaggttacgggact

SEQ ID NO: 9451108 - DNA, 22 bp, Homo sapiens
aggaaactcccctacatctcaa

SEQ ID NO: 9451109 - DNA, 22 bp, Homo sapiens
aggaaactcccctacatctcaa

SEQ ID NO: 9451110 - DNA, 22 bp, Homo sapiens
aggaaactcaaagtgtcaggta

SEQ ID NO: 9451111 - DNA, 22 bp, Homo sapiens
aggaaactaattagtagaataa

SEQ ID NO: 9451112 - DNA, 22 bp, Homo sapiens
aggaaactaaggctcagtgaag

SEQ ID NO: 9451113 - DNA, 22 bp, Homo sapiens
aggaaactaacttatctttata

SEQ ID NO: 9451114 - DNA, 19 bp, Homo sapiens
aggaaactgtcttttccag

SEQ ID NO: 9451115 - DNA, 22 bp, Homo sapiens
aggaaacttcagagttttggtc

SEQ ID NO: 9451116 - DNA, 22 bp, Homo sapiens
aggaaactttcttttgcttcat

SEQ ID NO: 9451117 - DNA, 22 bp, Homo sapiens
aggaaactttcttttgcttcat

SEQ ID NO: 9451118 - DNA, 22 bp, Homo sapiens
aggaaagaaaggaggtgcattt

SEQ ID NO: 9451119 - DNA, 22 bp, Homo sapiens
aggaaactgatgttttttacaa

SEQ ID NO: 9451120 - DNA, 22 bp, Homo sapiens
aggaaactgatgttttttacaa

SEQ ID NO: 9451121 - DNA, 22 bp, Homo sapiens
aggaaactgggcctcaggttag

SEQ ID NO: 9451122 - DNA, 22 bp, Homo sapiens
aggaaactgggtatggttatac

SEQ ID NO: 9451123 - DNA, 22 bp, Homo sapiens
aggaaactgtcccctcatccta

SEQ ID NO: 9451124 - DNA, 19 bp, Homo sapiens
aggaaactgtcttttccag

SEQ ID NO: 9451125 - DNA, 22 bp, Homo sapiens
aggaaagaaaggaggtgcattt

SEQ ID NO: 9451126 - DNA, 22 bp, Homo sapiens
aggaaagaaaggaggtgcattt

SEQ ID NO: 9451127 - DNA, 18 bp, Homo sapiens
aggaaagaaaggcaggtg

SEQ ID NO: 9451128 - DNA, 18 bp, Homo sapiens
aggaaagaaaggcaggtg

SEQ ID NO: 9451129 - DNA, 18 bp, Homo sapiens
aggaaagaaaggcaggtg

SEQ ID NO: 9451130 - DNA, 18 bp, Homo sapiens
aggaaagaaaggcaggtg

SEQ ID NO: 9451131 - DNA, 18 bp, Homo sapiens
aggaaagaaaggcaggtg

SEQ ID NO: 9451132 - DNA, 22 bp, Homo sapiens
aggaagagcattcacatggtag

SEQ ID NO: 9451133 - DNA, 22 bp, Homo sapiens
aggaagagcattcacatggtag

SEQ ID NO: 9451134 - DNA, 22 bp, Homo sapiens
aggaagagcattcacatggtag

SEQ ID NO: 9451135 - DNA, 18 bp, Homo sapiens
aggaagcaggaggaaggc

SEQ ID NO: 9451136 - DNA, 22 bp, Homo sapiens
aggaagccaagcctgacactca

SEQ ID NO: 9451137 - DNA, 22 bp, Homo sapiens
aggaagccatggtggacgtcta

SEQ ID NO: 9451138 - DNA, 22 bp, Homo sapiens
aggagctgcagattctgccttg

SEQ ID NO: 9451139 - DNA, 22 bp, Homo sapiens
aggagctgcagattctgccttg

SEQ ID NO: 9451140 - DNA, 22 bp, Homo sapiens
aggagctgcatggatacctggt

SEQ ID NO: 9451141 - DNA, 22 bp, Homo sapiens
aggagctgcactgggagttttt

SEQ ID NO: 9451142 - DNA, 22 bp, Homo sapiens
aggagctgcactgggagttttt

SEQ ID NO: 9451143 - DNA, 22 bp, Homo sapiens
aggagctgcagattctgccttg

SEQ ID NO: 9451144 - DNA, 22 bp, Homo sapiens
aggagctgcaaatattagtaat

SEQ ID NO: 9451145 - DNA, 22 bp, Homo sapiens
aggagctggaatggtccttttg

SEQ ID NO: 9451146 - DNA, 22 bp, Homo sapiens
aggagctgctttggtgcggttt

SEQ ID NO: 9451147 - DNA, 22 bp, Homo sapiens
aggagctggaatggtccttttg

SEQ ID NO: 9451148 - DNA, 22 bp, Homo sapiens
aggagctgcatggatacctggt

SEQ ID NO: 9451149 - DNA, 22 bp, Homo sapiens
aggagctgcttaaatggttggt

SEQ ID NO: 9451150 - DNA, 22 bp, Homo sapiens
aggagctgctttggtgcggttt

SEQ ID NO: 9451151 - DNA, 22 bp, Homo sapiens
aggagctgcttaaatggttggt

SEQ ID NO: 9451152 - DNA, 22 bp, Homo sapiens
aggagcccctcttcagtcctgg

SEQ ID NO: 9451153 - DNA, 22 bp, Homo sapiens
aggagcccctcttcagtcctgg

SEQ ID NO: 9451154 - DNA, 22 bp, Homo sapiens
aggagctgcaaaaccggccgct

SEQ ID NO: 9451155 - DNA, 22 bp, Homo sapiens
aggagctgcaaaaccggccgct

SEQ ID NO: 9451156 - DNA, 22 bp, Homo sapiens
aggagctgatgattctttgatc

SEQ ID NO: 9451157 - DNA, 22 bp, Homo sapiens
aggagcctgagtcacagtgcct

SEQ ID NO: 9451158 - DNA, 22 bp, Homo sapiens
aggagcctgagtcacagtgcct

SEQ ID NO: 9451159 - DNA, 22 bp, Homo sapiens
aggagcctccttctcatgtgca

SEQ ID NO: 9451160 - DNA, 22 bp, Homo sapiens
aggagcctgaatcagagggtga

SEQ ID NO: 9451161 - DNA, 22 bp, Homo sapiens
aggagcctccatggtcacattc

SEQ ID NO: 9451162 - DNA, 22 bp, Homo sapiens
aggagcctccttctcatgtgca

SEQ ID NO: 9451163 - DNA, 22 bp, Homo sapiens
aggagccatggaggtgaggcgg

SEQ ID NO: 9451164 - DNA, 22 bp, Homo sapiens
aggagccatggaggtgaggcgg

SEQ ID NO: 9451165 - DNA, 22 bp, Homo sapiens
aggagccatgagtgacatcaca

SEQ ID NO: 9451166 - DNA, 23 bp, Homo sapiens
aggagccatgagttggatatgtt

SEQ ID NO: 9451167 - DNA, 23 bp, Homo sapiens
aggagccatgagttggatatgtt

SEQ ID NO: 9451168 - DNA, 22 bp, Homo sapiens
aggagcagaccgtagtcctgca

SEQ ID NO: 9451169 - DNA, 22 bp, Homo sapiens
aggagcagaccgtagtcctgca

SEQ ID NO: 9451170 - DNA, 22 bp, Homo sapiens
aggagcagaccgtagtcctgca

SEQ ID NO: 9451171 - DNA, 22 bp, Homo sapiens
aggagccatgagtgacatcaca

SEQ ID NO: 9451172 - DNA, 22 bp, Homo sapiens
aggagccatgagtgacatcaca

SEQ ID NO: 9451173 - DNA, 20 bp, Homo sapiens
aggagccattgactgcagca

SEQ ID NO: 9451174 - DNA, 22 bp, Homo sapiens
aggagccattttccaagggcga

SEQ ID NO: 9451175 - DNA, 22 bp, Homo sapiens
aggagccattgcaggatggcag

SEQ ID NO: 9451176 - DNA, 22 bp, Homo sapiens
aggagccattgcaggatggcag

SEQ ID NO: 9451177 - DNA, 22 bp, Homo sapiens
acagggggtcccatggcctgga

SEQ ID NO: 9451178 - DNA, 22 bp, Homo sapiens
acagggggtcccatggcctgga

SEQ ID NO: 9451179 - DNA, 22 bp, Homo sapiens
acaggggctccgaaggtgaggg

SEQ ID NO: 9451180 - DNA, 22 bp, Homo sapiens
acagggtgaatgtgacattatc

SEQ ID NO: 9451181 - DNA, 22 bp, Homo sapiens
acagggtgactttgtgacagat

SEQ ID NO: 9451182 - DNA, 22 bp, Homo sapiens
acagggtgactttgtgacagat

SEQ ID NO: 9451183 - DNA, 22 bp, Homo sapiens
acagggtgactttgtgacagat

SEQ ID NO: 9451184 - DNA, 22 bp, Homo sapiens
acagggtggggatggtgagctt

SEQ ID NO: 9451185 - DNA, 22 bp, Homo sapiens
acagggtggggatggtgagctt

SEQ ID NO: 9451186 - DNA, 22 bp, Homo sapiens
aggaaggcacattgttggctaa

SEQ ID NO: 9451187 - DNA, 22 bp, Homo sapiens
aggaaggcacattgttggctaa

SEQ ID NO: 9451188 - DNA, 22 bp, Homo sapiens
aggaaggcatgaggtgttcaca

SEQ ID NO: 9451189 - DNA, 23 bp, Homo sapiens
aggaaggaggtcctaacagtatc

SEQ ID NO: 9451190 - DNA, 23 bp, Homo sapiens
aggaaggaggtcctaacagtatc

SEQ ID NO: 9451191 - DNA, 22 bp, Homo sapiens
aggaaggagggcagatattaag

SEQ ID NO: 9451192 - DNA, 22 bp, Homo sapiens
aggaaggagggcagatattaag

SEQ ID NO: 9451193 - DNA, 20 bp, Homo sapiens
aggaaggagaatctgagcaa

SEQ ID NO: 9451194 - DNA, 23 bp, Homo sapiens
aggaaggaggtcctaacagtatc

SEQ ID NO: 9451195 - DNA, 23 bp, Homo sapiens
aggaaggaggtcctaacagtatc

SEQ ID NO: 9451196 - DNA, 22 bp, Homo sapiens
aggaaggctgatcactgcttgt

SEQ ID NO: 9451197 - DNA, 22 bp, Homo sapiens
aggaaggctgatcactgcttgt

SEQ ID NO: 9451198 - DNA, 22 bp, Homo sapiens
aggaaggcttctttggtcttct

SEQ ID NO: 9451199 - DNA, 22 bp, Homo sapiens
aggaagcctggggctgccctcg

SEQ ID NO: 9451200 - DNA, 22 bp, Homo sapiens
aggaagcctggcattaaaaagc

SEQ ID NO: 9451201 - DNA, 22 bp, Homo sapiens
aggaagcccaagtctcatcttc

SEQ ID NO: 9451202 - DNA, 23 bp, Homo sapiens
aggaagctaccaattttgtaggc

SEQ ID NO: 9451203 - DNA, 22 bp, Homo sapiens
aggaagctagagccaccggact

SEQ ID NO: 9451204 - DNA, 23 bp, Homo sapiens
aggaagctaagtgtggctgcgga

SEQ ID NO: 9451205 - DNA, 23 bp, Homo sapiens
aggaagctaagtgtggctgcgga

SEQ ID NO: 9451206 - DNA, 22 bp, Homo sapiens
aggaagctaaccagggagtgag

SEQ ID NO: 9451207 - DNA, 22 bp, Homo sapiens
aggaagctaaccagggagtgag

SEQ ID NO: 9451208 - DNA, 22 bp, Homo sapiens
aggagacatctaactgtaggtt

SEQ ID NO: 9451209 - DNA, 22 bp, Homo sapiens
aggagacatctaactgtaggtt

SEQ ID NO: 9451210 - DNA, 22 bp, Homo sapiens
aggagacatctaactgtaggtt

SEQ ID NO: 9451211 - DNA, 22 bp, Homo sapiens
aggagacatggaatagtgaggc

SEQ ID NO: 9451212 - DNA, 21 bp, Homo sapiens
aggagaccggcttgtttgtgc

SEQ ID NO: 9451213 - DNA, 22 bp, Homo sapiens
aggagaccttttgagtgtgaga

SEQ ID NO: 9451214 - DNA, 22 bp, Homo sapiens
acaggggctccgaaggtgaggg

SEQ ID NO: 9451215 - DNA, 22 bp, Homo sapiens
acaggggctccgaaggtgaggg

SEQ ID NO: 9451216 - DNA, 17 bp, Homo sapiens
aggaagggcaagtttct

SEQ ID NO: 9451217 - DNA, 17 bp, Homo sapiens
aggaagggcaagtttct

SEQ ID NO: 9451218 - DNA, 17 bp, Homo sapiens
aggaagggcaagtttct

SEQ ID NO: 9451219 - DNA, 23 bp, Homo sapiens
aggagacagggaagtgcctggct

SEQ ID NO: 9451220 - DNA, 22 bp, Homo sapiens
aggagacagccaggggcctgag

SEQ ID NO: 9451221 - DNA, 22 bp, Homo sapiens
aggagacagccaggggcctgag

SEQ ID NO: 9451222 - DNA, 22 bp, Homo sapiens
aggagacagccaggggcctgag

SEQ ID NO: 9451223 - DNA, 23 bp, Homo sapiens
aggagacagggaagtgcctggct

SEQ ID NO: 9451224 - DNA, 22 bp, Homo sapiens
aggagacagtttggacgtgtag

SEQ ID NO: 9451225 - DNA, 22 bp, Homo sapiens
aggagacataactatgatgaga

SEQ ID NO: 9451226 - DNA, 18 bp, Homo sapiens
aggcacagagcatacata

SEQ ID NO: 9451227 - DNA, 22 bp, Homo sapiens
aggcacagatttggggaaagca

SEQ ID NO: 9451228 - DNA, 18 bp, Homo sapiens
aggcacagagcatacata

SEQ ID NO: 9451229 - DNA, 22 bp, Homo sapiens
aggcacagatttggggaaagca

SEQ ID NO: 9451230 - DNA, 22 bp, Homo sapiens
aggcacagatttggggaaagca

SEQ ID NO: 9451231 - DNA, 22 bp, Homo sapiens
aggcacagatttggggaaagca

SEQ ID NO: 9451232 - DNA, 22 bp, Homo sapiens
aggcacagaatggcattcagtg

SEQ ID NO: 9451233 - DNA, 22 bp, Homo sapiens
aggcacagaatggcattcagtg

SEQ ID NO: 9451234 - DNA, 22 bp, Homo sapiens
aggcacagaatggcattcagtg

SEQ ID NO: 9451235 - DNA, 22 bp, Homo sapiens
aggcacagagaatgccctccat

SEQ ID NO: 9451236 - DNA, 22 bp, Homo sapiens
aggcacagagaatgccctccat

SEQ ID NO: 9451237 - DNA, 22 bp, Homo sapiens
aggcacagaatggcattcagtg

SEQ ID NO: 9451238 - DNA, 22 bp, Homo sapiens
aggcacagaatggcattcagtg

SEQ ID NO: 9451239 - DNA, 19 bp, Homo sapiens
aggcacaattctgagaagc

SEQ ID NO: 9451240 - DNA, 22 bp, Homo sapiens
aggcaacatgggccaggcagaa

SEQ ID NO: 9451241 - DNA, 22 bp, Homo sapiens
aggcacaaagacagaaaagcac

SEQ ID NO: 9451242 - DNA, 22 bp, Homo sapiens
aggcaacatgggccaggcagaa

SEQ ID NO: 9451243 - DNA, 22 bp, Homo sapiens
aggcaacataacacgaaagtct

SEQ ID NO: 9451244 - DNA, 22 bp, Homo sapiens
aggcaacaggaaaccacatgat

SEQ ID NO: 9451245 - DNA, 22 bp, Homo sapiens
aggcaacaagggtagtcagtga

SEQ ID NO: 9451246 - DNA, 17 bp, Homo sapiens
acatacactggtgaaca

SEQ ID NO: 9451247 - DNA, 22 bp, Homo sapiens
acatacacgggaaacctctttt

SEQ ID NO: 9451248 - DNA, 23 bp, Homo sapiens
acatacataagcaccacattttg

SEQ ID NO: 9451249 - DNA, 22 bp, Homo sapiens
acatacacaagcgtacatgaac

SEQ ID NO: 9451250 - DNA, 22 bp, Homo sapiens
acatacacatgaatatattttt

SEQ ID NO: 9451251 - DNA, 22 bp, Homo sapiens
acatacacaagcgtacatgaac

SEQ ID NO: 9451252 - DNA, 22 bp, Homo sapiens
acatacacacatactttctcct

SEQ ID NO: 9451253 - DNA, 22 bp, Homo sapiens
acatacacaagcgtacatgaac

SEQ ID NO: 9451254 - DNA, 22 bp, Homo sapiens
acatacatcaagtatcacaaga

SEQ ID NO: 9451255 - DNA, 22 bp, Homo sapiens
acatacatcaagtatcacaaga

SEQ ID NO: 9451256 - DNA, 22 bp, Homo sapiens
acatacatcaagtatcacaaga

SEQ ID NO: 9451257 - DNA, 22 bp, Homo sapiens
acatacatcaagtatcacaaga

SEQ ID NO: 9451258 - DNA, 22 bp, Homo sapiens
acatacatcaagtatcacaaga

SEQ ID NO: 9451259 - DNA, 23 bp, Homo sapiens
acatacatggagataaagtgatg

SEQ ID NO: 9451260 - DNA, 23 bp, Homo sapiens
acatacatggagataaagtgatg

SEQ ID NO: 9451261 - DNA, 22 bp, Homo sapiens
acatacatatgtttaaatgcat

SEQ ID NO: 9451262 - DNA, 22 bp, Homo sapiens
acatacatatgtttaaatgcat

SEQ ID NO: 9451263 - DNA, 21 bp, Homo sapiens
acatacataccttaccacctt

SEQ ID NO: 9451264 - DNA, 22 bp, Homo sapiens
acatacatatgacaactttcct

SEQ ID NO: 9451265 - DNA, 22 bp, Homo sapiens
acatacatatgacaactttcct

SEQ ID NO: 9451266 - DNA, 22 bp, Homo sapiens
aggatggcgattcgagcacctc

SEQ ID NO: 9451267 - DNA, 22 bp, Homo sapiens
aggcaaaagaatgtcataaatg

SEQ ID NO: 9451268 - DNA, 22 bp, Homo sapiens
aggcaaaagaatgtcataaatg

SEQ ID NO: 9451269 - DNA, 22 bp, Homo sapiens
aggcaaagaagttggtcaggag

SEQ ID NO: 9451270 - DNA, 22 bp, Homo sapiens
aggcaaagaagttggtcaggag

SEQ ID NO: 9451271 - DNA, 22 bp, Homo sapiens
aggcaaagaagttggtcaggag

SEQ ID NO: 9451272 - DNA, 22 bp, Homo sapiens
aggcaaaagaatgtcataaatg

SEQ ID NO: 9451273 - DNA, 22 bp, Homo sapiens
aggcaaaattacaaagttatta

SEQ ID NO: 9451274 - DNA, 22 bp, Homo sapiens
aggcaaagcgataccagagcta

SEQ ID NO: 9451275 - DNA, 22 bp, Homo sapiens
aggcaaagaggatattttgggg

SEQ ID NO: 9451276 - DNA, 22 bp, Homo sapiens
aggcaaagcgataccagagcta

SEQ ID NO: 9451277 - DNA, 22 bp, Homo sapiens
aggcaaagaagttggtcaggag

SEQ ID NO: 9451278 - DNA, 22 bp, Homo sapiens
aggcaaagagccagcaaatctg

SEQ ID NO: 9451279 - DNA, 22 bp, Homo sapiens
aggcaaatctgagacatttaaa

SEQ ID NO: 9451280 - DNA, 22 bp, Homo sapiens
aggcaaatagatagtccataca

SEQ ID NO: 9451281 - DNA, 22 bp, Homo sapiens
aggcaaatctgagacatttaaa

SEQ ID NO: 9451282 - DNA, 22 bp, Homo sapiens
aggcaaattattgtatgcagtt

SEQ ID NO: 9451283 - DNA, 22 bp, Homo sapiens
aggcaaattattgtatgcagtt

SEQ ID NO: 9451284 - DNA, 22 bp, Homo sapiens
aggcaaattattgtatgcagtt

SEQ ID NO: 9451285 - DNA, 22 bp, Homo sapiens
aggaggggttctcgggtgctga

SEQ ID NO: 9451286 - DNA, 22 bp, Homo sapiens
aggaggggttctcgggtgctga

SEQ ID NO: 9451287 - DNA, 22 bp, Homo sapiens
aggaggggttctcgggtgctga

SEQ ID NO: 9451288 - DNA, 22 bp, Homo sapiens
aggaggggttctcgggtgctga

SEQ ID NO: 9451289 - DNA, 22 bp, Homo sapiens
aggagggtacaatgggtggaaa

SEQ ID NO: 9451290 - DNA, 22 bp, Homo sapiens
aggaggggttctcgggtgctga

SEQ ID NO: 9451291 - DNA, 22 bp, Homo sapiens
aggaggggttctcgggtgctga

SEQ ID NO: 9451292 - DNA, 21 bp, Homo sapiens
aggaggggtctttcccactga

SEQ ID NO: 9451293 - DNA, 21 bp, Homo sapiens
aggaggggtctttcccactga

SEQ ID NO: 9451294 - DNA, 21 bp, Homo sapiens
aggaggggtctttcccactga

SEQ ID NO: 9451295 - DNA, 22 bp, Homo sapiens
aggaggcttttgcaggtgccac

SEQ ID NO: 9451296 - DNA, 22 bp, Homo sapiens
aggaggcttttgcaggtgccac

SEQ ID NO: 9451297 - DNA, 22 bp, Homo sapiens
aggaggctgtggagcactccat

SEQ ID NO: 9451298 - DNA, 22 bp, Homo sapiens
aggaggccgctgatgggctccc

SEQ ID NO: 9451299 - DNA, 21 bp, Homo sapiens
aggagctggagaaaactttcc

SEQ ID NO: 9451300 - DNA, 22 bp, Homo sapiens
aggaggccgatttcagaggtcg

SEQ ID NO: 9451301 - DNA, 22 bp, Homo sapiens
aggaggctgtggagcactccat

SEQ ID NO: 9451302 - DNA, 22 bp, Homo sapiens
aggaggctgtggagcactccat

SEQ ID NO: 9451303 - DNA, 22 bp, Homo sapiens
aggagggacaccaatatatgtt

SEQ ID NO: 9451304 - DNA, 22 bp, Homo sapiens
aggagggacaccaatatatgtt

SEQ ID NO: 9451305 - DNA, 22 bp, Homo sapiens
aggagggaataagaaagagtca

SEQ ID NO: 9451306 - DNA, 22 bp, Homo sapiens
aggagggaataagaaagagtca

SEQ ID NO: 9451307 - DNA, 17 bp, Homo sapiens
aggagggaaatagcttg

SEQ ID NO: 9451308 - DNA, 17 bp, Homo sapiens
aggagggaaatagcttg

SEQ ID NO: 9451309 - DNA, 17 bp, Homo sapiens
aggagggaaatagcttg

SEQ ID NO: 9451310 - DNA, 22 bp, Homo sapiens
aggagggagatgcccatcctgg

SEQ ID NO: 9451311 - DNA, 22 bp, Homo sapiens
aggagggagatgcccatcctgg

SEQ ID NO: 9451312 - DNA, 22 bp, Homo sapiens
aggagggacctaggaatattgc

SEQ ID NO: 9451313 - DNA, 20 bp, Homo sapiens
aggagggacctggattggcg

SEQ ID NO: 9451314 - DNA, 20 bp, Homo sapiens
aggagggacctggattggcg

SEQ ID NO: 9451315 - DNA, 22 bp, Homo sapiens
aggagggagatgcccatcctgg

SEQ ID NO: 9451316 - DNA, 22 bp, Homo sapiens
aggaggggcatagaaatgtaat

SEQ ID NO: 9451317 - DNA, 22 bp, Homo sapiens
aggaggggcatagaaatgtaat

SEQ ID NO: 9451318 - DNA, 22 bp, Homo sapiens
aggaggggcatagaaatgtaat

SEQ ID NO: 9451319 - DNA, 22 bp, Homo sapiens
aggaggggcatagaaatgtaat

SEQ ID NO: 9451320 - DNA, 22 bp, Homo sapiens
acattcctgaatgggcacattt

SEQ ID NO: 9451321 - DNA, 22 bp, Homo sapiens
acattcctcagtgccagttgag

SEQ ID NO: 9451322 - DNA, 22 bp, Homo sapiens
acattcctcagtgccagttgag

SEQ ID NO: 9451323 - DNA, 22 bp, Homo sapiens
acattcctacctgctcgggtgt

SEQ ID NO: 9451324 - DNA, 22 bp, Homo sapiens
acattcctgccataaatttttt

SEQ ID NO: 9451325 - DNA, 22 bp, Homo sapiens
acattcctgcctccccggagat

SEQ ID NO: 9451326 - DNA, 22 bp, Homo sapiens
acattcctgaggaaatacattc

SEQ ID NO: 9451327 - DNA, 22 bp, Homo sapiens
acattcctgaggaaatacattc

SEQ ID NO: 9451328 - DNA, 22 bp, Homo sapiens
acattcctttcttgagcacagt

SEQ ID NO: 9451329 - DNA, 22 bp, Homo sapiens
acattcctttcttgagcacagt

SEQ ID NO: 9451330 - DNA, 22 bp, Homo sapiens
acattctaaagcatgctcagga

SEQ ID NO: 9451331 - DNA, 22 bp, Homo sapiens
acattctaaagcatgctcagga

SEQ ID NO: 9451332 - DNA, 22 bp, Homo sapiens
acattctaacattgtacagata

SEQ ID NO: 9451333 - DNA, 22 bp, Homo sapiens
acattctaacattgtacagata

SEQ ID NO: 9451334 - DNA, 22 bp, Homo sapiens
acattctaaagcatgctcagga

SEQ ID NO: 9451335 - DNA, 22 bp, Homo sapiens
acattctaacattgtacagata

SEQ ID NO: 9451336 - DNA, 22 bp, Homo sapiens
acattctaacattgtacagata

SEQ ID NO: 9451337 - DNA, 22 bp, Homo sapiens
acattctacagttaaccattag

SEQ ID NO: 9451338 - DNA, 22 bp, Homo sapiens
acattctacagttaaccattag

SEQ ID NO: 9451339 - DNA, 22 bp, Homo sapiens
acattctacagttaaccattag

SEQ ID NO: 9451340 - DNA, 22 bp, Homo sapiens
acattctagatatgttatattt

SEQ ID NO: 9451341 - DNA, 22 bp, Homo sapiens
acattctatagcaagctgatct

SEQ ID NO: 9451342 - DNA, 22 bp, Homo sapiens
acattctatagcaagctgatct

SEQ ID NO: 9451343 - DNA, 22 bp, Homo sapiens
acattctagatatgttatattt

SEQ ID NO: 9451344 - DNA, 22 bp, Homo sapiens
acattctatgaagataatttta

SEQ ID NO: 9451345 - DNA, 22 bp, Homo sapiens
acattctatgaagataatttta

SEQ ID NO: 9451346 - DNA, 22 bp, Homo sapiens
acattctatggttgatgagttg

SEQ ID NO: 9451347 - DNA, 22 bp, Homo sapiens
acattctatgaagataatttta

SEQ ID NO: 9451348 - DNA, 22 bp, Homo sapiens
acattctagatatgttatattt

SEQ ID NO: 9451349 - DNA, 22 bp, Homo sapiens
acattctagatatgttatattt

SEQ ID NO: 9451350 - DNA, 22 bp, Homo sapiens
acattctagatatgttatattt

SEQ ID NO: 9451351 - DNA, 22 bp, Homo sapiens
acattctagaagtctttgcaat

SEQ ID NO: 9451352 - DNA, 22 bp, Homo sapiens
acattctagaagtctttgcaat

SEQ ID NO: 9451353 - DNA, 22 bp, Homo sapiens
acattctagaagagcttcactt

SEQ ID NO: 9451354 - DNA, 22 bp, Homo sapiens
acattctagaagtctttgcaat

SEQ ID NO: 9451355 - DNA, 22 bp, Homo sapiens
acattctagaagagcttcactt

SEQ ID NO: 9451356 - DNA, 22 bp, Homo sapiens
acattctttgagttttgttaaa

SEQ ID NO: 9451357 - DNA, 22 bp, Homo sapiens
acattctttgagttttgttaaa

SEQ ID NO: 9451358 - DNA, 22 bp, Homo sapiens
acattctatggttgatgagttg

SEQ ID NO: 9451359 - DNA, 22 bp, Homo sapiens
acattctttcaccttgtgtcca

SEQ ID NO: 9451360 - DNA, 22 bp, Homo sapiens
acattctttcgatgtctgattt

SEQ ID NO: 9451361 - DNA, 22 bp, Homo sapiens
acattcatgtcccacttctagc

SEQ ID NO: 9451362 - DNA, 22 bp, Homo sapiens
acattcatgtcccacttctagc

SEQ ID NO: 9451363 - DNA, 22 bp, Homo sapiens
acattcattccaggtcagtcag

SEQ ID NO: 9451364 - DNA, 22 bp, Homo sapiens
acattcattgagcaacaacaat

SEQ ID NO: 9451365 - DNA, 22 bp, Homo sapiens
acattcattccaggtcagtcag

SEQ ID NO: 9451366 - DNA, 22 bp, Homo sapiens
acattcactatgtccaaactct

SEQ ID NO: 9451367 - DNA, 22 bp, Homo sapiens
acattcacgctctcaaagctga

SEQ ID NO: 9451368 - DNA, 22 bp, Homo sapiens
acattcactatgtccaaactct

SEQ ID NO: 9451369 - DNA, 22 bp, Homo sapiens
acattcaggccacagtggagtc

SEQ ID NO: 9451370 - DNA, 21 bp, Homo sapiens
acattcacaggatattatcat

SEQ ID NO: 9451371 - DNA, 21 bp, Homo sapiens
acattcacaggatattatcat

SEQ ID NO: 9451372 - DNA, 22 bp, Homo sapiens
acattcacgctctcaaagctga

SEQ ID NO: 9451373 - DNA, 22 bp, Homo sapiens
acattcacgctctcaaagctga

SEQ ID NO: 9451374 - DNA, 22 bp, Homo sapiens
acattcacaagcctacaaggtt

SEQ ID NO: 9451375 - DNA, 22 bp, Homo sapiens
acattcacaagcctacaaggtt

SEQ ID NO: 9451376 - DNA, 22 bp, Homo sapiens
acattcaaggccttctgacaca

SEQ ID NO: 9451377 - DNA, 22 bp, Homo sapiens
acattcaaggcagcactgagtg

SEQ ID NO: 9451378 - DNA, 22 bp, Homo sapiens
acattcaaggccttctgacaca

SEQ ID NO: 9451379 - DNA, 22 bp, Homo sapiens
acattcaaggcagcactgagtg

SEQ ID NO: 9451380 - DNA, 22 bp, Homo sapiens
acattcaagatgcattcactta

SEQ ID NO: 9451381 - DNA, 22 bp, Homo sapiens
acattcaaggccttctgacaca

SEQ ID NO: 9451382 - DNA, 22 bp, Homo sapiens
aggccctgcattgtactgaggg

SEQ ID NO: 9451383 - DNA, 22 bp, Homo sapiens
aggccctgcattgtactgaggg

SEQ ID NO: 9451384 - DNA, 22 bp, Homo sapiens
aggccctgcattgtactgaggg

SEQ ID NO: 9451385 - DNA, 22 bp, Homo sapiens
aggccctgcaggagtggggaca

SEQ ID NO: 9451386 - DNA, 22 bp, Homo sapiens
aggccctgcaggagtggggaca

SEQ ID NO: 9451387 - DNA, 22 bp, Homo sapiens
aggccctgcaggagtggggaca

SEQ ID NO: 9451388 - DNA, 22 bp, Homo sapiens
aggccctgcaggaagcaggatg

SEQ ID NO: 9451389 - DNA, 22 bp, Homo sapiens
aggccctgcaggaagcaggatg

SEQ ID NO: 9451390 - DNA, 22 bp, Homo sapiens
aggccctgcaggaagcaggatg

SEQ ID NO: 9451391 - DNA, 20 bp, Homo sapiens
aggccctgccagggacggag

SEQ ID NO: 9451392 - DNA, 23 bp, Homo sapiens
acattacacgcagtaattgcccc

SEQ ID NO: 9451393 - DNA, 22 bp, Homo sapiens
acattcaagatgcattcactta

SEQ ID NO: 9451394 - DNA, 22 bp, Homo sapiens
aggcttcagggcttttgagggt

SEQ ID NO: 9451395 - DNA, 22 bp, Homo sapiens
aggcttcagtagggagcatgtc

SEQ ID NO: 9451396 - DNA, 22 bp, Homo sapiens
aggcttcagttgtaccttcttg

SEQ ID NO: 9451397 - DNA, 18 bp, Homo sapiens
aggcttcccaggcaggcc

SEQ ID NO: 9451398 - DNA, 22 bp, Homo sapiens
aggcttcccttcctctgggggt

SEQ ID NO: 9451399 - DNA, 18 bp, Homo sapiens
aggcttcccaggcaggcc

SEQ ID NO: 9451400 - DNA, 22 bp, Homo sapiens
aggcttcccagctgagctcagc

SEQ ID NO: 9451401 - DNA, 22 bp, Homo sapiens
aggcttcattgtggcatcagga

SEQ ID NO: 9451402 - DNA, 22 bp, Homo sapiens
aggcttcattgtggcatcagga

SEQ ID NO: 9451403 - DNA, 22 bp, Homo sapiens
aggctgtgattccaccactctc

SEQ ID NO: 9451404 - DNA, 22 bp, Homo sapiens
aggctgtgcaattagggtaaga

SEQ ID NO: 9451405 - DNA, 22 bp, Homo sapiens
aggctccaggcctccctgcatg

SEQ ID NO: 9451406 - DNA, 22 bp, Homo sapiens
aggctccaggcctccctgcatg

SEQ ID NO: 9451407 - DNA, 22 bp, Homo sapiens
aggctccagggctgtgtgggag

SEQ ID NO: 9451408 - DNA, 22 bp, Homo sapiens
aggctccaggcaaaatttcgga

SEQ ID NO: 9451409 - DNA, 22 bp, Homo sapiens
aggctgtgcaattagggtaaga

SEQ ID NO: 9451410 - DNA, 22 bp, Homo sapiens
aggcttcagcagccctctcttg

SEQ ID NO: 9451411 - DNA, 22 bp, Homo sapiens
aggcttcagcctagagctggag

SEQ ID NO: 9451412 - DNA, 22 bp, Homo sapiens
aggcttcaggaagtctcctggg

SEQ ID NO: 9451413 - DNA, 22 bp, Homo sapiens
acattgaacagtacaaatgatc

SEQ ID NO: 9451414 - DNA, 22 bp, Homo sapiens
acattgaagctgtgaaatcaaa

SEQ ID NO: 9451415 - DNA, 22 bp, Homo sapiens
acattgaagctgtgaaatcaaa

SEQ ID NO: 9451416 - DNA, 22 bp, Homo sapiens
aggctccagcagccagaggaag

SEQ ID NO: 9451417 - DNA, 22 bp, Homo sapiens
aggctccagcccaaggctgcag

SEQ ID NO: 9451418 - DNA, 22 bp, Homo sapiens
aggctccagcagccagaggaag

SEQ ID NO: 9451419 - DNA, 22 bp, Homo sapiens
aggctccagcagccagaggaag

SEQ ID NO: 9451420 - DNA, 22 bp, Homo sapiens
aggctccagcagccagaggaag

SEQ ID NO: 9451421 - DNA, 23 bp, Homo sapiens
aggctccactccctgggatgtgg

SEQ ID NO: 9451422 - DNA, 22 bp, Homo sapiens
acattgacttggatgggtagca

SEQ ID NO: 9451423 - DNA, 19 bp, Homo sapiens
acattgaattttcttcttt

SEQ ID NO: 9451424 - DNA, 22 bp, Homo sapiens
acattgatatttcaaatacagg

SEQ ID NO: 9451425 - DNA, 22 bp, Homo sapiens
aggctccacggtcactggctct

SEQ ID NO: 9451426 - DNA, 23 bp, Homo sapiens
aggctccactccctgggatgtgg

SEQ ID NO: 9451427 - DNA, 23 bp, Homo sapiens
aggctccactccctgggatgtgg

SEQ ID NO: 9451428 - DNA, 22 bp, Homo sapiens
acatacatggttctcagccctt

SEQ ID NO: 9451429 - DNA, 22 bp, Homo sapiens
acatacatggtgctttcttggt

SEQ ID NO: 9451430 - DNA, 22 bp, Homo sapiens
acatacatggtgctttcttggt

SEQ ID NO: 9451431 - DNA, 22 bp, Homo sapiens
acatacatgtaaaggaaattat

SEQ ID NO: 9451432 - DNA, 22 bp, Homo sapiens
acatacatgtaaaggaaattat

SEQ ID NO: 9451433 - DNA, 22 bp, Homo sapiens
aggcagtgttcttctaagggca

SEQ ID NO: 9451434 - DNA, 20 bp, Homo sapiens
aggcagttagaaggagatga

SEQ ID NO: 9451435 - DNA, 22 bp, Homo sapiens
acatacatggattcatggattc

SEQ ID NO: 9451436 - DNA, 23 bp, Homo sapiens
acatacatggagataaagtgatg

SEQ ID NO: 9451437 - DNA, 22 bp, Homo sapiens
acatacatgggattaaaaaatt

SEQ ID NO: 9451438 - DNA, 22 bp, Homo sapiens
acatacatgggattaaaaaatt

SEQ ID NO: 9451439 - DNA, 22 bp, Homo sapiens
acatacatgggattaaaaaatt

SEQ ID NO: 9451440 - DNA, 22 bp, Homo sapiens
acatacatgggattaaaaaatt

SEQ ID NO: 9451441 - DNA, 22 bp, Homo sapiens
acatacatgggattaaaaaatt

SEQ ID NO: 9451442 - DNA, 22 bp, Homo sapiens
aggcatggcattcctcaagcaa

SEQ ID NO: 9451443 - DNA, 19 bp, Homo sapiens
aggcatgggaagagaagtc

SEQ ID NO: 9451444 - DNA, 22 bp, Homo sapiens
aggcatggctttaggcaggcgt

SEQ ID NO: 9451445 - DNA, 20 bp, Homo sapiens
aggcatgggatgcccagatt

SEQ ID NO: 9451446 - DNA, 19 bp, Homo sapiens
aggcatgggaagagaagtc

SEQ ID NO: 9451447 - DNA, 20 bp, Homo sapiens
aggcatgggatgcccagatt

SEQ ID NO: 9451448 - DNA, 20 bp, Homo sapiens
aggcatgggatgcccagatt

SEQ ID NO: 9451449 - DNA, 20 bp, Homo sapiens
aggcatgggatgcccagatt

SEQ ID NO: 9451450 - DNA, 22 bp, Homo sapiens
aggcatggggctgcagtcaggt

SEQ ID NO: 9451451 - DNA, 22 bp, Homo sapiens
aggcatgggtagaagagaagcc

SEQ ID NO: 9451452 - DNA, 17 bp, Homo sapiens
aggcatggtctggggtg

SEQ ID NO: 9451453 - DNA, 17 bp, Homo sapiens
aggcatggtctggggtg

SEQ ID NO: 9451454 - DNA, 22 bp, Homo sapiens
aggcatgggtagaagagaagcc

SEQ ID NO: 9451455 - DNA, 22 bp, Homo sapiens
aggccacagagagtgcatgtgc

SEQ ID NO: 9451456 - DNA, 22 bp, Homo sapiens
aggccacagagagtgcatgtgc

SEQ ID NO: 9451457 - DNA, 22 bp, Homo sapiens
aggccacagatactgtgaagta

SEQ ID NO: 9451458 - DNA, 22 bp, Homo sapiens
aggccacagagagtgcatgtgc

SEQ ID NO: 9451459 - DNA, 18 bp, Homo sapiens
aggccacactccagaaca

SEQ ID NO: 9451460 - DNA, 22 bp, Homo sapiens
aggccacacaactcttagagat

SEQ ID NO: 9451461 - DNA, 22 bp, Homo sapiens
aggccacaggattgcacagcat

SEQ ID NO: 9451462 - DNA, 22 bp, Homo sapiens
aggccacaggattgcacagcat

SEQ ID NO: 9451463 - DNA, 22 bp, Homo sapiens
aggccacaggattgcacagcat

SEQ ID NO: 9451464 - DNA, 22 bp, Homo sapiens
aggccacaggcaccctgtgttc

SEQ ID NO: 9451465 - DNA, 22 bp, Homo sapiens
aggccacagcctgggaggtgac

SEQ ID NO: 9451466 - DNA, 22 bp, Homo sapiens
aggccacaggagtactgtcggt

SEQ ID NO: 9451467 - DNA, 22 bp, Homo sapiens
aggccacagcctgggaggtgac

SEQ ID NO: 9451468 - DNA, 22 bp, Homo sapiens
aggccagcaccagagtcaagaa

SEQ ID NO: 9451469 - DNA, 22 bp, Homo sapiens
aggccagcaccagagtcaagaa

SEQ ID NO: 9451470 - DNA, 22 bp, Homo sapiens
aggccagcacgacagccgcagg

SEQ ID NO: 9451471 - DNA, 22 bp, Homo sapiens
aggccagcacgacagccgcagg

SEQ ID NO: 9451472 - DNA, 22 bp, Homo sapiens
aggccagcacgacagccgcagg

SEQ ID NO: 9451473 - DNA, 22 bp, Homo sapiens
aggccagcaagaaagagagtct

SEQ ID NO: 9451474 - DNA, 22 bp, Homo sapiens
aggccagcaagaaagagagtct

SEQ ID NO: 9451475 - DNA, 22 bp, Homo sapiens
aggccacaggtggaagccagag

SEQ ID NO: 9451476 - DNA, 22 bp, Homo sapiens
aggccacaggcaccctgtgttc

SEQ ID NO: 9451477 - DNA, 22 bp, Homo sapiens
aggcccagcttgaagtgggaag

SEQ ID NO: 9451478 - DNA, 22 bp, Homo sapiens
aggccaggtggtcatgcttgct

SEQ ID NO: 9451479 - DNA, 21 bp, Homo sapiens
aggcccagctttcctcttgct

SEQ ID NO: 9451480 - DNA, 22 bp, Homo sapiens
aggcccagcttgaagtgggaag

SEQ ID NO: 9451481 - DNA, 22 bp, Homo sapiens
aggcccagcttgaagtgggaag

SEQ ID NO: 9451482 - DNA, 22 bp, Homo sapiens
acatgaaacctgagtctaactc

SEQ ID NO: 9451483 - DNA, 20 bp, Homo sapiens
acatgaaaggaaacaggaaa

SEQ ID NO: 9451484 - DNA, 22 bp, Homo sapiens
aggccaggtggtcatgcttgct

SEQ ID NO: 9451485 - DNA, 22 bp, Homo sapiens
aggccagggtcccacactcgca

SEQ ID NO: 9451486 - DNA, 22 bp, Homo sapiens
aggccagggtcccacactcgca

SEQ ID NO: 9451487 - DNA, 20 bp, Homo sapiens
acatgaaaggaaacaggaaa

SEQ ID NO: 9451488 - DNA, 22 bp, Homo sapiens
aggccctgagaaaatccctgca

SEQ ID NO: 9451489 - DNA, 22 bp, Homo sapiens
aggccctgagaaaatccctgca

SEQ ID NO: 9451490 - DNA, 22 bp, Homo sapiens
aggccctgagaaaatccctgca

SEQ ID NO: 9451491 - DNA, 22 bp, Homo sapiens
aggccctgatccgaatccagat

SEQ ID NO: 9451492 - DNA, 22 bp, Homo sapiens
aggccctgagcatccgagggca

SEQ ID NO: 9451493 - DNA, 22 bp, Homo sapiens
aggccctgagcatccgagggca

SEQ ID NO: 9451494 - DNA, 21 bp, Homo sapiens
aggcccaggaatatgcatttt

SEQ ID NO: 9451495 - DNA, 22 bp, Homo sapiens
aggcccagggctgctctctgaa

SEQ ID NO: 9451496 - DNA, 22 bp, Homo sapiens
aggcccagggctgctctctgaa

SEQ ID NO: 9451497 - DNA, 22 bp, Homo sapiens
aggcccagggctgctctctgaa

SEQ ID NO: 9451498 - DNA, 23 bp, Homo sapiens
aggcccaggtatgtttgttttgg

SEQ ID NO: 9451499 - DNA, 22 bp, Homo sapiens
aggccagccctgggctgagaga

SEQ ID NO: 9451500 - DNA, 22 bp, Homo sapiens
aggccagccctgggctgagaga

SEQ ID NO: 9451501 - DNA, 22 bp, Homo sapiens
acatctttgctcttatagagct

SEQ ID NO: 9451502 - DNA, 22 bp, Homo sapiens
acatctttttggaaacggctga

SEQ ID NO: 9451503 - DNA, 22 bp, Homo sapiens
acatcttttttctctaattgtg

SEQ ID NO: 9451504 - DNA, 22 bp, Homo sapiens
acatctttgtttcttagtgtat

SEQ ID NO: 9451505 - DNA, 22 bp, Homo sapiens
acatctttgctcttatagagct

SEQ ID NO: 9451506 - DNA, 22 bp, Homo sapiens
aggccagcattctctctccagg

SEQ ID NO: 9451507 - DNA, 22 bp, Homo sapiens
aggccagcattctctctccagg

SEQ ID NO: 9451508 - DNA, 22 bp, Homo sapiens
aggccagcattctctctccagg

SEQ ID NO: 9451509 - DNA, 22 bp, Homo sapiens
aggccagcatgcagttctaagg

SEQ ID NO: 9451510 - DNA, 22 bp, Homo sapiens
aggccagcagacgtgggactga

SEQ ID NO: 9451511 - DNA, 22 bp, Homo sapiens
aggccagcagacgtgggactga

SEQ ID NO: 9451512 - DNA, 22 bp, Homo sapiens
aggccagcagacgtgggactga

SEQ ID NO: 9451513 - DNA, 22 bp, Homo sapiens
aggccagcagacgtgggactga

SEQ ID NO: 9451514 - DNA, 22 bp, Homo sapiens
aggccagcagacgtgggactga

SEQ ID NO: 9451515 - DNA, 22 bp, Homo sapiens
aggccagcagcatgacggcatc

SEQ ID NO: 9451516 - DNA, 22 bp, Homo sapiens
aggccagcagcatgacggcatc

SEQ ID NO: 9451517 - DNA, 22 bp, Homo sapiens
aggccagcagcatgacggcatc

SEQ ID NO: 9451518 - DNA, 18 bp, Homo sapiens
aggccagccctgctactg

SEQ ID NO: 9451519 - DNA, 22 bp, Homo sapiens
aggccagccctgggctgagaga

SEQ ID NO: 9451520 - DNA, 18 bp, Homo sapiens
aggccagccctgctactg

SEQ ID NO: 9451521 - DNA, 22 bp, Homo sapiens
aggccagccctcacctgtgttc

SEQ ID NO: 9451522 - DNA, 22 bp, Homo sapiens
aggccagccctcacctgtgttc

SEQ ID NO: 9451523 - DNA, 22 bp, Homo sapiens
aggccagcattctctctccagg

SEQ ID NO: 9451524 - DNA, 22 bp, Homo sapiens
aggccagcattctctctccagg

SEQ ID NO: 9451525 - DNA, 18 bp, Homo sapiens
aggccagccctgctactg

SEQ ID NO: 9451526 - DNA, 22 bp, Homo sapiens
aggccagccctcacctgtgttc

SEQ ID NO: 9451527 - DNA, 22 bp, Homo sapiens
aggccagccctcacctgtgttc

SEQ ID NO: 9451528 - DNA, 22 bp, Homo sapiens
acccacagccgctgtgcgtccc

SEQ ID NO: 9451529 - DNA, 22 bp, Homo sapiens
acccacagccgctgtgcgtccc

SEQ ID NO: 9451530 - DNA, 22 bp, Homo sapiens
acccacagccgctgtgcgtccc

SEQ ID NO: 9451531 - DNA, 22 bp, Homo sapiens
acccacagccgctgtgcgtccc

SEQ ID NO: 9451532 - DNA, 22 bp, Homo sapiens
agggcctgagctctcctccagt

SEQ ID NO: 9451533 - DNA, 22 bp, Homo sapiens
acccaccctactagcagtgtcc

SEQ ID NO: 9451534 - DNA, 22 bp, Homo sapiens
acccaccctactagcagtgtcc

SEQ ID NO: 9451535 - DNA, 22 bp, Homo sapiens
agggcctgagctctcctccagt

SEQ ID NO: 9451536 - DNA, 19 bp, Homo sapiens
agggcctgagcagatgttg

SEQ ID NO: 9451537 - DNA, 19 bp, Homo sapiens
agggcctgagcagatgttg

SEQ ID NO: 9451538 - DNA, 19 bp, Homo sapiens
agggcctgagcagatgttg

SEQ ID NO: 9451539 - DNA, 22 bp, Homo sapiens
acccagagaactgaggcatgaa

SEQ ID NO: 9451540 - DNA, 22 bp, Homo sapiens
acccagagaactgaggcatgaa

SEQ ID NO: 9451541 - DNA, 22 bp, Homo sapiens
acccagagaactgaggcatgaa

SEQ ID NO: 9451542 - DNA, 22 bp, Homo sapiens
acccagagaactgtgccttgag

SEQ ID NO: 9451543 - DNA, 22 bp, Homo sapiens
acccactgtagccactctgggt

SEQ ID NO: 9451544 - DNA, 22 bp, Homo sapiens
acccaccctactagcagtgtcc

SEQ ID NO: 9451545 - DNA, 22 bp, Homo sapiens
agggcctctggaacactgaggg

SEQ ID NO: 9451546 - DNA, 22 bp, Homo sapiens
agggcctgacacccttgccagc

SEQ ID NO: 9451547 - DNA, 22 bp, Homo sapiens
agggcctgacacccttgccagc

SEQ ID NO: 9451548 - DNA, 22 bp, Homo sapiens
agggcctgacacccttgccagc

SEQ ID NO: 9451549 - DNA, 22 bp, Homo sapiens
agggcctgagaccgtggcttga

SEQ ID NO: 9451550 - DNA, 22 bp, Homo sapiens
agggcctgagaccgtggcttga

SEQ ID NO: 9451551 - DNA, 22 bp, Homo sapiens
acccagtcatcctggtgtgaga

SEQ ID NO: 9451552 - DNA, 22 bp, Homo sapiens
acccagtcatcctggtgtgaga

SEQ ID NO: 9451553 - DNA, 22 bp, Homo sapiens
acccagggtttgagctctgcag

SEQ ID NO: 9451554 - DNA, 22 bp, Homo sapiens
acccagggtttgagctctgcag

SEQ ID NO: 9451555 - DNA, 22 bp, Homo sapiens
acccagtgcatggatagatagc

SEQ ID NO: 9451556 - DNA, 22 bp, Homo sapiens
acccagtctggagtgcagtgac

SEQ ID NO: 9451557 - DNA, 22 bp, Homo sapiens
acccagtctggagtgcagtgac

SEQ ID NO: 9451558 - DNA, 22 bp, Homo sapiens
acccagtgacatcctttacctg

SEQ ID NO: 9451559 - DNA, 23 bp, Homo sapiens
acccagttagagccctttaggaa

SEQ ID NO: 9451560 - DNA, 18 bp, Homo sapiens
acccagtttgaaggaaag

SEQ ID NO: 9451561 - DNA, 22 bp, Homo sapiens
acccatacacacatatttatgt

SEQ ID NO: 9451562 - DNA, 18 bp, Homo sapiens
acccagtttgaaggaaag

SEQ ID NO: 9451563 - DNA, 22 bp, Homo sapiens
acccagggtcaccccgtagggt

SEQ ID NO: 9451564 - DNA, 22 bp, Homo sapiens
acccagggttcctgggtcccag

SEQ ID NO: 9451565 - DNA, 22 bp, Homo sapiens
acccagggttcctgggtcccag

SEQ ID NO: 9451566 - DNA, 22 bp, Homo sapiens
acccagggttcctgggtcccag

SEQ ID NO: 9451567 - DNA, 19 bp, Homo sapiens
acccagggttgatgtccag

SEQ ID NO: 9451568 - DNA, 19 bp, Homo sapiens
acccagggttgatgtccag

SEQ ID NO: 9451569 - DNA, 22 bp, Homo sapiens
acccagggttcctgggtcccag

SEQ ID NO: 9451570 - DNA, 19 bp, Homo sapiens
acccagggttgatgtccag

SEQ ID NO: 9451571 - DNA, 22 bp, Homo sapiens
acccagagaactgtgccttgag

SEQ ID NO: 9451572 - DNA, 17 bp, Homo sapiens
acccagagaaggaggtc

SEQ ID NO: 9451573 - DNA, 22 bp, Homo sapiens
acccagagatggacctggctgc

SEQ ID NO: 9451574 - DNA, 22 bp, Homo sapiens
acccagagatggacctggctgc

SEQ ID NO: 9451575 - DNA, 22 bp, Homo sapiens
acccagagcacagatgcaacgt

SEQ ID NO: 9451576 - DNA, 22 bp, Homo sapiens
acccagagcactgggtgtgggc

SEQ ID NO: 9451577 - DNA, 22 bp, Homo sapiens
acccaggctggcgtgcagtggc

SEQ ID NO: 9451578 - DNA, 22 bp, Homo sapiens
acccagagcacagatgcaacgt

SEQ ID NO: 9451579 - DNA, 22 bp, Homo sapiens
acccagagcacagatgcaacgt

SEQ ID NO: 9451580 - DNA, 22 bp, Homo sapiens
acccagagcacagatgcaacgt

SEQ ID NO: 9451581 - DNA, 22 bp, Homo sapiens
acccagagcacagatgcaacgt

SEQ ID NO: 9451582 - DNA, 22 bp, Homo sapiens
acccagggtagaacctcagagc

SEQ ID NO: 9451583 - DNA, 22 bp, Homo sapiens
acccagggtagagtgcagtggc

SEQ ID NO: 9451584 - DNA, 22 bp, Homo sapiens
acccagggtagagtgcagtggc

SEQ ID NO: 9451585 - DNA, 22 bp, Homo sapiens
acccagggtagagtgcagtggc

SEQ ID NO: 9451586 - DNA, 23 bp, Homo sapiens
acccatctctcctgtcatgcaga

SEQ ID NO: 9451587 - DNA, 17 bp, Homo sapiens
acccatccccagggcag

SEQ ID NO: 9451588 - DNA, 22 bp, Homo sapiens
acccatccagtgtccctgctag

SEQ ID NO: 9451589 - DNA, 22 bp, Homo sapiens
acccattcctctcctgagggat

SEQ ID NO: 9451590 - DNA, 22 bp, Homo sapiens
acccatttcataaacatgcttt

SEQ ID NO: 9451591 - DNA, 22 bp, Homo sapiens
acccattcctttacttcatctg

SEQ ID NO: 9451592 - DNA, 22 bp, Homo sapiens
accccagaggcggaggctgcag

SEQ ID NO: 9451593 - DNA, 22 bp, Homo sapiens
accccagaagcagcagtggcag

SEQ ID NO: 9451594 - DNA, 22 bp, Homo sapiens
accccagaatctatgctttaca

SEQ ID NO: 9451595 - DNA, 22 bp, Homo sapiens
accccacagcatacaaaggcac

SEQ ID NO: 9451596 - DNA, 22 bp, Homo sapiens
acccatttttaaatataacttg

SEQ ID NO: 9451597 - DNA, 22 bp, Homo sapiens
accccaaaagagtaatagaatt

SEQ ID NO: 9451598 - DNA, 22 bp, Homo sapiens
accccaaaagagtaatagaatt

SEQ ID NO: 9451599 - DNA, 22 bp, Homo sapiens
accccaagacagtagaagagaa

SEQ ID NO: 9451600 - DNA, 20 bp, Homo sapiens
accccacagagtccattgca

SEQ ID NO: 9451601 - DNA, 22 bp, Homo sapiens
accctctgccttgagcagtgcc

SEQ ID NO: 9451602 - DNA, 22 bp, Homo sapiens
accccagcgcatatggtctgcg

SEQ ID NO: 9451603 - DNA, 22 bp, Homo sapiens
accctctgccttgagcagtgcc

SEQ ID NO: 9451604 - DNA, 22 bp, Homo sapiens
accccagcgcatatggtctgcg

SEQ ID NO: 9451605 - DNA, 22 bp, Homo sapiens
accccagaggcggaggctgcag

SEQ ID NO: 9451606 - DNA, 22 bp, Homo sapiens
accccagaggcggaggctgcag

SEQ ID NO: 9451607 - DNA, 22 bp, Homo sapiens
accccagcgcatatggtctgcg

SEQ ID NO: 9451608 - DNA, 22 bp, Homo sapiens
accccagccctgcttctgggag

SEQ ID NO: 9451609 - DNA, 22 bp, Homo sapiens
accctgctttatgccgtcctct

SEQ ID NO: 9451610 - DNA, 22 bp, Homo sapiens
accctggacatcttgtcatagc

SEQ ID NO: 9451611 - DNA, 22 bp, Homo sapiens
accctggacatcttgtcatagc

SEQ ID NO: 9451612 - DNA, 22 bp, Homo sapiens
accctggactggggctgaggct

SEQ ID NO: 9451613 - DNA, 22 bp, Homo sapiens
accctggactggggctgaggct

SEQ ID NO: 9451614 - DNA, 22 bp, Homo sapiens
accctgggttcccgcagcacca

SEQ ID NO: 9451615 - DNA, 22 bp, Homo sapiens
accctgggtgagaggcaaacag

SEQ ID NO: 9451616 - DNA, 22 bp, Homo sapiens
accctgggtgagaggcaaacag

SEQ ID NO: 9451617 - DNA, 22 bp, Homo sapiens
accctgggttcccgcagcacca

SEQ ID NO: 9451618 - DNA, 22 bp, Homo sapiens
accctgggttcccgcagcacca

SEQ ID NO: 9451619 - DNA, 22 bp, Homo sapiens
accctggtgttgccccgctttt

SEQ ID NO: 9451620 - DNA, 22 bp, Homo sapiens
accctgggtatttcccaaactt

SEQ ID NO: 9451621 - DNA, 22 bp, Homo sapiens
accctgggggtggccagtgcca

SEQ ID NO: 9451622 - DNA, 22 bp, Homo sapiens
accctgggggtggccagtgcca

SEQ ID NO: 9451623 - DNA, 22 bp, Homo sapiens
accctggagcttttctggccct

SEQ ID NO: 9451624 - DNA, 22 bp, Homo sapiens
accctggaggtggaggtgcagt

SEQ ID NO: 9451625 - DNA, 22 bp, Homo sapiens
accctggaggtctacagtgcag

SEQ ID NO: 9451626 - DNA, 22 bp, Homo sapiens
accctggaggtggaggtgcagt

SEQ ID NO: 9451627 - DNA, 22 bp, Homo sapiens
accctggctctctggccaccgc

SEQ ID NO: 9451628 - DNA, 22 bp, Homo sapiens
accctgggacctggaggtggat

SEQ ID NO: 9451629 - DNA, 22 bp, Homo sapiens
accctgggacctggaggtggat

SEQ ID NO: 9451630 - DNA, 23 bp, Homo sapiens
accaacaagcctctggagagtgg

SEQ ID NO: 9451631 - DNA, 22 bp, Homo sapiens
accaagcacaaagatgagtaaa

SEQ ID NO: 9451632 - DNA, 22 bp, Homo sapiens
accaagcttcgtggaggaagtt

SEQ ID NO: 9451633 - DNA, 22 bp, Homo sapiens
accaaggaagagattctcagtt

SEQ ID NO: 9451634 - DNA, 22 bp, Homo sapiens
accaaggagacaaaggtgtatt

SEQ ID NO: 9451635 - DNA, 22 bp, Homo sapiens
accaaatgcttggctgctgtga

SEQ ID NO: 9451636 - DNA, 22 bp, Homo sapiens
accaaatgctgacagcatgact

SEQ ID NO: 9451637 - DNA, 23 bp, Homo sapiens
accaacaagcctctggagagtgg

SEQ ID NO: 9451638 - DNA, 22 bp, Homo sapiens
accaaaggctcctgaagaactg

SEQ ID NO: 9451639 - DNA, 23 bp, Homo sapiens
aggcttcctatcttagagctggg

SEQ ID NO: 9451640 - DNA, 23 bp, Homo sapiens
aggcttcctatcttagagctggg

SEQ ID NO: 9451641 - DNA, 22 bp, Homo sapiens
accaaaggcagagctgaacact

SEQ ID NO: 9451642 - DNA, 22 bp, Homo sapiens
accacaggaattgctctgtggt

SEQ ID NO: 9451643 - DNA, 22 bp, Homo sapiens
accacagctttgcaccaggtgt

SEQ ID NO: 9451644 - DNA, 22 bp, Homo sapiens
accacagaggaatttgaagagg

SEQ ID NO: 9451645 - DNA, 22 bp, Homo sapiens
accagctctttcttttcactat

SEQ ID NO: 9451646 - DNA, 22 bp, Homo sapiens
accaggaacaagccatggagga

SEQ ID NO: 9451647 - DNA, 22 bp, Homo sapiens
accaggaacaagccatggagga

SEQ ID NO: 9451648 - DNA, 22 bp, Homo sapiens
accaaggctaaaataacatgtt

SEQ ID NO: 9451649 - DNA, 22 bp, Homo sapiens
accaaggagtttggtattttag

SEQ ID NO: 9451650 - DNA, 22 bp, Homo sapiens
accaatctgcttaaatgctgac

SEQ ID NO: 9451651 - DNA, 22 bp, Homo sapiens
accaatataagtataggtaagt

SEQ ID NO: 9451652 - DNA, 22 bp, Homo sapiens
accacactggctagtgaagaag

SEQ ID NO: 9451653 - DNA, 22 bp, Homo sapiens
accacaaacttagtggtgcaaa

SEQ ID NO: 9451654 - DNA, 22 bp, Homo sapiens
accaggaggcctggagcacaaa

SEQ ID NO: 9451655 - DNA, 22 bp, Homo sapiens
accaggaggcctggagcacaaa

SEQ ID NO: 9451656 - DNA, 22 bp, Homo sapiens
accaggaggaagtgttaatgat

SEQ ID NO: 9451657 - DNA, 22 bp, Homo sapiens
accaggagccatagagtcaggc

SEQ ID NO: 9451658 - DNA, 20 bp, Homo sapiens
accaggagatggaggcaggg

SEQ ID NO: 9451659 - DNA, 22 bp, Homo sapiens
accaggagccacaggaggagcc

SEQ ID NO: 9451660 - DNA, 22 bp, Homo sapiens
accaggagccacaggaggagcc

SEQ ID NO: 9451661 - DNA, 20 bp, Homo sapiens
accaggagatggaggcaggg

SEQ ID NO: 9451662 - DNA, 20 bp, Homo sapiens
accaggaatcttttctgagc

SEQ ID NO: 9451663 - DNA, 19 bp, Homo sapiens
accaggaacttccctaggc

SEQ ID NO: 9451664 - DNA, 19 bp, Homo sapiens
accaggaacttccctaggc

SEQ ID NO: 9451665 - DNA, 22 bp, Homo sapiens
accaggaagaacaggcaaggca

SEQ ID NO: 9451666 - DNA, 18 bp, Homo sapiens
accaggaagcttcttgtc

SEQ ID NO: 9451667 - DNA, 18 bp, Homo sapiens
accaggaagcttcttgtc

SEQ ID NO: 9451668 - DNA, 22 bp, Homo sapiens
accaggaagctgtgagaccttt

SEQ ID NO: 9451669 - DNA, 22 bp, Homo sapiens
accaggaagcatccctttgtaa

SEQ ID NO: 9451670 - DNA, 22 bp, Homo sapiens
accaggaagagattccaattta

SEQ ID NO: 9451671 - DNA, 22 bp, Homo sapiens
accagggcggcttgaggaggca

SEQ ID NO: 9451672 - DNA, 22 bp, Homo sapiens
accagggcggcttgaggaggca

SEQ ID NO: 9451673 - DNA, 22 bp, Homo sapiens
accagggccgcgggcgactagc

SEQ ID NO: 9451674 - DNA, 22 bp, Homo sapiens
accagggcagccgaggtgtgtc

SEQ ID NO: 9451675 - DNA, 22 bp, Homo sapiens
accagggcccgggagagctctc

SEQ ID NO: 9451676 - DNA, 22 bp, Homo sapiens
accagggcccgggagagctctc

SEQ ID NO: 9451677 - DNA, 22 bp, Homo sapiens
accagggcagccgaggtgtgtc

SEQ ID NO: 9451678 - DNA, 22 bp, Homo sapiens
accagggcacattccggccaga

SEQ ID NO: 9451679 - DNA, 22 bp, Homo sapiens
accagggcccgggagagctctc

SEQ ID NO: 9451680 - DNA, 22 bp, Homo sapiens
accagggctgacaatctgatgg

SEQ ID NO: 9451681 - DNA, 22 bp, Homo sapiens
accagggcggcttgaggaggca

SEQ ID NO: 9451682 - DNA, 22 bp, Homo sapiens
accagggctgacaatctgatgg

SEQ ID NO: 9451683 - DNA, 22 bp, Homo sapiens
accagggctgggataggtcagg

SEQ ID NO: 9451684 - DNA, 22 bp, Homo sapiens
accagggttgagtcagctgcgt

SEQ ID NO: 9451685 - DNA, 22 bp, Homo sapiens
accagggcttacagcagtagct

SEQ ID NO: 9451686 - DNA, 22 bp, Homo sapiens
accagggcacaggagtctgaag

SEQ ID NO: 9451687 - DNA, 22 bp, Homo sapiens
accagggcacaggagtctgaag

SEQ ID NO: 9451688 - DNA, 22 bp, Homo sapiens
accagggcacattccggccaga

SEQ ID NO: 9451689 - DNA, 22 bp, Homo sapiens
accagggcacaggagtctgaag

SEQ ID NO: 9451690 - DNA, 19 bp, Homo sapiens
accaggagtatcagagctg

SEQ ID NO: 9451691 - DNA, 19 bp, Homo sapiens
accaggagtatcagagctg

SEQ ID NO: 9451692 - DNA, 22 bp, Homo sapiens
accaggagtaacagtgagtggt

SEQ ID NO: 9451693 - DNA, 22 bp, Homo sapiens
accaggagggaccctggtggcc

SEQ ID NO: 9451694 - DNA, 22 bp, Homo sapiens
accaggtggccccagcgtggtt

SEQ ID NO: 9451695 - DNA, 22 bp, Homo sapiens
accaggtggccccagcgtggtt

SEQ ID NO: 9451696 - DNA, 20 bp, Homo sapiens
accaggtggctgatgacacc

SEQ ID NO: 9451697 - DNA, 22 bp, Homo sapiens
accagtcatagaaagcagtggt

SEQ ID NO: 9451698 - DNA, 22 bp, Homo sapiens
accagtaagatcctgtacatac

SEQ ID NO: 9451699 - DNA, 21 bp, Homo sapiens
accagtccctagtcttatcct

SEQ ID NO: 9451700 - DNA, 23 bp, Homo sapiens
accagtccattcccctcatgatt

SEQ ID NO: 9451701 - DNA, 22 bp, Homo sapiens
accagtccgcggagctccgggg

SEQ ID NO: 9451702 - DNA, 22 bp, Homo sapiens
accagtccgcggagctccgggg

SEQ ID NO: 9451703 - DNA, 22 bp, Homo sapiens
accagtccgcggagctccgggg

SEQ ID NO: 9451704 - DNA, 22 bp, Homo sapiens
accagtgagtatttgtaacaga

SEQ ID NO: 9451705 - DNA, 22 bp, Homo sapiens
accagtgcttcctgctggagct

SEQ ID NO: 9451706 - DNA, 22 bp, Homo sapiens
accagtggaattattctgtggt

SEQ ID NO: 9451707 - DNA, 22 bp, Homo sapiens
accagtggatgaatgctggacc

SEQ ID NO: 9451708 - DNA, 22 bp, Homo sapiens
accagtgtcaccccaaccagga

SEQ ID NO: 9451709 - DNA, 22 bp, Homo sapiens
accagtgtcttattgaccatct

SEQ ID NO: 9451710 - DNA, 23 bp, Homo sapiens
agggcccaagcctggacagcagg

SEQ ID NO: 9451711 - DNA, 22 bp, Homo sapiens
agggccagttctacctctgaat

SEQ ID NO: 9451712 - DNA, 22 bp, Homo sapiens
accatacacaatttgcaacggt

SEQ ID NO: 9451713 - DNA, 22 bp, Homo sapiens
accatataacaagtttaggaga

SEQ ID NO: 9451714 - DNA, 22 bp, Homo sapiens
accatacattaaatgactttca

SEQ ID NO: 9451715 - DNA, 22 bp, Homo sapiens
accagttattagccctacaact

SEQ ID NO: 9451716 - DNA, 22 bp, Homo sapiens
accagtttatagcgatctgtca

SEQ ID NO: 9451717 - DNA, 22 bp, Homo sapiens
agctgcctctcttgaggttacg

SEQ ID NO: 9451718 - DNA, 17 bp, Homo sapiens
agctgcctctcccacca

SEQ ID NO: 9451719 - DNA, 22 bp, Homo sapiens
agctgcctcctggtgccccatc

SEQ ID NO: 9451720 - DNA, 22 bp, Homo sapiens
agctgcctcctggtgccccatc

SEQ ID NO: 9451721 - DNA, 22 bp, Homo sapiens
agctgcctcctggtgccccatc

SEQ ID NO: 9451722 - DNA, 17 bp, Homo sapiens
agctgcctctcccacca

SEQ ID NO: 9451723 - DNA, 17 bp, Homo sapiens
agctgcctctcccacca

SEQ ID NO: 9451724 - DNA, 22 bp, Homo sapiens
agctgcctccatggtcaaagat

SEQ ID NO: 9451725 - DNA, 22 bp, Homo sapiens
agctgcctccctgtgcttgtcc

SEQ ID NO: 9451726 - DNA, 22 bp, Homo sapiens
agctgcctccatggtcaaagat

SEQ ID NO: 9451727 - DNA, 21 bp, Homo sapiens
agctgcctccacttctgaggc

SEQ ID NO: 9451728 - DNA, 22 bp, Homo sapiens
agctgcctccatggtcaaagat

SEQ ID NO: 9451729 - DNA, 22 bp, Homo sapiens
agctgcctccctgtgcttgtcc

SEQ ID NO: 9451730 - DNA, 22 bp, Homo sapiens
agctgcctccctgtgcttgtcc

SEQ ID NO: 9451731 - DNA, 22 bp, Homo sapiens
agctgcctccctgtgcttgtcc

SEQ ID NO: 9451732 - DNA, 22 bp, Homo sapiens
agctgcctctgctggtttagaa

SEQ ID NO: 9451733 - DNA, 22 bp, Homo sapiens
agctgcctgcatttatatcctg

SEQ ID NO: 9451734 - DNA, 22 bp, Homo sapiens
agctgcctgccatgccgctggt

SEQ ID NO: 9451735 - DNA, 22 bp, Homo sapiens
agctgcctgccatgccgctggt

SEQ ID NO: 9451736 - DNA, 22 bp, Homo sapiens
agctgcctctcttgaggttacg

SEQ ID NO: 9451737 - DNA, 22 bp, Homo sapiens
agctgcctctgaactttaattc

SEQ ID NO: 9451738 - DNA, 21 bp, Homo sapiens
agctgcctgctctggacctgg

SEQ ID NO: 9451739 - DNA, 21 bp, Homo sapiens
agctgcctgctctggacctgg

SEQ ID NO: 9451740 - DNA, 22 bp, Homo sapiens
agctgcctgccatgccgctggt

SEQ ID NO: 9451741 - DNA, 22 bp, Homo sapiens
agctgcctgccatgccgctggt

SEQ ID NO: 9451742 - DNA, 22 bp, Homo sapiens
agctgcctgctgcactcggtgc

SEQ ID NO: 9451743 - DNA, 21 bp, Homo sapiens
agctgcctgctctggacctgg

SEQ ID NO: 9451744 - DNA, 23 bp, Homo sapiens
agctggaaatggccgagctctgc

SEQ ID NO: 9451745 - DNA, 22 bp, Homo sapiens
agctggaaagaaggtggcagcc

SEQ ID NO: 9451746 - DNA, 22 bp, Homo sapiens
agctggaacgtcacaggagcag

SEQ ID NO: 9451747 - DNA, 22 bp, Homo sapiens
agctggaagctgatgagcacag

SEQ ID NO: 9451748 - DNA, 22 bp, Homo sapiens
agctggaatcctacttctaaca

SEQ ID NO: 9451749 - DNA, 22 bp, Homo sapiens
agctggaagtgcatttctcact

SEQ ID NO: 9451750 - DNA, 22 bp, Homo sapiens
agctgcctggagccagagttga

SEQ ID NO: 9451751 - DNA, 22 bp, Homo sapiens
agctgcctgcttatgagctcca

SEQ ID NO: 9451752 - DNA, 22 bp, Homo sapiens
agctgcctgcttatgagctcca

SEQ ID NO: 9451753 - DNA, 22 bp, Homo sapiens
agctgctgggaccccagatcca

SEQ ID NO: 9451754 - DNA, 22 bp, Homo sapiens
agctgctgggaccccagatcca

SEQ ID NO: 9451755 - DNA, 22 bp, Homo sapiens
agctgcctggagccagagttga

SEQ ID NO: 9451756 - DNA, 21 bp, Homo sapiens
agctgctttcagctcctagag

SEQ ID NO: 9451757 - DNA, 22 bp, Homo sapiens
agctgctttgctgggcaggccc

SEQ ID NO: 9451758 - DNA, 14 bp, Homo sapiens
caggaagactcagc

SEQ ID NO: 9451759 - DNA, 22 bp, Homo sapiens
caggaagaccagggctgtggct

SEQ ID NO: 9451760 - DNA, 22 bp, Homo sapiens
agctgcccccagggctgtgctt

SEQ ID NO: 9451761 - DNA, 22 bp, Homo sapiens
agctgcccctcattttcaccac

SEQ ID NO: 9451762 - DNA, 18 bp, Homo sapiens
agctgccctgggctggag

SEQ ID NO: 9451763 - DNA, 20 bp, Homo sapiens
agctgcccctgggcactgcc

SEQ ID NO: 9451764 - DNA, 22 bp, Homo sapiens
agctgcctcagtcactcatggc

SEQ ID NO: 9451765 - DNA, 22 bp, Homo sapiens
agctgcctcagcaacacagacc

SEQ ID NO: 9451766 - DNA, 22 bp, Homo sapiens
agctgcctcagcaacacagacc

SEQ ID NO: 9451767 - DNA, 21 bp, Homo sapiens
agctgcctccacttctgaggc

SEQ ID NO: 9451768 - DNA, 22 bp, Homo sapiens
agctgcctcagtcactcatggc

SEQ ID NO: 9451769 - DNA, 21 bp, Homo sapiens
agctgcctccacttctgaggc

SEQ ID NO: 9451770 - DNA, 20 bp, Homo sapiens
agctgcccttttcacatgtt

SEQ ID NO: 9451771 - DNA, 20 bp, Homo sapiens
agctgcccttttcacatgtt

SEQ ID NO: 9451772 - DNA, 22 bp, Homo sapiens
agctgcctcagcaacacagacc

SEQ ID NO: 9451773 - DNA, 22 bp, Homo sapiens
agctgcctagtagattgattgg

SEQ ID NO: 9451774 - DNA, 22 bp, Homo sapiens
agctgcccttaataggcattca

SEQ ID NO: 9451775 - DNA, 22 bp, Homo sapiens
agctgccctggtaagattgatg

SEQ ID NO: 9451776 - DNA, 22 bp, Homo sapiens
agctgccctgggtcttgctgct

SEQ ID NO: 9451777 - DNA, 22 bp, Homo sapiens
agctgaagaaatgggaagcatt

SEQ ID NO: 9451778 - DNA, 22 bp, Homo sapiens
agctgaagaaatgggaagcatt

SEQ ID NO: 9451779 - DNA, 22 bp, Homo sapiens
agctgaaattcacaaggatcca

SEQ ID NO: 9451780 - DNA, 22 bp, Homo sapiens
agctgaagaaatgggaagcatt

SEQ ID NO: 9451781 - DNA, 22 bp, Homo sapiens
caggaaaaggagactttagcac

SEQ ID NO: 9451782 - DNA, 17 bp, Homo sapiens
caggaaaatatgagtga

SEQ ID NO: 9451783 - DNA, 17 bp, Homo sapiens
caggaaaatatgagtga

SEQ ID NO: 9451784 - DNA, 17 bp, Homo sapiens
caggaaaatatgagtga

SEQ ID NO: 9451785 - DNA, 17 bp, Homo sapiens
caggaaaatatgagtga

SEQ ID NO: 9451786 - DNA, 22 bp, Homo sapiens
caggaaatataggaaaaggaac

SEQ ID NO: 9451787 - DNA, 22 bp, Homo sapiens
caggaaatataggaaaaggaac

SEQ ID NO: 9451788 - DNA, 22 bp, Homo sapiens
caggaaatagttcagtcaaact

SEQ ID NO: 9451789 - DNA, 22 bp, Homo sapiens
caggaaatatctcaacacttta

SEQ ID NO: 9451790 - DNA, 22 bp, Homo sapiens
caggaaatatctcaacacttta

SEQ ID NO: 9451791 - DNA, 22 bp, Homo sapiens
caggaaatataggaaaaggaac

SEQ ID NO: 9451792 - DNA, 22 bp, Homo sapiens
caggaaatcactctgattttgg

SEQ ID NO: 9451793 - DNA, 22 bp, Homo sapiens
caggaaatcactctgattttgg

SEQ ID NO: 9451794 - DNA, 22 bp, Homo sapiens
caggaaatcagaactcaagtgg

SEQ ID NO: 9451795 - DNA, 21 bp, Homo sapiens
caggaaatcagtgtgaattag

SEQ ID NO: 9451796 - DNA, 21 bp, Homo sapiens
caggaaatcagtgtgaattag

SEQ ID NO: 9451797 - DNA, 22 bp, Homo sapiens
caggaaatcagaactcaagtgg

SEQ ID NO: 9451798 - DNA, 22 bp, Homo sapiens
caggaaatcagaactcaagtgg

SEQ ID NO: 9451799 - DNA, 22 bp, Homo sapiens
caggaaatatctcctggcagag

SEQ ID NO: 9451800 - DNA, 22 bp, Homo sapiens
caggaaatatctcctggcagag

SEQ ID NO: 9451801 - DNA, 22 bp, Homo sapiens
caggaaatatctcctggcagag

SEQ ID NO: 9451802 - DNA, 23 bp, Homo sapiens
caggaaatcaattcttccagcat

SEQ ID NO: 9451803 - DNA, 22 bp, Homo sapiens
caggaaatcactctgattttgg

SEQ ID NO: 9451804 - DNA, 23 bp, Homo sapiens
caggaaatcaattcttccagcat

SEQ ID NO: 9451805 - DNA, 23 bp, Homo sapiens
caggaaatcaattcttccagcat

SEQ ID NO: 9451806 - DNA, 22 bp, Homo sapiens
caggaagaagggtggtgagtcc

SEQ ID NO: 9451807 - DNA, 22 bp, Homo sapiens
caggaagaagggtggtgagtcc

SEQ ID NO: 9451808 - DNA, 22 bp, Homo sapiens
caggaagaagggtggtgagtcc

SEQ ID NO: 9451809 - DNA, 22 bp, Homo sapiens
caggaagaccagggctgtggct

SEQ ID NO: 9451810 - DNA, 22 bp, Homo sapiens
caggaagaccagggctgtggct

SEQ ID NO: 9451811 - DNA, 22 bp, Homo sapiens
caggaagaagggtggtgagtcc

SEQ ID NO: 9451812 - DNA, 22 bp, Homo sapiens
caggaagaccagggctgtggct

SEQ ID NO: 9451813 - DNA, 22 bp, Homo sapiens
caggaagaccagggctgtggct

SEQ ID NO: 9451814 - DNA, 22 bp, Homo sapiens
caggaagaaagaggtgaggtgt

SEQ ID NO: 9451815 - DNA, 22 bp, Homo sapiens
caggaagaaagaggtgaggtgt

SEQ ID NO: 9451816 - DNA, 22 bp, Homo sapiens
caggaagaaagaggtgaggtgt

SEQ ID NO: 9451817 - DNA, 22 bp, Homo sapiens
caggaagaaagaggtgaggtgt

SEQ ID NO: 9451818 - DNA, 22 bp, Homo sapiens
caggaagaaagaggtgaggtgt

SEQ ID NO: 9451819 - DNA, 22 bp, Homo sapiens
caggaactggaaccctggccga

SEQ ID NO: 9451820 - DNA, 22 bp, Homo sapiens
caggaacgcctggtgttggcct

SEQ ID NO: 9451821 - DNA, 22 bp, Homo sapiens
caggaacctgtgcgtagggatg

SEQ ID NO: 9451822 - DNA, 22 bp, Homo sapiens
caggaaatgcgtagttgaactt

SEQ ID NO: 9451823 - DNA, 22 bp, Homo sapiens
caggaaatgctatcatagctga

SEQ ID NO: 9451824 - DNA, 22 bp, Homo sapiens
caggaaatgaggctgaagggtg

SEQ ID NO: 9451825 - DNA, 15 bp, Homo sapiens
caggaaatgaatctg

SEQ ID NO: 9451826 - DNA, 22 bp, Homo sapiens
caggaaatgcgtagttgaactt

SEQ ID NO: 9451827 - DNA, 22 bp, Homo sapiens
caggaaatgaaagctagctaat

SEQ ID NO: 9451828 - DNA, 22 bp, Homo sapiens
caggaaatgaaagctagctaat

SEQ ID NO: 9451829 - DNA, 22 bp, Homo sapiens
caggaaatgaacaggaatgaac

SEQ ID NO: 9451830 - DNA, 23 bp, Homo sapiens
caggaaatgaatccaggaggatg

SEQ ID NO: 9451831 - DNA, 22 bp, Homo sapiens
caggaaccaggagagtccctga

SEQ ID NO: 9451832 - DNA, 22 bp, Homo sapiens
caggaacatttaaccacagggt

SEQ ID NO: 9451833 - DNA, 23 bp, Homo sapiens
caggaaatgcttggaggggctgg

SEQ ID NO: 9451834 - DNA, 23 bp, Homo sapiens
caggaaatgcttggaggggctgg

SEQ ID NO: 9451835 - DNA, 22 bp, Homo sapiens
caggaacccccactctcagctc

SEQ ID NO: 9451836 - DNA, 22 bp, Homo sapiens
caggaacctaaagagacattac

SEQ ID NO: 9451837 - DNA, 22 bp, Homo sapiens
agctggtgatgtggtccctcac

SEQ ID NO: 9451838 - DNA, 22 bp, Homo sapiens
agctggtgctcaggggcatgga

SEQ ID NO: 9451839 - DNA, 22 bp, Homo sapiens
agctggtgagggttgaggggta

SEQ ID NO: 9451840 - DNA, 22 bp, Homo sapiens
agctggtgatggcctaagaagg

SEQ ID NO: 9451841 - DNA, 22 bp, Homo sapiens
agctggtcctaattgagccatt

SEQ ID NO: 9451842 - DNA, 22 bp, Homo sapiens
agctggtcctaattgagccatt

SEQ ID NO: 9451843 - DNA, 22 bp, Homo sapiens
agctggtcttaaatgtgtccag

SEQ ID NO: 9451844 - DNA, 22 bp, Homo sapiens
agctggtgaacctgaggcacag

SEQ ID NO: 9451845 - DNA, 20 bp, Homo sapiens
agctggtgaattaaagactg

SEQ ID NO: 9451846 - DNA, 22 bp, Homo sapiens
agctggtaagtggcagagattc

SEQ ID NO: 9451847 - DNA, 22 bp, Homo sapiens
agctgggtttctggcaggctta

SEQ ID NO: 9451848 - DNA, 22 bp, Homo sapiens
agctggtatttgttagggagtt

SEQ ID NO: 9451849 - DNA, 19 bp, Homo sapiens
agctgggtgttagtggaga

SEQ ID NO: 9451850 - DNA, 22 bp, Homo sapiens
agctgggtgttcttgggcctaa

SEQ ID NO: 9451851 - DNA, 22 bp, Homo sapiens
agctgggtgttcttgggcctaa

SEQ ID NO: 9451852 - DNA, 22 bp, Homo sapiens
agctgggttcagaggcacatgg

SEQ ID NO: 9451853 - DNA, 17 bp, Homo sapiens
agctgggttctcaggaa

SEQ ID NO: 9451854 - DNA, 22 bp, Homo sapiens
agctgggttcagaggcacatgg

SEQ ID NO: 9451855 - DNA, 22 bp, Homo sapiens
agctgggttgacaagatggaaa

SEQ ID NO: 9451856 - DNA, 17 bp, Homo sapiens
agctgggttctcaggaa

SEQ ID NO: 9451857 - DNA, 22 bp, Homo sapiens
agctgggttgacaagatggaaa

SEQ ID NO: 9451858 - DNA, 19 bp, Homo sapiens
agctggggcggtgtgtgtt

SEQ ID NO: 9451859 - DNA, 22 bp, Homo sapiens
caggcagagtgagaagcccttg

SEQ ID NO: 9451860 - DNA, 22 bp, Homo sapiens
agctgggtgcggtggctcatgc

SEQ ID NO: 9451861 - DNA, 22 bp, Homo sapiens
agctgggtgcggtggctcatgc

SEQ ID NO: 9451862 - DNA, 19 bp, Homo sapiens
agctggggcggtgtgtgtt

SEQ ID NO: 9451863 - DNA, 19 bp, Homo sapiens
agctggggcggtgtgtgtt

SEQ ID NO: 9451864 - DNA, 23 bp, Homo sapiens
agctgggtggcctgcgtgaagct

SEQ ID NO: 9451865 - DNA, 22 bp, Homo sapiens
agctgggtggcctctcctcggg

SEQ ID NO: 9451866 - DNA, 21 bp, Homo sapiens
agctgggtgctaatgacaact

SEQ ID NO: 9451867 - DNA, 22 bp, Homo sapiens
agctgggtgtgtatcagataaa

SEQ ID NO: 9451868 - DNA, 22 bp, Homo sapiens
agctgggtgtagggctggacaa

SEQ ID NO: 9451869 - DNA, 22 bp, Homo sapiens
agctgggtggtgctgagccttg

SEQ ID NO: 9451870 - DNA, 21 bp, Homo sapiens
agctgggtgggctgagtgaca

SEQ ID NO: 9451871 - DNA, 21 bp, Homo sapiens
agctgggtgggctgagtgaca

SEQ ID NO: 9451872 - DNA, 23 bp, Homo sapiens
agctgggtggcctgcgtgaagct

SEQ ID NO: 9451873 - DNA, 20 bp, Homo sapiens
caggcagaggatgctgacca

SEQ ID NO: 9451874 - DNA, 20 bp, Homo sapiens
caggcagaggatgctgacca

SEQ ID NO: 9451875 - DNA, 22 bp, Homo sapiens
caggcagaggaagtctgggtct

SEQ ID NO: 9451876 - DNA, 22 bp, Homo sapiens
caggcagaggaggccttctcct

SEQ ID NO: 9451877 - DNA, 22 bp, Homo sapiens
caggcagaggaagtctgggtct

SEQ ID NO: 9451878 - DNA, 22 bp, Homo sapiens
caggcagaggaagtctgggtct

SEQ ID NO: 9451879 - DNA, 22 bp, Homo sapiens
caggcagaggaagtctgggtct

SEQ ID NO: 9451880 - DNA, 22 bp, Homo sapiens
caggcagagtcagattagactt

SEQ ID NO: 9451881 - DNA, 22 bp, Homo sapiens
caggcagagtcagattagactt

SEQ ID NO: 9451882 - DNA, 22 bp, Homo sapiens
caggcagagtgagaagcccttg

SEQ ID NO: 9451883 - DNA, 22 bp, Homo sapiens
caggcagagtgagaagcccttg

SEQ ID NO: 9451884 - DNA, 22 bp, Homo sapiens
caggcagaggcttttcatggct

SEQ ID NO: 9451885 - DNA, 22 bp, Homo sapiens
caggcagaggcttttcatggct

SEQ ID NO: 9451886 - DNA, 22 bp, Homo sapiens
caggcagaggtaccaagattga

SEQ ID NO: 9451887 - DNA, 22 bp, Homo sapiens
agctggagattctggggacagt

SEQ ID NO: 9451888 - DNA, 22 bp, Homo sapiens
agctggagatgcccagcaccgg

SEQ ID NO: 9451889 - DNA, 22 bp, Homo sapiens
agctggagccagtgtgaggctt

SEQ ID NO: 9451890 - DNA, 19 bp, Homo sapiens
agctggagattggagggca

SEQ ID NO: 9451891 - DNA, 19 bp, Homo sapiens
agctggagattggagggca

SEQ ID NO: 9451892 - DNA, 19 bp, Homo sapiens
agctggagattggagggca

SEQ ID NO: 9451893 - DNA, 19 bp, Homo sapiens
agctggagattggagggca

SEQ ID NO: 9451894 - DNA, 19 bp, Homo sapiens
agctggagattggagggca

SEQ ID NO: 9451895 - DNA, 22 bp, Homo sapiens
agctggagcttcaagcaggtaa

SEQ ID NO: 9451896 - DNA, 22 bp, Homo sapiens
agctggagcttcaagcaggtaa

SEQ ID NO: 9451897 - DNA, 22 bp, Homo sapiens
agctggagcttcaagcaggtaa

SEQ ID NO: 9451898 - DNA, 22 bp, Homo sapiens
agctggagcttcaagcaggtaa

SEQ ID NO: 9451899 - DNA, 22 bp, Homo sapiens
agctggagcttcaagcaggtaa

SEQ ID NO: 9451900 - DNA, 22 bp, Homo sapiens
agctggagccagtgtgaggctt

SEQ ID NO: 9451901 - DNA, 22 bp, Homo sapiens
agctggagccagtgtgaggctt

SEQ ID NO: 9451902 - DNA, 22 bp, Homo sapiens
agctggagccagtgtgaggctt

SEQ ID NO: 9451903 - DNA, 20 bp, Homo sapiens
agctggagaagggcccttcc

SEQ ID NO: 9451904 - DNA, 22 bp, Homo sapiens
agctggagaaacctgggagggt

SEQ ID NO: 9451905 - DNA, 22 bp, Homo sapiens
agctggaattacaggcacgcac

SEQ ID NO: 9451906 - DNA, 21 bp, Homo sapiens
agctggaatctggctgtgctt

SEQ ID NO: 9451907 - DNA, 22 bp, Homo sapiens
agctggagaaacctgggagggt

SEQ ID NO: 9451908 - DNA, 22 bp, Homo sapiens
agctggagaaacctgggagggt

SEQ ID NO: 9451909 - DNA, 22 bp, Homo sapiens
agctggagatcatgctgatact

SEQ ID NO: 9451910 - DNA, 22 bp, Homo sapiens
agctggagatgagtgacgtgcc

SEQ ID NO: 9451911 - DNA, 22 bp, Homo sapiens
agctggagatgcccagcaccgg

SEQ ID NO: 9451912 - DNA, 22 bp, Homo sapiens
agctggagagtttccaggaagg

SEQ ID NO: 9451913 - DNA, 22 bp, Homo sapiens
agctggagaatgtggatgatcc

SEQ ID NO: 9451914 - DNA, 22 bp, Homo sapiens
agctggagatcatgctgatact

SEQ ID NO: 9451915 - DNA, 22 bp, Homo sapiens
caggcagagctgaagatagatg

SEQ ID NO: 9451916 - DNA, 22 bp, Homo sapiens
agctgggcctgagctggaagct

SEQ ID NO: 9451917 - DNA, 22 bp, Homo sapiens
agctggaggagtttctcctagc

SEQ ID NO: 9451918 - DNA, 22 bp, Homo sapiens
agctggaggagtttctcctagc

SEQ ID NO: 9451919 - DNA, 22 bp, Homo sapiens
agctggaggagtttctcctagc

SEQ ID NO: 9451920 - DNA, 22 bp, Homo sapiens
agctgggactcaactgtctggg

SEQ ID NO: 9451921 - DNA, 22 bp, Homo sapiens
agctggaggataactcacttct

SEQ ID NO: 9451922 - DNA, 22 bp, Homo sapiens
agctgggactcaactgtctggg

SEQ ID NO: 9451923 - DNA, 22 bp, Homo sapiens
agctgggactcaactgtctggg

SEQ ID NO: 9451924 - DNA, 22 bp, Homo sapiens
agcttctctctttgcactcaca

SEQ ID NO: 9451925 - DNA, 22 bp, Homo sapiens
agcttctctctttgcactcaca

SEQ ID NO: 9451926 - DNA, 22 bp, Homo sapiens
agcttctctcagggtatctttc

SEQ ID NO: 9451927 - DNA, 22 bp, Homo sapiens
agcttctcctggtacagaactg

SEQ ID NO: 9451928 - DNA, 22 bp, Homo sapiens
agcttctcctggtacagaactg

SEQ ID NO: 9451929 - DNA, 22 bp, Homo sapiens
agcttctgcatcttttcttccc

SEQ ID NO: 9451930 - DNA, 22 bp, Homo sapiens
agcttctgcccgtgtttgctct

SEQ ID NO: 9451931 - DNA, 22 bp, Homo sapiens
agcttctggaaggcaaggcttg

SEQ ID NO: 9451932 - DNA, 22 bp, Homo sapiens
agcttctggaagcctggcagca

SEQ ID NO: 9451933 - DNA, 22 bp, Homo sapiens
agcttctggaagcctggcagca

SEQ ID NO: 9451934 - DNA, 22 bp, Homo sapiens
agcttctggaagcctggcagca

SEQ ID NO: 9451935 - DNA, 22 bp, Homo sapiens
agcttctggaagcctggcagca

SEQ ID NO: 9451936 - DNA, 23 bp, Homo sapiens
agcttctggttcaggtcaagcag

SEQ ID NO: 9451937 - DNA, 22 bp, Homo sapiens
agcttctggaaggcaaggcttg

SEQ ID NO: 9451938 - DNA, 22 bp, Homo sapiens
agcttctgttcatcttccaggc

SEQ ID NO: 9451939 - DNA, 22 bp, Homo sapiens
agcttctgttcatcttccaggc

SEQ ID NO: 9451940 - DNA, 22 bp, Homo sapiens
agctttcagtctctgaaggaac

SEQ ID NO: 9451941 - DNA, 22 bp, Homo sapiens
agctttccactatcttaggggt

SEQ ID NO: 9451942 - DNA, 22 bp, Homo sapiens
agctttctagactctgtggtca

SEQ ID NO: 9451943 - DNA, 22 bp, Homo sapiens
agctttcacgatttggaacagg

SEQ ID NO: 9451944 - DNA, 22 bp, Homo sapiens
agctttcacgatttggaacagg

SEQ ID NO: 9451945 - DNA, 22 bp, Homo sapiens
agctttcaggataatgaaaaag

SEQ ID NO: 9451946 - DNA, 22 bp, Homo sapiens
agctttcaggataatgaaaaag

SEQ ID NO: 9451947 - DNA, 22 bp, Homo sapiens
agcttctgttcatcttccaggc

SEQ ID NO: 9451948 - DNA, 22 bp, Homo sapiens
agctttatatttaatgaattct

SEQ ID NO: 9451949 - DNA, 22 bp, Homo sapiens
agctttatatttaatgaattct

SEQ ID NO: 9451950 - DNA, 22 bp, Homo sapiens
caggcttgattattcagacaat

SEQ ID NO: 9451951 - DNA, 22 bp, Homo sapiens
agcttctcaggagtctgaggca

SEQ ID NO: 9451952 - DNA, 22 bp, Homo sapiens
agcttctcatcttccaaaattg

SEQ ID NO: 9451953 - DNA, 22 bp, Homo sapiens
agcttctccatctgcccagaga

SEQ ID NO: 9451954 - DNA, 21 bp, Homo sapiens
caggcttgaccctagtgggaa

SEQ ID NO: 9451955 - DNA, 22 bp, Homo sapiens
caggcttgaagcttcagagtat

SEQ ID NO: 9451956 - DNA, 22 bp, Homo sapiens
caggcttcgctctgtgggcagg

SEQ ID NO: 9451957 - DNA, 22 bp, Homo sapiens
caggctgtgaaactgagatgcg

SEQ ID NO: 9451958 - DNA, 22 bp, Homo sapiens
caggctgtggatcaggagcctt

SEQ ID NO: 9451959 - DNA, 22 bp, Homo sapiens
caggctgtctgctgaggaaagg

SEQ ID NO: 9451960 - DNA, 22 bp, Homo sapiens
caggctgtgaaactgagatgcg

SEQ ID NO: 9451961 - DNA, 22 bp, Homo sapiens
caggctgtgaaactgagatgcg

SEQ ID NO: 9451962 - DNA, 22 bp, Homo sapiens
caggctgtgttcctggaacccc

SEQ ID NO: 9451963 - DNA, 22 bp, Homo sapiens
caggctgtgttcctggaacccc

SEQ ID NO: 9451964 - DNA, 22 bp, Homo sapiens
caggctgtgggagtcaggaccc

SEQ ID NO: 9451965 - DNA, 22 bp, Homo sapiens
agctggtgctcggggagctggc

SEQ ID NO: 9451966 - DNA, 22 bp, Homo sapiens
agctggtgctgaagctcttgag

SEQ ID NO: 9451967 - DNA, 22 bp, Homo sapiens
agctggtgctcggggagctggc

SEQ ID NO: 9451968 - DNA, 22 bp, Homo sapiens
caggctgtgaaactgagatgcg

SEQ ID NO: 9451969 - DNA, 22 bp, Homo sapiens
caggctgtctgaatggaggccc

SEQ ID NO: 9451970 - DNA, 22 bp, Homo sapiens
caggctggagttcagtggtgtg

SEQ ID NO: 9451971 - DNA, 22 bp, Homo sapiens
aggaaacaacttggcatgagcc

SEQ ID NO: 9451972 - DNA, 22 bp, Homo sapiens
aggaaacagaggtgccacaata

SEQ ID NO: 9451973 - DNA, 22 bp, Homo sapiens
aggaaacagaggtgccacaata

SEQ ID NO: 9451974 - DNA, 22 bp, Homo sapiens
aggaaaattatcatgagagcca

SEQ ID NO: 9451975 - DNA, 22 bp, Homo sapiens
aggaaaatggaccagagttgtt

SEQ ID NO: 9451976 - DNA, 22 bp, Homo sapiens
aggaaaagtgtgaagtatggag

SEQ ID NO: 9451977 - DNA, 22 bp, Homo sapiens
aggaaaatgaaacagcaactgt

SEQ ID NO: 9451978 - DNA, 22 bp, Homo sapiens
aggaaaatcgagtctggaggca

SEQ ID NO: 9451979 - DNA, 22 bp, Homo sapiens
aggaaaagtgtgaagtatggag

SEQ ID NO: 9451980 - DNA, 20 bp, Homo sapiens
aggaaaagggtggtggtaga

SEQ ID NO: 9451981 - DNA, 20 bp, Homo sapiens
aggaaaagggtggtggtaga

SEQ ID NO: 9451982 - DNA, 22 bp, Homo sapiens
aggaaaacagaccaaggagctc

SEQ ID NO: 9451983 - DNA, 22 bp, Homo sapiens
aggaaaacacagtattgatgga

SEQ ID NO: 9451984 - DNA, 20 bp, Homo sapiens
aggaaaaatggaaactggag

SEQ ID NO: 9451985 - DNA, 22 bp, Homo sapiens
aggaaaaataaggcagcagggc

SEQ ID NO: 9451986 - DNA, 22 bp, Homo sapiens
aggaaaaataaggcagcagggc

SEQ ID NO: 9451987 - DNA, 22 bp, Homo sapiens
aggaaaaataaggcagcagggc

SEQ ID NO: 9451988 - DNA, 20 bp, Homo sapiens
aggaaaaatggaaactggag

SEQ ID NO: 9451989 - DNA, 22 bp, Homo sapiens
aggaaaaataaggcagcagggc

SEQ ID NO: 9451990 - DNA, 20 bp, Homo sapiens
aggaaaaatggaaactggag

SEQ ID NO: 9451991 - DNA, 22 bp, Homo sapiens
cagggacagcgggactctgaca

SEQ ID NO: 9451992 - DNA, 22 bp, Homo sapiens
cagggacagggatcatttgctt

SEQ ID NO: 9451993 - DNA, 22 bp, Homo sapiens
cagggacaggggagaaaagatg

SEQ ID NO: 9451994 - DNA, 22 bp, Homo sapiens
cagggacataagaggaacatgg

SEQ ID NO: 9451995 - DNA, 22 bp, Homo sapiens
cagggacatgactggtctctgt

SEQ ID NO: 9451996 - DNA, 22 bp, Homo sapiens
cagggacataagaggaacatgg

SEQ ID NO: 9451997 - DNA, 20 bp, Homo sapiens
agctttctccttggagctcc

SEQ ID NO: 9451998 - DNA, 22 bp, Homo sapiens
agctttctccctgacgctttgg

SEQ ID NO: 9451999 - DNA, 22 bp, Homo sapiens
cagggacagcgggactctgaca

SEQ ID NO: 9452000 - DNA, 22 bp, Homo sapiens
cagggaccctactagctcacac

SEQ ID NO: 9452001 - DNA, 22 bp, Homo sapiens
agctttgggggaggtagtctgt

SEQ ID NO: 9452002 - DNA, 22 bp, Homo sapiens
agctttgggggtaggtatagag

SEQ ID NO: 9452003 - DNA, 22 bp, Homo sapiens
agctttggggacagccaaggtt

SEQ ID NO: 9452004 - DNA, 22 bp, Homo sapiens
agctttgggccactggctggat

SEQ ID NO: 9452005 - DNA, 22 bp, Homo sapiens
agctttgggccactggctggat

SEQ ID NO: 9452006 - DNA, 22 bp, Homo sapiens
agctttggggacagccaaggtt

SEQ ID NO: 9452007 - DNA, 22 bp, Homo sapiens
cagggacccgcacaggtagcat

SEQ ID NO: 9452008 - DNA, 22 bp, Homo sapiens
cagggacattggtggccaggtt

SEQ ID NO: 9452009 - DNA, 22 bp, Homo sapiens
cagggacattggtggccaggtt

SEQ ID NO: 9452010 - DNA, 22 bp, Homo sapiens
cagggacatgactggtctctgt

SEQ ID NO: 9452011 - DNA, 22 bp, Homo sapiens
caggtcctcacgcctcaccctt

SEQ ID NO: 9452012 - DNA, 22 bp, Homo sapiens
caggtcctcacgcctcaccctt

SEQ ID NO: 9452013 - DNA, 22 bp, Homo sapiens
caggtcctcgggggaggccggc

SEQ ID NO: 9452014 - DNA, 22 bp, Homo sapiens
caggtcctggcagctgactcag

SEQ ID NO: 9452015 - DNA, 22 bp, Homo sapiens
caggtcctgccttggttaccct

SEQ ID NO: 9452016 - DNA, 22 bp, Homo sapiens
aggaatgacagatgtccgcacc

SEQ ID NO: 9452017 - DNA, 22 bp, Homo sapiens
aggaatgacagatgtccgcacc

SEQ ID NO: 9452018 - DNA, 22 bp, Homo sapiens
aggaatgtcgtcataaacatga

SEQ ID NO: 9452019 - DNA, 22 bp, Homo sapiens
aggaatgaactcgagtgatctg

SEQ ID NO: 9452020 - DNA, 22 bp, Homo sapiens
aggaatgaactcgagtgatctg

SEQ ID NO: 9452021 - DNA, 22 bp, Homo sapiens
aggaatgaactcgagtgatctg

SEQ ID NO: 9452022 - DNA, 22 bp, Homo sapiens
caggtcctggcagctgactcag

SEQ ID NO: 9452023 - DNA, 22 bp, Homo sapiens
caggtcctggcagctgactcag

SEQ ID NO: 9452024 - DNA, 22 bp, Homo sapiens
caggtcctggcatcaggcaggt

SEQ ID NO: 9452025 - DNA, 22 bp, Homo sapiens
caggtcctggcatcaggcaggt

SEQ ID NO: 9452026 - DNA, 22 bp, Homo sapiens
aggaatgtggcaatcttcaagt

SEQ ID NO: 9452027 - DNA, 21 bp, Homo sapiens
aggaatgtgtatatatacaat

SEQ ID NO: 9452028 - DNA, 22 bp, Homo sapiens
aggaaggtaatgaactgaggag

SEQ ID NO: 9452029 - DNA, 22 bp, Homo sapiens
aggaaggtaatgaactgaggag

SEQ ID NO: 9452030 - DNA, 22 bp, Homo sapiens
aggaaggtgcagtagggtgtgc

SEQ ID NO: 9452031 - DNA, 20 bp, Homo sapiens
aggaagtattgtcatgaagg

SEQ ID NO: 9452032 - DNA, 22 bp, Homo sapiens
aggaagtcagctgccatgctgt

SEQ ID NO: 9452033 - DNA, 22 bp, Homo sapiens
aggaagtgaaagggaaggagtt

SEQ ID NO: 9452034 - DNA, 22 bp, Homo sapiens
caggtcccgccccgggctgacc

SEQ ID NO: 9452035 - DNA, 17 bp, Homo sapiens
caggtcccagggtctct

SEQ ID NO: 9452036 - DNA, 22 bp, Homo sapiens
caggtccccagggtacctacct

SEQ ID NO: 9452037 - DNA, 22 bp, Homo sapiens
caggtccagtaaaaagagtcct

SEQ ID NO: 9452038 - DNA, 20 bp, Homo sapiens
caggtccagcacgtgcacgg

SEQ ID NO: 9452039 - DNA, 22 bp, Homo sapiens
caggtccagtcactggtctgca

SEQ ID NO: 9452040 - DNA, 22 bp, Homo sapiens
aggaaggggagaagttaaagct

SEQ ID NO: 9452041 - DNA, 22 bp, Homo sapiens
aggaagggttctttgtgaaaga

SEQ ID NO: 9452042 - DNA, 22 bp, Homo sapiens
aggaagggttctttctgtttat

SEQ ID NO: 9452043 - DNA, 22 bp, Homo sapiens
aggaagcaccggaatgatgact

SEQ ID NO: 9452044 - DNA, 22 bp, Homo sapiens
aggaaggactgcagcatttggt

SEQ ID NO: 9452045 - DNA, 20 bp, Homo sapiens
aggaaggagaatctgagcaa

SEQ ID NO: 9452046 - DNA, 22 bp, Homo sapiens
aggaagcaaaaggcagggtcta

SEQ ID NO: 9452047 - DNA, 22 bp, Homo sapiens
aggaagatgtgcaaagttggaa

SEQ ID NO: 9452048 - DNA, 22 bp, Homo sapiens
aggaagaggtgtgcaatggtgt

SEQ ID NO: 9452049 - DNA, 22 bp, Homo sapiens
aggaagagtgttacctatgggt

SEQ ID NO: 9452050 - DNA, 22 bp, Homo sapiens
aggaagagtgttacctatgggt

SEQ ID NO: 9452051 - DNA, 22 bp, Homo sapiens
aggaagagtgttacctatgggt

SEQ ID NO: 9452052 - DNA, 22 bp, Homo sapiens
cagggtttcaccatgttagcag

SEQ ID NO: 9452053 - DNA, 22 bp, Homo sapiens
cagggtttcaccatgttagcag

SEQ ID NO: 9452054 - DNA, 22 bp, Homo sapiens
aggaagaggtagctgtcaaggg

SEQ ID NO: 9452055 - DNA, 22 bp, Homo sapiens
aggaagaggtagctgtcaaggg

SEQ ID NO: 9452056 - DNA, 22 bp, Homo sapiens
aggaagaggtagctgtcaaggg

SEQ ID NO: 9452057 - DNA, 22 bp, Homo sapiens
aggaagagggtggcagataatc

SEQ ID NO: 9452058 - DNA, 22 bp, Homo sapiens
aggaagagggtggcagataatc

SEQ ID NO: 9452059 - DNA, 22 bp, Homo sapiens
cagggtgtatagtgtagaagtt

SEQ ID NO: 9452060 - DNA, 22 bp, Homo sapiens
cagggttcagtgggccctcttg

SEQ ID NO: 9452061 - DNA, 22 bp, Homo sapiens
cagggtggtgaatagctatagt

SEQ ID NO: 9452062 - DNA, 22 bp, Homo sapiens
cagggtggtaccagcatctagt

SEQ ID NO: 9452063 - DNA, 22 bp, Homo sapiens
cagggtggtaccagcatctagt

SEQ ID NO: 9452064 - DNA, 22 bp, Homo sapiens
cagggtggtaccagcatctagt

SEQ ID NO: 9452065 - DNA, 22 bp, Homo sapiens
cagggtggggctggctatcaaa

SEQ ID NO: 9452066 - DNA, 22 bp, Homo sapiens
cagggtggtaccagcatctagt

SEQ ID NO: 9452067 - DNA, 22 bp, Homo sapiens
cagggtggggctggctatcaaa

SEQ ID NO: 9452068 - DNA, 22 bp, Homo sapiens
cagggtggggctggctatcaaa

SEQ ID NO: 9452069 - DNA, 22 bp, Homo sapiens
cagggtgctgcaccatccctca

SEQ ID NO: 9452070 - DNA, 22 bp, Homo sapiens
cagggtgcttagaaatggacct

SEQ ID NO: 9452071 - DNA, 22 bp, Homo sapiens
cagggtgctgcaccatccctca

SEQ ID NO: 9452072 - DNA, 22 bp, Homo sapiens
aggaaacaggcagcctttgaac

SEQ ID NO: 9452073 - DNA, 22 bp, Homo sapiens
aggaaacagagtgaagcttggg

SEQ ID NO: 9452074 - DNA, 22 bp, Homo sapiens
aggaaacagtgaacttggcagg

SEQ ID NO: 9452075 - DNA, 22 bp, Homo sapiens
aggaaacagttggtaatgcata

SEQ ID NO: 9452076 - DNA, 22 bp, Homo sapiens
aggaaacagttggtaatgcata

SEQ ID NO: 9452077 - DNA, 22 bp, Homo sapiens
aggaaacatccttatctattct

SEQ ID NO: 9452078 - DNA, 22 bp, Homo sapiens
aggaaacatccttatctattct

SEQ ID NO: 9452079 - DNA, 22 bp, Homo sapiens
aggaaacatccttatctattct

SEQ ID NO: 9452080 - DNA, 22 bp, Homo sapiens
cagggtgcgggagatgtgcacc

SEQ ID NO: 9452081 - DNA, 17 bp, Homo sapiens
aggaaacattttctttc

SEQ ID NO: 9452082 - DNA, 17 bp, Homo sapiens
aggaaacattttctttc

SEQ ID NO: 9452083 - DNA, 22 bp, Homo sapiens
aggaaacattgatattgggaaa

SEQ ID NO: 9452084 - DNA, 22 bp, Homo sapiens
aggaaacatgaatctgccttga

SEQ ID NO: 9452085 - DNA, 22 bp, Homo sapiens
aggaaacatgaatctgccttga

SEQ ID NO: 9452086 - DNA, 22 bp, Homo sapiens
aggaaacatgaatctgccttga

SEQ ID NO: 9452087 - DNA, 22 bp, Homo sapiens
aggaaacatccttatctattct

SEQ ID NO: 9452088 - DNA, 22 bp, Homo sapiens
aggaaacatccttatctattct

SEQ ID NO: 9452089 - DNA, 22 bp, Homo sapiens
aggaaacatccttatctattct

SEQ ID NO: 9452090 - DNA, 22 bp, Homo sapiens
cagttctcttgatcgtctcttg

SEQ ID NO: 9452091 - DNA, 22 bp, Homo sapiens
cagttctctgtgcctcgctggg

SEQ ID NO: 9452092 - DNA, 21 bp, Homo sapiens
cagttctcttagatttccagt

SEQ ID NO: 9452093 - DNA, 22 bp, Homo sapiens
cagttctacttggatgtctgca

SEQ ID NO: 9452094 - DNA, 22 bp, Homo sapiens
cagttcccttcttctggcccct

SEQ ID NO: 9452095 - DNA, 22 bp, Homo sapiens
cagttcccttcttctggcccct

SEQ ID NO: 9452096 - DNA, 22 bp, Homo sapiens
catcacatttaattaaaatgtc

SEQ ID NO: 9452097 - DNA, 22 bp, Homo sapiens
catcacatttaaggggaaggac

SEQ ID NO: 9452098 - DNA, 22 bp, Homo sapiens
catcacatttaattaaaatgtc

SEQ ID NO: 9452099 - DNA, 22 bp, Homo sapiens
cagttctgactttcataatgtc

SEQ ID NO: 9452100 - DNA, 22 bp, Homo sapiens
cagttctctttccactggaggc

SEQ ID NO: 9452101 - DNA, 22 bp, Homo sapiens
cagttctctttccactggaggc

SEQ ID NO: 9452102 - DNA, 22 bp, Homo sapiens
catattttagttgctgaacagc

SEQ ID NO: 9452103 - DNA, 22 bp, Homo sapiens
catattttagttgctgaacagc

SEQ ID NO: 9452104 - DNA, 22 bp, Homo sapiens
cagttattttgaggattaaatg

SEQ ID NO: 9452105 - DNA, 22 bp, Homo sapiens
cagttattatgaggtcattagg

SEQ ID NO: 9452106 - DNA, 22 bp, Homo sapiens
cagttataggagccattgtata

SEQ ID NO: 9452107 - DNA, 22 bp, Homo sapiens
cagttataagactaagctattc

SEQ ID NO: 9452108 - DNA, 22 bp, Homo sapiens
cagttataggagccattgtata

SEQ ID NO: 9452109 - DNA, 22 bp, Homo sapiens
cagttcaagagaaatactactg

SEQ ID NO: 9452110 - DNA, 22 bp, Homo sapiens
cagttcaaagttaagcagcagt

SEQ ID NO: 9452111 - DNA, 22 bp, Homo sapiens
cagttcagactacccacattgt

SEQ ID NO: 9452112 - DNA, 22 bp, Homo sapiens
cagttcaggtgcattagtaatc

SEQ ID NO: 9452113 - DNA, 22 bp, Homo sapiens
cagttcaggccggctgactcag

SEQ ID NO: 9452114 - DNA, 22 bp, Homo sapiens
aggaggctgggcacagtggcct

SEQ ID NO: 9452115 - DNA, 22 bp, Homo sapiens
aggaggctgggcacagtggcct

SEQ ID NO: 9452116 - DNA, 22 bp, Homo sapiens
aggaggctggttcaggccatat

SEQ ID NO: 9452117 - DNA, 22 bp, Homo sapiens
aggaggctgggcacagtggcct

SEQ ID NO: 9452118 - DNA, 22 bp, Homo sapiens
aggaggctgcaaccctgaggcc

SEQ ID NO: 9452119 - DNA, 22 bp, Homo sapiens
aggaggctgggcacagtggcct

SEQ ID NO: 9452120 - DNA, 22 bp, Homo sapiens
aggaggctgggcacagtggcct

SEQ ID NO: 9452121 - DNA, 22 bp, Homo sapiens
catcagacctgccagactaggt

SEQ ID NO: 9452122 - DNA, 23 bp, Homo sapiens
catcagaggttgccactccctgg

SEQ ID NO: 9452123 - DNA, 23 bp, Homo sapiens
catcagaggttgccactccctgg

SEQ ID NO: 9452124 - DNA, 22 bp, Homo sapiens
catcagaggtacttaatgaatg

SEQ ID NO: 9452125 - DNA, 22 bp, Homo sapiens
aggaggctgcaaccctgaggcc

SEQ ID NO: 9452126 - DNA, 22 bp, Homo sapiens
aggaggctgcaaccctgaggcc

SEQ ID NO: 9452127 - DNA, 22 bp, Homo sapiens
aggaggctgcaaccctgaggcc

SEQ ID NO: 9452128 - DNA, 22 bp, Homo sapiens
catcagaagatggctctggaaa

SEQ ID NO: 9452129 - DNA, 22 bp, Homo sapiens
catcagaagatggctctggaaa

SEQ ID NO: 9452130 - DNA, 22 bp, Homo sapiens
catcacttttaaaggtgatcga

SEQ ID NO: 9452131 - DNA, 22 bp, Homo sapiens
catcactgtcaccatctttcct

SEQ ID NO: 9452132 - DNA, 22 bp, Homo sapiens
aggagtggtgcaggacctgcca

SEQ ID NO: 9452133 - DNA, 22 bp, Homo sapiens
aggagtgggggcgagaagttaa

SEQ ID NO: 9452134 - DNA, 22 bp, Homo sapiens
aggagtggtgcaggacctgcca

SEQ ID NO: 9452135 - DNA, 22 bp, Homo sapiens
aggagtggtgcaggacctgcca

SEQ ID NO: 9452136 - DNA, 22 bp, Homo sapiens
catcattttgtatccaagggga

SEQ ID NO: 9452137 - DNA, 22 bp, Homo sapiens
catcattttattaaccaagaaa

SEQ ID NO: 9452138 - DNA, 22 bp, Homo sapiens
catcatttttgtaagctggtag

SEQ ID NO: 9452139 - DNA, 22 bp, Homo sapiens
aggagtgggggcgagaagttaa

SEQ ID NO: 9452140 - DNA, 22 bp, Homo sapiens
aggagtatctaataatctgaga

SEQ ID NO: 9452141 - DNA, 22 bp, Homo sapiens
aggagtcacctgcccaaagtca

SEQ ID NO: 9452142 - DNA, 22 bp, Homo sapiens
aggagtggaattactgggttct

SEQ ID NO: 9452143 - DNA, 22 bp, Homo sapiens
aggaggtgttgatagaaggttt

SEQ ID NO: 9452144 - DNA, 22 bp, Homo sapiens
catcatttcacttagatgaagt

SEQ ID NO: 9452145 - DNA, 22 bp, Homo sapiens
catcatttcacttagatgaagt

SEQ ID NO: 9452146 - DNA, 22 bp, Homo sapiens
catcatttaattataggggctg

SEQ ID NO: 9452147 - DNA, 23 bp, Homo sapiens
catcattgttatgggtgctacta

SEQ ID NO: 9452148 - DNA, 22 bp, Homo sapiens
catcattgttagggactctaac

SEQ ID NO: 9452149 - DNA, 22 bp, Homo sapiens
catcattaccatcattagtagt

SEQ ID NO: 9452150 - DNA, 22 bp, Homo sapiens
aggaggtgagcggtcatgtggt

SEQ ID NO: 9452151 - DNA, 20 bp, Homo sapiens
catcattttaaaatctctcc

SEQ ID NO: 9452152 - DNA, 22 bp, Homo sapiens
catcattttattaaccaagaaa

SEQ ID NO: 9452153 - DNA, 22 bp, Homo sapiens
catcatttgtttgcatgcagga

SEQ ID NO: 9452154 - DNA, 22 bp, Homo sapiens
catcatttgttcacttgattcc

SEQ ID NO: 9452155 - DNA, 22 bp, Homo sapiens
catcatttgttcacttgattcc

SEQ ID NO: 9452156 - DNA, 22 bp, Homo sapiens
aggaggctggttcaggccatat

SEQ ID NO: 9452157 - DNA, 22 bp, Homo sapiens
aggaggctggttcaggccatat

SEQ ID NO: 9452158 - DNA, 22 bp, Homo sapiens
aggaggctggttcaggccatat

SEQ ID NO: 9452159 - DNA, 22 bp, Homo sapiens
aggaggggcaatgatagtctgg

SEQ ID NO: 9452160 - DNA, 22 bp, Homo sapiens
aggaggggcaatgatagtctgg

SEQ ID NO: 9452161 - DNA, 22 bp, Homo sapiens
aggaggggcaatgatagtctgg

SEQ ID NO: 9452162 - DNA, 22 bp, Homo sapiens
aggaggctggttcaggccatat

SEQ ID NO: 9452163 - DNA, 22 bp, Homo sapiens
aggagggtgggaagcagtttta

SEQ ID NO: 9452164 - DNA, 22 bp, Homo sapiens
aggagggtggggtctgcctgtc

SEQ ID NO: 9452165 - DNA, 22 bp, Homo sapiens
aggagggttctctggacagagg

SEQ ID NO: 9452166 - DNA, 22 bp, Homo sapiens
aggaggtcagagccccatgctg

SEQ ID NO: 9452167 - DNA, 22 bp, Homo sapiens
aggaggtgacagcctgcatctg

SEQ ID NO: 9452168 - DNA, 22 bp, Homo sapiens
aggaggtgacagcctgcatctg

SEQ ID NO: 9452169 - DNA, 22 bp, Homo sapiens
aggaggtgacagcctgcatctg

SEQ ID NO: 9452170 - DNA, 22 bp, Homo sapiens
aggaggtgagcggtcatgtggt

SEQ ID NO: 9452171 - DNA, 22 bp, Homo sapiens
aggaggtgagcggtcatgtggt

SEQ ID NO: 9452172 - DNA, 20 bp, Homo sapiens
aggaggtcaaatggaatctg

SEQ ID NO: 9452173 - DNA, 22 bp, Homo sapiens
aggagggttctctggacagagg

SEQ ID NO: 9452174 - DNA, 22 bp, Homo sapiens
aggagctggcctagaaaggaga

SEQ ID NO: 9452175 - DNA, 22 bp, Homo sapiens
aggagctgggagaaggactaaa

SEQ ID NO: 9452176 - DNA, 22 bp, Homo sapiens
aggagctgggagaaggactaaa

SEQ ID NO: 9452177 - DNA, 22 bp, Homo sapiens
aggagctgggcccaaggatgct

SEQ ID NO: 9452178 - DNA, 22 bp, Homo sapiens
aggagctgggagaaggactaaa

SEQ ID NO: 9452179 - DNA, 22 bp, Homo sapiens
aggagctgggagaaggactaaa

SEQ ID NO: 9452180 - DNA, 22 bp, Homo sapiens
aggagctgggcccaaggatgct

SEQ ID NO: 9452181 - DNA, 22 bp, Homo sapiens
aggagctgggcccaaggatgct

SEQ ID NO: 9452182 - DNA, 22 bp, Homo sapiens
aggagctgggctgctgctggga

SEQ ID NO: 9452183 - DNA, 22 bp, Homo sapiens
aggagctgggctgctgctggga

SEQ ID NO: 9452184 - DNA, 22 bp, Homo sapiens
aggagctgggctgctgctggga

SEQ ID NO: 9452185 - DNA, 17 bp, Homo sapiens
aggagctgggggtggtg

SEQ ID NO: 9452186 - DNA, 17 bp, Homo sapiens
aggagctgggggtggtg

SEQ ID NO: 9452187 - DNA, 22 bp, Homo sapiens
cagtggaatatataggggattt

SEQ ID NO: 9452188 - DNA, 22 bp, Homo sapiens
cagtggaatacgagcagatgtc

SEQ ID NO: 9452189 - DNA, 22 bp, Homo sapiens
cagtggaagctggctgtgaaga

SEQ ID NO: 9452190 - DNA, 22 bp, Homo sapiens
cagtggaaatattggcagcatc

SEQ ID NO: 9452191 - DNA, 23 bp, Homo sapiens
cagtggagactcatgcttcctta

SEQ ID NO: 9452192 - DNA, 23 bp, Homo sapiens
cagtggagactcatgcttcctta

SEQ ID NO: 9452193 - DNA, 22 bp, Homo sapiens
aggagctggccactaggatgca

SEQ ID NO: 9452194 - DNA, 22 bp, Homo sapiens
aggagctgatagtctatggaga

SEQ ID NO: 9452195 - DNA, 22 bp, Homo sapiens
aggagctgatagtctatggaga

SEQ ID NO: 9452196 - DNA, 22 bp, Homo sapiens
aggagctggccactaggatgca

SEQ ID NO: 9452197 - DNA, 22 bp, Homo sapiens
aggagctggccactaggatgca

SEQ ID NO: 9452198 - DNA, 22 bp, Homo sapiens
aggagctggccactaggatgca

SEQ ID NO: 9452199 - DNA, 22 bp, Homo sapiens
aggagctggcctagaaaggaga

SEQ ID NO: 9452200 - DNA, 22 bp, Homo sapiens
cagtggaaatcagagtgagagt

SEQ ID NO: 9452201 - DNA, 22 bp, Homo sapiens
cagtggaaactatgctgctgga

SEQ ID NO: 9452202 - DNA, 22 bp, Homo sapiens
cagtgcttttcaaagttctatg

SEQ ID NO: 9452203 - DNA, 22 bp, Homo sapiens
cagtgcttttttaccttccaac

SEQ ID NO: 9452204 - DNA, 22 bp, Homo sapiens
cagtgcttttcaaagttctatg

SEQ ID NO: 9452205 - DNA, 22 bp, Homo sapiens
cagtgctttgggaggctgagga

SEQ ID NO: 9452206 - DNA, 22 bp, Homo sapiens
cagtgcttggggagcggagaga

SEQ ID NO: 9452207 - DNA, 20 bp, Homo sapiens
cagtgcttcctcctttcttt

SEQ ID NO: 9452208 - DNA, 17 bp, Homo sapiens
cagtgcttctgcttctt

SEQ ID NO: 9452209 - DNA, 22 bp, Homo sapiens
aggagccacctaggagctgttt

SEQ ID NO: 9452210 - DNA, 22 bp, Homo sapiens
aggagccaagatgctgtctggc

SEQ ID NO: 9452211 - DNA, 22 bp, Homo sapiens
aggagccaagatggggcaagta

SEQ ID NO: 9452212 - DNA, 22 bp, Homo sapiens
aggagccaagatggggcaagta

SEQ ID NO: 9452213 - DNA, 22 bp, Homo sapiens
aggagccaaattttagactctg

SEQ ID NO: 9452214 - DNA, 22 bp, Homo sapiens
aggagccaaattttagactctg

SEQ ID NO: 9452215 - DNA, 22 bp, Homo sapiens
aggagccaaattttagactctg

SEQ ID NO: 9452216 - DNA, 22 bp, Homo sapiens
aggagccaaggaaaacagtatt

SEQ ID NO: 9452217 - DNA, 22 bp, Homo sapiens
aggagccaaggaaaacagtatt

SEQ ID NO: 9452218 - DNA, 22 bp, Homo sapiens
aggagccaagcagaactaagga

SEQ ID NO: 9452219 - DNA, 20 bp, Homo sapiens
aggagatgatccagagtcag

SEQ ID NO: 9452220 - DNA, 22 bp, Homo sapiens
aggagcagattggtaagatcat

SEQ ID NO: 9452221 - DNA, 22 bp, Homo sapiens
aggagcagattggtaagatcat

SEQ ID NO: 9452222 - DNA, 22 bp, Homo sapiens
aggagcagcccactcctgtcct

SEQ ID NO: 9452223 - DNA, 22 bp, Homo sapiens
aggagcagcccactcctgtcct

SEQ ID NO: 9452224 - DNA, 22 bp, Homo sapiens
aggagcagcccactcctgtcct

SEQ ID NO: 9452225 - DNA, 22 bp, Homo sapiens
aggagcagcccactcctgtcct

SEQ ID NO: 9452226 - DNA, 22 bp, Homo sapiens
aggagcagcccactcctgtcct

SEQ ID NO: 9452227 - DNA, 22 bp, Homo sapiens
aggagccaaaagctgaacaaga

SEQ ID NO: 9452228 - DNA, 22 bp, Homo sapiens
aggagcagcttctgaaccatgt

SEQ ID NO: 9452229 - DNA, 21 bp, Homo sapiens
aggagcattgttgtggtggag

SEQ ID NO: 9452230 - DNA, 22 bp, Homo sapiens
aggagcagcttctgaaccatgt

SEQ ID NO: 9452231 - DNA, 22 bp, Homo sapiens
aggagcagcttctgaaccatgt

SEQ ID NO: 9452232 - DNA, 22 bp, Homo sapiens
aggagcagcttctgaaccatgt

SEQ ID NO: 9452233 - DNA, 22 bp, Homo sapiens
aggagccaaacatattgagaga

SEQ ID NO: 9452234 - DNA, 22 bp, Homo sapiens
aggagccaaattactagctctg

SEQ ID NO: 9452235 - DNA, 22 bp, Homo sapiens
aggagccaaacatattgagaga

SEQ ID NO: 9452236 - DNA, 22 bp, Homo sapiens
aggagccaaattactagctctg

SEQ ID NO: 9452237 - DNA, 20 bp, Homo sapiens
aggagatgatccagagtcag

SEQ ID NO: 9452238 - DNA, 23 bp, Homo sapiens
cagtgcagggcaactcagactcc

SEQ ID NO: 9452239 - DNA, 23 bp, Homo sapiens
cagtgcagggcaactcagactcc

SEQ ID NO: 9452240 - DNA, 22 bp, Homo sapiens
cagtgcagctgccccgctggta

SEQ ID NO: 9452241 - DNA, 22 bp, Homo sapiens
cagtgcaggaagtgagatgcct

SEQ ID NO: 9452242 - DNA, 22 bp, Homo sapiens
cagtgcaggctgggggccctgc

SEQ ID NO: 9452243 - DNA, 22 bp, Homo sapiens
cagtgcaggaagtgagatgcct

SEQ ID NO: 9452244 - DNA, 22 bp, Homo sapiens
cagtgagggcattcagtgctgg

SEQ ID NO: 9452245 - DNA, 22 bp, Homo sapiens
cagtgagggcattcagtgctgg

SEQ ID NO: 9452246 - DNA, 22 bp, Homo sapiens
cagtgagggcattcagtgctgg

SEQ ID NO: 9452247 - DNA, 22 bp, Homo sapiens
cagtgagggaagatctcagcac

SEQ ID NO: 9452248 - DNA, 22 bp, Homo sapiens
cagtgagggcattcagtgctgg

SEQ ID NO: 9452249 - DNA, 22 bp, Homo sapiens
cagtgcagccaaggacaggcac

SEQ ID NO: 9452250 - DNA, 22 bp, Homo sapiens
cagtgagggcccccttccaggt

SEQ ID NO: 9452251 - DNA, 22 bp, Homo sapiens
cagtgagggaagatctcagcac

SEQ ID NO: 9452252 - DNA, 22 bp, Homo sapiens
cagtgagggaagatctcagcac

SEQ ID NO: 9452253 - DNA, 22 bp, Homo sapiens
cagtgagggaagatctcagcac

SEQ ID NO: 9452254 - DNA, 22 bp, Homo sapiens
cagtgaggctctgctgagcggt

SEQ ID NO: 9452255 - DNA, 22 bp, Homo sapiens
cagtgaggctctgctgagcggt

SEQ ID NO: 9452256 - DNA, 22 bp, Homo sapiens
cagtgaggctctgctgagcggt

SEQ ID NO: 9452257 - DNA, 17 bp, Homo sapiens
cagtgaggcctttcctc

SEQ ID NO: 9452258 - DNA, 21 bp, Homo sapiens
cagtgaggccctcctgttccc

SEQ ID NO: 9452259 - DNA, 21 bp, Homo sapiens
cagtgaggccctcctgttccc

SEQ ID NO: 9452260 - DNA, 22 bp, Homo sapiens
aggaattactcatctgtggtat

SEQ ID NO: 9452261 - DNA, 22 bp, Homo sapiens
aggaattactcatctgtggtat

SEQ ID NO: 9452262 - DNA, 22 bp, Homo sapiens
aggaattatagtagtatttgtc

SEQ ID NO: 9452263 - DNA, 22 bp, Homo sapiens
aggaattatttgtcttagtctt

SEQ ID NO: 9452264 - DNA, 22 bp, Homo sapiens
aggaattatttgtcttagtctt

SEQ ID NO: 9452265 - DNA, 22 bp, Homo sapiens
aggaattcaagaccagctgggc

SEQ ID NO: 9452266 - DNA, 22 bp, Homo sapiens
aggaattcaagaccagctgggc

SEQ ID NO: 9452267 - DNA, 22 bp, Homo sapiens
aggaattgagatcctaggtttt

SEQ ID NO: 9452268 - DNA, 22 bp, Homo sapiens
aggaattctgtctctagacatt

SEQ ID NO: 9452269 - DNA, 22 bp, Homo sapiens
aggaatttggggttacatgatg

SEQ ID NO: 9452270 - DNA, 22 bp, Homo sapiens
aggacaagacaaggaccagaga

SEQ ID NO: 9452271 - DNA, 22 bp, Homo sapiens
cagtctcttttcagctccatcc

SEQ ID NO: 9452272 - DNA, 22 bp, Homo sapiens
aggacaaaggaccagatctgga

SEQ ID NO: 9452273 - DNA, 22 bp, Homo sapiens
aggacaaaggaccagatctgga

SEQ ID NO: 9452274 - DNA, 22 bp, Homo sapiens
cagtgaggagtccagggcagag

SEQ ID NO: 9452275 - DNA, 22 bp, Homo sapiens
cagtgaggatgataattaaggt

SEQ ID NO: 9452276 - DNA, 22 bp, Homo sapiens
cagtgaggatgataattaaggt

SEQ ID NO: 9452277 - DNA, 18 bp, Homo sapiens
cagtgaggatgaagggtt

SEQ ID NO: 9452278 - DNA, 22 bp, Homo sapiens
cagtgaggagtccagggcagag

SEQ ID NO: 9452279 - DNA, 22 bp, Homo sapiens
cagtgaggagtccagggcagag

SEQ ID NO: 9452280 - DNA, 22 bp, Homo sapiens
aggcagctttctggtgcaccat

SEQ ID NO: 9452281 - DNA, 22 bp, Homo sapiens
aggcagctttgtagtaaagcta

SEQ ID NO: 9452282 - DNA, 22 bp, Homo sapiens
ccaaaaggaactttttgaaggt

SEQ ID NO: 9452283 - DNA, 22 bp, Homo sapiens
aggcagctttaactggtagtag

SEQ ID NO: 9452284 - DNA, 22 bp, Homo sapiens
aggcagctttaactggtagtag

SEQ ID NO: 9452285 - DNA, 22 bp, Homo sapiens
aggcagcttctgattagcagcg

SEQ ID NO: 9452286 - DNA, 22 bp, Homo sapiens
aggcagcttctgattagcagcg

SEQ ID NO: 9452287 - DNA, 22 bp, Homo sapiens
aggcagcttctgattagcagcg

SEQ ID NO: 9452288 - DNA, 22 bp, Homo sapiens
aggcagctttaactggtagtag

SEQ ID NO: 9452289 - DNA, 22 bp, Homo sapiens
aggcagctgtgaggactggatt

SEQ ID NO: 9452290 - DNA, 20 bp, Homo sapiens
aggcagctgggaaatgaggg

SEQ ID NO: 9452291 - DNA, 23 bp, Homo sapiens
aggcagctgggtagcatctttct

SEQ ID NO: 9452292 - DNA, 22 bp, Homo sapiens
aggcagctgtgaggactggatt

SEQ ID NO: 9452293 - DNA, 20 bp, Homo sapiens
aggcagctggccaggcaggt

SEQ ID NO: 9452294 - DNA, 22 bp, Homo sapiens
aggcagctggcaaattctagag

SEQ ID NO: 9452295 - DNA, 22 bp, Homo sapiens
aggcagctggcaaattctagag

SEQ ID NO: 9452296 - DNA, 22 bp, Homo sapiens
aggcagctggcagcacccaggg

SEQ ID NO: 9452297 - DNA, 22 bp, Homo sapiens
aggcagcgtagcaaggctagta

SEQ ID NO: 9452298 - DNA, 19 bp, Homo sapiens
aggcagaggcttggctagc

SEQ ID NO: 9452299 - DNA, 19 bp, Homo sapiens
aggcagaggcttggctagc

SEQ ID NO: 9452300 - DNA, 20 bp, Homo sapiens
aggcagagcgcacttttaga

SEQ ID NO: 9452301 - DNA, 22 bp, Homo sapiens
aggcagagctaggaagaattgt

SEQ ID NO: 9452302 - DNA, 23 bp, Homo sapiens
aggcagagccaaggtcaaaaccc

SEQ ID NO: 9452303 - DNA, 20 bp, Homo sapiens
aggcagagcgcacttttaga

SEQ ID NO: 9452304 - DNA, 20 bp, Homo sapiens
aggcagagcgcacttttaga

SEQ ID NO: 9452305 - DNA, 22 bp, Homo sapiens
aggcagagctgatgttctgtga

SEQ ID NO: 9452306 - DNA, 22 bp, Homo sapiens
aggcagagctgatgttctgtga

SEQ ID NO: 9452307 - DNA, 22 bp, Homo sapiens
aggcagagctaggaagaattgt

SEQ ID NO: 9452308 - DNA, 22 bp, Homo sapiens
aggcagagctgatgttctgtga

SEQ ID NO: 9452309 - DNA, 22 bp, Homo sapiens
aggcagagctgatgttctgtga

SEQ ID NO: 9452310 - DNA, 22 bp, Homo sapiens
aggcagagctgggttttgaaat

SEQ ID NO: 9452311 - DNA, 22 bp, Homo sapiens
aggcagaggaagggtggatttg

SEQ ID NO: 9452312 - DNA, 22 bp, Homo sapiens
aggcagaggaagggtggatttg

SEQ ID NO: 9452313 - DNA, 22 bp, Homo sapiens
aggcagaggaagggtggatttg

SEQ ID NO: 9452314 - DNA, 19 bp, Homo sapiens
aggcagaggcttggctagc

SEQ ID NO: 9452315 - DNA, 22 bp, Homo sapiens
aggcagaggagaatgatcttcc

SEQ ID NO: 9452316 - DNA, 22 bp, Homo sapiens
aggcagaggagaatgatcttcc

SEQ ID NO: 9452317 - DNA, 22 bp, Homo sapiens
aggcaggcctacacaatgggag

SEQ ID NO: 9452318 - DNA, 22 bp, Homo sapiens
aggcaggcctacacaatgggag

SEQ ID NO: 9452319 - DNA, 18 bp, Homo sapiens
aggcaggcggatcacaag

SEQ ID NO: 9452320 - DNA, 22 bp, Homo sapiens
aggcaggccgtgtccctcctca

SEQ ID NO: 9452321 - DNA, 22 bp, Homo sapiens
aggcaggcctacacaatgggag

SEQ ID NO: 9452322 - DNA, 22 bp, Homo sapiens
aggcaggccctgggccatcccg

SEQ ID NO: 9452323 - DNA, 22 bp, Homo sapiens
aggcaggccgtgtccctcctca

SEQ ID NO: 9452324 - DNA, 22 bp, Homo sapiens
aggcaggccctgggccatcccg

SEQ ID NO: 9452325 - DNA, 22 bp, Homo sapiens
aggcaggccctgggccatcccg

SEQ ID NO: 9452326 - DNA, 22 bp, Homo sapiens
aggcaggccctctggaaaggta

SEQ ID NO: 9452327 - DNA, 22 bp, Homo sapiens
aggcaggccctctggaaaggta

SEQ ID NO: 9452328 - DNA, 22 bp, Homo sapiens
aggcaggccctctggaaaggta

SEQ ID NO: 9452329 - DNA, 22 bp, Homo sapiens
aggcaggctcaatgcccagtct

SEQ ID NO: 9452330 - DNA, 22 bp, Homo sapiens
aggcaggctcaggcccatgctt

SEQ ID NO: 9452331 - DNA, 22 bp, Homo sapiens
aggcaggctagtcgcttgagcc

SEQ ID NO: 9452332 - DNA, 22 bp, Homo sapiens
aggcaggctagtcgcttgagcc

SEQ ID NO: 9452333 - DNA, 22 bp, Homo sapiens
aggcaggctagtcgcttgagcc

SEQ ID NO: 9452334 - DNA, 22 bp, Homo sapiens
aggcaggctctgggtatgtgca

SEQ ID NO: 9452335 - DNA, 22 bp, Homo sapiens
aggcaggctctgggtatgtgca

SEQ ID NO: 9452336 - DNA, 22 bp, Homo sapiens
aggcaggctcaggcccatgctt

SEQ ID NO: 9452337 - DNA, 22 bp, Homo sapiens
ccaaaatattagtgcttaagta

SEQ ID NO: 9452338 - DNA, 22 bp, Homo sapiens
ccaaaatattagtgcttaagta

SEQ ID NO: 9452339 - DNA, 22 bp, Homo sapiens
ccaaaataacagcccaattcac

SEQ ID NO: 9452340 - DNA, 22 bp, Homo sapiens
ccaaaataacagcccaattcac

SEQ ID NO: 9452341 - DNA, 22 bp, Homo sapiens
ccaaaataacagcccaattcac

SEQ ID NO: 9452342 - DNA, 22 bp, Homo sapiens
ccaaaataacagcccaattcac

SEQ ID NO: 9452343 - DNA, 22 bp, Homo sapiens
ccaaaatgtttgaatgcatgtg

SEQ ID NO: 9452344 - DNA, 22 bp, Homo sapiens
ccaaaatattagtgcttaagta

SEQ ID NO: 9452345 - DNA, 22 bp, Homo sapiens
ccaaaatattagtgcttaagta

SEQ ID NO: 9452346 - DNA, 22 bp, Homo sapiens
ccaaaattaagcctcttatgtt

SEQ ID NO: 9452347 - DNA, 22 bp, Homo sapiens
ccaaaattaagcctcttatgtt

SEQ ID NO: 9452348 - DNA, 22 bp, Homo sapiens
ccaaagaaacccaagctcaggg

SEQ ID NO: 9452349 - DNA, 22 bp, Homo sapiens
ccaaaattattacatttgtagg

SEQ ID NO: 9452350 - DNA, 22 bp, Homo sapiens
ccaaaattattacatttgtagg

SEQ ID NO: 9452351 - DNA, 22 bp, Homo sapiens
ccaaacaaatccccattcttag

SEQ ID NO: 9452352 - DNA, 22 bp, Homo sapiens
ccaaacatttcaaatttagaga

SEQ ID NO: 9452353 - DNA, 21 bp, Homo sapiens
aggcaggattcaaacacagag

SEQ ID NO: 9452354 - DNA, 23 bp, Homo sapiens
aggcaggcagttcagctgttgtt

SEQ ID NO: 9452355 - DNA, 22 bp, Homo sapiens
aggcaggcccctgagaatagac

SEQ ID NO: 9452356 - DNA, 23 bp, Homo sapiens
aggcaggcagttcagctgttgtt

SEQ ID NO: 9452357 - DNA, 22 bp, Homo sapiens
aggcaggcccctgagaatagac

SEQ ID NO: 9452358 - DNA, 22 bp, Homo sapiens
aggcaggcccctgagaatagac

SEQ ID NO: 9452359 - DNA, 22 bp, Homo sapiens
aggcaggcccctgagaatagac

SEQ ID NO: 9452360 - DNA, 22 bp, Homo sapiens
aggcaggcccctgagaatagac

SEQ ID NO: 9452361 - DNA, 21 bp, Homo sapiens
ccaaagaactgccatttgtca

SEQ ID NO: 9452362 - DNA, 18 bp, Homo sapiens
aggcaggatcctggcctc

SEQ ID NO: 9452363 - DNA, 20 bp, Homo sapiens
aggcacagttcctagttggg

SEQ ID NO: 9452364 - DNA, 20 bp, Homo sapiens
aggcacagttcctagttggg

SEQ ID NO: 9452365 - DNA, 22 bp, Homo sapiens
aggcacagtggctcacacctgt

SEQ ID NO: 9452366 - DNA, 22 bp, Homo sapiens
aggcacagtggctcacacctgt

SEQ ID NO: 9452367 - DNA, 22 bp, Homo sapiens
aggcacagtggctcacacctgt

SEQ ID NO: 9452368 - DNA, 22 bp, Homo sapiens
aggcacagtgcctggaatcaaa

SEQ ID NO: 9452369 - DNA, 22 bp, Homo sapiens
aggcacagtggctcacacctgt

SEQ ID NO: 9452370 - DNA, 22 bp, Homo sapiens
aggcacagtggccctgtttggg

SEQ ID NO: 9452371 - DNA, 22 bp, Homo sapiens
aggcacagtgcctggaatcaaa

SEQ ID NO: 9452372 - DNA, 22 bp, Homo sapiens
aggcacagtgcctggaatcaaa

SEQ ID NO: 9452373 - DNA, 22 bp, Homo sapiens
aggcacagtgcctggaatcaaa

SEQ ID NO: 9452374 - DNA, 19 bp, Homo sapiens
aggcacaggttgtctggac

SEQ ID NO: 9452375 - DNA, 19 bp, Homo sapiens
aggcacaggttgtctggac

SEQ ID NO: 9452376 - DNA, 22 bp, Homo sapiens
aggcacaggtggacttcacagt

SEQ ID NO: 9452377 - DNA, 19 bp, Homo sapiens
aggcacaggttgtctggac

SEQ ID NO: 9452378 - DNA, 19 bp, Homo sapiens
aggcacaggttgtctggac

SEQ ID NO: 9452379 - DNA, 22 bp, Homo sapiens
aggcactgaagtggtaaatgta

SEQ ID NO: 9452380 - DNA, 22 bp, Homo sapiens
aggcactgaatatccagtaaaa

SEQ ID NO: 9452381 - DNA, 22 bp, Homo sapiens
aggcactgaaggaagcttgcgc

SEQ ID NO: 9452382 - DNA, 22 bp, Homo sapiens
aggcactgaaggaagcttgcgc

SEQ ID NO: 9452383 - DNA, 22 bp, Homo sapiens
aggcactgaaggaagcttgcgc

SEQ ID NO: 9452384 - DNA, 22 bp, Homo sapiens
aggcactgaagtggtaaatgta

SEQ ID NO: 9452385 - DNA, 22 bp, Homo sapiens
aggcactgaaaggtggccagag

SEQ ID NO: 9452386 - DNA, 22 bp, Homo sapiens
aggcactgaaaggtggccagag

SEQ ID NO: 9452387 - DNA, 20 bp, Homo sapiens
aggcacagttcctagttggg

SEQ ID NO: 9452388 - DNA, 22 bp, Homo sapiens
aggcactgaaaggtggccagag

SEQ ID NO: 9452389 - DNA, 22 bp, Homo sapiens
aggcactgaaaggtggccagag

SEQ ID NO: 9452390 - DNA, 22 bp, Homo sapiens
aggcactgaaaggtggccagag

SEQ ID NO: 9452391 - DNA, 22 bp, Homo sapiens
aggcactgaagaactctttttg

SEQ ID NO: 9452392 - DNA, 22 bp, Homo sapiens
aggcactgaaaggtggccagag

SEQ ID NO: 9452393 - DNA, 22 bp, Homo sapiens
aggcactgactcaagggagcca

SEQ ID NO: 9452394 - DNA, 22 bp, Homo sapiens
aggcactgagaggctgtgttgc

SEQ ID NO: 9452395 - DNA, 22 bp, Homo sapiens
aggcactgacctgcttccttga

SEQ ID NO: 9452396 - DNA, 22 bp, Homo sapiens
aggcactgactcaagggagcca

SEQ ID NO: 9452397 - DNA, 22 bp, Homo sapiens
aggcactgacaattctggactg

SEQ ID NO: 9452398 - DNA, 22 bp, Homo sapiens
aggcactgacagattctgtgtc

SEQ ID NO: 9452399 - DNA, 22 bp, Homo sapiens
aggcactgacagattctgtgtc

SEQ ID NO: 9452400 - DNA, 22 bp, Homo sapiens
aggcactgacaattctggactg

SEQ ID NO: 9452401 - DNA, 22 bp, Homo sapiens
aggcactgacaattctggactg

SEQ ID NO: 9452402 - DNA, 23 bp, Homo sapiens
aggcactgaatgtgtcagtgagt

SEQ ID NO: 9452403 - DNA, 23 bp, Homo sapiens
aggcactgaatgtgtcagtgagt

SEQ ID NO: 9452404 - DNA, 22 bp, Homo sapiens
aggcagagagcagtggccgtct

SEQ ID NO: 9452405 - DNA, 22 bp, Homo sapiens
aggcagagagcagtggccgtct

SEQ ID NO: 9452406 - DNA, 22 bp, Homo sapiens
aggcactgattctcagagttac

SEQ ID NO: 9452407 - DNA, 22 bp, Homo sapiens
aggcactgattctcagagttac

SEQ ID NO: 9452408 - DNA, 22 bp, Homo sapiens
aggcactgattctgttttccat

SEQ ID NO: 9452409 - DNA, 22 bp, Homo sapiens
aggcactttaggatcaggttga

SEQ ID NO: 9452410 - DNA, 22 bp, Homo sapiens
aggcactttccttgaggagttt

SEQ ID NO: 9452411 - DNA, 22 bp, Homo sapiens
aggcactttctgtatgctagtt

SEQ ID NO: 9452412 - DNA, 22 bp, Homo sapiens
catgtgtgaatcttgtgatcat

SEQ ID NO: 9452413 - DNA, 22 bp, Homo sapiens
catgtgtgaatcttgtgatcat

SEQ ID NO: 9452414 - DNA, 22 bp, Homo sapiens
catgtgtcctagctattctcct

SEQ ID NO: 9452415 - DNA, 22 bp, Homo sapiens
catgtgtctaatctactaatat

SEQ ID NO: 9452416 - DNA, 22 bp, Homo sapiens
catgtccttctcattgcctcat

SEQ ID NO: 9452417 - DNA, 22 bp, Homo sapiens
catgtccttctcattgcctcat

SEQ ID NO: 9452418 - DNA, 22 bp, Homo sapiens
catgtgtccacccttgaacaca

SEQ ID NO: 9452419 - DNA, 22 bp, Homo sapiens
catgtctgagtagagtgtgatt

SEQ ID NO: 9452420 - DNA, 22 bp, Homo sapiens
aggatgaataactgaaatggtg

SEQ ID NO: 9452421 - DNA, 22 bp, Homo sapiens
aggatgaatatttagtgggata

SEQ ID NO: 9452422 - DNA, 22 bp, Homo sapiens
catgtgtgacaaactgcctgca

SEQ ID NO: 9452423 - DNA, 23 bp, Homo sapiens
catgtgtgacagtatcactgttt

SEQ ID NO: 9452424 - DNA, 22 bp, Homo sapiens
catgtgtgacaaactgcctgca

SEQ ID NO: 9452425 - DNA, 22 bp, Homo sapiens
catgtgtggtctgtggctatct

SEQ ID NO: 9452426 - DNA, 22 bp, Homo sapiens
aggcacagggatgcggagccag

SEQ ID NO: 9452427 - DNA, 22 bp, Homo sapiens
aggcacaggtggacttcacagt

SEQ ID NO: 9452428 - DNA, 22 bp, Homo sapiens
aggcacagggatgcggagccag

SEQ ID NO: 9452429 - DNA, 22 bp, Homo sapiens
aggagttatggcagaatcaaat

SEQ ID NO: 9452430 - DNA, 22 bp, Homo sapiens
aggagtttcaaagcttccatgt

SEQ ID NO: 9452431 - DNA, 22 bp, Homo sapiens
aggataaattctccaaagtgtg

SEQ ID NO: 9452432 - DNA, 22 bp, Homo sapiens
aggataaaggtcattattccca

SEQ ID NO: 9452433 - DNA, 22 bp, Homo sapiens
aggataattggcatttgtaggc

SEQ ID NO: 9452434 - DNA, 22 bp, Homo sapiens
aggatcagtgaatactcagggt

SEQ ID NO: 9452435 - DNA, 22 bp, Homo sapiens
aggatcaggccctctagggtag

SEQ ID NO: 9452436 - DNA, 22 bp, Homo sapiens
aggatataaaaagactatttgg

SEQ ID NO: 9452437 - DNA, 22 bp, Homo sapiens
aggatataaaaagactatttgg

SEQ ID NO: 9452438 - DNA, 22 bp, Homo sapiens
aggatagaagccccatgttctt

SEQ ID NO: 9452439 - DNA, 22 bp, Homo sapiens
aggatctgggtattccttttct

SEQ ID NO: 9452440 - DNA, 22 bp, Homo sapiens
aggatctgttgaataaatttga

SEQ ID NO: 9452441 - DNA, 23 bp, Homo sapiens
aggatcctggtacaggagcagag

SEQ ID NO: 9452442 - DNA, 22 bp, Homo sapiens
ccctgatggcacagtggcaggc

SEQ ID NO: 9452443 - DNA, 22 bp, Homo sapiens
ccctcccaggagtggccagaga

SEQ ID NO: 9452444 - DNA, 22 bp, Homo sapiens
ccctgcacagcctggctctctt

SEQ ID NO: 9452445 - DNA, 22 bp, Homo sapiens
ccctgatgttttctctgccttt

SEQ ID NO: 9452446 - DNA, 22 bp, Homo sapiens
ccctcccagatgggcttgaggt

SEQ ID NO: 9452447 - DNA, 22 bp, Homo sapiens
ccctcccaggagtggccagaga

SEQ ID NO: 9452448 - DNA, 22 bp, Homo sapiens
ccctcccagatgggcttgaggt

SEQ ID NO: 9452449 - DNA, 22 bp, Homo sapiens
ccctcccagatgggcttgaggt

SEQ ID NO: 9452450 - DNA, 22 bp, Homo sapiens
ccctgcagtgtgacctcaccta

SEQ ID NO: 9452451 - DNA, 22 bp, Homo sapiens
ccctgcacagcctggctctctt

SEQ ID NO: 9452452 - DNA, 23 bp, Homo sapiens
ccctgcatctgtccctcaccagt

SEQ ID NO: 9452453 - DNA, 22 bp, Homo sapiens
ccctgccaatcccgtctctctg

SEQ ID NO: 9452454 - DNA, 22 bp, Homo sapiens
ccctcccaagcactctgacata

SEQ ID NO: 9452455 - DNA, 22 bp, Homo sapiens
ccctcccaagcactctgacata

SEQ ID NO: 9452456 - DNA, 20 bp, Homo sapiens
ccctcccagatgcttcccaa

SEQ ID NO: 9452457 - DNA, 20 bp, Homo sapiens
ccctcccagatgcttcccaa

SEQ ID NO: 9452458 - DNA, 20 bp, Homo sapiens
ccctcccagatgcttcccaa

SEQ ID NO: 9452459 - DNA, 22 bp, Homo sapiens
ccctcagctcaagcccctgtgc

SEQ ID NO: 9452460 - DNA, 22 bp, Homo sapiens
ccctcactctgcctcctggggt

SEQ ID NO: 9452461 - DNA, 22 bp, Homo sapiens
ccctcagagcctgaagcaagca

SEQ ID NO: 9452462 - DNA, 22 bp, Homo sapiens
ccctcagagcctgaagcaagca

SEQ ID NO: 9452463 - DNA, 22 bp, Homo sapiens
ccctccattaaaacagacctat

SEQ ID NO: 9452464 - DNA, 22 bp, Homo sapiens
ccctgctgcatggcctccacga

SEQ ID NO: 9452465 - DNA, 22 bp, Homo sapiens
ccctgctgccttcacccaggac

SEQ ID NO: 9452466 - DNA, 22 bp, Homo sapiens
ccctgctgcaggcttcaggagg

SEQ ID NO: 9452467 - DNA, 22 bp, Homo sapiens
ccctgctgtcaggtgctgggag

SEQ ID NO: 9452468 - DNA, 22 bp, Homo sapiens
ccctgctgtccctcagtcctgc

SEQ ID NO: 9452469 - DNA, 22 bp, Homo sapiens
ccctgctgtccctcagtcctgc

SEQ ID NO: 9452470 - DNA, 22 bp, Homo sapiens
ccctgctgtgtagcggaggaac

SEQ ID NO: 9452471 - DNA, 22 bp, Homo sapiens
ccctgctgtgcctgactgccat

SEQ ID NO: 9452472 - DNA, 22 bp, Homo sapiens
ccctgctgtgcctgactgccat

SEQ ID NO: 9452473 - DNA, 22 bp, Homo sapiens
ccctgctgtgcctgactgccat

SEQ ID NO: 9452474 - DNA, 22 bp, Homo sapiens
ccctgctgtgtcccacctggaa

SEQ ID NO: 9452475 - DNA, 22 bp, Homo sapiens
ccctgctgtgtcccacctggaa

SEQ ID NO: 9452476 - DNA, 22 bp, Homo sapiens
ccctgcccaccacatgctggga

SEQ ID NO: 9452477 - DNA, 22 bp, Homo sapiens
ccctgccagggtcctgacagac

SEQ ID NO: 9452478 - DNA, 18 bp, Homo sapiens
ccctgccagctcccagca

SEQ ID NO: 9452479 - DNA, 22 bp, Homo sapiens
cccatggggacaccatgaagga

SEQ ID NO: 9452480 - DNA, 22 bp, Homo sapiens
cccatggggacaccatgaagga

SEQ ID NO: 9452481 - DNA, 22 bp, Homo sapiens
cccatggcttaggagggagtgt

SEQ ID NO: 9452482 - DNA, 22 bp, Homo sapiens
cccatgctgagtggcctgagat

SEQ ID NO: 9452483 - DNA, 22 bp, Homo sapiens
cccatgctgagtggcctgagat

SEQ ID NO: 9452484 - DNA, 22 bp, Homo sapiens
cccatggagtgcctgagggcca

SEQ ID NO: 9452485 - DNA, 22 bp, Homo sapiens
cccatgctgagtggcctgagat

SEQ ID NO: 9452486 - DNA, 22 bp, Homo sapiens
cccatgagtgctgctcagaggc

SEQ ID NO: 9452487 - DNA, 22 bp, Homo sapiens
cccatgagtgctgctcagaggc

SEQ ID NO: 9452488 - DNA, 22 bp, Homo sapiens
cccatgcaccctctaagaagga

SEQ ID NO: 9452489 - DNA, 22 bp, Homo sapiens
cccatgcaccctctaagaagga

SEQ ID NO: 9452490 - DNA, 22 bp, Homo sapiens
cccatgagattctgaatttggc

SEQ ID NO: 9452491 - DNA, 22 bp, Homo sapiens
ccccagaagtttgcacaagaga

SEQ ID NO: 9452492 - DNA, 22 bp, Homo sapiens
ccccagaagtttgcacaagaga

SEQ ID NO: 9452493 - DNA, 22 bp, Homo sapiens
ccccagagaaagtcagcagcat

SEQ ID NO: 9452494 - DNA, 22 bp, Homo sapiens
ccccagagaaagtcagcagcat

SEQ ID NO: 9452495 - DNA, 22 bp, Homo sapiens
ccccagagtgagggattgagtg

SEQ ID NO: 9452496 - DNA, 22 bp, Homo sapiens
ccccagagagcaccatgaagcc

SEQ ID NO: 9452497 - DNA, 22 bp, Homo sapiens
ccccagagagcaccatgaagcc

SEQ ID NO: 9452498 - DNA, 22 bp, Homo sapiens
ccccagagagcaccatgaagcc

SEQ ID NO: 9452499 - DNA, 22 bp, Homo sapiens
ccccagagagcaccatgaagcc

SEQ ID NO: 9452500 - DNA, 22 bp, Homo sapiens
cccattcatcctcgcttccttc

SEQ ID NO: 9452501 - DNA, 22 bp, Homo sapiens
cccattcatcctcgcttccttc

SEQ ID NO: 9452502 - DNA, 22 bp, Homo sapiens
ccccactttgagtagcacttga

SEQ ID NO: 9452503 - DNA, 22 bp, Homo sapiens
ccccacttgctcagcatgtcca

SEQ ID NO: 9452504 - DNA, 22 bp, Homo sapiens
ccccagaaggggacagagggta

SEQ ID NO: 9452505 - DNA, 22 bp, Homo sapiens
ccccagaaggggacagagggta

SEQ ID NO: 9452506 - DNA, 22 bp, Homo sapiens
ccccagcactaccagaagccag

SEQ ID NO: 9452507 - DNA, 22 bp, Homo sapiens
ccccagcacaggctcctcagat

SEQ ID NO: 9452508 - DNA, 22 bp, Homo sapiens
ccccagcacaggctcctcagat

SEQ ID NO: 9452509 - DNA, 21 bp, Homo sapiens
ccccagcaccttgccagcctg

SEQ ID NO: 9452510 - DNA, 21 bp, Homo sapiens
ccccagcaccttgccagcctg

SEQ ID NO: 9452511 - DNA, 22 bp, Homo sapiens
ccctagggctaagcaggactgc

SEQ ID NO: 9452512 - DNA, 22 bp, Homo sapiens
ccctagggctaagcaggactgc

SEQ ID NO: 9452513 - DNA, 22 bp, Homo sapiens
ccctaggggcaatgatggtgct

SEQ ID NO: 9452514 - DNA, 22 bp, Homo sapiens
ccctaggggcaatgatggtgct

SEQ ID NO: 9452515 - DNA, 22 bp, Homo sapiens
ccctagggtttggccagagccc

SEQ ID NO: 9452516 - DNA, 22 bp, Homo sapiens
ccctagggtttggccagagccc

SEQ ID NO: 9452517 - DNA, 22 bp, Homo sapiens
ccctagggtttggccagagccc

SEQ ID NO: 9452518 - DNA, 22 bp, Homo sapiens
ccctatcctgcaggcctgggct

SEQ ID NO: 9452519 - DNA, 22 bp, Homo sapiens
ccctagtccacaggttcctgga

SEQ ID NO: 9452520 - DNA, 22 bp, Homo sapiens
ccctcacttcacgctctgcaga

SEQ ID NO: 9452521 - DNA, 22 bp, Homo sapiens
ccctcactctgcctcctggggt

SEQ ID NO: 9452522 - DNA, 22 bp, Homo sapiens
ccctcactgtccttgggccctt

SEQ ID NO: 9452523 - DNA, 22 bp, Homo sapiens
ccctcaccaggctccaggcatg

SEQ ID NO: 9452524 - DNA, 22 bp, Homo sapiens
aggctggtgtgtcctgaagcct

SEQ ID NO: 9452525 - DNA, 22 bp, Homo sapiens
aggctggtgtgtcctgaagcct

SEQ ID NO: 9452526 - DNA, 22 bp, Homo sapiens
aggctggtgtgtcctgaagcct

SEQ ID NO: 9452527 - DNA, 22 bp, Homo sapiens
aggctggtgtctctgtcctgtc

SEQ ID NO: 9452528 - DNA, 22 bp, Homo sapiens
aggctggtgtctctgtcctgtc

SEQ ID NO: 9452529 - DNA, 22 bp, Homo sapiens
aggctggtgcctgcagtgaatc

SEQ ID NO: 9452530 - DNA, 22 bp, Homo sapiens
aggctggtgcttcctagggcag

SEQ ID NO: 9452531 - DNA, 22 bp, Homo sapiens
aggctggtgcttcctagggcag

SEQ ID NO: 9452532 - DNA, 22 bp, Homo sapiens
aggctggtgcttcctagggcag

SEQ ID NO: 9452533 - DNA, 22 bp, Homo sapiens
aggctggtgcctgcagtgaatc

SEQ ID NO: 9452534 - DNA, 22 bp, Homo sapiens
aggctggtgattagaagcagcc

SEQ ID NO: 9452535 - DNA, 22 bp, Homo sapiens
aggctggtgattagaagcagcc

SEQ ID NO: 9452536 - DNA, 22 bp, Homo sapiens
aggctggtctgttggcattttt

SEQ ID NO: 9452537 - DNA, 22 bp, Homo sapiens
aggctggtctatacggagacga

SEQ ID NO: 9452538 - DNA, 22 bp, Homo sapiens
aggctggtcccagggagggaat

SEQ ID NO: 9452539 - DNA, 22 bp, Homo sapiens
aggctggtagtatttagtcaca

SEQ ID NO: 9452540 - DNA, 22 bp, Homo sapiens
aggctgggtacctgtcatatgc

SEQ ID NO: 9452541 - DNA, 22 bp, Homo sapiens
aggctgggtacctgtcatatgc

SEQ ID NO: 9452542 - DNA, 22 bp, Homo sapiens
cccaggaatgaggggcggaggc

SEQ ID NO: 9452543 - DNA, 22 bp, Homo sapiens
cccaggaatgagcaggcagggg

SEQ ID NO: 9452544 - DNA, 22 bp, Homo sapiens
aggctgtgaaatgtggcaagga

SEQ ID NO: 9452545 - DNA, 22 bp, Homo sapiens
aggctgtgaaatgtggcaagga

SEQ ID NO: 9452546 - DNA, 22 bp, Homo sapiens
aggctgtgaaatgtggcaagga

SEQ ID NO: 9452547 - DNA, 22 bp, Homo sapiens
aggctgtgaactctatgctgaa

SEQ ID NO: 9452548 - DNA, 22 bp, Homo sapiens
aggctgtgaactctatgctgaa

SEQ ID NO: 9452549 - DNA, 21 bp, Homo sapiens
aggctgtcctttgccagccct

SEQ ID NO: 9452550 - DNA, 21 bp, Homo sapiens
aggctgtcctttgccagccct

SEQ ID NO: 9452551 - DNA, 22 bp, Homo sapiens
aggctgtccaaggtggcgaagt

SEQ ID NO: 9452552 - DNA, 22 bp, Homo sapiens
aggctgtcctctcttgctcagt

SEQ ID NO: 9452553 - DNA, 22 bp, Homo sapiens
aggctgtcttcctccctcttgg

SEQ ID NO: 9452554 - DNA, 22 bp, Homo sapiens
aggctgtctgaccccagagccc

SEQ ID NO: 9452555 - DNA, 22 bp, Homo sapiens
aggctgtctcacctcaggaggg

SEQ ID NO: 9452556 - DNA, 23 bp, Homo sapiens
cccaggagcctgagtcctctctg

SEQ ID NO: 9452557 - DNA, 22 bp, Homo sapiens
cccaggagcttctctctgcctc

SEQ ID NO: 9452558 - DNA, 22 bp, Homo sapiens
cccaggagggtggcctctgccc

SEQ ID NO: 9452559 - DNA, 22 bp, Homo sapiens
cccaggagggtggcctctgccc

SEQ ID NO: 9452560 - DNA, 22 bp, Homo sapiens
cccaggaggtagaggttgcagt

SEQ ID NO: 9452561 - DNA, 22 bp, Homo sapiens
cccaggaggtcaaggctgcagt

SEQ ID NO: 9452562 - DNA, 22 bp, Homo sapiens
cccaggaggtagaggttgcagt

SEQ ID NO: 9452563 - DNA, 22 bp, Homo sapiens
cccaggaggtagaggttgcagt

SEQ ID NO: 9452564 - DNA, 19 bp, Homo sapiens
cccaggagcagtattgatg

SEQ ID NO: 9452565 - DNA, 22 bp, Homo sapiens
cccaggagatggaggttgcagt

SEQ ID NO: 9452566 - DNA, 22 bp, Homo sapiens
cccaggagatgcactccattgg

SEQ ID NO: 9452567 - DNA, 22 bp, Homo sapiens
cccaggagatggaggttgcagt

SEQ ID NO: 9452568 - DNA, 22 bp, Homo sapiens
cccaggagatggaggttgcagt

SEQ ID NO: 9452569 - DNA, 22 bp, Homo sapiens
cccaggagatctggatctcgtc

SEQ ID NO: 9452570 - DNA, 22 bp, Homo sapiens
cccaggagatctggatctcgtc

SEQ ID NO: 9452571 - DNA, 22 bp, Homo sapiens
cccaggagatgcactccattgg

SEQ ID NO: 9452572 - DNA, 22 bp, Homo sapiens
cccaggaatgggaaggaggaat

SEQ ID NO: 9452573 - DNA, 22 bp, Homo sapiens
cccaggaatgggaaggaggaat

SEQ ID NO: 9452574 - DNA, 23 bp, Homo sapiens
cccaggctacaaattatgctctg

SEQ ID NO: 9452575 - DNA, 22 bp, Homo sapiens
cccaggaggtcgaagctgcagt

SEQ ID NO: 9452576 - DNA, 22 bp, Homo sapiens
cccaggaggtcgaagctgcagt

SEQ ID NO: 9452577 - DNA, 22 bp, Homo sapiens
cccaggaggtggagcttgcagt

SEQ ID NO: 9452578 - DNA, 22 bp, Homo sapiens
cccaggaggtggagcttgcagt

SEQ ID NO: 9452579 - DNA, 22 bp, Homo sapiens
cccaggaggtcgaagctgcagt

SEQ ID NO: 9452580 - DNA, 22 bp, Homo sapiens
cccaggaggtcgaagctgcagt

SEQ ID NO: 9452581 - DNA, 22 bp, Homo sapiens
cccaggaggtcgaagctgcagt

SEQ ID NO: 9452582 - DNA, 22 bp, Homo sapiens
cccaggaggtcgaagctgcagt

SEQ ID NO: 9452583 - DNA, 22 bp, Homo sapiens
cccaggaggtcaaggctgcagt

SEQ ID NO: 9452584 - DNA, 22 bp, Homo sapiens
cccaggaggtcaaggctgcagt

SEQ ID NO: 9452585 - DNA, 22 bp, Homo sapiens
cccaggaggtcaaggctgcagt

SEQ ID NO: 9452586 - DNA, 22 bp, Homo sapiens
cccaggaggtcaaggctgcagt

SEQ ID NO: 9452587 - DNA, 22 bp, Homo sapiens
cccaggaggtcaaggctgcagt

SEQ ID NO: 9452588 - DNA, 22 bp, Homo sapiens
cccaggctgcatgagtccatgg

SEQ ID NO: 9452589 - DNA, 22 bp, Homo sapiens
cccaggctgcatgagtccatgg

SEQ ID NO: 9452590 - DNA, 22 bp, Homo sapiens
cccaggctgatgttcagcgggt

SEQ ID NO: 9452591 - DNA, 22 bp, Homo sapiens
cccaggctgatgttcagcgggt

SEQ ID NO: 9452592 - DNA, 22 bp, Homo sapiens
cccaggctgatgttcagcgggt

SEQ ID NO: 9452593 - DNA, 22 bp, Homo sapiens
cccaggctgatgggatgggcca

SEQ ID NO: 9452594 - DNA, 22 bp, Homo sapiens
cccaggctgatgggatgggcca

SEQ ID NO: 9452595 - DNA, 22 bp, Homo sapiens
cccaggctgatgttcagcgggt

SEQ ID NO: 9452596 - DNA, 22 bp, Homo sapiens
cccaggctgatgttcagcgggt

SEQ ID NO: 9452597 - DNA, 22 bp, Homo sapiens
cccaggctgatgttcagcgggt

SEQ ID NO: 9452598 - DNA, 22 bp, Homo sapiens
cccaggctgtctgtcctttgct

SEQ ID NO: 9452599 - DNA, 22 bp, Homo sapiens
cccaggctggtcctgaactcct

SEQ ID NO: 9452600 - DNA, 22 bp, Homo sapiens
cccaggctgtctgtcctttgct

SEQ ID NO: 9452601 - DNA, 22 bp, Homo sapiens
cccaggctgcgtatccacaata

SEQ ID NO: 9452602 - DNA, 22 bp, Homo sapiens
cccaggctgcgtatccacaata

SEQ ID NO: 9452603 - DNA, 22 bp, Homo sapiens
cccaggcttcccaatcagaagg

SEQ ID NO: 9452604 - DNA, 22 bp, Homo sapiens
cccaggctgtgcaaacttcaaa

SEQ ID NO: 9452605 - DNA, 22 bp, Homo sapiens
cccaggctgtgcaaacttcaaa

SEQ ID NO: 9452606 - DNA, 22 bp, Homo sapiens
cccaggctgtgcaaacttcaaa

SEQ ID NO: 9452607 - DNA, 18 bp, Homo sapiens
cccaggctttgtgggtct

SEQ ID NO: 9452608 - DNA, 18 bp, Homo sapiens
cccaggctttgtgggtct

SEQ ID NO: 9452609 - DNA, 22 bp, Homo sapiens
cccaggcttttctcttgcccca

SEQ ID NO: 9452610 - DNA, 22 bp, Homo sapiens
cccaggcttttctcttgcccca

SEQ ID NO: 9452611 - DNA, 22 bp, Homo sapiens
cccaggcttttaagttagacag

SEQ ID NO: 9452612 - DNA, 22 bp, Homo sapiens
cccagtcatcctgcaggtgaaa

SEQ ID NO: 9452613 - DNA, 22 bp, Homo sapiens
cccatccctgattttcactcgt

SEQ ID NO: 9452614 - DNA, 22 bp, Homo sapiens
cccatctcagtcgtgctaaggg

SEQ ID NO: 9452615 - DNA, 22 bp, Homo sapiens
cctgaggtctagagtcagggtg

SEQ ID NO: 9452616 - DNA, 22 bp, Homo sapiens
agggtcaccagttcataggcac

SEQ ID NO: 9452617 - DNA, 22 bp, Homo sapiens
agggtcacaatgtgtgaattgg

SEQ ID NO: 9452618 - DNA, 22 bp, Homo sapiens
agggtcaaaggaaaggcccaca

SEQ ID NO: 9452619 - DNA, 22 bp, Homo sapiens
agggtagggccgtagggccatg

SEQ ID NO: 9452620 - DNA, 22 bp, Homo sapiens
agggtaggtgtaagatagccct

SEQ ID NO: 9452621 - DNA, 22 bp, Homo sapiens
agggtagggtaaatgatgcatc

SEQ ID NO: 9452622 - DNA, 22 bp, Homo sapiens
agggtagggtaaatgatgcatc

SEQ ID NO: 9452623 - DNA, 22 bp, Homo sapiens
agggtagggcccggagacagac

SEQ ID NO: 9452624 - DNA, 22 bp, Homo sapiens
agggtagggcccggagacagac

SEQ ID NO: 9452625 - DNA, 22 bp, Homo sapiens
agggtaggaactgagtggaagg

SEQ ID NO: 9452626 - DNA, 22 bp, Homo sapiens
agggtagggcccggagacagac

SEQ ID NO: 9452627 - DNA, 22 bp, Homo sapiens
agggtaggaactgagtggaagg

SEQ ID NO: 9452628 - DNA, 22 bp, Homo sapiens
aggggtgaaggcccgataggag

SEQ ID NO: 9452629 - DNA, 22 bp, Homo sapiens
agggtagctacccaactccaga

SEQ ID NO: 9452630 - DNA, 22 bp, Homo sapiens
cctgagagtgagtgcctcctta

SEQ ID NO: 9452631 - DNA, 22 bp, Homo sapiens
cctgagagtgagggcctcctta

SEQ ID NO: 9452632 - DNA, 22 bp, Homo sapiens
cctgagagtaggtgtctcttta

SEQ ID NO: 9452633 - DNA, 22 bp, Homo sapiens
cctgagagtgagtgccacctta

SEQ ID NO: 9452634 - DNA, 22 bp, Homo sapiens
cctgaaatccatagtttacact

SEQ ID NO: 9452635 - DNA, 22 bp, Homo sapiens
cctgaaacatcttctgtaaata

SEQ ID NO: 9452636 - DNA, 20 bp, Homo sapiens
cctgaagagtttctctttct

SEQ ID NO: 9452637 - DNA, 22 bp, Homo sapiens
cctgaagatccattatagacac

SEQ ID NO: 9452638 - DNA, 22 bp, Homo sapiens
cctgaagaattcaaatccagat

SEQ ID NO: 9452639 - DNA, 22 bp, Homo sapiens
cctgaagagcactctagagttg

SEQ ID NO: 9452640 - DNA, 22 bp, Homo sapiens
cctgaagagcactctagagttg

SEQ ID NO: 9452641 - DNA, 22 bp, Homo sapiens
cctgaagagtgaatgtggcagt

SEQ ID NO: 9452642 - DNA, 22 bp, Homo sapiens
cctgaagagcactctagagttg

SEQ ID NO: 9452643 - DNA, 22 bp, Homo sapiens
cctgagaggttggcctgtccag

SEQ ID NO: 9452644 - DNA, 22 bp, Homo sapiens
cctgagagggggccctagaaat

SEQ ID NO: 9452645 - DNA, 22 bp, Homo sapiens
cctgagagggggccctagaaat

SEQ ID NO: 9452646 - DNA, 22 bp, Homo sapiens
cctgagaggccctctcactgtc

SEQ ID NO: 9452647 - DNA, 22 bp, Homo sapiens
cctgagaggccctctcactgtc

SEQ ID NO: 9452648 - DNA, 22 bp, Homo sapiens
cctgagaggccctctcactgtc

SEQ ID NO: 9452649 - DNA, 22 bp, Homo sapiens
cctgagagccctagccaggcgc

SEQ ID NO: 9452650 - DNA, 22 bp, Homo sapiens
cctgagagccctagccaggcgc

SEQ ID NO: 9452651 - DNA, 22 bp, Homo sapiens
cctgagagcgagtggcctcatg

SEQ ID NO: 9452652 - DNA, 22 bp, Homo sapiens
cctgagagcgagtggcctcatg

SEQ ID NO: 9452653 - DNA, 22 bp, Homo sapiens
cctgagagcgagtggcctcatg

SEQ ID NO: 9452654 - DNA, 22 bp, Homo sapiens
cctgaagatgctgtggcctggt

SEQ ID NO: 9452655 - DNA, 22 bp, Homo sapiens
cctgagagagtgagccctgaca

SEQ ID NO: 9452656 - DNA, 22 bp, Homo sapiens
cctgagagcagcttcctgctta

SEQ ID NO: 9452657 - DNA, 22 bp, Homo sapiens
cctgagagccctagccaggcgc

SEQ ID NO: 9452658 - DNA, 22 bp, Homo sapiens
cctgagagccagtgcctgccca

SEQ ID NO: 9452659 - DNA, 22 bp, Homo sapiens
cctgagagccagtgcctgccca

SEQ ID NO: 9452660 - DNA, 22 bp, Homo sapiens
cctgagagcattccacactgaa

SEQ ID NO: 9452661 - DNA, 22 bp, Homo sapiens
cctgagagcattccacactgaa

SEQ ID NO: 9452662 - DNA, 22 bp, Homo sapiens
aggggcacgagtagagctctag

SEQ ID NO: 9452663 - DNA, 22 bp, Homo sapiens
aggggcacgagtagagctctag

SEQ ID NO: 9452664 - DNA, 22 bp, Homo sapiens
aggggcactagaatgggagact

SEQ ID NO: 9452665 - DNA, 19 bp, Homo sapiens
aggggcactgtctctagag

SEQ ID NO: 9452666 - DNA, 20 bp, Homo sapiens
aggggcacctgcgacggggc

SEQ ID NO: 9452667 - DNA, 22 bp, Homo sapiens
aggggcaaatgtgagcctggaa

SEQ ID NO: 9452668 - DNA, 20 bp, Homo sapiens
aggggcacctgcgacggggc

SEQ ID NO: 9452669 - DNA, 22 bp, Homo sapiens
aggggatggagctggaaggcag

SEQ ID NO: 9452670 - DNA, 22 bp, Homo sapiens
aggggatgcctgaggatctgta

SEQ ID NO: 9452671 - DNA, 22 bp, Homo sapiens
aggggatgcctagtggagtctc

SEQ ID NO: 9452672 - DNA, 22 bp, Homo sapiens
aggggatgcctgaggatctgta

SEQ ID NO: 9452673 - DNA, 22 bp, Homo sapiens
aggggatgcctgaggatctgta

SEQ ID NO: 9452674 - DNA, 22 bp, Homo sapiens
aggggatggagctggaaggcag

SEQ ID NO: 9452675 - DNA, 22 bp, Homo sapiens
aggggatggagctggaaggcag

SEQ ID NO: 9452676 - DNA, 22 bp, Homo sapiens
aggggatggagctggaaggcag

SEQ ID NO: 9452677 - DNA, 22 bp, Homo sapiens
aggggatggagctggaaggcag

SEQ ID NO: 9452678 - DNA, 22 bp, Homo sapiens
aggggcacttctcaggctgtgg

SEQ ID NO: 9452679 - DNA, 22 bp, Homo sapiens
aggggcacttctcaggctgtgg

SEQ ID NO: 9452680 - DNA, 19 bp, Homo sapiens
aggggcactgtctctagag

SEQ ID NO: 9452681 - DNA, 19 bp, Homo sapiens
aggggcactgtctctagag

SEQ ID NO: 9452682 - DNA, 23 bp, Homo sapiens
aggggcagcaagttttggtgtta

SEQ ID NO: 9452683 - DNA, 23 bp, Homo sapiens
aggggcagcaagttttggtgtta

SEQ ID NO: 9452684 - DNA, 22 bp, Homo sapiens
aggggcagcctcacaatcctct

SEQ ID NO: 9452685 - DNA, 23 bp, Homo sapiens
aggggcagcaagttttggtgtta

SEQ ID NO: 9452686 - DNA, 23 bp, Homo sapiens
aggggcagcaagttttggtgtta

SEQ ID NO: 9452687 - DNA, 23 bp, Homo sapiens
aggggcagcaagttttggtgtta

SEQ ID NO: 9452688 - DNA, 23 bp, Homo sapiens
aggggcagcaagttttggtgtta

SEQ ID NO: 9452689 - DNA, 18 bp, Homo sapiens
aggggcagcttgtgtgga

SEQ ID NO: 9452690 - DNA, 18 bp, Homo sapiens
aggggcagcttgtgtgga

SEQ ID NO: 9452691 - DNA, 22 bp, Homo sapiens
aggggcagcctcacaatcctct

SEQ ID NO: 9452692 - DNA, 22 bp, Homo sapiens
cctgaaaatcaaggtagtttgg

SEQ ID NO: 9452693 - DNA, 22 bp, Homo sapiens
cctgaaacagtccttgccctca

SEQ ID NO: 9452694 - DNA, 22 bp, Homo sapiens
cctgaaacagtccttgccctca

SEQ ID NO: 9452695 - DNA, 22 bp, Homo sapiens
cctcttccactgggccccatcc

SEQ ID NO: 9452696 - DNA, 22 bp, Homo sapiens
cctcttccactgggccccatcc

SEQ ID NO: 9452697 - DNA, 22 bp, Homo sapiens
agggctggccacatgatttggt

SEQ ID NO: 9452698 - DNA, 22 bp, Homo sapiens
agggctggccacatgatttggt

SEQ ID NO: 9452699 - DNA, 22 bp, Homo sapiens
agggctggcatctctaatgctg

SEQ ID NO: 9452700 - DNA, 22 bp, Homo sapiens
agggctggcatctctaatgctg

SEQ ID NO: 9452701 - DNA, 22 bp, Homo sapiens
agggctggcatctctaatgctg

SEQ ID NO: 9452702 - DNA, 22 bp, Homo sapiens
agggctggccacatgatttggt

SEQ ID NO: 9452703 - DNA, 22 bp, Homo sapiens
agggctggccacatgatttggt

SEQ ID NO: 9452704 - DNA, 22 bp, Homo sapiens
agggctggctaggtgcgttccc

SEQ ID NO: 9452705 - DNA, 22 bp, Homo sapiens
agggctggctccgttaccttga

SEQ ID NO: 9452706 - DNA, 22 bp, Homo sapiens
agggctggctccgttaccttga

SEQ ID NO: 9452707 - DNA, 22 bp, Homo sapiens
agggctggctaggtgcgttccc

SEQ ID NO: 9452708 - DNA, 22 bp, Homo sapiens
agggctggctaggtgcgttccc

SEQ ID NO: 9452709 - DNA, 22 bp, Homo sapiens
agggctggctaggtgcgttccc

SEQ ID NO: 9452710 - DNA, 22 bp, Homo sapiens
agggctggctccgttaccttga

SEQ ID NO: 9452711 - DNA, 22 bp, Homo sapiens
agggctggctccgttaccttga

SEQ ID NO: 9452712 - DNA, 22 bp, Homo sapiens
aggggagcaacatagtcactct

SEQ ID NO: 9452713 - DNA, 22 bp, Homo sapiens
aggggagcaacatagtcactct

SEQ ID NO: 9452714 - DNA, 22 bp, Homo sapiens
aggggaggtgtccccaaatctc

SEQ ID NO: 9452715 - DNA, 22 bp, Homo sapiens
aggggaggtgtccccaaatctc

SEQ ID NO: 9452716 - DNA, 22 bp, Homo sapiens
aggggatgatcctcccgcagcg

SEQ ID NO: 9452717 - DNA, 22 bp, Homo sapiens
aggggatgcctagtggagtctc

SEQ ID NO: 9452718 - DNA, 22 bp, Homo sapiens
aggggaggcagcgataaacctg

SEQ ID NO: 9452719 - DNA, 22 bp, Homo sapiens
aggggaggcagcgataaacctg

SEQ ID NO: 9452720 - DNA, 22 bp, Homo sapiens
aggggaggagcttttcttgcct

SEQ ID NO: 9452721 - DNA, 22 bp, Homo sapiens
aggggaggagcttttcttgcct

SEQ ID NO: 9452722 - DNA, 22 bp, Homo sapiens
aggggaggcagcgataaacctg

SEQ ID NO: 9452723 - DNA, 22 bp, Homo sapiens
agggcctggaactggagaccac

SEQ ID NO: 9452724 - DNA, 22 bp, Homo sapiens
agggcctggaactggagaccac

SEQ ID NO: 9452725 - DNA, 22 bp, Homo sapiens
agggcctggaactgtgggcagg

SEQ ID NO: 9452726 - DNA, 22 bp, Homo sapiens
agggcctggaactgtgggcagg

SEQ ID NO: 9452727 - DNA, 22 bp, Homo sapiens
agggcctggaactgtgggcagg

SEQ ID NO: 9452728 - DNA, 22 bp, Homo sapiens
agggcctggaactgtgggcagg

SEQ ID NO: 9452729 - DNA, 22 bp, Homo sapiens
agggcctgctctatcactctca

SEQ ID NO: 9452730 - DNA, 20 bp, Homo sapiens
agggcctgctctgtggtgtc

SEQ ID NO: 9452731 - DNA, 20 bp, Homo sapiens
agggcctgctctgtggtgtc

SEQ ID NO: 9452732 - DNA, 22 bp, Homo sapiens
cctcagcttgatttctgcagag

SEQ ID NO: 9452733 - DNA, 22 bp, Homo sapiens
cctcagcttgatttctgcagag

SEQ ID NO: 9452734 - DNA, 22 bp, Homo sapiens
cctcaggaaccacattgctgct

SEQ ID NO: 9452735 - DNA, 22 bp, Homo sapiens
cctcaggaaatgaataaatggc

SEQ ID NO: 9452736 - DNA, 22 bp, Homo sapiens
cctcagcttgatttctgcagag

SEQ ID NO: 9452737 - DNA, 23 bp, Homo sapiens
agggcctggcgtggagtgtgtgc

SEQ ID NO: 9452738 - DNA, 23 bp, Homo sapiens
agggcctggcgtggagtgtgtgc

SEQ ID NO: 9452739 - DNA, 19 bp, Homo sapiens
cctcagagctagtgaacat

SEQ ID NO: 9452740 - DNA, 22 bp, Homo sapiens
agggcctggcgcgtggccgccg

SEQ ID NO: 9452741 - DNA, 22 bp, Homo sapiens
agggcctggcgcgtggccgccg

SEQ ID NO: 9452742 - DNA, 23 bp, Homo sapiens
agggcctggcgtggagtgtgtgc

SEQ ID NO: 9452743 - DNA, 23 bp, Homo sapiens
agggcctggcgtggagtgtgtgc

SEQ ID NO: 9452744 - DNA, 20 bp, Homo sapiens
agggcctggagtacagcagg

SEQ ID NO: 9452745 - DNA, 22 bp, Homo sapiens
agggcctggactaattggatcc

SEQ ID NO: 9452746 - DNA, 22 bp, Homo sapiens
ccctggaacccatggccagtgt

SEQ ID NO: 9452747 - DNA, 22 bp, Homo sapiens
ccctggaaatgaggcatgtgcg

SEQ ID NO: 9452748 - DNA, 22 bp, Homo sapiens
ccctgctttgcacccaggctgg

SEQ ID NO: 9452749 - DNA, 22 bp, Homo sapiens
ccctgcttccgctgttttctca

SEQ ID NO: 9452750 - DNA, 23 bp, Homo sapiens
ccctggaacttcactcatgcaca

SEQ ID NO: 9452751 - DNA, 22 bp, Homo sapiens
ccctggaagagcctgggcatgg

SEQ ID NO: 9452752 - DNA, 22 bp, Homo sapiens
ccctggaactcctaggcaagca

SEQ ID NO: 9452753 - DNA, 22 bp, Homo sapiens
agggcctgagctctcctccagt

SEQ ID NO: 9452754 - DNA, 22 bp, Homo sapiens
agggcctgagctctcctccagt

SEQ ID NO: 9452755 - DNA, 22 bp, Homo sapiens
agggcctgagctggctgacctc

SEQ ID NO: 9452756 - DNA, 19 bp, Homo sapiens
agggcctgcagctcaagct

SEQ ID NO: 9452757 - DNA, 19 bp, Homo sapiens
agggcctgcagctcaagct

SEQ ID NO: 9452758 - DNA, 22 bp, Homo sapiens
agggcctgcatcaggagcttgg

SEQ ID NO: 9452759 - DNA, 22 bp, Homo sapiens
agggctggagccacagctggga

SEQ ID NO: 9452760 - DNA, 22 bp, Homo sapiens
agggctggagccacagctggga

SEQ ID NO: 9452761 - DNA, 22 bp, Homo sapiens
agggctggagggtactagttta

SEQ ID NO: 9452762 - DNA, 22 bp, Homo sapiens
agggctggagggtactagttta

SEQ ID NO: 9452763 - DNA, 22 bp, Homo sapiens
agggctggagccacagctggga

SEQ ID NO: 9452764 - DNA, 22 bp, Homo sapiens
agggctggagccacagctggga

SEQ ID NO: 9452765 - DNA, 22 bp, Homo sapiens
agggctggagccacagctggga

SEQ ID NO: 9452766 - DNA, 22 bp, Homo sapiens
agggctggcaagggattgaaat

SEQ ID NO: 9452767 - DNA, 22 bp, Homo sapiens
agggctggcaagggattgaaat

SEQ ID NO: 9452768 - DNA, 22 bp, Homo sapiens
agggctggcaagggattgaaat

SEQ ID NO: 9452769 - DNA, 22 bp, Homo sapiens
agggctggagggtactagttta

SEQ ID NO: 9452770 - DNA, 22 bp, Homo sapiens
agggctggagggtactagttta

SEQ ID NO: 9452771 - DNA, 22 bp, Homo sapiens
agggctggcatctctaatgctg

SEQ ID NO: 9452772 - DNA, 22 bp, Homo sapiens
agggctggcatctctaatgctg

SEQ ID NO: 9452773 - DNA, 22 bp, Homo sapiens
agggctggcatctctaatgctg

SEQ ID NO: 9452774 - DNA, 22 bp, Homo sapiens
agggctggcaagggattgaaat

SEQ ID NO: 9452775 - DNA, 22 bp, Homo sapiens
agggctggcaagggattgaaat

SEQ ID NO: 9452776 - DNA, 22 bp, Homo sapiens
agggctggcaagggattgaaat

SEQ ID NO: 9452777 - DNA, 22 bp, Homo sapiens
agggctggcaagggattgaaat

SEQ ID NO: 9452778 - DNA, 22 bp, Homo sapiens
agggctgctgctccgggcccag

SEQ ID NO: 9452779 - DNA, 22 bp, Homo sapiens
agggctgctgctccgggcccag

SEQ ID NO: 9452780 - DNA, 22 bp, Homo sapiens
agggctgctgaggaagccttgc

SEQ ID NO: 9452781 - DNA, 22 bp, Homo sapiens
agggctgcatctgcctggtgaa

SEQ ID NO: 9452782 - DNA, 22 bp, Homo sapiens
agggctgcatctgcctggtgaa

SEQ ID NO: 9452783 - DNA, 22 bp, Homo sapiens
agggctgcatctgcctggtgaa

SEQ ID NO: 9452784 - DNA, 22 bp, Homo sapiens
agggctgcatctgcctggtgaa

SEQ ID NO: 9452785 - DNA, 22 bp, Homo sapiens
agggctagagttgagatgggga

SEQ ID NO: 9452786 - DNA, 22 bp, Homo sapiens
agggcgtggtggtgctggagca

SEQ ID NO: 9452787 - DNA, 23 bp, Homo sapiens
agggctagcattgagtacccact

SEQ ID NO: 9452788 - DNA, 22 bp, Homo sapiens
agggctgcagtcctaaggtgct

SEQ ID NO: 9452789 - DNA, 22 bp, Homo sapiens
agggctgctttgctaaatatgg

SEQ ID NO: 9452790 - DNA, 22 bp, Homo sapiens
agggctgcttacctggaatggc

SEQ ID NO: 9452791 - DNA, 22 bp, Homo sapiens
agggctgcttacctggaatggc

SEQ ID NO: 9452792 - DNA, 22 bp, Homo sapiens
agggctgcttacctggaatggc

SEQ ID NO: 9452793 - DNA, 22 bp, Homo sapiens
agggctggagccacagctggga

SEQ ID NO: 9452794 - DNA, 22 bp, Homo sapiens
agggctggagccacagctggga

SEQ ID NO: 9452795 - DNA, 22 bp, Homo sapiens
agggctggagccacagctggga

SEQ ID NO: 9452796 - DNA, 22 bp, Homo sapiens
agggctggagccacagctggga

SEQ ID NO: 9452797 - DNA, 22 bp, Homo sapiens
agggctggagccacagctggga

SEQ ID NO: 9452798 - DNA, 20 bp, Homo sapiens
cctcaggccagttttaaagt

SEQ ID NO: 9452799 - DNA, 22 bp, Homo sapiens
cctcaggccagggggcggccag

SEQ ID NO: 9452800 - DNA, 22 bp, Homo sapiens
cctcaggccagggggcggccag

SEQ ID NO: 9452801 - DNA, 22 bp, Homo sapiens
cctcaggcagtggtatggatgg

SEQ ID NO: 9452802 - DNA, 22 bp, Homo sapiens
cctcaggccagggggcggccag

SEQ ID NO: 9452803 - DNA, 22 bp, Homo sapiens
cctcaggcctctgcctcattgg

SEQ ID NO: 9452804 - DNA, 22 bp, Homo sapiens
cctcaggccctgtccctgcgcc

SEQ ID NO: 9452805 - DNA, 22 bp, Homo sapiens
cctcaggccctgtccctgcgcc

SEQ ID NO: 9452806 - DNA, 22 bp, Homo sapiens
cctcaggcaggaaactgtcccg

SEQ ID NO: 9452807 - DNA, 22 bp, Homo sapiens
cctcaggcaggaaactgtcccg

SEQ ID NO: 9452808 - DNA, 22 bp, Homo sapiens
cctcaggcaggaaactgtcccg

SEQ ID NO: 9452809 - DNA, 22 bp, Homo sapiens
cctcaggcaggaaactgtcccg

SEQ ID NO: 9452810 - DNA, 22 bp, Homo sapiens
cctcaggcaagtcacttaacat

SEQ ID NO: 9452811 - DNA, 22 bp, Homo sapiens
cctcaggcaagtcacttaacat

SEQ ID NO: 9452812 - DNA, 22 bp, Homo sapiens
cctcaggatccgcaggtgcagt

SEQ ID NO: 9452813 - DNA, 22 bp, Homo sapiens
cctcaggatacaggagccacag

SEQ ID NO: 9452814 - DNA, 22 bp, Homo sapiens
cctcaggatacaggagccacag

SEQ ID NO: 9452815 - DNA, 22 bp, Homo sapiens
cctcaggatacaggagccacag

SEQ ID NO: 9452816 - DNA, 22 bp, Homo sapiens
agggcgtggtggtgctggagca

SEQ ID NO: 9452817 - DNA, 19 bp, Homo sapiens
agggcgtggtggcacatgt

SEQ ID NO: 9452818 - DNA, 19 bp, Homo sapiens
agggcgtggtggcacatgt

SEQ ID NO: 9452819 - DNA, 22 bp, Homo sapiens
agggcgctgaaatactaacatg

SEQ ID NO: 9452820 - DNA, 22 bp, Homo sapiens
agggcgcctgctgtggccaccg

SEQ ID NO: 9452821 - DNA, 22 bp, Homo sapiens
agggcgcctgctgtggccaccg

SEQ ID NO: 9452822 - DNA, 22 bp, Homo sapiens
agggcgcatctctggggtgaat

SEQ ID NO: 9452823 - DNA, 22 bp, Homo sapiens
agggcgaggagacggaggcaca

SEQ ID NO: 9452824 - DNA, 22 bp, Homo sapiens
agggcgaggagacggaggcaca

SEQ ID NO: 9452825 - DNA, 22 bp, Homo sapiens
agggcgacaatggagagcgttt

SEQ ID NO: 9452826 - DNA, 22 bp, Homo sapiens
agggcgacaatggagagcgttt

SEQ ID NO: 9452827 - DNA, 22 bp, Homo sapiens
agggccttgctgtctgaagctg

SEQ ID NO: 9452828 - DNA, 22 bp, Homo sapiens
aggctggaaagggaccagagtg

SEQ ID NO: 9452829 - DNA, 22 bp, Homo sapiens
aggctggaaagggaccagagtg

SEQ ID NO: 9452830 - DNA, 22 bp, Homo sapiens
aggctgcttcagctgcagggag

SEQ ID NO: 9452831 - DNA, 22 bp, Homo sapiens
aggctgctcagtagatggagct

SEQ ID NO: 9452832 - DNA, 22 bp, Homo sapiens
aggctgcttcttgtccttggca

SEQ ID NO: 9452833 - DNA, 22 bp, Homo sapiens
aggctgctttattcacaatagc

SEQ ID NO: 9452834 - DNA, 22 bp, Homo sapiens
ccaggtcttcactttactgaag

SEQ ID NO: 9452835 - DNA, 22 bp, Homo sapiens
ccaggtcttcactttactgaag

SEQ ID NO: 9452836 - DNA, 22 bp, Homo sapiens
ccaggtcttcactttactgaag

SEQ ID NO: 9452837 - DNA, 22 bp, Homo sapiens
ccaggtctgtcttcttagctca

SEQ ID NO: 9452838 - DNA, 22 bp, Homo sapiens
ccaggtctgtcttcttagctca

SEQ ID NO: 9452839 - DNA, 22 bp, Homo sapiens
ccaggtctggcactggccagtc

SEQ ID NO: 9452840 - DNA, 19 bp, Homo sapiens
ccaggtctggggccagatt

SEQ ID NO: 9452841 - DNA, 21 bp, Homo sapiens
ccaggtcttggtccttggact

SEQ ID NO: 9452842 - DNA, 22 bp, Homo sapiens
ccaggtcttggcccccggacct

SEQ ID NO: 9452843 - DNA, 21 bp, Homo sapiens
ccaggtcttggtccttggact

SEQ ID NO: 9452844 - DNA, 22 bp, Homo sapiens
ccaggtcttgtttgacatcaat

SEQ ID NO: 9452845 - DNA, 22 bp, Homo sapiens
ccaggtctttgactaatatgct

SEQ ID NO: 9452846 - DNA, 22 bp, Homo sapiens
ccaggtctttgactaatatgct

SEQ ID NO: 9452847 - DNA, 22 bp, Homo sapiens
ccaggtctttggccttggcact

SEQ ID NO: 9452848 - DNA, 22 bp, Homo sapiens
aggctggagtgcaatggcgtga

SEQ ID NO: 9452849 - DNA, 22 bp, Homo sapiens
aggctggagtgcagtggcgtga

SEQ ID NO: 9452850 - DNA, 22 bp, Homo sapiens
aggctggagtgcaatggcgtga

SEQ ID NO: 9452851 - DNA, 22 bp, Homo sapiens
aggctggagtgctggagtgctg

SEQ ID NO: 9452852 - DNA, 22 bp, Homo sapiens
aggctggagtgtagcagtgcag

SEQ ID NO: 9452853 - DNA, 22 bp, Homo sapiens
aggctggccagtgctgcagtgg

SEQ ID NO: 9452854 - DNA, 22 bp, Homo sapiens
aggctggccagtgctgcagtgg

SEQ ID NO: 9452855 - DNA, 22 bp, Homo sapiens
aggctggcccacctcttgtctt

SEQ ID NO: 9452856 - DNA, 22 bp, Homo sapiens
aggctggcccacctcttgtctt

SEQ ID NO: 9452857 - DNA, 22 bp, Homo sapiens
aggctggcccacctcttgtctt

SEQ ID NO: 9452858 - DNA, 22 bp, Homo sapiens
aggctggagggcaatggcaaga

SEQ ID NO: 9452859 - DNA, 22 bp, Homo sapiens
aggctggaggtttgttgcggct

SEQ ID NO: 9452860 - DNA, 22 bp, Homo sapiens
aggctggagcaagggggcatat

SEQ ID NO: 9452861 - DNA, 22 bp, Homo sapiens
aggctggagagtgcagtggcgt

SEQ ID NO: 9452862 - DNA, 19 bp, Homo sapiens
aggctggagacaccaggcc

SEQ ID NO: 9452863 - DNA, 22 bp, Homo sapiens
aggctggagacccgccaagaaa

SEQ ID NO: 9452864 - DNA, 22 bp, Homo sapiens
aggctggagacccgccaagaaa

SEQ ID NO: 9452865 - DNA, 22 bp, Homo sapiens
aggctggagagtgcagtggcgt

SEQ ID NO: 9452866 - DNA, 22 bp, Homo sapiens
ccatttgtggtttatttgctct

SEQ ID NO: 9452867 - DNA, 22 bp, Homo sapiens
ccatttgtggtttatttgctct

SEQ ID NO: 9452868 - DNA, 22 bp, Homo sapiens
ccatttgtcacctctgcactcc

SEQ ID NO: 9452869 - DNA, 22 bp, Homo sapiens
ccatttgtaccatttctttgta

SEQ ID NO: 9452870 - DNA, 22 bp, Homo sapiens
ccatttgtaaccttagagcaat

SEQ ID NO: 9452871 - DNA, 22 bp, Homo sapiens
aggctggctggggatgcgtctt

SEQ ID NO: 9452872 - DNA, 22 bp, Homo sapiens
aggctgggaaggtaaagttgta

SEQ ID NO: 9452873 - DNA, 22 bp, Homo sapiens
aggctgggaaggtaaagttgta

SEQ ID NO: 9452874 - DNA, 22 bp, Homo sapiens
ccatttgttgtgtattaatatt

SEQ ID NO: 9452875 - DNA, 22 bp, Homo sapiens
ccatttgtttcccttgggaaac

SEQ ID NO: 9452876 - DNA, 22 bp, Homo sapiens
ccatttgttttcgctaccatgg

SEQ ID NO: 9452877 - DNA, 22 bp, Homo sapiens
ccatttgttttcgctaccatgg

SEQ ID NO: 9452878 - DNA, 20 bp, Homo sapiens
aggctggggtgttttgccca

SEQ ID NO: 9452879 - DNA, 20 bp, Homo sapiens
aggctggggtgttttgccca

SEQ ID NO: 9452880 - DNA, 22 bp, Homo sapiens
aggctgggtacctgtcatatgc

SEQ ID NO: 9452881 - DNA, 22 bp, Homo sapiens
aggctggggaattgaatttgct

SEQ ID NO: 9452882 - DNA, 22 bp, Homo sapiens
aggctggggaattgaatttgct

SEQ ID NO: 9452883 - DNA, 22 bp, Homo sapiens
aggctggggaattgaatttgct

SEQ ID NO: 9452884 - DNA, 20 bp, Homo sapiens
aggctggggtgttttgccca

SEQ ID NO: 9452885 - DNA, 22 bp, Homo sapiens
aggctgggctccgcccaactcc

SEQ ID NO: 9452886 - DNA, 22 bp, Homo sapiens
aggctggggaattgaatttgct

SEQ ID NO: 9452887 - DNA, 22 bp, Homo sapiens
aggctgggctccgcccaactcc

SEQ ID NO: 9452888 - DNA, 22 bp, Homo sapiens
aggctgggaaggtaaagttgta

SEQ ID NO: 9452889 - DNA, 22 bp, Homo sapiens
aggctgggaaggtaaagttgta

SEQ ID NO: 9452890 - DNA, 22 bp, Homo sapiens
aggctgggcaccgttttgatcc

SEQ ID NO: 9452891 - DNA, 22 bp, Homo sapiens
aggctgggcaccgttttgatcc

SEQ ID NO: 9452892 - DNA, 22 bp, Homo sapiens
aggctgggcaccgttttgatcc

SEQ ID NO: 9452893 - DNA, 22 bp, Homo sapiens
aggctgggctccgcccaactcc

SEQ ID NO: 9452894 - DNA, 22 bp, Homo sapiens
aggctggagtgcagtggtgtga

SEQ ID NO: 9452895 - DNA, 22 bp, Homo sapiens
aggctggccctactggctgcct

SEQ ID NO: 9452896 - DNA, 22 bp, Homo sapiens
aggctggccctactggctgcct

SEQ ID NO: 9452897 - DNA, 22 bp, Homo sapiens
aggctggccctactggctgcct

SEQ ID NO: 9452898 - DNA, 22 bp, Homo sapiens
aggctggcctatttctttatcg

SEQ ID NO: 9452899 - DNA, 17 bp, Homo sapiens
aggctggccttcacagt

SEQ ID NO: 9452900 - DNA, 22 bp, Homo sapiens
aggctggcgacatctggcgggc

SEQ ID NO: 9452901 - DNA, 22 bp, Homo sapiens
aggctggcggtgactgctctga

SEQ ID NO: 9452902 - DNA, 22 bp, Homo sapiens
aggctggcgacatctggcgggc

SEQ ID NO: 9452903 - DNA, 22 bp, Homo sapiens
ccatttatagatgtatttggct

SEQ ID NO: 9452904 - DNA, 22 bp, Homo sapiens
ccatttacattgtactctgtga

SEQ ID NO: 9452905 - DNA, 22 bp, Homo sapiens
ccatttactagggagatctaga

SEQ ID NO: 9452906 - DNA, 22 bp, Homo sapiens
ccatttaacacagagttttcca

SEQ ID NO: 9452907 - DNA, 22 bp, Homo sapiens
ccatttacattgtactctgtga

SEQ ID NO: 9452908 - DNA, 22 bp, Homo sapiens
aggctggcgtcaggggctgtac

SEQ ID NO: 9452909 - DNA, 22 bp, Homo sapiens
aggctggcggtgactgctctga

SEQ ID NO: 9452910 - DNA, 22 bp, Homo sapiens
aggctggcggtgactgctctga

SEQ ID NO: 9452911 - DNA, 22 bp, Homo sapiens
ccaggctgcttagccttatctt

SEQ ID NO: 9452912 - DNA, 22 bp, Homo sapiens
ccaggctgcttagccttatctt

SEQ ID NO: 9452913 - DNA, 22 bp, Homo sapiens
ccaggctggaatcaatattctg

SEQ ID NO: 9452914 - DNA, 22 bp, Homo sapiens
ccaggctgctttattactctgt

SEQ ID NO: 9452915 - DNA, 22 bp, Homo sapiens
ccaggctggaatcaatattctg

SEQ ID NO: 9452916 - DNA, 22 bp, Homo sapiens
ccaggctggagtatagtggcgc

SEQ ID NO: 9452917 - DNA, 22 bp, Homo sapiens
ccaggctggagtatagtggcgc

SEQ ID NO: 9452918 - DNA, 22 bp, Homo sapiens
ccaggctggagtatagtggcgc

SEQ ID NO: 9452919 - DNA, 22 bp, Homo sapiens
ccaggctggtctgaatttctag

SEQ ID NO: 9452920 - DNA, 15 bp, Homo sapiens
ccaggctgggtgagc

SEQ ID NO: 9452921 - DNA, 22 bp, Homo sapiens
ccaggctgggctacaagttgag

SEQ ID NO: 9452922 - DNA, 22 bp, Homo sapiens
ccaggctgggctacaagttgag

SEQ ID NO: 9452923 - DNA, 22 bp, Homo sapiens
ccaggctgggctacaagttgag

SEQ ID NO: 9452924 - DNA, 22 bp, Homo sapiens
ccaggctgggctacaagttgag

SEQ ID NO: 9452925 - DNA, 22 bp, Homo sapiens
ccaggctgggcggggaacctgg

SEQ ID NO: 9452926 - DNA, 22 bp, Homo sapiens
ccaggctgggcggggaacctgg

SEQ ID NO: 9452927 - DNA, 22 bp, Homo sapiens
ccaggctgggcggggaacctgg

SEQ ID NO: 9452928 - DNA, 22 bp, Homo sapiens
ccaggctgggcggggaacctgg

SEQ ID NO: 9452929 - DNA, 21 bp, Homo sapiens
ccaggctgggagggcagttcc

SEQ ID NO: 9452930 - DNA, 21 bp, Homo sapiens
ccaggctgggagggcagttcc

SEQ ID NO: 9452931 - DNA, 22 bp, Homo sapiens
aggctacaaataagcatgtaat

SEQ ID NO: 9452932 - DNA, 22 bp, Homo sapiens
aggctaatatggcacatgaaca

SEQ ID NO: 9452933 - DNA, 22 bp, Homo sapiens
aggctaatatttatgaaaccaa

SEQ ID NO: 9452934 - DNA, 22 bp, Homo sapiens
aggctaatatggcacatgaaca

SEQ ID NO: 9452935 - DNA, 22 bp, Homo sapiens
aggctaagtgggtgtcagggcc

SEQ ID NO: 9452936 - DNA, 22 bp, Homo sapiens
aggctaagatgtggtctgagca

SEQ ID NO: 9452937 - DNA, 22 bp, Homo sapiens
aggctaagtgattagtgacata

SEQ ID NO: 9452938 - DNA, 22 bp, Homo sapiens
aggctaaggtgggaggatcgct

SEQ ID NO: 9452939 - DNA, 19 bp, Homo sapiens
aggctaaagagtcttgcgt

SEQ ID NO: 9452940 - DNA, 19 bp, Homo sapiens
aggctaaagagtcttgcgt

SEQ ID NO: 9452941 - DNA, 22 bp, Homo sapiens
aggcgtgggaggatctgaggcc

SEQ ID NO: 9452942 - DNA, 22 bp, Homo sapiens
aggcgtggttgaggcgagcata

SEQ ID NO: 9452943 - DNA, 22 bp, Homo sapiens
aggcgtggttgaggcgagcata

SEQ ID NO: 9452944 - DNA, 22 bp, Homo sapiens
aggctaaaagagaatcatttag

SEQ ID NO: 9452945 - DNA, 22 bp, Homo sapiens
aggcgtggttgaggcgagcata

SEQ ID NO: 9452946 - DNA, 22 bp, Homo sapiens
aggctacagatacagaggctac

SEQ ID NO: 9452947 - DNA, 22 bp, Homo sapiens
aggctacagcctcaagagtgca

SEQ ID NO: 9452948 - DNA, 22 bp, Homo sapiens
aggctacagatacagaggctac

SEQ ID NO: 9452949 - DNA, 22 bp, Homo sapiens
aggctacatgttggggtggaag

SEQ ID NO: 9452950 - DNA, 22 bp, Homo sapiens
ccaggctgctgttggtgtccgc

SEQ ID NO: 9452951 - DNA, 22 bp, Homo sapiens
ccaggctgctgttggtgtccgc

SEQ ID NO: 9452952 - DNA, 22 bp, Homo sapiens
ccaggctctgcgctggacatgg

SEQ ID NO: 9452953 - DNA, 22 bp, Homo sapiens
ccaggctgctgttggtgtccgc

SEQ ID NO: 9452954 - DNA, 22 bp, Homo sapiens
ccaggctctgcgctggacatgg

SEQ ID NO: 9452955 - DNA, 22 bp, Homo sapiens
aggctgaggatccctgtgttct

SEQ ID NO: 9452956 - DNA, 22 bp, Homo sapiens
aggctgaggatccctgtgttct

SEQ ID NO: 9452957 - DNA, 22 bp, Homo sapiens
aggctgaggatcgtactttcca

SEQ ID NO: 9452958 - DNA, 22 bp, Homo sapiens
aggctgaggatcgtactttcca

SEQ ID NO: 9452959 - DNA, 22 bp, Homo sapiens
aggctgagctgacctggtttgg

SEQ ID NO: 9452960 - DNA, 22 bp, Homo sapiens
aggctgagctgacctggtttgg

SEQ ID NO: 9452961 - DNA, 22 bp, Homo sapiens
ccagggctggtgggagatgctg

SEQ ID NO: 9452962 - DNA, 22 bp, Homo sapiens
ccagggctgggtttgtcggtgt

SEQ ID NO: 9452963 - DNA, 22 bp, Homo sapiens
ccagggctggtggctgcagagg

SEQ ID NO: 9452964 - DNA, 22 bp, Homo sapiens
ccagggctggtggctgcagagg

SEQ ID NO: 9452965 - DNA, 22 bp, Homo sapiens
ccaggtctggaaccaccagggc

SEQ ID NO: 9452966 - DNA, 22 bp, Homo sapiens
ccaggtctggaaccaccagggc

SEQ ID NO: 9452967 - DNA, 22 bp, Homo sapiens
ccaggtctcgggtctgctcgtg

SEQ ID NO: 9452968 - DNA, 22 bp, Homo sapiens
ccaggtctgcgggcggcaggca

SEQ ID NO: 9452969 - DNA, 22 bp, Homo sapiens
ccaggtctcgggtctgctcgtg

SEQ ID NO: 9452970 - DNA, 22 bp, Homo sapiens
aggctgaggcaggtggatcacc

SEQ ID NO: 9452971 - DNA, 22 bp, Homo sapiens
aggctgaggcaggtggatcacc

SEQ ID NO: 9452972 - DNA, 22 bp, Homo sapiens
aggctgaggcaggtggatcacc

SEQ ID NO: 9452973 - DNA, 22 bp, Homo sapiens
aggctgaggcaggtggatcacc

SEQ ID NO: 9452974 - DNA, 22 bp, Homo sapiens
aggctgaggcaagaggatcact

SEQ ID NO: 9452975 - DNA, 22 bp, Homo sapiens
aggctgaggcaagaggatcact

SEQ ID NO: 9452976 - DNA, 22 bp, Homo sapiens
aggctgaggcaggtggatcacc

SEQ ID NO: 9452977 - DNA, 22 bp, Homo sapiens
aggctgaggcaagaggatcact

SEQ ID NO: 9452978 - DNA, 22 bp, Homo sapiens
aggctgaggcaagaggatcact

SEQ ID NO: 9452979 - DNA, 22 bp, Homo sapiens
aggctgaggcaagaggatcact

SEQ ID NO: 9452980 - DNA, 22 bp, Homo sapiens
aggctgaggcaagaggatcact

SEQ ID NO: 9452981 - DNA, 22 bp, Homo sapiens
aggctgaggcaagaggatcact

SEQ ID NO: 9452982 - DNA, 22 bp, Homo sapiens
ccaggctggtctgaatttctag

SEQ ID NO: 9452983 - DNA, 22 bp, Homo sapiens
ccagggcagcgcccctccacgc

SEQ ID NO: 9452984 - DNA, 22 bp, Homo sapiens
ccagggcctcgtgttctgagtg

SEQ ID NO: 9452985 - DNA, 22 bp, Homo sapiens
ccagggcctcgtgttctgagtg

SEQ ID NO: 9452986 - DNA, 22 bp, Homo sapiens
ccagggcctgccacttagcaag

SEQ ID NO: 9452987 - DNA, 22 bp, Homo sapiens
ccagggcctgccacttagcaag

SEQ ID NO: 9452988 - DNA, 22 bp, Homo sapiens
ccagggcctgccacttagcaag

SEQ ID NO: 9452989 - DNA, 22 bp, Homo sapiens
ccagggcctgccacttagcaag

SEQ ID NO: 9452990 - DNA, 23 bp, Homo sapiens
ccagggctacgggcaccgtcctg

SEQ ID NO: 9452991 - DNA, 22 bp, Homo sapiens
ccagggcctgagggcgacgccc

SEQ ID NO: 9452992 - DNA, 22 bp, Homo sapiens
ccagggcctgccacttagcaag

SEQ ID NO: 9452993 - DNA, 22 bp, Homo sapiens
ccagggcctgagggcgacgccc

SEQ ID NO: 9452994 - DNA, 22 bp, Homo sapiens
ccagggctggaccagtgcttgg

SEQ ID NO: 9452995 - DNA, 20 bp, Homo sapiens
ccagggctggctcctgggat

SEQ ID NO: 9452996 - DNA, 20 bp, Homo sapiens
ccagggctggctcctgggat

SEQ ID NO: 9452997 - DNA, 20 bp, Homo sapiens
ccagggctggctcctgggat

SEQ ID NO: 9452998 - DNA, 19 bp, Homo sapiens
ccagggctccaagctgagt

SEQ ID NO: 9452999 - DNA, 22 bp, Homo sapiens
ccagggctccattgctcatcct

SEQ ID NO: 9453000 - DNA, 19 bp, Homo sapiens
ccagggctccaagctgagt

SEQ ID NO: 9453001 - DNA, 19 bp, Homo sapiens
ccagggctccaagctgagt

SEQ ID NO: 9453002 - DNA, 22 bp, Homo sapiens
ccagggctcaggctcccagtgg

SEQ ID NO: 9453003 - DNA, 23 bp, Homo sapiens
ccagggctacgggcaccgtcctg

SEQ ID NO: 9453004 - DNA, 22 bp, Homo sapiens
ccagggctcaggctcccagtgg

SEQ ID NO: 9453005 - DNA, 22 bp, Homo sapiens
ccagggctcaggctcccagtgg

SEQ ID NO: 9453006 - DNA, 22 bp, Homo sapiens
aggcctctgagcagcactcatg

SEQ ID NO: 9453007 - DNA, 22 bp, Homo sapiens
aggcctgctgtcttgaggccaa

SEQ ID NO: 9453008 - DNA, 22 bp, Homo sapiens
aggcctgctgtcttgaggccaa

SEQ ID NO: 9453009 - DNA, 22 bp, Homo sapiens
ccagctggagctcgcagatagg

SEQ ID NO: 9453010 - DNA, 22 bp, Homo sapiens
ccagctggcactgtggctgccc

SEQ ID NO: 9453011 - DNA, 22 bp, Homo sapiens
ccagctggcactgtggctgccc

SEQ ID NO: 9453012 - DNA, 22 bp, Homo sapiens
ccagctggcaggagagtcaggg

SEQ ID NO: 9453013 - DNA, 22 bp, Homo sapiens
ccagctggcaggagagtcaggg

SEQ ID NO: 9453014 - DNA, 22 bp, Homo sapiens
ccagctggcaggagagtcaggg

SEQ ID NO: 9453015 - DNA, 22 bp, Homo sapiens
ccagctggagccaaggtggact

SEQ ID NO: 9453016 - DNA, 22 bp, Homo sapiens
ccagctggagccaaggtggact

SEQ ID NO: 9453017 - DNA, 22 bp, Homo sapiens
ccagctggaagagtgcagaact

SEQ ID NO: 9453018 - DNA, 22 bp, Homo sapiens
ccagctggaagagtgcagaact

SEQ ID NO: 9453019 - DNA, 22 bp, Homo sapiens
ccagctggaaacaaatagagtg

SEQ ID NO: 9453020 - DNA, 22 bp, Homo sapiens
ccagctggaacggcagcccagc

SEQ ID NO: 9453021 - DNA, 22 bp, Homo sapiens
ccagctcttttggctgagtgag

SEQ ID NO: 9453022 - DNA, 22 bp, Homo sapiens
ccagctcttttggctgagtgag

SEQ ID NO: 9453023 - DNA, 22 bp, Homo sapiens
ccagctgacgatgcctggtctc

SEQ ID NO: 9453024 - DNA, 21 bp, Homo sapiens
ccagctctgcctccagttggt

SEQ ID NO: 9453025 - DNA, 22 bp, Homo sapiens
ccagctctgcttgcccagtcag

SEQ ID NO: 9453026 - DNA, 22 bp, Homo sapiens
ccagctctgcttgcccagtcag

SEQ ID NO: 9453027 - DNA, 22 bp, Homo sapiens
ccagctctgcttgcccagtcag

SEQ ID NO: 9453028 - DNA, 22 bp, Homo sapiens
ccagctctggcttcttgctggg

SEQ ID NO: 9453029 - DNA, 22 bp, Homo sapiens
ccagctctgcttgcccagtcag

SEQ ID NO: 9453030 - DNA, 22 bp, Homo sapiens
ccagctcttttggctgagtgag

SEQ ID NO: 9453031 - DNA, 22 bp, Homo sapiens
ccagctcttggtgcacttacat

SEQ ID NO: 9453032 - DNA, 22 bp, Homo sapiens
ccagctcttggtgcacttacat

SEQ ID NO: 9453033 - DNA, 22 bp, Homo sapiens
ccagctctggcttcttgctggg

SEQ ID NO: 9453034 - DNA, 22 bp, Homo sapiens
ccagctctggcttcttgctggg

SEQ ID NO: 9453035 - DNA, 22 bp, Homo sapiens
ccagctcttggtgcacttacat

SEQ ID NO: 9453036 - DNA, 22 bp, Homo sapiens
ccagctctgtaagctgtgaaat

SEQ ID NO: 9453037 - DNA, 23 bp, Homo sapiens
ccagctccgtgagcctcgggctc

SEQ ID NO: 9453038 - DNA, 21 bp, Homo sapiens
ccagctctgcctccagttggt

SEQ ID NO: 9453039 - DNA, 22 bp, Homo sapiens
ccagctctgccaagcgtcagct

SEQ ID NO: 9453040 - DNA, 22 bp, Homo sapiens
ccagcaggcagtcatatccttt

SEQ ID NO: 9453041 - DNA, 22 bp, Homo sapiens
ccagcaggagatgcctgtgtct

SEQ ID NO: 9453042 - DNA, 22 bp, Homo sapiens
ccagcaggagactagcaacata

SEQ ID NO: 9453043 - DNA, 22 bp, Homo sapiens
ccagcaggagagaacatttccc

SEQ ID NO: 9453044 - DNA, 22 bp, Homo sapiens
ccaggaaggtatgggaagaaaa

SEQ ID NO: 9453045 - DNA, 22 bp, Homo sapiens
ccaggaaggtatgggaagaaaa

SEQ ID NO: 9453046 - DNA, 22 bp, Homo sapiens
ccaggaaggtgtttaactagag

SEQ ID NO: 9453047 - DNA, 22 bp, Homo sapiens
ccaggacaagccagagggacag

SEQ ID NO: 9453048 - DNA, 22 bp, Homo sapiens
ccaggacaagccagagggacag

SEQ ID NO: 9453049 - DNA, 22 bp, Homo sapiens
ccaggaatgcacactctgagaa

SEQ ID NO: 9453050 - DNA, 22 bp, Homo sapiens
aggcgctgagtaggcaaggagg

SEQ ID NO: 9453051 - DNA, 22 bp, Homo sapiens
aggcgctgagtaggcaaggagg

SEQ ID NO: 9453052 - DNA, 22 bp, Homo sapiens
aggcctgtctgaggtccccact

SEQ ID NO: 9453053 - DNA, 22 bp, Homo sapiens
aggcctgtcccagctgaggacg

SEQ ID NO: 9453054 - DNA, 22 bp, Homo sapiens
aggcctgtcccagctgaggacg

SEQ ID NO: 9453055 - DNA, 22 bp, Homo sapiens
ccaggacaagccagagggacag

SEQ ID NO: 9453056 - DNA, 22 bp, Homo sapiens
aggcctgtaatcccagcacttt

SEQ ID NO: 9453057 - DNA, 22 bp, Homo sapiens
aggcctgtaattttcctctttt

SEQ ID NO: 9453058 - DNA, 22 bp, Homo sapiens
aggcgctgcatgtgaaggagtt

SEQ ID NO: 9453059 - DNA, 22 bp, Homo sapiens
aggcgctgcgctggggccagaa

SEQ ID NO: 9453060 - DNA, 22 bp, Homo sapiens
aggcgctgcatgtgaaggagtt

SEQ ID NO: 9453061 - DNA, 22 bp, Homo sapiens
aggcgctgcatgtgaaggagtt

SEQ ID NO: 9453062 - DNA, 22 bp, Homo sapiens
aggcgctgcgctggggccagaa

SEQ ID NO: 9453063 - DNA, 22 bp, Homo sapiens
aggcgctgtgcttggggctgga

SEQ ID NO: 9453064 - DNA, 22 bp, Homo sapiens
aggcgtgggaggatctgaggcc

SEQ ID NO: 9453065 - DNA, 22 bp, Homo sapiens
aggcggtgtgctttgcagagca

SEQ ID NO: 9453066 - DNA, 22 bp, Homo sapiens
aggcggtgtgctttgcagagca

SEQ ID NO: 9453067 - DNA, 22 bp, Homo sapiens
aggcggcttctgaggaggctgc

SEQ ID NO: 9453068 - DNA, 22 bp, Homo sapiens
aggcggcttctgaggaggctgc

SEQ ID NO: 9453069 - DNA, 22 bp, Homo sapiens
aggcggtgctgtggacagtgac

SEQ ID NO: 9453070 - DNA, 22 bp, Homo sapiens
ccaggaaggtatgggaagaaaa

SEQ ID NO: 9453071 - DNA, 22 bp, Homo sapiens
ccaggaaggcgttgttcctctc

SEQ ID NO: 9453072 - DNA, 22 bp, Homo sapiens
ccaggaaggcctggatgccccc

SEQ ID NO: 9453073 - DNA, 22 bp, Homo sapiens
ccaggaaggcaggcctccccgc

SEQ ID NO: 9453074 - DNA, 22 bp, Homo sapiens
ccaggaaggcaggcctccccgc

SEQ ID NO: 9453075 - DNA, 22 bp, Homo sapiens
ccaggaaggatcgtttgggagt

SEQ ID NO: 9453076 - DNA, 18 bp, Homo sapiens
aggcctgggaagctgagg

SEQ ID NO: 9453077 - DNA, 18 bp, Homo sapiens
aggcctgggaagctgagg

SEQ ID NO: 9453078 - DNA, 22 bp, Homo sapiens
aggcctggccccagttgctagg

SEQ ID NO: 9453079 - DNA, 22 bp, Homo sapiens
aggcctggcatgagacctgaga

SEQ ID NO: 9453080 - DNA, 22 bp, Homo sapiens
aggcctggccccagttgctagg

SEQ ID NO: 9453081 - DNA, 22 bp, Homo sapiens
aggcctggcctttatgttcaag

SEQ ID NO: 9453082 - DNA, 22 bp, Homo sapiens
aggcctggctttggtttgctga

SEQ ID NO: 9453083 - DNA, 22 bp, Homo sapiens
aggcctggcctttatgttcaag

SEQ ID NO: 9453084 - DNA, 22 bp, Homo sapiens
aggcccaaaagaaaccactggg

SEQ ID NO: 9453085 - DNA, 22 bp, Homo sapiens
aggccatgaggtcatgggagat

SEQ ID NO: 9453086 - DNA, 22 bp, Homo sapiens
aggcccagactcagcggggcgg

SEQ ID NO: 9453087 - DNA, 19 bp, Homo sapiens
ccagcagctttgattctct

SEQ ID NO: 9453088 - DNA, 23 bp, Homo sapiens
aggcccaactctgtgagggctgc

SEQ ID NO: 9453089 - DNA, 22 bp, Homo sapiens
aggcccagactcagcggggcgg

SEQ ID NO: 9453090 - DNA, 22 bp, Homo sapiens
ccagcaggaaagtgacgtttga

SEQ ID NO: 9453091 - DNA, 22 bp, Homo sapiens
ccagcaggactttggaaatatg

SEQ ID NO: 9453092 - DNA, 22 bp, Homo sapiens
ccagcaggagactagcaacata

SEQ ID NO: 9453093 - DNA, 19 bp, Homo sapiens
ccagcagctttgattctct

SEQ ID NO: 9453094 - DNA, 19 bp, Homo sapiens
ccagcagctttgattctct

SEQ ID NO: 9453095 - DNA, 19 bp, Homo sapiens
ccagcagctttgattctct

SEQ ID NO: 9453096 - DNA, 22 bp, Homo sapiens
ccagcaggaaagtgacgtttga

SEQ ID NO: 9453097 - DNA, 22 bp, Homo sapiens
ccagcagctttgcatacactaa

SEQ ID NO: 9453098 - DNA, 22 bp, Homo sapiens
ccagcagctttgcatacactaa

SEQ ID NO: 9453099 - DNA, 22 bp, Homo sapiens
aggccaggtggtcatgcttgct

SEQ ID NO: 9453100 - DNA, 22 bp, Homo sapiens
aggccaggtggtcatgcttgct

SEQ ID NO: 9453101 - DNA, 22 bp, Homo sapiens
aggccaggtggtcatgcttgct

SEQ ID NO: 9453102 - DNA, 22 bp, Homo sapiens
aggccaggttcctcaatcttga

SEQ ID NO: 9453103 - DNA, 22 bp, Homo sapiens
aggccaggttcctcaatcttga

SEQ ID NO: 9453104 - DNA, 22 bp, Homo sapiens
aggccaggtggtcatgcttgct

SEQ ID NO: 9453105 - DNA, 22 bp, Homo sapiens
aggccaggcaacattctgaagt

SEQ ID NO: 9453106 - DNA, 22 bp, Homo sapiens
aggccagtgcctttccagggct

SEQ ID NO: 9453107 - DNA, 22 bp, Homo sapiens
aggccagtgcagctggaacaga

SEQ ID NO: 9453108 - DNA, 22 bp, Homo sapiens
aggccagtgtggctggagcaca

SEQ ID NO: 9453109 - DNA, 22 bp, Homo sapiens
ccagagctaaacacacaggctg

SEQ ID NO: 9453110 - DNA, 17 bp, Homo sapiens
ccagagctactgagact

SEQ ID NO: 9453111 - DNA, 22 bp, Homo sapiens
ccagagctccagggctacagaa

SEQ ID NO: 9453112 - DNA, 22 bp, Homo sapiens
ccagagctgaggagatgggctt

SEQ ID NO: 9453113 - DNA, 20 bp, Homo sapiens
aggccactgaatgccaatca

SEQ ID NO: 9453114 - DNA, 22 bp, Homo sapiens
aggccagaaaaagacagctcca

SEQ ID NO: 9453115 - DNA, 22 bp, Homo sapiens
aggccacagttgaggccagcaa

SEQ ID NO: 9453116 - DNA, 22 bp, Homo sapiens
aggccacatagcttgcatgtag

SEQ ID NO: 9453117 - DNA, 22 bp, Homo sapiens
aggccacagttgaggccagcaa

SEQ ID NO: 9453118 - DNA, 22 bp, Homo sapiens
aggccacatagcttgcatgtag

SEQ ID NO: 9453119 - DNA, 22 bp, Homo sapiens
aggccacatagcttgcatgtag

SEQ ID NO: 9453120 - DNA, 22 bp, Homo sapiens
ccagagcctggcatctgcataa

SEQ ID NO: 9453121 - DNA, 22 bp, Homo sapiens
aggccagaaatgtcagggagtg

SEQ ID NO: 9453122 - DNA, 22 bp, Homo sapiens
aggccagaaatgtcagggagtg

SEQ ID NO: 9453123 - DNA, 22 bp, Homo sapiens
aggccagaaatgtcagggagtg

SEQ ID NO: 9453124 - DNA, 22 bp, Homo sapiens
aggccagaaatgtcagggagtg

SEQ ID NO: 9453125 - DNA, 22 bp, Homo sapiens
aggccacaagaaaatgcttcat

SEQ ID NO: 9453126 - DNA, 22 bp, Homo sapiens
aggccacaagaaaatgcttcat

SEQ ID NO: 9453127 - DNA, 22 bp, Homo sapiens
ccagagaaaagaggccaaggat

SEQ ID NO: 9453128 - DNA, 22 bp, Homo sapiens
ccagagaaagctcacaggcagt

SEQ ID NO: 9453129 - DNA, 22 bp, Homo sapiens
ccagactggggctccttgaggg

SEQ ID NO: 9453130 - DNA, 22 bp, Homo sapiens
ccagactggggctccttgaggg

SEQ ID NO: 9453131 - DNA, 22 bp, Homo sapiens
aggccacagtactttgcagacc

SEQ ID NO: 9453132 - DNA, 22 bp, Homo sapiens
aggccacagtactttgcagacc

SEQ ID NO: 9453133 - DNA, 22 bp, Homo sapiens
aggccacagtcagtgggtgctg

SEQ ID NO: 9453134 - DNA, 22 bp, Homo sapiens
aggccacagtcagtgggtgctg

SEQ ID NO: 9453135 - DNA, 22 bp, Homo sapiens
aggccacagtcagtgggtgctg

SEQ ID NO: 9453136 - DNA, 22 bp, Homo sapiens
aggccacagtcagtgggtgctg

SEQ ID NO: 9453137 - DNA, 22 bp, Homo sapiens
aggccacagttgaggccagcaa

SEQ ID NO: 9453138 - DNA, 22 bp, Homo sapiens
aggccacagttgaggccagcaa

SEQ ID NO: 9453139 - DNA, 22 bp, Homo sapiens
aggccacagttgaggccagcaa

SEQ ID NO: 9453140 - DNA, 22 bp, Homo sapiens
ccagaccagactgacttgagcc

SEQ ID NO: 9453141 - DNA, 22 bp, Homo sapiens
ccagacatgtgcccttgaggaa

SEQ ID NO: 9453142 - DNA, 22 bp, Homo sapiens
ccagacagttccttgaggttca

SEQ ID NO: 9453143 - DNA, 22 bp, Homo sapiens
ccagaagagatcacagttcttg

SEQ ID NO: 9453144 - DNA, 22 bp, Homo sapiens
ccagaagaccggggagtcaggg

SEQ ID NO: 9453145 - DNA, 22 bp, Homo sapiens
ccagaagaccggggagtcaggg

SEQ ID NO: 9453146 - DNA, 22 bp, Homo sapiens
ccagactgcttgcttcccagcc

SEQ ID NO: 9453147 - DNA, 21 bp, Homo sapiens
ccagactcagaagtttaacca

SEQ ID NO: 9453148 - DNA, 22 bp, Homo sapiens
ccagactcatctgccattgctg

SEQ ID NO: 9453149 - DNA, 22 bp, Homo sapiens
ccagaccctgctctggggctct

SEQ ID NO: 9453150 - DNA, 22 bp, Homo sapiens
ccagaccctttcttggcatgtg

SEQ ID NO: 9453151 - DNA, 22 bp, Homo sapiens
ccagaccctttcttggcatgtg

SEQ ID NO: 9453152 - DNA, 22 bp, Homo sapiens
ccagaaagaatgaactgaaccc

SEQ ID NO: 9453153 - DNA, 22 bp, Homo sapiens
ccagaaagaatgaactgaaccc

SEQ ID NO: 9453154 - DNA, 22 bp, Homo sapiens
ccagaaagactttttaggtacg

SEQ ID NO: 9453155 - DNA, 22 bp, Homo sapiens
ccagaaagactttttaggtacg

SEQ ID NO: 9453156 - DNA, 22 bp, Homo sapiens
ccagaaaatatggctaaggtga

SEQ ID NO: 9453157 - DNA, 22 bp, Homo sapiens
ccagaaaatgcagaacatagaa

SEQ ID NO: 9453158 - DNA, 18 bp, Homo sapiens
aggcaggctggagtgact

SEQ ID NO: 9453159 - DNA, 22 bp, Homo sapiens
aggcaggctgctatggagtaga

SEQ ID NO: 9453160 - DNA, 22 bp, Homo sapiens
ccactgggggctgcaggcactc

SEQ ID NO: 9453161 - DNA, 22 bp, Homo sapiens
ccactgggggctgcaggcactc

SEQ ID NO: 9453162 - DNA, 22 bp, Homo sapiens
ccagaaccaaaagcatggagta

SEQ ID NO: 9453163 - DNA, 22 bp, Homo sapiens
ccagaactgggcaacagaaagt

SEQ ID NO: 9453164 - DNA, 22 bp, Homo sapiens
ccagaagaaaaagctggtatta

SEQ ID NO: 9453165 - DNA, 22 bp, Homo sapiens
ccagaagaaaaagctggtatta

SEQ ID NO: 9453166 - DNA, 22 bp, Homo sapiens
ccagaagaacttaattcaaaac

SEQ ID NO: 9453167 - DNA, 22 bp, Homo sapiens
ccagaagacaagaatgttctta

SEQ ID NO: 9453168 - DNA, 22 bp, Homo sapiens
ccagaagacaagaatgttctta

SEQ ID NO: 9453169 - DNA, 22 bp, Homo sapiens
ccagaagaccggggagtcaggg

SEQ ID NO: 9453170 - DNA, 22 bp, Homo sapiens
ccagaagaccccgtccacctcc

SEQ ID NO: 9453171 - DNA, 22 bp, Homo sapiens
ccagaaagataggaaatcaagt

SEQ ID NO: 9453172 - DNA, 22 bp, Homo sapiens
ccagaaatgagtagaggatgct

SEQ ID NO: 9453173 - DNA, 22 bp, Homo sapiens
ccagaacacagtggaagaatat

SEQ ID NO: 9453174 - DNA, 22 bp, Homo sapiens
ccagaacacagtggaagaatat

SEQ ID NO: 9453175 - DNA, 22 bp, Homo sapiens
ccagaacacagtggaagaatat

SEQ ID NO: 9453176 - DNA, 19 bp, Homo sapiens
atacacatacgtaaactga

SEQ ID NO: 9453177 - DNA, 22 bp, Homo sapiens
atacacatatcaggtgtataca

SEQ ID NO: 9453178 - DNA, 22 bp, Homo sapiens
atacaagttgcccaaatgatta

SEQ ID NO: 9453179 - DNA, 22 bp, Homo sapiens
atacacaggtgctaggtcaata

SEQ ID NO: 9453180 - DNA, 21 bp, Homo sapiens
atacacatacacataaatgtg

SEQ ID NO: 9453181 - DNA, 21 bp, Homo sapiens
atacacatacacataaatgtg

SEQ ID NO: 9453182 - DNA, 22 bp, Homo sapiens
atacacatatgtgtgtatatgt

SEQ ID NO: 9453183 - DNA, 20 bp, Homo sapiens
atacacatattcttgcaact

SEQ ID NO: 9453184 - DNA, 20 bp, Homo sapiens
atacacatattcttgcaact

SEQ ID NO: 9453185 - DNA, 22 bp, Homo sapiens
atacacatatgtgtgtatatgt

SEQ ID NO: 9453186 - DNA, 22 bp, Homo sapiens
atacacatgcacacatgtgtgt

SEQ ID NO: 9453187 - DNA, 22 bp, Homo sapiens
atacacatgcacacatgtgtgt

SEQ ID NO: 9453188 - DNA, 22 bp, Homo sapiens
atacacatctatttaagagaca

SEQ ID NO: 9453189 - DNA, 20 bp, Homo sapiens
atacacatattcttgcaact

SEQ ID NO: 9453190 - DNA, 22 bp, Homo sapiens
ctgctggggtcagagcactggg

SEQ ID NO: 9453191 - DNA, 22 bp, Homo sapiens
ctgctggggtcagagcactggg

SEQ ID NO: 9453192 - DNA, 22 bp, Homo sapiens
ctgctggggtcagagcactggg

SEQ ID NO: 9453193 - DNA, 22 bp, Homo sapiens
ctgctggggtcagagcactggg

SEQ ID NO: 9453194 - DNA, 22 bp, Homo sapiens
ctgctggggtcagagcactggg

SEQ ID NO: 9453195 - DNA, 22 bp, Homo sapiens
ctgctggggtcagagcactggg

SEQ ID NO: 9453196 - DNA, 22 bp, Homo sapiens
ctgctgggggacacaggtccgg

SEQ ID NO: 9453197 - DNA, 22 bp, Homo sapiens
ctgctgggggacacaggtccgg

SEQ ID NO: 9453198 - DNA, 22 bp, Homo sapiens
ctgctgtgcctcttttcacgtg

SEQ ID NO: 9453199 - DNA, 22 bp, Homo sapiens
ctgctgtgcaggtgcctatgat

SEQ ID NO: 9453200 - DNA, 22 bp, Homo sapiens
ctgctgtgcaggtgcctatgat

SEQ ID NO: 9453201 - DNA, 22 bp, Homo sapiens
ctgctgtgcaggtgcctatgat

SEQ ID NO: 9453202 - DNA, 22 bp, Homo sapiens
ctgctgtgcagacagactctct

SEQ ID NO: 9453203 - DNA, 22 bp, Homo sapiens
atacaagttaatgagaatgaca

SEQ ID NO: 9453204 - DNA, 22 bp, Homo sapiens
ctgctgtgtcagagtccagggg

SEQ ID NO: 9453205 - DNA, 22 bp, Homo sapiens
ctgctgtgggttaagacactgt

SEQ ID NO: 9453206 - DNA, 22 bp, Homo sapiens
ctgctgtgggcagggtagctgg

SEQ ID NO: 9453207 - DNA, 21 bp, Homo sapiens
ctgctgtggcccccgacatgc

SEQ ID NO: 9453208 - DNA, 22 bp, Homo sapiens
ataaaggaaattccatgtctaa

SEQ ID NO: 9453209 - DNA, 22 bp, Homo sapiens
ctgcctgggttcaagtcctgtt

SEQ ID NO: 9453210 - DNA, 22 bp, Homo sapiens
ctgcctgggttcaagtcctgtt

SEQ ID NO: 9453211 - DNA, 22 bp, Homo sapiens
ctgcctggtactttaggcactt

SEQ ID NO: 9453212 - DNA, 22 bp, Homo sapiens
ctgcctggtactttaggcactt

SEQ ID NO: 9453213 - DNA, 22 bp, Homo sapiens
ctgctaaacctctctgagagct

SEQ ID NO: 9453214 - DNA, 22 bp, Homo sapiens
ctgctaaacctctctgagagct

SEQ ID NO: 9453215 - DNA, 22 bp, Homo sapiens
ctgcctgtgccaccgcctcatt

SEQ ID NO: 9453216 - DNA, 22 bp, Homo sapiens
ctgcctgtgccaatgctccttt

SEQ ID NO: 9453217 - DNA, 22 bp, Homo sapiens
ctgcctgtgccaatgctccttt

SEQ ID NO: 9453218 - DNA, 22 bp, Homo sapiens
ctgcctgtattgtctgcttggg

SEQ ID NO: 9453219 - DNA, 22 bp, Homo sapiens
ctgcctgtattgtctgcttggg

SEQ ID NO: 9453220 - DNA, 22 bp, Homo sapiens
ctgcctgtgatttttctctagt

SEQ ID NO: 9453221 - DNA, 22 bp, Homo sapiens
ctgcctgtgatttttctctagt

SEQ ID NO: 9453222 - DNA, 22 bp, Homo sapiens
ctgcctgtgatttttctctagt

SEQ ID NO: 9453223 - DNA, 19 bp, Homo sapiens
ctgctcagagcagctccag

SEQ ID NO: 9453224 - DNA, 19 bp, Homo sapiens
ctgctcagagcagctccag

SEQ ID NO: 9453225 - DNA, 19 bp, Homo sapiens
ctgctcagagcagctccag

SEQ ID NO: 9453226 - DNA, 22 bp, Homo sapiens
ctgctcagcggaaggaagagcg

SEQ ID NO: 9453227 - DNA, 22 bp, Homo sapiens
ctgctcagaggaaggaatgtct

SEQ ID NO: 9453228 - DNA, 22 bp, Homo sapiens
ctgctcagcggaaggaagagcg

SEQ ID NO: 9453229 - DNA, 22 bp, Homo sapiens
ctgctcaagtgcgcacccaggg

SEQ ID NO: 9453230 - DNA, 22 bp, Homo sapiens
ctgctagcccgccggccagcga

SEQ ID NO: 9453231 - DNA, 22 bp, Homo sapiens
ctgctagggttcagcagtgcct

SEQ ID NO: 9453232 - DNA, 22 bp, Homo sapiens
ctgctagaatttctggaaaaga

SEQ ID NO: 9453233 - DNA, 22 bp, Homo sapiens
ctgctagcccaggatgcaggga

SEQ ID NO: 9453234 - DNA, 22 bp, Homo sapiens
ctgctgcccagtgtgcattggg

SEQ ID NO: 9453235 - DNA, 22 bp, Homo sapiens
ctgctgggcctggtctctgagg

SEQ ID NO: 9453236 - DNA, 22 bp, Homo sapiens
ctgctgggcctggtctctgagg

SEQ ID NO: 9453237 - DNA, 22 bp, Homo sapiens
ctgctgggcctggtctctgagg

SEQ ID NO: 9453238 - DNA, 22 bp, Homo sapiens
ctgctgggcagaggctgcatga

SEQ ID NO: 9453239 - DNA, 22 bp, Homo sapiens
ctgctgggcagaggctgcatga

SEQ ID NO: 9453240 - DNA, 22 bp, Homo sapiens
ctgctgggctcctcatgtgact

SEQ ID NO: 9453241 - DNA, 22 bp, Homo sapiens
ctgctgggctcctcatgtgact

SEQ ID NO: 9453242 - DNA, 22 bp, Homo sapiens
ctgctgggctcctcatgtgact

SEQ ID NO: 9453243 - DNA, 22 bp, Homo sapiens
ctgctgggctcctcatgtgact

SEQ ID NO: 9453244 - DNA, 22 bp, Homo sapiens
ctgctgggctcctcatgtgact

SEQ ID NO: 9453245 - DNA, 22 bp, Homo sapiens
ctgctgggggacacaggtccgg

SEQ ID NO: 9453246 - DNA, 22 bp, Homo sapiens
ctgctggggaggcgcctcgacg

SEQ ID NO: 9453247 - DNA, 22 bp, Homo sapiens
ctgctggggaggcgcctcgacg

SEQ ID NO: 9453248 - DNA, 22 bp, Homo sapiens
ataaagctaagacttacatgaa

SEQ ID NO: 9453249 - DNA, 22 bp, Homo sapiens
ataaagctattcctctcttttt

SEQ ID NO: 9453250 - DNA, 22 bp, Homo sapiens
ataaagctatttttaattctgt

SEQ ID NO: 9453251 - DNA, 22 bp, Homo sapiens
ataaagcatgcttgtttggaga

SEQ ID NO: 9453252 - DNA, 22 bp, Homo sapiens
ataaagcatctagtctgtcact

SEQ ID NO: 9453253 - DNA, 22 bp, Homo sapiens
ataaagcatctagtctgtcact

SEQ ID NO: 9453254 - DNA, 22 bp, Homo sapiens
ataaagcaggtccccagacact

SEQ ID NO: 9453255 - DNA, 22 bp, Homo sapiens
ataaagcaggtccccagacact

SEQ ID NO: 9453256 - DNA, 22 bp, Homo sapiens
ataaagcaatagattgtgtaat

SEQ ID NO: 9453257 - DNA, 22 bp, Homo sapiens
ataaagcaagcataccattaag

SEQ ID NO: 9453258 - DNA, 22 bp, Homo sapiens
ataaagcaaataggactattgc

SEQ ID NO: 9453259 - DNA, 22 bp, Homo sapiens
ataaacttgagtctcagagtat

SEQ ID NO: 9453260 - DNA, 22 bp, Homo sapiens
ataaagaccagtatcttatgtt

SEQ ID NO: 9453261 - DNA, 22 bp, Homo sapiens
ataaacttgagtctcagagtat

SEQ ID NO: 9453262 - DNA, 22 bp, Homo sapiens
ataaacttgagtctcagagtat

SEQ ID NO: 9453263 - DNA, 22 bp, Homo sapiens
ataaactgggtatcaagaggcc

SEQ ID NO: 9453264 - DNA, 22 bp, Homo sapiens
ataaagaggatgtatttacagc

SEQ ID NO: 9453265 - DNA, 22 bp, Homo sapiens
ataaagatagaatgctttcctg

SEQ ID NO: 9453266 - DNA, 22 bp, Homo sapiens
ataaagaccagtatcttatgtt

SEQ ID NO: 9453267 - DNA, 22 bp, Homo sapiens
ataaagatttttaggcatttct

SEQ ID NO: 9453268 - DNA, 22 bp, Homo sapiens
ataaagatttttaggcatttct

SEQ ID NO: 9453269 - DNA, 22 bp, Homo sapiens
ataaagatttctttttctctac

SEQ ID NO: 9453270 - DNA, 22 bp, Homo sapiens
ataaagatttctttttctctac

SEQ ID NO: 9453271 - DNA, 22 bp, Homo sapiens
ataaaccagaagtaaaagctac

SEQ ID NO: 9453272 - DNA, 22 bp, Homo sapiens
ataaacctatgctaagctgtgg

SEQ ID NO: 9453273 - DNA, 22 bp, Homo sapiens
ataaactatgtaatttgctcta

SEQ ID NO: 9453274 - DNA, 22 bp, Homo sapiens
ataaactatgtaatttgctcta

SEQ ID NO: 9453275 - DNA, 22 bp, Homo sapiens
ataaactaattggggtatagtt

SEQ ID NO: 9453276 - DNA, 22 bp, Homo sapiens
ataaactaattggggtatagtt

SEQ ID NO: 9453277 - DNA, 22 bp, Homo sapiens
ataaactgaagggaacactgag

SEQ ID NO: 9453278 - DNA, 22 bp, Homo sapiens
ataaaatcaactggctccagtt

SEQ ID NO: 9453279 - DNA, 22 bp, Homo sapiens
ataaacatctgtttctcttctg

SEQ ID NO: 9453280 - DNA, 22 bp, Homo sapiens
ataaacatctgtttctcttctg

SEQ ID NO: 9453281 - DNA, 22 bp, Homo sapiens
ataaacatctgtttctcttctg

SEQ ID NO: 9453282 - DNA, 22 bp, Homo sapiens
ataaacatctgtttctcttctg

SEQ ID NO: 9453283 - DNA, 22 bp, Homo sapiens
ctgcaggcttccagggctgtgg

SEQ ID NO: 9453284 - DNA, 22 bp, Homo sapiens
ctgcaggctgagcgcctgccgg

SEQ ID NO: 9453285 - DNA, 22 bp, Homo sapiens
ctgcagggaactgaggcccaga

SEQ ID NO: 9453286 - DNA, 22 bp, Homo sapiens
ctgcaggcttccagggctgtgg

SEQ ID NO: 9453287 - DNA, 22 bp, Homo sapiens
ctgcagggaactgaggcccaga

SEQ ID NO: 9453288 - DNA, 22 bp, Homo sapiens
ctgcagggacccaagtctttgg

SEQ ID NO: 9453289 - DNA, 22 bp, Homo sapiens
ctgcagggaccacaagcaggtt

SEQ ID NO: 9453290 - DNA, 22 bp, Homo sapiens
ataaaacttattagaattgtgt

SEQ ID NO: 9453291 - DNA, 22 bp, Homo sapiens
ataaaacttattagaattgtgt

SEQ ID NO: 9453292 - DNA, 22 bp, Homo sapiens
ataaaacttattagaattgtgt

SEQ ID NO: 9453293 - DNA, 22 bp, Homo sapiens
ataaaagaagttttggtacttg

SEQ ID NO: 9453294 - DNA, 22 bp, Homo sapiens
ataaaagaagttttggtacttg

SEQ ID NO: 9453295 - DNA, 22 bp, Homo sapiens
ataaaacttgggtatgatccct

SEQ ID NO: 9453296 - DNA, 22 bp, Homo sapiens
ataaaacttgggtatgatccct

SEQ ID NO: 9453297 - DNA, 22 bp, Homo sapiens
ataaaacttgggtatgatccct

SEQ ID NO: 9453298 - DNA, 22 bp, Homo sapiens
ctgcaggctcgaagacacggat

SEQ ID NO: 9453299 - DNA, 22 bp, Homo sapiens
ataaaagatcccttctgagctc

SEQ ID NO: 9453300 - DNA, 22 bp, Homo sapiens
ataaaagatcccttctgagctc

SEQ ID NO: 9453301 - DNA, 21 bp, Homo sapiens
agttctgttatgctggactca

SEQ ID NO: 9453302 - DNA, 22 bp, Homo sapiens
agttcttattttggaactgagg

SEQ ID NO: 9453303 - DNA, 22 bp, Homo sapiens
agttcttattgaatagaaatca

SEQ ID NO: 9453304 - DNA, 22 bp, Homo sapiens
agttcttacaggggacctttga

SEQ ID NO: 9453305 - DNA, 22 bp, Homo sapiens
agttcttacaggggacctttga

SEQ ID NO: 9453306 - DNA, 22 bp, Homo sapiens
agttcttattgaatagaaatca

SEQ ID NO: 9453307 - DNA, 22 bp, Homo sapiens
agttttgtaattctcaaaaata

SEQ ID NO: 9453308 - DNA, 22 bp, Homo sapiens
ataaaaactgacccatcctttg

SEQ ID NO: 9453309 - DNA, 22 bp, Homo sapiens
ataaaaatgagggcggtagcta

SEQ ID NO: 9453310 - DNA, 22 bp, Homo sapiens
ataaaaatgagggcggtagcta

SEQ ID NO: 9453311 - DNA, 22 bp, Homo sapiens
ataaaaatgagggcggtagcta

SEQ ID NO: 9453312 - DNA, 22 bp, Homo sapiens
ataaaaatgagggcggtagcta

SEQ ID NO: 9453313 - DNA, 22 bp, Homo sapiens
ataaaaatgagggcggtagcta

SEQ ID NO: 9453314 - DNA, 22 bp, Homo sapiens
ataaaaatgagggcggtagcta

SEQ ID NO: 9453315 - DNA, 22 bp, Homo sapiens
ataaaaaggacagatgtggtct

SEQ ID NO: 9453316 - DNA, 22 bp, Homo sapiens
ataaaaaggacagatgtggtct

SEQ ID NO: 9453317 - DNA, 22 bp, Homo sapiens
agttctcgagcgtccctgtttc

SEQ ID NO: 9453318 - DNA, 22 bp, Homo sapiens
agttctctatgaagtctattgt

SEQ ID NO: 9453319 - DNA, 22 bp, Homo sapiens
agttctcaaggttaggaaaagt

SEQ ID NO: 9453320 - DNA, 22 bp, Homo sapiens
agttctcagaattgcacctcaa

SEQ ID NO: 9453321 - DNA, 22 bp, Homo sapiens
agttctattgggtaggttctgt

SEQ ID NO: 9453322 - DNA, 22 bp, Homo sapiens
agttctatttctaacatgttat

SEQ ID NO: 9453323 - DNA, 22 bp, Homo sapiens
agttccttttatctgagtctaa

SEQ ID NO: 9453324 - DNA, 22 bp, Homo sapiens
agttcgagatctgctgatgaga

SEQ ID NO: 9453325 - DNA, 22 bp, Homo sapiens
agttctaattgcgttttcttgc

SEQ ID NO: 9453326 - DNA, 22 bp, Homo sapiens
agttctgggaggtgcacgtcca

SEQ ID NO: 9453327 - DNA, 22 bp, Homo sapiens
agttctgggaaaaacatggcca

SEQ ID NO: 9453328 - DNA, 22 bp, Homo sapiens
agttctggcccagggtttcttg

SEQ ID NO: 9453329 - DNA, 22 bp, Homo sapiens
agttctggcccagggtttcttg

SEQ ID NO: 9453330 - DNA, 22 bp, Homo sapiens
agttctggcgcccatgagcaga

SEQ ID NO: 9453331 - DNA, 22 bp, Homo sapiens
agttctggcgcccatgagcaga

SEQ ID NO: 9453332 - DNA, 22 bp, Homo sapiens
agttctggttaacctgcaacct

SEQ ID NO: 9453333 - DNA, 22 bp, Homo sapiens
agttctggttgcccatgacatc

SEQ ID NO: 9453334 - DNA, 22 bp, Homo sapiens
agttctgtggctgtgccctgta

SEQ ID NO: 9453335 - DNA, 22 bp, Homo sapiens
agttctgtgacaatatcattac

SEQ ID NO: 9453336 - DNA, 22 bp, Homo sapiens
agttctctggctcctttccaga

SEQ ID NO: 9453337 - DNA, 22 bp, Homo sapiens
agttctcttccacagcctcctc

SEQ ID NO: 9453338 - DNA, 22 bp, Homo sapiens
agttctcttctcatcacccagg

SEQ ID NO: 9453339 - DNA, 22 bp, Homo sapiens
agttctcttggaagttatgtga

SEQ ID NO: 9453340 - DNA, 22 bp, Homo sapiens
agttctggaactctacagcaac

SEQ ID NO: 9453341 - DNA, 22 bp, Homo sapiens
agttctgactctgaatctggga

SEQ ID NO: 9453342 - DNA, 22 bp, Homo sapiens
agttctgaatgaggaatctggg

SEQ ID NO: 9453343 - DNA, 22 bp, Homo sapiens
agttctctttagctcatatggt

SEQ ID NO: 9453344 - DNA, 22 bp, Homo sapiens
atacatggaagatgcttagcac

SEQ ID NO: 9453345 - DNA, 23 bp, Homo sapiens
atacatggccggatatgatgttc

SEQ ID NO: 9453346 - DNA, 22 bp, Homo sapiens
atacatgtaactgcattgtaat

SEQ ID NO: 9453347 - DNA, 22 bp, Homo sapiens
atacatgtaactgcattgtaat

SEQ ID NO: 9453348 - DNA, 19 bp, Homo sapiens
atacatgcatttacatgct

SEQ ID NO: 9453349 - DNA, 22 bp, Homo sapiens
atacatgatgggtgtatagttt

SEQ ID NO: 9453350 - DNA, 22 bp, Homo sapiens
ctggcacagcttgggccccatc

SEQ ID NO: 9453351 - DNA, 22 bp, Homo sapiens
ctggcacagcttgggccccatc

SEQ ID NO: 9453352 - DNA, 22 bp, Homo sapiens
ctggcacaggatccgagacctt

SEQ ID NO: 9453353 - DNA, 22 bp, Homo sapiens
ctggcacagccactgcaggcag

SEQ ID NO: 9453354 - DNA, 22 bp, Homo sapiens
ctggcacaggatccgagacctt

SEQ ID NO: 9453355 - DNA, 22 bp, Homo sapiens
ctggcacagttaacatatgcta

SEQ ID NO: 9453356 - DNA, 22 bp, Homo sapiens
ctggcacataattagtgatcct

SEQ ID NO: 9453357 - DNA, 22 bp, Homo sapiens
ctggcacataattagtgatcct

SEQ ID NO: 9453358 - DNA, 22 bp, Homo sapiens
atacatgtcatcatatgtttgt

SEQ ID NO: 9453359 - DNA, 22 bp, Homo sapiens
atacatgtcatcatatgtttgt

SEQ ID NO: 9453360 - DNA, 22 bp, Homo sapiens
atacatgtcatcatatgtttgt

SEQ ID NO: 9453361 - DNA, 22 bp, Homo sapiens
atacatgtacataaatgtagca

SEQ ID NO: 9453362 - DNA, 22 bp, Homo sapiens
atacatgtaactgcattgtaat

SEQ ID NO: 9453363 - DNA, 22 bp, Homo sapiens
atacatgtgggtctaaacatat

SEQ ID NO: 9453364 - DNA, 22 bp, Homo sapiens
atacatgtgtccctgatttatt

SEQ ID NO: 9453365 - DNA, 22 bp, Homo sapiens
ctggcagcttagcactctggtt

SEQ ID NO: 9453366 - DNA, 22 bp, Homo sapiens
atacatgtgtccctgatttatt

SEQ ID NO: 9453367 - DNA, 22 bp, Homo sapiens
atacatgtgtccctgatttatt

SEQ ID NO: 9453368 - DNA, 22 bp, Homo sapiens
atacatgtgtgagcgaagatgt

SEQ ID NO: 9453369 - DNA, 22 bp, Homo sapiens
atacatgtgtgtgcatacatgt

SEQ ID NO: 9453370 - DNA, 22 bp, Homo sapiens
atacatgtgtgtgcatacatgt

SEQ ID NO: 9453371 - DNA, 22 bp, Homo sapiens
ctggagtgcagtggcatgatca

SEQ ID NO: 9453372 - DNA, 22 bp, Homo sapiens
ctggagtggccggtgctgtggc

SEQ ID NO: 9453373 - DNA, 22 bp, Homo sapiens
ctggagtgcagtggcatgatca

SEQ ID NO: 9453374 - DNA, 22 bp, Homo sapiens
ctggagtgcagtggcatgatca

SEQ ID NO: 9453375 - DNA, 20 bp, Homo sapiens
atacacattcatagaaaaat

SEQ ID NO: 9453376 - DNA, 20 bp, Homo sapiens
atacacattcatagaaaaat

SEQ ID NO: 9453377 - DNA, 20 bp, Homo sapiens
atacacattcatagaaaaat

SEQ ID NO: 9453378 - DNA, 22 bp, Homo sapiens
atacacattactttctgtctga

SEQ ID NO: 9453379 - DNA, 20 bp, Homo sapiens
atacacatgcagacagatgc

SEQ ID NO: 9453380 - DNA, 22 bp, Homo sapiens
ctggcacaactccacctcagcg

SEQ ID NO: 9453381 - DNA, 22 bp, Homo sapiens
ctggcacacagaggccctcggg

SEQ ID NO: 9453382 - DNA, 22 bp, Homo sapiens
ctggcacacagcaggctctcag

SEQ ID NO: 9453383 - DNA, 22 bp, Homo sapiens
ctggcacaaaagaaaactgcca

SEQ ID NO: 9453384 - DNA, 22 bp, Homo sapiens
ctggcacaactccacctcagcg

SEQ ID NO: 9453385 - DNA, 22 bp, Homo sapiens
ctggcacaactccacctcagcg

SEQ ID NO: 9453386 - DNA, 22 bp, Homo sapiens
ctggcacagccactgcaggcag

SEQ ID NO: 9453387 - DNA, 22 bp, Homo sapiens
ctggcacagagtgagcattcaa

SEQ ID NO: 9453388 - DNA, 22 bp, Homo sapiens
ctggcacagagtgagcattcaa

SEQ ID NO: 9453389 - DNA, 22 bp, Homo sapiens
ctggcacagagacagaaggatt

SEQ ID NO: 9453390 - DNA, 22 bp, Homo sapiens
ctggcacagagacagaaggatt

SEQ ID NO: 9453391 - DNA, 22 bp, Homo sapiens
ctggcacacagtaggcaccaat

SEQ ID NO: 9453392 - DNA, 22 bp, Homo sapiens
ctggcacacagtaggcaccaat

SEQ ID NO: 9453393 - DNA, 22 bp, Homo sapiens
ctggcagcttattagaaatgca

SEQ ID NO: 9453394 - DNA, 22 bp, Homo sapiens
ctggcaggtccagctggactca

SEQ ID NO: 9453395 - DNA, 22 bp, Homo sapiens
ctggcaggtggaggttgcagtg

SEQ ID NO: 9453396 - DNA, 22 bp, Homo sapiens
ctggccactggtggtcataggc

SEQ ID NO: 9453397 - DNA, 22 bp, Homo sapiens
ctggccactggaggtggcaccc

SEQ ID NO: 9453398 - DNA, 22 bp, Homo sapiens
ctggccactggtggtcataggc

SEQ ID NO: 9453399 - DNA, 22 bp, Homo sapiens
ctggccactgcgggcctctgcc

SEQ ID NO: 9453400 - DNA, 22 bp, Homo sapiens
ctggccactgcgggcctctgcc

SEQ ID NO: 9453401 - DNA, 22 bp, Homo sapiens
ctggccactgcgggcctctgcc

SEQ ID NO: 9453402 - DNA, 22 bp, Homo sapiens
ctggccactgcgggcctctgcc

SEQ ID NO: 9453403 - DNA, 22 bp, Homo sapiens
ctggcaggtttggtgtctggtg

SEQ ID NO: 9453404 - DNA, 22 bp, Homo sapiens
ctggcaggttatagagctgccc

SEQ ID NO: 9453405 - DNA, 22 bp, Homo sapiens
ctggccagactacacatgtgtg

SEQ ID NO: 9453406 - DNA, 22 bp, Homo sapiens
ctggccagaagcacctttggcg

SEQ ID NO: 9453407 - DNA, 22 bp, Homo sapiens
ctggccagaagcacctttggcg

SEQ ID NO: 9453408 - DNA, 22 bp, Homo sapiens
ctggccagaagcacctttggcg

SEQ ID NO: 9453409 - DNA, 20 bp, Homo sapiens
ctggccagaacgcctacaca

SEQ ID NO: 9453410 - DNA, 20 bp, Homo sapiens
ctggccagaacgcctacaca

SEQ ID NO: 9453411 - DNA, 20 bp, Homo sapiens
ctggccagaacgcctacaca

SEQ ID NO: 9453412 - DNA, 22 bp, Homo sapiens
ctggccctaggcaaacacagat

SEQ ID NO: 9453413 - DNA, 22 bp, Homo sapiens
ctggccagactacacatgtgtg

SEQ ID NO: 9453414 - DNA, 22 bp, Homo sapiens
ctggccagactacacatgtgtg

SEQ ID NO: 9453415 - DNA, 22 bp, Homo sapiens
ctggccagactacacatgtgtg

SEQ ID NO: 9453416 - DNA, 22 bp, Homo sapiens
ctggcccttgacttacagcagg

SEQ ID NO: 9453417 - DNA, 22 bp, Homo sapiens
ctggcccttctcttgcttcctg

SEQ ID NO: 9453418 - DNA, 22 bp, Homo sapiens
ctggccctatgagcctcctgat

SEQ ID NO: 9453419 - DNA, 22 bp, Homo sapiens
ctggcctaaaattgcttctgca

SEQ ID NO: 9453420 - DNA, 22 bp, Homo sapiens
ctggcctcacagaggctaagcc

SEQ ID NO: 9453421 - DNA, 22 bp, Homo sapiens
ctggccggtatttgcctctggg

SEQ ID NO: 9453422 - DNA, 22 bp, Homo sapiens
ctggccgcctggggccgggtga

SEQ ID NO: 9453423 - DNA, 22 bp, Homo sapiens
ctggccgcagtgtggagttgtg

SEQ ID NO: 9453424 - DNA, 22 bp, Homo sapiens
ctggccgccgtcccaacctcga

SEQ ID NO: 9453425 - DNA, 21 bp, Homo sapiens
ctggccgacccctctgtgctc

SEQ ID NO: 9453426 - DNA, 22 bp, Homo sapiens
ctggcctaaaattgcttctgca

SEQ ID NO: 9453427 - DNA, 22 bp, Homo sapiens
ctggccggtatttgcctctggg

SEQ ID NO: 9453428 - DNA, 22 bp, Homo sapiens
ctggcctcagagggtcatggtg

SEQ ID NO: 9453429 - DNA, 22 bp, Homo sapiens
ctggcctcagagggtcatggtg

SEQ ID NO: 9453430 - DNA, 22 bp, Homo sapiens
ctggcctcagagggtcatggtg

SEQ ID NO: 9453431 - DNA, 22 bp, Homo sapiens
ctggcctcacctcagacttact

SEQ ID NO: 9453432 - DNA, 22 bp, Homo sapiens
ctggcctcatagccaagctgtg

SEQ ID NO: 9453433 - DNA, 23 bp, Homo sapiens
ctggcctccgacactggccaaga

SEQ ID NO: 9453434 - DNA, 22 bp, Homo sapiens
ctggcctcggcagcaggaacag

SEQ ID NO: 9453435 - DNA, 23 bp, Homo sapiens
ctggcctccgacactggccaaga

SEQ ID NO: 9453436 - DNA, 22 bp, Homo sapiens
ctggcctcatagccaagctgtg

SEQ ID NO: 9453437 - DNA, 19 bp, Homo sapiens
ctggctgcaatgccagggt

SEQ ID NO: 9453438 - DNA, 22 bp, Homo sapiens
ctggctgagctagagtccatgg

SEQ ID NO: 9453439 - DNA, 22 bp, Homo sapiens
ctggctgaggcagagcctgggg

SEQ ID NO: 9453440 - DNA, 22 bp, Homo sapiens
atataatacaacctgctaagtg

SEQ ID NO: 9453441 - DNA, 22 bp, Homo sapiens
atataatacaacctgctaagtg

SEQ ID NO: 9453442 - DNA, 22 bp, Homo sapiens
atatacacatgtgtatacattt

SEQ ID NO: 9453443 - DNA, 22 bp, Homo sapiens
atatacacatgtgtatacattt

SEQ ID NO: 9453444 - DNA, 22 bp, Homo sapiens
atatacactgtttcagttgaag

SEQ ID NO: 9453445 - DNA, 22 bp, Homo sapiens
atatacactgtttcagttgaag

SEQ ID NO: 9453446 - DNA, 22 bp, Homo sapiens
atatacactccactgatacagg

SEQ ID NO: 9453447 - DNA, 22 bp, Homo sapiens
atatacacatttgcttatgtgt

SEQ ID NO: 9453448 - DNA, 22 bp, Homo sapiens
atatacactcaccatggtattt

SEQ ID NO: 9453449 - DNA, 22 bp, Homo sapiens
atatacaggtggtatgtgtaaa

SEQ ID NO: 9453450 - DNA, 22 bp, Homo sapiens
atatacagtatgtactgtggtt

SEQ ID NO: 9453451 - DNA, 22 bp, Homo sapiens
atatacagtatgtactgtggtt

SEQ ID NO: 9453452 - DNA, 22 bp, Homo sapiens
atatacaggtggtatgtgtaaa

SEQ ID NO: 9453453 - DNA, 22 bp, Homo sapiens
atatacaggtggtatgtgtaaa

SEQ ID NO: 9453454 - DNA, 22 bp, Homo sapiens
atatacctcattctttgagtgc

SEQ ID NO: 9453455 - DNA, 22 bp, Homo sapiens
atatacctgaagttggtaatta

SEQ ID NO: 9453456 - DNA, 22 bp, Homo sapiens
atatacttgatttaactgagca

SEQ ID NO: 9453457 - DNA, 19 bp, Homo sapiens
atatacatactgtgtgcat

SEQ ID NO: 9453458 - DNA, 20 bp, Homo sapiens
atataccatcccacaacagg

SEQ ID NO: 9453459 - DNA, 22 bp, Homo sapiens
atatacttggagactatcattg

SEQ ID NO: 9453460 - DNA, 22 bp, Homo sapiens
ctgggagaggaacctcgagggt

SEQ ID NO: 9453461 - DNA, 22 bp, Homo sapiens
ctgggagaggaacctcgagggt

SEQ ID NO: 9453462 - DNA, 22 bp, Homo sapiens
ctgggagaggaacctcgagggt

SEQ ID NO: 9453463 - DNA, 22 bp, Homo sapiens
ctgggagctggaatgggagaag

SEQ ID NO: 9453464 - DNA, 19 bp, Homo sapiens
ctggcctgtgtcctgtgct

SEQ ID NO: 9453465 - DNA, 22 bp, Homo sapiens
ctggccttgaggaggccaccaa

SEQ ID NO: 9453466 - DNA, 22 bp, Homo sapiens
ctggcctgtgggctgtctccgg

SEQ ID NO: 9453467 - DNA, 19 bp, Homo sapiens
ctggcctgtgtcctgtgct

SEQ ID NO: 9453468 - DNA, 22 bp, Homo sapiens
ctggcctgtgggctgtctccgg

SEQ ID NO: 9453469 - DNA, 22 bp, Homo sapiens
ctggcctgtgggctgtctccgg

SEQ ID NO: 9453470 - DNA, 22 bp, Homo sapiens
ctggcctcggcagcaggaacag

SEQ ID NO: 9453471 - DNA, 22 bp, Homo sapiens
ctggcctcggcagcaggaacag

SEQ ID NO: 9453472 - DNA, 22 bp, Homo sapiens
ctggcctctctgagcagggagc

SEQ ID NO: 9453473 - DNA, 22 bp, Homo sapiens
ctggcctctctgagcagggagc

SEQ ID NO: 9453474 - DNA, 22 bp, Homo sapiens
ctggcctctctgagcagggagc

SEQ ID NO: 9453475 - DNA, 22 bp, Homo sapiens
ctggcctctctgagcagggagc

SEQ ID NO: 9453476 - DNA, 22 bp, Homo sapiens
ctggcctctctgagcagggagc

SEQ ID NO: 9453477 - DNA, 22 bp, Homo sapiens
atagtttaccttccagatggct

SEQ ID NO: 9453478 - DNA, 22 bp, Homo sapiens
atagtttaccttccagatggct

SEQ ID NO: 9453479 - DNA, 22 bp, Homo sapiens
atagtgggtacaggggcagaga

SEQ ID NO: 9453480 - DNA, 22 bp, Homo sapiens
atagtgggtacaggggcagaga

SEQ ID NO: 9453481 - DNA, 22 bp, Homo sapiens
atagtgcagggaaggccaatct

SEQ ID NO: 9453482 - DNA, 22 bp, Homo sapiens
ctggctcacaggtgagatgcat

SEQ ID NO: 9453483 - DNA, 22 bp, Homo sapiens
ctggctcacaggtgagatgcat

SEQ ID NO: 9453484 - DNA, 22 bp, Homo sapiens
ctggctcaatttgtactgctgt

SEQ ID NO: 9453485 - DNA, 22 bp, Homo sapiens
ctggctcaatttgtactgctgt

SEQ ID NO: 9453486 - DNA, 22 bp, Homo sapiens
ctggctcaatttgtactgctgt

SEQ ID NO: 9453487 - DNA, 22 bp, Homo sapiens
ctggctcaataaatattagctg

SEQ ID NO: 9453488 - DNA, 22 bp, Homo sapiens
ctggctcaataaatattagctg

SEQ ID NO: 9453489 - DNA, 22 bp, Homo sapiens
ctggctaaagagcaagaagatg

SEQ ID NO: 9453490 - DNA, 22 bp, Homo sapiens
atagttttctatgcactgttat

SEQ ID NO: 9453491 - DNA, 22 bp, Homo sapiens
atagttttctatgcactgttat

SEQ ID NO: 9453492 - DNA, 23 bp, Homo sapiens
atagttttccctggttcttgcca

SEQ ID NO: 9453493 - DNA, 22 bp, Homo sapiens
atagttttatagatattgtgta

SEQ ID NO: 9453494 - DNA, 22 bp, Homo sapiens
atagttttaaaacctcaggaag

SEQ ID NO: 9453495 - DNA, 22 bp, Homo sapiens
atagttttatagatattgtgta

SEQ ID NO: 9453496 - DNA, 22 bp, Homo sapiens
atagttttatagatattgtgta

SEQ ID NO: 9453497 - DNA, 22 bp, Homo sapiens
atagttttatagatattgtgta

SEQ ID NO: 9453498 - DNA, 22 bp, Homo sapiens
atataaagagcttagtatagtg

SEQ ID NO: 9453499 - DNA, 22 bp, Homo sapiens
atataaagaagtggaaaatgag

SEQ ID NO: 9453500 - DNA, 22 bp, Homo sapiens
atataaagaagtggaaaatgag

SEQ ID NO: 9453501 - DNA, 22 bp, Homo sapiens
atataaagagcttagtatagtg

SEQ ID NO: 9453502 - DNA, 22 bp, Homo sapiens
atataaagaagtggaaaatgag

SEQ ID NO: 9453503 - DNA, 22 bp, Homo sapiens
atataaagaagtggaaaatgag

SEQ ID NO: 9453504 - DNA, 23 bp, Homo sapiens
atataaacaccagatagattgta

SEQ ID NO: 9453505 - DNA, 22 bp, Homo sapiens
ctggctcttgcgactcagcttg

SEQ ID NO: 9453506 - DNA, 22 bp, Homo sapiens
atataaagtgtttagaaagctg

SEQ ID NO: 9453507 - DNA, 22 bp, Homo sapiens
ctggctcttgcgactcagcttg

SEQ ID NO: 9453508 - DNA, 19 bp, Homo sapiens
ctggctcttgggtggagga

SEQ ID NO: 9453509 - DNA, 22 bp, Homo sapiens
ctggctcttggctagggagagt

SEQ ID NO: 9453510 - DNA, 22 bp, Homo sapiens
atataaagtgtttagaaagctg

SEQ ID NO: 9453511 - DNA, 22 bp, Homo sapiens
atataaagagcttagtatagtg

SEQ ID NO: 9453512 - DNA, 22 bp, Homo sapiens
atataaagtgtttagaaagctg

SEQ ID NO: 9453513 - DNA, 22 bp, Homo sapiens
ctggctgacacaaaggtatcga

SEQ ID NO: 9453514 - DNA, 22 bp, Homo sapiens
ctggctctttcagccgctggag

SEQ ID NO: 9453515 - DNA, 22 bp, Homo sapiens
ctggctctttcagccgctggag

SEQ ID NO: 9453516 - DNA, 22 bp, Homo sapiens
ctggctctttcagccgctggag

SEQ ID NO: 9453517 - DNA, 22 bp, Homo sapiens
ctggctctttcctagctaggct

SEQ ID NO: 9453518 - DNA, 22 bp, Homo sapiens
ctggctctttcctagctaggct

SEQ ID NO: 9453519 - DNA, 22 bp, Homo sapiens
ctggctctttcctagctaggct

SEQ ID NO: 9453520 - DNA, 22 bp, Homo sapiens
atattattctagtaacagtgat

SEQ ID NO: 9453521 - DNA, 22 bp, Homo sapiens
ctgggggcaatggtcagagtgt

SEQ ID NO: 9453522 - DNA, 19 bp, Homo sapiens
ctggggctttggtactgcc

SEQ ID NO: 9453523 - DNA, 19 bp, Homo sapiens
ctggggctttggtactgcc

SEQ ID NO: 9453524 - DNA, 19 bp, Homo sapiens
ctggggctttggtactgcc

SEQ ID NO: 9453525 - DNA, 22 bp, Homo sapiens
ctgggggcaagcagacagctgt

SEQ ID NO: 9453526 - DNA, 22 bp, Homo sapiens
ctgggggcaagcagacagctgt

SEQ ID NO: 9453527 - DNA, 22 bp, Homo sapiens
ctgggggcaagcagacagctgt

SEQ ID NO: 9453528 - DNA, 22 bp, Homo sapiens
ctggggctgtgggagacaaggc

SEQ ID NO: 9453529 - DNA, 22 bp, Homo sapiens
ctggggctgtgggagacaaggc

SEQ ID NO: 9453530 - DNA, 22 bp, Homo sapiens
ctggggcttcaatgcttcggtg

SEQ ID NO: 9453531 - DNA, 22 bp, Homo sapiens
ctggggcttcaatgcttcggtg

SEQ ID NO: 9453532 - DNA, 23 bp, Homo sapiens
ctggggctttcaaatctgggcag

SEQ ID NO: 9453533 - DNA, 19 bp, Homo sapiens
ctgggaggtgttcagagaa

SEQ ID NO: 9453534 - DNA, 22 bp, Homo sapiens
ctggggcatgggcccctagagg

SEQ ID NO: 9453535 - DNA, 22 bp, Homo sapiens
ctggggctgtaggaggacttat

SEQ ID NO: 9453536 - DNA, 22 bp, Homo sapiens
ctggggctgtaggaggacttat

SEQ ID NO: 9453537 - DNA, 22 bp, Homo sapiens
ctggggctgtaggaggacttat

SEQ ID NO: 9453538 - DNA, 22 bp, Homo sapiens
ctggggctgtaggaggacttat

SEQ ID NO: 9453539 - DNA, 22 bp, Homo sapiens
ctggggctgtgggagacaaggc

SEQ ID NO: 9453540 - DNA, 22 bp, Homo sapiens
ctgggaggacaacttggagctc

SEQ ID NO: 9453541 - DNA, 22 bp, Homo sapiens
ctgggaggacaacttggagctc

SEQ ID NO: 9453542 - DNA, 22 bp, Homo sapiens
ctgggagcttgttaggaatgca

SEQ ID NO: 9453543 - DNA, 22 bp, Homo sapiens
ctgggaggatacacaagatcag

SEQ ID NO: 9453544 - DNA, 22 bp, Homo sapiens
ctgggaggacaacttggagctc

SEQ ID NO: 9453545 - DNA, 22 bp, Homo sapiens
ctgggaggacaacttggagctc

SEQ ID NO: 9453546 - DNA, 22 bp, Homo sapiens
ctgggaggatacacaagatcag

SEQ ID NO: 9453547 - DNA, 22 bp, Homo sapiens
ctgggaggcggaggttgcagtg

SEQ ID NO: 9453548 - DNA, 22 bp, Homo sapiens
ctgggaggcggaggttgcagtg

SEQ ID NO: 9453549 - DNA, 22 bp, Homo sapiens
ctgggaggcggaggttgcagtg

SEQ ID NO: 9453550 - DNA, 22 bp, Homo sapiens
ctgggaggcggaggttgcagtg

SEQ ID NO: 9453551 - DNA, 22 bp, Homo sapiens
ctgggaggcggaggttgcagtg

SEQ ID NO: 9453552 - DNA, 22 bp, Homo sapiens
ctgggaggattcattgaggtga

SEQ ID NO: 9453553 - DNA, 22 bp, Homo sapiens
ctgggaggattcattgaggtga

SEQ ID NO: 9453554 - DNA, 20 bp, Homo sapiens
ctgggaggtcttccaaatca

SEQ ID NO: 9453555 - DNA, 22 bp, Homo sapiens
ctgggaggggtagccaatccta

SEQ ID NO: 9453556 - DNA, 22 bp, Homo sapiens
ctgggaggcggaggttgtagtg

SEQ ID NO: 9453557 - DNA, 22 bp, Homo sapiens
ctgggaggcggaggttgtagtg

SEQ ID NO: 9453558 - DNA, 22 bp, Homo sapiens
ctgggaggcggaggttgtagtg

SEQ ID NO: 9453559 - DNA, 22 bp, Homo sapiens
ctgggaggtggaggttgcattg

SEQ ID NO: 9453560 - DNA, 22 bp, Homo sapiens
ctgggaggtgaacagaaaaact

SEQ ID NO: 9453561 - DNA, 22 bp, Homo sapiens
atattattttccctggagttgt

SEQ ID NO: 9453562 - DNA, 22 bp, Homo sapiens
atattcaaattacatttactaa

SEQ ID NO: 9453563 - DNA, 22 bp, Homo sapiens
atattcaaattacatttactaa

SEQ ID NO: 9453564 - DNA, 22 bp, Homo sapiens
atattcaaattacatttactaa

SEQ ID NO: 9453565 - DNA, 22 bp, Homo sapiens
atattcaaattacatttactaa

SEQ ID NO: 9453566 - DNA, 22 bp, Homo sapiens
atattcactcctggtgagacta

SEQ ID NO: 9453567 - DNA, 23 bp, Homo sapiens
atattcacgccgccagaggtccc

SEQ ID NO: 9453568 - DNA, 23 bp, Homo sapiens
atattcacgccgccagaggtccc

SEQ ID NO: 9453569 - DNA, 22 bp, Homo sapiens
atattcactcctggtgagacta

SEQ ID NO: 9453570 - DNA, 23 bp, Homo sapiens
atattcacgccgccagaggtccc

SEQ ID NO: 9453571 - DNA, 22 bp, Homo sapiens
atattcacagtaagtgtagcag

SEQ ID NO: 9453572 - DNA, 22 bp, Homo sapiens
atattcacagtaagtgtagcag

SEQ ID NO: 9453573 - DNA, 22 bp, Homo sapiens
atattcacagatagaaggttct

SEQ ID NO: 9453574 - DNA, 22 bp, Homo sapiens
atattcactgagcataaagcca

SEQ ID NO: 9453575 - DNA, 22 bp, Homo sapiens
atattcactcctggtgagacta

SEQ ID NO: 9453576 - DNA, 18 bp, Homo sapiens
ctgggtctccaggctgcc

SEQ ID NO: 9453577 - DNA, 22 bp, Homo sapiens
atattcacactgtttagttaca

SEQ ID NO: 9453578 - DNA, 18 bp, Homo sapiens
atattcaagaagacagag

SEQ ID NO: 9453579 - DNA, 22 bp, Homo sapiens
ctgggtggagcctggtcatctg

SEQ ID NO: 9453580 - DNA, 18 bp, Homo sapiens
ctgggtctccaggctgcc

SEQ ID NO: 9453581 - DNA, 18 bp, Homo sapiens
ctgggtctccaggctgcc

SEQ ID NO: 9453582 - DNA, 20 bp, Homo sapiens
ctgggtggcaagcaaggggg

SEQ ID NO: 9453583 - DNA, 22 bp, Homo sapiens
ctgggtggatcgcagccccagg

SEQ ID NO: 9453584 - DNA, 22 bp, Homo sapiens
ctgggtggatcgcagccccagg

SEQ ID NO: 9453585 - DNA, 22 bp, Homo sapiens
ctgggtggcagagcctgcagtg

SEQ ID NO: 9453586 - DNA, 22 bp, Homo sapiens
ctgggtggcagagcctgcagtg

SEQ ID NO: 9453587 - DNA, 22 bp, Homo sapiens
ctgggtggcagagcctgcagtg

SEQ ID NO: 9453588 - DNA, 20 bp, Homo sapiens
ctgggtggcaagcaaggggg

SEQ ID NO: 9453589 - DNA, 22 bp, Homo sapiens
ctggtcaggaaggtggggacag

SEQ ID NO: 9453590 - DNA, 22 bp, Homo sapiens
ctggtcagggctctttgggagc

SEQ ID NO: 9453591 - DNA, 18 bp, Homo sapiens
ctggtcagggcaatgggc

SEQ ID NO: 9453592 - DNA, 18 bp, Homo sapiens
ctggtcagggcaatgggc

SEQ ID NO: 9453593 - DNA, 22 bp, Homo sapiens
ctggtcaggggatggggctcag

SEQ ID NO: 9453594 - DNA, 22 bp, Homo sapiens
ctgggtggcgtctggggccagt

SEQ ID NO: 9453595 - DNA, 22 bp, Homo sapiens
ctgggtggcgtctggggccagt

SEQ ID NO: 9453596 - DNA, 22 bp, Homo sapiens
ctgggtggctgtccagccagcc

SEQ ID NO: 9453597 - DNA, 22 bp, Homo sapiens
ctgggtggctgtccagccagcc

SEQ ID NO: 9453598 - DNA, 22 bp, Homo sapiens
ctgggtggctgtccagccagcc

SEQ ID NO: 9453599 - DNA, 22 bp, Homo sapiens
ctgggtggctgtccagccagcc

SEQ ID NO: 9453600 - DNA, 22 bp, Homo sapiens
ctggtccattctctccctgaag

SEQ ID NO: 9453601 - DNA, 22 bp, Homo sapiens
ctggtccattctctccctgaag

SEQ ID NO: 9453602 - DNA, 22 bp, Homo sapiens
ctggtccagtggatgctgaggg

SEQ ID NO: 9453603 - DNA, 17 bp, Homo sapiens
ctggtcccaccaagccc

SEQ ID NO: 9453604 - DNA, 22 bp, Homo sapiens
ctggtcccagaggcaagagatg

SEQ ID NO: 9453605 - DNA, 22 bp, Homo sapiens
ctggtcccagcagagctctgag

SEQ ID NO: 9453606 - DNA, 22 bp, Homo sapiens
ctggtcccagaggcaagagatg

SEQ ID NO: 9453607 - DNA, 22 bp, Homo sapiens
ctggtcccagctctgccaccaa

SEQ ID NO: 9453608 - DNA, 22 bp, Homo sapiens
ctggtcccagcagagctctgag

SEQ ID NO: 9453609 - DNA, 22 bp, Homo sapiens
ctggtcccagcagagctctgag

SEQ ID NO: 9453610 - DNA, 22 bp, Homo sapiens
ctggtcccagcagagctctgag

SEQ ID NO: 9453611 - DNA, 22 bp, Homo sapiens
atcaagaaaagtgctttcggct

SEQ ID NO: 9453612 - DNA, 22 bp, Homo sapiens
atcaagaacttattttggaaat

SEQ ID NO: 9453613 - DNA, 22 bp, Homo sapiens
ctggtccctggacctccctgga

SEQ ID NO: 9453614 - DNA, 22 bp, Homo sapiens
ctggtcctaaagccctactcca

SEQ ID NO: 9453615 - DNA, 22 bp, Homo sapiens
ctggtccctgcagtgtgctggg

SEQ ID NO: 9453616 - DNA, 22 bp, Homo sapiens
ctggtccctgcagtgtgctggg

SEQ ID NO: 9453617 - DNA, 22 bp, Homo sapiens
ctggtccctgcagtgtgctggg

SEQ ID NO: 9453618 - DNA, 22 bp, Homo sapiens
ctggtccctgcagtgtgctggg

SEQ ID NO: 9453619 - DNA, 22 bp, Homo sapiens
ctggtccctggacctccctgga

SEQ ID NO: 9453620 - DNA, 22 bp, Homo sapiens
ctggtccctggacctccctgga

SEQ ID NO: 9453621 - DNA, 22 bp, Homo sapiens
ctgtaaatggaactatgtagta

SEQ ID NO: 9453622 - DNA, 22 bp, Homo sapiens
ctgtaaatacctgcttgcttct

SEQ ID NO: 9453623 - DNA, 22 bp, Homo sapiens
ctgtaaataatgacagttgact

SEQ ID NO: 9453624 - DNA, 22 bp, Homo sapiens
ctgtaaataatgacagttgact

SEQ ID NO: 9453625 - DNA, 22 bp, Homo sapiens
ctgtaaacttctggaggtcaag

SEQ ID NO: 9453626 - DNA, 22 bp, Homo sapiens
atcacagattgtgaataactat

SEQ ID NO: 9453627 - DNA, 22 bp, Homo sapiens
atcacagcacacctgacatgta

SEQ ID NO: 9453628 - DNA, 22 bp, Homo sapiens
ctgtaaactaggtcatttttaa

SEQ ID NO: 9453629 - DNA, 20 bp, Homo sapiens
ctgtaaactgcgtctgtaat

SEQ ID NO: 9453630 - DNA, 20 bp, Homo sapiens
ctgtaaaccaggcttcttgg

SEQ ID NO: 9453631 - DNA, 22 bp, Homo sapiens
atcacagagattgcttttaaaa

SEQ ID NO: 9453632 - DNA, 18 bp, Homo sapiens
atcacagagggggagtct

SEQ ID NO: 9453633 - DNA, 22 bp, Homo sapiens
atcacaaaggtctcagagcaca

SEQ ID NO: 9453634 - DNA, 22 bp, Homo sapiens
atcaagaattgggagctattga

SEQ ID NO: 9453635 - DNA, 22 bp, Homo sapiens
atcacaaaggctgcttcatgat

SEQ ID NO: 9453636 - DNA, 22 bp, Homo sapiens
atcaagaatgttcattcttcta

SEQ ID NO: 9453637 - DNA, 22 bp, Homo sapiens
atcaagaatgttcattcttcta

SEQ ID NO: 9453638 - DNA, 22 bp, Homo sapiens
atcacaaaggctgcttcatgat

SEQ ID NO: 9453639 - DNA, 22 bp, Homo sapiens
atcacaaaggtctcagagcaca

SEQ ID NO: 9453640 - DNA, 22 bp, Homo sapiens
atcacaaaggtctcagagcaca

SEQ ID NO: 9453641 - DNA, 22 bp, Homo sapiens
atcacaatcttcaaatcgattc

SEQ ID NO: 9453642 - DNA, 22 bp, Homo sapiens
atcacaatccctctctctgata

SEQ ID NO: 9453643 - DNA, 22 bp, Homo sapiens
atcacaatgtacgttaaaatgt

SEQ ID NO: 9453644 - DNA, 22 bp, Homo sapiens
atcacactggacattggatact

SEQ ID NO: 9453645 - DNA, 22 bp, Homo sapiens
atcagcaggtgctggtggagac

SEQ ID NO: 9453646 - DNA, 22 bp, Homo sapiens
atcagcagatgctcaatgaaca

SEQ ID NO: 9453647 - DNA, 22 bp, Homo sapiens
atcagcacaacgtacagagaaa

SEQ ID NO: 9453648 - DNA, 22 bp, Homo sapiens
atcagcaatctcgtgtattagg

SEQ ID NO: 9453649 - DNA, 22 bp, Homo sapiens
atcagcatctttaacaattacc

SEQ ID NO: 9453650 - DNA, 22 bp, Homo sapiens
atcagccaattacagaacatga

SEQ ID NO: 9453651 - DNA, 22 bp, Homo sapiens
atcagctgaaaaacaggcagca

SEQ ID NO: 9453652 - DNA, 22 bp, Homo sapiens
atcagctgatgaatggatgaat

SEQ ID NO: 9453653 - DNA, 19 bp, Homo sapiens
atcagctgaagccttcaga

SEQ ID NO: 9453654 - DNA, 22 bp, Homo sapiens
atcagctcattttgatggaaat

SEQ ID NO: 9453655 - DNA, 22 bp, Homo sapiens
atcagctcaagaacgttcccca

SEQ ID NO: 9453656 - DNA, 22 bp, Homo sapiens
atcagctgaaaaacaggcagca

SEQ ID NO: 9453657 - DNA, 22 bp, Homo sapiens
ctgtaaatggaactatgtagta

SEQ ID NO: 9453658 - DNA, 22 bp, Homo sapiens
ctgtaatcccagctacctggga

SEQ ID NO: 9453659 - DNA, 22 bp, Homo sapiens
ctgtaatcccagctactcggga

SEQ ID NO: 9453660 - DNA, 22 bp, Homo sapiens
ctgtaatcccagctactcggga

SEQ ID NO: 9453661 - DNA, 22 bp, Homo sapiens
ctgtaatcccagctacctggga

SEQ ID NO: 9453662 - DNA, 22 bp, Homo sapiens
ctgtaatcccagctacctggga

SEQ ID NO: 9453663 - DNA, 22 bp, Homo sapiens
ctgtaatcccagctacctggga

SEQ ID NO: 9453664 - DNA, 22 bp, Homo sapiens
atcagtttatacttataaatct

SEQ ID NO: 9453665 - DNA, 22 bp, Homo sapiens
atcagtttatacttataaatct

SEQ ID NO: 9453666 - DNA, 22 bp, Homo sapiens
atcagtttatacttataaatct

SEQ ID NO: 9453667 - DNA, 22 bp, Homo sapiens
atcagtttcacttgcttgcaaa

SEQ ID NO: 9453668 - DNA, 22 bp, Homo sapiens
atcagtttggaacattcaggcc

SEQ ID NO: 9453669 - DNA, 22 bp, Homo sapiens
atcagtttggtgctttcagtga

SEQ ID NO: 9453670 - DNA, 22 bp, Homo sapiens
atcagtttctgtgaagaacaca

SEQ ID NO: 9453671 - DNA, 22 bp, Homo sapiens
atcagtttgagtgctgtgtcaa

SEQ ID NO: 9453672 - DNA, 22 bp, Homo sapiens
atcagttttgttcactactata

SEQ ID NO: 9453673 - DNA, 22 bp, Homo sapiens
atcagtttgtatatgaaacact

SEQ ID NO: 9453674 - DNA, 22 bp, Homo sapiens
atcagtttgtatatgaaacact

SEQ ID NO: 9453675 - DNA, 22 bp, Homo sapiens
atcataaaattgcaccatttct

SEQ ID NO: 9453676 - DNA, 22 bp, Homo sapiens
atcataaaattgcaccatttct

SEQ ID NO: 9453677 - DNA, 22 bp, Homo sapiens
atcataaaattgcaccatttct

SEQ ID NO: 9453678 - DNA, 22 bp, Homo sapiens
atcataaagtgctatctgattg

SEQ ID NO: 9453679 - DNA, 22 bp, Homo sapiens
atcataaaccactttgtaatct

SEQ ID NO: 9453680 - DNA, 22 bp, Homo sapiens
atcataaagtgctatctgattg

SEQ ID NO: 9453681 - DNA, 22 bp, Homo sapiens
atcataaaccactttgtaatct

SEQ ID NO: 9453682 - DNA, 22 bp, Homo sapiens
atcataaaccactttgtaatct

SEQ ID NO: 9453683 - DNA, 22 bp, Homo sapiens
atcataaaattgcaccatttct

SEQ ID NO: 9453684 - DNA, 22 bp, Homo sapiens
atcataaaattgcaccatttct

SEQ ID NO: 9453685 - DNA, 22 bp, Homo sapiens
atcataaaccactttgtaatct

SEQ ID NO: 9453686 - DNA, 22 bp, Homo sapiens
atcataattgctccagtgatat

SEQ ID NO: 9453687 - DNA, 22 bp, Homo sapiens
atcatacactcacataaacaga

SEQ ID NO: 9453688 - DNA, 22 bp, Homo sapiens
atcataaagtgctatctgattg

SEQ ID NO: 9453689 - DNA, 22 bp, Homo sapiens
atcataagacccagccagtatt

SEQ ID NO: 9453690 - DNA, 22 bp, Homo sapiens
atcataaagtgctatctgattg

SEQ ID NO: 9453691 - DNA, 22 bp, Homo sapiens
atcataaagtgctatctgattg

SEQ ID NO: 9453692 - DNA, 22 bp, Homo sapiens
atcataaagtgctatctgattg

SEQ ID NO: 9453693 - DNA, 22 bp, Homo sapiens
ctgtctcctccactgcatggga

SEQ ID NO: 9453694 - DNA, 22 bp, Homo sapiens
ctgtctcctcctttgttcttaa

SEQ ID NO: 9453695 - DNA, 22 bp, Homo sapiens
ctgtctcctccactgcatggga

SEQ ID NO: 9453696 - DNA, 22 bp, Homo sapiens
ctgtctccgccctcttggtagg

SEQ ID NO: 9453697 - DNA, 22 bp, Homo sapiens
ctgtctccgccctcttggtagg

SEQ ID NO: 9453698 - DNA, 22 bp, Homo sapiens
ctgtctccagggcaggtgcagg

SEQ ID NO: 9453699 - DNA, 22 bp, Homo sapiens
atcagtttaactgtcaagagcc

SEQ ID NO: 9453700 - DNA, 22 bp, Homo sapiens
ctgtctctctaggacactgggg

SEQ ID NO: 9453701 - DNA, 22 bp, Homo sapiens
ctgtctctgataagctcgaggg

SEQ ID NO: 9453702 - DNA, 22 bp, Homo sapiens
atcaggaaagaaaagcttggcg

SEQ ID NO: 9453703 - DNA, 22 bp, Homo sapiens
atcaggaaaaattgtgaaaggg

SEQ ID NO: 9453704 - DNA, 22 bp, Homo sapiens
atcaggaaagagtggaactctg

SEQ ID NO: 9453705 - DNA, 22 bp, Homo sapiens
atcagcttttctcatcagaaat

SEQ ID NO: 9453706 - DNA, 22 bp, Homo sapiens
atcagcttggaccaataagatg

SEQ ID NO: 9453707 - DNA, 22 bp, Homo sapiens
atcagctggaacaagtgtctga

SEQ ID NO: 9453708 - DNA, 22 bp, Homo sapiens
atcagcttaattctcaacaggt

SEQ ID NO: 9453709 - DNA, 22 bp, Homo sapiens
atcagctgatgaatggatgaat

SEQ ID NO: 9453710 - DNA, 22 bp, Homo sapiens
atcagctgatgaatggatgaat

SEQ ID NO: 9453711 - DNA, 22 bp, Homo sapiens
atcagctggaacaagtgtctga

SEQ ID NO: 9453712 - DNA, 22 bp, Homo sapiens
atcagctgctacattggcctct

SEQ ID NO: 9453713 - DNA, 22 bp, Homo sapiens
ctgtcgcctggtcctctctgga

SEQ ID NO: 9453714 - DNA, 19 bp, Homo sapiens
ctgtccttggctgcactgt

SEQ ID NO: 9453715 - DNA, 22 bp, Homo sapiens
ctgtctcaagactgcaggcact

SEQ ID NO: 9453716 - DNA, 22 bp, Homo sapiens
ctgtctcagcaggaagtcatca

SEQ ID NO: 9453717 - DNA, 22 bp, Homo sapiens
ctgtctatcccttccttccttt

SEQ ID NO: 9453718 - DNA, 22 bp, Homo sapiens
cttcaaatgtgattttaataac

SEQ ID NO: 9453719 - DNA, 22 bp, Homo sapiens
cttcaaatgtgattttaataac

SEQ ID NO: 9453720 - DNA, 22 bp, Homo sapiens
cttcaaatgtgattttaataac

SEQ ID NO: 9453721 - DNA, 22 bp, Homo sapiens
cttcaacttccctagatgtcat

SEQ ID NO: 9453722 - DNA, 22 bp, Homo sapiens
cttcaactttgtaagtagaatt

SEQ ID NO: 9453723 - DNA, 22 bp, Homo sapiens
cttcaacagttttagaacactg

SEQ ID NO: 9453724 - DNA, 22 bp, Homo sapiens
cttcaaattcgaggagtagatg

SEQ ID NO: 9453725 - DNA, 22 bp, Homo sapiens
cttcaacatacacagagagagg

SEQ ID NO: 9453726 - DNA, 22 bp, Homo sapiens
cttattcagaaggagaaatgga

SEQ ID NO: 9453727 - DNA, 22 bp, Homo sapiens
cttattcagaaggagaaatgga

SEQ ID NO: 9453728 - DNA, 22 bp, Homo sapiens
cttattcagatacagactcttg

SEQ ID NO: 9453729 - DNA, 22 bp, Homo sapiens
cttattcagcacttgctctgta

SEQ ID NO: 9453730 - DNA, 22 bp, Homo sapiens
cttatgtacacacatatattgt

SEQ ID NO: 9453731 - DNA, 22 bp, Homo sapiens
cttatgtaaactacagataata

SEQ ID NO: 9453732 - DNA, 22 bp, Homo sapiens
cttatgtataatgttccacata

SEQ ID NO: 9453733 - DNA, 22 bp, Homo sapiens
cttatgtataatgttccacata

SEQ ID NO: 9453734 - DNA, 22 bp, Homo sapiens
cttatgtatatttggaacgtac

SEQ ID NO: 9453735 - DNA, 22 bp, Homo sapiens
cttatgattcaaataggatctt

SEQ ID NO: 9453736 - DNA, 22 bp, Homo sapiens
cttatctgtaaaatggatacaa

SEQ ID NO: 9453737 - DNA, 22 bp, Homo sapiens
cttatgctgagaatgaaagaat

SEQ ID NO: 9453738 - DNA, 22 bp, Homo sapiens
cttatggaagaaacctcagaga

SEQ ID NO: 9453739 - DNA, 22 bp, Homo sapiens
cttatgtaaaacggaaagggaa

SEQ ID NO: 9453740 - DNA, 22 bp, Homo sapiens
cttattataaaatcctgtttga

SEQ ID NO: 9453741 - DNA, 22 bp, Homo sapiens
cttattaatggaatcctaatga

SEQ ID NO: 9453742 - DNA, 22 bp, Homo sapiens
cttatgtatgctactttgtggt

SEQ ID NO: 9453743 - DNA, 22 bp, Homo sapiens
cttattaatggaatcctaatga

SEQ ID NO: 9453744 - DNA, 22 bp, Homo sapiens
cttccttctgtaagaccagttg

SEQ ID NO: 9453745 - DNA, 22 bp, Homo sapiens
cttccttgcggcccctgcctag

SEQ ID NO: 9453746 - DNA, 22 bp, Homo sapiens
cttccttgcggcccctgcctag

SEQ ID NO: 9453747 - DNA, 22 bp, Homo sapiens
cttccttgcggcccctgcctag

SEQ ID NO: 9453748 - DNA, 19 bp, Homo sapiens
cttccttgctccccatgtg

SEQ ID NO: 9453749 - DNA, 19 bp, Homo sapiens
cttccttgctccccatgtg

SEQ ID NO: 9453750 - DNA, 22 bp, Homo sapiens
cttccttgctgtctgctccagg

SEQ ID NO: 9453751 - DNA, 22 bp, Homo sapiens
cttccttgctgtctgctccagg

SEQ ID NO: 9453752 - DNA, 22 bp, Homo sapiens
cttccttgctgtctgctccagg

SEQ ID NO: 9453753 - DNA, 22 bp, Homo sapiens
cttcctctatgttcaggtagaa

SEQ ID NO: 9453754 - DNA, 22 bp, Homo sapiens
cttcctctatgttcaggtagaa

SEQ ID NO: 9453755 - DNA, 22 bp, Homo sapiens
cttcctctcaataagatgagaa

SEQ ID NO: 9453756 - DNA, 22 bp, Homo sapiens
cttccttccttccccgaaatgc

SEQ ID NO: 9453757 - DNA, 22 bp, Homo sapiens
cttccttctcactagcagcgcc

SEQ ID NO: 9453758 - DNA, 22 bp, Homo sapiens
cttcaagttgggcggcgggcag

SEQ ID NO: 9453759 - DNA, 22 bp, Homo sapiens
cttcaagttgtctgagggtggg

SEQ ID NO: 9453760 - DNA, 22 bp, Homo sapiens
cttcaaggtggctaaatggggc

SEQ ID NO: 9453761 - DNA, 22 bp, Homo sapiens
cttcaagatccatagatattgc

SEQ ID NO: 9453762 - DNA, 21 bp, Homo sapiens
cttcaattcaacactgccatg

SEQ ID NO: 9453763 - DNA, 22 bp, Homo sapiens
cttcacaaatggcctagagttc

SEQ ID NO: 9453764 - DNA, 22 bp, Homo sapiens
cttcacaaatggcctagagttc

SEQ ID NO: 9453765 - DNA, 22 bp, Homo sapiens
cttcacaaaatatttcattata

SEQ ID NO: 9453766 - DNA, 22 bp, Homo sapiens
cttcacaaaatatttcattata

SEQ ID NO: 9453767 - DNA, 22 bp, Homo sapiens
cttcacaaagctctctttatgt

SEQ ID NO: 9453768 - DNA, 22 bp, Homo sapiens
atcatacatgtaactaagtaaa

SEQ ID NO: 9453769 - DNA, 22 bp, Homo sapiens
atcatacagaacctgagcactt

SEQ ID NO: 9453770 - DNA, 22 bp, Homo sapiens
atcatagaacacctacctacct

SEQ ID NO: 9453771 - DNA, 22 bp, Homo sapiens
ctgtttctccacactcttccca

SEQ ID NO: 9453772 - DNA, 22 bp, Homo sapiens
atcatcagggacatttctgtgc

SEQ ID NO: 9453773 - DNA, 22 bp, Homo sapiens
atcatcatcaacaagaaacatt

SEQ ID NO: 9453774 - DNA, 22 bp, Homo sapiens
cttaacaagcccaactttcatt

SEQ ID NO: 9453775 - DNA, 22 bp, Homo sapiens
cttaacaaacagtgtggatata

SEQ ID NO: 9453776 - DNA, 21 bp, Homo sapiens
cttaacattttaaatgaaagg

SEQ ID NO: 9453777 - DNA, 22 bp, Homo sapiens
cttaactctacactgcacttta

SEQ ID NO: 9453778 - DNA, 22 bp, Homo sapiens
cttaacttgatgtctctctgct

SEQ ID NO: 9453779 - DNA, 22 bp, Homo sapiens
cttaacttgatgtctctctgct

SEQ ID NO: 9453780 - DNA, 22 bp, Homo sapiens
cttaagaaattgcattctaatc

SEQ ID NO: 9453781 - DNA, 22 bp, Homo sapiens
cttaacatggggggtaagtctg

SEQ ID NO: 9453782 - DNA, 22 bp, Homo sapiens
cttaacatcctgcatttttctt

SEQ ID NO: 9453783 - DNA, 22 bp, Homo sapiens
cttaacatcctgcatttttctt

SEQ ID NO: 9453784 - DNA, 22 bp, Homo sapiens
cttaacatcctgcatttttctt

SEQ ID NO: 9453785 - DNA, 22 bp, Homo sapiens
cttaagcaaaatattctttcac

SEQ ID NO: 9453786 - DNA, 22 bp, Homo sapiens
cttaagagtctttctgtgttta

SEQ ID NO: 9453787 - DNA, 22 bp, Homo sapiens
cttaagaagcaagtctcagcaa

SEQ ID NO: 9453788 - DNA, 22 bp, Homo sapiens
cttaagaagcaagtctcagcaa

SEQ ID NO: 9453789 - DNA, 22 bp, Homo sapiens
cttaagaagcaagtctcagcaa

SEQ ID NO: 9453790 - DNA, 22 bp, Homo sapiens
cttaagaaattgcattctaatc

SEQ ID NO: 9453791 - DNA, 22 bp, Homo sapiens
cttaagaagcaagtctcagcaa

SEQ ID NO: 9453792 - DNA, 22 bp, Homo sapiens
cttaatctcacctgcaaagtcc

SEQ ID NO: 9453793 - DNA, 22 bp, Homo sapiens
cttaatctcacctgcaaagtcc

SEQ ID NO: 9453794 - DNA, 22 bp, Homo sapiens
atccatgaaggtacttctcagg

SEQ ID NO: 9453795 - DNA, 20 bp, Homo sapiens
atccatgagagtctggattc

SEQ ID NO: 9453796 - DNA, 22 bp, Homo sapiens
atccatctttcctgctgaactg

SEQ ID NO: 9453797 - DNA, 22 bp, Homo sapiens
atccatcttgatgtaatagcca

SEQ ID NO: 9453798 - DNA, 21 bp, Homo sapiens
atccatccatcttggcctaac

SEQ ID NO: 9453799 - DNA, 22 bp, Homo sapiens
atccatcccatcttcaccaggg

SEQ ID NO: 9453800 - DNA, 22 bp, Homo sapiens
atccatcagaagggcaaaattt

SEQ ID NO: 9453801 - DNA, 22 bp, Homo sapiens
atccatttgacataatttcagc

SEQ ID NO: 9453802 - DNA, 22 bp, Homo sapiens
atccatttgaaagaacagtcca

SEQ ID NO: 9453803 - DNA, 22 bp, Homo sapiens
atccatttgacataatttcagc

SEQ ID NO: 9453804 - DNA, 22 bp, Homo sapiens
atccatttctatcttgctgagg

SEQ ID NO: 9453805 - DNA, 22 bp, Homo sapiens
atccatttctatcttgctgagg

SEQ ID NO: 9453806 - DNA, 22 bp, Homo sapiens
atccatttcctccactataaag

SEQ ID NO: 9453807 - DNA, 22 bp, Homo sapiens
cttagatgaagtcacagaaccc

SEQ ID NO: 9453808 - DNA, 22 bp, Homo sapiens
cttagatgaagtcacagaaccc

SEQ ID NO: 9453809 - DNA, 22 bp, Homo sapiens
cttatctgtaaaatggatacaa

SEQ ID NO: 9453810 - DNA, 22 bp, Homo sapiens
atccatgattagtaggataaag

SEQ ID NO: 9453811 - DNA, 23 bp, Homo sapiens
atccatgcttaagtaatcatttg

SEQ ID NO: 9453812 - DNA, 22 bp, Homo sapiens
atccatgattagtaggataaag

SEQ ID NO: 9453813 - DNA, 23 bp, Homo sapiens
atccatgtgagaatagactagca

SEQ ID NO: 9453814 - DNA, 22 bp, Homo sapiens
atccatggaggacaagagcaat

SEQ ID NO: 9453815 - DNA, 22 bp, Homo sapiens
atccatggaggacaagagcaat

SEQ ID NO: 9453816 - DNA, 18 bp, Homo sapiens
atccatttaatgcctgga

SEQ ID NO: 9453817 - DNA, 22 bp, Homo sapiens
atccatttaattgaggggaagg

SEQ ID NO: 9453818 - DNA, 22 bp, Homo sapiens
atccatttcagtgttccacttg

SEQ ID NO: 9453819 - DNA, 22 bp, Homo sapiens
atccatttcagtgttccacttg

SEQ ID NO: 9453820 - DNA, 22 bp, Homo sapiens
atccattctatgtgaaatgtcc

SEQ ID NO: 9453821 - DNA, 21 bp, Homo sapiens
atccattctccggttaatgag

SEQ ID NO: 9453822 - DNA, 22 bp, Homo sapiens
atccattctatgtgaaatgtcc

SEQ ID NO: 9453823 - DNA, 21 bp, Homo sapiens
atccattctccggttaatgag

SEQ ID NO: 9453824 - DNA, 22 bp, Homo sapiens
atccattgtcttgttggcttct

SEQ ID NO: 9453825 - DNA, 22 bp, Homo sapiens
atccattgtcttgttggcttct

SEQ ID NO: 9453826 - DNA, 22 bp, Homo sapiens
atccattgtggtcttgtacatt

SEQ ID NO: 9453827 - DNA, 22 bp, Homo sapiens
cttctgtggatatgttctctct

SEQ ID NO: 9453828 - DNA, 22 bp, Homo sapiens
cttctgttactgttagctgaag

SEQ ID NO: 9453829 - DNA, 22 bp, Homo sapiens
cttctgtgcaattgtggaggag

SEQ ID NO: 9453830 - DNA, 22 bp, Homo sapiens
cttctgtgctaaatgcaaaacc

SEQ ID NO: 9453831 - DNA, 22 bp, Homo sapiens
cttctgctgccgcctcggcaca

SEQ ID NO: 9453832 - DNA, 22 bp, Homo sapiens
cttctgcccctgtagcctgagt

SEQ ID NO: 9453833 - DNA, 19 bp, Homo sapiens
cttctgcagggtgacagtg

SEQ ID NO: 9453834 - DNA, 22 bp, Homo sapiens
cttctgcagaattaattcacta

SEQ ID NO: 9453835 - DNA, 22 bp, Homo sapiens
cttctgcaggagtcaactctgg

SEQ ID NO: 9453836 - DNA, 22 bp, Homo sapiens
cttctgcaggccttattttagt

SEQ ID NO: 9453837 - DNA, 22 bp, Homo sapiens
cttctgcaggagtcaactctgg

SEQ ID NO: 9453838 - DNA, 22 bp, Homo sapiens
cttctgcaggccctgtctgacc

SEQ ID NO: 9453839 - DNA, 22 bp, Homo sapiens
cttctgcactgaccttttgtcc

SEQ ID NO: 9453840 - DNA, 22 bp, Homo sapiens
cttctgcaagagcatcagttgt

SEQ ID NO: 9453841 - DNA, 22 bp, Homo sapiens
cttctgcaataagttttggtcc

SEQ ID NO: 9453842 - DNA, 22 bp, Homo sapiens
cttctgagatgttgttttacag

SEQ ID NO: 9453843 - DNA, 22 bp, Homo sapiens
cttctgagatgttgttttacag

SEQ ID NO: 9453844 - DNA, 22 bp, Homo sapiens
cttctgagcagacctcctgggg

SEQ ID NO: 9453845 - DNA, 22 bp, Homo sapiens
cttctgagatgttgttttacag

SEQ ID NO: 9453846 - DNA, 22 bp, Homo sapiens
cttctgaggactctaaagagga

SEQ ID NO: 9453847 - DNA, 22 bp, Homo sapiens
atctctctgcccaggggctgtg

SEQ ID NO: 9453848 - DNA, 22 bp, Homo sapiens
atctctctatgcactgaggact

SEQ ID NO: 9453849 - DNA, 15 bp, Homo sapiens
atctctctagctgct

SEQ ID NO: 9453850 - DNA, 22 bp, Homo sapiens
atctctctatgcactgaggact

SEQ ID NO: 9453851 - DNA, 22 bp, Homo sapiens
atctctctgcccaggggctgtg

SEQ ID NO: 9453852 - DNA, 23 bp, Homo sapiens
atctctctggtggtcacagtcag

SEQ ID NO: 9453853 - DNA, 23 bp, Homo sapiens
atctctctggtggtcacagtcag

SEQ ID NO: 9453854 - DNA, 17 bp, Homo sapiens
atctctctaaggcaggc

SEQ ID NO: 9453855 - DNA, 22 bp, Homo sapiens
atctctccttcagctgaggccc

SEQ ID NO: 9453856 - DNA, 22 bp, Homo sapiens
cttctgacccctggtctacagc

SEQ ID NO: 9453857 - DNA, 22 bp, Homo sapiens
cttctgagatgttgttttacag

SEQ ID NO: 9453858 - DNA, 22 bp, Homo sapiens
cttccttgtggtccttctcatt

SEQ ID NO: 9453859 - DNA, 22 bp, Homo sapiens
cttccttgtggtccttctcatt

SEQ ID NO: 9453860 - DNA, 22 bp, Homo sapiens
cttccttgtggtccttctcatt

SEQ ID NO: 9453861 - DNA, 22 bp, Homo sapiens
cttccttggcttctggggtgtg

SEQ ID NO: 9453862 - DNA, 22 bp, Homo sapiens
cttccttggcttctggggtgtg

SEQ ID NO: 9453863 - DNA, 22 bp, Homo sapiens
cttccttgtggtccttctcatt

SEQ ID NO: 9453864 - DNA, 22 bp, Homo sapiens
cttccttgtggtccttctcatt

SEQ ID NO: 9453865 - DNA, 22 bp, Homo sapiens
cttcctttcagaggaaggcctg

SEQ ID NO: 9453866 - DNA, 18 bp, Homo sapiens
atctcccattggccaagg

SEQ ID NO: 9453867 - DNA, 23 bp, Homo sapiens
atctcctgagaacccacagtggt

SEQ ID NO: 9453868 - DNA, 22 bp, Homo sapiens
atctccgccatcgcgaacgcct

SEQ ID NO: 9453869 - DNA, 19 bp, Homo sapiens
atctcctttcttcaagctt

SEQ ID NO: 9453870 - DNA, 19 bp, Homo sapiens
atctcctttcttcaagctt

SEQ ID NO: 9453871 - DNA, 21 bp, Homo sapiens
atctcgggcttctcgcccagc

SEQ ID NO: 9453872 - DNA, 22 bp, Homo sapiens
atctctaaagtctgttcagctc

SEQ ID NO: 9453873 - DNA, 22 bp, Homo sapiens
atctctaatttaaaaagtaaca

SEQ ID NO: 9453874 - DNA, 22 bp, Homo sapiens
atctctaatcaccagctctagc

SEQ ID NO: 9453875 - DNA, 22 bp, Homo sapiens
atctgtctatgatatagtctgt

SEQ ID NO: 9453876 - DNA, 22 bp, Homo sapiens
atctgtctatgatatagtctgt

SEQ ID NO: 9453877 - DNA, 18 bp, Homo sapiens
atctgtcctttctctgcc

SEQ ID NO: 9453878 - DNA, 22 bp, Homo sapiens
atctgtctatgtggctatgtat

SEQ ID NO: 9453879 - DNA, 22 bp, Homo sapiens
atctgtctgagtgcttaggacc

SEQ ID NO: 9453880 - DNA, 22 bp, Homo sapiens
atctgtctggaggcctggcatg

SEQ ID NO: 9453881 - DNA, 22 bp, Homo sapiens
atctgtctggaggcctggcatg

SEQ ID NO: 9453882 - DNA, 22 bp, Homo sapiens
atctgtctgggtgcagcagtcc

SEQ ID NO: 9453883 - DNA, 22 bp, Homo sapiens
atctgtcttccaccacacatcc

SEQ ID NO: 9453884 - DNA, 22 bp, Homo sapiens
atctgtcttccaccacacatcc

SEQ ID NO: 9453885 - DNA, 22 bp, Homo sapiens
atctgtcttgccttgcatattt

SEQ ID NO: 9453886 - DNA, 22 bp, Homo sapiens
atctgtcttgccttgcatattt

SEQ ID NO: 9453887 - DNA, 22 bp, Homo sapiens
atctgtcttgccttgcatattt

SEQ ID NO: 9453888 - DNA, 22 bp, Homo sapiens
atctgtcttgccttgcatattt

SEQ ID NO: 9453889 - DNA, 22 bp, Homo sapiens
atctgtggaaattggcaagtgc

SEQ ID NO: 9453890 - DNA, 22 bp, Homo sapiens
atctgtcttttattcatgagct

SEQ ID NO: 9453891 - DNA, 22 bp, Homo sapiens
atctgtcttttattcatgagct

SEQ ID NO: 9453892 - DNA, 23 bp, Homo sapiens
atctgtgtgtgggtagggatgat

SEQ ID NO: 9453893 - DNA, 22 bp, Homo sapiens
atctgtgtgttcaggaagtcct

SEQ ID NO: 9453894 - DNA, 22 bp, Homo sapiens
atctgtgtatgtgaccttatct

SEQ ID NO: 9453895 - DNA, 22 bp, Homo sapiens
atctgtgtccttataagagaca

SEQ ID NO: 9453896 - DNA, 22 bp, Homo sapiens
atctgtggcagtgatgagtctt

SEQ ID NO: 9453897 - DNA, 22 bp, Homo sapiens
atcttatttaacacagcaaaac

SEQ ID NO: 9453898 - DNA, 22 bp, Homo sapiens
atcttcaaagaatttcttgtcc

SEQ ID NO: 9453899 - DNA, 22 bp, Homo sapiens
atctgttcccctatgctctcta

SEQ ID NO: 9453900 - DNA, 22 bp, Homo sapiens
atctgttcccctatgctctcta

SEQ ID NO: 9453901 - DNA, 22 bp, Homo sapiens
atctgttcccctatgctctcta

SEQ ID NO: 9453902 - DNA, 22 bp, Homo sapiens
atctgttatttacccatctctg

SEQ ID NO: 9453903 - DNA, 22 bp, Homo sapiens
atctgttcccctatgctctcta

SEQ ID NO: 9453904 - DNA, 22 bp, Homo sapiens
atctgttatttacccatctctg

SEQ ID NO: 9453905 - DNA, 22 bp, Homo sapiens
cttcttaaatatttggctgact

SEQ ID NO: 9453906 - DNA, 22 bp, Homo sapiens
cttcttaactgtatatactatg

SEQ ID NO: 9453907 - DNA, 22 bp, Homo sapiens
cttcttaactgtatatactatg

SEQ ID NO: 9453908 - DNA, 22 bp, Homo sapiens
cttcttaaattggattgctatt

SEQ ID NO: 9453909 - DNA, 22 bp, Homo sapiens
atctggctcttcctggagttcc

SEQ ID NO: 9453910 - DNA, 22 bp, Homo sapiens
atctggctctctcatttacaaa

SEQ ID NO: 9453911 - DNA, 22 bp, Homo sapiens
atctggctcgctaggctctggg

SEQ ID NO: 9453912 - DNA, 22 bp, Homo sapiens
atctggctcctacacttgaaga

SEQ ID NO: 9453913 - DNA, 22 bp, Homo sapiens
atctggctcattcagggaacgg

SEQ ID NO: 9453914 - DNA, 22 bp, Homo sapiens
cttcttaatcccttatatattt

SEQ ID NO: 9453915 - DNA, 22 bp, Homo sapiens
cttcttaatcccttatatattt

SEQ ID NO: 9453916 - DNA, 22 bp, Homo sapiens
atctggctcacttagtctagga

SEQ ID NO: 9453917 - DNA, 22 bp, Homo sapiens
atctgtatatttttcaatgcaa

SEQ ID NO: 9453918 - DNA, 22 bp, Homo sapiens
atctgtcaagatagactctgca

SEQ ID NO: 9453919 - DNA, 22 bp, Homo sapiens
atctgtcagcctgggattaggg

SEQ ID NO: 9453920 - DNA, 22 bp, Homo sapiens
atctgtcaggagcaaggactac

SEQ ID NO: 9453921 - DNA, 22 bp, Homo sapiens
atctgtcaggagcaaggactac

SEQ ID NO: 9453922 - DNA, 22 bp, Homo sapiens
atctgtaattttgaatgcaaat

SEQ ID NO: 9453923 - DNA, 22 bp, Homo sapiens
atctgtaactgctatcatctcc

SEQ ID NO: 9453924 - DNA, 22 bp, Homo sapiens
atctgtaattttgaatgcaaat

SEQ ID NO: 9453925 - DNA, 22 bp, Homo sapiens
atctgtaattttgaatgcaaat

SEQ ID NO: 9453926 - DNA, 22 bp, Homo sapiens
atctgtaacatcagtagcagaa

SEQ ID NO: 9453927 - DNA, 22 bp, Homo sapiens
atctgtaacatcagtagcagaa

SEQ ID NO: 9453928 - DNA, 22 bp, Homo sapiens
atctgtaacacacagaggagaa

SEQ ID NO: 9453929 - DNA, 22 bp, Homo sapiens
atctgtaaatgcaaatgtagct

SEQ ID NO: 9453930 - DNA, 22 bp, Homo sapiens
atctggtttggggatccttgtg

SEQ ID NO: 9453931 - DNA, 22 bp, Homo sapiens
atctggttttggctgtgtccct

SEQ ID NO: 9453932 - DNA, 22 bp, Homo sapiens
atctgtaaagataatcatatgt

SEQ ID NO: 9453933 - DNA, 22 bp, Homo sapiens
atctggttcttcttaggcatca

SEQ ID NO: 9453934 - DNA, 22 bp, Homo sapiens
ctattgaattaactattaaagt

SEQ ID NO: 9453935 - DNA, 19 bp, Homo sapiens
ctattgcacatagctgaag

SEQ ID NO: 9453936 - DNA, 22 bp, Homo sapiens
ctattgaaagtgtacaattcaa

SEQ ID NO: 9453937 - DNA, 22 bp, Homo sapiens
ctattgaatagcccaaatcatt

SEQ ID NO: 9453938 - DNA, 22 bp, Homo sapiens
ctattgaattaactattaaagt

SEQ ID NO: 9453939 - DNA, 22 bp, Homo sapiens
agtcctgggtccagcaggtcct

SEQ ID NO: 9453940 - DNA, 22 bp, Homo sapiens
ctatttatctatttctgaatga

SEQ ID NO: 9453941 - DNA, 22 bp, Homo sapiens
ctatttatctatttctgaatga

SEQ ID NO: 9453942 - DNA, 22 bp, Homo sapiens
ctattctgcttgaaattattct

SEQ ID NO: 9453943 - DNA, 22 bp, Homo sapiens
ctattctgattaccagatattg

SEQ ID NO: 9453944 - DNA, 22 bp, Homo sapiens
ctattctgattaccagatattg

SEQ ID NO: 9453945 - DNA, 22 bp, Homo sapiens
ctattctagattacagtataaa

SEQ ID NO: 9453946 - DNA, 22 bp, Homo sapiens
ctatgaccccagcatgaataag

SEQ ID NO: 9453947 - DNA, 22 bp, Homo sapiens
ctatgaaatgtcagattctgca

SEQ ID NO: 9453948 - DNA, 22 bp, Homo sapiens
ctatgaaaggatttggagttgt

SEQ ID NO: 9453949 - DNA, 22 bp, Homo sapiens
ctatgaaatgtcagattctgca

SEQ ID NO: 9453950 - DNA, 22 bp, Homo sapiens
ctatgaaaggatttggagttgt

SEQ ID NO: 9453951 - DNA, 22 bp, Homo sapiens
ctatctgtaaatttgaggttct

SEQ ID NO: 9453952 - DNA, 22 bp, Homo sapiens
ctatcttttgttcattttgagt

SEQ ID NO: 9453953 - DNA, 22 bp, Homo sapiens
ctatcccatccttctagctgac

SEQ ID NO: 9453954 - DNA, 18 bp, Homo sapiens
ctatccctggagcttggg

SEQ ID NO: 9453955 - DNA, 22 bp, Homo sapiens
agtcaggaacctcagcaagtct

SEQ ID NO: 9453956 - DNA, 22 bp, Homo sapiens
agtcaggaagctggagctgggg

SEQ ID NO: 9453957 - DNA, 22 bp, Homo sapiens
agtcaggaagctggagctgggg

SEQ ID NO: 9453958 - DNA, 22 bp, Homo sapiens
agtcaggaaaagctttcctgga

SEQ ID NO: 9453959 - DNA, 22 bp, Homo sapiens
agtcagcttgtctctagggttg

SEQ ID NO: 9453960 - DNA, 22 bp, Homo sapiens
agtcagctgctgcacacagcag

SEQ ID NO: 9453961 - DNA, 22 bp, Homo sapiens
agtcaggagctgctgcattgta

SEQ ID NO: 9453962 - DNA, 22 bp, Homo sapiens
agtcaggagatattttgatatg

SEQ ID NO: 9453963 - DNA, 22 bp, Homo sapiens
agtcaggacacagcatgaacat

SEQ ID NO: 9453964 - DNA, 22 bp, Homo sapiens
agtcaggacacagcatgaacat

SEQ ID NO: 9453965 - DNA, 22 bp, Homo sapiens
agtcaggatatgccttgtgggc

SEQ ID NO: 9453966 - DNA, 22 bp, Homo sapiens
agtcaggagctgctgcattgta

SEQ ID NO: 9453967 - DNA, 22 bp, Homo sapiens
agtcaggagatattttgatatg

SEQ ID NO: 9453968 - DNA, 22 bp, Homo sapiens
agtcaggagctgctgcattgta

SEQ ID NO: 9453969 - DNA, 22 bp, Homo sapiens
agtcaggacagattttctgggg

SEQ ID NO: 9453970 - DNA, 22 bp, Homo sapiens
agtcagctgcagcagctttggt

SEQ ID NO: 9453971 - DNA, 22 bp, Homo sapiens
agtcagcagtgaaagcacagcc

SEQ ID NO: 9453972 - DNA, 22 bp, Homo sapiens
agtcagcagtgaaagcacagcc

SEQ ID NO: 9453973 - DNA, 22 bp, Homo sapiens
agtcagcagcctggccaggaga

SEQ ID NO: 9453974 - DNA, 22 bp, Homo sapiens
agtcagcagcctggccaggaga

SEQ ID NO: 9453975 - DNA, 22 bp, Homo sapiens
agtcaggatttaaactcagaca

SEQ ID NO: 9453976 - DNA, 22 bp, Homo sapiens
agtcaggatatgccttgtgggc

SEQ ID NO: 9453977 - DNA, 22 bp, Homo sapiens
ctagtctctggaggtcagggct

SEQ ID NO: 9453978 - DNA, 22 bp, Homo sapiens
ctagtctgtgtgggaccagggc

SEQ ID NO: 9453979 - DNA, 20 bp, Homo sapiens
ctagtctttgctatctgcta

SEQ ID NO: 9453980 - DNA, 22 bp, Homo sapiens
ctatatctacatttgctgtttg

SEQ ID NO: 9453981 - DNA, 22 bp, Homo sapiens
ctatattggtaatatttgctca

SEQ ID NO: 9453982 - DNA, 22 bp, Homo sapiens
ctatattctggaatgtccattt

SEQ ID NO: 9453983 - DNA, 22 bp, Homo sapiens
ctatcattttacatggttggtg

SEQ ID NO: 9453984 - DNA, 22 bp, Homo sapiens
ctatcaaacagccattaatata

SEQ ID NO: 9453985 - DNA, 22 bp, Homo sapiens
ctatatttcttggctttaaaca

SEQ ID NO: 9453986 - DNA, 22 bp, Homo sapiens
ctaggaatcaccaagattctag

SEQ ID NO: 9453987 - DNA, 22 bp, Homo sapiens
ctaggaccactgtaacaaagta

SEQ ID NO: 9453988 - DNA, 22 bp, Homo sapiens
ctaggaccactgtaacaaagta

SEQ ID NO: 9453989 - DNA, 22 bp, Homo sapiens
ctaggaggcgggggctgcagta

SEQ ID NO: 9453990 - DNA, 22 bp, Homo sapiens
ctaggaggcgggggctgcagta

SEQ ID NO: 9453991 - DNA, 22 bp, Homo sapiens
ctaggaatagcaaagtaggaca

SEQ ID NO: 9453992 - DNA, 22 bp, Homo sapiens
ctaggaacagttcaacagttta

SEQ ID NO: 9453993 - DNA, 22 bp, Homo sapiens
ctaggaaatgaatacagtacac

SEQ ID NO: 9453994 - DNA, 22 bp, Homo sapiens
ctaggaaagacacagagagttt

SEQ ID NO: 9453995 - DNA, 22 bp, Homo sapiens
ctagcttagggaaactgacaga

SEQ ID NO: 9453996 - DNA, 22 bp, Homo sapiens
ctagagaaaaagcttaggtacg

SEQ ID NO: 9453997 - DNA, 23 bp, Homo sapiens
ctagaattttgctaaaagactag

SEQ ID NO: 9453998 - DNA, 22 bp, Homo sapiens
ctagaattgcattctatgaata

SEQ ID NO: 9453999 - DNA, 22 bp, Homo sapiens
agtcacatttgggggtgtcaaa

SEQ ID NO: 9454000 - DNA, 22 bp, Homo sapiens
ctagaattgcattctatgaata

SEQ ID NO: 9454001 - DNA, 20 bp, Homo sapiens
agtcacattgagcttttgga

SEQ ID NO: 9454002 - DNA, 21 bp, Homo sapiens
agtcacattgggggtttaggg

SEQ ID NO: 9454003 - DNA, 22 bp, Homo sapiens
agtcacatggactcaggatgac

SEQ ID NO: 9454004 - DNA, 22 bp, Homo sapiens
agtcacatggcagagagaagtt

SEQ ID NO: 9454005 - DNA, 22 bp, Homo sapiens
agtcacatggcagagagaagtt

SEQ ID NO: 9454006 - DNA, 22 bp, Homo sapiens
agtcacatggcagagagaagtt

SEQ ID NO: 9454007 - DNA, 22 bp, Homo sapiens
agtcacatgggattagaaccca

SEQ ID NO: 9454008 - DNA, 22 bp, Homo sapiens
agtcacattctggggtactggg

SEQ ID NO: 9454009 - DNA, 22 bp, Homo sapiens
agtcacattctggggtactggg

SEQ ID NO: 9454010 - DNA, 22 bp, Homo sapiens
agtcacatggactcaggatgac

SEQ ID NO: 9454011 - DNA, 22 bp, Homo sapiens
agtcacatgggattagaaccca

SEQ ID NO: 9454012 - DNA, 22 bp, Homo sapiens
agtcacatcgattataaaattt

SEQ ID NO: 9454013 - DNA, 23 bp, Homo sapiens
agtcacatcttagcagccaggtc

SEQ ID NO: 9454014 - DNA, 22 bp, Homo sapiens
agtcacatgagcactaattagg

SEQ ID NO: 9454015 - DNA, 22 bp, Homo sapiens
agtcacatgagcactaattagg

SEQ ID NO: 9454016 - DNA, 22 bp, Homo sapiens
agtcacatcgattataaaattt

SEQ ID NO: 9454017 - DNA, 22 bp, Homo sapiens
agtcacatcgattataaaattt

SEQ ID NO: 9454018 - DNA, 22 bp, Homo sapiens
agtcacatagtgttttggaatc

SEQ ID NO: 9454019 - DNA, 20 bp, Homo sapiens
agtcacatgcatacacaagt

SEQ ID NO: 9454020 - DNA, 20 bp, Homo sapiens
agtcacatgcatacacaagt

SEQ ID NO: 9454021 - DNA, 22 bp, Homo sapiens
agtcacatgcattttcttcaat

SEQ ID NO: 9454022 - DNA, 22 bp, Homo sapiens
agtcacatgaggaaggggaagg

SEQ ID NO: 9454023 - DNA, 22 bp, Homo sapiens
agtcacatgaggaaggggaagg

SEQ ID NO: 9454024 - DNA, 22 bp, Homo sapiens
agtcacatgagtttctctttat

SEQ ID NO: 9454025 - DNA, 20 bp, Homo sapiens
agtcacatgcatacacaagt

SEQ ID NO: 9454026 - DNA, 22 bp, Homo sapiens
agtcacatgatccctgggcctg

SEQ ID NO: 9454027 - DNA, 20 bp, Homo sapiens
agtcacagtatcagtcttag

SEQ ID NO: 9454028 - DNA, 22 bp, Homo sapiens
agtcacagttagactacccaag

SEQ ID NO: 9454029 - DNA, 22 bp, Homo sapiens
agtcacagttcctacccagtaa

SEQ ID NO: 9454030 - DNA, 22 bp, Homo sapiens
agtcacagttcctacccagtaa

SEQ ID NO: 9454031 - DNA, 22 bp, Homo sapiens
agtcacatagaagtgggtttaa

SEQ ID NO: 9454032 - DNA, 22 bp, Homo sapiens
agtcacatagctctggtttctt

SEQ ID NO: 9454033 - DNA, 22 bp, Homo sapiens
agtcacagttctgctgtctgag

SEQ ID NO: 9454034 - DNA, 22 bp, Homo sapiens
agtcacagtttccctgagagag

SEQ ID NO: 9454035 - DNA, 22 bp, Homo sapiens
agtcacaggcaagagggctcca

SEQ ID NO: 9454036 - DNA, 19 bp, Homo sapiens
agtcacagaccttgtctcc

SEQ ID NO: 9454037 - DNA, 22 bp, Homo sapiens
agtcacaggcaagagggctcca

SEQ ID NO: 9454038 - DNA, 22 bp, Homo sapiens
agtcacagggggcccctgcaac

SEQ ID NO: 9454039 - DNA, 22 bp, Homo sapiens
agtcacagggggcccctgcaac

SEQ ID NO: 9454040 - DNA, 19 bp, Homo sapiens
agtcacagggaagaggaac

SEQ ID NO: 9454041 - DNA, 22 bp, Homo sapiens
agtcacagaaacccaggtgtgg

SEQ ID NO: 9454042 - DNA, 22 bp, Homo sapiens
agtcacagaatgatggctccag

SEQ ID NO: 9454043 - DNA, 22 bp, Homo sapiens
agtcacagaatgatggctccag

SEQ ID NO: 9454044 - DNA, 22 bp, Homo sapiens
agtcacagaaacccaggtgtgg

SEQ ID NO: 9454045 - DNA, 22 bp, Homo sapiens
agtcaattatctctaggtcatc

SEQ ID NO: 9454046 - DNA, 22 bp, Homo sapiens
agtcaattatctctaggtcatc

SEQ ID NO: 9454047 - DNA, 22 bp, Homo sapiens
agtaaacatgtaattgttcatt

SEQ ID NO: 9454048 - DNA, 22 bp, Homo sapiens
agtaaacatgtaattgttcatt

SEQ ID NO: 9454049 - DNA, 22 bp, Homo sapiens
agtaaacatttcagatttattt

SEQ ID NO: 9454050 - DNA, 22 bp, Homo sapiens
agtaaacatttcagatttattt

SEQ ID NO: 9454051 - DNA, 22 bp, Homo sapiens
agtaaacataatttacctgtag

SEQ ID NO: 9454052 - DNA, 22 bp, Homo sapiens
agtaaacatagaatgttcttcc

SEQ ID NO: 9454053 - DNA, 22 bp, Homo sapiens
agtaaacataatttacctgtag

SEQ ID NO: 9454054 - DNA, 22 bp, Homo sapiens
agtaaacattttcatattttct

SEQ ID NO: 9454055 - DNA, 22 bp, Homo sapiens
agtaaactgtgggtacagatgt

SEQ ID NO: 9454056 - DNA, 22 bp, Homo sapiens
agtaaagcagagttgcagtaca

SEQ ID NO: 9454057 - DNA, 22 bp, Homo sapiens
agtaaagcagagttgcagtaca

SEQ ID NO: 9454058 - DNA, 22 bp, Homo sapiens
agtaaagcctactcaaccacac

SEQ ID NO: 9454059 - DNA, 22 bp, Homo sapiens
agtaaagcattgtcttcagagt

SEQ ID NO: 9454060 - DNA, 18 bp, Homo sapiens
agtaaatgttaaatattg

SEQ ID NO: 9454061 - DNA, 18 bp, Homo sapiens
agtaaatgttaaatattg

SEQ ID NO: 9454062 - DNA, 22 bp, Homo sapiens
agtaaatgtttatcacacagat

SEQ ID NO: 9454063 - DNA, 22 bp, Homo sapiens
agtaaatgaaagcaattttaga

SEQ ID NO: 9454064 - DNA, 22 bp, Homo sapiens
agtaaatgaaagcaattttaga

SEQ ID NO: 9454065 - DNA, 22 bp, Homo sapiens
agtaaatgaaagcaattttaga

SEQ ID NO: 9454066 - DNA, 22 bp, Homo sapiens
agtaaatgaaagcaattttaga

SEQ ID NO: 9454067 - DNA, 22 bp, Homo sapiens
agtaaatgaaagcaattttaga

SEQ ID NO: 9454068 - DNA, 18 bp, Homo sapiens
agtaaatgctaaggtctg

SEQ ID NO: 9454069 - DNA, 18 bp, Homo sapiens
agtaaatgctaaggtctg

SEQ ID NO: 9454070 - DNA, 22 bp, Homo sapiens
agtaaataacagagaaaatggg

SEQ ID NO: 9454071 - DNA, 22 bp, Homo sapiens
agtaaataacagagaaaatggg

SEQ ID NO: 9454072 - DNA, 22 bp, Homo sapiens
agtaaataacagagaaaatggg

SEQ ID NO: 9454073 - DNA, 22 bp, Homo sapiens
agtaaataacagagaaaatggg

SEQ ID NO: 9454074 - DNA, 22 bp, Homo sapiens
agtaaaggaaggaccttggaag

SEQ ID NO: 9454075 - DNA, 22 bp, Homo sapiens
agtaaataacagagaaaatggg

SEQ ID NO: 9454076 - DNA, 22 bp, Homo sapiens
agtaaataacagagaaaatggg

SEQ ID NO: 9454077 - DNA, 22 bp, Homo sapiens
agtaaagcggtgtcacagaatg

SEQ ID NO: 9454078 - DNA, 22 bp, Homo sapiens
agtaaagcggtgtcacagaatg

SEQ ID NO: 9454079 - DNA, 22 bp, Homo sapiens
ccttctctaccatgtgaggaaa

SEQ ID NO: 9454080 - DNA, 22 bp, Homo sapiens
ccttctcctgccttgggttcat

SEQ ID NO: 9454081 - DNA, 22 bp, Homo sapiens
ccttctctaccatgtgaggaaa

SEQ ID NO: 9454082 - DNA, 22 bp, Homo sapiens
ccttctccctctgagaggaacc

SEQ ID NO: 9454083 - DNA, 22 bp, Homo sapiens
ccttctccctctgagaggaacc

SEQ ID NO: 9454084 - DNA, 22 bp, Homo sapiens
ccttctcctgccttgggttcat

SEQ ID NO: 9454085 - DNA, 22 bp, Homo sapiens
agtaaacagtttcttagaagaa

SEQ ID NO: 9454086 - DNA, 22 bp, Homo sapiens
agtaaaaatatgcttgtggcta

SEQ ID NO: 9454087 - DNA, 22 bp, Homo sapiens
agtaaaaatatgcttgtggcta

SEQ ID NO: 9454088 - DNA, 22 bp, Homo sapiens
ccttctctctgaagaccccaaa

SEQ ID NO: 9454089 - DNA, 22 bp, Homo sapiens
ccttctctactcctgatgcatg

SEQ ID NO: 9454090 - DNA, 22 bp, Homo sapiens
ccttctctctgaagaccccaaa

SEQ ID NO: 9454091 - DNA, 21 bp, Homo sapiens
ccttctccattacagtaagct

SEQ ID NO: 9454092 - DNA, 20 bp, Homo sapiens
ccttctccagcttgttcttg

SEQ ID NO: 9454093 - DNA, 21 bp, Homo sapiens
ccttctccattacagtaagct

SEQ ID NO: 9454094 - DNA, 20 bp, Homo sapiens
ccttctccagcttgttcttg

SEQ ID NO: 9454095 - DNA, 21 bp, Homo sapiens
ccttctccattacagtaagct

SEQ ID NO: 9454096 - DNA, 22 bp, Homo sapiens
ccttctcccctctgcagggtgt

SEQ ID NO: 9454097 - DNA, 22 bp, Homo sapiens
ccttctccctctgagaggaacc

SEQ ID NO: 9454098 - DNA, 22 bp, Homo sapiens
ccttccaggttttggctccatt

SEQ ID NO: 9454099 - DNA, 22 bp, Homo sapiens
ccttccagtatgttaagatggt

SEQ ID NO: 9454100 - DNA, 22 bp, Homo sapiens
agtatttctgaatattatcata

SEQ ID NO: 9454101 - DNA, 22 bp, Homo sapiens
agtatttctgaatattatcata

SEQ ID NO: 9454102 - DNA, 22 bp, Homo sapiens
agtatttctgctcatgaaagag

SEQ ID NO: 9454103 - DNA, 22 bp, Homo sapiens
agtatttctgctcatgaaagag

SEQ ID NO: 9454104 - DNA, 22 bp, Homo sapiens
agtcaagagacttaaaatattt

SEQ ID NO: 9454105 - DNA, 22 bp, Homo sapiens
agtcaatattcaagtgtaaata

SEQ ID NO: 9454106 - DNA, 20 bp, Homo sapiens
agtaggggaatgcaagagca

SEQ ID NO: 9454107 - DNA, 20 bp, Homo sapiens
agtaggggaatgcaagagca

SEQ ID NO: 9454108 - DNA, 22 bp, Homo sapiens
agtatttcctggcttatctgct

SEQ ID NO: 9454109 - DNA, 20 bp, Homo sapiens
agtaggggaatgcaagagca

SEQ ID NO: 9454110 - DNA, 22 bp, Homo sapiens
agtaggctgttttatgggccaa

SEQ ID NO: 9454111 - DNA, 22 bp, Homo sapiens
agtaggcagaagtggcattcgg

SEQ ID NO: 9454112 - DNA, 22 bp, Homo sapiens
agtaggcatagaaagaagcacc

SEQ ID NO: 9454113 - DNA, 22 bp, Homo sapiens
agtaggcattgtgaaactgcat

SEQ ID NO: 9454114 - DNA, 22 bp, Homo sapiens
agtaggaggcgggagcatgaag

SEQ ID NO: 9454115 - DNA, 22 bp, Homo sapiens
agtagcttatagccaaagagag

SEQ ID NO: 9454116 - DNA, 22 bp, Homo sapiens
agtagccaacatttatgatcca

SEQ ID NO: 9454117 - DNA, 22 bp, Homo sapiens
agtaggaggcgggagcatgaag

SEQ ID NO: 9454118 - DNA, 22 bp, Homo sapiens
agtagcagtgacagctgaggta

SEQ ID NO: 9454119 - DNA, 22 bp, Homo sapiens
agtagcagtgacagctgaggta

SEQ ID NO: 9454120 - DNA, 20 bp, Homo sapiens
agtagcagtgtgacattgac

SEQ ID NO: 9454121 - DNA, 20 bp, Homo sapiens
agtagcagtgtgacattgac

SEQ ID NO: 9454122 - DNA, 22 bp, Homo sapiens
agtagcagagttggactatgca

SEQ ID NO: 9454123 - DNA, 20 bp, Homo sapiens
agtagcagtaatatggaaga

SEQ ID NO: 9454124 - DNA, 22 bp, Homo sapiens
agtagcagaaggtcttgaaggg

SEQ ID NO: 9454125 - DNA, 22 bp, Homo sapiens
agtagcagaaggtcttgaaggg

SEQ ID NO: 9454126 - DNA, 22 bp, Homo sapiens
agtagcagaaggtcttgaaggg

SEQ ID NO: 9454127 - DNA, 19 bp, Homo sapiens
agtagcagaaagtgcagtg

SEQ ID NO: 9454128 - DNA, 19 bp, Homo sapiens
agtagcagaaagtgcagtg

SEQ ID NO: 9454129 - DNA, 22 bp, Homo sapiens
agtagacattttgcaacatctg

SEQ ID NO: 9454130 - DNA, 22 bp, Homo sapiens
agtagaggccaggcctccctgg

SEQ ID NO: 9454131 - DNA, 22 bp, Homo sapiens
agtagacatgagcaatgataat

SEQ ID NO: 9454132 - DNA, 22 bp, Homo sapiens
agtagacagacagaacacagcc

SEQ ID NO: 9454133 - DNA, 22 bp, Homo sapiens
agtagaatcccttgcaatgtcc

SEQ ID NO: 9454134 - DNA, 22 bp, Homo sapiens
agtagaatcagcctcttgatgg

SEQ ID NO: 9454135 - DNA, 22 bp, Homo sapiens
agtagacaataattcaactccc

SEQ ID NO: 9454136 - DNA, 22 bp, Homo sapiens
agtagaatagatggatactatt

SEQ ID NO: 9454137 - DNA, 22 bp, Homo sapiens
agtagaataattggattacagt

SEQ ID NO: 9454138 - DNA, 22 bp, Homo sapiens
agtagaatagatggatactatt

SEQ ID NO: 9454139 - DNA, 22 bp, Homo sapiens
agtacagtggtcataatataaa

SEQ ID NO: 9454140 - DNA, 22 bp, Homo sapiens
agtacatacttcaaatgtactt

SEQ ID NO: 9454141 - DNA, 22 bp, Homo sapiens
agtacatacttcaaatgtactt

SEQ ID NO: 9454142 - DNA, 22 bp, Homo sapiens
agtagaaatgtaagaaggatta

SEQ ID NO: 9454143 - DNA, 22 bp, Homo sapiens
agtaacaagtgccaacgttaga

SEQ ID NO: 9454144 - DNA, 22 bp, Homo sapiens
agtaacaagtgccaacgttaga

SEQ ID NO: 9454145 - DNA, 22 bp, Homo sapiens
agtaacaagtgccaacgttaga

SEQ ID NO: 9454146 - DNA, 22 bp, Homo sapiens
agtaacacttggaatgatagca

SEQ ID NO: 9454147 - DNA, 22 bp, Homo sapiens
agtaacactattttcatatgta

SEQ ID NO: 9454148 - DNA, 22 bp, Homo sapiens
agtaacacttggaatgatagca

SEQ ID NO: 9454149 - DNA, 22 bp, Homo sapiens
agtaacactattttcatatgta

SEQ ID NO: 9454150 - DNA, 22 bp, Homo sapiens
agtaacacaagaggtccttgcg

SEQ ID NO: 9454151 - DNA, 22 bp, Homo sapiens
agtaacactattttcatatgta

SEQ ID NO: 9454152 - DNA, 22 bp, Homo sapiens
agtaacaaatattcattggatt

SEQ ID NO: 9454153 - DNA, 22 bp, Homo sapiens
agtaacaaagtgggagaatgat

SEQ ID NO: 9454154 - DNA, 22 bp, Homo sapiens
agtaacaaatagctgcctttaa

SEQ ID NO: 9454155 - DNA, 22 bp, Homo sapiens
aggtcaggaggcctctgccatt

SEQ ID NO: 9454156 - DNA, 22 bp, Homo sapiens
aggtcaggaggcctctgccatt

SEQ ID NO: 9454157 - DNA, 18 bp, Homo sapiens
aggtcaggaaagcagagt

SEQ ID NO: 9454158 - DNA, 22 bp, Homo sapiens
aggtcaggaggttaagagtctt

SEQ ID NO: 9454159 - DNA, 22 bp, Homo sapiens
aggtcaggaggcctctgccatt

SEQ ID NO: 9454160 - DNA, 22 bp, Homo sapiens
aggtcagctgctgataggcagc

SEQ ID NO: 9454161 - DNA, 22 bp, Homo sapiens
aggtcagctgcactggtgtaat

SEQ ID NO: 9454162 - DNA, 22 bp, Homo sapiens
aggtcagctgctgataggcagc

SEQ ID NO: 9454163 - DNA, 22 bp, Homo sapiens
aggtcagctgtgtgtgcatgag

SEQ ID NO: 9454164 - DNA, 18 bp, Homo sapiens
aggtcaggaaagcagagt

SEQ ID NO: 9454165 - DNA, 22 bp, Homo sapiens
aggtcagcatgctcctctctgt

SEQ ID NO: 9454166 - DNA, 21 bp, Homo sapiens
aggtcagcccagctctggaag

SEQ ID NO: 9454167 - DNA, 22 bp, Homo sapiens
aggtcagagcaatgtattgctt

SEQ ID NO: 9454168 - DNA, 22 bp, Homo sapiens
aggtcagatgggagatgggatg

SEQ ID NO: 9454169 - DNA, 20 bp, Homo sapiens
aggtcactgttagggcattc

SEQ ID NO: 9454170 - DNA, 20 bp, Homo sapiens
aggtcactgttagggcattc

SEQ ID NO: 9454171 - DNA, 22 bp, Homo sapiens
aggtcacgtcctgtgatgtcat

SEQ ID NO: 9454172 - DNA, 22 bp, Homo sapiens
aggtcagaaaaggagagcattg

SEQ ID NO: 9454173 - DNA, 22 bp, Homo sapiens
aggtcagaagtgccagggaatt

SEQ ID NO: 9454174 - DNA, 22 bp, Homo sapiens
aggtcagaaaaggagagcattg

SEQ ID NO: 9454175 - DNA, 22 bp, Homo sapiens
aggtcaccatggcatgctccac

SEQ ID NO: 9454176 - DNA, 22 bp, Homo sapiens
aggtcacatggataatgatcag

SEQ ID NO: 9454177 - DNA, 22 bp, Homo sapiens
cctgggaggctgaggctgcagt

SEQ ID NO: 9454178 - DNA, 21 bp, Homo sapiens
cctgggagaattgggtgtggc

SEQ ID NO: 9454179 - DNA, 22 bp, Homo sapiens
cctgggaggctgaggctgcagt

SEQ ID NO: 9454180 - DNA, 22 bp, Homo sapiens
cctgggaggctgaggctgcagt

SEQ ID NO: 9454181 - DNA, 22 bp, Homo sapiens
cctgggaggctgaggctgcagt

SEQ ID NO: 9454182 - DNA, 22 bp, Homo sapiens
cctgggagaactgctgggttgg

SEQ ID NO: 9454183 - DNA, 22 bp, Homo sapiens
aggtcaggtatcagcaggtatt

SEQ ID NO: 9454184 - DNA, 22 bp, Homo sapiens
aggtcaggtatcagcaggtatt

SEQ ID NO: 9454185 - DNA, 22 bp, Homo sapiens
aggtcagggtattcacgtctgt

SEQ ID NO: 9454186 - DNA, 22 bp, Homo sapiens
aggtcagggtattcacgtctgt

SEQ ID NO: 9454187 - DNA, 22 bp, Homo sapiens
aggtcaggaggttaagagtctt

SEQ ID NO: 9454188 - DNA, 22 bp, Homo sapiens
aggtcagggtattcacgtctgt

SEQ ID NO: 9454189 - DNA, 22 bp, Homo sapiens
aggtcaggtatcagcaggtatt

SEQ ID NO: 9454190 - DNA, 22 bp, Homo sapiens
cctgggaggctgtgggtctgct

SEQ ID NO: 9454191 - DNA, 22 bp, Homo sapiens
cctgggagggcaagtgctgatg

SEQ ID NO: 9454192 - DNA, 22 bp, Homo sapiens
cctgggagggcaagtgctgatg

SEQ ID NO: 9454193 - DNA, 22 bp, Homo sapiens
cctgggaggtggaggttgcagt

SEQ ID NO: 9454194 - DNA, 22 bp, Homo sapiens
cctgggaggtggaggttgcagt

SEQ ID NO: 9454195 - DNA, 22 bp, Homo sapiens
cctgggaggtggaggttgcagc

SEQ ID NO: 9454196 - DNA, 22 bp, Homo sapiens
cctgggaggtggaggttgcagc

SEQ ID NO: 9454197 - DNA, 22 bp, Homo sapiens
agggttgcttgagcccaggagt

SEQ ID NO: 9454198 - DNA, 22 bp, Homo sapiens
aggtaaagaaaggtgtaacatt

SEQ ID NO: 9454199 - DNA, 22 bp, Homo sapiens
aggtaaaatagatagtatttct

SEQ ID NO: 9454200 - DNA, 22 bp, Homo sapiens
aggtaaaatagatagtatttct

SEQ ID NO: 9454201 - DNA, 22 bp, Homo sapiens
aggtaaaatgagtctccattat

SEQ ID NO: 9454202 - DNA, 22 bp, Homo sapiens
agggttgcaggggccatgccca

SEQ ID NO: 9454203 - DNA, 22 bp, Homo sapiens
agggttgcctctgagtgctccg

SEQ ID NO: 9454204 - DNA, 22 bp, Homo sapiens
agggttgcagcagaggcccagt

SEQ ID NO: 9454205 - DNA, 22 bp, Homo sapiens
agggttctgccagtgtcttgag

SEQ ID NO: 9454206 - DNA, 20 bp, Homo sapiens
agggttcccttgttcagcag

SEQ ID NO: 9454207 - DNA, 20 bp, Homo sapiens
agggttcccttgttcagcag

SEQ ID NO: 9454208 - DNA, 22 bp, Homo sapiens
agggttcccatcacctccttcc

SEQ ID NO: 9454209 - DNA, 22 bp, Homo sapiens
agggtgggctagactcttcccc

SEQ ID NO: 9454210 - DNA, 22 bp, Homo sapiens
agggtgggctagactcttcccc

SEQ ID NO: 9454211 - DNA, 22 bp, Homo sapiens
cctgagtagctggaattaaagg

SEQ ID NO: 9454212 - DNA, 22 bp, Homo sapiens
cctgaggtggctgcagcactgc

SEQ ID NO: 9454213 - DNA, 18 bp, Homo sapiens
cctgaggtgggaggaagg

SEQ ID NO: 9454214 - DNA, 22 bp, Homo sapiens
cctgaggttatccatctacctg

SEQ ID NO: 9454215 - DNA, 22 bp, Homo sapiens
aggtacagatgaaagtctagtt

SEQ ID NO: 9454216 - DNA, 22 bp, Homo sapiens
aggtacagatgaaagtctagtt

SEQ ID NO: 9454217 - DNA, 22 bp, Homo sapiens
aggtaatagggttcagaattat

SEQ ID NO: 9454218 - DNA, 22 bp, Homo sapiens
aggtaaggtttggaggcagtgg

SEQ ID NO: 9454219 - DNA, 22 bp, Homo sapiens
aggtaatttctccaaacatgct

SEQ ID NO: 9454220 - DNA, 22 bp, Homo sapiens
aggtaatgcaactactttgcta

SEQ ID NO: 9454221 - DNA, 20 bp, Homo sapiens
aggtaatgggagaaaatgtt

SEQ ID NO: 9454222 - DNA, 17 bp, Homo sapiens
aggtatttaaggagctg

SEQ ID NO: 9454223 - DNA, 22 bp, Homo sapiens
aggtatttacccacttttgttt

SEQ ID NO: 9454224 - DNA, 22 bp, Homo sapiens
aggtatttatgagagcacatat

SEQ ID NO: 9454225 - DNA, 22 bp, Homo sapiens
aggtacagcaatataagaggtc

SEQ ID NO: 9454226 - DNA, 22 bp, Homo sapiens
aggtcacagctttctcgtgagg

SEQ ID NO: 9454227 - DNA, 22 bp, Homo sapiens
aggtaacagcttcagcttcaga

SEQ ID NO: 9454228 - DNA, 22 bp, Homo sapiens
aggtaaatgtcagagcctttaa

SEQ ID NO: 9454229 - DNA, 22 bp, Homo sapiens
aggtaagcatggtggctgctgt

SEQ ID NO: 9454230 - DNA, 22 bp, Homo sapiens
aggtaactgtggctaggtaact

SEQ ID NO: 9454231 - DNA, 22 bp, Homo sapiens
aggtaacattgcctccatctga

SEQ ID NO: 9454232 - DNA, 22 bp, Homo sapiens
aggtaactggctaactgaacga

SEQ ID NO: 9454233 - DNA, 22 bp, Homo sapiens
aggtaaggctgtaagctaagcc

SEQ ID NO: 9454234 - DNA, 22 bp, Homo sapiens
aggtaaggctgtaagctaagcc

SEQ ID NO: 9454235 - DNA, 22 bp, Homo sapiens
aggtaaggctgtaagctaagcc

SEQ ID NO: 9454236 - DNA, 22 bp, Homo sapiens
cctggggctttctttgtatcat

SEQ ID NO: 9454237 - DNA, 22 bp, Homo sapiens
cctggggctctgcacagagcag

SEQ ID NO: 9454238 - DNA, 22 bp, Homo sapiens
cctggggctctgcacagagcag

SEQ ID NO: 9454239 - DNA, 22 bp, Homo sapiens
cctgggggccaggaaggtgtga

SEQ ID NO: 9454240 - DNA, 22 bp, Homo sapiens
cctgggggccaggaaggtgtga

SEQ ID NO: 9454241 - DNA, 22 bp, Homo sapiens
cctggggctccagagcagcgga

SEQ ID NO: 9454242 - DNA, 20 bp, Homo sapiens
aggtcctggttctctgggat

SEQ ID NO: 9454243 - DNA, 20 bp, Homo sapiens
aggtcctggttctctgggat

SEQ ID NO: 9454244 - DNA, 22 bp, Homo sapiens
cctgggctttgagggcaggatg

SEQ ID NO: 9454245 - DNA, 22 bp, Homo sapiens
cctgggctttgagggcaggatg

SEQ ID NO: 9454246 - DNA, 20 bp, Homo sapiens
aggtcctgggactggcagag

SEQ ID NO: 9454247 - DNA, 20 bp, Homo sapiens
aggtcctgggactggcagag

SEQ ID NO: 9454248 - DNA, 20 bp, Homo sapiens
aggtcctgggactggcagag

SEQ ID NO: 9454249 - DNA, 22 bp, Homo sapiens
aggtcctgggagttctagtgtg

SEQ ID NO: 9454250 - DNA, 22 bp, Homo sapiens
aggtcctgggagttctagtgtg

SEQ ID NO: 9454251 - DNA, 22 bp, Homo sapiens
aggtcctggtcttgagtcttaa

SEQ ID NO: 9454252 - DNA, 22 bp, Homo sapiens
aggtcctggtcttgagtcttaa

SEQ ID NO: 9454253 - DNA, 22 bp, Homo sapiens
aggtcctggtgaccatggagtt

SEQ ID NO: 9454254 - DNA, 22 bp, Homo sapiens
aggtcctggtgaccatggagtt

SEQ ID NO: 9454255 - DNA, 22 bp, Homo sapiens
aggtcctggactgctcttgtta

SEQ ID NO: 9454256 - DNA, 22 bp, Homo sapiens
aggtcctggactgctcttgtta

SEQ ID NO: 9454257 - DNA, 23 bp, Homo sapiens
aggtcctggacatatgtgcatca

SEQ ID NO: 9454258 - DNA, 23 bp, Homo sapiens
aggtcctggacatatgtgcatca

SEQ ID NO: 9454259 - DNA, 23 bp, Homo sapiens
aggtcctggacatatgtgcatca

SEQ ID NO: 9454260 - DNA, 22 bp, Homo sapiens
aggtcctgatgatctctgagag

SEQ ID NO: 9454261 - DNA, 22 bp, Homo sapiens
aggtcctgatgatctctgagag

SEQ ID NO: 9454262 - DNA, 19 bp, Homo sapiens
aggtcctgatcagcaagga

SEQ ID NO: 9454263 - DNA, 22 bp, Homo sapiens
aggtcctgagggttcgtctgca

SEQ ID NO: 9454264 - DNA, 19 bp, Homo sapiens
aggtcctgatcagcaagga

SEQ ID NO: 9454265 - DNA, 22 bp, Homo sapiens
aggtgcagcatgagtccaacgg

SEQ ID NO: 9454266 - DNA, 17 bp, Homo sapiens
aggtgcagaggcagagc

SEQ ID NO: 9454267 - DNA, 22 bp, Homo sapiens
aggtgcagcatgagtccaacgg

SEQ ID NO: 9454268 - DNA, 22 bp, Homo sapiens
aggtgcagctgacaccatgtgg

SEQ ID NO: 9454269 - DNA, 22 bp, Homo sapiens
aggtgcagctggtggagtctgg

SEQ ID NO: 9454270 - DNA, 22 bp, Homo sapiens
aggtgcagctgacaccatgtgg

SEQ ID NO: 9454271 - DNA, 18 bp, Homo sapiens
aggtgcagcctctgaggc

SEQ ID NO: 9454272 - DNA, 18 bp, Homo sapiens
aggtgcagcctctgaggc

SEQ ID NO: 9454273 - DNA, 18 bp, Homo sapiens
aggtgcagcctctgaggc

SEQ ID NO: 9454274 - DNA, 21 bp, Homo sapiens
cctgtgccagtctatgtgttc

SEQ ID NO: 9454275 - DNA, 22 bp, Homo sapiens
cctgtgggagcccaggcagata

SEQ ID NO: 9454276 - DNA, 22 bp, Homo sapiens
cctgtgccagctgggccctgcc

SEQ ID NO: 9454277 - DNA, 22 bp, Homo sapiens
cctgtgccagctgggccctgcc

SEQ ID NO: 9454278 - DNA, 22 bp, Homo sapiens
aggtgcaggagctgtgcaggga

SEQ ID NO: 9454279 - DNA, 22 bp, Homo sapiens
aggtgcagctggtggagtctgg

SEQ ID NO: 9454280 - DNA, 22 bp, Homo sapiens
cctgtgccagccccttctgctg

SEQ ID NO: 9454281 - DNA, 22 bp, Homo sapiens
aggtgcagctggtggagtctgg

SEQ ID NO: 9454282 - DNA, 22 bp, Homo sapiens
aggtgcagctggtggagtctgg

SEQ ID NO: 9454283 - DNA, 22 bp, Homo sapiens
aggtgcagctggtggagtctgg

SEQ ID NO: 9454284 - DNA, 22 bp, Homo sapiens
cctgggtcaccaggcccaggca

SEQ ID NO: 9454285 - DNA, 22 bp, Homo sapiens
cctgggtcaccaggcccaggca

SEQ ID NO: 9454286 - DNA, 22 bp, Homo sapiens
cctgggtcactcaggcaggcgg

SEQ ID NO: 9454287 - DNA, 22 bp, Homo sapiens
cctgggtacgcagggctcctct

SEQ ID NO: 9454288 - DNA, 17 bp, Homo sapiens
aggtgcagaggcagagc

SEQ ID NO: 9454289 - DNA, 17 bp, Homo sapiens
aggtgcagaggcagagc

SEQ ID NO: 9454290 - DNA, 21 bp, Homo sapiens
aggtgcagagccagggaccag

SEQ ID NO: 9454291 - DNA, 17 bp, Homo sapiens
aggtgcagaggcagagc

SEQ ID NO: 9454292 - DNA, 22 bp, Homo sapiens
cctgggtccaattctggcttgt

SEQ ID NO: 9454293 - DNA, 22 bp, Homo sapiens
ccttccaaaggagccacatctg

SEQ ID NO: 9454294 - DNA, 22 bp, Homo sapiens
ccttccaagtgctgctttttcc

SEQ ID NO: 9454295 - DNA, 22 bp, Homo sapiens
aggtggcagccgagacataagg

SEQ ID NO: 9454296 - DNA, 22 bp, Homo sapiens
cctgttgtttagcacttagaac

SEQ ID NO: 9454297 - DNA, 22 bp, Homo sapiens
ccttccagatgtaagagctgat

SEQ ID NO: 9454298 - DNA, 22 bp, Homo sapiens
ccttccagatgtaagagctgat

SEQ ID NO: 9454299 - DNA, 22 bp, Homo sapiens
ccttccagaggcgtgacaccct

SEQ ID NO: 9454300 - DNA, 22 bp, Homo sapiens
cctgtggggctgaaagaggctt

SEQ ID NO: 9454301 - DNA, 22 bp, Homo sapiens
aggtggcagagtgacaggctga

SEQ ID NO: 9454302 - DNA, 22 bp, Homo sapiens
aggtggcagaggactcctcctg

SEQ ID NO: 9454303 - DNA, 22 bp, Homo sapiens
aggtggcagagctggcccagcg

SEQ ID NO: 9454304 - DNA, 22 bp, Homo sapiens
aggtggcaaggggcgcctctct

SEQ ID NO: 9454305 - DNA, 22 bp, Homo sapiens
aggtggcagagctggcccagcg

SEQ ID NO: 9454306 - DNA, 22 bp, Homo sapiens
cctgtgggccaaggacctgcca

SEQ ID NO: 9454307 - DNA, 22 bp, Homo sapiens
cctgtgggccaaggacctgcca

SEQ ID NO: 9454308 - DNA, 22 bp, Homo sapiens
cctgtgggccctggacagagac

SEQ ID NO: 9454309 - DNA, 22 bp, Homo sapiens
cctgtgggccctggacagagac

SEQ ID NO: 9454310 - DNA, 22 bp, Homo sapiens
cctgtgggagggagcggctgga

SEQ ID NO: 9454311 - DNA, 22 bp, Homo sapiens
cctgtgggaggttctgtgagtc

SEQ ID NO: 9454312 - DNA, 22 bp, Homo sapiens
cctgtgggaggttctgtgagtc

SEQ ID NO: 9454313 - DNA, 22 bp, Homo sapiens
agtggcagtggggcagggccct

SEQ ID NO: 9454314 - DNA, 22 bp, Homo sapiens
agtggcatcaaatcaaggtttg

SEQ ID NO: 9454315 - DNA, 22 bp, Homo sapiens
agtggcattttaatggatgtca

SEQ ID NO: 9454316 - DNA, 22 bp, Homo sapiens
agtggccagcagcctagcctag

SEQ ID NO: 9454317 - DNA, 20 bp, Homo sapiens
agtggccactgcagagatgc

SEQ ID NO: 9454318 - DNA, 22 bp, Homo sapiens
agtggccaccatgccagctctc

SEQ ID NO: 9454319 - DNA, 22 bp, Homo sapiens
agtggccaatatgtcatgctct

SEQ ID NO: 9454320 - DNA, 22 bp, Homo sapiens
agtggcaattgacaacaaagga

SEQ ID NO: 9454321 - DNA, 22 bp, Homo sapiens
agtggcaatgtagagagtgatc

SEQ ID NO: 9454322 - DNA, 22 bp, Homo sapiens
agtggcaatgggagtggagaca

SEQ ID NO: 9454323 - DNA, 22 bp, Homo sapiens
agtggcagtggggcagggccct

SEQ ID NO: 9454324 - DNA, 22 bp, Homo sapiens
agtggcaagtcaatgatagtga

SEQ ID NO: 9454325 - DNA, 22 bp, Homo sapiens
agtggcaagtcaatgatagtga

SEQ ID NO: 9454326 - DNA, 20 bp, Homo sapiens
agtggcaaggtctctgctca

SEQ ID NO: 9454327 - DNA, 22 bp, Homo sapiens
agtggcaagagggtctattgtt

SEQ ID NO: 9454328 - DNA, 22 bp, Homo sapiens
agtggcaagagggtctattgtt

SEQ ID NO: 9454329 - DNA, 22 bp, Homo sapiens
agtggcaaagtcttcagaagtt

SEQ ID NO: 9454330 - DNA, 22 bp, Homo sapiens
agtggcaaaagcaggcttaggc

SEQ ID NO: 9454331 - DNA, 22 bp, Homo sapiens
agtggcaaagtcttcagaagtt

SEQ ID NO: 9454332 - DNA, 22 bp, Homo sapiens
agtggcaaagtcttcagaagtt

SEQ ID NO: 9454333 - DNA, 22 bp, Homo sapiens
agtggcaaaagcaggcttaggc

SEQ ID NO: 9454334 - DNA, 22 bp, Homo sapiens
agtggagttgagttgatggatt

SEQ ID NO: 9454335 - DNA, 22 bp, Homo sapiens
agtggagtgagtggcagaagga

SEQ ID NO: 9454336 - DNA, 22 bp, Homo sapiens
agtggagaccccacttctacat

SEQ ID NO: 9454337 - DNA, 22 bp, Homo sapiens
agtggagcaggcggcgctcact

SEQ ID NO: 9454338 - DNA, 22 bp, Homo sapiens
agtggagctaaggtatctttta

SEQ ID NO: 9454339 - DNA, 22 bp, Homo sapiens
agtggagcgtgttacctttgct

SEQ ID NO: 9454340 - DNA, 22 bp, Homo sapiens
agtggaggcactaattggattt

SEQ ID NO: 9454341 - DNA, 22 bp, Homo sapiens
agtggaggcactaattggattt

SEQ ID NO: 9454342 - DNA, 22 bp, Homo sapiens
agtggagcttttcctatcagag

SEQ ID NO: 9454343 - DNA, 22 bp, Homo sapiens
agtggaggcactaattggattt

SEQ ID NO: 9454344 - DNA, 22 bp, Homo sapiens
agtggaggttacagctgtacat

SEQ ID NO: 9454345 - DNA, 22 bp, Homo sapiens
agtggaggttacagctgtacat

SEQ ID NO: 9454346 - DNA, 22 bp, Homo sapiens
agtggaggttacagctgtacat

SEQ ID NO: 9454347 - DNA, 22 bp, Homo sapiens
agtggaggttacagctgtacat

SEQ ID NO: 9454348 - DNA, 22 bp, Homo sapiens
agtggagaagaggatggtctcc

SEQ ID NO: 9454349 - DNA, 22 bp, Homo sapiens
agtggaccagaagactgaagct

SEQ ID NO: 9454350 - DNA, 22 bp, Homo sapiens
agtggacaaccatgctgagatt

SEQ ID NO: 9454351 - DNA, 22 bp, Homo sapiens
agtggacattctgcacttggag

SEQ ID NO: 9454352 - DNA, 22 bp, Homo sapiens
agtggagacaggacagtcgata

SEQ ID NO: 9454353 - DNA, 22 bp, Homo sapiens
agtggagaatatgcagaaagcc

SEQ ID NO: 9454354 - DNA, 22 bp, Homo sapiens
agtggagaatatgcagaaagcc

SEQ ID NO: 9454355 - DNA, 22 bp, Homo sapiens
agtggaaagaaccctggactca

SEQ ID NO: 9454356 - DNA, 22 bp, Homo sapiens
agtggaaggctgggaaatgcgg

SEQ ID NO: 9454357 - DNA, 22 bp, Homo sapiens
agtggaaggtcaggggacagtg

SEQ ID NO: 9454358 - DNA, 22 bp, Homo sapiens
agtggaaggctgggaaatgcgg

SEQ ID NO: 9454359 - DNA, 22 bp, Homo sapiens
agtggaaggtcaggggacagtg

SEQ ID NO: 9454360 - DNA, 22 bp, Homo sapiens
agtggaaggtcaggggacagtg

SEQ ID NO: 9454361 - DNA, 22 bp, Homo sapiens
agtgcttttattatatacagga

SEQ ID NO: 9454362 - DNA, 22 bp, Homo sapiens
agtgcttttatatcattaatcc

SEQ ID NO: 9454363 - DNA, 22 bp, Homo sapiens
agtgcttttgtcattgaatctt

SEQ ID NO: 9454364 - DNA, 18 bp, Homo sapiens
agtggaaaacaaatacac

SEQ ID NO: 9454365 - DNA, 22 bp, Homo sapiens
agtgctttgtggagaatttgta

SEQ ID NO: 9454366 - DNA, 22 bp, Homo sapiens
agtgctttgtggagaatttgta

SEQ ID NO: 9454367 - DNA, 22 bp, Homo sapiens
agtgctttgtgctctcactgca

SEQ ID NO: 9454368 - DNA, 22 bp, Homo sapiens
agtgctttgtagtttcattgtg

SEQ ID NO: 9454369 - DNA, 22 bp, Homo sapiens
agtgcctcttgtctacggtttt

SEQ ID NO: 9454370 - DNA, 22 bp, Homo sapiens
agtgcctggaccccatgacata

SEQ ID NO: 9454371 - DNA, 22 bp, Homo sapiens
agtgcctggaccccatgacata

SEQ ID NO: 9454372 - DNA, 22 bp, Homo sapiens
agtgctgtcagttttatagata

SEQ ID NO: 9454373 - DNA, 22 bp, Homo sapiens
agtgctgtcagttttatagata

SEQ ID NO: 9454374 - DNA, 22 bp, Homo sapiens
agtgctgggtactgttcccatt

SEQ ID NO: 9454375 - DNA, 22 bp, Homo sapiens
agtgcgtggtttacagctagtt

SEQ ID NO: 9454376 - DNA, 22 bp, Homo sapiens
agtgcgtgggcaggcatggaag

SEQ ID NO: 9454377 - DNA, 22 bp, Homo sapiens
agtgcgtggtttacagctagtt

SEQ ID NO: 9454378 - DNA, 22 bp, Homo sapiens
agtgccttgtgtgtgggcagcc

SEQ ID NO: 9454379 - DNA, 22 bp, Homo sapiens
agtgcgtggacccctggctgct

SEQ ID NO: 9454380 - DNA, 22 bp, Homo sapiens
agtgcgtgggcaggcatggaag

SEQ ID NO: 9454381 - DNA, 22 bp, Homo sapiens
agtgcgtggacccctggctgct

SEQ ID NO: 9454382 - DNA, 22 bp, Homo sapiens
agtgccaggagcaaggagctcc

SEQ ID NO: 9454383 - DNA, 23 bp, Homo sapiens
agtgccagggagatcaggacgga

SEQ ID NO: 9454384 - DNA, 22 bp, Homo sapiens
agtgccaggagcaaggagctcc

SEQ ID NO: 9454385 - DNA, 18 bp, Homo sapiens
agtgccagctctgctttc

SEQ ID NO: 9454386 - DNA, 22 bp, Homo sapiens
agtgccagctccacacagcagc

SEQ ID NO: 9454387 - DNA, 22 bp, Homo sapiens
agtgccaggagcaaggagctcc

SEQ ID NO: 9454388 - DNA, 22 bp, Homo sapiens
agtgccatggaggaacagatgc

SEQ ID NO: 9454389 - DNA, 22 bp, Homo sapiens
agtgccagttaataagaaatgg

SEQ ID NO: 9454390 - DNA, 22 bp, Homo sapiens
agtgccccatgggtgcctgggg

SEQ ID NO: 9454391 - DNA, 22 bp, Homo sapiens
agtgcccggacaactggacaga

SEQ ID NO: 9454392 - DNA, 22 bp, Homo sapiens
agtgcccggggtgccagacaca

SEQ ID NO: 9454393 - DNA, 20 bp, Homo sapiens
agtgccagggcaggtgagag

SEQ ID NO: 9454394 - DNA, 22 bp, Homo sapiens
agtgcatgttcactggcatggt

SEQ ID NO: 9454395 - DNA, 22 bp, Homo sapiens
agtgccagctccacacagcagc

SEQ ID NO: 9454396 - DNA, 22 bp, Homo sapiens
agtgccagctccacacagcagc

SEQ ID NO: 9454397 - DNA, 22 bp, Homo sapiens
agtgccagagacgtgcacttta

SEQ ID NO: 9454398 - DNA, 22 bp, Homo sapiens
agtgccagagacgtgcacttta

SEQ ID NO: 9454399 - DNA, 22 bp, Homo sapiens
agtgccaaggtattaatttata

SEQ ID NO: 9454400 - DNA, 22 bp, Homo sapiens
agtgccaaatcgagggctctga

SEQ ID NO: 9454401 - DNA, 22 bp, Homo sapiens
agtgccaaatattgctggtgta

SEQ ID NO: 9454402 - DNA, 21 bp, Homo sapiens
agtgattatgggtttttacat

SEQ ID NO: 9454403 - DNA, 22 bp, Homo sapiens
agtgatttactaccatattggg

SEQ ID NO: 9454404 - DNA, 20 bp, Homo sapiens
agtgatttatctttttccac

SEQ ID NO: 9454405 - DNA, 22 bp, Homo sapiens
agtgatttcatcattttatcaa

SEQ ID NO: 9454406 - DNA, 22 bp, Homo sapiens
agtgcagggcctgcccagcagg

SEQ ID NO: 9454407 - DNA, 22 bp, Homo sapiens
agtgatttcatcattttatcaa

SEQ ID NO: 9454408 - DNA, 22 bp, Homo sapiens
agtgatgtaggtggattctggc

SEQ ID NO: 9454409 - DNA, 22 bp, Homo sapiens
agtgatgtgaggtgtgagaggg

SEQ ID NO: 9454410 - DNA, 22 bp, Homo sapiens
agtgatgtgaggtgtgagaggg

SEQ ID NO: 9454411 - DNA, 22 bp, Homo sapiens
agtgatgtcacaaactatggtg

SEQ ID NO: 9454412 - DNA, 22 bp, Homo sapiens
agtgatgttaataaatgatgtt

SEQ ID NO: 9454413 - DNA, 22 bp, Homo sapiens
agtgatgttgattttaccactt

SEQ ID NO: 9454414 - DNA, 22 bp, Homo sapiens
agtgattaaagctaggataaaa

SEQ ID NO: 9454415 - DNA, 22 bp, Homo sapiens
agtgatgtaacaaacagagtta

SEQ ID NO: 9454416 - DNA, 22 bp, Homo sapiens
agtgatggtgagtgagaagctc

SEQ ID NO: 9454417 - DNA, 22 bp, Homo sapiens
agtgatggggccctgcactgat

SEQ ID NO: 9454418 - DNA, 22 bp, Homo sapiens
agtgatggcatcgggtccagca

SEQ ID NO: 9454419 - DNA, 22 bp, Homo sapiens
agtgatggcatcgggtccagca

SEQ ID NO: 9454420 - DNA, 22 bp, Homo sapiens
agtgatggcatatatagatgtg

SEQ ID NO: 9454421 - DNA, 22 bp, Homo sapiens
agtgatggcagtgaataaggct

SEQ ID NO: 9454422 - DNA, 22 bp, Homo sapiens
agtgatggagcttcctctgcta

SEQ ID NO: 9454423 - DNA, 22 bp, Homo sapiens
agtgatgccacacaatgctttg

SEQ ID NO: 9454424 - DNA, 22 bp, Homo sapiens
agtgagtttagggtgcaggtgt

SEQ ID NO: 9454425 - DNA, 22 bp, Homo sapiens
agtgagtggatgtaggaattgg

SEQ ID NO: 9454426 - DNA, 20 bp, Homo sapiens
agtgagttatcagctacagt

SEQ ID NO: 9454427 - DNA, 22 bp, Homo sapiens
agtgataatgtggtaattattt

SEQ ID NO: 9454428 - DNA, 22 bp, Homo sapiens
agtgaggggcagctgagtgggc

SEQ ID NO: 9454429 - DNA, 22 bp, Homo sapiens
agtgaggtcatactggagaggg

SEQ ID NO: 9454430 - DNA, 22 bp, Homo sapiens
agtgagtggagagctctaggtt

SEQ ID NO: 9454431 - DNA, 22 bp, Homo sapiens
agtgagtggaccctgcaaggaa

SEQ ID NO: 9454432 - DNA, 22 bp, Homo sapiens
agtgagtcaaacatatcctgac

SEQ ID NO: 9454433 - DNA, 22 bp, Homo sapiens
agtgaggggcagctgagtgggc

SEQ ID NO: 9454434 - DNA, 22 bp, Homo sapiens
agtgactttagttgaatcttgt

SEQ ID NO: 9454435 - DNA, 22 bp, Homo sapiens
agtgagggactagtgctgggga

SEQ ID NO: 9454436 - DNA, 21 bp, Homo sapiens
agtgaaattgcatcagaggga

SEQ ID NO: 9454437 - DNA, 22 bp, Homo sapiens
agtgacttaattcattatattt

SEQ ID NO: 9454438 - DNA, 22 bp, Homo sapiens
agtgacttctcctaatgtcata

SEQ ID NO: 9454439 - DNA, 19 bp, Homo sapiens
agtgaaatggagtattcaa

SEQ ID NO: 9454440 - DNA, 22 bp, Homo sapiens
agtgaaatgattctgagcaaga

SEQ ID NO: 9454441 - DNA, 22 bp, Homo sapiens
agtgaaatatgcccattgctgt

SEQ ID NO: 9454442 - DNA, 22 bp, Homo sapiens
agtgaaatcaggttttgactgc

SEQ ID NO: 9454443 - DNA, 22 bp, Homo sapiens
agtgaaaggttgagaatattct

SEQ ID NO: 9454444 - DNA, 22 bp, Homo sapiens
agtgaaaggttgagaatattct

SEQ ID NO: 9454445 - DNA, 22 bp, Homo sapiens
agtgaaaagatgcatttctctg

SEQ ID NO: 9454446 - DNA, 22 bp, Homo sapiens
agtgaaaggaaaaactgatatt

SEQ ID NO: 9454447 - DNA, 22 bp, Homo sapiens
agtgaaaacctaatcatgcagt

SEQ ID NO: 9454448 - DNA, 22 bp, Homo sapiens
agtctattttcagaagcagttt

SEQ ID NO: 9454449 - DNA, 22 bp, Homo sapiens
agtctcaagtgttagtattatt

SEQ ID NO: 9454450 - DNA, 22 bp, Homo sapiens
agtctcaagtgttagtattatt

SEQ ID NO: 9454451 - DNA, 23 bp, Homo sapiens
agtctcaagctggagaattacct

SEQ ID NO: 9454452 - DNA, 19 bp, Homo sapiens
agtctcacccaagcagtct

SEQ ID NO: 9454453 - DNA, 20 bp, Homo sapiens
ctcacagtcaatgcagaggt

SEQ ID NO: 9454454 - DNA, 22 bp, Homo sapiens
ctcacagtgatgtcttatgaca

SEQ ID NO: 9454455 - DNA, 22 bp, Homo sapiens
agtcctgggtctggagaatgga

SEQ ID NO: 9454456 - DNA, 22 bp, Homo sapiens
agtctagatccccagtgctgtc

SEQ ID NO: 9454457 - DNA, 22 bp, Homo sapiens
agtctagtaggatctctgggct

SEQ ID NO: 9454458 - DNA, 22 bp, Homo sapiens
agtctaggtaggacaccccagg

SEQ ID NO: 9454459 - DNA, 22 bp, Homo sapiens
agtctaggtacgggtccaactt

SEQ ID NO: 9454460 - DNA, 22 bp, Homo sapiens
agtctattgcctaacagagagg

SEQ ID NO: 9454461 - DNA, 22 bp, Homo sapiens
agtctatattgtgaaagtaaaa

SEQ ID NO: 9454462 - DNA, 22 bp, Homo sapiens
agtctagggtggggtccacagg

SEQ ID NO: 9454463 - DNA, 22 bp, Homo sapiens
agtctagggattgaagcatgat

SEQ ID NO: 9454464 - DNA, 22 bp, Homo sapiens
agtctagggaatactgaaaggt

SEQ ID NO: 9454465 - DNA, 22 bp, Homo sapiens
agtctaggcagccctgcagggt

SEQ ID NO: 9454466 - DNA, 20 bp, Homo sapiens
agtctaggattttggcagct

SEQ ID NO: 9454467 - DNA, 20 bp, Homo sapiens
agtctaggagagggtaaagc

SEQ ID NO: 9454468 - DNA, 22 bp, Homo sapiens
agtctagatccccagtgctgtc

SEQ ID NO: 9454469 - DNA, 19 bp, Homo sapiens
agtctttcccactcgtctt

SEQ ID NO: 9454470 - DNA, 18 bp, Homo sapiens
agtctttatttctttcat

SEQ ID NO: 9454471 - DNA, 22 bp, Homo sapiens
agtctttcctgcttgactgttc

SEQ ID NO: 9454472 - DNA, 18 bp, Homo sapiens
agtctttatttctttcat

SEQ ID NO: 9454473 - DNA, 22 bp, Homo sapiens
agtctttccttttggaagaaaa

SEQ ID NO: 9454474 - DNA, 22 bp, Homo sapiens
agtctttggttataagagacag

SEQ ID NO: 9454475 - DNA, 22 bp, Homo sapiens
agtctttattcactattgataa

SEQ ID NO: 9454476 - DNA, 22 bp, Homo sapiens
agtctttattcactattgataa

SEQ ID NO: 9454477 - DNA, 18 bp, Homo sapiens
agtcttctgatccatttt

SEQ ID NO: 9454478 - DNA, 18 bp, Homo sapiens
agtcttctgatccatttt

SEQ ID NO: 9454479 - DNA, 22 bp, Homo sapiens
agtcttctgctctgtcactaac

SEQ ID NO: 9454480 - DNA, 22 bp, Homo sapiens
ctcacatgatggcctttttcat

SEQ ID NO: 9454481 - DNA, 22 bp, Homo sapiens
ctcacatagtaagcagtcagta

SEQ ID NO: 9454482 - DNA, 22 bp, Homo sapiens
ctcacatatgctgggatttccg

SEQ ID NO: 9454483 - DNA, 22 bp, Homo sapiens
ctcacatacctgttttcccttt

SEQ ID NO: 9454484 - DNA, 22 bp, Homo sapiens
ctcacagtttcacagtgtagat

SEQ ID NO: 9454485 - DNA, 22 bp, Homo sapiens
ctcaccacagagcctgtccagc

SEQ ID NO: 9454486 - DNA, 22 bp, Homo sapiens
ctcaccacagagcctgtccagc

SEQ ID NO: 9454487 - DNA, 23 bp, Homo sapiens
ctcaccaagcgccgccgctgtgt

SEQ ID NO: 9454488 - DNA, 23 bp, Homo sapiens
ctcaccaagcgccgccgctgtgt

SEQ ID NO: 9454489 - DNA, 22 bp, Homo sapiens
agtgtgagcctacaggccaaag

SEQ ID NO: 9454490 - DNA, 22 bp, Homo sapiens
agtgtgagatgattgaggagca

SEQ ID NO: 9454491 - DNA, 22 bp, Homo sapiens
agtgtgagctaatagcagagcc

SEQ ID NO: 9454492 - DNA, 22 bp, Homo sapiens
agtgtgagctaatagcagagcc

SEQ ID NO: 9454493 - DNA, 22 bp, Homo sapiens
agtgtgagccctggagtggtgc

SEQ ID NO: 9454494 - DNA, 22 bp, Homo sapiens
agtgtgagtaattcagggaggg

SEQ ID NO: 9454495 - DNA, 22 bp, Homo sapiens
agtgtgagctaatagcagagcc

SEQ ID NO: 9454496 - DNA, 22 bp, Homo sapiens
agtgtgagctaatagcagagcc

SEQ ID NO: 9454497 - DNA, 22 bp, Homo sapiens
agtgtgagtaattcagggaggg

SEQ ID NO: 9454498 - DNA, 22 bp, Homo sapiens
agtgtctttgtctctcaagcac

SEQ ID NO: 9454499 - DNA, 22 bp, Homo sapiens
agtgtctttgtcaaattacagg

SEQ ID NO: 9454500 - DNA, 22 bp, Homo sapiens
agtgtctttgtctctcaagcac

SEQ ID NO: 9454501 - DNA, 22 bp, Homo sapiens
agtgtgaccttatttggaaaca

SEQ ID NO: 9454502 - DNA, 22 bp, Homo sapiens
agtgtgactacattacaagagt

SEQ ID NO: 9454503 - DNA, 22 bp, Homo sapiens
agtgtctttctctctccaagtg

SEQ ID NO: 9454504 - DNA, 22 bp, Homo sapiens
agtgtctttggctaagtgctgt

SEQ ID NO: 9454505 - DNA, 22 bp, Homo sapiens
agtgtctttctctctccaagtg

SEQ ID NO: 9454506 - DNA, 22 bp, Homo sapiens
agtgtctttgacacattcaaag

SEQ ID NO: 9454507 - DNA, 22 bp, Homo sapiens
agtgtctgggctcccttggagc

SEQ ID NO: 9454508 - DNA, 22 bp, Homo sapiens
agtgtctggtctctgaactaaa

SEQ ID NO: 9454509 - DNA, 22 bp, Homo sapiens
agtgtcctcctctgggagccag

SEQ ID NO: 9454510 - DNA, 22 bp, Homo sapiens
agtgtccaagtcttctgtttgt

SEQ ID NO: 9454511 - DNA, 22 bp, Homo sapiens
agtgtcctcaggctttgttcct

SEQ ID NO: 9454512 - DNA, 19 bp, Homo sapiens
agtgtcctagtcatttgcc

SEQ ID NO: 9454513 - DNA, 17 bp, Homo sapiens
agtgtcagaagacagtt

SEQ ID NO: 9454514 - DNA, 22 bp, Homo sapiens
agtgtcacaaacctgccttgta

SEQ ID NO: 9454515 - DNA, 22 bp, Homo sapiens
agtgtcaattctcaaatctcgg

SEQ ID NO: 9454516 - DNA, 22 bp, Homo sapiens
agtgtcaagtacatggtagtga

SEQ ID NO: 9454517 - DNA, 22 bp, Homo sapiens
agtgtcaactgtctacagggag

SEQ ID NO: 9454518 - DNA, 22 bp, Homo sapiens
agtgtcaaggttgagaaaccct

SEQ ID NO: 9454519 - DNA, 22 bp, Homo sapiens
agtgtcaagtgaggagggaaag

SEQ ID NO: 9454520 - DNA, 22 bp, Homo sapiens
agtgtcaataatttctttttgg

SEQ ID NO: 9454521 - DNA, 22 bp, Homo sapiens
agtgtcaatgctctgttaaaaa

SEQ ID NO: 9454522 - DNA, 22 bp, Homo sapiens
agtgtcaatgccaacagtatat

SEQ ID NO: 9454523 - DNA, 22 bp, Homo sapiens
agtgtcataaggagaaattaca

SEQ ID NO: 9454524 - DNA, 22 bp, Homo sapiens
agtgtcatgaatcaaagattat

SEQ ID NO: 9454525 - DNA, 22 bp, Homo sapiens
agtgtcatttccacgacattca

SEQ ID NO: 9454526 - DNA, 22 bp, Homo sapiens
agtgtcagctaattattcatga

SEQ ID NO: 9454527 - DNA, 22 bp, Homo sapiens
agtgtcagttgccttgtcataa

SEQ ID NO: 9454528 - DNA, 18 bp, Homo sapiens
agtgtcagctgcagctca

SEQ ID NO: 9454529 - DNA, 22 bp, Homo sapiens
agtgtcaactcggaataaggat

SEQ ID NO: 9454530 - DNA, 22 bp, Homo sapiens
agtgtcaactgtctacagggag

SEQ ID NO: 9454531 - DNA, 22 bp, Homo sapiens
agtgtcaactcggaataaggat

SEQ ID NO: 9454532 - DNA, 22 bp, Homo sapiens
agtgtcaaattaaataatctgg

SEQ ID NO: 9454533 - DNA, 22 bp, Homo sapiens
agtgtcaaatgtgtgccaagct

SEQ ID NO: 9454534 - DNA, 22 bp, Homo sapiens
agtgtcaaatcagcatctgggt

SEQ ID NO: 9454535 - DNA, 22 bp, Homo sapiens
agtgtcaaatgtgtgccaagct

SEQ ID NO: 9454536 - DNA, 21 bp, Homo sapiens
ctctggagtttgaaggctggg

SEQ ID NO: 9454537 - DNA, 21 bp, Homo sapiens
ctctggagtttgaaggctggg

SEQ ID NO: 9454538 - DNA, 21 bp, Homo sapiens
ctctggagtttgaaggctggg

SEQ ID NO: 9454539 - DNA, 21 bp, Homo sapiens
ctctggagtttgaaggctggg

SEQ ID NO: 9454540 - DNA, 22 bp, Homo sapiens
ctctggatatgcactgggtgag

SEQ ID NO: 9454541 - DNA, 22 bp, Homo sapiens
ctctggatatgcactgggtgag

SEQ ID NO: 9454542 - DNA, 22 bp, Homo sapiens
agtgtacaaaatgatagataaa

SEQ ID NO: 9454543 - DNA, 22 bp, Homo sapiens
agtgtacaaaatgatagataaa

SEQ ID NO: 9454544 - DNA, 22 bp, Homo sapiens
agtgtattctgcatgggagact

SEQ ID NO: 9454545 - DNA, 22 bp, Homo sapiens
agtgtattatgcagcggaggtc

SEQ ID NO: 9454546 - DNA, 21 bp, Homo sapiens
ctctggagtttgaaggctggg

SEQ ID NO: 9454547 - DNA, 20 bp, Homo sapiens
ctctggagttggggaacatt

SEQ ID NO: 9454548 - DNA, 22 bp, Homo sapiens
ctctggagttcttcaagctact

SEQ ID NO: 9454549 - DNA, 22 bp, Homo sapiens
ctctggagttcttcaagctact

SEQ ID NO: 9454550 - DNA, 22 bp, Homo sapiens
ctctggagttctcatgaggaac

SEQ ID NO: 9454551 - DNA, 22 bp, Homo sapiens
ctctggagttctcatgaggaac

SEQ ID NO: 9454552 - DNA, 22 bp, Homo sapiens
ctctggagttctcatgaggaac

SEQ ID NO: 9454553 - DNA, 22 bp, Homo sapiens
ctctggagttctcatgaggaac

SEQ ID NO: 9454554 - DNA, 22 bp, Homo sapiens
ctctggagttcccttgatctga

SEQ ID NO: 9454555 - DNA, 22 bp, Homo sapiens
ctctggagttcccttgatctga

SEQ ID NO: 9454556 - DNA, 22 bp, Homo sapiens
ctctggagttcccttgatctga

SEQ ID NO: 9454557 - DNA, 22 bp, Homo sapiens
ctctggagttagtgatctgggc

SEQ ID NO: 9454558 - DNA, 22 bp, Homo sapiens
ctctggagttagtgatctgggc

SEQ ID NO: 9454559 - DNA, 22 bp, Homo sapiens
ctctggagttagtgatctgggc

SEQ ID NO: 9454560 - DNA, 22 bp, Homo sapiens
ctctggagtgtctggccagggt

SEQ ID NO: 9454561 - DNA, 22 bp, Homo sapiens
ctctggagtgtctggccagggt

SEQ ID NO: 9454562 - DNA, 22 bp, Homo sapiens
ctctggagtgtctggccagggt

SEQ ID NO: 9454563 - DNA, 19 bp, Homo sapiens
agtggtagatgagcaggag

SEQ ID NO: 9454564 - DNA, 22 bp, Homo sapiens
agtgggtgtagtcttcctcctg

SEQ ID NO: 9454565 - DNA, 22 bp, Homo sapiens
agtggtaagggcataggcactg

SEQ ID NO: 9454566 - DNA, 22 bp, Homo sapiens
ctctggagtgggtggccgggag

SEQ ID NO: 9454567 - DNA, 22 bp, Homo sapiens
ctctggagtgggtggccgggag

SEQ ID NO: 9454568 - DNA, 22 bp, Homo sapiens
agtggtcctgcaaacccgtgtg

SEQ ID NO: 9454569 - DNA, 22 bp, Homo sapiens
agtgggtgcaaccatggctagg

SEQ ID NO: 9454570 - DNA, 22 bp, Homo sapiens
agtgggtgcaaccatggctagg

SEQ ID NO: 9454571 - DNA, 22 bp, Homo sapiens
agtgggtggcgcagaggaggaa

SEQ ID NO: 9454572 - DNA, 22 bp, Homo sapiens
agtgggtgggtgtctgacagtt

SEQ ID NO: 9454573 - DNA, 22 bp, Homo sapiens
agtgggtgtagtcttcctcctg

SEQ ID NO: 9454574 - DNA, 20 bp, Homo sapiens
agtgggtgtaagttattgcc

SEQ ID NO: 9454575 - DNA, 20 bp, Homo sapiens
agtgggtgtaagttattgcc

SEQ ID NO: 9454576 - DNA, 22 bp, Homo sapiens
agtgggtggcgcagaggaggaa

SEQ ID NO: 9454577 - DNA, 22 bp, Homo sapiens
agtgggtgggtgtctgacagtt

SEQ ID NO: 9454578 - DNA, 22 bp, Homo sapiens
agtggctatgcatgactggaat

SEQ ID NO: 9454579 - DNA, 22 bp, Homo sapiens
agtggctacccttcctagcttt

SEQ ID NO: 9454580 - DNA, 22 bp, Homo sapiens
agtggcctggagccccgcctgg

SEQ ID NO: 9454581 - DNA, 22 bp, Homo sapiens
agtggcggggattagcagtgtt

SEQ ID NO: 9454582 - DNA, 22 bp, Homo sapiens
agtggcctggagccccgcctgg

SEQ ID NO: 9454583 - DNA, 22 bp, Homo sapiens
agtggcccttagtggcaaagtc

SEQ ID NO: 9454584 - DNA, 22 bp, Homo sapiens
agtggcctggagccccgcctgg

SEQ ID NO: 9454585 - DNA, 22 bp, Homo sapiens
agtggcctggagccccgcctgg

SEQ ID NO: 9454586 - DNA, 22 bp, Homo sapiens
agtggccagtgctgctctgggg

SEQ ID NO: 9454587 - DNA, 22 bp, Homo sapiens
agtggccaggaaaggtccagcc

SEQ ID NO: 9454588 - DNA, 22 bp, Homo sapiens
agtggcccctgtgccaccacac

SEQ ID NO: 9454589 - DNA, 22 bp, Homo sapiens
agtgggtactgggcaggcagag

SEQ ID NO: 9454590 - DNA, 22 bp, Homo sapiens
agtgggtgacagttaacaggtt

SEQ ID NO: 9454591 - DNA, 22 bp, Homo sapiens
agtgggtgacagttaacaggtt

SEQ ID NO: 9454592 - DNA, 22 bp, Homo sapiens
agtgggtgacagtgaacacgta

SEQ ID NO: 9454593 - DNA, 22 bp, Homo sapiens
agtgggtgagcttggtctagat

SEQ ID NO: 9454594 - DNA, 22 bp, Homo sapiens
agtgggtgagcttggtctagat

SEQ ID NO: 9454595 - DNA, 22 bp, Homo sapiens
agtgggtgagcttggtctagat

SEQ ID NO: 9454596 - DNA, 22 bp, Homo sapiens
agtgggtgagcttggtctagat

SEQ ID NO: 9454597 - DNA, 20 bp, Homo sapiens
agtgggtgatgaaggaatag

SEQ ID NO: 9454598 - DNA, 22 bp, Homo sapiens
agtgggtgataagaccaaggag

SEQ ID NO: 9454599 - DNA, 22 bp, Homo sapiens
agtggctcttgggtcactgggc

SEQ ID NO: 9454600 - DNA, 22 bp, Homo sapiens
agtgtgctgtttccagaagggc

SEQ ID NO: 9454601 - DNA, 22 bp, Homo sapiens
agtgtgcttaagtttatcagga

SEQ ID NO: 9454602 - DNA, 22 bp, Homo sapiens
agtgtgcttcactgggaggtga

SEQ ID NO: 9454603 - DNA, 22 bp, Homo sapiens
agtgtggagccactgagtggct

SEQ ID NO: 9454604 - DNA, 22 bp, Homo sapiens
agtgtggacttttcctaggagg

SEQ ID NO: 9454605 - DNA, 22 bp, Homo sapiens
agtgtgcatggtggaggcttgc

SEQ ID NO: 9454606 - DNA, 22 bp, Homo sapiens
agtgtgagttacaaagtgtgaa

SEQ ID NO: 9454607 - DNA, 22 bp, Homo sapiens
agtgtgagtaattgagtctgtc

SEQ ID NO: 9454608 - DNA, 19 bp, Homo sapiens
agtgtgagtaattggagtt

SEQ ID NO: 9454609 - DNA, 20 bp, Homo sapiens
agtgtgcatttagagtctgc

SEQ ID NO: 9454610 - DNA, 22 bp, Homo sapiens
agtgtgcatttgcagaagaccc

SEQ ID NO: 9454611 - DNA, 22 bp, Homo sapiens
agtgtggcaggaatgactagaa

SEQ ID NO: 9454612 - DNA, 22 bp, Homo sapiens
agtgtggcaggaatgactagaa

SEQ ID NO: 9454613 - DNA, 22 bp, Homo sapiens
agtgtgggccacgcagctgagc

SEQ ID NO: 9454614 - DNA, 17 bp, Homo sapiens
agtgtggccctggttaa

SEQ ID NO: 9454615 - DNA, 22 bp, Homo sapiens
agtgtgggccacgcagctgagc

SEQ ID NO: 9454616 - DNA, 22 bp, Homo sapiens
agtgtgggccacgcagctgagc

SEQ ID NO: 9454617 - DNA, 22 bp, Homo sapiens
agtgtgggcccccaggttagcc

SEQ ID NO: 9454618 - DNA, 22 bp, Homo sapiens
agtgtgggggctttggtgtcac

SEQ ID NO: 9454619 - DNA, 22 bp, Homo sapiens
agtgtgggcccccaggttagcc

SEQ ID NO: 9454620 - DNA, 22 bp, Homo sapiens
agtgtttatggaatcttagtta

SEQ ID NO: 9454621 - DNA, 18 bp, Homo sapiens
agtgtttatttaggtgaa

SEQ ID NO: 9454622 - DNA, 22 bp, Homo sapiens
agtgtttcaagaagcaggaagt

SEQ ID NO: 9454623 - DNA, 22 bp, Homo sapiens
agtgtttcaagtgatgctttgg

SEQ ID NO: 9454624 - DNA, 22 bp, Homo sapiens
agtgtttatttacagatggttt

SEQ ID NO: 9454625 - DNA, 20 bp, Homo sapiens
agtgtttgctcacagtctcc

SEQ ID NO: 9454626 - DNA, 22 bp, Homo sapiens
agtgtttctggaatcagtgttt

SEQ ID NO: 9454627 - DNA, 22 bp, Homo sapiens
agtgtttctggcaaatgaaagt

SEQ ID NO: 9454628 - DNA, 22 bp, Homo sapiens
agtgtttctggaatcagtgttt

SEQ ID NO: 9454629 - DNA, 22 bp, Homo sapiens
agtgtttctggaatcagtgttt

SEQ ID NO: 9454630 - DNA, 22 bp, Homo sapiens
agtgtttctcagaagggcctat

SEQ ID NO: 9454631 - DNA, 22 bp, Homo sapiens
agtgtttgagacacatttcact

SEQ ID NO: 9454632 - DNA, 22 bp, Homo sapiens
agtgtttctgtgccccagtgtt

SEQ ID NO: 9454633 - DNA, 17 bp, Homo sapiens
agtgtttccttatcatt

SEQ ID NO: 9454634 - DNA, 22 bp, Homo sapiens
agtgtttcctgagtgttatcat

SEQ ID NO: 9454635 - DNA, 20 bp, Homo sapiens
agtgtttctcaacatggggc

SEQ ID NO: 9454636 - DNA, 20 bp, Homo sapiens
agtgtttctcaacatggggc

SEQ ID NO: 9454637 - DNA, 20 bp, Homo sapiens
agtgtttctcaacatggggc

SEQ ID NO: 9454638 - DNA, 22 bp, Homo sapiens
agtgtttctaagtagatgtgaa

SEQ ID NO: 9454639 - DNA, 17 bp, Homo sapiens
agtgtttccttatcatt

SEQ ID NO: 9454640 - DNA, 22 bp, Homo sapiens
agtgtttctaagtagatgtgaa

SEQ ID NO: 9454641 - DNA, 22 bp, Homo sapiens
agtgtttcaccgtatgttctca

SEQ ID NO: 9454642 - DNA, 22 bp, Homo sapiens
agtgtttcaccgtatgttctca

SEQ ID NO: 9454643 - DNA, 22 bp, Homo sapiens
agtgtttcaatcctaggggttg

SEQ ID NO: 9454644 - DNA, 22 bp, Homo sapiens
agtgtttcacagcactttttct

SEQ ID NO: 9454645 - DNA, 18 bp, Homo sapiens
agtgtttatttaggtgaa

SEQ ID NO: 9454646 - DNA, 22 bp, Homo sapiens
agtgtttcctgagtgttatcat

SEQ ID NO: 9454647 - DNA, 22 bp, Homo sapiens
agtgtttcccagtaggatgaaa

SEQ ID NO: 9454648 - DNA, 19 bp, Homo sapiens
agtgtttcatgtgctttta

SEQ ID NO: 9454649 - DNA, 22 bp, Homo sapiens
agtgtttcaccgtatgttctca

SEQ ID NO: 9454650 - DNA, 22 bp, Homo sapiens
agttaaatgtcagtagcttaac

SEQ ID NO: 9454651 - DNA, 22 bp, Homo sapiens
agttaaatgtcagtagcttaac

SEQ ID NO: 9454652 - DNA, 22 bp, Homo sapiens
agtgtttgtcccgttagaaatg

SEQ ID NO: 9454653 - DNA, 22 bp, Homo sapiens
agtgtttgtcccgttagaaatg

SEQ ID NO: 9454654 - DNA, 22 bp, Homo sapiens
agtgttttggagtgggaaggca

SEQ ID NO: 9454655 - DNA, 22 bp, Homo sapiens
agtgtttttgggtagggtgagt

SEQ ID NO: 9454656 - DNA, 22 bp, Homo sapiens
agttccagtgtgagagaacatg

SEQ ID NO: 9454657 - DNA, 22 bp, Homo sapiens
agttccagctgtgaccagaaaa

SEQ ID NO: 9454658 - DNA, 22 bp, Homo sapiens
agttccagctgtgaccagaaaa

SEQ ID NO: 9454659 - DNA, 22 bp, Homo sapiens
agttccagctgtgaccagaaaa

SEQ ID NO: 9454660 - DNA, 22 bp, Homo sapiens
agttccagaactggaaaaggac

SEQ ID NO: 9454661 - DNA, 23 bp, Homo sapiens
agttcctaagggctttgaactta

SEQ ID NO: 9454662 - DNA, 23 bp, Homo sapiens
agttcctaagggctttgaactta

SEQ ID NO: 9454663 - DNA, 18 bp, Homo sapiens
agttccttaaattggtgt

SEQ ID NO: 9454664 - DNA, 22 bp, Homo sapiens
agttccttacatgtactgttaa

SEQ ID NO: 9454665 - DNA, 23 bp, Homo sapiens
agttccagaaaaatgctcaagca

SEQ ID NO: 9454666 - DNA, 22 bp, Homo sapiens
agttcattttatttgtcagggt

SEQ ID NO: 9454667 - DNA, 23 bp, Homo sapiens
agttcataatttcttatttgtgt

SEQ ID NO: 9454668 - DNA, 22 bp, Homo sapiens
agttatttcagtaacataatag

SEQ ID NO: 9454669 - DNA, 22 bp, Homo sapiens
agttcatgtggtttaacttaat

SEQ ID NO: 9454670 - DNA, 22 bp, Homo sapiens
agttcatggaagattcaatgga

SEQ ID NO: 9454671 - DNA, 23 bp, Homo sapiens
agttcataatttcttatttgtgt

SEQ ID NO: 9454672 - DNA, 22 bp, Homo sapiens
ctgagctgaaacttgagaggct

SEQ ID NO: 9454673 - DNA, 22 bp, Homo sapiens
ctgagctgaaacttgagaggct

SEQ ID NO: 9454674 - DNA, 22 bp, Homo sapiens
ctgagctgacatcttcctcttt

SEQ ID NO: 9454675 - DNA, 20 bp, Homo sapiens
ctgagctgagctccatgggt

SEQ ID NO: 9454676 - DNA, 20 bp, Homo sapiens
ctgagctgagctccatgggt

SEQ ID NO: 9454677 - DNA, 22 bp, Homo sapiens
ctgagctgcagtcctggctctg

SEQ ID NO: 9454678 - DNA, 22 bp, Homo sapiens
ctgagctgcggcaggcacctgg

SEQ ID NO: 9454679 - DNA, 22 bp, Homo sapiens
ctgagctgcggcaggcacctgg

SEQ ID NO: 9454680 - DNA, 22 bp, Homo sapiens
agttatttcagtaacataatag

SEQ ID NO: 9454681 - DNA, 22 bp, Homo sapiens
ctgagctgctttgcttttgggg

SEQ ID NO: 9454682 - DNA, 22 bp, Homo sapiens
ctgagctgctcccgctgcagcg

SEQ ID NO: 9454683 - DNA, 22 bp, Homo sapiens
ctgagccagctggcatgtgcta

SEQ ID NO: 9454684 - DNA, 22 bp, Homo sapiens
ctgagccagctggcatgtgcta

SEQ ID NO: 9454685 - DNA, 22 bp, Homo sapiens
ctgagccagggccacacatgga

SEQ ID NO: 9454686 - DNA, 22 bp, Homo sapiens
ctgagccagctggcatgtgcta

SEQ ID NO: 9454687 - DNA, 22 bp, Homo sapiens
ctgagccagctggcatgtgcta

SEQ ID NO: 9454688 - DNA, 22 bp, Homo sapiens
ctgagccagcgggctcactttt

SEQ ID NO: 9454689 - DNA, 22 bp, Homo sapiens
ctgagccagcgggctcactttt

SEQ ID NO: 9454690 - DNA, 22 bp, Homo sapiens
ctgagctcaagcgatcctccca

SEQ ID NO: 9454691 - DNA, 22 bp, Homo sapiens
ctgagccagggccacacatgga

SEQ ID NO: 9454692 - DNA, 22 bp, Homo sapiens
ctgagccagggccacacatgga

SEQ ID NO: 9454693 - DNA, 22 bp, Homo sapiens
ctgagctctaatgtcagccttg

SEQ ID NO: 9454694 - DNA, 22 bp, Homo sapiens
ctgagctcacgccattctcctt

SEQ ID NO: 9454695 - DNA, 22 bp, Homo sapiens
ctgagccagagggagtcgggtc

SEQ ID NO: 9454696 - DNA, 22 bp, Homo sapiens
ctgagccagcgggctcactttt

SEQ ID NO: 9454697 - DNA, 22 bp, Homo sapiens
ctgagccactgcttgttcagtg

SEQ ID NO: 9454698 - DNA, 22 bp, Homo sapiens
ctgagccaaggggacagtgaca

SEQ ID NO: 9454699 - DNA, 22 bp, Homo sapiens
ctgagccaaggggacagtgaca

SEQ ID NO: 9454700 - DNA, 22 bp, Homo sapiens
ctgagccaccggcagggacatc

SEQ ID NO: 9454701 - DNA, 22 bp, Homo sapiens
ctgagccaccggcagggacatc

SEQ ID NO: 9454702 - DNA, 22 bp, Homo sapiens
agttaactattttaagattgtt

SEQ ID NO: 9454703 - DNA, 22 bp, Homo sapiens
ctgagcagccccaccagccatt

SEQ ID NO: 9454704 - DNA, 22 bp, Homo sapiens
ctgagcagccccaccagccatt

SEQ ID NO: 9454705 - DNA, 22 bp, Homo sapiens
ctgagcagccccaccagccatt

SEQ ID NO: 9454706 - DNA, 22 bp, Homo sapiens
agttaactaaactgtgagtaaa

SEQ ID NO: 9454707 - DNA, 18 bp, Homo sapiens
atttacccagcaacgtgg

SEQ ID NO: 9454708 - DNA, 18 bp, Homo sapiens
gccagagggaagcaggtg

SEQ ID NO: 9454709 - DNA, 18 bp, Homo sapiens
gccagagggaagcaggtg

SEQ ID NO: 9454710 - DNA, 18 bp, Homo sapiens
gccagagggaagcaggtg

SEQ ID NO: 9454711 - DNA, 22 bp, Homo sapiens
gccagagggattcctggtgtgt

SEQ ID NO: 9454712 - DNA, 17 bp, Homo sapiens
atttacattgtcaccga

SEQ ID NO: 9454713 - DNA, 17 bp, Homo sapiens
atttacattgtcaccga

SEQ ID NO: 9454714 - DNA, 17 bp, Homo sapiens
atttacattgtcaccga

SEQ ID NO: 9454715 - DNA, 17 bp, Homo sapiens
atttacattgtcaccga

SEQ ID NO: 9454716 - DNA, 22 bp, Homo sapiens
atttacatttatttgagaaggt

SEQ ID NO: 9454717 - DNA, 22 bp, Homo sapiens
atttacatttatttgagaaggt

SEQ ID NO: 9454718 - DNA, 22 bp, Homo sapiens
atttacatttatttgagaaggt

SEQ ID NO: 9454719 - DNA, 22 bp, Homo sapiens
atttaccagtgctgacatttga

SEQ ID NO: 9454720 - DNA, 22 bp, Homo sapiens
atttacatttatttgagaaggt

SEQ ID NO: 9454721 - DNA, 22 bp, Homo sapiens
atttacatttatttgagaaggt

SEQ ID NO: 9454722 - DNA, 22 bp, Homo sapiens
atttacagtttagcatttcaag

SEQ ID NO: 9454723 - DNA, 22 bp, Homo sapiens
atttacagtgtgcctactatat

SEQ ID NO: 9454724 - DNA, 22 bp, Homo sapiens
atttacagacgtggattagtgc

SEQ ID NO: 9454725 - DNA, 22 bp, Homo sapiens
atttacagtgtgcctactatat

SEQ ID NO: 9454726 - DNA, 22 bp, Homo sapiens
atttacattccatggtggttac

SEQ ID NO: 9454727 - DNA, 22 bp, Homo sapiens
atttacattccatggtggttac

SEQ ID NO: 9454728 - DNA, 22 bp, Homo sapiens
atttacattccatggtggttac

SEQ ID NO: 9454729 - DNA, 22 bp, Homo sapiens
atttacataatagactttaggt

SEQ ID NO: 9454730 - DNA, 22 bp, Homo sapiens
atttacataatagactttaggt

SEQ ID NO: 9454731 - DNA, 22 bp, Homo sapiens
atttacagtttagcatttcaag

SEQ ID NO: 9454732 - DNA, 22 bp, Homo sapiens
atttacagtttagcatttcaag

SEQ ID NO: 9454733 - DNA, 22 bp, Homo sapiens
gcccagcaggggatggcagctc

SEQ ID NO: 9454734 - DNA, 22 bp, Homo sapiens
gcccagccacagtcactttcat

SEQ ID NO: 9454735 - DNA, 22 bp, Homo sapiens
gcccagccacagtcactttcat

SEQ ID NO: 9454736 - DNA, 22 bp, Homo sapiens
gcccagcaggggatggcagctc

SEQ ID NO: 9454737 - DNA, 22 bp, Homo sapiens
gcccagcaggacagagtggttt

SEQ ID NO: 9454738 - DNA, 22 bp, Homo sapiens
gcccagcccctgggtggacgtg

SEQ ID NO: 9454739 - DNA, 22 bp, Homo sapiens
gcccagcccagaaaggttcgga

SEQ ID NO: 9454740 - DNA, 22 bp, Homo sapiens
gcccagcccagaaaggttcgga

SEQ ID NO: 9454741 - DNA, 22 bp, Homo sapiens
gcccagccagagctgtgtgatg

SEQ ID NO: 9454742 - DNA, 22 bp, Homo sapiens
gcccagccagagctgtgtgatg

SEQ ID NO: 9454743 - DNA, 22 bp, Homo sapiens
gcccagccagagctgtgtgatg

SEQ ID NO: 9454744 - DNA, 22 bp, Homo sapiens
gcccagcccagaaaggttcgga

SEQ ID NO: 9454745 - DNA, 22 bp, Homo sapiens
gcccagcccagaaaggttcgga

SEQ ID NO: 9454746 - DNA, 22 bp, Homo sapiens
gcccagccacagtcactttcat

SEQ ID NO: 9454747 - DNA, 22 bp, Homo sapiens
gcccagccagagctgtgtgatg

SEQ ID NO: 9454748 - DNA, 22 bp, Homo sapiens
gcccagccacagtcactttcat

SEQ ID NO: 9454749 - DNA, 22 bp, Homo sapiens
gcccagccagagctgtgtgatg

SEQ ID NO: 9454750 - DNA, 22 bp, Homo sapiens
gcccagccagagctgtgtgatg

SEQ ID NO: 9454751 - DNA, 22 bp, Homo sapiens
gcccagccagagctgtgtgatg

SEQ ID NO: 9454752 - DNA, 22 bp, Homo sapiens
gccagaggggctcgaaggcgcg

SEQ ID NO: 9454753 - DNA, 22 bp, Homo sapiens
gccagaggggctcgaaggcgcg

SEQ ID NO: 9454754 - DNA, 18 bp, Homo sapiens
gccagaggtactactgat

SEQ ID NO: 9454755 - DNA, 18 bp, Homo sapiens
gccagagggcccaaggtc

SEQ ID NO: 9454756 - DNA, 18 bp, Homo sapiens
gccagagggcccaaggtc

SEQ ID NO: 9454757 - DNA, 22 bp, Homo sapiens
gccagaggtatcaaagatagta

SEQ ID NO: 9454758 - DNA, 22 bp, Homo sapiens
gccagaggtatcaaagatagta

SEQ ID NO: 9454759 - DNA, 18 bp, Homo sapiens
gccagaggtactactgat

SEQ ID NO: 9454760 - DNA, 18 bp, Homo sapiens
gccagaggtactactgat

SEQ ID NO: 9454761 - DNA, 18 bp, Homo sapiens
gccagaggtactactgat

SEQ ID NO: 9454762 - DNA, 22 bp, Homo sapiens
gcccagcagctggtggagaagg

SEQ ID NO: 9454763 - DNA, 22 bp, Homo sapiens
gcccactccagcttctcccaca

SEQ ID NO: 9454764 - DNA, 22 bp, Homo sapiens
gccagaggttcaacaactgtct

SEQ ID NO: 9454765 - DNA, 22 bp, Homo sapiens
gcccagcccctgggtggacgtg

SEQ ID NO: 9454766 - DNA, 22 bp, Homo sapiens
gcccagcccctgggtggacgtg

SEQ ID NO: 9454767 - DNA, 22 bp, Homo sapiens
gcccagcccctgggtggacgtg

SEQ ID NO: 9454768 - DNA, 22 bp, Homo sapiens
gcccagcccctgggtggacgtg

SEQ ID NO: 9454769 - DNA, 22 bp, Homo sapiens
gcccagcccctgggtggacgtg

SEQ ID NO: 9454770 - DNA, 22 bp, Homo sapiens
gcccagcccctgggtggacgtg

SEQ ID NO: 9454771 - DNA, 22 bp, Homo sapiens
gcccaggaggtggaggtgcagt

SEQ ID NO: 9454772 - DNA, 22 bp, Homo sapiens
gcccaggaggtggaggtgcagt

SEQ ID NO: 9454773 - DNA, 22 bp, Homo sapiens
gcccaggaggtggaggtgcagt

SEQ ID NO: 9454774 - DNA, 22 bp, Homo sapiens
gcccaggaggttgggctgtgca

SEQ ID NO: 9454775 - DNA, 22 bp, Homo sapiens
gcccaggagttcaaggctgcag

SEQ ID NO: 9454776 - DNA, 22 bp, Homo sapiens
gcccaggagttcaaggctgcag

SEQ ID NO: 9454777 - DNA, 22 bp, Homo sapiens
gcccaggagttcaaggctgcag

SEQ ID NO: 9454778 - DNA, 22 bp, Homo sapiens
gcccaggagttcaagtctagtg

SEQ ID NO: 9454779 - DNA, 22 bp, Homo sapiens
gcccaggagttcaagtctagtg

SEQ ID NO: 9454780 - DNA, 22 bp, Homo sapiens
gccctccagctgttgcgcgtcg

SEQ ID NO: 9454781 - DNA, 22 bp, Homo sapiens
gccctccatgagacacagtgta

SEQ ID NO: 9454782 - DNA, 22 bp, Homo sapiens
gccctccaccagagcccttctc

SEQ ID NO: 9454783 - DNA, 19 bp, Homo sapiens
gccctcatgatattcagat

SEQ ID NO: 9454784 - DNA, 22 bp, Homo sapiens
gcccaggagttgaagggctgac

SEQ ID NO: 9454785 - DNA, 22 bp, Homo sapiens
gcccaggagttcaagtctagtg

SEQ ID NO: 9454786 - DNA, 22 bp, Homo sapiens
gcccaggagttcaagtctagtg

SEQ ID NO: 9454787 - DNA, 22 bp, Homo sapiens
gcccaggagttgaagggctgac

SEQ ID NO: 9454788 - DNA, 22 bp, Homo sapiens
gcccaggagttgaagggctgac

SEQ ID NO: 9454789 - DNA, 22 bp, Homo sapiens
gcccccttgacctaatcacctt

SEQ ID NO: 9454790 - DNA, 21 bp, Homo sapiens
gccccctggactcctcatcca

SEQ ID NO: 9454791 - DNA, 19 bp, Homo sapiens
gccctcctcactgagctct

SEQ ID NO: 9454792 - DNA, 19 bp, Homo sapiens
gccctcctcactgagctct

SEQ ID NO: 9454793 - DNA, 22 bp, Homo sapiens
gccctgagttgagccttccaaa

SEQ ID NO: 9454794 - DNA, 22 bp, Homo sapiens
gccctcccctctgggtggtgag

SEQ ID NO: 9454795 - DNA, 22 bp, Homo sapiens
gccctcccctctgggtggtgag

SEQ ID NO: 9454796 - DNA, 22 bp, Homo sapiens
gccctccctacagcctatttct

SEQ ID NO: 9454797 - DNA, 23 bp, Homo sapiens
gccctccctcccaggtgggtgtt

SEQ ID NO: 9454798 - DNA, 23 bp, Homo sapiens
gccctccctcccaggtgggtgtt

SEQ ID NO: 9454799 - DNA, 19 bp, Homo sapiens
gccctgcaggaggtggggc

SEQ ID NO: 9454800 - DNA, 22 bp, Homo sapiens
gccctgcaccccaatggcatga

SEQ ID NO: 9454801 - DNA, 22 bp, Homo sapiens
gccctgcaccccaatggcatga

SEQ ID NO: 9454802 - DNA, 22 bp, Homo sapiens
gccctgccctctcggcactcgc

SEQ ID NO: 9454803 - DNA, 22 bp, Homo sapiens
gccctgccctctcggcactcgc

SEQ ID NO: 9454804 - DNA, 23 bp, Homo sapiens
gccctgcccttagcacactcaca

SEQ ID NO: 9454805 - DNA, 23 bp, Homo sapiens
gccctgcccttagcacactcaca

SEQ ID NO: 9454806 - DNA, 22 bp, Homo sapiens
gccctgccctgagccgtagacc

SEQ ID NO: 9454807 - DNA, 22 bp, Homo sapiens
gccctgccctgagccgtagacc

SEQ ID NO: 9454808 - DNA, 22 bp, Homo sapiens
atttgacattgacacacctatg

SEQ ID NO: 9454809 - DNA, 22 bp, Homo sapiens
atttcttccttctcctagaaga

SEQ ID NO: 9454810 - DNA, 22 bp, Homo sapiens
atttcttccttctcctagaaga

SEQ ID NO: 9454811 - DNA, 23 bp, Homo sapiens
atttgacagagcatagcatttct

SEQ ID NO: 9454812 - DNA, 23 bp, Homo sapiens
atttgacagagcatagcatttct

SEQ ID NO: 9454813 - DNA, 22 bp, Homo sapiens
atttgattagctgtgtaatttt

SEQ ID NO: 9454814 - DNA, 22 bp, Homo sapiens
atttgattagctgtgtaatttt

SEQ ID NO: 9454815 - DNA, 22 bp, Homo sapiens
atttgattgtgtctgagacgat

SEQ ID NO: 9454816 - DNA, 22 bp, Homo sapiens
atttgattagctgtgtaatttt

SEQ ID NO: 9454817 - DNA, 22 bp, Homo sapiens
atttgagatggtaaataacttt

SEQ ID NO: 9454818 - DNA, 22 bp, Homo sapiens
atttgcaaagtcgtatctgtga

SEQ ID NO: 9454819 - DNA, 22 bp, Homo sapiens
atttgatttgtagatagtgtag

SEQ ID NO: 9454820 - DNA, 22 bp, Homo sapiens
atttgcaatgatttcagtgctt

SEQ ID NO: 9454821 - DNA, 22 bp, Homo sapiens
atttgcaattactcatgtcatt

SEQ ID NO: 9454822 - DNA, 22 bp, Homo sapiens
atttgcaattactcatgtcatt

SEQ ID NO: 9454823 - DNA, 22 bp, Homo sapiens
atttgcagctaggatccaaagt

SEQ ID NO: 9454824 - DNA, 22 bp, Homo sapiens
atttgcagagctctgaattttg

SEQ ID NO: 9454825 - DNA, 22 bp, Homo sapiens
atttgcagagctctgaattttg

SEQ ID NO: 9454826 - DNA, 22 bp, Homo sapiens
atttgcagagctctgaattttg

SEQ ID NO: 9454827 - DNA, 22 bp, Homo sapiens
atttgcataaggatgctactgt

SEQ ID NO: 9454828 - DNA, 22 bp, Homo sapiens
atttgcataaggatgctactgt

SEQ ID NO: 9454829 - DNA, 22 bp, Homo sapiens
atttgcataatagtgatttgta

SEQ ID NO: 9454830 - DNA, 22 bp, Homo sapiens
atttgcataatagtgatttgta

SEQ ID NO: 9454831 - DNA, 22 bp, Homo sapiens
atttgcatatctgatagactaa

SEQ ID NO: 9454832 - DNA, 22 bp, Homo sapiens
atttgcataatagtgatttgta

SEQ ID NO: 9454833 - DNA, 22 bp, Homo sapiens
atttgcataatagtgatttgta

SEQ ID NO: 9454834 - DNA, 20 bp, Homo sapiens
atttgcatctgaataactta

SEQ ID NO: 9454835 - DNA, 20 bp, Homo sapiens
atttgcatctgaataactta

SEQ ID NO: 9454836 - DNA, 22 bp, Homo sapiens
atttgcatgcttctattgtgaa

SEQ ID NO: 9454837 - DNA, 22 bp, Homo sapiens
atttgcatgcttctattgtgaa

SEQ ID NO: 9454838 - DNA, 22 bp, Homo sapiens
atttgcatgcttctattgtgaa

SEQ ID NO: 9454839 - DNA, 23 bp, Homo sapiens
atttgcatggccggattatggat

SEQ ID NO: 9454840 - DNA, 23 bp, Homo sapiens
atttgcatggccggattatggat

SEQ ID NO: 9454841 - DNA, 22 bp, Homo sapiens
atttgcatgcttctattgtgaa

SEQ ID NO: 9454842 - DNA, 23 bp, Homo sapiens
atttgcatggccggattatggat

SEQ ID NO: 9454843 - DNA, 22 bp, Homo sapiens
atttgcatttagaaagatcact

SEQ ID NO: 9454844 - DNA, 22 bp, Homo sapiens
atttgcatttacatagcataga

SEQ ID NO: 9454845 - DNA, 21 bp, Homo sapiens
atttgcattaaaatattacgc

SEQ ID NO: 9454846 - DNA, 21 bp, Homo sapiens
atttgcattaaaatattacgc

SEQ ID NO: 9454847 - DNA, 22 bp, Homo sapiens
atttgccatgaagagtgtttga

SEQ ID NO: 9454848 - DNA, 22 bp, Homo sapiens
atttgcctgtaagacaaggcct

SEQ ID NO: 9454849 - DNA, 22 bp, Homo sapiens
atttgcatttagaaagatcact

SEQ ID NO: 9454850 - DNA, 22 bp, Homo sapiens
atttgcctctgctttcaaggat

SEQ ID NO: 9454851 - DNA, 22 bp, Homo sapiens
atttgcctttcgaatcaacagg

SEQ ID NO: 9454852 - DNA, 22 bp, Homo sapiens
atttgccttgtgatttgtaagt

SEQ ID NO: 9454853 - DNA, 22 bp, Homo sapiens
atttgccttgtgaattggatat

SEQ ID NO: 9454854 - DNA, 22 bp, Homo sapiens
atttgccttactgaagaaggag

SEQ ID NO: 9454855 - DNA, 22 bp, Homo sapiens
atttgccttggtgatttgtaaa

SEQ ID NO: 9454856 - DNA, 22 bp, Homo sapiens
attttaaggcttatttaaaggc

SEQ ID NO: 9454857 - DNA, 22 bp, Homo sapiens
atttgtcttcagtaggttcttc

SEQ ID NO: 9454858 - DNA, 22 bp, Homo sapiens
atttgtctctgcactttactca

SEQ ID NO: 9454859 - DNA, 22 bp, Homo sapiens
atttgcctttcgaatcaacagg

SEQ ID NO: 9454860 - DNA, 22 bp, Homo sapiens
attttaaggcttatttaaaggc

SEQ ID NO: 9454861 - DNA, 22 bp, Homo sapiens
attttaaggcttatttaaaggc

SEQ ID NO: 9454862 - DNA, 22 bp, Homo sapiens
attttaaggcttatttaaaggc

SEQ ID NO: 9454863 - DNA, 22 bp, Homo sapiens
attttaataagatccatttggt

SEQ ID NO: 9454864 - DNA, 22 bp, Homo sapiens
attttaataagattcccaagta

SEQ ID NO: 9454865 - DNA, 22 bp, Homo sapiens
attttaataagattcccaagta

SEQ ID NO: 9454866 - DNA, 22 bp, Homo sapiens
gcctgcctagaattgcagcttt

SEQ ID NO: 9454867 - DNA, 22 bp, Homo sapiens
gcctgcctagaattgcagcttt

SEQ ID NO: 9454868 - DNA, 22 bp, Homo sapiens
attttctagatagatgatgcat

SEQ ID NO: 9454869 - DNA, 22 bp, Homo sapiens
gcctgcctagaattgcagcttt

SEQ ID NO: 9454870 - DNA, 22 bp, Homo sapiens
gcctgcctagaattgcagcttt

SEQ ID NO: 9454871 - DNA, 22 bp, Homo sapiens
gcctgccctgaaagaggtgaag

SEQ ID NO: 9454872 - DNA, 22 bp, Homo sapiens
gcctgccctgaaagaggtgaag

SEQ ID NO: 9454873 - DNA, 21 bp, Homo sapiens
gcctgccctctgtgatggcca

SEQ ID NO: 9454874 - DNA, 21 bp, Homo sapiens
gcctgccctctgtgatggcca

SEQ ID NO: 9454875 - DNA, 22 bp, Homo sapiens
gcctgccccttcctgggcaggg

SEQ ID NO: 9454876 - DNA, 22 bp, Homo sapiens
gcctgccccttcctgggcaggg

SEQ ID NO: 9454877 - DNA, 22 bp, Homo sapiens
gcctgccccttcctgggcaggg

SEQ ID NO: 9454878 - DNA, 22 bp, Homo sapiens
attttacataaggaaggtttaa

SEQ ID NO: 9454879 - DNA, 22 bp, Homo sapiens
attttacataaggaaggtttaa

SEQ ID NO: 9454880 - DNA, 18 bp, Homo sapiens
gcctgccatccccacagc

SEQ ID NO: 9454881 - DNA, 22 bp, Homo sapiens
attttactaagtggatatctgt

SEQ ID NO: 9454882 - DNA, 22 bp, Homo sapiens
gcctgcccacggggctggcata

SEQ ID NO: 9454883 - DNA, 22 bp, Homo sapiens
gcctgcccacggggctggcata

SEQ ID NO: 9454884 - DNA, 22 bp, Homo sapiens
gcctgcccacggggctggcata

SEQ ID NO: 9454885 - DNA, 21 bp, Homo sapiens
gcctgccccatgtttctgttg

SEQ ID NO: 9454886 - DNA, 22 bp, Homo sapiens
attttgaaaccaagttatttcc

SEQ ID NO: 9454887 - DNA, 22 bp, Homo sapiens
attttgaaaagcatttgagtaa

SEQ ID NO: 9454888 - DNA, 22 bp, Homo sapiens
attttcttctctccctggctgc

SEQ ID NO: 9454889 - DNA, 22 bp, Homo sapiens
attttcttctctccctggctgc

SEQ ID NO: 9454890 - DNA, 22 bp, Homo sapiens
attttgaaaagcatttgagtaa

SEQ ID NO: 9454891 - DNA, 22 bp, Homo sapiens
attttgaaaagcatttgagtaa

SEQ ID NO: 9454892 - DNA, 22 bp, Homo sapiens
attttctgtgtgcagataaata

SEQ ID NO: 9454893 - DNA, 22 bp, Homo sapiens
attttctagatagatgatgcat

SEQ ID NO: 9454894 - DNA, 22 bp, Homo sapiens
attttctagatagatgatgcat

SEQ ID NO: 9454895 - DNA, 22 bp, Homo sapiens
attttctagatagatgatgcat

SEQ ID NO: 9454896 - DNA, 22 bp, Homo sapiens
attttctgtgtgcagataaata

SEQ ID NO: 9454897 - DNA, 22 bp, Homo sapiens
attttcttctctccctggctgc

SEQ ID NO: 9454898 - DNA, 22 bp, Homo sapiens
attttcttctctccctggctgc

SEQ ID NO: 9454899 - DNA, 18 bp, Homo sapiens
attttgaactgggaatat

SEQ ID NO: 9454900 - DNA, 18 bp, Homo sapiens
attttgaacaatgctgta

SEQ ID NO: 9454901 - DNA, 22 bp, Homo sapiens
attttgaagggaattgaagttc

SEQ ID NO: 9454902 - DNA, 18 bp, Homo sapiens
attttgaacaatgctgta

SEQ ID NO: 9454903 - DNA, 18 bp, Homo sapiens
attttgaacaatgctgta

SEQ ID NO: 9454904 - DNA, 18 bp, Homo sapiens
attttgaacaatgctgta

SEQ ID NO: 9454905 - DNA, 22 bp, Homo sapiens
gcctggctcctaagagcacaac

SEQ ID NO: 9454906 - DNA, 22 bp, Homo sapiens
gcctggctcacagagcagcctt

SEQ ID NO: 9454907 - DNA, 22 bp, Homo sapiens
gcctggctcacagagcagcctt

SEQ ID NO: 9454908 - DNA, 22 bp, Homo sapiens
attttgaagggaattgaagttc

SEQ ID NO: 9454909 - DNA, 22 bp, Homo sapiens
gctaaatagtttttggaacctc

SEQ ID NO: 9454910 - DNA, 22 bp, Homo sapiens
gctaaggagggtcttgcaaatt

SEQ ID NO: 9454911 - DNA, 22 bp, Homo sapiens
gctaaggctcaggttctaagga

SEQ ID NO: 9454912 - DNA, 22 bp, Homo sapiens
gctaagaggctatatctttctc

SEQ ID NO: 9454913 - DNA, 22 bp, Homo sapiens
gcgtgtatgcaggtctgtgcag

SEQ ID NO: 9454914 - DNA, 22 bp, Homo sapiens
gcgtgtgtgatatgcctctgca

SEQ ID NO: 9454915 - DNA, 22 bp, Homo sapiens
gcgtgtttgcccagtgagtggc

SEQ ID NO: 9454916 - DNA, 22 bp, Homo sapiens
gcgttggggaccccgaagctgg

SEQ ID NO: 9454917 - DNA, 22 bp, Homo sapiens
gcctggctctgagggagctcct

SEQ ID NO: 9454918 - DNA, 22 bp, Homo sapiens
gcctggctctgagtttctctcc

SEQ ID NO: 9454919 - DNA, 22 bp, Homo sapiens
gcctggctctgagggagctcct

SEQ ID NO: 9454920 - DNA, 21 bp, Homo sapiens
gcctggctctcactggcctgg

SEQ ID NO: 9454921 - DNA, 21 bp, Homo sapiens
gcctggctctcactggcctgg

SEQ ID NO: 9454922 - DNA, 22 bp, Homo sapiens
gcctggctcgggcactcgccag

SEQ ID NO: 9454923 - DNA, 22 bp, Homo sapiens
gcctggctcctaaggactggct

SEQ ID NO: 9454924 - DNA, 21 bp, Homo sapiens
gcctggctctcactggcctgg

SEQ ID NO: 9454925 - DNA, 22 bp, Homo sapiens
gcctggctcgggcactcgccag

SEQ ID NO: 9454926 - DNA, 22 bp, Homo sapiens
gcctggctcctaagagcacaac

SEQ ID NO: 9454927 - DNA, 22 bp, Homo sapiens
gcctggctcctaaggactggct

SEQ ID NO: 9454928 - DNA, 22 bp, Homo sapiens
gctattgtgacagcttttcgcc

SEQ ID NO: 9454929 - DNA, 22 bp, Homo sapiens
gctattgtttattttgaatcta

SEQ ID NO: 9454930 - DNA, 22 bp, Homo sapiens
gctatttattaaaatagtgaag

SEQ ID NO: 9454931 - DNA, 21 bp, Homo sapiens
gctatgaatgtagaaaattat

SEQ ID NO: 9454932 - DNA, 21 bp, Homo sapiens
gctatgaatgtagaaaattat

SEQ ID NO: 9454933 - DNA, 22 bp, Homo sapiens
gctaatcaatgttaaggctgtg

SEQ ID NO: 9454934 - DNA, 22 bp, Homo sapiens
gctaatcaatgttaaggctgtg

SEQ ID NO: 9454935 - DNA, 22 bp, Homo sapiens
gctacagactgagcatggctct

SEQ ID NO: 9454936 - DNA, 22 bp, Homo sapiens
gctatttattaaaatggtgaag

SEQ ID NO: 9454937 - DNA, 22 bp, Homo sapiens
gctatttattaaaatggtgaag

SEQ ID NO: 9454938 - DNA, 22 bp, Homo sapiens
gctatttattaaaatggtgaag

SEQ ID NO: 9454939 - DNA, 22 bp, Homo sapiens
gctatttattaaaatggtgaag

SEQ ID NO: 9454940 - DNA, 23 bp, Homo sapiens
gctcaggcatcattcttcctggc

SEQ ID NO: 9454941 - DNA, 23 bp, Homo sapiens
gctcaggcatcattcttcctggc

SEQ ID NO: 9454942 - DNA, 21 bp, Homo sapiens
gctcaaagggcttgccatgct

SEQ ID NO: 9454943 - DNA, 22 bp, Homo sapiens
gctcaaaggccaggtagcagca

SEQ ID NO: 9454944 - DNA, 22 bp, Homo sapiens
gctcaaagcactttgcaaatat

SEQ ID NO: 9454945 - DNA, 22 bp, Homo sapiens
gctcaaagaggcctccaaatcc

SEQ ID NO: 9454946 - DNA, 20 bp, Homo sapiens
gctctaaagccacagattga

SEQ ID NO: 9454947 - DNA, 22 bp, Homo sapiens
gctctaaagagaatctatgcgg

SEQ ID NO: 9454948 - DNA, 19 bp, Homo sapiens
gctctaaaagattttgaag

SEQ ID NO: 9454949 - DNA, 22 bp, Homo sapiens
gctctaagtgagaaggtgccat

SEQ ID NO: 9454950 - DNA, 22 bp, Homo sapiens
gctctagacagaaagaccagtg

SEQ ID NO: 9454951 - DNA, 22 bp, Homo sapiens
gctctagaaagaaggatgtggg

SEQ ID NO: 9454952 - DNA, 22 bp, Homo sapiens
gctctaggttcctagccaagtc

SEQ ID NO: 9454953 - DNA, 22 bp, Homo sapiens
gctctagtaggaatgtccctct

SEQ ID NO: 9454954 - DNA, 22 bp, Homo sapiens
gctcctggatgttcaagtcggc

SEQ ID NO: 9454955 - DNA, 22 bp, Homo sapiens
gctcgcgccgcaccggtccacc

SEQ ID NO: 9454956 - DNA, 22 bp, Homo sapiens
gctcgcctggctggatctgggt

SEQ ID NO: 9454957 - DNA, 22 bp, Homo sapiens
gctcggccccttccctttcttg

SEQ ID NO: 9454958 - DNA, 22 bp, Homo sapiens
gctcggccccgacggccggcgg

SEQ ID NO: 9454959 - DNA, 22 bp, Homo sapiens
gctcggtggccagcctgaggcc

SEQ ID NO: 9454960 - DNA, 22 bp, Homo sapiens
gctcggtggccagcctgaggcc

SEQ ID NO: 9454961 - DNA, 19 bp, Homo sapiens
gctcctggatgacctgtgg

SEQ ID NO: 9454962 - DNA, 22 bp, Homo sapiens
gctccagggaacagaatgtact

SEQ ID NO: 9454963 - DNA, 22 bp, Homo sapiens
gctccaggctgctctgtcccat

SEQ ID NO: 9454964 - DNA, 22 bp, Homo sapiens
gctccaggctgctctgtcccat

SEQ ID NO: 9454965 - DNA, 19 bp, Homo sapiens
gctcctggatgacctgtgg

SEQ ID NO: 9454966 - DNA, 17 bp, Homo sapiens
gctccaggcgtgagtga

SEQ ID NO: 9454967 - DNA, 17 bp, Homo sapiens
gctccaggcgtgagtga

SEQ ID NO: 9454968 - DNA, 17 bp, Homo sapiens
gctccaggcgtgagtga

SEQ ID NO: 9454969 - DNA, 22 bp, Homo sapiens
gctccaggctgctctgtcccat

SEQ ID NO: 9454970 - DNA, 22 bp, Homo sapiens
gctcagggtcccttggtgctgg

SEQ ID NO: 9454971 - DNA, 22 bp, Homo sapiens
gctcaggggaatgggctgccgt

SEQ ID NO: 9454972 - DNA, 22 bp, Homo sapiens
gctcagggtcccttggtgctgg

SEQ ID NO: 9454973 - DNA, 22 bp, Homo sapiens
gctcagggctaaggctgagggg

SEQ ID NO: 9454974 - DNA, 22 bp, Homo sapiens
gctcaggggaatgggctgccgt

SEQ ID NO: 9454975 - DNA, 20 bp, Homo sapiens
gctcaggtttgggctttgtg

SEQ ID NO: 9454976 - DNA, 20 bp, Homo sapiens
gctcaggtgacagtcaggag

SEQ ID NO: 9454977 - DNA, 23 bp, Homo sapiens
gctcaggtggctcagggactgat

SEQ ID NO: 9454978 - DNA, 22 bp, Homo sapiens
gctcagggtgcagtgtccatga

SEQ ID NO: 9454979 - DNA, 18 bp, Homo sapiens
gctcaggtatagacaggg

SEQ ID NO: 9454980 - DNA, 19 bp, Homo sapiens
gctcagtctcctgattgct

SEQ ID NO: 9454981 - DNA, 22 bp, Homo sapiens
gctccaggcagcatagtggatg

SEQ ID NO: 9454982 - DNA, 22 bp, Homo sapiens
gctccaggcagcatagtggatg

SEQ ID NO: 9454983 - DNA, 22 bp, Homo sapiens
gctccaggccacggcttcttgg

SEQ ID NO: 9454984 - DNA, 22 bp, Homo sapiens
gctccaggcgagctggaccaga

SEQ ID NO: 9454985 - DNA, 22 bp, Homo sapiens
gctccaggccccagcgttccgc

SEQ ID NO: 9454986 - DNA, 17 bp, Homo sapiens
gctccaggcgtgagtga

SEQ ID NO: 9454987 - DNA, 17 bp, Homo sapiens
gctccaggcgtgagtga

SEQ ID NO: 9454988 - DNA, 22 bp, Homo sapiens
gctccaggcgagctggaccaga

SEQ ID NO: 9454989 - DNA, 22 bp, Homo sapiens
gctctgagacagtagagatggc

SEQ ID NO: 9454990 - DNA, 22 bp, Homo sapiens
gctctgagagagcaaagtcacc

SEQ ID NO: 9454991 - DNA, 22 bp, Homo sapiens
gctctgagagagcaaagtcacc

SEQ ID NO: 9454992 - DNA, 22 bp, Homo sapiens
gctctgagacacaaagggtgca

SEQ ID NO: 9454993 - DNA, 22 bp, Homo sapiens
gctctgagaggatgctgagcag

SEQ ID NO: 9454994 - DNA, 22 bp, Homo sapiens
gctctgagagctacacagggta

SEQ ID NO: 9454995 - DNA, 22 bp, Homo sapiens
gctctgaacttccaccttttca

SEQ ID NO: 9454996 - DNA, 20 bp, Homo sapiens
gctctgaaccaagagctgtc

SEQ ID NO: 9454997 - DNA, 20 bp, Homo sapiens
gctctgaccatatcaagaca

SEQ ID NO: 9454998 - DNA, 22 bp, Homo sapiens
gctctgacacatttgttctacc

SEQ ID NO: 9454999 - DNA, 22 bp, Homo sapiens
gctctgacaaaggccacttaca

SEQ ID NO: 9455000 - DNA, 22 bp, Homo sapiens
gctctgaatcaatcagataagg

SEQ ID NO: 9455001 - DNA, 22 bp, Homo sapiens
gctctgactggtgggccacagt

SEQ ID NO: 9455002 - DNA, 22 bp, Homo sapiens
gctctgactgagcttcctgcct

SEQ ID NO: 9455003 - DNA, 22 bp, Homo sapiens
gctctgacctggccgccctgct

SEQ ID NO: 9455004 - DNA, 22 bp, Homo sapiens
gctctgacttcctgcgctccag

SEQ ID NO: 9455005 - DNA, 22 bp, Homo sapiens
gctctgagaaccaggaacacag

SEQ ID NO: 9455006 - DNA, 22 bp, Homo sapiens
gctctgagaggatgctgagcag

SEQ ID NO: 9455007 - DNA, 22 bp, Homo sapiens
gctctgagaggatgctgagcag

SEQ ID NO: 9455008 - DNA, 19 bp, Homo sapiens
gctctgagaggggcatggg

SEQ ID NO: 9455009 - DNA, 22 bp, Homo sapiens
gctctgagaggtgcagcagtaa

SEQ ID NO: 9455010 - DNA, 22 bp, Homo sapiens
gctctgagaggtgcagcagtaa

SEQ ID NO: 9455011 - DNA, 19 bp, Homo sapiens
gctctgagaggggcatggg

SEQ ID NO: 9455012 - DNA, 22 bp, Homo sapiens
caaatattccaggtacatccct

SEQ ID NO: 9455013 - DNA, 22 bp, Homo sapiens
caaatagacttcaatctcttga

SEQ ID NO: 9455014 - DNA, 22 bp, Homo sapiens
caaatagacttaagcatctgta

SEQ ID NO: 9455015 - DNA, 22 bp, Homo sapiens
gctctgagagtgcatgatagca

SEQ ID NO: 9455016 - DNA, 22 bp, Homo sapiens
caaatattccaggtacatccct

SEQ ID NO: 9455017 - DNA, 22 bp, Homo sapiens
caaatattccaggtacatccct

SEQ ID NO: 9455018 - DNA, 22 bp, Homo sapiens
caaatattccaggtacatccct

SEQ ID NO: 9455019 - DNA, 20 bp, Homo sapiens
caaatcacaggtaattgcaa

SEQ ID NO: 9455020 - DNA, 22 bp, Homo sapiens
gctctgggtgaacttggagcaa

SEQ ID NO: 9455021 - DNA, 22 bp, Homo sapiens
gctctgggtgaacttggagcaa

SEQ ID NO: 9455022 - DNA, 22 bp, Homo sapiens
caaatgaaaatggcgtcttgga

SEQ ID NO: 9455023 - DNA, 22 bp, Homo sapiens
caaatctttaattgaggaatca

SEQ ID NO: 9455024 - DNA, 15 bp, Homo sapiens
gctctgggtatttga

SEQ ID NO: 9455025 - DNA, 22 bp, Homo sapiens
caaatgaagaaccttctcacct

SEQ ID NO: 9455026 - DNA, 22 bp, Homo sapiens
gctctgggtgaagggtaccatt

SEQ ID NO: 9455027 - DNA, 22 bp, Homo sapiens
gctctgggtgaagggtaccatt

SEQ ID NO: 9455028 - DNA, 22 bp, Homo sapiens
gctctgggtgaatggcagattg

SEQ ID NO: 9455029 - DNA, 22 bp, Homo sapiens
gctctgggtgaatggcagattg

SEQ ID NO: 9455030 - DNA, 22 bp, Homo sapiens
gctctgggtgaatggcagattg

SEQ ID NO: 9455031 - DNA, 20 bp, Homo sapiens
gctctgggtggtaaatgact

SEQ ID NO: 9455032 - DNA, 22 bp, Homo sapiens
caaatcatggaataactagaga

SEQ ID NO: 9455033 - DNA, 22 bp, Homo sapiens
caaatcatggaataactagaga

SEQ ID NO: 9455034 - DNA, 22 bp, Homo sapiens
caaatcatggaataactagaga

SEQ ID NO: 9455035 - DNA, 22 bp, Homo sapiens
caaatcatggaataactagaga

SEQ ID NO: 9455036 - DNA, 22 bp, Homo sapiens
caaatcatggaataactagaga

SEQ ID NO: 9455037 - DNA, 22 bp, Homo sapiens
caaatcatggaataactagaga

SEQ ID NO: 9455038 - DNA, 22 bp, Homo sapiens
caaatcatggaataactagaga

SEQ ID NO: 9455039 - DNA, 22 bp, Homo sapiens
caaatcatggctctagcttaca

SEQ ID NO: 9455040 - DNA, 22 bp, Homo sapiens
caaatcatggctctagcttaca

SEQ ID NO: 9455041 - DNA, 22 bp, Homo sapiens
caaatccagatcccagtcgtag

SEQ ID NO: 9455042 - DNA, 22 bp, Homo sapiens
caaatccagatcccagtcgtag

SEQ ID NO: 9455043 - DNA, 20 bp, Homo sapiens
caaatccctgctctgtgctg

SEQ ID NO: 9455044 - DNA, 22 bp, Homo sapiens
caaatcctggagccatggtaac

SEQ ID NO: 9455045 - DNA, 22 bp, Homo sapiens
caaatctaggatgcatgtagtg

SEQ ID NO: 9455046 - DNA, 20 bp, Homo sapiens
caaatccctgctctgtgctg

SEQ ID NO: 9455047 - DNA, 22 bp, Homo sapiens
caaatctatatgttgatattct

SEQ ID NO: 9455048 - DNA, 22 bp, Homo sapiens
caaatctatatgttgatattct

SEQ ID NO: 9455049 - DNA, 22 bp, Homo sapiens
caaatctgagtctacaatttta

SEQ ID NO: 9455050 - DNA, 20 bp, Homo sapiens
gctgaggagcagtgtggttg

SEQ ID NO: 9455051 - DNA, 20 bp, Homo sapiens
gctgaggagcagtgtggttg

SEQ ID NO: 9455052 - DNA, 22 bp, Homo sapiens
gctgaggacatcatggaaggaa

SEQ ID NO: 9455053 - DNA, 22 bp, Homo sapiens
gctgaggacatcatggaaggaa

SEQ ID NO: 9455054 - DNA, 22 bp, Homo sapiens
gctgaggaagtcaggtggccca

SEQ ID NO: 9455055 - DNA, 22 bp, Homo sapiens
gctgaggaaaccaatgctcaga

SEQ ID NO: 9455056 - DNA, 22 bp, Homo sapiens
gctgaggaaaccaatgctcaga

SEQ ID NO: 9455057 - DNA, 22 bp, Homo sapiens
gctgaggaagtcaggtggccca

SEQ ID NO: 9455058 - DNA, 22 bp, Homo sapiens
gctgaggaaaggctggaaggga

SEQ ID NO: 9455059 - DNA, 22 bp, Homo sapiens
gctgaggaaaggctggaaggga

SEQ ID NO: 9455060 - DNA, 22 bp, Homo sapiens
gctctggtggtgatcagacgct

SEQ ID NO: 9455061 - DNA, 22 bp, Homo sapiens
gctctggtggtgatcagacgct

SEQ ID NO: 9455062 - DNA, 22 bp, Homo sapiens
gctctggttaaaaagaattaaa

SEQ ID NO: 9455063 - DNA, 22 bp, Homo sapiens
gctctggtgagtgtagttcagg

SEQ ID NO: 9455064 - DNA, 22 bp, Homo sapiens
gctctggtgagtgtagttcagg

SEQ ID NO: 9455065 - DNA, 22 bp, Homo sapiens
gctctggtggtgatcagacgct

SEQ ID NO: 9455066 - DNA, 22 bp, Homo sapiens
gctctggttaaaaagaattaaa

SEQ ID NO: 9455067 - DNA, 22 bp, Homo sapiens
gctctggtaccagctactccta

SEQ ID NO: 9455068 - DNA, 22 bp, Homo sapiens
gctctggttccagcgcgcccga

SEQ ID NO: 9455069 - DNA, 20 bp, Homo sapiens
gctgactgtttgggtggcgg

SEQ ID NO: 9455070 - DNA, 22 bp, Homo sapiens
gctctggtagatcctcaggctc

SEQ ID NO: 9455071 - DNA, 22 bp, Homo sapiens
gctctggtagatcctcaggctc

SEQ ID NO: 9455072 - DNA, 22 bp, Homo sapiens
gctctggtctgcttatatctat

SEQ ID NO: 9455073 - DNA, 22 bp, Homo sapiens
gctctggtctgcttatatctat

SEQ ID NO: 9455074 - DNA, 22 bp, Homo sapiens
gctctggtgagtgtagttcagg

SEQ ID NO: 9455075 - DNA, 22 bp, Homo sapiens
gctctggtagatcctcaggctc

SEQ ID NO: 9455076 - DNA, 22 bp, Homo sapiens
gctctggtaccagctactccta

SEQ ID NO: 9455077 - DNA, 22 bp, Homo sapiens
gctctggtaccagctactccta

SEQ ID NO: 9455078 - DNA, 22 bp, Homo sapiens
gctctgggttctgatttatgag

SEQ ID NO: 9455079 - DNA, 22 bp, Homo sapiens
gctgagctgctgttcatcctgc

SEQ ID NO: 9455080 - DNA, 22 bp, Homo sapiens
gctgagctgggacagtcctggg

SEQ ID NO: 9455081 - DNA, 22 bp, Homo sapiens
gctgagctgggacagtcctggg

SEQ ID NO: 9455082 - DNA, 22 bp, Homo sapiens
gctgagaaatgcagacatgctg

SEQ ID NO: 9455083 - DNA, 22 bp, Homo sapiens
gctgagaacagagctctgagct

SEQ ID NO: 9455084 - DNA, 22 bp, Homo sapiens
gctgagaacagagctctgagct

SEQ ID NO: 9455085 - DNA, 22 bp, Homo sapiens
gctgagaaatgcagacatgctg

SEQ ID NO: 9455086 - DNA, 22 bp, Homo sapiens
gctgagaaatgcagacatgctg

SEQ ID NO: 9455087 - DNA, 22 bp, Homo sapiens
caaatgaaggtggtgggtcatt

SEQ ID NO: 9455088 - DNA, 22 bp, Homo sapiens
caaatgaagtccaaagggctta

SEQ ID NO: 9455089 - DNA, 22 bp, Homo sapiens
caaatgaatagggagtgtgatg

SEQ ID NO: 9455090 - DNA, 22 bp, Homo sapiens
caaatgaagggagctgaagtct

SEQ ID NO: 9455091 - DNA, 22 bp, Homo sapiens
caaatgaagggagctgaagtct

SEQ ID NO: 9455092 - DNA, 22 bp, Homo sapiens
caaatgaaggtggtgggtcatt

SEQ ID NO: 9455093 - DNA, 22 bp, Homo sapiens
gctgaggaggtgtggttaggtg

SEQ ID NO: 9455094 - DNA, 22 bp, Homo sapiens
gctgaggagcgagaactctgct

SEQ ID NO: 9455095 - DNA, 22 bp, Homo sapiens
caaatgaagagggcaacttctg

SEQ ID NO: 9455096 - DNA, 20 bp, Homo sapiens
caaatgaagctgttggcctc

SEQ ID NO: 9455097 - DNA, 20 bp, Homo sapiens
caaatgaagctgttggcctc

SEQ ID NO: 9455098 - DNA, 22 bp, Homo sapiens
caaatgaagggagctgaagtct

SEQ ID NO: 9455099 - DNA, 22 bp, Homo sapiens
caaatgaatttccctgcaaatg

SEQ ID NO: 9455100 - DNA, 22 bp, Homo sapiens
caaatgaatttccctgcaaatg

SEQ ID NO: 9455101 - DNA, 22 bp, Homo sapiens
caaatgaatttccctgcaaatg

SEQ ID NO: 9455102 - DNA, 22 bp, Homo sapiens
caaatgaatatttccatgggtt

SEQ ID NO: 9455103 - DNA, 22 bp, Homo sapiens
caaatgaatagggagtgtgatg

SEQ ID NO: 9455104 - DNA, 22 bp, Homo sapiens
caaatgaatatttccatgggtt

SEQ ID NO: 9455105 - DNA, 22 bp, Homo sapiens
caaattcacatgattgcttctg

SEQ ID NO: 9455106 - DNA, 22 bp, Homo sapiens
caaattcagaaaattggtagag

SEQ ID NO: 9455107 - DNA, 22 bp, Homo sapiens
caaattcaatgaacatgtttaa

SEQ ID NO: 9455108 - DNA, 22 bp, Homo sapiens
caaattcacatgattgcttctg

SEQ ID NO: 9455109 - DNA, 22 bp, Homo sapiens
caaattcaaatttcatcagtgt

SEQ ID NO: 9455110 - DNA, 22 bp, Homo sapiens
caaattcaatgaacatgtttaa

SEQ ID NO: 9455111 - DNA, 22 bp, Homo sapiens
caaattaccctcaacatctaga

SEQ ID NO: 9455112 - DNA, 22 bp, Homo sapiens
caaattcaaatttcatcagtgt

SEQ ID NO: 9455113 - DNA, 20 bp, Homo sapiens
gcaaaataggctctgttggt

SEQ ID NO: 9455114 - DNA, 20 bp, Homo sapiens
gcaaaataggctctgttggt

SEQ ID NO: 9455115 - DNA, 20 bp, Homo sapiens
gcaaaataggctctgttggt

SEQ ID NO: 9455116 - DNA, 20 bp, Homo sapiens
gcaaaataggctctgttggt

SEQ ID NO: 9455117 - DNA, 20 bp, Homo sapiens
gcaaaataggctctgttggt

SEQ ID NO: 9455118 - DNA, 22 bp, Homo sapiens
gcaaacaagctgcctgaagatt

SEQ ID NO: 9455119 - DNA, 22 bp, Homo sapiens
gcaaacaagctgcctgaagatt

SEQ ID NO: 9455120 - DNA, 20 bp, Homo sapiens
gcaaaataggctctgttggt

SEQ ID NO: 9455121 - DNA, 22 bp, Homo sapiens
gcaaaaattccagggacgactc

SEQ ID NO: 9455122 - DNA, 22 bp, Homo sapiens
gcaaaaattccagggacgactc

SEQ ID NO: 9455123 - DNA, 22 bp, Homo sapiens
gcaaaaagtagtgctggttagg

SEQ ID NO: 9455124 - DNA, 22 bp, Homo sapiens
gcaaaaagtagtgctggttagg

SEQ ID NO: 9455125 - DNA, 22 bp, Homo sapiens
gcaaaaactgcaattacttttg

SEQ ID NO: 9455126 - DNA, 22 bp, Homo sapiens
gcaaaaattccagggacgactc

SEQ ID NO: 9455127 - DNA, 22 bp, Homo sapiens
gcaaaaattccagggacgactc

SEQ ID NO: 9455128 - DNA, 22 bp, Homo sapiens
gcaaaacagtcgatgcctccca

SEQ ID NO: 9455129 - DNA, 22 bp, Homo sapiens
gcaaaacagtcgatgcctccca

SEQ ID NO: 9455130 - DNA, 22 bp, Homo sapiens
gcaaaactcggacatctaatct

SEQ ID NO: 9455131 - DNA, 22 bp, Homo sapiens
atgtttctagttgtatgtcact

SEQ ID NO: 9455132 - DNA, 22 bp, Homo sapiens
atgtttctacagcgtccactga

SEQ ID NO: 9455133 - DNA, 22 bp, Homo sapiens
atgtttctaaaacttgcatggc

SEQ ID NO: 9455134 - DNA, 22 bp, Homo sapiens
atgtttctacagcgtccactga

SEQ ID NO: 9455135 - DNA, 22 bp, Homo sapiens
atgtttctacagcgtccactga

SEQ ID NO: 9455136 - DNA, 22 bp, Homo sapiens
gatttctgggctttatttcaga

SEQ ID NO: 9455137 - DNA, 22 bp, Homo sapiens
atgtttctcactgtttctctat

SEQ ID NO: 9455138 - DNA, 22 bp, Homo sapiens
atgtttctagttgtatgtcact

SEQ ID NO: 9455139 - DNA, 22 bp, Homo sapiens
gcaaaaaatgcttgttgcttag

SEQ ID NO: 9455140 - DNA, 22 bp, Homo sapiens
gcaaaaaatgcttgttgcttag

SEQ ID NO: 9455141 - DNA, 22 bp, Homo sapiens
gcaaaaaccacaattactttta

SEQ ID NO: 9455142 - DNA, 22 bp, Homo sapiens
gcaaaaaccacaattacttttg

SEQ ID NO: 9455143 - DNA, 22 bp, Homo sapiens
gcaacagcccaggttctgtgtg

SEQ ID NO: 9455144 - DNA, 22 bp, Homo sapiens
gcaacagttggattccagagga

SEQ ID NO: 9455145 - DNA, 22 bp, Homo sapiens
gcaacatgaagaaaacagaacc

SEQ ID NO: 9455146 - DNA, 18 bp, Homo sapiens
gcaacagtatcagcaggc

SEQ ID NO: 9455147 - DNA, 22 bp, Homo sapiens
gcaacagttggattccagagga

SEQ ID NO: 9455148 - DNA, 22 bp, Homo sapiens
gcacacaggggagttctcagaa

SEQ ID NO: 9455149 - DNA, 22 bp, Homo sapiens
gcaaacaaggacatacatcctg

SEQ ID NO: 9455150 - DNA, 22 bp, Homo sapiens
gcaaacaaggacatacatcctg

SEQ ID NO: 9455151 - DNA, 20 bp, Homo sapiens
gcaaatggatcccacaagcc

SEQ ID NO: 9455152 - DNA, 22 bp, Homo sapiens
gcaaatgttcacggggagcata

SEQ ID NO: 9455153 - DNA, 22 bp, Homo sapiens
gcaaatgtggcttcctttctag

SEQ ID NO: 9455154 - DNA, 20 bp, Homo sapiens
gcaaatggacactcagggaa

SEQ ID NO: 9455155 - DNA, 22 bp, Homo sapiens
gcaacacagatcttctttgttg

SEQ ID NO: 9455156 - DNA, 22 bp, Homo sapiens
gcaaatgtttttgagtgtttac

SEQ ID NO: 9455157 - DNA, 22 bp, Homo sapiens
gcaaatgtttttgagtgtttac

SEQ ID NO: 9455158 - DNA, 22 bp, Homo sapiens
gcaaatgttctatatttgctgt

SEQ ID NO: 9455159 - DNA, 22 bp, Homo sapiens
gcaaattaaccaatcatgctcg

SEQ ID NO: 9455160 - DNA, 22 bp, Homo sapiens
gcaaattaaccaatcatgctcg

SEQ ID NO: 9455161 - DNA, 22 bp, Homo sapiens
gcaaatgtttttgagtgtttac

SEQ ID NO: 9455162 - DNA, 22 bp, Homo sapiens
gcaaattagtggccaagcccaa

SEQ ID NO: 9455163 - DNA, 22 bp, Homo sapiens
gcaaattcaacagcacattctc

SEQ ID NO: 9455164 - DNA, 22 bp, Homo sapiens
gcacagagcctggtaccgagaa

SEQ ID NO: 9455165 - DNA, 22 bp, Homo sapiens
gcacagagcctggtaccgagaa

SEQ ID NO: 9455166 - DNA, 18 bp, Homo sapiens
gcacagagcccaggctct

SEQ ID NO: 9455167 - DNA, 22 bp, Homo sapiens
gcacagagcctggtaccgagaa

SEQ ID NO: 9455168 - DNA, 22 bp, Homo sapiens
gcacagagctggccctccaggc

SEQ ID NO: 9455169 - DNA, 22 bp, Homo sapiens
gcacagaggaagcacagactct

SEQ ID NO: 9455170 - DNA, 23 bp, Homo sapiens
gcacagagcagttaggggaagat

SEQ ID NO: 9455171 - DNA, 20 bp, Homo sapiens
gcacagagatgagcaaagta

SEQ ID NO: 9455172 - DNA, 23 bp, Homo sapiens
gcacagagcagttaggggaagat

SEQ ID NO: 9455173 - DNA, 23 bp, Homo sapiens
gcacagagcagttaggggaagat

SEQ ID NO: 9455174 - DNA, 22 bp, Homo sapiens
gcacaggctctcttggggacac

SEQ ID NO: 9455175 - DNA, 22 bp, Homo sapiens
gcacaggctgttggccttcaga

SEQ ID NO: 9455176 - DNA, 22 bp, Homo sapiens
gcacaggctctcttggggacac

SEQ ID NO: 9455177 - DNA, 22 bp, Homo sapiens
gcacagaggatgaggcagctct

SEQ ID NO: 9455178 - DNA, 22 bp, Homo sapiens
gcacagaggaagcacagactct

SEQ ID NO: 9455179 - DNA, 22 bp, Homo sapiens
gcacagaggaagcacagactct

SEQ ID NO: 9455180 - DNA, 22 bp, Homo sapiens
gcacagaggatgaggcagctct

SEQ ID NO: 9455181 - DNA, 22 bp, Homo sapiens
gcacagaggatgaggcagctct

SEQ ID NO: 9455182 - DNA, 22 bp, Homo sapiens
gcacagaggatgaggcagctct

SEQ ID NO: 9455183 - DNA, 22 bp, Homo sapiens
gcacagggagacagccgtggcc

SEQ ID NO: 9455184 - DNA, 22 bp, Homo sapiens
gcacagggagcaggtctctggt

SEQ ID NO: 9455185 - DNA, 22 bp, Homo sapiens
gcacagggagacagccgtggcc

SEQ ID NO: 9455186 - DNA, 22 bp, Homo sapiens
gcacagggagacagccgtggcc

SEQ ID NO: 9455187 - DNA, 22 bp, Homo sapiens
gcacagggagacagccgtggcc

SEQ ID NO: 9455188 - DNA, 22 bp, Homo sapiens
gcacaggctgttggccttcaga

SEQ ID NO: 9455189 - DNA, 22 bp, Homo sapiens
gcacaggctgttggccttcaga

SEQ ID NO: 9455190 - DNA, 21 bp, Homo sapiens
gcacagggacagatcatcaca

SEQ ID NO: 9455191 - DNA, 22 bp, Homo sapiens
gcactgtagtgggggagaaatg

SEQ ID NO: 9455192 - DNA, 22 bp, Homo sapiens
gcactggttaccctgagtggct

SEQ ID NO: 9455193 - DNA, 22 bp, Homo sapiens
gcactggtgtgaaacagtagat

SEQ ID NO: 9455194 - DNA, 22 bp, Homo sapiens
gcactggtgtgttagtaaggga

SEQ ID NO: 9455195 - DNA, 22 bp, Homo sapiens
gcactggggtcatagcctccag

SEQ ID NO: 9455196 - DNA, 22 bp, Homo sapiens
gcactggggtcatagcctccag

SEQ ID NO: 9455197 - DNA, 22 bp, Homo sapiens
gcactgggggcagcagtgaggg

SEQ ID NO: 9455198 - DNA, 22 bp, Homo sapiens
gcactgggggcagcagtgaggg

SEQ ID NO: 9455199 - DNA, 22 bp, Homo sapiens
gcactgggggcagcagtgaggg

SEQ ID NO: 9455200 - DNA, 22 bp, Homo sapiens
gcactgggtgggagatctgaat

SEQ ID NO: 9455201 - DNA, 22 bp, Homo sapiens
gcactgggtgggagatctgaat

SEQ ID NO: 9455202 - DNA, 22 bp, Homo sapiens
gcactgggtgtgaggcagcgtc

SEQ ID NO: 9455203 - DNA, 22 bp, Homo sapiens
gcactgggtgtgaggcagcgtc

SEQ ID NO: 9455204 - DNA, 22 bp, Homo sapiens
gcactgggtgtgaggcagcgtc

SEQ ID NO: 9455205 - DNA, 22 bp, Homo sapiens
gcacagggaggctggcctggcc

SEQ ID NO: 9455206 - DNA, 22 bp, Homo sapiens
gcacagggaggctggcctggcc

SEQ ID NO: 9455207 - DNA, 22 bp, Homo sapiens
gcacagggagcaggtctctggt

SEQ ID NO: 9455208 - DNA, 22 bp, Homo sapiens
gcacagggaggctggcctggcc

SEQ ID NO: 9455209 - DNA, 22 bp, Homo sapiens
gcacagggaggctggcctggcc

SEQ ID NO: 9455210 - DNA, 22 bp, Homo sapiens
gcacagggcaacaggtctgtta

SEQ ID NO: 9455211 - DNA, 22 bp, Homo sapiens
gcacagggcaacaggtctgtta

SEQ ID NO: 9455212 - DNA, 22 bp, Homo sapiens
gcacagggcaacaggtctgtta

SEQ ID NO: 9455213 - DNA, 22 bp, Homo sapiens
gcacagggaggctggcctggcc

SEQ ID NO: 9455214 - DNA, 22 bp, Homo sapiens
gcactcaggactctcatcagta

SEQ ID NO: 9455215 - DNA, 22 bp, Homo sapiens
gcacagggccctgtgcgtaggt

SEQ ID NO: 9455216 - DNA, 22 bp, Homo sapiens
gcacagggccctgtgcgtaggt

SEQ ID NO: 9455217 - DNA, 22 bp, Homo sapiens
gcactgggggcagcagtgaggg

SEQ ID NO: 9455218 - DNA, 22 bp, Homo sapiens
gcactcagtaccaggtcactgc

SEQ ID NO: 9455219 - DNA, 23 bp, Homo sapiens
gcactgggctctcagcaaggtgt

SEQ ID NO: 9455220 - DNA, 22 bp, Homo sapiens
gcagaggctgtagggaaggttg

SEQ ID NO: 9455221 - DNA, 22 bp, Homo sapiens
gcagaggctgtagggaaggttg

SEQ ID NO: 9455222 - DNA, 22 bp, Homo sapiens
gcagaggctctttaatgcttag

SEQ ID NO: 9455223 - DNA, 22 bp, Homo sapiens
gcagaggctgggtgtcccagtc

SEQ ID NO: 9455224 - DNA, 22 bp, Homo sapiens
gcagaggctgggtgtcccagtc

SEQ ID NO: 9455225 - DNA, 22 bp, Homo sapiens
gcagaggcctaggtggaaggcc

SEQ ID NO: 9455226 - DNA, 22 bp, Homo sapiens
gcagaggcctaggtggaaggcc

SEQ ID NO: 9455227 - DNA, 22 bp, Homo sapiens
gcagaggcctaggtggaaggcc

SEQ ID NO: 9455228 - DNA, 22 bp, Homo sapiens
gcagaggcctgaaggtggcggg

SEQ ID NO: 9455229 - DNA, 22 bp, Homo sapiens
gcagaggcctgaaggtggcggg

SEQ ID NO: 9455230 - DNA, 22 bp, Homo sapiens
gcagaggctccattttacagat

SEQ ID NO: 9455231 - DNA, 22 bp, Homo sapiens
gcagaggcctgaaggtggcggg

SEQ ID NO: 9455232 - DNA, 22 bp, Homo sapiens
gcagaggggaagctgaggaatt

SEQ ID NO: 9455233 - DNA, 22 bp, Homo sapiens
gcagagttggagccagcccagg

SEQ ID NO: 9455234 - DNA, 22 bp, Homo sapiens
gcagagttgatgcaagtactga

SEQ ID NO: 9455235 - DNA, 22 bp, Homo sapiens
gcagaggggaagctgaggaatt

SEQ ID NO: 9455236 - DNA, 22 bp, Homo sapiens
gcagagggcaggggtgtttgtt

SEQ ID NO: 9455237 - DNA, 22 bp, Homo sapiens
gcagagggcaggggtgtttgtt

SEQ ID NO: 9455238 - DNA, 22 bp, Homo sapiens
gcagaggctgtagggaaggttg

SEQ ID NO: 9455239 - DNA, 22 bp, Homo sapiens
gcagaggctgtagggaaggttg

SEQ ID NO: 9455240 - DNA, 19 bp, Homo sapiens
gcagatgatgaggctggtc

SEQ ID NO: 9455241 - DNA, 22 bp, Homo sapiens
gcagatgagtgagatagacttc

SEQ ID NO: 9455242 - DNA, 20 bp, Homo sapiens
gcagatgagactcacagagg

SEQ ID NO: 9455243 - DNA, 22 bp, Homo sapiens
gcagatgaaaatgctgccgtgc

SEQ ID NO: 9455244 - DNA, 22 bp, Homo sapiens
gcagataacttgtccaacacca

SEQ ID NO: 9455245 - DNA, 22 bp, Homo sapiens
gcagatgaagtttacaggaaac

SEQ ID NO: 9455246 - DNA, 22 bp, Homo sapiens
gcagaggcctaggtggaaggcc

SEQ ID NO: 9455247 - DNA, 22 bp, Homo sapiens
gcagaggcctaggtggaaggcc

SEQ ID NO: 9455248 - DNA, 22 bp, Homo sapiens
gcagaggcctaggtggaaggcc

SEQ ID NO: 9455249 - DNA, 22 bp, Homo sapiens
gcagaattgatggagaacttaa

SEQ ID NO: 9455250 - DNA, 22 bp, Homo sapiens
gcagaatttaggaattaggaaa

SEQ ID NO: 9455251 - DNA, 21 bp, Homo sapiens
gcagaggaatggtatacataa

SEQ ID NO: 9455252 - DNA, 22 bp, Homo sapiens
gcagaatactgagagctgattg

SEQ ID NO: 9455253 - DNA, 22 bp, Homo sapiens
gcagaattctacagatgataaa

SEQ ID NO: 9455254 - DNA, 22 bp, Homo sapiens
gcagaatgtaggccttcagtgt

SEQ ID NO: 9455255 - DNA, 22 bp, Homo sapiens
gcactgtgacccagagcaggtg

SEQ ID NO: 9455256 - DNA, 22 bp, Homo sapiens
gcactgtgacccagagcaggtg

SEQ ID NO: 9455257 - DNA, 22 bp, Homo sapiens
gcagaaggtcaaagcaagatgt

SEQ ID NO: 9455258 - DNA, 22 bp, Homo sapiens
gcagaaggtctggcacttcagg

SEQ ID NO: 9455259 - DNA, 22 bp, Homo sapiens
gcagaaggttgtttgggaaagg

SEQ ID NO: 9455260 - DNA, 22 bp, Homo sapiens
gcagaagtacctcgttctagtt

SEQ ID NO: 9455261 - DNA, 22 bp, Homo sapiens
gcaggagagccagcaggcttcc

SEQ ID NO: 9455262 - DNA, 22 bp, Homo sapiens
gcagctttaaacattggaaata

SEQ ID NO: 9455263 - DNA, 22 bp, Homo sapiens
gcagccttccgtggacctggac

SEQ ID NO: 9455264 - DNA, 22 bp, Homo sapiens
gcagccttggtgactgagtctg

SEQ ID NO: 9455265 - DNA, 22 bp, Homo sapiens
gcaggagagtctgtgccaggtt

SEQ ID NO: 9455266 - DNA, 22 bp, Homo sapiens
gcaggagagtctgtgccaggtt

SEQ ID NO: 9455267 - DNA, 18 bp, Homo sapiens
gcaggagatgggtggggt

SEQ ID NO: 9455268 - DNA, 22 bp, Homo sapiens
gcaggagagtctgtgccaggtt

SEQ ID NO: 9455269 - DNA, 22 bp, Homo sapiens
gcaggagagtctgtgccaggtt

SEQ ID NO: 9455270 - DNA, 22 bp, Homo sapiens
gcaggagagtctgtgccaggtt

SEQ ID NO: 9455271 - DNA, 22 bp, Homo sapiens
gcaggagagtctgtgccaggtt

SEQ ID NO: 9455272 - DNA, 22 bp, Homo sapiens
gcaggagagtctgtgccaggtt

SEQ ID NO: 9455273 - DNA, 22 bp, Homo sapiens
gcagcctgaggccctttctggc

SEQ ID NO: 9455274 - DNA, 17 bp, Homo sapiens
gcagcctcttggtagtg

SEQ ID NO: 9455275 - DNA, 22 bp, Homo sapiens
gcagcctgatgatctgggttgt

SEQ ID NO: 9455276 - DNA, 22 bp, Homo sapiens
gcagcctgaggccctttctggc

SEQ ID NO: 9455277 - DNA, 22 bp, Homo sapiens
gcagcctgatgatctgggttgt

SEQ ID NO: 9455278 - DNA, 22 bp, Homo sapiens
gcagcctgggcaacagagtgag

SEQ ID NO: 9455279 - DNA, 22 bp, Homo sapiens
gcagcctgggcaacagagtgag

SEQ ID NO: 9455280 - DNA, 22 bp, Homo sapiens
gcagcctgggcaacagagtgag

SEQ ID NO: 9455281 - DNA, 22 bp, Homo sapiens
gcagcctgttgtaccagcctgt

SEQ ID NO: 9455282 - DNA, 22 bp, Homo sapiens
gcagcctgttgtaccagcctgt

SEQ ID NO: 9455283 - DNA, 22 bp, Homo sapiens
gcagcctgggcaacagagtgag

SEQ ID NO: 9455284 - DNA, 22 bp, Homo sapiens
gcagcctgggcaacagagtgag

SEQ ID NO: 9455285 - DNA, 22 bp, Homo sapiens
gcagcctgggcaacagagtgag

SEQ ID NO: 9455286 - DNA, 22 bp, Homo sapiens
gcagcctgggcaacagagtgag

SEQ ID NO: 9455287 - DNA, 22 bp, Homo sapiens
gcagcctgggcaacagagtgag

SEQ ID NO: 9455288 - DNA, 21 bp, Homo sapiens
gcagccaggactttgggctgg

SEQ ID NO: 9455289 - DNA, 21 bp, Homo sapiens
gcagccaggactttgggctgg

SEQ ID NO: 9455290 - DNA, 21 bp, Homo sapiens
gcagccaggactttgggctgg

SEQ ID NO: 9455291 - DNA, 22 bp, Homo sapiens
gcagcaggtccgcatcatcatc

SEQ ID NO: 9455292 - DNA, 22 bp, Homo sapiens
gcagcaggtccgcatcatcatc

SEQ ID NO: 9455293 - DNA, 22 bp, Homo sapiens
gcagatgctgagatttatttct

SEQ ID NO: 9455294 - DNA, 22 bp, Homo sapiens
gcagatgccagatcatgcaggg

SEQ ID NO: 9455295 - DNA, 19 bp, Homo sapiens
gcagatgatgaggctggtc

SEQ ID NO: 9455296 - DNA, 22 bp, Homo sapiens
gcagatgatgtagacagacagt

SEQ ID NO: 9455297 - DNA, 22 bp, Homo sapiens
gcagatgatgtagacagacagt

SEQ ID NO: 9455298 - DNA, 19 bp, Homo sapiens
gcagatgatgaggctggtc

SEQ ID NO: 9455299 - DNA, 22 bp, Homo sapiens
gcagatgccactaggtgaagtg

SEQ ID NO: 9455300 - DNA, 22 bp, Homo sapiens
gcagccaggtttgaggaccact

SEQ ID NO: 9455301 - DNA, 19 bp, Homo sapiens
gcagccaggtgctctacct

SEQ ID NO: 9455302 - DNA, 19 bp, Homo sapiens
gcagccaggtgctctacct

SEQ ID NO: 9455303 - DNA, 19 bp, Homo sapiens
gcagccaggtgctctacct

SEQ ID NO: 9455304 - DNA, 22 bp, Homo sapiens
gcagccagggctaagctgggga

SEQ ID NO: 9455305 - DNA, 22 bp, Homo sapiens
gcagccaggggctgtgacctgt

SEQ ID NO: 9455306 - DNA, 22 bp, Homo sapiens
gcagccaggggctgtgacctgt

SEQ ID NO: 9455307 - DNA, 19 bp, Homo sapiens
gcagccaggtgctctacct

SEQ ID NO: 9455308 - DNA, 22 bp, Homo sapiens
gcagccagggctaagctgggga

SEQ ID NO: 9455309 - DNA, 22 bp, Homo sapiens
gcagccagggagagaaccaggg

SEQ ID NO: 9455310 - DNA, 22 bp, Homo sapiens
gcagccagggagagaaccaggg

SEQ ID NO: 9455311 - DNA, 22 bp, Homo sapiens
gcagccagggctaagctgggga

SEQ ID NO: 9455312 - DNA, 22 bp, Homo sapiens
gcagccagggctaagctgggga

SEQ ID NO: 9455313 - DNA, 22 bp, Homo sapiens
gcagccagggagagaaccaggg

SEQ ID NO: 9455314 - DNA, 22 bp, Homo sapiens
gcagccaggctacagcgggctt

SEQ ID NO: 9455315 - DNA, 22 bp, Homo sapiens
gcagccaggctacagcgggctt

SEQ ID NO: 9455316 - DNA, 22 bp, Homo sapiens
gcagggaggaagagatgcttcc

SEQ ID NO: 9455317 - DNA, 22 bp, Homo sapiens
gcagggaggaagagatgcttcc

SEQ ID NO: 9455318 - DNA, 22 bp, Homo sapiens
gcagggaggaagagatgcttcc

SEQ ID NO: 9455319 - DNA, 22 bp, Homo sapiens
gcagggaggaagagatgcttcc

SEQ ID NO: 9455320 - DNA, 22 bp, Homo sapiens
gcagggagggcctttcatgaca

SEQ ID NO: 9455321 - DNA, 22 bp, Homo sapiens
gcagggagggcctttcatgaca

SEQ ID NO: 9455322 - DNA, 22 bp, Homo sapiens
gcagggagggcctttcatgaca

SEQ ID NO: 9455323 - DNA, 22 bp, Homo sapiens
gcagggaggtttgctgacctgg

SEQ ID NO: 9455324 - DNA, 22 bp, Homo sapiens
gcaggctgtggtatgttgggca

SEQ ID NO: 9455325 - DNA, 22 bp, Homo sapiens
gcaggctgtgaggctcagatgg

SEQ ID NO: 9455326 - DNA, 22 bp, Homo sapiens
gcaggctgtggtatgttgggca

SEQ ID NO: 9455327 - DNA, 22 bp, Homo sapiens
gcagggacgccagggacagcaa

SEQ ID NO: 9455328 - DNA, 22 bp, Homo sapiens
gcaggctgtgaggctcagatgg

SEQ ID NO: 9455329 - DNA, 22 bp, Homo sapiens
gcaggctgtgaggctcagatgg

SEQ ID NO: 9455330 - DNA, 22 bp, Homo sapiens
gcaggctgtggtatgttgggca

SEQ ID NO: 9455331 - DNA, 22 bp, Homo sapiens
gcaggctgtctaaagttagagt

SEQ ID NO: 9455332 - DNA, 22 bp, Homo sapiens
gcaggctgtctaaagttagagt

SEQ ID NO: 9455333 - DNA, 22 bp, Homo sapiens
gcaggctggtctgaccatccct

SEQ ID NO: 9455334 - DNA, 22 bp, Homo sapiens
gcaggctgtagacaccaaacta

SEQ ID NO: 9455335 - DNA, 22 bp, Homo sapiens
gcaggctgtctaaagttagagt

SEQ ID NO: 9455336 - DNA, 22 bp, Homo sapiens
gcaggctgtctaaagttagagt

SEQ ID NO: 9455337 - DNA, 22 bp, Homo sapiens
gcaggctgtctaaagttagagt

SEQ ID NO: 9455338 - DNA, 22 bp, Homo sapiens
gcaggctgtctaaagttagagt

SEQ ID NO: 9455339 - DNA, 22 bp, Homo sapiens
gcaggctgtctaaagttagagt

SEQ ID NO: 9455340 - DNA, 22 bp, Homo sapiens
gcaggatgggtgtagcccagca

SEQ ID NO: 9455341 - DNA, 22 bp, Homo sapiens
gcaggatgccagggcagcagcg

SEQ ID NO: 9455342 - DNA, 23 bp, Homo sapiens
gcaggagttcctggactccagga

SEQ ID NO: 9455343 - DNA, 23 bp, Homo sapiens
gcaggagttcctggactccagga

SEQ ID NO: 9455344 - DNA, 22 bp, Homo sapiens
gcaggagcagtcaggggcagct

SEQ ID NO: 9455345 - DNA, 22 bp, Homo sapiens
gcaggagcagtcaggggcagct

SEQ ID NO: 9455346 - DNA, 22 bp, Homo sapiens
gcaggagcagtcaggggcagct

SEQ ID NO: 9455347 - DNA, 22 bp, Homo sapiens
gcaggagccacttcagggatgc

SEQ ID NO: 9455348 - DNA, 22 bp, Homo sapiens
gcaggagcagtcaggggcagct

SEQ ID NO: 9455349 - DNA, 22 bp, Homo sapiens
gcaggagcaaactgcagtgtgg

SEQ ID NO: 9455350 - DNA, 18 bp, Homo sapiens
gcaggagatgggtggggt

SEQ ID NO: 9455351 - DNA, 22 bp, Homo sapiens
gcaggagcagtcaggggcagct

SEQ ID NO: 9455352 - DNA, 18 bp, Homo sapiens
gcaggagatgggtggggt

SEQ ID NO: 9455353 - DNA, 22 bp, Homo sapiens
gcaggagcaatggcctatcaga

SEQ ID NO: 9455354 - DNA, 22 bp, Homo sapiens
gcaggagcaaactgcagtgtgg

SEQ ID NO: 9455355 - DNA, 22 bp, Homo sapiens
gcagggtacattgggatgggat

SEQ ID NO: 9455356 - DNA, 22 bp, Homo sapiens
gcagggtacattgggatgggat

SEQ ID NO: 9455357 - DNA, 21 bp, Homo sapiens
gcagggtcctttccattccta

SEQ ID NO: 9455358 - DNA, 22 bp, Homo sapiens
gcagggtctgaggccacagagg

SEQ ID NO: 9455359 - DNA, 22 bp, Homo sapiens
gcagggtctgaggccacagagg

SEQ ID NO: 9455360 - DNA, 22 bp, Homo sapiens
gcagggtctgaggccacagagg

SEQ ID NO: 9455361 - DNA, 22 bp, Homo sapiens
gcaggggtagtgtcttcctgag

SEQ ID NO: 9455362 - DNA, 16 bp, Homo sapiens
gcaggggtgggtggag

SEQ ID NO: 9455363 - DNA, 22 bp, Homo sapiens
gcaggggtggaggctgtcctgt

SEQ ID NO: 9455364 - DNA, 22 bp, Homo sapiens
gcaggggtagagattgctggtg

SEQ ID NO: 9455365 - DNA, 22 bp, Homo sapiens
gcagggaggtttgctgacctgg

SEQ ID NO: 9455366 - DNA, 22 bp, Homo sapiens
gcagggaggtttgctgacctgg

SEQ ID NO: 9455367 - DNA, 22 bp, Homo sapiens
gcagggaggtttgctgacctgg

SEQ ID NO: 9455368 - DNA, 22 bp, Homo sapiens
gcagggatgctgaggctcagtg

SEQ ID NO: 9455369 - DNA, 22 bp, Homo sapiens
gcagggatgctgaggctcagtg

SEQ ID NO: 9455370 - DNA, 22 bp, Homo sapiens
gcagggattgtgcagggggcta

SEQ ID NO: 9455371 - DNA, 22 bp, Homo sapiens
gcaggtggatcaccacgtcagg

SEQ ID NO: 9455372 - DNA, 22 bp, Homo sapiens
gcagggtgaaggtcacatagaa

SEQ ID NO: 9455373 - DNA, 22 bp, Homo sapiens
gcagggtgaaggtcacatagaa

SEQ ID NO: 9455374 - DNA, 22 bp, Homo sapiens
gcaggtggatcacctgaggtca

SEQ ID NO: 9455375 - DNA, 22 bp, Homo sapiens
gcaggtggatcacctgaggtca

SEQ ID NO: 9455376 - DNA, 22 bp, Homo sapiens
gcaggtggatcacctgaggtca

SEQ ID NO: 9455377 - DNA, 22 bp, Homo sapiens
attggcagggccagcatctccc

SEQ ID NO: 9455378 - DNA, 22 bp, Homo sapiens
attggttaagacgcatcatgct

SEQ ID NO: 9455379 - DNA, 22 bp, Homo sapiens
attggttaactctgtgtgtcaa

SEQ ID NO: 9455380 - DNA, 22 bp, Homo sapiens
attggttaactctgtgtgtcaa

SEQ ID NO: 9455381 - DNA, 22 bp, Homo sapiens
attggttactcaatttgactga

SEQ ID NO: 9455382 - DNA, 22 bp, Homo sapiens
attggttagagtaacacctatt

SEQ ID NO: 9455383 - DNA, 22 bp, Homo sapiens
attggttaccactttaaatctt

SEQ ID NO: 9455384 - DNA, 22 bp, Homo sapiens
attggttacggcttttcaaatt

SEQ ID NO: 9455385 - DNA, 22 bp, Homo sapiens
attggttaagacgcatcatgct

SEQ ID NO: 9455386 - DNA, 22 bp, Homo sapiens
attggttagaagtagtatgact

SEQ ID NO: 9455387 - DNA, 22 bp, Homo sapiens
attgtaaaagtattctaagatt

SEQ ID NO: 9455388 - DNA, 22 bp, Homo sapiens
attgtaaaagtattctaagatt

SEQ ID NO: 9455389 - DNA, 22 bp, Homo sapiens
attgtaaatagtgccacaataa

SEQ ID NO: 9455390 - DNA, 22 bp, Homo sapiens
attgtaaatagtgccacaataa

SEQ ID NO: 9455391 - DNA, 22 bp, Homo sapiens
attgtaaatagtgccacaataa

SEQ ID NO: 9455392 - DNA, 22 bp, Homo sapiens
attgtaaagtactgtgtacaat

SEQ ID NO: 9455393 - DNA, 22 bp, Homo sapiens
attgtaaagtactgtgtacaat

SEQ ID NO: 9455394 - DNA, 22 bp, Homo sapiens
attgtaaatagtgccacaataa

SEQ ID NO: 9455395 - DNA, 22 bp, Homo sapiens
attgtaaagtactgtgtacaat

SEQ ID NO: 9455396 - DNA, 21 bp, Homo sapiens
gcagtgcagcttggagggtag

SEQ ID NO: 9455397 - DNA, 21 bp, Homo sapiens
gcagtgcagcttggagggtag

SEQ ID NO: 9455398 - DNA, 21 bp, Homo sapiens
gcagtgcagcttggagggtag

SEQ ID NO: 9455399 - DNA, 22 bp, Homo sapiens
gcagtgattttgctcagataaa

SEQ ID NO: 9455400 - DNA, 22 bp, Homo sapiens
attgtacaatgcctggaacatt

SEQ ID NO: 9455401 - DNA, 22 bp, Homo sapiens
attgtacaatgctgaggtttgg

SEQ ID NO: 9455402 - DNA, 22 bp, Homo sapiens
attgtacactagtggcagcagt

SEQ ID NO: 9455403 - DNA, 22 bp, Homo sapiens
gcagtgattggatcagagatgg

SEQ ID NO: 9455404 - DNA, 22 bp, Homo sapiens
attgtacaatgcctggaacatt

SEQ ID NO: 9455405 - DNA, 22 bp, Homo sapiens
attgtacaatgcctggaacatt

SEQ ID NO: 9455406 - DNA, 22 bp, Homo sapiens
attgtacaaaaaagtagacctt

SEQ ID NO: 9455407 - DNA, 22 bp, Homo sapiens
attgtacaactgagggtggaat

SEQ ID NO: 9455408 - DNA, 22 bp, Homo sapiens
attgtaaatagtgccacaataa

SEQ ID NO: 9455409 - DNA, 22 bp, Homo sapiens
attgtaaatagtgccacaataa

SEQ ID NO: 9455410 - DNA, 22 bp, Homo sapiens
attgtaacaacaatagtttagg

SEQ ID NO: 9455411 - DNA, 22 bp, Homo sapiens
attgtaagtagaaatgttatgg

SEQ ID NO: 9455412 - DNA, 22 bp, Homo sapiens
gcagtgctctgcctataatgga

SEQ ID NO: 9455413 - DNA, 22 bp, Homo sapiens
gcagtgctctgcctataatgga

SEQ ID NO: 9455414 - DNA, 22 bp, Homo sapiens
gcagtgctgagaggtgatcgga

SEQ ID NO: 9455415 - DNA, 22 bp, Homo sapiens
gcagtgctgagaggtgatcgga

SEQ ID NO: 9455416 - DNA, 22 bp, Homo sapiens
gcagtgcatgtcggaactcatt

SEQ ID NO: 9455417 - DNA, 22 bp, Homo sapiens
gcagtgcatgtcggaactcatt

SEQ ID NO: 9455418 - DNA, 22 bp, Homo sapiens
gcagtgcaggacaaatcagtgc

SEQ ID NO: 9455419 - DNA, 22 bp, Homo sapiens
gcagtgcagtgggacagggcgc

SEQ ID NO: 9455420 - DNA, 22 bp, Homo sapiens
gcagtgcattactcacatgttt

SEQ ID NO: 9455421 - DNA, 22 bp, Homo sapiens
gcagtgcattactcacatgttt

SEQ ID NO: 9455422 - DNA, 22 bp, Homo sapiens
gcagtgcaggacaaatcagtgc

SEQ ID NO: 9455423 - DNA, 22 bp, Homo sapiens
gcagtgcagtgggacagggcgc

SEQ ID NO: 9455424 - DNA, 18 bp, Homo sapiens
gcagtgcaggaagaagag

SEQ ID NO: 9455425 - DNA, 18 bp, Homo sapiens
gcagtgcaggaagaagag

SEQ ID NO: 9455426 - DNA, 22 bp, Homo sapiens
gcagtgcaggaacatagcttct

SEQ ID NO: 9455427 - DNA, 22 bp, Homo sapiens
attgttgagtgcttcagctgta

SEQ ID NO: 9455428 - DNA, 22 bp, Homo sapiens
attgttccctactgttcaactg

SEQ ID NO: 9455429 - DNA, 22 bp, Homo sapiens
attgttcctggaaaagaacagg

SEQ ID NO: 9455430 - DNA, 22 bp, Homo sapiens
attgttccacttccttgtttgc

SEQ ID NO: 9455431 - DNA, 22 bp, Homo sapiens
attgttccttagaaccatgcct

SEQ ID NO: 9455432 - DNA, 22 bp, Homo sapiens
attgtttacactaacttcataa

SEQ ID NO: 9455433 - DNA, 22 bp, Homo sapiens
attgttgggtagtttgttcagc

SEQ ID NO: 9455434 - DNA, 22 bp, Homo sapiens
attgttgctaggattcaatgag

SEQ ID NO: 9455435 - DNA, 22 bp, Homo sapiens
gcattattaactggaggaaaag

SEQ ID NO: 9455436 - DNA, 22 bp, Homo sapiens
gcattattaatagctgcatgag

SEQ ID NO: 9455437 - DNA, 21 bp, Homo sapiens
attgttatcattgtgctgtgt

SEQ ID NO: 9455438 - DNA, 22 bp, Homo sapiens
attgttaatgttgcactaaggt

SEQ ID NO: 9455439 - DNA, 22 bp, Homo sapiens
attgttaatgttgcactaaggt

SEQ ID NO: 9455440 - DNA, 22 bp, Homo sapiens
attgttatgaaaataagatgtt

SEQ ID NO: 9455441 - DNA, 22 bp, Homo sapiens
attgttcaaagtgctttgcatg

SEQ ID NO: 9455442 - DNA, 22 bp, Homo sapiens
attgttatgaaaataagatgtt

SEQ ID NO: 9455443 - DNA, 22 bp, Homo sapiens
attgttcactgtgaatcttgat

SEQ ID NO: 9455444 - DNA, 22 bp, Homo sapiens
attgttcattgtacacctagta

SEQ ID NO: 9455445 - DNA, 22 bp, Homo sapiens
attgttccacttccttgtttgc

SEQ ID NO: 9455446 - DNA, 22 bp, Homo sapiens
attgttcatgtatgaataaata

SEQ ID NO: 9455447 - DNA, 22 bp, Homo sapiens
gcattcattcattcattaggta

SEQ ID NO: 9455448 - DNA, 22 bp, Homo sapiens
gcattcctacaggctgctatga

SEQ ID NO: 9455449 - DNA, 21 bp, Homo sapiens
gcattcctaggaggtaagcat

SEQ ID NO: 9455450 - DNA, 15 bp, Homo sapiens
gcattcctcatttcc

SEQ ID NO: 9455451 - DNA, 22 bp, Homo sapiens
gcattccttgagttccctgtgc

SEQ ID NO: 9455452 - DNA, 22 bp, Homo sapiens
gcattccttggtttaaaacaag

SEQ ID NO: 9455453 - DNA, 22 bp, Homo sapiens
gcattcctgagaatgcagagtg

SEQ ID NO: 9455454 - DNA, 22 bp, Homo sapiens
gcattcctgtacctctctgcta

SEQ ID NO: 9455455 - DNA, 22 bp, Homo sapiens
gcattccttgagttccctgtgc

SEQ ID NO: 9455456 - DNA, 22 bp, Homo sapiens
gcattcatatggaaggaaacta

SEQ ID NO: 9455457 - DNA, 22 bp, Homo sapiens
gcattcatcaaaaatgttcctc

SEQ ID NO: 9455458 - DNA, 22 bp, Homo sapiens
gcattcatctagtatcactctg

SEQ ID NO: 9455459 - DNA, 22 bp, Homo sapiens
gcattcatatggaaggaaacta

SEQ ID NO: 9455460 - DNA, 22 bp, Homo sapiens
gccactcatgggaggtgtgcaa

SEQ ID NO: 9455461 - DNA, 22 bp, Homo sapiens
gccactgagcccggccattgtt

SEQ ID NO: 9455462 - DNA, 22 bp, Homo sapiens
gccaccttccaaaataatcaca

SEQ ID NO: 9455463 - DNA, 22 bp, Homo sapiens
gccacagtgggctggggccaga

SEQ ID NO: 9455464 - DNA, 22 bp, Homo sapiens
gccacagtcaggacggggagag

SEQ ID NO: 9455465 - DNA, 22 bp, Homo sapiens
gccactggacccagggttatca

SEQ ID NO: 9455466 - DNA, 22 bp, Homo sapiens
gccactggagacagtggggaag

SEQ ID NO: 9455467 - DNA, 22 bp, Homo sapiens
gccactgattattcagcagaca

SEQ ID NO: 9455468 - DNA, 22 bp, Homo sapiens
gccactgattccaagtcaattt

SEQ ID NO: 9455469 - DNA, 22 bp, Homo sapiens
gccactggcatctagttggtag

SEQ ID NO: 9455470 - DNA, 22 bp, Homo sapiens
gccactggcgctgtgcagagtg

SEQ ID NO: 9455471 - DNA, 22 bp, Homo sapiens
gccactggcgctgtgcagagtg

SEQ ID NO: 9455472 - DNA, 20 bp, Homo sapiens
gccactgggcaccagcaggg

SEQ ID NO: 9455473 - DNA, 22 bp, Homo sapiens
gccactgtcataccctggcaat

SEQ ID NO: 9455474 - DNA, 22 bp, Homo sapiens
gccactgtagagtatggacaag

SEQ ID NO: 9455475 - DNA, 22 bp, Homo sapiens
gccactgtactccagcctgcga

SEQ ID NO: 9455476 - DNA, 22 bp, Homo sapiens
gccactgtcatcttgtgaagca

SEQ ID NO: 9455477 - DNA, 22 bp, Homo sapiens
gccactgtcataccctggcaat

SEQ ID NO: 9455478 - DNA, 20 bp, Homo sapiens
attgtttcatttaatgtaca

SEQ ID NO: 9455479 - DNA, 22 bp, Homo sapiens
attgtttccccggaattattca

SEQ ID NO: 9455480 - DNA, 22 bp, Homo sapiens
attgtttctgctttatttaggg

SEQ ID NO: 9455481 - DNA, 22 bp, Homo sapiens
gccactgtcctgtgcctgtgct

SEQ ID NO: 9455482 - DNA, 22 bp, Homo sapiens
atttaaattttctgatggagag

SEQ ID NO: 9455483 - DNA, 22 bp, Homo sapiens
atttaaattttctgatggagag

SEQ ID NO: 9455484 - DNA, 22 bp, Homo sapiens
atttaaatgcttaagagggttt

SEQ ID NO: 9455485 - DNA, 22 bp, Homo sapiens
atttaaatgcttaagagggttt

SEQ ID NO: 9455486 - DNA, 22 bp, Homo sapiens
atttaaatgcttaagagggttt

SEQ ID NO: 9455487 - DNA, 22 bp, Homo sapiens
atttaaatgcttaagagggttt

SEQ ID NO: 9455488 - DNA, 22 bp, Homo sapiens
atttaaatgcttaagagggttt

SEQ ID NO: 9455489 - DNA, 22 bp, Homo sapiens
atttaaatgcttaagagggttt

SEQ ID NO: 9455490 - DNA, 22 bp, Homo sapiens
atttaaatgcttaagagggttt

SEQ ID NO: 9455491 - DNA, 22 bp, Homo sapiens
atttaaatgcttaagagggttt

SEQ ID NO: 9455492 - DNA, 17 bp, Homo sapiens
gaggccaaggcaggcgg

SEQ ID NO: 9455493 - DNA, 22 bp, Homo sapiens
gaggccaaggtgggcagatcac

SEQ ID NO: 9455494 - DNA, 22 bp, Homo sapiens
gaggccaaggtgggcagatcac

SEQ ID NO: 9455495 - DNA, 17 bp, Homo sapiens
gaggccaaggcaggcgg

SEQ ID NO: 9455496 - DNA, 22 bp, Homo sapiens
gaggcatgtctggcctgtccca

SEQ ID NO: 9455497 - DNA, 22 bp, Homo sapiens
gaggccaactttggagaacagg

SEQ ID NO: 9455498 - DNA, 22 bp, Homo sapiens
gaggccaactttggagaacagg

SEQ ID NO: 9455499 - DNA, 22 bp, Homo sapiens
gaggccacagctatcagggaca

SEQ ID NO: 9455500 - DNA, 22 bp, Homo sapiens
gaggccaatcaatagggcaata

SEQ ID NO: 9455501 - DNA, 22 bp, Homo sapiens
gaggccaatcaatagggcaata

SEQ ID NO: 9455502 - DNA, 22 bp, Homo sapiens
gaggccaagttggagaccaggt

SEQ ID NO: 9455503 - DNA, 22 bp, Homo sapiens
gaggccaagttggagaccaggt

SEQ ID NO: 9455504 - DNA, 22 bp, Homo sapiens
gaggccaaggtgggcagatcac

SEQ ID NO: 9455505 - DNA, 22 bp, Homo sapiens
gaggccaagttggagaccaggt

SEQ ID NO: 9455506 - DNA, 22 bp, Homo sapiens
gaggcattaaagggaatcttct

SEQ ID NO: 9455507 - DNA, 22 bp, Homo sapiens
atgtcacattggagctgctgga

SEQ ID NO: 9455508 - DNA, 22 bp, Homo sapiens
atgtcaccagtttccaaatttg

SEQ ID NO: 9455509 - DNA, 22 bp, Homo sapiens
atgtcacattggagctgctgga

SEQ ID NO: 9455510 - DNA, 22 bp, Homo sapiens
atgtcacatggttctggggcct

SEQ ID NO: 9455511 - DNA, 22 bp, Homo sapiens
atgtcacatggttctggggcct

SEQ ID NO: 9455512 - DNA, 22 bp, Homo sapiens
atgtcacagttgcaacatgaat

SEQ ID NO: 9455513 - DNA, 22 bp, Homo sapiens
atgtcacatctgggatggccct

SEQ ID NO: 9455514 - DNA, 22 bp, Homo sapiens
atgtcacatctgggatggccct

SEQ ID NO: 9455515 - DNA, 22 bp, Homo sapiens
atgtcacatgagagcgcagcac

SEQ ID NO: 9455516 - DNA, 22 bp, Homo sapiens
atgtcacatggtcacctctagc

SEQ ID NO: 9455517 - DNA, 22 bp, Homo sapiens
atgtcacatggcctgtactttg

SEQ ID NO: 9455518 - DNA, 22 bp, Homo sapiens
atgtcacatggtcacctctagc

SEQ ID NO: 9455519 - DNA, 22 bp, Homo sapiens
atgtcacatgagagcgcagcac

SEQ ID NO: 9455520 - DNA, 22 bp, Homo sapiens
gaggccacagctatcagggaca

SEQ ID NO: 9455521 - DNA, 22 bp, Homo sapiens
gaggccacagtcagtgttcatc

SEQ ID NO: 9455522 - DNA, 22 bp, Homo sapiens
gaggccacagtcctgaggcatc

SEQ ID NO: 9455523 - DNA, 22 bp, Homo sapiens
gaggccacagtcctgaggcatc

SEQ ID NO: 9455524 - DNA, 22 bp, Homo sapiens
gaggccacagtgtctgggggcc

SEQ ID NO: 9455525 - DNA, 23 bp, Homo sapiens
gaggccacattcccctgcttgag

SEQ ID NO: 9455526 - DNA, 22 bp, Homo sapiens
gaggccacattacttggtgggt

SEQ ID NO: 9455527 - DNA, 22 bp, Homo sapiens
gaggccacagtgtctgggggcc

SEQ ID NO: 9455528 - DNA, 22 bp, Homo sapiens
gaggccacagtcctgaggcatc

SEQ ID NO: 9455529 - DNA, 23 bp, Homo sapiens
gaggccacattcccctgcttgag

SEQ ID NO: 9455530 - DNA, 22 bp, Homo sapiens
gaggctgctttgatgacaggag

SEQ ID NO: 9455531 - DNA, 22 bp, Homo sapiens
gaggctggaatattagaaatgt

SEQ ID NO: 9455532 - DNA, 22 bp, Homo sapiens
gaggctggaatattagaaatgt

SEQ ID NO: 9455533 - DNA, 22 bp, Homo sapiens
gaggctgtgtttcagtgaggcc

SEQ ID NO: 9455534 - DNA, 22 bp, Homo sapiens
gaggctgtgtgtccctctggac

SEQ ID NO: 9455535 - DNA, 22 bp, Homo sapiens
gaggctgtgtttcagtgaggcc

SEQ ID NO: 9455536 - DNA, 22 bp, Homo sapiens
gagggaaaataaaattgcagta

SEQ ID NO: 9455537 - DNA, 22 bp, Homo sapiens
gagggaaacagatgggttgtgg

SEQ ID NO: 9455538 - DNA, 22 bp, Homo sapiens
gagggaaaataaaattgcagta

SEQ ID NO: 9455539 - DNA, 22 bp, Homo sapiens
gagggaaaataaaattgcagta

SEQ ID NO: 9455540 - DNA, 22 bp, Homo sapiens
gaggcttctgttcactcacgct

SEQ ID NO: 9455541 - DNA, 22 bp, Homo sapiens
gaggcttctgtaaccctgtcct

SEQ ID NO: 9455542 - DNA, 22 bp, Homo sapiens
gaggcttctggaaagcctggca

SEQ ID NO: 9455543 - DNA, 22 bp, Homo sapiens
gaggctgttcagtgtccagctt

SEQ ID NO: 9455544 - DNA, 22 bp, Homo sapiens
gaggcttcccgcccatgctgga

SEQ ID NO: 9455545 - DNA, 22 bp, Homo sapiens
gaggcttcccgcccatgctgga

SEQ ID NO: 9455546 - DNA, 22 bp, Homo sapiens
gagggatggtgtgagaggctca

SEQ ID NO: 9455547 - DNA, 22 bp, Homo sapiens
gagggatggtgtgagaggctca

SEQ ID NO: 9455548 - DNA, 22 bp, Homo sapiens
gagggatggtgtgagaggctca

SEQ ID NO: 9455549 - DNA, 22 bp, Homo sapiens
gagggatgtcaggggaccttgg

SEQ ID NO: 9455550 - DNA, 22 bp, Homo sapiens
gagggatgtgcctgaaggcagg

SEQ ID NO: 9455551 - DNA, 22 bp, Homo sapiens
gagggatgtgcctgaaggcagg

SEQ ID NO: 9455552 - DNA, 22 bp, Homo sapiens
gagggcacaaaggcaacattca

SEQ ID NO: 9455553 - DNA, 22 bp, Homo sapiens
gagggatggtgtgagaggctca

SEQ ID NO: 9455554 - DNA, 22 bp, Homo sapiens
gagggaagaaagaattgatgcg

SEQ ID NO: 9455555 - DNA, 22 bp, Homo sapiens
gagggatggtagttgacactga

SEQ ID NO: 9455556 - DNA, 22 bp, Homo sapiens
gagggaaacagatgggttgtgg

SEQ ID NO: 9455557 - DNA, 22 bp, Homo sapiens
gagggaaaggttaatacatgat

SEQ ID NO: 9455558 - DNA, 22 bp, Homo sapiens
gagggaagaaagaattgatgcg

SEQ ID NO: 9455559 - DNA, 22 bp, Homo sapiens
gagggaaaggttaatacatgat

SEQ ID NO: 9455560 - DNA, 22 bp, Homo sapiens
gagggaaaggttaatacatgat

SEQ ID NO: 9455561 - DNA, 22 bp, Homo sapiens
gagggaagaaagaattgatgcg

SEQ ID NO: 9455562 - DNA, 22 bp, Homo sapiens
gagggaagaaagaattgatgcg

SEQ ID NO: 9455563 - DNA, 22 bp, Homo sapiens
gagggggtctatgaggtagagc

SEQ ID NO: 9455564 - DNA, 22 bp, Homo sapiens
gaggggtcacatgggctggctt

SEQ ID NO: 9455565 - DNA, 22 bp, Homo sapiens
gaggtacagagtgttccaatgt

SEQ ID NO: 9455566 - DNA, 23 bp, Homo sapiens
gaggtacagcaccagtgaatagg

SEQ ID NO: 9455567 - DNA, 22 bp, Homo sapiens
gaggtacatgaggatacacagg

SEQ ID NO: 9455568 - DNA, 22 bp, Homo sapiens
gaggtactttctggttcaggtg

SEQ ID NO: 9455569 - DNA, 18 bp, Homo sapiens
gaggtagataagattttc

SEQ ID NO: 9455570 - DNA, 22 bp, Homo sapiens
gaggtaggctgtgaaagggggt

SEQ ID NO: 9455571 - DNA, 22 bp, Homo sapiens
gaggtaggaggtaggtattgtg

SEQ ID NO: 9455572 - DNA, 22 bp, Homo sapiens
gaggtaggaggtaggtattgtg

SEQ ID NO: 9455573 - DNA, 22 bp, Homo sapiens
gaggtaggaggtaggtattgtg

SEQ ID NO: 9455574 - DNA, 17 bp, Homo sapiens
gaggtaggaagtgagtc

SEQ ID NO: 9455575 - DNA, 22 bp, Homo sapiens
gaggtagcgagtggacagtgca

SEQ ID NO: 9455576 - DNA, 22 bp, Homo sapiens
gaggtagcgagtggacagtgca

SEQ ID NO: 9455577 - DNA, 22 bp, Homo sapiens
gaggtagcgagtggacagtgca

SEQ ID NO: 9455578 - DNA, 22 bp, Homo sapiens
gaggtagccacagatagagact

SEQ ID NO: 9455579 - DNA, 22 bp, Homo sapiens
gagtccagctcattgtctggga

SEQ ID NO: 9455580 - DNA, 22 bp, Homo sapiens
gagtccagcagaatgagccaag

SEQ ID NO: 9455581 - DNA, 22 bp, Homo sapiens
gagtccagcagaatgagccaag

SEQ ID NO: 9455582 - DNA, 22 bp, Homo sapiens
gagtccagcagaatgagccaag

SEQ ID NO: 9455583 - DNA, 22 bp, Homo sapiens
gagtccagcagaatgagccaag

SEQ ID NO: 9455584 - DNA, 22 bp, Homo sapiens
gaggttgggatgagggatacag

SEQ ID NO: 9455585 - DNA, 22 bp, Homo sapiens
gaggttggggctgcagtgagct

SEQ ID NO: 9455586 - DNA, 22 bp, Homo sapiens
gaggttggggctgcagtgagct

SEQ ID NO: 9455587 - DNA, 22 bp, Homo sapiens
gagtccaggatttgagctctgt

SEQ ID NO: 9455588 - DNA, 22 bp, Homo sapiens
gagtccagctctgcctcttact

SEQ ID NO: 9455589 - DNA, 22 bp, Homo sapiens
gagtccaggatttgagctctgt

SEQ ID NO: 9455590 - DNA, 22 bp, Homo sapiens
gagtccaggctgttgctcatct

SEQ ID NO: 9455591 - DNA, 18 bp, Homo sapiens
gagtccaggctcttcacc

SEQ ID NO: 9455592 - DNA, 22 bp, Homo sapiens
gagtccaggcatccctcccata

SEQ ID NO: 9455593 - DNA, 20 bp, Homo sapiens
gagggcacattgttccgtgc

SEQ ID NO: 9455594 - DNA, 22 bp, Homo sapiens
gagggcacgaaacaaccacttc

SEQ ID NO: 9455595 - DNA, 22 bp, Homo sapiens
gagggcaccttcagtaatagct

SEQ ID NO: 9455596 - DNA, 22 bp, Homo sapiens
gagggcaccagaagagccagat

SEQ ID NO: 9455597 - DNA, 22 bp, Homo sapiens
gagggcaccagaagagccagat

SEQ ID NO: 9455598 - DNA, 22 bp, Homo sapiens
gagggcactcgagactacggca

SEQ ID NO: 9455599 - DNA, 22 bp, Homo sapiens
gagggcagaaaattatgcggtg

SEQ ID NO: 9455600 - DNA, 22 bp, Homo sapiens
gagggcagaaaattatgcggtg

SEQ ID NO: 9455601 - DNA, 22 bp, Homo sapiens
gagggggcgtgcaaggctccgc

SEQ ID NO: 9455602 - DNA, 22 bp, Homo sapiens
gagggggcgtgcaaggctccgc

SEQ ID NO: 9455603 - DNA, 22 bp, Homo sapiens
gagggggcgtgcaaggctccgc

SEQ ID NO: 9455604 - DNA, 22 bp, Homo sapiens
gagggggcgtgcaaggctccgc

SEQ ID NO: 9455605 - DNA, 22 bp, Homo sapiens
gagggggctagcgcagtgccca

SEQ ID NO: 9455606 - DNA, 22 bp, Homo sapiens
gagggggctagcgcagtgccca

SEQ ID NO: 9455607 - DNA, 22 bp, Homo sapiens
gagggggctagcgcagtgccca

SEQ ID NO: 9455608 - DNA, 22 bp, Homo sapiens
gagggggctagcgcagtgccca

SEQ ID NO: 9455609 - DNA, 22 bp, Homo sapiens
gagggggcgtgcaaggctccgc

SEQ ID NO: 9455610 - DNA, 22 bp, Homo sapiens
gagggggcgtgcaaggctccgc

SEQ ID NO: 9455611 - DNA, 22 bp, Homo sapiens
gagggggctagcgcagtgccca

SEQ ID NO: 9455612 - DNA, 22 bp, Homo sapiens
gagggggctccctgaagccagt

SEQ ID NO: 9455613 - DNA, 22 bp, Homo sapiens
gagggggctccctgaagccagt

SEQ ID NO: 9455614 - DNA, 22 bp, Homo sapiens
gagggggctccctgaagccagt

SEQ ID NO: 9455615 - DNA, 22 bp, Homo sapiens
gagggggtctatgaggtagagc

SEQ ID NO: 9455616 - DNA, 22 bp, Homo sapiens
gagggggtctatgaggtagagc

SEQ ID NO: 9455617 - DNA, 22 bp, Homo sapiens
gaggggggcgccctgcagtgca

SEQ ID NO: 9455618 - DNA, 22 bp, Homo sapiens
gagggggctctgccaacctgtc

SEQ ID NO: 9455619 - DNA, 22 bp, Homo sapiens
gagggggctccctgaagccagt

SEQ ID NO: 9455620 - DNA, 22 bp, Homo sapiens
gagggggctctgccaacctgtc

SEQ ID NO: 9455621 - DNA, 22 bp, Homo sapiens
gagtccagtagttaggacagag

SEQ ID NO: 9455622 - DNA, 22 bp, Homo sapiens
gagtccagtagttaggacagag

SEQ ID NO: 9455623 - DNA, 22 bp, Homo sapiens
gagtccagtgatgttcctggtc

SEQ ID NO: 9455624 - DNA, 22 bp, Homo sapiens
gagtccagtagttaggacagag

SEQ ID NO: 9455625 - DNA, 20 bp, Homo sapiens
gagtccaggggcctgtagca

SEQ ID NO: 9455626 - DNA, 20 bp, Homo sapiens
gagtccaggggcctgtagca

SEQ ID NO: 9455627 - DNA, 22 bp, Homo sapiens
gagtccaggctgttgctcatct

SEQ ID NO: 9455628 - DNA, 22 bp, Homo sapiens
gagtccaggctgttgctcatct

SEQ ID NO: 9455629 - DNA, 22 bp, Homo sapiens
gagtccagttagtgaggctggg

SEQ ID NO: 9455630 - DNA, 22 bp, Homo sapiens
gagtccagttagtgaggctggg

SEQ ID NO: 9455631 - DNA, 22 bp, Homo sapiens
gagtccagtgtttaccaggggt

SEQ ID NO: 9455632 - DNA, 22 bp, Homo sapiens
gagtccagtgatgttcctggtc

SEQ ID NO: 9455633 - DNA, 22 bp, Homo sapiens
gagtccagttagtgaggctggg

SEQ ID NO: 9455634 - DNA, 22 bp, Homo sapiens
gagtccagttagtgaggctggg

SEQ ID NO: 9455635 - DNA, 22 bp, Homo sapiens
gagtgcaggcctgagcaccatc

SEQ ID NO: 9455636 - DNA, 22 bp, Homo sapiens
gagtgcaggcctgagcaccatc

SEQ ID NO: 9455637 - DNA, 22 bp, Homo sapiens
gagtgcaggcctgagcaccatc

SEQ ID NO: 9455638 - DNA, 22 bp, Homo sapiens
gagtgcaggcctgagcaccatc

SEQ ID NO: 9455639 - DNA, 21 bp, Homo sapiens
gagtgcagcaaggtagagtct

SEQ ID NO: 9455640 - DNA, 21 bp, Homo sapiens
gagtgcagcaaggtagagtct

SEQ ID NO: 9455641 - DNA, 22 bp, Homo sapiens
gagtgcagatgccagccccagt

SEQ ID NO: 9455642 - DNA, 22 bp, Homo sapiens
gagtgcagatgccagccccagt

SEQ ID NO: 9455643 - DNA, 22 bp, Homo sapiens
gagtgcagatgaacagaagatt

SEQ ID NO: 9455644 - DNA, 17 bp, Homo sapiens
gagtgcagacacaagca

SEQ ID NO: 9455645 - DNA, 23 bp, Homo sapiens
gagtgcagaatagacatgcagtg

SEQ ID NO: 9455646 - DNA, 23 bp, Homo sapiens
gagtgcagaatagacatgcagtg

SEQ ID NO: 9455647 - DNA, 23 bp, Homo sapiens
gagtgcagaatagacatgcagtg

SEQ ID NO: 9455648 - DNA, 22 bp, Homo sapiens
atgtttcaatgcactttagcct

SEQ ID NO: 9455649 - DNA, 22 bp, Homo sapiens
atgtttcaagagaaaaagagac

SEQ ID NO: 9455650 - DNA, 22 bp, Homo sapiens
atgtttcaaatatatagagttg

SEQ ID NO: 9455651 - DNA, 22 bp, Homo sapiens
atgtttcaaatatatagagttg

SEQ ID NO: 9455652 - DNA, 22 bp, Homo sapiens
atgtttcaccagcaaattacct

SEQ ID NO: 9455653 - DNA, 22 bp, Homo sapiens
atgtttcaccagcaaattacct

SEQ ID NO: 9455654 - DNA, 22 bp, Homo sapiens
atgtttcaccagttttataaga

SEQ ID NO: 9455655 - DNA, 22 bp, Homo sapiens
atgtttcaccagcaaattacct

SEQ ID NO: 9455656 - DNA, 22 bp, Homo sapiens
atgtttcaccagttttataaga

SEQ ID NO: 9455657 - DNA, 22 bp, Homo sapiens
atgtttcaccagttttataaga

SEQ ID NO: 9455658 - DNA, 21 bp, Homo sapiens
gagtgcaggtctgatgccatc

SEQ ID NO: 9455659 - DNA, 21 bp, Homo sapiens
gagtgcaggtctgatgccatc

SEQ ID NO: 9455660 - DNA, 22 bp, Homo sapiens
atgtttattgttttaagctgct

SEQ ID NO: 9455661 - DNA, 22 bp, Homo sapiens
atgtttaattatctgggttttg

SEQ ID NO: 9455662 - DNA, 22 bp, Homo sapiens
atgtttcaggcgaactaacatg

SEQ ID NO: 9455663 - DNA, 22 bp, Homo sapiens
atgtttcagttctaaagttaga

SEQ ID NO: 9455664 - DNA, 22 bp, Homo sapiens
atgtttcagttctaaagttaga

SEQ ID NO: 9455665 - DNA, 22 bp, Homo sapiens
atgtttcagttctaaagttaga

SEQ ID NO: 9455666 - DNA, 22 bp, Homo sapiens
atgtttcagggtgatagaaggt

SEQ ID NO: 9455667 - DNA, 22 bp, Homo sapiens
atgtttcagggtgatagaaggt

SEQ ID NO: 9455668 - DNA, 22 bp, Homo sapiens
atgtttcaggaaatcagctaga

SEQ ID NO: 9455669 - DNA, 22 bp, Homo sapiens
atgtttcaggaaatcagctaga

SEQ ID NO: 9455670 - DNA, 22 bp, Homo sapiens
atgtttcaggaaatcagctaga

SEQ ID NO: 9455671 - DNA, 22 bp, Homo sapiens
atgtttcagatacagatcaaat

SEQ ID NO: 9455672 - DNA, 22 bp, Homo sapiens
atgtttcatttagatatcaggc

SEQ ID NO: 9455673 - DNA, 22 bp, Homo sapiens
atgtttcatgactgagcaaaat

SEQ ID NO: 9455674 - DNA, 22 bp, Homo sapiens
gagttaaatagcttaggattca

SEQ ID NO: 9455675 - DNA, 22 bp, Homo sapiens
gagttaaatgacttggttaagg

SEQ ID NO: 9455676 - DNA, 22 bp, Homo sapiens
gagttactgggtggaaggcact

SEQ ID NO: 9455677 - DNA, 22 bp, Homo sapiens
gagttacagagaggattatggt

SEQ ID NO: 9455678 - DNA, 22 bp, Homo sapiens
gagttacatttggtgacacttc

SEQ ID NO: 9455679 - DNA, 22 bp, Homo sapiens
gagttatatttgcgatattgga

SEQ ID NO: 9455680 - DNA, 22 bp, Homo sapiens
gagttatatttgcgatattgga

SEQ ID NO: 9455681 - DNA, 22 bp, Homo sapiens
gagttattaatggctgagtttg

SEQ ID NO: 9455682 - DNA, 19 bp, Homo sapiens
gagttattgccagggcatg

SEQ ID NO: 9455683 - DNA, 22 bp, Homo sapiens
gagttattctaggtcctttgta

SEQ ID NO: 9455684 - DNA, 22 bp, Homo sapiens
gagttattctaggtcctttgta

SEQ ID NO: 9455685 - DNA, 22 bp, Homo sapiens
gagttatatcctgagtcatatt

SEQ ID NO: 9455686 - DNA, 22 bp, Homo sapiens
gagttatatcctgagtcatatt

SEQ ID NO: 9455687 - DNA, 22 bp, Homo sapiens
gagttatagatggactattatt

SEQ ID NO: 9455688 - DNA, 22 bp, Homo sapiens
gagttatagatggactattatt

SEQ ID NO: 9455689 - DNA, 22 bp, Homo sapiens
gagttataacctagtttaactg

SEQ ID NO: 9455690 - DNA, 22 bp, Homo sapiens
gatcctgggactgaatgggtgc

SEQ ID NO: 9455691 - DNA, 22 bp, Homo sapiens
gatcctgggactgaatgggtgc

SEQ ID NO: 9455692 - DNA, 22 bp, Homo sapiens
gatcctggcacaggttggtccc

SEQ ID NO: 9455693 - DNA, 22 bp, Homo sapiens
gatatttacaaatttgccaata

SEQ ID NO: 9455694 - DNA, 22 bp, Homo sapiens
gatatttaactctcacaggtcc

SEQ ID NO: 9455695 - DNA, 22 bp, Homo sapiens
gatatttacaaatttgccaata

SEQ ID NO: 9455696 - DNA, 22 bp, Homo sapiens
gagttatttgtagggattatat

SEQ ID NO: 9455697 - DNA, 22 bp, Homo sapiens
gagttatttcagaaggaaagat

SEQ ID NO: 9455698 - DNA, 22 bp, Homo sapiens
gagttattgggtggaaaggtag

SEQ ID NO: 9455699 - DNA, 22 bp, Homo sapiens
gatcctgggcccttctgggtca

SEQ ID NO: 9455700 - DNA, 22 bp, Homo sapiens
gatccttatccttaaagatgct

SEQ ID NO: 9455701 - DNA, 22 bp, Homo sapiens
gatccttatttggtcaagcttc

SEQ ID NO: 9455702 - DNA, 22 bp, Homo sapiens
gatctagaaggcaaatatagtg

SEQ ID NO: 9455703 - DNA, 22 bp, Homo sapiens
gatctgagatctaaaccagagg

SEQ ID NO: 9455704 - DNA, 22 bp, Homo sapiens
gatctggaatctgaaggctgag

SEQ ID NO: 9455705 - DNA, 18 bp, Homo sapiens
gatctctgcagtgcctac

SEQ ID NO: 9455706 - DNA, 22 bp, Homo sapiens
gatctctgtggactcttagcac

SEQ ID NO: 9455707 - DNA, 22 bp, Homo sapiens
gatctatttactcttttcctag

SEQ ID NO: 9455708 - DNA, 22 bp, Homo sapiens
atgtttccatgttcaatttact

SEQ ID NO: 9455709 - DNA, 22 bp, Homo sapiens
atgtttcccagagcaaatctgg

SEQ ID NO: 9455710 - DNA, 22 bp, Homo sapiens
atgtttccattttcttgtatca

SEQ ID NO: 9455711 - DNA, 22 bp, Homo sapiens
atgtttccgtgagcatccttga

SEQ ID NO: 9455712 - DNA, 22 bp, Homo sapiens
atgtttcccataagattttctg

SEQ ID NO: 9455713 - DNA, 22 bp, Homo sapiens
atgtttcccataagattttctg

SEQ ID NO: 9455714 - DNA, 22 bp, Homo sapiens
gatctggaatctgaaggctgag

SEQ ID NO: 9455715 - DNA, 22 bp, Homo sapiens
gatctgggagcctcatggagac

SEQ ID NO: 9455716 - DNA, 22 bp, Homo sapiens
gatctggaatctgaaggctgag

SEQ ID NO: 9455717 - DNA, 22 bp, Homo sapiens
atgtttcatttagatatcaggc

SEQ ID NO: 9455718 - DNA, 22 bp, Homo sapiens
atgtttcatttagatatcaggc

SEQ ID NO: 9455719 - DNA, 22 bp, Homo sapiens
atgtttccaggttcttcctatg

SEQ ID NO: 9455720 - DNA, 22 bp, Homo sapiens
atgtatttctatgtagtgaaga

SEQ ID NO: 9455721 - DNA, 22 bp, Homo sapiens
atgtatttctatgtagtgaaga

SEQ ID NO: 9455722 - DNA, 22 bp, Homo sapiens
atgtatttgaaatttgagacat

SEQ ID NO: 9455723 - DNA, 22 bp, Homo sapiens
atgtatttctatgtagtgaaga

SEQ ID NO: 9455724 - DNA, 22 bp, Homo sapiens
atgtcacaaaagtcccattatg

SEQ ID NO: 9455725 - DNA, 22 bp, Homo sapiens
atgtcacagcaggagtattctt

SEQ ID NO: 9455726 - DNA, 22 bp, Homo sapiens
atgtcaacaggcctttaaacat

SEQ ID NO: 9455727 - DNA, 21 bp, Homo sapiens
atgtcaaatgctttattttat

SEQ ID NO: 9455728 - DNA, 22 bp, Homo sapiens
atgtcaatttgttctctcgaag

SEQ ID NO: 9455729 - DNA, 22 bp, Homo sapiens
atgtcacagttgcaacatgaat

SEQ ID NO: 9455730 - DNA, 22 bp, Homo sapiens
atgtcacagtctgactcagtga

SEQ ID NO: 9455731 - DNA, 22 bp, Homo sapiens
atgtcacagtctgactcagtga

SEQ ID NO: 9455732 - DNA, 22 bp, Homo sapiens
atgtcacagtctgactcagtga

SEQ ID NO: 9455733 - DNA, 22 bp, Homo sapiens
atgtcacagctcccattcctcc

SEQ ID NO: 9455734 - DNA, 22 bp, Homo sapiens
atgtcacagctcccattcctcc

SEQ ID NO: 9455735 - DNA, 22 bp, Homo sapiens
atgtcacaggcaacaagattgc

SEQ ID NO: 9455736 - DNA, 22 bp, Homo sapiens
atgtcacagcaggagtattctt

SEQ ID NO: 9455737 - DNA, 22 bp, Homo sapiens
atgtcacagcaggagtattctt

SEQ ID NO: 9455738 - DNA, 22 bp, Homo sapiens
atgtacaaaatgttttgaaatg

SEQ ID NO: 9455739 - DNA, 22 bp, Homo sapiens
atgtacaaaatgttttgaaatg

SEQ ID NO: 9455740 - DNA, 22 bp, Homo sapiens
atgtacaaaatgttttgaaatg

SEQ ID NO: 9455741 - DNA, 22 bp, Homo sapiens
atgtacaacctgcatgacagtc

SEQ ID NO: 9455742 - DNA, 22 bp, Homo sapiens
atgtacaacctgcatgacagtc

SEQ ID NO: 9455743 - DNA, 22 bp, Homo sapiens
atgtacaacctgcatgacagtc

SEQ ID NO: 9455744 - DNA, 22 bp, Homo sapiens
atgtacaacctgcatgacagtc

SEQ ID NO: 9455745 - DNA, 22 bp, Homo sapiens
atgtacaaaatgccactgaatt

SEQ ID NO: 9455746 - DNA, 22 bp, Homo sapiens
atgtacaaaatgccactgaatt

SEQ ID NO: 9455747 - DNA, 22 bp, Homo sapiens
atgtacaaaatgccactgaatt

SEQ ID NO: 9455748 - DNA, 22 bp, Homo sapiens
atgtacaaaatgttttgaaatg

SEQ ID NO: 9455749 - DNA, 22 bp, Homo sapiens
atgtacaatctagggtttgcat

SEQ ID NO: 9455750 - DNA, 22 bp, Homo sapiens
atgtacaatctatcacaagaag

SEQ ID NO: 9455751 - DNA, 22 bp, Homo sapiens
atgtacaagctgttttactgca

SEQ ID NO: 9455752 - DNA, 22 bp, Homo sapiens
atgtacaatctagggtttgcat

SEQ ID NO: 9455753 - DNA, 22 bp, Homo sapiens
atgtacaacctgcatgacagtc

SEQ ID NO: 9455754 - DNA, 22 bp, Homo sapiens
atgtacaagctgttttactgca

SEQ ID NO: 9455755 - DNA, 22 bp, Homo sapiens
atgtacaacctgcatgacagtc

SEQ ID NO: 9455756 - DNA, 22 bp, Homo sapiens
atgtaacaaatggtatacatgt

SEQ ID NO: 9455757 - DNA, 22 bp, Homo sapiens
atgtaacaaatggtatacatgt

SEQ ID NO: 9455758 - DNA, 22 bp, Homo sapiens
atgtaaattgtactgacacacg

SEQ ID NO: 9455759 - DNA, 22 bp, Homo sapiens
atgtaaatcaagcagtgctggt

SEQ ID NO: 9455760 - DNA, 22 bp, Homo sapiens
atgtaaattgtactgacacacg

SEQ ID NO: 9455761 - DNA, 22 bp, Homo sapiens
atgtaaagtatctgaaatgctg

SEQ ID NO: 9455762 - DNA, 22 bp, Homo sapiens
atgtaaagttcagtacagtttt

SEQ ID NO: 9455763 - DNA, 22 bp, Homo sapiens
atgtaacacccacttttatagc

SEQ ID NO: 9455764 - DNA, 22 bp, Homo sapiens
atgtaacaaatggtatacatgt

SEQ ID NO: 9455765 - DNA, 22 bp, Homo sapiens
atgtaacaaatggtatacatgt

SEQ ID NO: 9455766 - DNA, 22 bp, Homo sapiens
atgtaacacccacttttatagc

SEQ ID NO: 9455767 - DNA, 22 bp, Homo sapiens
atgtaacattgaattatatagt

SEQ ID NO: 9455768 - DNA, 22 bp, Homo sapiens
atgtaacatatgtgatcgcatt

SEQ ID NO: 9455769 - DNA, 22 bp, Homo sapiens
atgtaacattgaattatatagt

SEQ ID NO: 9455770 - DNA, 22 bp, Homo sapiens
atgtaagtattcaaaatatttc

SEQ ID NO: 9455771 - DNA, 22 bp, Homo sapiens
atgtaagtattcaaaatatttc

SEQ ID NO: 9455772 - DNA, 22 bp, Homo sapiens
atgtaagtattcaaaatatttc

SEQ ID NO: 9455773 - DNA, 22 bp, Homo sapiens
atgtaaccaccacacaaagcaa

SEQ ID NO: 9455774 - DNA, 22 bp, Homo sapiens
atgtaagagtctaagattgtag

SEQ ID NO: 9455775 - DNA, 17 bp, Homo sapiens
atgtaagaagaaagcag

SEQ ID NO: 9455776 - DNA, 22 bp, Homo sapiens
atgtaatttatgttatccataa

SEQ ID NO: 9455777 - DNA, 22 bp, Homo sapiens
atgtaatagggtaacataacat

SEQ ID NO: 9455778 - DNA, 22 bp, Homo sapiens
gagctctgtccacacttggaga

SEQ ID NO: 9455779 - DNA, 22 bp, Homo sapiens
gagctctgtacacagagggtgt

SEQ ID NO: 9455780 - DNA, 22 bp, Homo sapiens
gagctctgcttgggttcttagg

SEQ ID NO: 9455781 - DNA, 22 bp, Homo sapiens
gagctctgcttgggttcttagg

SEQ ID NO: 9455782 - DNA, 22 bp, Homo sapiens
gagctctggcagggcaggtctg

SEQ ID NO: 9455783 - DNA, 22 bp, Homo sapiens
gagctctggcagggcaggtctg

SEQ ID NO: 9455784 - DNA, 22 bp, Homo sapiens
gagctctggcagggcaggtctg

SEQ ID NO: 9455785 - DNA, 22 bp, Homo sapiens
gagcttggctggacctcacgga

SEQ ID NO: 9455786 - DNA, 22 bp, Homo sapiens
gagcttggctggacctcacgga

SEQ ID NO: 9455787 - DNA, 22 bp, Homo sapiens
gagctggggcggatactcagct

SEQ ID NO: 9455788 - DNA, 22 bp, Homo sapiens
gagcttggctggacctcacgga

SEQ ID NO: 9455789 - DNA, 22 bp, Homo sapiens
gagcttggggcatatggtgcta

SEQ ID NO: 9455790 - DNA, 22 bp, Homo sapiens
gagcttgggtgccatgctgagc

SEQ ID NO: 9455791 - DNA, 22 bp, Homo sapiens
gagcttggtgatgcctcctggt

SEQ ID NO: 9455792 - DNA, 22 bp, Homo sapiens
gagcttggtgatgcctcctggt

SEQ ID NO: 9455793 - DNA, 22 bp, Homo sapiens
gagctttacttctgactggtgc

SEQ ID NO: 9455794 - DNA, 22 bp, Homo sapiens
gagctttaagggcactggtctt

SEQ ID NO: 9455795 - DNA, 22 bp, Homo sapiens
gagctttaccttaggttctgtt

SEQ ID NO: 9455796 - DNA, 22 bp, Homo sapiens
gagctttaagggataaaatgat

SEQ ID NO: 9455797 - DNA, 22 bp, Homo sapiens
gagcttggtgttatttctgtgg

SEQ ID NO: 9455798 - DNA, 22 bp, Homo sapiens
gagcttggtgctgcctgttgtc

SEQ ID NO: 9455799 - DNA, 22 bp, Homo sapiens
gagcttggtgttatttctgtgg

SEQ ID NO: 9455800 - DNA, 22 bp, Homo sapiens
gagcttggtgctgcctgttgtc

SEQ ID NO: 9455801 - DNA, 22 bp, Homo sapiens
gagcttggtgctgcctgttgtc

SEQ ID NO: 9455802 - DNA, 22 bp, Homo sapiens
gagcttggtgctgcctgttgtc

SEQ ID NO: 9455803 - DNA, 22 bp, Homo sapiens
gagcttggtgcacagtggttaa

SEQ ID NO: 9455804 - DNA, 22 bp, Homo sapiens
gaggaagctgcgtggcatttca

SEQ ID NO: 9455805 - DNA, 22 bp, Homo sapiens
gaggaagccccattgaagccag

SEQ ID NO: 9455806 - DNA, 22 bp, Homo sapiens
gaggaagctgcgtggcatttca

SEQ ID NO: 9455807 - DNA, 22 bp, Homo sapiens
gaggaagccccattgaagccag

SEQ ID NO: 9455808 - DNA, 22 bp, Homo sapiens
gagcttttactgctgtattgaa

SEQ ID NO: 9455809 - DNA, 22 bp, Homo sapiens
gaggaagcagggcttggctgag

SEQ ID NO: 9455810 - DNA, 22 bp, Homo sapiens
gaggaaggaatgcagtgtatgc

SEQ ID NO: 9455811 - DNA, 22 bp, Homo sapiens
gaggaaggaatgcagtgtatgc

SEQ ID NO: 9455812 - DNA, 22 bp, Homo sapiens
gaggaaggaatgcagtgtatgc

SEQ ID NO: 9455813 - DNA, 22 bp, Homo sapiens
gaggaaggatttagtttgaggg

SEQ ID NO: 9455814 - DNA, 22 bp, Homo sapiens
atggttattgacctgttgtgct

SEQ ID NO: 9455815 - DNA, 22 bp, Homo sapiens
atggttattggccagatgccat

SEQ ID NO: 9455816 - DNA, 22 bp, Homo sapiens
atggttatttcatggaaaaatt

SEQ ID NO: 9455817 - DNA, 22 bp, Homo sapiens
gaggaaggctaaggggcttaga

SEQ ID NO: 9455818 - DNA, 22 bp, Homo sapiens
atggtttaagggagaatattga

SEQ ID NO: 9455819 - DNA, 22 bp, Homo sapiens
atggtttaagggagaatattga

SEQ ID NO: 9455820 - DNA, 22 bp, Homo sapiens
atggttctggagactggtaatc

SEQ ID NO: 9455821 - DNA, 22 bp, Homo sapiens
gagctctgcagattgttttagg

SEQ ID NO: 9455822 - DNA, 23 bp, Homo sapiens
gagctctgcactaggccctggga

SEQ ID NO: 9455823 - DNA, 18 bp, Homo sapiens
gagctctgcctcccagtc

SEQ ID NO: 9455824 - DNA, 22 bp, Homo sapiens
gagcgcgccacaaggagcggcg

SEQ ID NO: 9455825 - DNA, 20 bp, Homo sapiens
gagcctgggaagtctaaggt

SEQ ID NO: 9455826 - DNA, 20 bp, Homo sapiens
gagcctgggaagtctaaggt

SEQ ID NO: 9455827 - DNA, 22 bp, Homo sapiens
gagcctggcctcctgcctcagc

SEQ ID NO: 9455828 - DNA, 22 bp, Homo sapiens
gagcctggcctcctgcctcagc

SEQ ID NO: 9455829 - DNA, 22 bp, Homo sapiens
gagcctggggaccctcctgagt

SEQ ID NO: 9455830 - DNA, 22 bp, Homo sapiens
gagcctgggtccttccctggga

SEQ ID NO: 9455831 - DNA, 22 bp, Homo sapiens
gagcctgggtccttccctggga

SEQ ID NO: 9455832 - DNA, 22 bp, Homo sapiens
gagcctgggtccttccctggga

SEQ ID NO: 9455833 - DNA, 22 bp, Homo sapiens
gagcctgggactgggggtcatg

SEQ ID NO: 9455834 - DNA, 22 bp, Homo sapiens
gagcctgggactgggggtcatg

SEQ ID NO: 9455835 - DNA, 22 bp, Homo sapiens
gagcctggggaccctcctgagt

SEQ ID NO: 9455836 - DNA, 22 bp, Homo sapiens
gagcctggggaccctcctgagt

SEQ ID NO: 9455837 - DNA, 22 bp, Homo sapiens
gagccctcttgtctatatggta

SEQ ID NO: 9455838 - DNA, 22 bp, Homo sapiens
gagcagtgactggagcatgaga

SEQ ID NO: 9455839 - DNA, 20 bp, Homo sapiens
gagccctctgcactagcgcc

SEQ ID NO: 9455840 - DNA, 22 bp, Homo sapiens
gagccctcttccctagtgatcg

SEQ ID NO: 9455841 - DNA, 22 bp, Homo sapiens
gagcagtaggagaaccctgagc

SEQ ID NO: 9455842 - DNA, 22 bp, Homo sapiens
gagcaggtttcaatgctgatgc

SEQ ID NO: 9455843 - DNA, 22 bp, Homo sapiens
gagcagggcttgtcctcctcat

SEQ ID NO: 9455844 - DNA, 22 bp, Homo sapiens
gagcaggtctttcatggtgcat

SEQ ID NO: 9455845 - DNA, 22 bp, Homo sapiens
gagcaggtctttcatggtgcat

SEQ ID NO: 9455846 - DNA, 22 bp, Homo sapiens
gagcaggtctttcatggtgcat

SEQ ID NO: 9455847 - DNA, 22 bp, Homo sapiens
gagcagggcttgtcctcctcat

SEQ ID NO: 9455848 - DNA, 17 bp, Homo sapiens
gagcagggatgcggttc

SEQ ID NO: 9455849 - DNA, 22 bp, Homo sapiens
gagcagggccacttctgtacct

SEQ ID NO: 9455850 - DNA, 17 bp, Homo sapiens
gagcagggatgcggttc

SEQ ID NO: 9455851 - DNA, 22 bp, Homo sapiens
gagcagggagacaactctggtg

SEQ ID NO: 9455852 - DNA, 17 bp, Homo sapiens
gagcagggatgcggttc

SEQ ID NO: 9455853 - DNA, 17 bp, Homo sapiens
gagcagggatgcggttc

SEQ ID NO: 9455854 - DNA, 22 bp, Homo sapiens
gagcagctgagctggaatgaga

SEQ ID NO: 9455855 - DNA, 22 bp, Homo sapiens
gagcagggagacaactctggtg

SEQ ID NO: 9455856 - DNA, 22 bp, Homo sapiens
gagcagctctgtgcctggagac

SEQ ID NO: 9455857 - DNA, 22 bp, Homo sapiens
gagcagctctgggtgacccagt

SEQ ID NO: 9455858 - DNA, 22 bp, Homo sapiens
gagcagctctgtgcctggagac

SEQ ID NO: 9455859 - DNA, 22 bp, Homo sapiens
gagcagctctgtgcctggagac

SEQ ID NO: 9455860 - DNA, 22 bp, Homo sapiens
gagcagctctgtgcctggagac

SEQ ID NO: 9455861 - DNA, 22 bp, Homo sapiens
gagaggctctgaggactggggt

SEQ ID NO: 9455862 - DNA, 22 bp, Homo sapiens
gagaggctctgaggactggggt

SEQ ID NO: 9455863 - DNA, 22 bp, Homo sapiens
gagaggctctgaggactggggt

SEQ ID NO: 9455864 - DNA, 22 bp, Homo sapiens
gagaggctccgccactgctcag

SEQ ID NO: 9455865 - DNA, 22 bp, Homo sapiens
atgcttttcctaaaatgatgcc

SEQ ID NO: 9455866 - DNA, 22 bp, Homo sapiens
atgcttttcctaaaatgatgcc

SEQ ID NO: 9455867 - DNA, 22 bp, Homo sapiens
atgcttttcctaaaatgatgcc

SEQ ID NO: 9455868 - DNA, 22 bp, Homo sapiens
atgcttttggtctttggtccgg

SEQ ID NO: 9455869 - DNA, 22 bp, Homo sapiens
atgcttttggtctttggtccgg

SEQ ID NO: 9455870 - DNA, 22 bp, Homo sapiens
atgctttttaaacttaattgga

SEQ ID NO: 9455871 - DNA, 22 bp, Homo sapiens
atgctttttaaacttaattgga

SEQ ID NO: 9455872 - DNA, 22 bp, Homo sapiens
gagaggaagccttctgtacttg

SEQ ID NO: 9455873 - DNA, 22 bp, Homo sapiens
gagaggaatatcattatattag

SEQ ID NO: 9455874 - DNA, 22 bp, Homo sapiens
gagaggctgactggctgtcctg

SEQ ID NO: 9455875 - DNA, 22 bp, Homo sapiens
gagaggctgatcctgcagagaa

SEQ ID NO: 9455876 - DNA, 22 bp, Homo sapiens
gagaggctgactggctgtcctg

SEQ ID NO: 9455877 - DNA, 22 bp, Homo sapiens
gagaggctggcagtgccaggtt

SEQ ID NO: 9455878 - DNA, 22 bp, Homo sapiens
gagaggtagcagtaagaacagg

SEQ ID NO: 9455879 - DNA, 22 bp, Homo sapiens
gagaggtagaggctctgcttaa

SEQ ID NO: 9455880 - DNA, 22 bp, Homo sapiens
gagaggtcggggacactgcaaa

SEQ ID NO: 9455881 - DNA, 22 bp, Homo sapiens
gagaggtccattcccctgtcag

SEQ ID NO: 9455882 - DNA, 22 bp, Homo sapiens
gagaggtggaggttgcagtgag

SEQ ID NO: 9455883 - DNA, 22 bp, Homo sapiens
gagaggtggtgaggacttgtct

SEQ ID NO: 9455884 - DNA, 22 bp, Homo sapiens
gagaggtggaggttgcagtgag

SEQ ID NO: 9455885 - DNA, 22 bp, Homo sapiens
gagaggtgtgtttcagataaga

SEQ ID NO: 9455886 - DNA, 22 bp, Homo sapiens
gagaggtggtgaggacttgtct

SEQ ID NO: 9455887 - DNA, 22 bp, Homo sapiens
gagaggtgtgtttcagataaga

SEQ ID NO: 9455888 - DNA, 22 bp, Homo sapiens
gagaggtggaggttgcagtgag

SEQ ID NO: 9455889 - DNA, 22 bp, Homo sapiens
gagaggtgaatgtggatgccac

SEQ ID NO: 9455890 - DNA, 22 bp, Homo sapiens
gagaggtggaggttgcagtgag

SEQ ID NO: 9455891 - DNA, 22 bp, Homo sapiens
gagaggtgaaatagttgtccgg

SEQ ID NO: 9455892 - DNA, 22 bp, Homo sapiens
gagaggtgaaaggatagtttga

SEQ ID NO: 9455893 - DNA, 22 bp, Homo sapiens
gagaggtgaatgtggatgccac

SEQ ID NO: 9455894 - DNA, 22 bp, Homo sapiens
gagaggtgaatgtggatgccac

SEQ ID NO: 9455895 - DNA, 22 bp, Homo sapiens
gagaggtgaaggctgccctggg

SEQ ID NO: 9455896 - DNA, 22 bp, Homo sapiens
gagaggtgaaggctgccctggg

SEQ ID NO: 9455897 - DNA, 22 bp, Homo sapiens
gagaggtgaaggctgccctggg

SEQ ID NO: 9455898 - DNA, 22 bp, Homo sapiens
gagcagctaaaattctcatgca

SEQ ID NO: 9455899 - DNA, 22 bp, Homo sapiens
gagcacagggaatagacagata

SEQ ID NO: 9455900 - DNA, 22 bp, Homo sapiens
gagcacagggaatagacagata

SEQ ID NO: 9455901 - DNA, 22 bp, Homo sapiens
gagcagctaaaattctcatgca

SEQ ID NO: 9455902 - DNA, 22 bp, Homo sapiens
gagcagctaaaattctcatgca

SEQ ID NO: 9455903 - DNA, 22 bp, Homo sapiens
gagcagctagataaagcccttc

SEQ ID NO: 9455904 - DNA, 22 bp, Homo sapiens
gagcagctagataaagcccttc

SEQ ID NO: 9455905 - DNA, 22 bp, Homo sapiens
gagcagctaaaattctcatgca

SEQ ID NO: 9455906 - DNA, 22 bp, Homo sapiens
gagcagctcagaggactagtgt

SEQ ID NO: 9455907 - DNA, 22 bp, Homo sapiens
gagcagctcagaggactagtgt

SEQ ID NO: 9455908 - DNA, 22 bp, Homo sapiens
gagcagctcaggcacttagcca

SEQ ID NO: 9455909 - DNA, 22 bp, Homo sapiens
gagcagctccagccgcatgact

SEQ ID NO: 9455910 - DNA, 22 bp, Homo sapiens
gagcagctcaggcacttagcca

SEQ ID NO: 9455911 - DNA, 22 bp, Homo sapiens
gagcagctcgagaaggaagcag

SEQ ID NO: 9455912 - DNA, 22 bp, Homo sapiens
gagcagctcgagaaggaagcag

SEQ ID NO: 9455913 - DNA, 22 bp, Homo sapiens
gagcagctcgagaaggaagcag

SEQ ID NO: 9455914 - DNA, 22 bp, Homo sapiens
gagcagctccagccgcatgact

SEQ ID NO: 9455915 - DNA, 22 bp, Homo sapiens
gaagcagacttttgcttatttg

SEQ ID NO: 9455916 - DNA, 22 bp, Homo sapiens
gaagcagagcctaaggcagaca

SEQ ID NO: 9455917 - DNA, 22 bp, Homo sapiens
gaagcagaagtacgatttacta

SEQ ID NO: 9455918 - DNA, 22 bp, Homo sapiens
gaagcactgtgctgctaagttg

SEQ ID NO: 9455919 - DNA, 22 bp, Homo sapiens
gaagcactgcatttcaagatca

SEQ ID NO: 9455920 - DNA, 22 bp, Homo sapiens
gaagcagagcctaaggcagaca

SEQ ID NO: 9455921 - DNA, 23 bp, Homo sapiens
gaatcagtggctaacaaggaaac

SEQ ID NO: 9455922 - DNA, 22 bp, Homo sapiens
gaatgtaagtgggcagaagaca

SEQ ID NO: 9455923 - DNA, 22 bp, Homo sapiens
gaatgtaataggaaacgtgtgg

SEQ ID NO: 9455924 - DNA, 22 bp, Homo sapiens
gaatgtaatagtcagtagaaca

SEQ ID NO: 9455925 - DNA, 22 bp, Homo sapiens
gaatcatagaacattaatagaa

SEQ ID NO: 9455926 - DNA, 23 bp, Homo sapiens
atgcacaagccagcaggggacag

SEQ ID NO: 9455927 - DNA, 22 bp, Homo sapiens
atgcacaagcaagagataatgg

SEQ ID NO: 9455928 - DNA, 22 bp, Homo sapiens
atgcacaagcaagagataatgg

SEQ ID NO: 9455929 - DNA, 22 bp, Homo sapiens
atgcacaagaggctagaaaaga

SEQ ID NO: 9455930 - DNA, 22 bp, Homo sapiens
atgcacaagaggctagaaaaga

SEQ ID NO: 9455931 - DNA, 22 bp, Homo sapiens
gaagcaatctggctcccagcca

SEQ ID NO: 9455932 - DNA, 22 bp, Homo sapiens
gaagcaatgtgttttcaacatt

SEQ ID NO: 9455933 - DNA, 22 bp, Homo sapiens
gaagcaattaagtttgtgatct

SEQ ID NO: 9455934 - DNA, 22 bp, Homo sapiens
gaagcacatggctatagctatt

SEQ ID NO: 9455935 - DNA, 22 bp, Homo sapiens
gaagcacatggctgtgagcaac

SEQ ID NO: 9455936 - DNA, 22 bp, Homo sapiens
gaagcacatggctgtgagcaac

SEQ ID NO: 9455937 - DNA, 22 bp, Homo sapiens
gaagcacaaagtgtagttccga

SEQ ID NO: 9455938 - DNA, 22 bp, Homo sapiens
gaagcaatttagaatcagaagc

SEQ ID NO: 9455939 - DNA, 22 bp, Homo sapiens
gaatgttattgaactacgagct

SEQ ID NO: 9455940 - DNA, 22 bp, Homo sapiens
gaatgttattggacagcagtgg

SEQ ID NO: 9455941 - DNA, 22 bp, Homo sapiens
gaatgttatgtatccagtcaca

SEQ ID NO: 9455942 - DNA, 22 bp, Homo sapiens
gaatgttagagattcttaggtt

SEQ ID NO: 9455943 - DNA, 22 bp, Homo sapiens
gaatgttactttgattttgtcc

SEQ ID NO: 9455944 - DNA, 22 bp, Homo sapiens
gaatgttaatgcacttctagct

SEQ ID NO: 9455945 - DNA, 22 bp, Homo sapiens
gaatgttaatgcacttctagct

SEQ ID NO: 9455946 - DNA, 22 bp, Homo sapiens
gaatgtccctgcagttgctgcc

SEQ ID NO: 9455947 - DNA, 22 bp, Homo sapiens
gaatgtaatagtcagtagaaca

SEQ ID NO: 9455948 - DNA, 22 bp, Homo sapiens
gaatgtaatagtcagtagaaca

SEQ ID NO: 9455949 - DNA, 22 bp, Homo sapiens
gaatgtcctcctggatcactcc

SEQ ID NO: 9455950 - DNA, 22 bp, Homo sapiens
gaatgtccctgcagttgctgcc

SEQ ID NO: 9455951 - DNA, 22 bp, Homo sapiens
atgcatataaggcacatgtatt

SEQ ID NO: 9455952 - DNA, 22 bp, Homo sapiens
atgcatatatacatacacagtc

SEQ ID NO: 9455953 - DNA, 22 bp, Homo sapiens
atgcatatagaacatttgacat

SEQ ID NO: 9455954 - DNA, 22 bp, Homo sapiens
atgcatataatggccagaacaa

SEQ ID NO: 9455955 - DNA, 22 bp, Homo sapiens
atgcatatagaacatttgacat

SEQ ID NO: 9455956 - DNA, 22 bp, Homo sapiens
gaatgtttcatgtgtatgttag

SEQ ID NO: 9455957 - DNA, 22 bp, Homo sapiens
atgcataagtgcagcagatttg

SEQ ID NO: 9455958 - DNA, 22 bp, Homo sapiens
atgcataatgtatgtattgact

SEQ ID NO: 9455959 - DNA, 22 bp, Homo sapiens
atgcctggactgacatgcactg

SEQ ID NO: 9455960 - DNA, 22 bp, Homo sapiens
gacaggaaatatgggggttgtt

SEQ ID NO: 9455961 - DNA, 22 bp, Homo sapiens
gacagggactccctggttagaa

SEQ ID NO: 9455962 - DNA, 22 bp, Homo sapiens
gacagggactccctggttagaa

SEQ ID NO: 9455963 - DNA, 22 bp, Homo sapiens
gacagggaggaaagagactgct

SEQ ID NO: 9455964 - DNA, 22 bp, Homo sapiens
atgcctcctcaaatctgccaca

SEQ ID NO: 9455965 - DNA, 22 bp, Homo sapiens
atgcctcctcaaatctgccaca

SEQ ID NO: 9455966 - DNA, 22 bp, Homo sapiens
atgcctcctgtgccactgtgat

SEQ ID NO: 9455967 - DNA, 22 bp, Homo sapiens
atgcctccttctgaaacagggc

SEQ ID NO: 9455968 - DNA, 20 bp, Homo sapiens
atgcctctaattttgcaaac

SEQ ID NO: 9455969 - DNA, 22 bp, Homo sapiens
atgcctggactgacatgcactg

SEQ ID NO: 9455970 - DNA, 22 bp, Homo sapiens
atgcctggactgacatgcactg

SEQ ID NO: 9455971 - DNA, 22 bp, Homo sapiens
atgcctctgctcttggtcctca

SEQ ID NO: 9455972 - DNA, 22 bp, Homo sapiens
atgcctcctcaaatctgccaca

SEQ ID NO: 9455973 - DNA, 22 bp, Homo sapiens
atgcctccgcatgtgcctttga

SEQ ID NO: 9455974 - DNA, 22 bp, Homo sapiens
atgcctccgcatgtgcctttga

SEQ ID NO: 9455975 - DNA, 22 bp, Homo sapiens
atgcctcccctgtgtcttttat

SEQ ID NO: 9455976 - DNA, 22 bp, Homo sapiens
atgcctccctgtccttcagttc

SEQ ID NO: 9455977 - DNA, 22 bp, Homo sapiens
atgcctcccctgtgtcttttat

SEQ ID NO: 9455978 - DNA, 22 bp, Homo sapiens
atgcctccaagattcttacgtt

SEQ ID NO: 9455979 - DNA, 22 bp, Homo sapiens
atgcctccaagattcttacgtt

SEQ ID NO: 9455980 - DNA, 22 bp, Homo sapiens
atgccctgtggttcatgtgaga

SEQ ID NO: 9455981 - DNA, 22 bp, Homo sapiens
atgcccttatgccagaggcaat

SEQ ID NO: 9455982 - DNA, 22 bp, Homo sapiens
atgcccttcatttatcatgaaa

SEQ ID NO: 9455983 - DNA, 23 bp, Homo sapiens
atgccctgtagaggctgctgacc

SEQ ID NO: 9455984 - DNA, 22 bp, Homo sapiens
atgccctggggctacctctgag

SEQ ID NO: 9455985 - DNA, 22 bp, Homo sapiens
atgccctgggagtgctgtacca

SEQ ID NO: 9455986 - DNA, 22 bp, Homo sapiens
atgccctgtgactctcctggac

SEQ ID NO: 9455987 - DNA, 23 bp, Homo sapiens
atgccctgtgcagaaatgtggaa

SEQ ID NO: 9455988 - DNA, 22 bp, Homo sapiens
atgcccagaaccccctggatgg

SEQ ID NO: 9455989 - DNA, 22 bp, Homo sapiens
atgcccagaaccccctggatgg

SEQ ID NO: 9455990 - DNA, 22 bp, Homo sapiens
atgcccaggcccatacctagat

SEQ ID NO: 9455991 - DNA, 22 bp, Homo sapiens
atgccccaggaggtgccatcca

SEQ ID NO: 9455992 - DNA, 22 bp, Homo sapiens
atgccccaggaggtgccatcca

SEQ ID NO: 9455993 - DNA, 22 bp, Homo sapiens
atgcccagggctggtgaggtcc

SEQ ID NO: 9455994 - DNA, 22 bp, Homo sapiens
atgccctgctctcgggaaggga

SEQ ID NO: 9455995 - DNA, 22 bp, Homo sapiens
atgccctgctgccatctggccg

SEQ ID NO: 9455996 - DNA, 22 bp, Homo sapiens
atgccctgctgctggggcagtg

SEQ ID NO: 9455997 - DNA, 22 bp, Homo sapiens
atgccctgctgccatctggccg

SEQ ID NO: 9455998 - DNA, 22 bp, Homo sapiens
atgccctgccaagcaggctaaa

SEQ ID NO: 9455999 - DNA, 22 bp, Homo sapiens
atgccctgccaagcaggctaaa

SEQ ID NO: 9456000 - DNA, 22 bp, Homo sapiens
atgccctgcatcaagtgacact

SEQ ID NO: 9456001 - DNA, 22 bp, Homo sapiens
atgccctgcatcaagtgacact

SEQ ID NO: 9456002 - DNA, 22 bp, Homo sapiens
atgccctgaggaatgtcacgct

SEQ ID NO: 9456003 - DNA, 22 bp, Homo sapiens
atgccctgaggaatgtcacgct

SEQ ID NO: 9456004 - DNA, 22 bp, Homo sapiens
atgcatatgcaatgcacaattt

SEQ ID NO: 9456005 - DNA, 22 bp, Homo sapiens
atgcatatgcatctgtgtacat

SEQ ID NO: 9456006 - DNA, 22 bp, Homo sapiens
atgcatatctcctatctcctca

SEQ ID NO: 9456007 - DNA, 22 bp, Homo sapiens
atgcatatcacagtctccatgt

SEQ ID NO: 9456008 - DNA, 22 bp, Homo sapiens
atgcatatcagtgattgtttgc

SEQ ID NO: 9456009 - DNA, 20 bp, Homo sapiens
atgcatatatgtggtgtctg

SEQ ID NO: 9456010 - DNA, 22 bp, Homo sapiens
atgccacttcattccagcctcg

SEQ ID NO: 9456011 - DNA, 22 bp, Homo sapiens
atgccacttcattccagcctcg

SEQ ID NO: 9456012 - DNA, 22 bp, Homo sapiens
atgcccaccctcagcccaggct

SEQ ID NO: 9456013 - DNA, 22 bp, Homo sapiens
atgcccactcccattacaggac

SEQ ID NO: 9456014 - DNA, 22 bp, Homo sapiens
atgcccacaacactgcactttt

SEQ ID NO: 9456015 - DNA, 22 bp, Homo sapiens
atgcccaccctcagcccaggct

SEQ ID NO: 9456016 - DNA, 22 bp, Homo sapiens
atgcccacagagagggaaattt

SEQ ID NO: 9456017 - DNA, 22 bp, Homo sapiens
atgcccacaacactgcactttt

SEQ ID NO: 9456018 - DNA, 22 bp, Homo sapiens
atgcccaatgtcacaatttttg

SEQ ID NO: 9456019 - DNA, 22 bp, Homo sapiens
gaccctcattgtcaccgtgagc

SEQ ID NO: 9456020 - DNA, 22 bp, Homo sapiens
gaccctccactcactgctgtgt

SEQ ID NO: 9456021 - DNA, 22 bp, Homo sapiens
gaccctcctactaccctggaaa

SEQ ID NO: 9456022 - DNA, 22 bp, Homo sapiens
gaccctccactcactgctgtgt

SEQ ID NO: 9456023 - DNA, 22 bp, Homo sapiens
gaccccaggcagatcagggggt

SEQ ID NO: 9456024 - DNA, 22 bp, Homo sapiens
gacccctagagataggaggaac

SEQ ID NO: 9456025 - DNA, 22 bp, Homo sapiens
gaccccaagggatgcgtgtgct

SEQ ID NO: 9456026 - DNA, 21 bp, Homo sapiens
gaccccagaccagcagacaca

SEQ ID NO: 9456027 - DNA, 22 bp, Homo sapiens
gaccccaaccctagagtctgac

SEQ ID NO: 9456028 - DNA, 22 bp, Homo sapiens
atgctttatgttctggcatttt

SEQ ID NO: 9456029 - DNA, 22 bp, Homo sapiens
atgctttatgttctggcatttt

SEQ ID NO: 9456030 - DNA, 22 bp, Homo sapiens
gactttctgagtcaaagaaagg

SEQ ID NO: 9456031 - DNA, 22 bp, Homo sapiens
gactttctgatgtaaacattta

SEQ ID NO: 9456032 - DNA, 22 bp, Homo sapiens
gactttctaatgctctgtagat

SEQ ID NO: 9456033 - DNA, 22 bp, Homo sapiens
gaccctggaactttcagcagag

SEQ ID NO: 9456034 - DNA, 22 bp, Homo sapiens
gaccctggaactttcagcagag

SEQ ID NO: 9456035 - DNA, 22 bp, Homo sapiens
gaccctgataggagtagaagaa

SEQ ID NO: 9456036 - DNA, 22 bp, Homo sapiens
gaccctgactctaatgcttggc

SEQ ID NO: 9456037 - DNA, 22 bp, Homo sapiens
gaccctgaggatgcaccagcag

SEQ ID NO: 9456038 - DNA, 22 bp, Homo sapiens
gaccctgaggatgcaccagcag

SEQ ID NO: 9456039 - DNA, 22 bp, Homo sapiens
gaccctctagatggaagcactg

SEQ ID NO: 9456040 - DNA, 22 bp, Homo sapiens
gaccctctagatggaagcactg

SEQ ID NO: 9456041 - DNA, 22 bp, Homo sapiens
gactttcttgcagaaatattcc

SEQ ID NO: 9456042 - DNA, 22 bp, Homo sapiens
gactttcttaggccccctaata

SEQ ID NO: 9456043 - DNA, 22 bp, Homo sapiens
gactttcttgtagtgtctgatg

SEQ ID NO: 9456044 - DNA, 21 bp, Homo sapiens
gactttcttaccagatttttg

SEQ ID NO: 9456045 - DNA, 22 bp, Homo sapiens
gactttgccacttgctccagct

SEQ ID NO: 9456046 - DNA, 19 bp, Homo sapiens
gactttggaaatgctgttt

SEQ ID NO: 9456047 - DNA, 22 bp, Homo sapiens
atgctttattggagacagtcat

SEQ ID NO: 9456048 - DNA, 22 bp, Homo sapiens
gactttggagcagaaagaaatt

SEQ ID NO: 9456049 - DNA, 17 bp, Homo sapiens
gactttggagtttcata

SEQ ID NO: 9456050 - DNA, 22 bp, Homo sapiens
atgcttttccaggagaaatata

SEQ ID NO: 9456051 - DNA, 22 bp, Homo sapiens
atgcttttccaggagaaatata

SEQ ID NO: 9456052 - DNA, 22 bp, Homo sapiens
atgcttttatgtcacatggtca

SEQ ID NO: 9456053 - DNA, 22 bp, Homo sapiens
atgcttttccaggagaaatata

SEQ ID NO: 9456054 - DNA, 22 bp, Homo sapiens
atgcttttccaggagaaatata

SEQ ID NO: 9456055 - DNA, 22 bp, Homo sapiens
atgcttttccaggagaaatata

SEQ ID NO: 9456056 - DNA, 22 bp, Homo sapiens
atgcttttatgtcacatggtca

SEQ ID NO: 9456057 - DNA, 22 bp, Homo sapiens
atgcttttaactcctttatccc

SEQ ID NO: 9456058 - DNA, 22 bp, Homo sapiens
atgctttctaggtgatctgagg

SEQ ID NO: 9456059 - DNA, 22 bp, Homo sapiens
atgctttattgttaggtcatgt

SEQ ID NO: 9456060 - DNA, 22 bp, Homo sapiens
atgctttattgttaggtcatgt

SEQ ID NO: 9456061 - DNA, 22 bp, Homo sapiens
atgctttgatttggtttctcta

SEQ ID NO: 9456062 - DNA, 22 bp, Homo sapiens
atgctttgatttggtttctcta

SEQ ID NO: 9456063 - DNA, 22 bp, Homo sapiens
atgctttggccaatgagaagtg

SEQ ID NO: 9456064 - DNA, 22 bp, Homo sapiens
atgctttggccaatgagaagtg

SEQ ID NO: 9456065 - DNA, 22 bp, Homo sapiens
atgctttgaagtttttcctcat

SEQ ID NO: 9456066 - DNA, 22 bp, Homo sapiens
gacagggcgagactcagtctca

SEQ ID NO: 9456067 - DNA, 22 bp, Homo sapiens
gacagggcgagactcagtctca

SEQ ID NO: 9456068 - DNA, 22 bp, Homo sapiens
gacagggcgagactcagtctca

SEQ ID NO: 9456069 - DNA, 22 bp, Homo sapiens
gacagggccgcagatggagact

SEQ ID NO: 9456070 - DNA, 22 bp, Homo sapiens
gacagggcatggtgcagagttc

SEQ ID NO: 9456071 - DNA, 22 bp, Homo sapiens
gacagggcaagactctgtctaa

SEQ ID NO: 9456072 - DNA, 22 bp, Homo sapiens
gacagggcatggtgcagagttc

SEQ ID NO: 9456073 - DNA, 22 bp, Homo sapiens
gacagggaggagcagagcttct

SEQ ID NO: 9456074 - DNA, 22 bp, Homo sapiens
gacagggaggagcagagcttct

SEQ ID NO: 9456075 - DNA, 22 bp, Homo sapiens
gacagggaggaaagagactgct

SEQ ID NO: 9456076 - DNA, 22 bp, Homo sapiens
gacagggaggaaagagactgct

SEQ ID NO: 9456077 - DNA, 22 bp, Homo sapiens
gacagggaggaaagagactgct

SEQ ID NO: 9456078 - DNA, 22 bp, Homo sapiens
gacagggaggaaagagactgct

SEQ ID NO: 9456079 - DNA, 23 bp, Homo sapiens
gacagggctgacttggcagctgc

SEQ ID NO: 9456080 - DNA, 23 bp, Homo sapiens
gacagggctgacttggcagctgc

SEQ ID NO: 9456081 - DNA, 23 bp, Homo sapiens
gacagggctgacttggcagctgc

SEQ ID NO: 9456082 - DNA, 22 bp, Homo sapiens
gacagtggttccaaggcagctt

SEQ ID NO: 9456083 - DNA, 22 bp, Homo sapiens
gacagtggttccaaggcagctt

SEQ ID NO: 9456084 - DNA, 22 bp, Homo sapiens
gacagtgtgaacatctaatagt

SEQ ID NO: 9456085 - DNA, 22 bp, Homo sapiens
gacagttacccccaaaagaatt

SEQ ID NO: 9456086 - DNA, 22 bp, Homo sapiens
gacagtttaagcacctaatatt

SEQ ID NO: 9456087 - DNA, 22 bp, Homo sapiens
gacagttaggacaactgacttc

SEQ ID NO: 9456088 - DNA, 22 bp, Homo sapiens
gacagttaggggctggatgcca

SEQ ID NO: 9456089 - DNA, 22 bp, Homo sapiens
gacagtttaagcacctaatatt

SEQ ID NO: 9456090 - DNA, 22 bp, Homo sapiens
gacagtttaggttcaaatctca

SEQ ID NO: 9456091 - DNA, 22 bp, Homo sapiens
gacagttttgctaaaaggttga

SEQ ID NO: 9456092 - DNA, 22 bp, Homo sapiens
atgcttgtactaaaaaaatatt

SEQ ID NO: 9456093 - DNA, 22 bp, Homo sapiens
atgcttaatacactgttaaagg

SEQ ID NO: 9456094 - DNA, 22 bp, Homo sapiens
gacataaaccttgagatattaa

SEQ ID NO: 9456095 - DNA, 22 bp, Homo sapiens
gacataaagttcttgcttgaat

SEQ ID NO: 9456096 - DNA, 22 bp, Homo sapiens
atgcttaagctcagttatatat

SEQ ID NO: 9456097 - DNA, 20 bp, Homo sapiens
atgcttaagtgttcattatt

SEQ ID NO: 9456098 - DNA, 20 bp, Homo sapiens
atgcttaagtgttcattatt

SEQ ID NO: 9456099 - DNA, 22 bp, Homo sapiens
atgcttaatacactgttaaagg

SEQ ID NO: 9456100 - DNA, 22 bp, Homo sapiens
gacataaaatggaattctgttg

SEQ ID NO: 9456101 - DNA, 22 bp, Homo sapiens
gacataaaatggaattctgttg

SEQ ID NO: 9456102 - DNA, 22 bp, Homo sapiens
gacagttttgctgaaattgagc

SEQ ID NO: 9456103 - DNA, 22 bp, Homo sapiens
gacataaaccttgagatattaa

SEQ ID NO: 9456104 - DNA, 22 bp, Homo sapiens
gacataaaattcaataatttgt

SEQ ID NO: 9456105 - DNA, 22 bp, Homo sapiens
atgctttatacaaaacacttaa

SEQ ID NO: 9456106 - DNA, 22 bp, Homo sapiens
atgctttatacaaaacacttaa

SEQ ID NO: 9456107 - DNA, 22 bp, Homo sapiens
atgctttatacaaaacacttaa

SEQ ID NO: 9456108 - DNA, 22 bp, Homo sapiens
atgctttatacaaaacacttaa

SEQ ID NO: 9456109 - DNA, 19 bp, Homo sapiens
atgctttatgttatttctt

SEQ ID NO: 9456110 - DNA, 19 bp, Homo sapiens
atgctttatgttatttctt

SEQ ID NO: 9456111 - DNA, 22 bp, Homo sapiens
atgctttagtgtcaagtttggg

SEQ ID NO: 9456112 - DNA, 22 bp, Homo sapiens
atgctttagttcaaaggactta

SEQ ID NO: 9456113 - DNA, 22 bp, Homo sapiens
atgctttagttcaaaggactta

SEQ ID NO: 9456114 - DNA, 22 bp, Homo sapiens
atgctttacgacaaaaaactca

SEQ ID NO: 9456115 - DNA, 22 bp, Homo sapiens
atgctttacgacaaaaaactca

SEQ ID NO: 9456116 - DNA, 22 bp, Homo sapiens
atgctttacgacaaaaaactca

SEQ ID NO: 9456117 - DNA, 22 bp, Homo sapiens
atgcttgtgtaagaagcctatg

SEQ ID NO: 9456118 - DNA, 22 bp, Homo sapiens
atgctttaaaacgtatgtgtaa

SEQ ID NO: 9456119 - DNA, 22 bp, Homo sapiens
atgctttaaaacgtatgtgtaa

SEQ ID NO: 9456120 - DNA, 22 bp, Homo sapiens
atgctttaaaacgtatgtgtaa

SEQ ID NO: 9456121 - DNA, 22 bp, Homo sapiens
atgctttaaactataaatccac

SEQ ID NO: 9456122 - DNA, 22 bp, Homo sapiens
atgctttaaactataaatccac

SEQ ID NO: 9456123 - DNA, 22 bp, Homo sapiens
atgctttaaactataaatccac

SEQ ID NO: 9456124 - DNA, 22 bp, Homo sapiens
atgctttacagttttccaaaca

SEQ ID NO: 9456125 - DNA, 22 bp, Homo sapiens
atgctttaaatgtcttttgctt

SEQ ID NO: 9456126 - DNA, 22 bp, Homo sapiens
atgctttacagttttccaaaca

SEQ ID NO: 9456127 - DNA, 22 bp, Homo sapiens
atgctttacagttttccaaaca

SEQ ID NO: 9456128 - DNA, 22 bp, Homo sapiens
atgaatccaaagtttactatta

SEQ ID NO: 9456129 - DNA, 22 bp, Homo sapiens
atgaatcaaagttcatttgatc

SEQ ID NO: 9456130 - DNA, 22 bp, Homo sapiens
atgaatcaagtgagaacagcat

SEQ ID NO: 9456131 - DNA, 22 bp, Homo sapiens
atgaatgaatgagagtaggtca

SEQ ID NO: 9456132 - DNA, 22 bp, Homo sapiens
atgaatgaaatacagagtactt

SEQ ID NO: 9456133 - DNA, 22 bp, Homo sapiens
atgaatcaaactgtacactgag

SEQ ID NO: 9456134 - DNA, 22 bp, Homo sapiens
atgaatattgaatgtcttatga

SEQ ID NO: 9456135 - DNA, 22 bp, Homo sapiens
atgaatcaaactgtacactgag

SEQ ID NO: 9456136 - DNA, 22 bp, Homo sapiens
atgaatcaaactgtacactgag

SEQ ID NO: 9456137 - DNA, 22 bp, Homo sapiens
atgaatcaaagttcatttgatc

SEQ ID NO: 9456138 - DNA, 22 bp, Homo sapiens
atgaataagtaaactcctttgg

SEQ ID NO: 9456139 - DNA, 22 bp, Homo sapiens
atgaatatgagactgagagcct

SEQ ID NO: 9456140 - DNA, 22 bp, Homo sapiens
atgaatatgtacacatctgtca

SEQ ID NO: 9456141 - DNA, 22 bp, Homo sapiens
atgaatatgagactgagagcct

SEQ ID NO: 9456142 - DNA, 22 bp, Homo sapiens
atgaatacaaaagagttgagga

SEQ ID NO: 9456143 - DNA, 22 bp, Homo sapiens
atgaagcagttaaggtgcatga

SEQ ID NO: 9456144 - DNA, 22 bp, Homo sapiens
atgaagcaggcacagcttcagg

SEQ ID NO: 9456145 - DNA, 22 bp, Homo sapiens
cttgaggttttgactcagcttt

SEQ ID NO: 9456146 - DNA, 22 bp, Homo sapiens
atgaataaaacattttaatcag

SEQ ID NO: 9456147 - DNA, 22 bp, Homo sapiens
atgaataaaacattttaatcag

SEQ ID NO: 9456148 - DNA, 22 bp, Homo sapiens
atgaagttctcaataatcatgt

SEQ ID NO: 9456149 - DNA, 22 bp, Homo sapiens
atgaataaaacattttaatcag

SEQ ID NO: 9456150 - DNA, 22 bp, Homo sapiens
atgaataaaacattttaatcag

SEQ ID NO: 9456151 - DNA, 22 bp, Homo sapiens
cttgagggactctatgacttag

SEQ ID NO: 9456152 - DNA, 22 bp, Homo sapiens
cttgagcacagcggcttcagga

SEQ ID NO: 9456153 - DNA, 22 bp, Homo sapiens
cttgagctaggaaggctgaggc

SEQ ID NO: 9456154 - DNA, 22 bp, Homo sapiens
cttgagcatcggatggaatttc

SEQ ID NO: 9456155 - DNA, 18 bp, Homo sapiens
cttgagctaagggacccc

SEQ ID NO: 9456156 - DNA, 22 bp, Homo sapiens
cttgagaatgtgagccacagat

SEQ ID NO: 9456157 - DNA, 22 bp, Homo sapiens
cttgagaatcttgatgtctacc

SEQ ID NO: 9456158 - DNA, 22 bp, Homo sapiens
cttgagaatcttctctgaagag

SEQ ID NO: 9456159 - DNA, 22 bp, Homo sapiens
cttgagaagagatttatatttg

SEQ ID NO: 9456160 - DNA, 22 bp, Homo sapiens
cttgagaacagggttaggtaac

SEQ ID NO: 9456161 - DNA, 22 bp, Homo sapiens
atcttcccaggctggggagagg

SEQ ID NO: 9456162 - DNA, 22 bp, Homo sapiens
atcttcccaggctggggagagg

SEQ ID NO: 9456163 - DNA, 22 bp, Homo sapiens
atcttcccaggctggggagagg

SEQ ID NO: 9456164 - DNA, 22 bp, Homo sapiens
atcttcccaggctggggagagg

SEQ ID NO: 9456165 - DNA, 22 bp, Homo sapiens
atcttcccaggctggggagagg

SEQ ID NO: 9456166 - DNA, 22 bp, Homo sapiens
cttgagaaaggaacaggaagct

SEQ ID NO: 9456167 - DNA, 22 bp, Homo sapiens
cttgagaacagggttaggtaac

SEQ ID NO: 9456168 - DNA, 22 bp, Homo sapiens
cttgagaaaggaacaggaagct

SEQ ID NO: 9456169 - DNA, 22 bp, Homo sapiens
atcttcaatatttttgtgtaga

SEQ ID NO: 9456170 - DNA, 22 bp, Homo sapiens
atcttcaattgaaaactagcct

SEQ ID NO: 9456171 - DNA, 22 bp, Homo sapiens
atcttcaattgaaaactagcct

SEQ ID NO: 9456172 - DNA, 22 bp, Homo sapiens
atcttcaagggaagaaagagta

SEQ ID NO: 9456173 - DNA, 22 bp, Homo sapiens
atcttcaagggaagaaagagta

SEQ ID NO: 9456174 - DNA, 22 bp, Homo sapiens
atcttcaaggaaaaaatacagt

SEQ ID NO: 9456175 - DNA, 22 bp, Homo sapiens
atcttcaaggaaaaaatacagt

SEQ ID NO: 9456176 - DNA, 22 bp, Homo sapiens
atcttcaagggaagaaagagta

SEQ ID NO: 9456177 - DNA, 22 bp, Homo sapiens
atcttcagcgaggtttcctttc

SEQ ID NO: 9456178 - DNA, 22 bp, Homo sapiens
atcttcagttttcagtgagcca

SEQ ID NO: 9456179 - DNA, 16 bp, Homo sapiens
atcttccaaagttatt

SEQ ID NO: 9456180 - DNA, 22 bp, Homo sapiens
atcttccaagctccctggtgta

SEQ ID NO: 9456181 - DNA, 22 bp, Homo sapiens
atcttccaggtgccgggggtca

SEQ ID NO: 9456182 - DNA, 22 bp, Homo sapiens
atcttcaacttgatcatttgaa

SEQ ID NO: 9456183 - DNA, 22 bp, Homo sapiens
atcttcaacttgatcatttgaa

SEQ ID NO: 9456184 - DNA, 22 bp, Homo sapiens
atcttcaaggaaaaaatacagt

SEQ ID NO: 9456185 - DNA, 22 bp, Homo sapiens
atcttcaaagcacatcgtttgt

SEQ ID NO: 9456186 - DNA, 19 bp, Homo sapiens
atcttcaaagccagcagca

SEQ ID NO: 9456187 - DNA, 19 bp, Homo sapiens
atcttcaaagccagcagca

SEQ ID NO: 9456188 - DNA, 22 bp, Homo sapiens
atcttcaaagcacatcgtttgt

SEQ ID NO: 9456189 - DNA, 22 bp, Homo sapiens
atcttcaacaacaaattgcctc

SEQ ID NO: 9456190 - DNA, 22 bp, Homo sapiens
atcttcaactcagagagtgctg

SEQ ID NO: 9456191 - DNA, 22 bp, Homo sapiens
atcttcaactcagagagtgctg

SEQ ID NO: 9456192 - DNA, 22 bp, Homo sapiens
atcttcaacaacaaattgcctc

SEQ ID NO: 9456193 - DNA, 22 bp, Homo sapiens
atcttcaaagggatgtccatgg

SEQ ID NO: 9456194 - DNA, 22 bp, Homo sapiens
atgaatgctgggacaaatatat

SEQ ID NO: 9456195 - DNA, 22 bp, Homo sapiens
atgaatgcatgcttattttgca

SEQ ID NO: 9456196 - DNA, 22 bp, Homo sapiens
atgaatgctatgctctaccagc

SEQ ID NO: 9456197 - DNA, 22 bp, Homo sapiens
atgaatgccacgatttcatcct

SEQ ID NO: 9456198 - DNA, 22 bp, Homo sapiens
atgaatgcagcactgtttttct

SEQ ID NO: 9456199 - DNA, 22 bp, Homo sapiens
atgaatgattttatgtaaatga

SEQ ID NO: 9456200 - DNA, 22 bp, Homo sapiens
atgaatgattttatgtaaatga

SEQ ID NO: 9456201 - DNA, 22 bp, Homo sapiens
atgaatgattttatgtaaatga

SEQ ID NO: 9456202 - DNA, 22 bp, Homo sapiens
atgaatgattaaagagtacagt

SEQ ID NO: 9456203 - DNA, 22 bp, Homo sapiens
atgaatgattaaagagtacagt

SEQ ID NO: 9456204 - DNA, 22 bp, Homo sapiens
atgaatgatgcaaaagacactg

SEQ ID NO: 9456205 - DNA, 22 bp, Homo sapiens
atgaatgagaaagctgaaatct

SEQ ID NO: 9456206 - DNA, 22 bp, Homo sapiens
atgaatgagaaagctgaaatct

SEQ ID NO: 9456207 - DNA, 22 bp, Homo sapiens
atgaattgaggaaaacagtcgt

SEQ ID NO: 9456208 - DNA, 22 bp, Homo sapiens
atgaattaaggataactggtct

SEQ ID NO: 9456209 - DNA, 22 bp, Homo sapiens
ctttttccagcttcagggtggg

SEQ ID NO: 9456210 - DNA, 22 bp, Homo sapiens
atgaattgaggaaaacagtcgt

SEQ ID NO: 9456211 - DNA, 19 bp, Homo sapiens
atgaatgtgttcttacctc

SEQ ID NO: 9456212 - DNA, 19 bp, Homo sapiens
gaaaacatgggtgagggtc

SEQ ID NO: 9456213 - DNA, 22 bp, Homo sapiens
ctttttccagcttcagggtggg

SEQ ID NO: 9456214 - DNA, 22 bp, Homo sapiens
ctttttccagcttcagggtggg

SEQ ID NO: 9456215 - DNA, 22 bp, Homo sapiens
gaaaactaacggaaaagttagg

SEQ ID NO: 9456216 - DNA, 21 bp, Homo sapiens
gaaaaccatttgcatcatgag

SEQ ID NO: 9456217 - DNA, 22 bp, Homo sapiens
gaaaaccacctcccatcaagca

SEQ ID NO: 9456218 - DNA, 22 bp, Homo sapiens
gaaaataggcagatgcattgta

SEQ ID NO: 9456219 - DNA, 22 bp, Homo sapiens
gaaaatagcagatagaccaatg

SEQ ID NO: 9456220 - DNA, 22 bp, Homo sapiens
gaaaatagcagatagaccaatg

SEQ ID NO: 9456221 - DNA, 22 bp, Homo sapiens
gaaaatagcagatagaccaatg

SEQ ID NO: 9456222 - DNA, 22 bp, Homo sapiens
gaaaataggcagatgcattgta

SEQ ID NO: 9456223 - DNA, 20 bp, Homo sapiens
gaaaataggccagccaggta

SEQ ID NO: 9456224 - DNA, 20 bp, Homo sapiens
gaaaataggccagccaggta

SEQ ID NO: 9456225 - DNA, 20 bp, Homo sapiens
gaaaataggccagccaggta

SEQ ID NO: 9456226 - DNA, 22 bp, Homo sapiens
gaaaatgagcctcagctacatt

SEQ ID NO: 9456227 - DNA, 22 bp, Homo sapiens
gaaaatagttcatcacaatgat

SEQ ID NO: 9456228 - DNA, 22 bp, Homo sapiens
gaaaataggctgcatctccttc

SEQ ID NO: 9456229 - DNA, 22 bp, Homo sapiens
gaaaataggctgcatctccttc

SEQ ID NO: 9456230 - DNA, 22 bp, Homo sapiens
gaaaatagttcatcacaatgat

SEQ ID NO: 9456231 - DNA, 22 bp, Homo sapiens
gaaaactattggcctagaacaa

SEQ ID NO: 9456232 - DNA, 22 bp, Homo sapiens
gaaaactattggcctagaacaa

SEQ ID NO: 9456233 - DNA, 22 bp, Homo sapiens
gaaaactattggcctagaacaa

SEQ ID NO: 9456234 - DNA, 22 bp, Homo sapiens
gaaaactaacggaaaagttagg

SEQ ID NO: 9456235 - DNA, 22 bp, Homo sapiens
gaaaactaacggaaaagttagg

SEQ ID NO: 9456236 - DNA, 22 bp, Homo sapiens
gaaaactaacggaaaagttagg

SEQ ID NO: 9456237 - DNA, 22 bp, Homo sapiens
gaaaactaacggaaaagttagg

SEQ ID NO: 9456238 - DNA, 22 bp, Homo sapiens
gaaaactattggcctagaacaa

SEQ ID NO: 9456239 - DNA, 22 bp, Homo sapiens
gaaaagaactgcatgggattaa

SEQ ID NO: 9456240 - DNA, 22 bp, Homo sapiens
gaaaagaactgcatgggattaa

SEQ ID NO: 9456241 - DNA, 22 bp, Homo sapiens
gaaaagagaacatctgaggatc

SEQ ID NO: 9456242 - DNA, 22 bp, Homo sapiens
gaaaagagaacatctgaggatc

SEQ ID NO: 9456243 - DNA, 22 bp, Homo sapiens
gaaaagaactgcatgggattaa

SEQ ID NO: 9456244 - DNA, 22 bp, Homo sapiens
gaacattcacagactcaccatt

SEQ ID NO: 9456245 - DNA, 23 bp, Homo sapiens
gaacattcattggttgctttaga

SEQ ID NO: 9456246 - DNA, 22 bp, Homo sapiens
gaacattattgtacaaatgtct

SEQ ID NO: 9456247 - DNA, 22 bp, Homo sapiens
gaacatcatgaagaaaacatat

SEQ ID NO: 9456248 - DNA, 22 bp, Homo sapiens
gaacatctgttaaataaaggta

SEQ ID NO: 9456249 - DNA, 22 bp, Homo sapiens
gaacatttccagaaaggaacta

SEQ ID NO: 9456250 - DNA, 22 bp, Homo sapiens
gaacatttccagaaaggaacta

SEQ ID NO: 9456251 - DNA, 22 bp, Homo sapiens
gaacatttatgatgcaatacct

SEQ ID NO: 9456252 - DNA, 22 bp, Homo sapiens
gaacattcttggaggaaataac

SEQ ID NO: 9456253 - DNA, 22 bp, Homo sapiens
gaacattcttggaggaaataac

SEQ ID NO: 9456254 - DNA, 22 bp, Homo sapiens
gaacatttatattagatagcta

SEQ ID NO: 9456255 - DNA, 22 bp, Homo sapiens
gaactttgtggggctgagagga

SEQ ID NO: 9456256 - DNA, 17 bp, Homo sapiens
gaacttttattaaattc

SEQ ID NO: 9456257 - DNA, 17 bp, Homo sapiens
gaacttttattaaattc

SEQ ID NO: 9456258 - DNA, 22 bp, Homo sapiens
gaagaaacaggggcttggggag

SEQ ID NO: 9456259 - DNA, 22 bp, Homo sapiens
gaacttttgggaagccgtgtga

SEQ ID NO: 9456260 - DNA, 18 bp, Homo sapiens
gaacttttggctttgtgt

SEQ ID NO: 9456261 - DNA, 22 bp, Homo sapiens
gaactttatcaaaagttgttta

SEQ ID NO: 9456262 - DNA, 22 bp, Homo sapiens
gaactttgcgcagttcccgggg

SEQ ID NO: 9456263 - DNA, 22 bp, Homo sapiens
gaactttcctagacctgagatg

SEQ ID NO: 9456264 - DNA, 22 bp, Homo sapiens
gaactttgcaaatgtcagaagc

SEQ ID NO: 9456265 - DNA, 22 bp, Homo sapiens
gaactttaaaacaaagtacagt

SEQ ID NO: 9456266 - DNA, 22 bp, Homo sapiens
gaactttaaaacaaagtacagt

SEQ ID NO: 9456267 - DNA, 22 bp, Homo sapiens
gaactttaatcccttgggctta

SEQ ID NO: 9456268 - DNA, 22 bp, Homo sapiens
gaacatttgatgatgacattgg

SEQ ID NO: 9456269 - DNA, 22 bp, Homo sapiens
gaactttaattagcttttgtct

SEQ ID NO: 9456270 - DNA, 22 bp, Homo sapiens
gaactttaccatttaggtaact

SEQ ID NO: 9456271 - DNA, 22 bp, Homo sapiens
gaactttaggattttcacaggt

SEQ ID NO: 9456272 - DNA, 22 bp, Homo sapiens
gaactttaggattttcacaggt

SEQ ID NO: 9456273 - DNA, 22 bp, Homo sapiens
atgcaagggttgcctttccagc

SEQ ID NO: 9456274 - DNA, 22 bp, Homo sapiens
atgcaagggtaaccccagacat

SEQ ID NO: 9456275 - DNA, 22 bp, Homo sapiens
atgcaagggtaaccccagacat

SEQ ID NO: 9456276 - DNA, 22 bp, Homo sapiens
atgcaataccttctgaaaataa

SEQ ID NO: 9456277 - DNA, 22 bp, Homo sapiens
atgcaagtcttaatagtttagg

SEQ ID NO: 9456278 - DNA, 22 bp, Homo sapiens
atgcaatatagggaagatagat

SEQ ID NO: 9456279 - DNA, 22 bp, Homo sapiens
atgcaatatagggaagatagat

SEQ ID NO: 9456280 - DNA, 22 bp, Homo sapiens
atgcaatatagggaagatagat

SEQ ID NO: 9456281 - DNA, 22 bp, Homo sapiens
atgcaatagtaattctagtctg

SEQ ID NO: 9456282 - DNA, 22 bp, Homo sapiens
atgcaataccttctgaaaataa

SEQ ID NO: 9456283 - DNA, 22 bp, Homo sapiens
atgcaataccttctgaaaataa

SEQ ID NO: 9456284 - DNA, 22 bp, Homo sapiens
atgcacaacagtggctgccttg

SEQ ID NO: 9456285 - DNA, 22 bp, Homo sapiens
atgcacaaacccacaattagtc

SEQ ID NO: 9456286 - DNA, 22 bp, Homo sapiens
atgcaatgttacagaatgtact

SEQ ID NO: 9456287 - DNA, 22 bp, Homo sapiens
atgcaatgttacagaatgtact

SEQ ID NO: 9456288 - DNA, 22 bp, Homo sapiens
atgcaatcatatggcatacagc

SEQ ID NO: 9456289 - DNA, 22 bp, Homo sapiens
gaagaaagatcaaatagtttcc

SEQ ID NO: 9456290 - DNA, 22 bp, Homo sapiens
gaagaaagattggcatgcttca

SEQ ID NO: 9456291 - DNA, 22 bp, Homo sapiens
gaagaaagattggcatgcttca

SEQ ID NO: 9456292 - DNA, 22 bp, Homo sapiens
atgcaaatgaacatgttgctag

SEQ ID NO: 9456293 - DNA, 22 bp, Homo sapiens
gaagaaagatcaaatagtttcc

SEQ ID NO: 9456294 - DNA, 22 bp, Homo sapiens
gaagaaagatcaaatagtttcc

SEQ ID NO: 9456295 - DNA, 22 bp, Homo sapiens
gaagaaacaggggcttggggag

SEQ ID NO: 9456296 - DNA, 22 bp, Homo sapiens
gaagaaacaggggcttggggag

SEQ ID NO: 9456297 - DNA, 22 bp, Homo sapiens
gaagaaactgaaaggggttggt

SEQ ID NO: 9456298 - DNA, 22 bp, Homo sapiens
gaagaaactgaaaggggttggt

SEQ ID NO: 9456299 - DNA, 22 bp, Homo sapiens
gaagaaagattggcatgcttca

SEQ ID NO: 9456300 - DNA, 22 bp, Homo sapiens
atgcaaatgcagccattgcaga

SEQ ID NO: 9456301 - DNA, 22 bp, Homo sapiens
atgcaaatgcagccattgcaga

SEQ ID NO: 9456302 - DNA, 23 bp, Homo sapiens
atgcaagagtttctcaaactgga

SEQ ID NO: 9456303 - DNA, 22 bp, Homo sapiens
atgcaagatcacaccaaacacg

SEQ ID NO: 9456304 - DNA, 22 bp, Homo sapiens
atgcaagatgtatagaagactt

SEQ ID NO: 9456305 - DNA, 22 bp, Homo sapiens
gaaatgatgtctgtgctgccac

SEQ ID NO: 9456306 - DNA, 22 bp, Homo sapiens
gaaatgacaaggacattcctgt

SEQ ID NO: 9456307 - DNA, 22 bp, Homo sapiens
atgaggcagtctggcctgaggg

SEQ ID NO: 9456308 - DNA, 22 bp, Homo sapiens
atgaggcatagcagggatcgga

SEQ ID NO: 9456309 - DNA, 22 bp, Homo sapiens
atgaggcatctgcagtcactag

SEQ ID NO: 9456310 - DNA, 22 bp, Homo sapiens
atgaggcatgtgaggagaaggg

SEQ ID NO: 9456311 - DNA, 22 bp, Homo sapiens
gaacataattaaatgtcctggg

SEQ ID NO: 9456312 - DNA, 22 bp, Homo sapiens
gaacatatgcatgtttgttttg

SEQ ID NO: 9456313 - DNA, 22 bp, Homo sapiens
gaacatcagtcataatttaacg

SEQ ID NO: 9456314 - DNA, 22 bp, Homo sapiens
gaacaatgagtcattcaggtga

SEQ ID NO: 9456315 - DNA, 22 bp, Homo sapiens
gaacataactattgtgaatagt

SEQ ID NO: 9456316 - DNA, 22 bp, Homo sapiens
gaacataactattgtgaatagt

SEQ ID NO: 9456317 - DNA, 22 bp, Homo sapiens
gaacataactattgtgaatagt

SEQ ID NO: 9456318 - DNA, 22 bp, Homo sapiens
atgaggcattcacagaaggcac

SEQ ID NO: 9456319 - DNA, 22 bp, Homo sapiens
gaacaatgaaagacataaactc

SEQ ID NO: 9456320 - DNA, 22 bp, Homo sapiens
gaaatcttttaaccattcattt

SEQ ID NO: 9456321 - DNA, 22 bp, Homo sapiens
gaaatcttttaaccattcattt

SEQ ID NO: 9456322 - DNA, 22 bp, Homo sapiens
gaaatcttttaaccattcattt

SEQ ID NO: 9456323 - DNA, 22 bp, Homo sapiens
gaaatcttttcatctcatttga

SEQ ID NO: 9456324 - DNA, 22 bp, Homo sapiens
gaaatctttatggaaataacaa

SEQ ID NO: 9456325 - DNA, 22 bp, Homo sapiens
gaaatctttgccttagctgtgt

SEQ ID NO: 9456326 - DNA, 22 bp, Homo sapiens
gaaatctttgccttagctgtgt

SEQ ID NO: 9456327 - DNA, 22 bp, Homo sapiens
gaaatctgtctttgtttgaata

SEQ ID NO: 9456328 - DNA, 22 bp, Homo sapiens
gaaatctgaatcttctgttggt

SEQ ID NO: 9456329 - DNA, 22 bp, Homo sapiens
gaaatcttgctcattgtgacaa

SEQ ID NO: 9456330 - DNA, 22 bp, Homo sapiens
gaaatcttgctcattgtgacaa

SEQ ID NO: 9456331 - DNA, 22 bp, Homo sapiens
gaaatcttgctcattgtgacaa

SEQ ID NO: 9456332 - DNA, 22 bp, Homo sapiens
gaaatgaaacaggcttttaagg

SEQ ID NO: 9456333 - DNA, 22 bp, Homo sapiens
gaaatcttttccaattgtttag

SEQ ID NO: 9456334 - DNA, 22 bp, Homo sapiens
gaaatgaactgattatcattgc

SEQ ID NO: 9456335 - DNA, 22 bp, Homo sapiens
gaaatgaactgattatcattgc

SEQ ID NO: 9456336 - DNA, 22 bp, Homo sapiens
gaaatgaactgattatcattgc

SEQ ID NO: 9456337 - DNA, 22 bp, Homo sapiens
gaaatgaaatagcaccaaggtt

SEQ ID NO: 9456338 - DNA, 22 bp, Homo sapiens
gaaatatacatgaagtcggctg

SEQ ID NO: 9456339 - DNA, 22 bp, Homo sapiens
gaaatatacatgaagtcggctg

SEQ ID NO: 9456340 - DNA, 22 bp, Homo sapiens
gaaatctacgattagtgaaaat

SEQ ID NO: 9456341 - DNA, 22 bp, Homo sapiens
gaaatctacttagtgtctggat

SEQ ID NO: 9456342 - DNA, 22 bp, Homo sapiens
gaaaatgagcctcagctacatt

SEQ ID NO: 9456343 - DNA, 22 bp, Homo sapiens
gaaaatgagcctcagctacatt

SEQ ID NO: 9456344 - DNA, 22 bp, Homo sapiens
gaaaatgcctctggcattaaac

SEQ ID NO: 9456345 - DNA, 18 bp, Homo sapiens
gtctcaggagtggcacgt

SEQ ID NO: 9456346 - DNA, 22 bp, Homo sapiens
gtctcagggactgcttctgggg

SEQ ID NO: 9456347 - DNA, 22 bp, Homo sapiens
gtctcagtccgtgctgttcagg

SEQ ID NO: 9456348 - DNA, 22 bp, Homo sapiens
gtctcagtgcccaatgccataa

SEQ ID NO: 9456349 - DNA, 22 bp, Homo sapiens
gtctcagtaagaaaggctcctg

SEQ ID NO: 9456350 - DNA, 22 bp, Homo sapiens
gtctcagttactctccctggta

SEQ ID NO: 9456351 - DNA, 20 bp, Homo sapiens
gtctccactgggggttaacc

SEQ ID NO: 9456352 - DNA, 20 bp, Homo sapiens
gtctccactgggggttaacc

SEQ ID NO: 9456353 - DNA, 20 bp, Homo sapiens
gtctccactgggggttaacc

SEQ ID NO: 9456354 - DNA, 22 bp, Homo sapiens
gtctctgtgcccccatttccgt

SEQ ID NO: 9456355 - DNA, 22 bp, Homo sapiens
gtctctgtgccttctccccacc

SEQ ID NO: 9456356 - DNA, 18 bp, Homo sapiens
gtctctgtgggaattggc

SEQ ID NO: 9456357 - DNA, 22 bp, Homo sapiens
gtctctgtggctggctccttcc

SEQ ID NO: 9456358 - DNA, 22 bp, Homo sapiens
gtctctgtgtctgagagagccc

SEQ ID NO: 9456359 - DNA, 22 bp, Homo sapiens
gtctctgttatttccagggtca

SEQ ID NO: 9456360 - DNA, 22 bp, Homo sapiens
gtctctgggttaagcagtgcat

SEQ ID NO: 9456361 - DNA, 22 bp, Homo sapiens
gtctctgggttaagcagtgcat

SEQ ID NO: 9456362 - DNA, 22 bp, Homo sapiens
gtctctggctttatgctggttt

SEQ ID NO: 9456363 - DNA, 19 bp, Homo sapiens
gtctctggatttcaggtcc

SEQ ID NO: 9456364 - DNA, 19 bp, Homo sapiens
gtctctggatttcaggtcc

SEQ ID NO: 9456365 - DNA, 22 bp, Homo sapiens
gtctctgggtgtgtgatgccaa

SEQ ID NO: 9456366 - DNA, 22 bp, Homo sapiens
gtctctgggttaagcagtgcat

SEQ ID NO: 9456367 - DNA, 22 bp, Homo sapiens
gtctctgggtgtgtgatgccaa

SEQ ID NO: 9456368 - DNA, 22 bp, Homo sapiens
gtctttgccacacttctgtaca

SEQ ID NO: 9456369 - DNA, 22 bp, Homo sapiens
gtctttggaaagacaaagttca

SEQ ID NO: 9456370 - DNA, 22 bp, Homo sapiens
gtctttggaggcactgttgagt

SEQ ID NO: 9456371 - DNA, 18 bp, Homo sapiens
gtctttggagtggaggta

SEQ ID NO: 9456372 - DNA, 22 bp, Homo sapiens
gtctttggagaggtgccatttc

SEQ ID NO: 9456373 - DNA, 19 bp, Homo sapiens
gtgaagtgccagaagtcag

SEQ ID NO: 9456374 - DNA, 22 bp, Homo sapiens
gtgaaggtgtgagccagctgca

SEQ ID NO: 9456375 - DNA, 22 bp, Homo sapiens
gtgaaggtggggagcctcagtt

SEQ ID NO: 9456376 - DNA, 22 bp, Homo sapiens
gtgaaggtgtgtccactgcggc

SEQ ID NO: 9456377 - DNA, 23 bp, Homo sapiens
gtgaaggtttctgcatttattgg

SEQ ID NO: 9456378 - DNA, 18 bp, Homo sapiens
gtctttggagtggaggta

SEQ ID NO: 9456379 - DNA, 20 bp, Homo sapiens
gtgaagggagtcaggtgtgc

SEQ ID NO: 9456380 - DNA, 20 bp, Homo sapiens
gtgaagggagtcaggtgtgc

SEQ ID NO: 9456381 - DNA, 22 bp, Homo sapiens
gtctttggatgtaagataaagt

SEQ ID NO: 9456382 - DNA, 22 bp, Homo sapiens
gtgaaggtgggagacaggtgag

SEQ ID NO: 9456383 - DNA, 22 bp, Homo sapiens
gtgaaggtagactgggcttcct

SEQ ID NO: 9456384 - DNA, 22 bp, Homo sapiens
gtgaaggtcagtggccctgggg

SEQ ID NO: 9456385 - DNA, 22 bp, Homo sapiens
gtctttctatgcatagagcaga

SEQ ID NO: 9456386 - DNA, 22 bp, Homo sapiens
gtctttctctggaacagtaaaa

SEQ ID NO: 9456387 - DNA, 22 bp, Homo sapiens
gtctttctgctgcacggactgc

SEQ ID NO: 9456388 - DNA, 22 bp, Homo sapiens
gtctttcttaaacaacagaaca

SEQ ID NO: 9456389 - DNA, 16 bp, Homo sapiens
gtctcttccctgctga

SEQ ID NO: 9456390 - DNA, 22 bp, Homo sapiens
gtctcttatgggcaggagcaca

SEQ ID NO: 9456391 - DNA, 22 bp, Homo sapiens
gtctctgttatttccagggtca

SEQ ID NO: 9456392 - DNA, 22 bp, Homo sapiens
gtcttaaaatcagaggatatag

SEQ ID NO: 9456393 - DNA, 22 bp, Homo sapiens
gtgcaaatgtaattgcagtttt

SEQ ID NO: 9456394 - DNA, 22 bp, Homo sapiens
gtgcagcagggggaagacagtg

SEQ ID NO: 9456395 - DNA, 23 bp, Homo sapiens
gtgcagcagtgtctgcagtcatg

SEQ ID NO: 9456396 - DNA, 22 bp, Homo sapiens
gtgcagcagggggaagacagtg

SEQ ID NO: 9456397 - DNA, 22 bp, Homo sapiens
gtgcaaatacatatgctgtgga

SEQ ID NO: 9456398 - DNA, 18 bp, Homo sapiens
gtgcaaatacttgctgac

SEQ ID NO: 9456399 - DNA, 22 bp, Homo sapiens
gtgcaaatgattctaatgggta

SEQ ID NO: 9456400 - DNA, 22 bp, Homo sapiens
gtgcaaatgagatggattcaag

SEQ ID NO: 9456401 - DNA, 22 bp, Homo sapiens
gtgcaaagtgcatggggaaggg

SEQ ID NO: 9456402 - DNA, 23 bp, Homo sapiens
gtgcaaagatataccacatggct

SEQ ID NO: 9456403 - DNA, 22 bp, Homo sapiens
gtgcaaaatgatatcctgaagc

SEQ ID NO: 9456404 - DNA, 16 bp, Homo sapiens
gtgcaaaagtgaggag

SEQ ID NO: 9456405 - DNA, 16 bp, Homo sapiens
gtgcaaaagtgaggag

SEQ ID NO: 9456406 - DNA, 22 bp, Homo sapiens
gtgcaaaatttggccaataaca

SEQ ID NO: 9456407 - DNA, 23 bp, Homo sapiens
gtgcaaagatataccacatggct

SEQ ID NO: 9456408 - DNA, 22 bp, Homo sapiens
gtgcaaacatcatagagtgtac

SEQ ID NO: 9456409 - DNA, 22 bp, Homo sapiens
gtgcagctgagggcctcttcta

SEQ ID NO: 9456410 - DNA, 22 bp, Homo sapiens
gtgcagctggtggagtctgggg

SEQ ID NO: 9456411 - DNA, 22 bp, Homo sapiens
gtgcagctgtggtggagccagg

SEQ ID NO: 9456412 - DNA, 22 bp, Homo sapiens
gtgcagcttcctggtctcagcc

SEQ ID NO: 9456413 - DNA, 22 bp, Homo sapiens
gtgcaggagcaggagccatgtc

SEQ ID NO: 9456414 - DNA, 22 bp, Homo sapiens
gtgcaggagcaggagccatgtc

SEQ ID NO: 9456415 - DNA, 22 bp, Homo sapiens
gtgcaggagccaggggtaggaa

SEQ ID NO: 9456416 - DNA, 22 bp, Homo sapiens
gtgcaggagccaggggtaggaa

SEQ ID NO: 9456417 - DNA, 22 bp, Homo sapiens
gtgcaggagccaggggtaggaa

SEQ ID NO: 9456418 - DNA, 22 bp, Homo sapiens
gtgcaaaagtaatggcagtttt

SEQ ID NO: 9456419 - DNA, 22 bp, Homo sapiens
gtgcaaaagtaattacagtttt

SEQ ID NO: 9456420 - DNA, 22 bp, Homo sapiens
gtgcaaaagtaattgaggtttt

SEQ ID NO: 9456421 - DNA, 22 bp, Homo sapiens
gtgcaaaagtaattacagtttt

SEQ ID NO: 9456422 - DNA, 22 bp, Homo sapiens
gtgcaaaagtaattgcagtact

SEQ ID NO: 9456423 - DNA, 22 bp, Homo sapiens
gtgcaaaagtaattgcagtact

SEQ ID NO: 9456424 - DNA, 22 bp, Homo sapiens
gtgcaaaagtaattgaggtttt

SEQ ID NO: 9456425 - DNA, 22 bp, Homo sapiens
gtgcaaaagtaattgcagtact

SEQ ID NO: 9456426 - DNA, 22 bp, Homo sapiens
gtgcaaaagtaattgcagtttt

SEQ ID NO: 9456427 - DNA, 22 bp, Homo sapiens
gtgcaaaagtaattgcagtttt

SEQ ID NO: 9456428 - DNA, 22 bp, Homo sapiens
gtgcaaaagtaattgcggtttt

SEQ ID NO: 9456429 - DNA, 22 bp, Homo sapiens
gtgcaaaagtaattgcggtttt

SEQ ID NO: 9456430 - DNA, 22 bp, Homo sapiens
gtgcaaaagtaattgctgtttt

SEQ ID NO: 9456431 - DNA, 22 bp, Homo sapiens
gtgcaaaagtaattgctgtttt

SEQ ID NO: 9456432 - DNA, 22 bp, Homo sapiens
gtgcaaaagtacttgcggattt

SEQ ID NO: 9456433 - DNA, 22 bp, Homo sapiens
gtgcaaaagtcattgtggtttt

SEQ ID NO: 9456434 - DNA, 22 bp, Homo sapiens
gtgcaaaagtcattgtggtttt

SEQ ID NO: 9456435 - DNA, 22 bp, Homo sapiens
gtgcaaaagtacttgcggattt

SEQ ID NO: 9456436 - DNA, 22 bp, Homo sapiens
gtgcaaaagtaattgtggtttt

SEQ ID NO: 9456437 - DNA, 22 bp, Homo sapiens
gtgcaaaagtaattgtggtttt

SEQ ID NO: 9456438 - DNA, 22 bp, Homo sapiens
gtgaataatattgtttataaaa

SEQ ID NO: 9456439 - DNA, 22 bp, Homo sapiens
gtgaataactttctatgttaat

SEQ ID NO: 9456440 - DNA, 22 bp, Homo sapiens
gtgaataatcacccttctggat

SEQ ID NO: 9456441 - DNA, 22 bp, Homo sapiens
gtgaataactttctatgttaat

SEQ ID NO: 9456442 - DNA, 22 bp, Homo sapiens
gtgaagttttagtatatgtaga

SEQ ID NO: 9456443 - DNA, 22 bp, Homo sapiens
gtgaagttgattgttatcgtca

SEQ ID NO: 9456444 - DNA, 22 bp, Homo sapiens
gtgaagttgattgttatcgtca

SEQ ID NO: 9456445 - DNA, 22 bp, Homo sapiens
gtgaatggggcaggaaggatgg

SEQ ID NO: 9456446 - DNA, 22 bp, Homo sapiens
gtgaatggggcaggaaggatgg

SEQ ID NO: 9456447 - DNA, 22 bp, Homo sapiens
gtgaattaaatatagccaggtc

SEQ ID NO: 9456448 - DNA, 21 bp, Homo sapiens
gtgaattaattatatgcctta

SEQ ID NO: 9456449 - DNA, 22 bp, Homo sapiens
gtgaatgacatattttgtactg

SEQ ID NO: 9456450 - DNA, 22 bp, Homo sapiens
gtgaatgactgttttcagcatt

SEQ ID NO: 9456451 - DNA, 22 bp, Homo sapiens
gtcctgagggcccaggcattct

SEQ ID NO: 9456452 - DNA, 22 bp, Homo sapiens
gtcctgagtcaagtgtgggcag

SEQ ID NO: 9456453 - DNA, 22 bp, Homo sapiens
gtcctgaggcaggatgggtttc

SEQ ID NO: 9456454 - DNA, 18 bp, Homo sapiens
gtcctgagctctgctgta

SEQ ID NO: 9456455 - DNA, 22 bp, Homo sapiens
gtcctgagccctcagcacagca

SEQ ID NO: 9456456 - DNA, 22 bp, Homo sapiens
gtcctgagccctcagcacagca

SEQ ID NO: 9456457 - DNA, 22 bp, Homo sapiens
gtcctgaatgcctttaggcaga

SEQ ID NO: 9456458 - DNA, 22 bp, Homo sapiens
gtcctgacggctgattggcctg

SEQ ID NO: 9456459 - DNA, 22 bp, Homo sapiens
gtcctgacggctgattggcctg

SEQ ID NO: 9456460 - DNA, 22 bp, Homo sapiens
gtcctgacggctgattggcctg

SEQ ID NO: 9456461 - DNA, 22 bp, Homo sapiens
gtcctgagccacatactatcca

SEQ ID NO: 9456462 - DNA, 22 bp, Homo sapiens
gtcctgagcattaagcaattgt

SEQ ID NO: 9456463 - DNA, 22 bp, Homo sapiens
gtcctgagaatactaggcacaa

SEQ ID NO: 9456464 - DNA, 22 bp, Homo sapiens
gtcctgagatgtcacaaggttt

SEQ ID NO: 9456465 - DNA, 22 bp, Homo sapiens
gtcctctgtgtaggctgcagac

SEQ ID NO: 9456466 - DNA, 22 bp, Homo sapiens
gtcctctgtgtaggctgcagac

SEQ ID NO: 9456467 - DNA, 22 bp, Homo sapiens
gtcctctgtgtaggctgcagac

SEQ ID NO: 9456468 - DNA, 22 bp, Homo sapiens
gtcctctgtttccatctgactt

SEQ ID NO: 9456469 - DNA, 22 bp, Homo sapiens
gtcctctgtttccatctgactt

SEQ ID NO: 9456470 - DNA, 22 bp, Homo sapiens
cagcagtgtacaaggtgtcaga

SEQ ID NO: 9456471 - DNA, 22 bp, Homo sapiens
cagcagtggctgcaggcagctg

SEQ ID NO: 9456472 - DNA, 22 bp, Homo sapiens
cagcagtggtgtatttgaggct

SEQ ID NO: 9456473 - DNA, 22 bp, Homo sapiens
cagcagtggctgcaggcagctg

SEQ ID NO: 9456474 - DNA, 22 bp, Homo sapiens
cagcagtggctgcaggcagctg

SEQ ID NO: 9456475 - DNA, 22 bp, Homo sapiens
cagcagtggctgcaggcagctg

SEQ ID NO: 9456476 - DNA, 22 bp, Homo sapiens
cagcatgcagcccctggcagct

SEQ ID NO: 9456477 - DNA, 22 bp, Homo sapiens
cagcatgcaggggcctgagcac

SEQ ID NO: 9456478 - DNA, 22 bp, Homo sapiens
cagcatgcaggggcctgagcac

SEQ ID NO: 9456479 - DNA, 22 bp, Homo sapiens
gtcctgtggaaagctagccgct

SEQ ID NO: 9456480 - DNA, 22 bp, Homo sapiens
gtcctgtgctcagacatggggg

SEQ ID NO: 9456481 - DNA, 22 bp, Homo sapiens
cagcatgcccagactgagctaa

SEQ ID NO: 9456482 - DNA, 22 bp, Homo sapiens
gtctcagagtcctacttattcc

SEQ ID NO: 9456483 - DNA, 22 bp, Homo sapiens
cagcatgagaaaatgaatcaga

SEQ ID NO: 9456484 - DNA, 22 bp, Homo sapiens
cagcatgagaaaatgaatcaga

SEQ ID NO: 9456485 - DNA, 22 bp, Homo sapiens
cagcatctttctcttctggagt

SEQ ID NO: 9456486 - DNA, 22 bp, Homo sapiens
cagcatgaccctggagcctgca

SEQ ID NO: 9456487 - DNA, 22 bp, Homo sapiens
cagcatgacagtctgcagcaga

SEQ ID NO: 9456488 - DNA, 22 bp, Homo sapiens
cagcatcttattttctatggaa

SEQ ID NO: 9456489 - DNA, 22 bp, Homo sapiens
cagcatcttcatgtgcatctcc

SEQ ID NO: 9456490 - DNA, 22 bp, Homo sapiens
cagcagtgcttcagtgtgagat

SEQ ID NO: 9456491 - DNA, 22 bp, Homo sapiens
cagcagtgcttcagtgtgagat

SEQ ID NO: 9456492 - DNA, 22 bp, Homo sapiens
cagcagtgcttcagtgtgagat

SEQ ID NO: 9456493 - DNA, 22 bp, Homo sapiens
cagcagtggaactacccaggga

SEQ ID NO: 9456494 - DNA, 22 bp, Homo sapiens
cagcagtggaactacccaggga

SEQ ID NO: 9456495 - DNA, 22 bp, Homo sapiens
cagcagtggctgcaggcagctg

SEQ ID NO: 9456496 - DNA, 22 bp, Homo sapiens
cagcagtggccatctgtgtggt

SEQ ID NO: 9456497 - DNA, 22 bp, Homo sapiens
cagcagtggccatctgtgtggt

SEQ ID NO: 9456498 - DNA, 22 bp, Homo sapiens
cagcagtggccatctgtgtggt

SEQ ID NO: 9456499 - DNA, 22 bp, Homo sapiens
cagcagtgcttcagtgtgagat

SEQ ID NO: 9456500 - DNA, 22 bp, Homo sapiens
cagcagtgatgtgtgagggttc

SEQ ID NO: 9456501 - DNA, 22 bp, Homo sapiens
cagcagtgatgtgtgagggttc

SEQ ID NO: 9456502 - DNA, 22 bp, Homo sapiens
cagcagtgacaagactaagaag

SEQ ID NO: 9456503 - DNA, 22 bp, Homo sapiens
cagcagtcaggcctgtgggaga

SEQ ID NO: 9456504 - DNA, 22 bp, Homo sapiens
cagcagtccctgcagtggggaa

SEQ ID NO: 9456505 - DNA, 22 bp, Homo sapiens
cagcagtctgtttcaacaggtc

SEQ ID NO: 9456506 - DNA, 22 bp, Homo sapiens
cagcagtctgtttcaacaggtc

SEQ ID NO: 9456507 - DNA, 22 bp, Homo sapiens
cagcagtctgtttcaacaggtc

SEQ ID NO: 9456508 - DNA, 22 bp, Homo sapiens
cagcaggtgcaggtgcggccgc

SEQ ID NO: 9456509 - DNA, 22 bp, Homo sapiens
cagcaggtcttgttgctgctga

SEQ ID NO: 9456510 - DNA, 22 bp, Homo sapiens
cagcaggtgctgcctgtcaccc

SEQ ID NO: 9456511 - DNA, 22 bp, Homo sapiens
cagcaggtggacacactcacct

SEQ ID NO: 9456512 - DNA, 22 bp, Homo sapiens
cagcaggtgtctagcaagggtc

SEQ ID NO: 9456513 - DNA, 22 bp, Homo sapiens
cagcaggtgggctttgcggatg

SEQ ID NO: 9456514 - DNA, 22 bp, Homo sapiens
cagcaggtgtccttttggtgga

SEQ ID NO: 9456515 - DNA, 22 bp, Homo sapiens
cagcaggttaacagaggctggt

SEQ ID NO: 9456516 - DNA, 22 bp, Homo sapiens
cagcaggttaacagaggctggt

SEQ ID NO: 9456517 - DNA, 22 bp, Homo sapiens
cagcagtaactcccgtgcagca

SEQ ID NO: 9456518 - DNA, 22 bp, Homo sapiens
cagcagtaattagtgctgcatg

SEQ ID NO: 9456519 - DNA, 22 bp, Homo sapiens
cagcagtagtctctgtggcttt

SEQ ID NO: 9456520 - DNA, 22 bp, Homo sapiens
cagcagagctgggctttgaatt

SEQ ID NO: 9456521 - DNA, 22 bp, Homo sapiens
cagcagagctgggaataaaatt

SEQ ID NO: 9456522 - DNA, 22 bp, Homo sapiens
cagcagagctgggctttgaatt

SEQ ID NO: 9456523 - DNA, 22 bp, Homo sapiens
cagcagagcatttggtaggagg

SEQ ID NO: 9456524 - DNA, 22 bp, Homo sapiens
cagcagagcatttggtaggagg

SEQ ID NO: 9456525 - DNA, 22 bp, Homo sapiens
cagcagagctgggaataaaatt

SEQ ID NO: 9456526 - DNA, 22 bp, Homo sapiens
cagcagagcatttggtaggagg

SEQ ID NO: 9456527 - DNA, 22 bp, Homo sapiens
cagcagagacggtaagcagaac

SEQ ID NO: 9456528 - DNA, 22 bp, Homo sapiens
cagcagagacggtaagcagaac

SEQ ID NO: 9456529 - DNA, 22 bp, Homo sapiens
cagcagagatgagattcctata

SEQ ID NO: 9456530 - DNA, 22 bp, Homo sapiens
cagcagagatgagattcctata

SEQ ID NO: 9456531 - DNA, 22 bp, Homo sapiens
cagcagagcatttggtaggagg

SEQ ID NO: 9456532 - DNA, 22 bp, Homo sapiens
cagcagagatgagattcctata

SEQ ID NO: 9456533 - DNA, 22 bp, Homo sapiens
cagcagagatgagattcctata

SEQ ID NO: 9456534 - DNA, 22 bp, Homo sapiens
cagcagagacggtaagcagaac

SEQ ID NO: 9456535 - DNA, 23 bp, Homo sapiens
cagcagagagcagacctttgtgt

SEQ ID NO: 9456536 - DNA, 22 bp, Homo sapiens
cagcaggtcctgggcgtggcct

SEQ ID NO: 9456537 - DNA, 22 bp, Homo sapiens
cagcaggtcctgggcgtggcct

SEQ ID NO: 9456538 - DNA, 22 bp, Homo sapiens
cagcaggtcccactgagggccc

SEQ ID NO: 9456539 - DNA, 22 bp, Homo sapiens
cagcaggtctcagcagctcctt

SEQ ID NO: 9456540 - DNA, 22 bp, Homo sapiens
cagcaggtctcagcagctcctt

SEQ ID NO: 9456541 - DNA, 22 bp, Homo sapiens
cagcaggtctgcatttgaggtc

SEQ ID NO: 9456542 - DNA, 22 bp, Homo sapiens
cagcaggtatgtttgttcagca

SEQ ID NO: 9456543 - DNA, 22 bp, Homo sapiens
cagcaggtatgtttgttcagca

SEQ ID NO: 9456544 - DNA, 22 bp, Homo sapiens
cagcaggtcccactgagggccc

SEQ ID NO: 9456545 - DNA, 22 bp, Homo sapiens
cagcagagctgtgtgggaaggg

SEQ ID NO: 9456546 - DNA, 22 bp, Homo sapiens
cagcagggttaagtgactcacc

SEQ ID NO: 9456547 - DNA, 22 bp, Homo sapiens
cagcagggttaagtgactcacc

SEQ ID NO: 9456548 - DNA, 22 bp, Homo sapiens
gtgctgaggtacacaaattcta

SEQ ID NO: 9456549 - DNA, 22 bp, Homo sapiens
cagctccacttgagtggggcct

SEQ ID NO: 9456550 - DNA, 22 bp, Homo sapiens
cagctccagccaccggggggtg

SEQ ID NO: 9456551 - DNA, 22 bp, Homo sapiens
cagctccagccaccggggggtg

SEQ ID NO: 9456552 - DNA, 22 bp, Homo sapiens
cagctccagcccaggcagctcc

SEQ ID NO: 9456553 - DNA, 22 bp, Homo sapiens
cagctccagcctgacaccaaga

SEQ ID NO: 9456554 - DNA, 22 bp, Homo sapiens
cagctccagcctgacaccaaga

SEQ ID NO: 9456555 - DNA, 22 bp, Homo sapiens
cagctcccagaactgaccatgt

SEQ ID NO: 9456556 - DNA, 22 bp, Homo sapiens
cagctcccagtggcagctcctt

SEQ ID NO: 9456557 - DNA, 22 bp, Homo sapiens
cagctcccagagtgaccagcag

SEQ ID NO: 9456558 - DNA, 22 bp, Homo sapiens
cagctcccagtggcagctcctt

SEQ ID NO: 9456559 - DNA, 22 bp, Homo sapiens
cagctcccagtggcagctcctt

SEQ ID NO: 9456560 - DNA, 22 bp, Homo sapiens
cagctccccatggttcctgaag

SEQ ID NO: 9456561 - DNA, 17 bp, Homo sapiens
gtgcctgttgtcctgga

SEQ ID NO: 9456562 - DNA, 22 bp, Homo sapiens
gtgcctgtccattcccaggctc

SEQ ID NO: 9456563 - DNA, 22 bp, Homo sapiens
gtgcctgtgcggactcagggaa

SEQ ID NO: 9456564 - DNA, 22 bp, Homo sapiens
gtgctgagagtttattatgata

SEQ ID NO: 9456565 - DNA, 22 bp, Homo sapiens
gtgcctgtaagttgtatgggct

SEQ ID NO: 9456566 - DNA, 22 bp, Homo sapiens
gtgcctgtaagttgtatgggct

SEQ ID NO: 9456567 - DNA, 22 bp, Homo sapiens
gtgcctgtccattcccaggctc

SEQ ID NO: 9456568 - DNA, 22 bp, Homo sapiens
gtgcctgtgccaggggtgtgct

SEQ ID NO: 9456569 - DNA, 22 bp, Homo sapiens
gtgcctggtttggggaatgttc

SEQ ID NO: 9456570 - DNA, 22 bp, Homo sapiens
gtgcctggtttggggagtgttc

SEQ ID NO: 9456571 - DNA, 22 bp, Homo sapiens
gtgcctggtttggggagtgttc

SEQ ID NO: 9456572 - DNA, 22 bp, Homo sapiens
gtgcctggggttgagctatgaa

SEQ ID NO: 9456573 - DNA, 22 bp, Homo sapiens
gtgctgagcatcatgaggcact

SEQ ID NO: 9456574 - DNA, 22 bp, Homo sapiens
gtgctgagctgcagatgcgctc

SEQ ID NO: 9456575 - DNA, 22 bp, Homo sapiens
gtgctgaggagagggggtggtc

SEQ ID NO: 9456576 - DNA, 22 bp, Homo sapiens
gtgctgaggatacagctgtgaa

SEQ ID NO: 9456577 - DNA, 22 bp, Homo sapiens
gtgctgaggatataaaactcag

SEQ ID NO: 9456578 - DNA, 22 bp, Homo sapiens
gtgctgagattacaggtgtgag

SEQ ID NO: 9456579 - DNA, 22 bp, Homo sapiens
gtgctgagatcttccctcactg

SEQ ID NO: 9456580 - DNA, 19 bp, Homo sapiens
cagcctcaatccctcgggc

SEQ ID NO: 9456581 - DNA, 22 bp, Homo sapiens
gtgccctgacacacctggtgtg

SEQ ID NO: 9456582 - DNA, 22 bp, Homo sapiens
gtgccctgacacacctggtgtg

SEQ ID NO: 9456583 - DNA, 22 bp, Homo sapiens
gtgcctgggacacgagattttc

SEQ ID NO: 9456584 - DNA, 22 bp, Homo sapiens
gtgcctgggacacagcagatac

SEQ ID NO: 9456585 - DNA, 22 bp, Homo sapiens
gtgcctgggacttgctccggat

SEQ ID NO: 9456586 - DNA, 22 bp, Homo sapiens
gtgcctgggacttgctccggat

SEQ ID NO: 9456587 - DNA, 22 bp, Homo sapiens
gtgcctgggacttgctccggat

SEQ ID NO: 9456588 - DNA, 22 bp, Homo sapiens
gtgcctgggacttgctccggat

SEQ ID NO: 9456589 - DNA, 22 bp, Homo sapiens
gtgcctgggggtaatgtaggat

SEQ ID NO: 9456590 - DNA, 22 bp, Homo sapiens
gtgcctgggggtaatgtaggat

SEQ ID NO: 9456591 - DNA, 22 bp, Homo sapiens
gtgcctgggggtaatgtaggat

SEQ ID NO: 9456592 - DNA, 22 bp, Homo sapiens
cagccctgttgcgcttccggcg

SEQ ID NO: 9456593 - DNA, 22 bp, Homo sapiens
cagccctttccttctcagcttt

SEQ ID NO: 9456594 - DNA, 22 bp, Homo sapiens
cagccctgtgcggagggccctg

SEQ ID NO: 9456595 - DNA, 22 bp, Homo sapiens
cagccctgtgcggagggccctg

SEQ ID NO: 9456596 - DNA, 22 bp, Homo sapiens
cagccctgtgctaagcaccctc

SEQ ID NO: 9456597 - DNA, 22 bp, Homo sapiens
cagccctgtgctaagcaccctc

SEQ ID NO: 9456598 - DNA, 22 bp, Homo sapiens
cagccctgtgctaagcaccctc

SEQ ID NO: 9456599 - DNA, 22 bp, Homo sapiens
cagccctgtgcggagggccctg

SEQ ID NO: 9456600 - DNA, 22 bp, Homo sapiens
cagccctgtgcggagggccctg

SEQ ID NO: 9456601 - DNA, 22 bp, Homo sapiens
gtgcatgtcggggtgcatgtca

SEQ ID NO: 9456602 - DNA, 22 bp, Homo sapiens
gtgcatgtgcatccatgtgtac

SEQ ID NO: 9456603 - DNA, 22 bp, Homo sapiens
gtgcatgtgcgttgactgtcca

SEQ ID NO: 9456604 - DNA, 22 bp, Homo sapiens
gtgcatgttaatggtgtacaaa

SEQ ID NO: 9456605 - DNA, 22 bp, Homo sapiens
gtgcatgaagactcagaaagtc

SEQ ID NO: 9456606 - DNA, 18 bp, Homo sapiens
gtgcatgcatgctctgcc

SEQ ID NO: 9456607 - DNA, 22 bp, Homo sapiens
gtgcatgcacacatgtgtgagg

SEQ ID NO: 9456608 - DNA, 22 bp, Homo sapiens
gtgcatgcacacatgtgtgagg

SEQ ID NO: 9456609 - DNA, 22 bp, Homo sapiens
gtgcatgcaaattactgtaaag

SEQ ID NO: 9456610 - DNA, 21 bp, Homo sapiens
gtgcatgcgccgctgagatgc

SEQ ID NO: 9456611 - DNA, 22 bp, Homo sapiens
gtgcatggggagggaagcgctc

SEQ ID NO: 9456612 - DNA, 22 bp, Homo sapiens
gtgcatattttgcacacagatg

SEQ ID NO: 9456613 - DNA, 22 bp, Homo sapiens
gtgcatatgtgtgtatacaaac

SEQ ID NO: 9456614 - DNA, 22 bp, Homo sapiens
gtgcatctgaatttgaaaatct

SEQ ID NO: 9456615 - DNA, 22 bp, Homo sapiens
gtgcaggagcttctggcctgac

SEQ ID NO: 9456616 - DNA, 22 bp, Homo sapiens
gtgcaggaggatgacaactgca

SEQ ID NO: 9456617 - DNA, 22 bp, Homo sapiens
gtgcaggagcttctggcctgac

SEQ ID NO: 9456618 - DNA, 21 bp, Homo sapiens
cagctctgagatttctactag

SEQ ID NO: 9456619 - DNA, 22 bp, Homo sapiens
cagctctgaggaacactccttt

SEQ ID NO: 9456620 - DNA, 22 bp, Homo sapiens
cagctctgaggaacactccttt

SEQ ID NO: 9456621 - DNA, 22 bp, Homo sapiens
cagctctgatgaaatgtaccag

SEQ ID NO: 9456622 - DNA, 22 bp, Homo sapiens
cagctcctctgttagccctggg

SEQ ID NO: 9456623 - DNA, 22 bp, Homo sapiens
cagctcctgaggactgctggga

SEQ ID NO: 9456624 - DNA, 22 bp, Homo sapiens
cagctcctgaggactgctggga

SEQ ID NO: 9456625 - DNA, 22 bp, Homo sapiens
cagctcctgcagctgctgccgt

SEQ ID NO: 9456626 - DNA, 22 bp, Homo sapiens
cagctcctcacgagtcttgaaa

SEQ ID NO: 9456627 - DNA, 22 bp, Homo sapiens
cagctcctcagccctgccttgg

SEQ ID NO: 9456628 - DNA, 22 bp, Homo sapiens
cagctcctctgttagccctggg

SEQ ID NO: 9456629 - DNA, 22 bp, Homo sapiens
cagctcctctgttagccctggg

SEQ ID NO: 9456630 - DNA, 22 bp, Homo sapiens
cagctcctctgttagccctggg

SEQ ID NO: 9456631 - DNA, 22 bp, Homo sapiens
cagctcctagatcggcgaagtg

SEQ ID NO: 9456632 - DNA, 22 bp, Homo sapiens
cagctcctatgagtatgattcc

SEQ ID NO: 9456633 - DNA, 22 bp, Homo sapiens
cagctcccctctgtggggcagt

SEQ ID NO: 9456634 - DNA, 22 bp, Homo sapiens
cagataatccaagtagttttca

SEQ ID NO: 9456635 - DNA, 22 bp, Homo sapiens
cagataactgaaatatcatacc

SEQ ID NO: 9456636 - DNA, 22 bp, Homo sapiens
cagataacacaaagaaatgggc

SEQ ID NO: 9456637 - DNA, 22 bp, Homo sapiens
cagataatccaagtagttttca

SEQ ID NO: 9456638 - DNA, 22 bp, Homo sapiens
cagataaatagatagataaact

SEQ ID NO: 9456639 - DNA, 22 bp, Homo sapiens
cagataaatagacttggtcaga

SEQ ID NO: 9456640 - DNA, 22 bp, Homo sapiens
cagataaaggcttactagtagt

SEQ ID NO: 9456641 - DNA, 22 bp, Homo sapiens
cagataaaggcttactagtagt

SEQ ID NO: 9456642 - DNA, 22 bp, Homo sapiens
cagataaaggcttactagtagt

SEQ ID NO: 9456643 - DNA, 22 bp, Homo sapiens
cagataaaggcttactagtagt

SEQ ID NO: 9456644 - DNA, 20 bp, Homo sapiens
cagataaacgggaaagaagc

SEQ ID NO: 9456645 - DNA, 22 bp, Homo sapiens
cagataaaattaatattaccaa

SEQ ID NO: 9456646 - DNA, 22 bp, Homo sapiens
cagataaaattaatattaccaa

SEQ ID NO: 9456647 - DNA, 22 bp, Homo sapiens
cagataaaattaatattaccaa

SEQ ID NO: 9456648 - DNA, 22 bp, Homo sapiens
ggtgagaggcagaggacagctt

SEQ ID NO: 9456649 - DNA, 22 bp, Homo sapiens
cagatatattttatttggtcaa

SEQ ID NO: 9456650 - DNA, 22 bp, Homo sapiens
cagatatattttccttattagg

SEQ ID NO: 9456651 - DNA, 22 bp, Homo sapiens
cagatagtaacctttctagagc

SEQ ID NO: 9456652 - DNA, 22 bp, Homo sapiens
cagatatagtggcttgcctggg

SEQ ID NO: 9456653 - DNA, 22 bp, Homo sapiens
cagatagaatgcaagacctctc

SEQ ID NO: 9456654 - DNA, 22 bp, Homo sapiens
cagatacattaaaatgatgatt

SEQ ID NO: 9456655 - DNA, 22 bp, Homo sapiens
cagatagaatgcaagacctctc

SEQ ID NO: 9456656 - DNA, 22 bp, Homo sapiens
ggtgcaagagctccaggccctg

SEQ ID NO: 9456657 - DNA, 22 bp, Homo sapiens
ggtgagaggcagaggacagctt

SEQ ID NO: 9456658 - DNA, 22 bp, Homo sapiens
ggtgcaagggttgagttgagtg

SEQ ID NO: 9456659 - DNA, 22 bp, Homo sapiens
ggtgcagaagaaagcagtcatt

SEQ ID NO: 9456660 - DNA, 22 bp, Homo sapiens
ggtgcaatggtgagggcagcca

SEQ ID NO: 9456661 - DNA, 22 bp, Homo sapiens
ggtgcagaggagccagctgggg

SEQ ID NO: 9456662 - DNA, 22 bp, Homo sapiens
ggtgcagagcagtgtcagagca

SEQ ID NO: 9456663 - DNA, 22 bp, Homo sapiens
ggtgcagaaggaagggagctgg

SEQ ID NO: 9456664 - DNA, 22 bp, Homo sapiens
ggtgcagaaggaagggagctgg

SEQ ID NO: 9456665 - DNA, 22 bp, Homo sapiens
ggtgcagaaggaagggagctgg

SEQ ID NO: 9456666 - DNA, 22 bp, Homo sapiens
cagatgctatagtgctgccata

SEQ ID NO: 9456667 - DNA, 22 bp, Homo sapiens
cagatgctatgtattatgtatg

SEQ ID NO: 9456668 - DNA, 22 bp, Homo sapiens
ggtgcagaggagccagctgggg

SEQ ID NO: 9456669 - DNA, 22 bp, Homo sapiens
ggtgcagcctccccagtgacag

SEQ ID NO: 9456670 - DNA, 22 bp, Homo sapiens
ggtgcagcctccccagtgacag

SEQ ID NO: 9456671 - DNA, 22 bp, Homo sapiens
ggtgcagcagtttgttcagctt

SEQ ID NO: 9456672 - DNA, 22 bp, Homo sapiens
ggtgcagctggacagagaagcc

SEQ ID NO: 9456673 - DNA, 22 bp, Homo sapiens
ggtgcagcctttgtttctactt

SEQ ID NO: 9456674 - DNA, 22 bp, Homo sapiens
ggtgcagctggacagagaagcc

SEQ ID NO: 9456675 - DNA, 21 bp, Homo sapiens
ggggtcaagtgaatggtgttg

SEQ ID NO: 9456676 - DNA, 22 bp, Homo sapiens
ggggtcctggaggccagctgga

SEQ ID NO: 9456677 - DNA, 22 bp, Homo sapiens
ggggtcctcggagcctgggtct

SEQ ID NO: 9456678 - DNA, 22 bp, Homo sapiens
ggggtctcactatgttacccag

SEQ ID NO: 9456679 - DNA, 22 bp, Homo sapiens
ggggtctgcgccactgtctgcg

SEQ ID NO: 9456680 - DNA, 22 bp, Homo sapiens
ggggtgagctgggcctgtgcct

SEQ ID NO: 9456681 - DNA, 22 bp, Homo sapiens
ggggtgagatcaaggaagccct

SEQ ID NO: 9456682 - DNA, 22 bp, Homo sapiens
cagagtgaaaactgagctcaaa

SEQ ID NO: 9456683 - DNA, 19 bp, Homo sapiens
cagagtttgcaggcagagg

SEQ ID NO: 9456684 - DNA, 22 bp, Homo sapiens
cagagtttaaacaaatgaaata

SEQ ID NO: 9456685 - DNA, 22 bp, Homo sapiens
cagagtttcggtaagcatagaa

SEQ ID NO: 9456686 - DNA, 22 bp, Homo sapiens
cagagtttgcaagggcagaagc

SEQ ID NO: 9456687 - DNA, 22 bp, Homo sapiens
cagagtttaaacaaatgaaata

SEQ ID NO: 9456688 - DNA, 18 bp, Homo sapiens
cagagtgggccaagagac

SEQ ID NO: 9456689 - DNA, 22 bp, Homo sapiens
cagagtgggctgtcagccacca

SEQ ID NO: 9456690 - DNA, 22 bp, Homo sapiens
cagagtgtggcatcttccaact

SEQ ID NO: 9456691 - DNA, 22 bp, Homo sapiens
cagagtgtattctgcagttgca

SEQ ID NO: 9456692 - DNA, 22 bp, Homo sapiens
cagagtggtgcaagggcagtgt

SEQ ID NO: 9456693 - DNA, 22 bp, Homo sapiens
ggggtagggtgattgtgaagta

SEQ ID NO: 9456694 - DNA, 22 bp, Homo sapiens
cagaggctgccagccatgtgca

SEQ ID NO: 9456695 - DNA, 22 bp, Homo sapiens
cagaggctgccagccatgtgca

SEQ ID NO: 9456696 - DNA, 22 bp, Homo sapiens
cagaggctgccagccatgtgca

SEQ ID NO: 9456697 - DNA, 22 bp, Homo sapiens
cagaggctgccagccatgtgca

SEQ ID NO: 9456698 - DNA, 22 bp, Homo sapiens
cagaggctgccagccatgtgca

SEQ ID NO: 9456699 - DNA, 22 bp, Homo sapiens
cagaggctgatgtgggatgggc

SEQ ID NO: 9456700 - DNA, 22 bp, Homo sapiens
cagaggctgatgtgggatgggc

SEQ ID NO: 9456701 - DNA, 22 bp, Homo sapiens
cagaggctgatgtgggatgggc

SEQ ID NO: 9456702 - DNA, 22 bp, Homo sapiens
cagaggcctttctacagtgata

SEQ ID NO: 9456703 - DNA, 22 bp, Homo sapiens
cagaggccttgtcttctttgct

SEQ ID NO: 9456704 - DNA, 22 bp, Homo sapiens
cagaggcaggataagaactgcg

SEQ ID NO: 9456705 - DNA, 15 bp, Homo sapiens
ggtgtctgcagtgtg

SEQ ID NO: 9456706 - DNA, 22 bp, Homo sapiens
ggtgtctgcttccctccagctg

SEQ ID NO: 9456707 - DNA, 22 bp, Homo sapiens
ggtgtctgcttccctccagctg

SEQ ID NO: 9456708 - DNA, 22 bp, Homo sapiens
ggtgtctgcttccctccagctg

SEQ ID NO: 9456709 - DNA, 22 bp, Homo sapiens
ggtgtctggacagtgagccagg

SEQ ID NO: 9456710 - DNA, 22 bp, Homo sapiens
ggtgtctgttgcctcctggtta

SEQ ID NO: 9456711 - DNA, 22 bp, Homo sapiens
ggtgtctgtgatggcatataac

SEQ ID NO: 9456712 - DNA, 19 bp, Homo sapiens
ggtgtgaagtgaggagtta

SEQ ID NO: 9456713 - DNA, 22 bp, Homo sapiens
ggtgtctgttgcctcctggtta

SEQ ID NO: 9456714 - DNA, 22 bp, Homo sapiens
ggtgtctcagctgctggcaggg

SEQ ID NO: 9456715 - DNA, 22 bp, Homo sapiens
ggtgtctgatggtggcttctca

SEQ ID NO: 9456716 - DNA, 22 bp, Homo sapiens
ggtgtctgatggtggcttctca

SEQ ID NO: 9456717 - DNA, 22 bp, Homo sapiens
ggtgtctgattccaaggccaca

SEQ ID NO: 9456718 - DNA, 22 bp, Homo sapiens
cagcagacttactagaatgtaa

SEQ ID NO: 9456719 - DNA, 22 bp, Homo sapiens
cagcagagaaattaaacttctg

SEQ ID NO: 9456720 - DNA, 22 bp, Homo sapiens
cagcagagaaattaaacttctg

SEQ ID NO: 9456721 - DNA, 22 bp, Homo sapiens
cagcagagaaattaaacttctg

SEQ ID NO: 9456722 - DNA, 22 bp, Homo sapiens
cagcagactgaccttcaacccc

SEQ ID NO: 9456723 - DNA, 22 bp, Homo sapiens
cagcagaagtgcatttgtgatt

SEQ ID NO: 9456724 - DNA, 22 bp, Homo sapiens
cagcagagaaattacatatttg

SEQ ID NO: 9456725 - DNA, 22 bp, Homo sapiens
cagcagagaaattacatatttg

SEQ ID NO: 9456726 - DNA, 18 bp, Homo sapiens
cagcagagacattcaaaa

SEQ ID NO: 9456727 - DNA, 18 bp, Homo sapiens
cagcagagacattcaaaa

SEQ ID NO: 9456728 - DNA, 18 bp, Homo sapiens
cagcagagacattcaaaa

SEQ ID NO: 9456729 - DNA, 22 bp, Homo sapiens
cagcagagaccaagtgatttga

SEQ ID NO: 9456730 - DNA, 20 bp, Homo sapiens
cagcagagacccatggggag

SEQ ID NO: 9456731 - DNA, 20 bp, Homo sapiens
cagcagagacccatggggag

SEQ ID NO: 9456732 - DNA, 22 bp, Homo sapiens
ggtgtgactcgccctcagggac

SEQ ID NO: 9456733 - DNA, 22 bp, Homo sapiens
ggtgtgcagtagcaggaggcct

SEQ ID NO: 9456734 - DNA, 22 bp, Homo sapiens
ggtgtgcagtagcaggaggcct

SEQ ID NO: 9456735 - DNA, 22 bp, Homo sapiens
ggtgtgcatggcacagggcttg

SEQ ID NO: 9456736 - DNA, 22 bp, Homo sapiens
ggtgtgcacgaaggaccagcag

SEQ ID NO: 9456737 - DNA, 22 bp, Homo sapiens
ggtgtgcacgaaggaccagcag

SEQ ID NO: 9456738 - DNA, 22 bp, Homo sapiens
gtaaacatcagccactctattt

SEQ ID NO: 9456739 - DNA, 22 bp, Homo sapiens
gtaaacatcagccactctattt

SEQ ID NO: 9456740 - DNA, 22 bp, Homo sapiens
gtaaacatcgacccaacagggg

SEQ ID NO: 9456741 - DNA, 22 bp, Homo sapiens
gtaaacatgctgtgtactcagc

SEQ ID NO: 9456742 - DNA, 22 bp, Homo sapiens
gtaacattattcatgagataca

SEQ ID NO: 9456743 - DNA, 22 bp, Homo sapiens
gtaacattattcatgagataca

SEQ ID NO: 9456744 - DNA, 22 bp, Homo sapiens
gtaacgaataaacaagtgataa

SEQ ID NO: 9456745 - DNA, 22 bp, Homo sapiens
gtaacatttacagttcctagag

SEQ ID NO: 9456746 - DNA, 22 bp, Homo sapiens
gtaacattttgagcagtaggct

SEQ ID NO: 9456747 - DNA, 22 bp, Homo sapiens
gtaacctgtcggaaagccttgt

SEQ ID NO: 9456748 - DNA, 22 bp, Homo sapiens
gtaacctgggatgtagcacaga

SEQ ID NO: 9456749 - DNA, 22 bp, Homo sapiens
gtaacattctagaaacttaaca

SEQ ID NO: 9456750 - DNA, 16 bp, Homo sapiens
gtaacattctgtagcc

SEQ ID NO: 9456751 - DNA, 22 bp, Homo sapiens
gtaacatttacagttcctagag

SEQ ID NO: 9456752 - DNA, 22 bp, Homo sapiens
gtaactttggatttagggtacc

SEQ ID NO: 9456753 - DNA, 22 bp, Homo sapiens
gtaacttatcatttcaatatag

SEQ ID NO: 9456754 - DNA, 22 bp, Homo sapiens
gtaagcaaacagcaaatgattt

SEQ ID NO: 9456755 - DNA, 22 bp, Homo sapiens
gtaagattagtgagtcacagtg

SEQ ID NO: 9456756 - DNA, 22 bp, Homo sapiens
gtaagatagccttgggttattt

SEQ ID NO: 9456757 - DNA, 20 bp, Homo sapiens
cagcagagacccatggggag

SEQ ID NO: 9456758 - DNA, 22 bp, Homo sapiens
cagcagagacggtaagcagaac

SEQ ID NO: 9456759 - DNA, 20 bp, Homo sapiens
cagcagagacccatggggag

SEQ ID NO: 9456760 - DNA, 20 bp, Homo sapiens
cagcagagacccatggggag

SEQ ID NO: 9456761 - DNA, 22 bp, Homo sapiens
cagcagagacggtaagcagaac

SEQ ID NO: 9456762 - DNA, 22 bp, Homo sapiens
cagcactctggcttcgttaagt

SEQ ID NO: 9456763 - DNA, 22 bp, Homo sapiens
cagcactcccaggagaaccagc

SEQ ID NO: 9456764 - DNA, 22 bp, Homo sapiens
cagcactgctgctgtacacaca

SEQ ID NO: 9456765 - DNA, 20 bp, Homo sapiens
cagcagaaatggggtgggaa

SEQ ID NO: 9456766 - DNA, 22 bp, Homo sapiens
cagcagaacaggcagggaagct

SEQ ID NO: 9456767 - DNA, 22 bp, Homo sapiens
cagcagaacaggcagggaagct

SEQ ID NO: 9456768 - DNA, 22 bp, Homo sapiens
cagcagaacaggcagggaagct

SEQ ID NO: 9456769 - DNA, 22 bp, Homo sapiens
cagcagaacagttaaagaaacc

SEQ ID NO: 9456770 - DNA, 22 bp, Homo sapiens
cagcagaacagttaaagaaacc

SEQ ID NO: 9456771 - DNA, 22 bp, Homo sapiens
ggtgggaaggggccagtgtgcg

SEQ ID NO: 9456772 - DNA, 22 bp, Homo sapiens
ggtgggaaggggccagtgtgcg

SEQ ID NO: 9456773 - DNA, 22 bp, Homo sapiens
ggtgggaaggggccagtgtgcg

SEQ ID NO: 9456774 - DNA, 22 bp, Homo sapiens
ggtgggacaggtaggagtggct

SEQ ID NO: 9456775 - DNA, 22 bp, Homo sapiens
ggtgggaaggccactgaaggtt

SEQ ID NO: 9456776 - DNA, 22 bp, Homo sapiens
ggtgggaaggccactgaaggtt

SEQ ID NO: 9456777 - DNA, 22 bp, Homo sapiens
ggtgggaaggccactgaaggtt

SEQ ID NO: 9456778 - DNA, 18 bp, Homo sapiens
ggtgggaagccagggcct

SEQ ID NO: 9456779 - DNA, 22 bp, Homo sapiens
ggtgggaaataattaggattat

SEQ ID NO: 9456780 - DNA, 22 bp, Homo sapiens
ggtgggaaggccactgaaggtt

SEQ ID NO: 9456781 - DNA, 22 bp, Homo sapiens
ggtggctggaggagctgatgga

SEQ ID NO: 9456782 - DNA, 22 bp, Homo sapiens
ggtggctgcttcctcaagagga

SEQ ID NO: 9456783 - DNA, 22 bp, Homo sapiens
ggtggctgcttcctcaagagga

SEQ ID NO: 9456784 - DNA, 22 bp, Homo sapiens
ggtggctgcaccctggctaact

SEQ ID NO: 9456785 - DNA, 22 bp, Homo sapiens
ggtggctgcaccctggctaact

SEQ ID NO: 9456786 - DNA, 22 bp, Homo sapiens
ggtggcagtgcttgcgggtcta

SEQ ID NO: 9456787 - DNA, 22 bp, Homo sapiens
ggtggctggaggagctgatgga

SEQ ID NO: 9456788 - DNA, 22 bp, Homo sapiens
ggtggctgggattagtagccca

SEQ ID NO: 9456789 - DNA, 22 bp, Homo sapiens
ggtggctgggattagtagccca

SEQ ID NO: 9456790 - DNA, 22 bp, Homo sapiens
ggtggctggaggagctgatgga

SEQ ID NO: 9456791 - DNA, 22 bp, Homo sapiens
ggtggctgggattagtagccca

SEQ ID NO: 9456792 - DNA, 22 bp, Homo sapiens
ggtggctgggattagtagccca

SEQ ID NO: 9456793 - DNA, 18 bp, Homo sapiens
ggtgggaagccagggcct

SEQ ID NO: 9456794 - DNA, 22 bp, Homo sapiens
ggtggctgtgagcattatgtga

SEQ ID NO: 9456795 - DNA, 22 bp, Homo sapiens
ggtggctggttttataagaggt

SEQ ID NO: 9456796 - DNA, 18 bp, Homo sapiens
ggtggctggggacggaca

SEQ ID NO: 9456797 - DNA, 18 bp, Homo sapiens
ggtggctggggacggaca

SEQ ID NO: 9456798 - DNA, 22 bp, Homo sapiens
ggtggctgggattagtagccca

SEQ ID NO: 9456799 - DNA, 22 bp, Homo sapiens
ggtggcagtcttaagagatctt

SEQ ID NO: 9456800 - DNA, 22 bp, Homo sapiens
ggtggcagtcttaagagatctt

SEQ ID NO: 9456801 - DNA, 22 bp, Homo sapiens
ggtggcagtgcttgcgggtcta

SEQ ID NO: 9456802 - DNA, 18 bp, Homo sapiens
ggtggcaggtcagatgcc

SEQ ID NO: 9456803 - DNA, 18 bp, Homo sapiens
ggtggcaggtcagatgcc

SEQ ID NO: 9456804 - DNA, 22 bp, Homo sapiens
ggtggcagtagcactgggcctg

SEQ ID NO: 9456805 - DNA, 22 bp, Homo sapiens
ggtggcagtagcactgggcctg

SEQ ID NO: 9456806 - DNA, 22 bp, Homo sapiens
cagatggaaggcatagaggttt

SEQ ID NO: 9456807 - DNA, 22 bp, Homo sapiens
cagatggaaggcatagaggttt

SEQ ID NO: 9456808 - DNA, 22 bp, Homo sapiens
cagatggaggataaaacatgca

SEQ ID NO: 9456809 - DNA, 22 bp, Homo sapiens
cagatggaacacagaaaggaga

SEQ ID NO: 9456810 - DNA, 22 bp, Homo sapiens
cagatgcttgttggctggtctc

SEQ ID NO: 9456811 - DNA, 22 bp, Homo sapiens
cagatggaacacagaaaggaga

SEQ ID NO: 9456812 - DNA, 22 bp, Homo sapiens
cagatgcttttgattctggggt

SEQ ID NO: 9456813 - DNA, 22 bp, Homo sapiens
ggtggcaggctggcattggcaa

SEQ ID NO: 9456814 - DNA, 22 bp, Homo sapiens
ggtgctgtggcagctcctcctc

SEQ ID NO: 9456815 - DNA, 22 bp, Homo sapiens
ggtggcaggctggcattggcaa

SEQ ID NO: 9456816 - DNA, 22 bp, Homo sapiens
ggtgctggttcagggtggctgt

SEQ ID NO: 9456817 - DNA, 22 bp, Homo sapiens
cagatggcaacagctctgtgac

SEQ ID NO: 9456818 - DNA, 22 bp, Homo sapiens
ggtgctggttcagggtggctgt

SEQ ID NO: 9456819 - DNA, 22 bp, Homo sapiens
ggtgctggttcagggtggctgt

SEQ ID NO: 9456820 - DNA, 22 bp, Homo sapiens
cagatggattttgtaggctgat

SEQ ID NO: 9456821 - DNA, 22 bp, Homo sapiens
cagagagaggccactgctatta

SEQ ID NO: 9456822 - DNA, 22 bp, Homo sapiens
cagagagaatcttggcagctga

SEQ ID NO: 9456823 - DNA, 19 bp, Homo sapiens
cagagagaccaaggcgcca

SEQ ID NO: 9456824 - DNA, 19 bp, Homo sapiens
cagagagaccaaggcgcca

SEQ ID NO: 9456825 - DNA, 22 bp, Homo sapiens
cagagagaggggctgcctggcc

SEQ ID NO: 9456826 - DNA, 22 bp, Homo sapiens
cagagagaggggctgcctggcc

SEQ ID NO: 9456827 - DNA, 22 bp, Homo sapiens
cagagactggagtgcagtggcg

SEQ ID NO: 9456828 - DNA, 22 bp, Homo sapiens
cagagagaatcttggcagctga

SEQ ID NO: 9456829 - DNA, 22 bp, Homo sapiens
cagagagaatcttggcagctga

SEQ ID NO: 9456830 - DNA, 22 bp, Homo sapiens
cagagagaatcttggcagctga

SEQ ID NO: 9456831 - DNA, 22 bp, Homo sapiens
cagagagaatcttggcagctga

SEQ ID NO: 9456832 - DNA, 22 bp, Homo sapiens
cagagagaatcttggcagctga

SEQ ID NO: 9456833 - DNA, 22 bp, Homo sapiens
cagagagaatcttggcagctga

SEQ ID NO: 9456834 - DNA, 18 bp, Homo sapiens
cagaagcaggcagtgcag

SEQ ID NO: 9456835 - DNA, 22 bp, Homo sapiens
cagagactggagtgcagtggcg

SEQ ID NO: 9456836 - DNA, 20 bp, Homo sapiens
cagagacctgtcttcacaga

SEQ ID NO: 9456837 - DNA, 22 bp, Homo sapiens
cagagacagtttcacagggtct

SEQ ID NO: 9456838 - DNA, 22 bp, Homo sapiens
cagagacatccatgttagttgg

SEQ ID NO: 9456839 - DNA, 22 bp, Homo sapiens
cagaagcagaacactagattta

SEQ ID NO: 9456840 - DNA, 22 bp, Homo sapiens
cagaagcagattctaaagcaag

SEQ ID NO: 9456841 - DNA, 22 bp, Homo sapiens
cagaagcactaggaggaaacgt

SEQ ID NO: 9456842 - DNA, 22 bp, Homo sapiens
cagaagcactaggaggaaacgt

SEQ ID NO: 9456843 - DNA, 22 bp, Homo sapiens
cagaagcactaggaggaaacgt

SEQ ID NO: 9456844 - DNA, 22 bp, Homo sapiens
cagaagcagaacactagattta

SEQ ID NO: 9456845 - DNA, 22 bp, Homo sapiens
cagaagcacatgtttacatgta

SEQ ID NO: 9456846 - DNA, 22 bp, Homo sapiens
cagaagcacatgtttacatgta

SEQ ID NO: 9456847 - DNA, 22 bp, Homo sapiens
cagaagcacatgtttacatgta

SEQ ID NO: 9456848 - DNA, 23 bp, Homo sapiens
cagaagcacctgttgactgctgc

SEQ ID NO: 9456849 - DNA, 22 bp, Homo sapiens
cagaagcacatgtttacatgta

SEQ ID NO: 9456850 - DNA, 22 bp, Homo sapiens
cagaagcaaatgccttgctgag

SEQ ID NO: 9456851 - DNA, 22 bp, Homo sapiens
cagaagcaaatgccttgctgag

SEQ ID NO: 9456852 - DNA, 22 bp, Homo sapiens
cagaagatgctttgtaaaatga

SEQ ID NO: 9456853 - DNA, 22 bp, Homo sapiens
cagaagagtagctgaacaagtt

SEQ ID NO: 9456854 - DNA, 22 bp, Homo sapiens
cagaagagtagctgaacaagtt

SEQ ID NO: 9456855 - DNA, 22 bp, Homo sapiens
cagaagagtagctgaacaagtt

SEQ ID NO: 9456856 - DNA, 22 bp, Homo sapiens
cagaagagtagctgaacaagtt

SEQ ID NO: 9456857 - DNA, 22 bp, Homo sapiens
cagaagatctcttagtggaggg

SEQ ID NO: 9456858 - DNA, 22 bp, Homo sapiens
cagaagatgcagtgtctgagaa

SEQ ID NO: 9456859 - DNA, 22 bp, Homo sapiens
cagaagcaagtagtgattcttt

SEQ ID NO: 9456860 - DNA, 22 bp, Homo sapiens
cagaagcaagtagtgattcttt

SEQ ID NO: 9456861 - DNA, 22 bp, Homo sapiens
cagaagcaagtagtgattcttt

SEQ ID NO: 9456862 - DNA, 22 bp, Homo sapiens
cagaagcaagggccaaagtctt

SEQ ID NO: 9456863 - DNA, 22 bp, Homo sapiens
cagaagcaagggccaaagtctt

SEQ ID NO: 9456864 - DNA, 22 bp, Homo sapiens
gggccctggatttaagcatgga

SEQ ID NO: 9456865 - DNA, 22 bp, Homo sapiens
gggccctggacgtggcggcaga

SEQ ID NO: 9456866 - DNA, 22 bp, Homo sapiens
gggccctggccgaatccctctg

SEQ ID NO: 9456867 - DNA, 18 bp, Homo sapiens
gggccctggcgtccgccc

SEQ ID NO: 9456868 - DNA, 22 bp, Homo sapiens
gggccctggatttaagcatgga

SEQ ID NO: 9456869 - DNA, 22 bp, Homo sapiens
gggccaggagtggagatatggg

SEQ ID NO: 9456870 - DNA, 22 bp, Homo sapiens
gggccagctctgtgatgtaggg

SEQ ID NO: 9456871 - DNA, 22 bp, Homo sapiens
gggccaggagtggagatatggg

SEQ ID NO: 9456872 - DNA, 22 bp, Homo sapiens
gggccagctctgtgatgtaggg

SEQ ID NO: 9456873 - DNA, 22 bp, Homo sapiens
gggccagctctgtgatgtaggg

SEQ ID NO: 9456874 - DNA, 22 bp, Homo sapiens
gggccctgcgtccggaagtctg

SEQ ID NO: 9456875 - DNA, 22 bp, Homo sapiens
gggccctggacgtggcggcaga

SEQ ID NO: 9456876 - DNA, 22 bp, Homo sapiens
gggccctggacgtggcggcaga

SEQ ID NO: 9456877 - DNA, 22 bp, Homo sapiens
gggccctgcgtccggaagtctg

SEQ ID NO: 9456878 - DNA, 22 bp, Homo sapiens
cagagagagtggggtgtggatt

SEQ ID NO: 9456879 - DNA, 22 bp, Homo sapiens
cagagagagtggggtgtggatt

SEQ ID NO: 9456880 - DNA, 22 bp, Homo sapiens
cagagagagtggggtgtggatt

SEQ ID NO: 9456881 - DNA, 22 bp, Homo sapiens
cagagagcacataggatacttt

SEQ ID NO: 9456882 - DNA, 22 bp, Homo sapiens
cagagagagtggggtgtggatt

SEQ ID NO: 9456883 - DNA, 22 bp, Homo sapiens
cagagagagtctgtccctgaag

SEQ ID NO: 9456884 - DNA, 22 bp, Homo sapiens
cagagagagtctgtccctgaag

SEQ ID NO: 9456885 - DNA, 22 bp, Homo sapiens
cagagagagtctgtccctgaag

SEQ ID NO: 9456886 - DNA, 16 bp, Homo sapiens
cagagaggacagaggc

SEQ ID NO: 9456887 - DNA, 22 bp, Homo sapiens
cagagagcttagtgtgctgcat

SEQ ID NO: 9456888 - DNA, 21 bp, Homo sapiens
cagagagctagaacttcatga

SEQ ID NO: 9456889 - DNA, 22 bp, Homo sapiens
gggccctggctttcctgttctt

SEQ ID NO: 9456890 - DNA, 22 bp, Homo sapiens
gggccctggctttcctgttctt

SEQ ID NO: 9456891 - DNA, 22 bp, Homo sapiens
gggccctggctttcctgttctt

SEQ ID NO: 9456892 - DNA, 18 bp, Homo sapiens
gggccctggcgtccgccc

SEQ ID NO: 9456893 - DNA, 22 bp, Homo sapiens
gggccctgggattcagagcaag

SEQ ID NO: 9456894 - DNA, 20 bp, Homo sapiens
gggccctgggattcagagca

SEQ ID NO: 9456895 - DNA, 22 bp, Homo sapiens
cagagcagatttctaagtattg

SEQ ID NO: 9456896 - DNA, 22 bp, Homo sapiens
cagagcagcagagcttccatgg

SEQ ID NO: 9456897 - DNA, 18 bp, Homo sapiens
cagagcagaggtggagcg

SEQ ID NO: 9456898 - DNA, 18 bp, Homo sapiens
cagagcagaggtggagcg

SEQ ID NO: 9456899 - DNA, 22 bp, Homo sapiens
cagagcagagtgattgttctgg

SEQ ID NO: 9456900 - DNA, 22 bp, Homo sapiens
cagagcagagtgattgttctgg

SEQ ID NO: 9456901 - DNA, 18 bp, Homo sapiens
cagagcagaggtggagcg

SEQ ID NO: 9456902 - DNA, 22 bp, Homo sapiens
cagagcaggaatagggtgttga

SEQ ID NO: 9456903 - DNA, 22 bp, Homo sapiens
cagagcaggaatagggtgttga

SEQ ID NO: 9456904 - DNA, 22 bp, Homo sapiens
cagagcaggaatagggtgttga

SEQ ID NO: 9456905 - DNA, 22 bp, Homo sapiens
cagagcaggcccactgccctcc

SEQ ID NO: 9456906 - DNA, 22 bp, Homo sapiens
gggcgccgtgggaaacagccgg

SEQ ID NO: 9456907 - DNA, 22 bp, Homo sapiens
gggcgcgcacgccagacagcct

SEQ ID NO: 9456908 - DNA, 22 bp, Homo sapiens
gggcgctgggtgtcgagactca

SEQ ID NO: 9456909 - DNA, 22 bp, Homo sapiens
cagagcagcctccagggggagc

SEQ ID NO: 9456910 - DNA, 22 bp, Homo sapiens
cagagcagcctccagggggagc

SEQ ID NO: 9456911 - DNA, 22 bp, Homo sapiens
cagagcagcctccagggggagc

SEQ ID NO: 9456912 - DNA, 22 bp, Homo sapiens
cagagcagcctccagggggagc

SEQ ID NO: 9456913 - DNA, 22 bp, Homo sapiens
cagagcagcctccagggggagc

SEQ ID NO: 9456914 - DNA, 22 bp, Homo sapiens
gggctcaggtcagggcatcagc

SEQ ID NO: 9456915 - DNA, 22 bp, Homo sapiens
gggctcagtcctggttctaccc

SEQ ID NO: 9456916 - DNA, 22 bp, Homo sapiens
gggctcagtcctggttctaccc

SEQ ID NO: 9456917 - DNA, 22 bp, Homo sapiens
gggctcaggtcagggcatcagc

SEQ ID NO: 9456918 - DNA, 22 bp, Homo sapiens
gggctcagggacacatgtgtgt

SEQ ID NO: 9456919 - DNA, 22 bp, Homo sapiens
gggctcagggacacatgtgtgt

SEQ ID NO: 9456920 - DNA, 22 bp, Homo sapiens
gggctcagggacacatgtgtgt

SEQ ID NO: 9456921 - DNA, 22 bp, Homo sapiens
gggctcagggacacatgtgtgt

SEQ ID NO: 9456922 - DNA, 22 bp, Homo sapiens
gggctcaggcctggcctctcac

SEQ ID NO: 9456923 - DNA, 22 bp, Homo sapiens
gggctcaggcctggcctctcac

SEQ ID NO: 9456924 - DNA, 22 bp, Homo sapiens
gggctcaggcctggcctctcac

SEQ ID NO: 9456925 - DNA, 22 bp, Homo sapiens
gggctcaggagtttgaggctgc

SEQ ID NO: 9456926 - DNA, 22 bp, Homo sapiens
gggctcaggagtttgaggctgc

SEQ ID NO: 9456927 - DNA, 22 bp, Homo sapiens
gggctcagtctggcgtggaatg

SEQ ID NO: 9456928 - DNA, 22 bp, Homo sapiens
gggctcagtctgcggcgcgcgg

SEQ ID NO: 9456929 - DNA, 22 bp, Homo sapiens
gggctctgcacgttctggcgtc

SEQ ID NO: 9456930 - DNA, 22 bp, Homo sapiens
gggctctgcagtgacttgaggg

SEQ ID NO: 9456931 - DNA, 22 bp, Homo sapiens
gggctctgcagagaactggctc

SEQ ID NO: 9456932 - DNA, 18 bp, Homo sapiens
gggctctgatccttcacc

SEQ ID NO: 9456933 - DNA, 18 bp, Homo sapiens
gggctctgatccttcacc

SEQ ID NO: 9456934 - DNA, 22 bp, Homo sapiens
gggctctgcacgttctggcgtc

SEQ ID NO: 9456935 - DNA, 22 bp, Homo sapiens
gggctctgatagagattattgc

SEQ ID NO: 9456936 - DNA, 20 bp, Homo sapiens
gggctctgcatccatcagcc

SEQ ID NO: 9456937 - DNA, 20 bp, Homo sapiens
gggctctgcatccatcagcc

SEQ ID NO: 9456938 - DNA, 20 bp, Homo sapiens
gggctctgcatccatcagcc

SEQ ID NO: 9456939 - DNA, 21 bp, Homo sapiens
gggctctgccctcctggagct

SEQ ID NO: 9456940 - DNA, 21 bp, Homo sapiens
gggctctgccctcctggagct

SEQ ID NO: 9456941 - DNA, 21 bp, Homo sapiens
gggctctgccctcctggagct

SEQ ID NO: 9456942 - DNA, 22 bp, Homo sapiens
gggctctgcctggctgggagta

SEQ ID NO: 9456943 - DNA, 22 bp, Homo sapiens
gggctctgcctggctgggagta

SEQ ID NO: 9456944 - DNA, 22 bp, Homo sapiens
gggctctgcctggctgggagta

SEQ ID NO: 9456945 - DNA, 22 bp, Homo sapiens
gggctctgcgctcagctccagc

SEQ ID NO: 9456946 - DNA, 22 bp, Homo sapiens
gggctctgcgctcagctccagc

SEQ ID NO: 9456947 - DNA, 22 bp, Homo sapiens
cagagctgtcatttgccagtga

SEQ ID NO: 9456948 - DNA, 22 bp, Homo sapiens
cagagctgtcatttgccagtga

SEQ ID NO: 9456949 - DNA, 22 bp, Homo sapiens
cagagcttcctgctgggcttct

SEQ ID NO: 9456950 - DNA, 22 bp, Homo sapiens
cagagcttctgacagctgctgc

SEQ ID NO: 9456951 - DNA, 22 bp, Homo sapiens
cagagctttgtgtcagggctgt

SEQ ID NO: 9456952 - DNA, 22 bp, Homo sapiens
cagagctttggctagatggttg

SEQ ID NO: 9456953 - DNA, 22 bp, Homo sapiens
cagagcttggctgtggttgtga

SEQ ID NO: 9456954 - DNA, 22 bp, Homo sapiens
cagaggaaatgggaaggagata

SEQ ID NO: 9456955 - DNA, 22 bp, Homo sapiens
cagaggaaatgggaaggagata

SEQ ID NO: 9456956 - DNA, 22 bp, Homo sapiens
cagaggaaatgggaaggagata

SEQ ID NO: 9456957 - DNA, 22 bp, Homo sapiens
cagaggaacgtttggattgatt

SEQ ID NO: 9456958 - DNA, 22 bp, Homo sapiens
cagaggaagagatacaagccct

SEQ ID NO: 9456959 - DNA, 22 bp, Homo sapiens
gggggcaggtctggaactttga

SEQ ID NO: 9456960 - DNA, 22 bp, Homo sapiens
gggggcagaatgtactcttgtc

SEQ ID NO: 9456961 - DNA, 22 bp, Homo sapiens
gggggcagaatgtactcttgtc

SEQ ID NO: 9456962 - DNA, 22 bp, Homo sapiens
gggggatgctcaggaggctgct

SEQ ID NO: 9456963 - DNA, 22 bp, Homo sapiens
gggggatgctcaggaggctgct

SEQ ID NO: 9456964 - DNA, 19 bp, Homo sapiens
cagaggcactttctcttag

SEQ ID NO: 9456965 - DNA, 22 bp, Homo sapiens
gggggcagtaacctcaaagtgt

SEQ ID NO: 9456966 - DNA, 22 bp, Homo sapiens
gggggcaggtctggaactttga

SEQ ID NO: 9456967 - DNA, 22 bp, Homo sapiens
gggggcaggtctggaactttga

SEQ ID NO: 9456968 - DNA, 22 bp, Homo sapiens
cagaggcagaatggagatttgg

SEQ ID NO: 9456969 - DNA, 19 bp, Homo sapiens
cagaggcactttctcttag

SEQ ID NO: 9456970 - DNA, 19 bp, Homo sapiens
cagaggcactttctcttag

SEQ ID NO: 9456971 - DNA, 22 bp, Homo sapiens
cagaggcagaggtcatctctgg

SEQ ID NO: 9456972 - DNA, 22 bp, Homo sapiens
cagaggcagaccctccagggcg

SEQ ID NO: 9456973 - DNA, 22 bp, Homo sapiens
cagaggcagaccctccagggcg

SEQ ID NO: 9456974 - DNA, 22 bp, Homo sapiens
cagaggcagaggtcatctctgg

SEQ ID NO: 9456975 - DNA, 22 bp, Homo sapiens
cagaggcagaggtcatctctgg

SEQ ID NO: 9456976 - DNA, 22 bp, Homo sapiens
cagaggcagccgggggagaacg

SEQ ID NO: 9456977 - DNA, 22 bp, Homo sapiens
cagaggcagccgggggagaacg

SEQ ID NO: 9456978 - DNA, 22 bp, Homo sapiens
cagaggcaggaagatgggcagt

SEQ ID NO: 9456979 - DNA, 22 bp, Homo sapiens
cagaggaagctgggtgtggagt

SEQ ID NO: 9456980 - DNA, 22 bp, Homo sapiens
cagaggaagcagacacatcttg

SEQ ID NO: 9456981 - DNA, 22 bp, Homo sapiens
cagaggaagcagacacatcttg

SEQ ID NO: 9456982 - DNA, 22 bp, Homo sapiens
cagaggacaactggggcaagga

SEQ ID NO: 9456983 - DNA, 22 bp, Homo sapiens
cagaggaagttccttgatgaga

SEQ ID NO: 9456984 - DNA, 22 bp, Homo sapiens
gggggaggtgaatgcaataagg

SEQ ID NO: 9456985 - DNA, 22 bp, Homo sapiens
gggggaggtgaatgcaataagg

SEQ ID NO: 9456986 - DNA, 22 bp, Homo sapiens
gggggaggtgaatgcaataagg

SEQ ID NO: 9456987 - DNA, 22 bp, Homo sapiens
cagaggacctgtgtggccagag

SEQ ID NO: 9456988 - DNA, 22 bp, Homo sapiens
cagaggacctgtgtggccagag

SEQ ID NO: 9456989 - DNA, 22 bp, Homo sapiens
ggggcgccccgagggtgcgcac

SEQ ID NO: 9456990 - DNA, 22 bp, Homo sapiens
ggggcggggctctgagaagcat

SEQ ID NO: 9456991 - DNA, 22 bp, Homo sapiens
ggccccagcctcagtcccctga

SEQ ID NO: 9456992 - DNA, 22 bp, Homo sapiens
ggccccagctgtggtgaataga

SEQ ID NO: 9456993 - DNA, 22 bp, Homo sapiens
ggccccagcttcaaccccgtgg

SEQ ID NO: 9456994 - DNA, 22 bp, Homo sapiens
ggccccaggacctccacggtcc

SEQ ID NO: 9456995 - DNA, 22 bp, Homo sapiens
ggccccaggcctttggtctggc

SEQ ID NO: 9456996 - DNA, 22 bp, Homo sapiens
ggccccagggattaggccaacc

SEQ ID NO: 9456997 - DNA, 22 bp, Homo sapiens
ggccccagggattaggccaacc

SEQ ID NO: 9456998 - DNA, 17 bp, Homo sapiens
ggcctgtgtggctgcag

SEQ ID NO: 9456999 - DNA, 22 bp, Homo sapiens
ggccccagggaagaaggtggtc

SEQ ID NO: 9457000 - DNA, 22 bp, Homo sapiens
ggccccaggcctttggtctggc

SEQ ID NO: 9457001 - DNA, 22 bp, Homo sapiens
ggcgcccatcggtgcagagggc

SEQ ID NO: 9457002 - DNA, 22 bp, Homo sapiens
ggcgccagcggtaagtaagaca

SEQ ID NO: 9457003 - DNA, 22 bp, Homo sapiens
ggcgcagttgagcgtgctgttc

SEQ ID NO: 9457004 - DNA, 22 bp, Homo sapiens
ggcgccagcactgcagcgcctc

SEQ ID NO: 9457005 - DNA, 22 bp, Homo sapiens
ggcgccagcactgcagcgcctc

SEQ ID NO: 9457006 - DNA, 22 bp, Homo sapiens
ggcgccagcggtaagtaagaca

SEQ ID NO: 9457007 - DNA, 22 bp, Homo sapiens
ggcgccagcggtaagtaagaca

SEQ ID NO: 9457008 - DNA, 22 bp, Homo sapiens
ggcgagggagcagtgcggtggg

SEQ ID NO: 9457009 - DNA, 22 bp, Homo sapiens
ggcgagggagcagtgcggtggg

SEQ ID NO: 9457010 - DNA, 17 bp, Homo sapiens
ggcctgtgtggctgcag

SEQ ID NO: 9457011 - DNA, 17 bp, Homo sapiens
ggcctgtgtggctgcag

SEQ ID NO: 9457012 - DNA, 22 bp, Homo sapiens
ggcgaggccgggacaggctgga

SEQ ID NO: 9457013 - DNA, 22 bp, Homo sapiens
ggcgagggagcagtgcggtggg

SEQ ID NO: 9457014 - DNA, 22 bp, Homo sapiens
ggcccagcatcttgtgaagttt

SEQ ID NO: 9457015 - DNA, 22 bp, Homo sapiens
ggcccagcatcttgtgaagttt

SEQ ID NO: 9457016 - DNA, 22 bp, Homo sapiens
ggcccagcatcttgtgaagttt

SEQ ID NO: 9457017 - DNA, 22 bp, Homo sapiens
ggcccagcacagtgcttggggg

SEQ ID NO: 9457018 - DNA, 22 bp, Homo sapiens
ggccccagcagaccctcctctg

SEQ ID NO: 9457019 - DNA, 22 bp, Homo sapiens
ggccccagcagaccctcctctg

SEQ ID NO: 9457020 - DNA, 22 bp, Homo sapiens
ggccccagcagaccctcctctg

SEQ ID NO: 9457021 - DNA, 22 bp, Homo sapiens
ggcccagcccgagtcagccttc

SEQ ID NO: 9457022 - DNA, 22 bp, Homo sapiens
ggccccagcagtgcttgtttat

SEQ ID NO: 9457023 - DNA, 19 bp, Homo sapiens
ggccccagccagggtatca

SEQ ID NO: 9457024 - DNA, 21 bp, Homo sapiens
ggccccagcccatgggttctc

SEQ ID NO: 9457025 - DNA, 21 bp, Homo sapiens
ggccccagcccatgggttctc

SEQ ID NO: 9457026 - DNA, 22 bp, Homo sapiens
ggccccagcctcagtcccctga

SEQ ID NO: 9457027 - DNA, 22 bp, Homo sapiens
ggccccagcctcagtcccctga

SEQ ID NO: 9457028 - DNA, 22 bp, Homo sapiens
ggcccagagggtcaggagctga

SEQ ID NO: 9457029 - DNA, 22 bp, Homo sapiens
ggcccagagtctgcaatggagt

SEQ ID NO: 9457030 - DNA, 22 bp, Homo sapiens
ggcccagagtctgcaatggagt

SEQ ID NO: 9457031 - DNA, 22 bp, Homo sapiens
ggcccagagggtcaggagctga

SEQ ID NO: 9457032 - DNA, 22 bp, Homo sapiens
ggcccagaggggttgagcatct

SEQ ID NO: 9457033 - DNA, 22 bp, Homo sapiens
ggcccagattagaagctgaatg

SEQ ID NO: 9457034 - DNA, 22 bp, Homo sapiens
ggcccagagtctgcaatggagt

SEQ ID NO: 9457035 - DNA, 22 bp, Homo sapiens
ggcccagattagaagctgaatg

SEQ ID NO: 9457036 - DNA, 22 bp, Homo sapiens
ggcccagcacagtgcttggggg

SEQ ID NO: 9457037 - DNA, 22 bp, Homo sapiens
ggcccagaagccagaagcctcc

SEQ ID NO: 9457038 - DNA, 22 bp, Homo sapiens
ggcccagaagccagaagcctcc

SEQ ID NO: 9457039 - DNA, 22 bp, Homo sapiens
ggcccagaatacatgaagtata

SEQ ID NO: 9457040 - DNA, 22 bp, Homo sapiens
ggcccagaatactttgtaaaat

SEQ ID NO: 9457041 - DNA, 22 bp, Homo sapiens
ggcccagacccaagagtggtgg

SEQ ID NO: 9457042 - DNA, 22 bp, Homo sapiens
ggcccagacccaagagtggtgg

SEQ ID NO: 9457043 - DNA, 22 bp, Homo sapiens
ggcccagaatacatgaagtata

SEQ ID NO: 9457044 - DNA, 22 bp, Homo sapiens
ggcccagaatactttgtaaaat

SEQ ID NO: 9457045 - DNA, 22 bp, Homo sapiens
ggcccagagacgtgcaatgtac

SEQ ID NO: 9457046 - DNA, 22 bp, Homo sapiens
ggcccagagctctgggggagct

SEQ ID NO: 9457047 - DNA, 22 bp, Homo sapiens
ggcccagagctccctggcacct

SEQ ID NO: 9457048 - DNA, 22 bp, Homo sapiens
ggccagccctcctccctgggtt

SEQ ID NO: 9457049 - DNA, 22 bp, Homo sapiens
ggccagcctggggctcccagac

SEQ ID NO: 9457050 - DNA, 22 bp, Homo sapiens
ggccagcctggggctcccagac

SEQ ID NO: 9457051 - DNA, 22 bp, Homo sapiens
ggccagcctggggctcccagac

SEQ ID NO: 9457052 - DNA, 22 bp, Homo sapiens
ggccagcggcacagcctggccc

SEQ ID NO: 9457053 - DNA, 22 bp, Homo sapiens
ggccagctacccatctgcgtca

SEQ ID NO: 9457054 - DNA, 18 bp, Homo sapiens
ggccagccccaggccagc

SEQ ID NO: 9457055 - DNA, 18 bp, Homo sapiens
ggccagccccaggccagc

SEQ ID NO: 9457056 - DNA, 22 bp, Homo sapiens
ggccagcccagtggtcctctct

SEQ ID NO: 9457057 - DNA, 23 bp, Homo sapiens
ggccactttgtgtcagtatgtgc

SEQ ID NO: 9457058 - DNA, 22 bp, Homo sapiens
ggccactgtttcctgggcagtt

SEQ ID NO: 9457059 - DNA, 22 bp, Homo sapiens
caccacagcatccactagaagg

SEQ ID NO: 9457060 - DNA, 22 bp, Homo sapiens
caccactgaattgttcactttc

SEQ ID NO: 9457061 - DNA, 22 bp, Homo sapiens
caccacagcatccactagaagg

SEQ ID NO: 9457062 - DNA, 22 bp, Homo sapiens
caccaagaatcttcacttttta

SEQ ID NO: 9457063 - DNA, 20 bp, Homo sapiens
caccacagaattggggacag

SEQ ID NO: 9457064 - DNA, 20 bp, Homo sapiens
caccacagaattggggacag

SEQ ID NO: 9457065 - DNA, 20 bp, Homo sapiens
caccaagctaaggttacttt

SEQ ID NO: 9457066 - DNA, 21 bp, Homo sapiens
cacatttgaacctcacagcaa

SEQ ID NO: 9457067 - DNA, 19 bp, Homo sapiens
cacattttgagtctgagat

SEQ ID NO: 9457068 - DNA, 22 bp, Homo sapiens
cacatttttactgccaacttaa

SEQ ID NO: 9457069 - DNA, 22 bp, Homo sapiens
cacatttttactgccaacttaa

SEQ ID NO: 9457070 - DNA, 19 bp, Homo sapiens
cacattttgagtctgagat

SEQ ID NO: 9457071 - DNA, 22 bp, Homo sapiens
ggccagctccttggcagtgcct

SEQ ID NO: 9457072 - DNA, 22 bp, Homo sapiens
ggccagctcagtctccatcagg

SEQ ID NO: 9457073 - DNA, 18 bp, Homo sapiens
ggccagctcctgaggcag

SEQ ID NO: 9457074 - DNA, 18 bp, Homo sapiens
ggccagctcctgaggcag

SEQ ID NO: 9457075 - DNA, 22 bp, Homo sapiens
ggccagctacccatctgcgtca

SEQ ID NO: 9457076 - DNA, 22 bp, Homo sapiens
ggccagctacccatctgcgtca

SEQ ID NO: 9457077 - DNA, 22 bp, Homo sapiens
ggccagctcagactccacttgc

SEQ ID NO: 9457078 - DNA, 22 bp, Homo sapiens
ggccagctcagtctccatcagg

SEQ ID NO: 9457079 - DNA, 22 bp, Homo sapiens
ggccagctcagggtccttgggc

SEQ ID NO: 9457080 - DNA, 22 bp, Homo sapiens
ggccagctccttggcagtgcct

SEQ ID NO: 9457081 - DNA, 21 bp, Homo sapiens
ggccagctcggaaggtcccat

SEQ ID NO: 9457082 - DNA, 22 bp, Homo sapiens
cacccagcattggctaagagag

SEQ ID NO: 9457083 - DNA, 22 bp, Homo sapiens
cacccagcttttgcatcctccg

SEQ ID NO: 9457084 - DNA, 22 bp, Homo sapiens
cacccagcttttgcatcctccg

SEQ ID NO: 9457085 - DNA, 22 bp, Homo sapiens
cacccaggacaaaatatggaat

SEQ ID NO: 9457086 - DNA, 22 bp, Homo sapiens
cacccagccttcacacaggagt

SEQ ID NO: 9457087 - DNA, 22 bp, Homo sapiens
cacccagccttcacacaggagt

SEQ ID NO: 9457088 - DNA, 22 bp, Homo sapiens
cacccagcttttgcatcctccg

SEQ ID NO: 9457089 - DNA, 22 bp, Homo sapiens
cacccaggctagagtgcagtgg

SEQ ID NO: 9457090 - DNA, 22 bp, Homo sapiens
cacccaggcatgggttgagatg

SEQ ID NO: 9457091 - DNA, 22 bp, Homo sapiens
cacccaggcaggtggctgagaa

SEQ ID NO: 9457092 - DNA, 22 bp, Homo sapiens
cacccaggcaggtggctgagaa

SEQ ID NO: 9457093 - DNA, 22 bp, Homo sapiens
cacccaggcaggtggctgagaa

SEQ ID NO: 9457094 - DNA, 22 bp, Homo sapiens
ggccagggcctggggactgtcc

SEQ ID NO: 9457095 - DNA, 22 bp, Homo sapiens
cacccaggctagagtgcagtgg

SEQ ID NO: 9457096 - DNA, 22 bp, Homo sapiens
ggccagggccaaggctttccca

SEQ ID NO: 9457097 - DNA, 22 bp, Homo sapiens
cacccaggacaggccagatgtg

SEQ ID NO: 9457098 - DNA, 22 bp, Homo sapiens
cacatttctgtacttaggtaga

SEQ ID NO: 9457099 - DNA, 22 bp, Homo sapiens
cacatttctctacctcacacaa

SEQ ID NO: 9457100 - DNA, 22 bp, Homo sapiens
cacatttctgtgagtcaatatt

SEQ ID NO: 9457101 - DNA, 22 bp, Homo sapiens
ggcagtcacaggggagactggg

SEQ ID NO: 9457102 - DNA, 19 bp, Homo sapiens
ggcagtcacggtcaggagc

SEQ ID NO: 9457103 - DNA, 21 bp, Homo sapiens
ggcagtaagccaaatccattt

SEQ ID NO: 9457104 - DNA, 22 bp, Homo sapiens
ggcaggttggatgctgtagtga

SEQ ID NO: 9457105 - DNA, 22 bp, Homo sapiens
ggcagtcaagagggagtctgaa

SEQ ID NO: 9457106 - DNA, 22 bp, Homo sapiens
ggcaggtgtggtgaccagagat

SEQ ID NO: 9457107 - DNA, 22 bp, Homo sapiens
ggcaggtgtttttatattaaag

SEQ ID NO: 9457108 - DNA, 22 bp, Homo sapiens
ggcaggtgtggtgaccagagat

SEQ ID NO: 9457109 - DNA, 22 bp, Homo sapiens
ggcaggtgtggtgaccagagat

SEQ ID NO: 9457110 - DNA, 22 bp, Homo sapiens
ggcaggtgccttctgtgctagc

SEQ ID NO: 9457111 - DNA, 22 bp, Homo sapiens
ggcaggtgccttctgtgctagc

SEQ ID NO: 9457112 - DNA, 22 bp, Homo sapiens
cacatgctagaataaatctcca

SEQ ID NO: 9457113 - DNA, 22 bp, Homo sapiens
cacatgcctattaaccaaacga

SEQ ID NO: 9457114 - DNA, 22 bp, Homo sapiens
cacatgccttcctcaggcctct

SEQ ID NO: 9457115 - DNA, 22 bp, Homo sapiens
cacatgcccagaacttctcatt

SEQ ID NO: 9457116 - DNA, 22 bp, Homo sapiens
cacatgctcattggcactgttc

SEQ ID NO: 9457117 - DNA, 22 bp, Homo sapiens
ggcaggtgtgagatcgaggcca

SEQ ID NO: 9457118 - DNA, 22 bp, Homo sapiens
ggcaggtgtgagatcgaggcca

SEQ ID NO: 9457119 - DNA, 22 bp, Homo sapiens
ggcaggtgtgagctgtaaagga

SEQ ID NO: 9457120 - DNA, 22 bp, Homo sapiens
ggcaggtgtggagtgttatttt

SEQ ID NO: 9457121 - DNA, 22 bp, Homo sapiens
ggcaggtgtggtgaccagagat

SEQ ID NO: 9457122 - DNA, 22 bp, Homo sapiens
cacatgcataaggataattact

SEQ ID NO: 9457123 - DNA, 22 bp, Homo sapiens
cacatgcagttttccagcagtc

SEQ ID NO: 9457124 - DNA, 22 bp, Homo sapiens
cacatgcagtttacgtcactga

SEQ ID NO: 9457125 - DNA, 22 bp, Homo sapiens
cacatgcataaggataattact

SEQ ID NO: 9457126 - DNA, 22 bp, Homo sapiens
cacatgcatctgtcatgtttgg

SEQ ID NO: 9457127 - DNA, 22 bp, Homo sapiens
cacatgcatctgtcatgtttgg

SEQ ID NO: 9457128 - DNA, 22 bp, Homo sapiens
cacatgcccagaacttctcatt

SEQ ID NO: 9457129 - DNA, 20 bp, Homo sapiens
ggcaggacccggtagggagc

SEQ ID NO: 9457130 - DNA, 22 bp, Homo sapiens
ggcaggactctcaggaccaagc

SEQ ID NO: 9457131 - DNA, 22 bp, Homo sapiens
ggcaggacagtcccagttcaaa

SEQ ID NO: 9457132 - DNA, 22 bp, Homo sapiens
ggcaggacaggggaatgtttgg

SEQ ID NO: 9457133 - DNA, 20 bp, Homo sapiens
ggcaggaccccagtggcatc

SEQ ID NO: 9457134 - DNA, 20 bp, Homo sapiens
ggcaggaccccagtggcatc

SEQ ID NO: 9457135 - DNA, 22 bp, Homo sapiens
ggcaggagaaaggtctcttctt

SEQ ID NO: 9457136 - DNA, 22 bp, Homo sapiens
ggagtgaagtggcgcgatctcg

SEQ ID NO: 9457137 - DNA, 22 bp, Homo sapiens
ggagtgaagtggcgcgatctcg

SEQ ID NO: 9457138 - DNA, 22 bp, Homo sapiens
ggagtgaagcaaataatgctgg

SEQ ID NO: 9457139 - DNA, 22 bp, Homo sapiens
ggagtgaatcactagatgcaga

SEQ ID NO: 9457140 - DNA, 22 bp, Homo sapiens
ggagtgactcacagctgggaca

SEQ ID NO: 9457141 - DNA, 22 bp, Homo sapiens
ggagtgactcacagctgggaca

SEQ ID NO: 9457142 - DNA, 22 bp, Homo sapiens
ggagtgactcacagctgggaca

SEQ ID NO: 9457143 - DNA, 22 bp, Homo sapiens
ggagtgactctcggggccacta

SEQ ID NO: 9457144 - DNA, 22 bp, Homo sapiens
ggagtgactcacagctgggaca

SEQ ID NO: 9457145 - DNA, 22 bp, Homo sapiens
ggagtgactctcggggccacta

SEQ ID NO: 9457146 - DNA, 21 bp, Homo sapiens
ggagtttttctggaagggact

SEQ ID NO: 9457147 - DNA, 22 bp, Homo sapiens
ggataaagtctttaggtggaca

SEQ ID NO: 9457148 - DNA, 23 bp, Homo sapiens
ggataaatctcagcttcttccat

SEQ ID NO: 9457149 - DNA, 23 bp, Homo sapiens
ggataaatctcagcttcttccat

SEQ ID NO: 9457150 - DNA, 22 bp, Homo sapiens
ggagtctgggaattggagagaa

SEQ ID NO: 9457151 - DNA, 22 bp, Homo sapiens
ggagtctgtcacctgtttctct

SEQ ID NO: 9457152 - DNA, 22 bp, Homo sapiens
ggagtctgtgtcttgaagcagt

SEQ ID NO: 9457153 - DNA, 21 bp, Homo sapiens
ggagtctgtggatgctgtttc

SEQ ID NO: 9457154 - DNA, 22 bp, Homo sapiens
ggagtcttggcctgctgagaaa

SEQ ID NO: 9457155 - DNA, 22 bp, Homo sapiens
ggagtctgttttacatgcagga

SEQ ID NO: 9457156 - DNA, 22 bp, Homo sapiens
ggagtctgttttacatgcagga

SEQ ID NO: 9457157 - DNA, 22 bp, Homo sapiens
ggagtctgttttacatgcagga

SEQ ID NO: 9457158 - DNA, 22 bp, Homo sapiens
ggaggtggaggttgcagtgagc

SEQ ID NO: 9457159 - DNA, 22 bp, Homo sapiens
ggaggtggaggttgcagtgagc

SEQ ID NO: 9457160 - DNA, 22 bp, Homo sapiens
ggagtctgcggcagacactgta

SEQ ID NO: 9457161 - DNA, 22 bp, Homo sapiens
ggagtctgattttttatgggtg

SEQ ID NO: 9457162 - DNA, 22 bp, Homo sapiens
ggaggtggaggttgcagtgagc

SEQ ID NO: 9457163 - DNA, 22 bp, Homo sapiens
ggagtctgggaattggagagaa

SEQ ID NO: 9457164 - DNA, 22 bp, Homo sapiens
ggagtctggagtggggcccaag

SEQ ID NO: 9457165 - DNA, 22 bp, Homo sapiens
ggagtctgctcccagacatgat

SEQ ID NO: 9457166 - DNA, 22 bp, Homo sapiens
ggagtctgctcccagacatgat

SEQ ID NO: 9457167 - DNA, 22 bp, Homo sapiens
ggagtctgcggcagacactgta

SEQ ID NO: 9457168 - DNA, 22 bp, Homo sapiens
ggatatgacgagtttggtgatt

SEQ ID NO: 9457169 - DNA, 22 bp, Homo sapiens
ggatcaaagggaacctgttagg

SEQ ID NO: 9457170 - DNA, 19 bp, Homo sapiens
ggataaggttggagtgatc

SEQ ID NO: 9457171 - DNA, 23 bp, Homo sapiens
ggataaatctcagcttcttccat

SEQ ID NO: 9457172 - DNA, 22 bp, Homo sapiens
ggataaagtctttaggtggaca

SEQ ID NO: 9457173 - DNA, 22 bp, Homo sapiens
ggataagaaaattgtaataact

SEQ ID NO: 9457174 - DNA, 22 bp, Homo sapiens
ggatacaactagaagatggcag

SEQ ID NO: 9457175 - DNA, 23 bp, Homo sapiens
ggatacaaagattaatagtagag

SEQ ID NO: 9457176 - DNA, 22 bp, Homo sapiens
ggataatgaaatggtagtggtt

SEQ ID NO: 9457177 - DNA, 22 bp, Homo sapiens
ggatacaactagaagatggcag

SEQ ID NO: 9457178 - DNA, 22 bp, Homo sapiens
ggatacaaggtgttctatcact

SEQ ID NO: 9457179 - DNA, 22 bp, Homo sapiens
ggatcaagaaagtcagatgaag

SEQ ID NO: 9457180 - DNA, 22 bp, Homo sapiens
ggatcagaacgtgatggctgtg

SEQ ID NO: 9457181 - DNA, 22 bp, Homo sapiens
ggatcagaggatcagggacagt

SEQ ID NO: 9457182 - DNA, 22 bp, Homo sapiens
ggatcaggctgaagctaggact

SEQ ID NO: 9457183 - DNA, 22 bp, Homo sapiens
ggatcaggctgaagctaggact

SEQ ID NO: 9457184 - DNA, 19 bp, Homo sapiens
ggatccagaggatctgcca

SEQ ID NO: 9457185 - DNA, 22 bp, Homo sapiens
ggcaggaataaattatggactt

SEQ ID NO: 9457186 - DNA, 22 bp, Homo sapiens
ggcaggaagctcatgtggactg

SEQ ID NO: 9457187 - DNA, 22 bp, Homo sapiens
ggcaggaagtagcagtctgagc

SEQ ID NO: 9457188 - DNA, 22 bp, Homo sapiens
ggcaggaagaggagggtgaact

SEQ ID NO: 9457189 - DNA, 22 bp, Homo sapiens
ggcaggaagcattaaaacgatt

SEQ ID NO: 9457190 - DNA, 22 bp, Homo sapiens
ggcaggaagctcatgtggactg

SEQ ID NO: 9457191 - DNA, 22 bp, Homo sapiens
ggcaggaagaggagggtgaact

SEQ ID NO: 9457192 - DNA, 22 bp, Homo sapiens
ggcaggaagaggagggtgaact

SEQ ID NO: 9457193 - DNA, 22 bp, Homo sapiens
ggcaggaaaacaatgagccagg

SEQ ID NO: 9457194 - DNA, 22 bp, Homo sapiens
ggcaggaaaacaatgagccagg

SEQ ID NO: 9457195 - DNA, 22 bp, Homo sapiens
ggcagctgcaaatctgctctgt

SEQ ID NO: 9457196 - DNA, 22 bp, Homo sapiens
ggcagctgcaaatctgctctgt

SEQ ID NO: 9457197 - DNA, 22 bp, Homo sapiens
ggatccagaggtgaagatggga

SEQ ID NO: 9457198 - DNA, 20 bp, Homo sapiens
ggcgcctggcctcatggctg

SEQ ID NO: 9457199 - DNA, 22 bp, Homo sapiens
ggcgccgcactcggtgcagccg

SEQ ID NO: 9457200 - DNA, 22 bp, Homo sapiens
ggcgctcagtgttgccccagag

SEQ ID NO: 9457201 - DNA, 22 bp, Homo sapiens
ggcgctcagtgttgccccagag

SEQ ID NO: 9457202 - DNA, 22 bp, Homo sapiens
cactgaggtatctgtctctcct

SEQ ID NO: 9457203 - DNA, 22 bp, Homo sapiens
cactgagggcggagcccaggga

SEQ ID NO: 9457204 - DNA, 22 bp, Homo sapiens
cactgagggcggagcccaggga

SEQ ID NO: 9457205 - DNA, 22 bp, Homo sapiens
cactgcaaaggggaaagaagca

SEQ ID NO: 9457206 - DNA, 22 bp, Homo sapiens
cactgattaagtctgctagagg

SEQ ID NO: 9457207 - DNA, 22 bp, Homo sapiens
cactgagttccctgacatttca

SEQ ID NO: 9457208 - DNA, 20 bp, Homo sapiens
cactgaggtgcagctcatgc

SEQ ID NO: 9457209 - DNA, 22 bp, Homo sapiens
cactgaggtttgttaactgagt

SEQ ID NO: 9457210 - DNA, 21 bp, Homo sapiens
cactgaggtcaggggtagggt

SEQ ID NO: 9457211 - DNA, 22 bp, Homo sapiens
ggctccagtttccccttggggc

SEQ ID NO: 9457212 - DNA, 22 bp, Homo sapiens
ggctccagtttccccttggggc

SEQ ID NO: 9457213 - DNA, 22 bp, Homo sapiens
ggctccagtttccccttggggc

SEQ ID NO: 9457214 - DNA, 19 bp, Homo sapiens
ggctcctggggctcagccc

SEQ ID NO: 9457215 - DNA, 19 bp, Homo sapiens
ggctcctggggctcagccc

SEQ ID NO: 9457216 - DNA, 19 bp, Homo sapiens
ggctcctggggctcagccc

SEQ ID NO: 9457217 - DNA, 20 bp, Homo sapiens
cactgccctccagcctgagc

SEQ ID NO: 9457218 - DNA, 22 bp, Homo sapiens
cactgcccaggacctgccaccc

SEQ ID NO: 9457219 - DNA, 19 bp, Homo sapiens
ggctcctgtggctgcagcc

SEQ ID NO: 9457220 - DNA, 19 bp, Homo sapiens
ggctcctgtggctgcagcc

SEQ ID NO: 9457221 - DNA, 22 bp, Homo sapiens
cactgcccagcgtcttaggcac

SEQ ID NO: 9457222 - DNA, 22 bp, Homo sapiens
ggctcctgtcccctcagctgct

SEQ ID NO: 9457223 - DNA, 22 bp, Homo sapiens
ggctcctgggggtgctcctgcc

SEQ ID NO: 9457224 - DNA, 16 bp, Homo sapiens
ggctcctggttccttc

SEQ ID NO: 9457225 - DNA, 22 bp, Homo sapiens
ggctcctgggggtgctcctgcc

SEQ ID NO: 9457226 - DNA, 22 bp, Homo sapiens
ggctcctgggggtgctcctgcc

SEQ ID NO: 9457227 - DNA, 22 bp, Homo sapiens
ggctcctgggggtgctcctgcc

SEQ ID NO: 9457228 - DNA, 22 bp, Homo sapiens
ggctcctgtggcaagacagctt

SEQ ID NO: 9457229 - DNA, 22 bp, Homo sapiens
ggctcctgtggcaagacagctt

SEQ ID NO: 9457230 - DNA, 18 bp, Homo sapiens
ggctcctgtgatcacatt

SEQ ID NO: 9457231 - DNA, 22 bp, Homo sapiens
ggctgcagatagccagccacca

SEQ ID NO: 9457232 - DNA, 22 bp, Homo sapiens
ggctgcagattgtagtctgtta

SEQ ID NO: 9457233 - DNA, 22 bp, Homo sapiens
ggctgcagattgtagtctgtta

SEQ ID NO: 9457234 - DNA, 22 bp, Homo sapiens
ggctgcagaggtcactttatag

SEQ ID NO: 9457235 - DNA, 22 bp, Homo sapiens
ggctgcagatagccagccacca

SEQ ID NO: 9457236 - DNA, 22 bp, Homo sapiens
ggctgcagatagccagccacca

SEQ ID NO: 9457237 - DNA, 22 bp, Homo sapiens
ggctgcagaggcgatctgaggt

SEQ ID NO: 9457238 - DNA, 22 bp, Homo sapiens
ggctgcagaggcgatctgaggt

SEQ ID NO: 9457239 - DNA, 22 bp, Homo sapiens
ggctgaggctcatgccatcttg

SEQ ID NO: 9457240 - DNA, 22 bp, Homo sapiens
cactgcctctgcctcctgggtt

SEQ ID NO: 9457241 - DNA, 22 bp, Homo sapiens
ggctgaggctcatgccatcttg

SEQ ID NO: 9457242 - DNA, 22 bp, Homo sapiens
cactgcctccccaggctccaca

SEQ ID NO: 9457243 - DNA, 22 bp, Homo sapiens
cactgcctccccaggctccaca

SEQ ID NO: 9457244 - DNA, 22 bp, Homo sapiens
cactgtctattaatataactta

SEQ ID NO: 9457245 - DNA, 22 bp, Homo sapiens
cactgtctattaatataactta

SEQ ID NO: 9457246 - DNA, 22 bp, Homo sapiens
cactgtccctgtttcctggaaa

SEQ ID NO: 9457247 - DNA, 22 bp, Homo sapiens
ggctgcagcggattggggattg

SEQ ID NO: 9457248 - DNA, 22 bp, Homo sapiens
ggctgcagccctcgcctagcca

SEQ ID NO: 9457249 - DNA, 22 bp, Homo sapiens
ggctgcagccctcgcctagcca

SEQ ID NO: 9457250 - DNA, 22 bp, Homo sapiens
ggctgcagccctcgcctagcca

SEQ ID NO: 9457251 - DNA, 22 bp, Homo sapiens
ggctgcagattgtagtctgtta

SEQ ID NO: 9457252 - DNA, 22 bp, Homo sapiens
ggctgcagattgtagtctgtta

SEQ ID NO: 9457253 - DNA, 22 bp, Homo sapiens
cactgtctgagctggtgattag

SEQ ID NO: 9457254 - DNA, 22 bp, Homo sapiens
cactgtctgagctggtgattag

SEQ ID NO: 9457255 - DNA, 22 bp, Homo sapiens
cactgtctcctagggggacttc

SEQ ID NO: 9457256 - DNA, 22 bp, Homo sapiens
cactgtctgcttcgactcttca

SEQ ID NO: 9457257 - DNA, 22 bp, Homo sapiens
cactgtctgggacatgtggtct

SEQ ID NO: 9457258 - DNA, 22 bp, Homo sapiens
cactgtctgtgtgtccttgggg

SEQ ID NO: 9457259 - DNA, 22 bp, Homo sapiens
cactgtctgtgtgtccttgggg

SEQ ID NO: 9457260 - DNA, 22 bp, Homo sapiens
cactgtcttcagtttcactgca

SEQ ID NO: 9457261 - DNA, 22 bp, Homo sapiens
cactgtcttcagtttcactgca

SEQ ID NO: 9457262 - DNA, 22 bp, Homo sapiens
cactgtcttcagtttcactgca

SEQ ID NO: 9457263 - DNA, 22 bp, Homo sapiens
cactgtcttcagtttcactgca

SEQ ID NO: 9457264 - DNA, 22 bp, Homo sapiens
cactgtcttgattactatgggt

SEQ ID NO: 9457265 - DNA, 22 bp, Homo sapiens
cactgtcttgattactatgggt

SEQ ID NO: 9457266 - DNA, 22 bp, Homo sapiens
cactgtcttttgtgaagacaat

SEQ ID NO: 9457267 - DNA, 22 bp, Homo sapiens
ggctgcctcagatttgctgact

SEQ ID NO: 9457268 - DNA, 22 bp, Homo sapiens
ggctgccttgaccctggctccg

SEQ ID NO: 9457269 - DNA, 22 bp, Homo sapiens
ggctgccttgaccctggctccg

SEQ ID NO: 9457270 - DNA, 22 bp, Homo sapiens
ggctgccttgaccctggctccg

SEQ ID NO: 9457271 - DNA, 22 bp, Homo sapiens
ggctgccttgaccctggctccg

SEQ ID NO: 9457272 - DNA, 22 bp, Homo sapiens
ggctgccttgggggttgtcatt

SEQ ID NO: 9457273 - DNA, 22 bp, Homo sapiens
cactgtcttttgtgaagacaat

SEQ ID NO: 9457274 - DNA, 22 bp, Homo sapiens
cactgtcttttgtgaagacaat

SEQ ID NO: 9457275 - DNA, 22 bp, Homo sapiens
ggctgcctcaaagctcaagctc

SEQ ID NO: 9457276 - DNA, 22 bp, Homo sapiens
ggctgcctcaaagctcaagctc

SEQ ID NO: 9457277 - DNA, 19 bp, Homo sapiens
ggctgcctttccttaccag

SEQ ID NO: 9457278 - DNA, 19 bp, Homo sapiens
ggctgcctttccttaccag

SEQ ID NO: 9457279 - DNA, 19 bp, Homo sapiens
ggctgcctttccttaccag

SEQ ID NO: 9457280 - DNA, 22 bp, Homo sapiens
ggctgcctttagaacggatgct

SEQ ID NO: 9457281 - DNA, 22 bp, Homo sapiens
ggctgcctttagaacggatgct

SEQ ID NO: 9457282 - DNA, 22 bp, Homo sapiens
ggctgccttgggggttgtcatt

SEQ ID NO: 9457283 - DNA, 22 bp, Homo sapiens
ggctgctcaaggactctgatcg

SEQ ID NO: 9457284 - DNA, 22 bp, Homo sapiens
ggctgctcaaggactctgatcg

SEQ ID NO: 9457285 - DNA, 22 bp, Homo sapiens
ggctgcggccgcgggtctgtgc

SEQ ID NO: 9457286 - DNA, 19 bp, Homo sapiens
ggctgcctttccttaccag

SEQ ID NO: 9457287 - DNA, 22 bp, Homo sapiens
ggctgctcacgcagccctccct

SEQ ID NO: 9457288 - DNA, 18 bp, Homo sapiens
ggctgctcctctccctac

SEQ ID NO: 9457289 - DNA, 18 bp, Homo sapiens
ggctgctcctctccctac

SEQ ID NO: 9457290 - DNA, 22 bp, Homo sapiens
ggctgctcaaggactctgatcg

SEQ ID NO: 9457291 - DNA, 18 bp, Homo sapiens
ggctgctcctctccctac

SEQ ID NO: 9457292 - DNA, 18 bp, Homo sapiens
ggctgctcgctctccccg

SEQ ID NO: 9457293 - DNA, 19 bp, Homo sapiens
cagaacagctgggaagaga

SEQ ID NO: 9457294 - DNA, 22 bp, Homo sapiens
cagaacagagtcaaaagtatgt

SEQ ID NO: 9457295 - DNA, 22 bp, Homo sapiens
cagaacagagtcaaaagtatgt

SEQ ID NO: 9457296 - DNA, 22 bp, Homo sapiens
cagaacagagtcaaaagtatgt

SEQ ID NO: 9457297 - DNA, 22 bp, Homo sapiens
cagaacagagcctgaatctctc

SEQ ID NO: 9457298 - DNA, 19 bp, Homo sapiens
cagaacagaggtcatggcc

SEQ ID NO: 9457299 - DNA, 22 bp, Homo sapiens
cagaacagagtcaaaagtatgt

SEQ ID NO: 9457300 - DNA, 22 bp, Homo sapiens
cagaacagagtcaaaagtatgt

SEQ ID NO: 9457301 - DNA, 22 bp, Homo sapiens
cagaacagagtcaaaagtatgt

SEQ ID NO: 9457302 - DNA, 22 bp, Homo sapiens
cagaacagtacctagcacatag

SEQ ID NO: 9457303 - DNA, 23 bp, Homo sapiens
cagaacagtaaaagatgccatgg

SEQ ID NO: 9457304 - DNA, 22 bp, Homo sapiens
cagaacaggtcatgcttgctgt

SEQ ID NO: 9457305 - DNA, 19 bp, Homo sapiens
cagaacaggaccaggggcc

SEQ ID NO: 9457306 - DNA, 22 bp, Homo sapiens
cagaagaggactgggtagctca

SEQ ID NO: 9457307 - DNA, 22 bp, Homo sapiens
cagaagagatgaaatagtatta

SEQ ID NO: 9457308 - DNA, 22 bp, Homo sapiens
cagaagagatgaaatagtatta

SEQ ID NO: 9457309 - DNA, 22 bp, Homo sapiens
cagaagaggactgggtagctca

SEQ ID NO: 9457310 - DNA, 22 bp, Homo sapiens
cagaagagtagctgaacaagtt

SEQ ID NO: 9457311 - DNA, 22 bp, Homo sapiens
cagaagagtagctgaacaagtt

SEQ ID NO: 9457312 - DNA, 22 bp, Homo sapiens
cagaagaggactgggtagctca

SEQ ID NO: 9457313 - DNA, 22 bp, Homo sapiens
cagaagaggactgggtagctca

SEQ ID NO: 9457314 - DNA, 22 bp, Homo sapiens
cagaagaggactgggtagctca

SEQ ID NO: 9457315 - DNA, 20 bp, Homo sapiens
cagaacatgagcatcgagcc

SEQ ID NO: 9457316 - DNA, 22 bp, Homo sapiens
cagaacatccccactgctacct

SEQ ID NO: 9457317 - DNA, 22 bp, Homo sapiens
cagaacattcactcatatgtgg

SEQ ID NO: 9457318 - DNA, 22 bp, Homo sapiens
cagaacagtcgcctgcatggat

SEQ ID NO: 9457319 - DNA, 22 bp, Homo sapiens
cagaacagtcgcctgcatggat

SEQ ID NO: 9457320 - DNA, 20 bp, Homo sapiens
cagaacagtctgagaggcca

SEQ ID NO: 9457321 - DNA, 20 bp, Homo sapiens
cagaacagtctgagaggcca

SEQ ID NO: 9457322 - DNA, 20 bp, Homo sapiens
ggcttctttacatctgtgtt

SEQ ID NO: 9457323 - DNA, 22 bp, Homo sapiens
ggcttctttttagtaaatgtca

SEQ ID NO: 9457324 - DNA, 22 bp, Homo sapiens
ggcttcttgtgtgtcaggctct

SEQ ID NO: 9457325 - DNA, 22 bp, Homo sapiens
ggcttcttgctattttccaatg

SEQ ID NO: 9457326 - DNA, 22 bp, Homo sapiens
ggcttcttcctggctcctatta

SEQ ID NO: 9457327 - DNA, 22 bp, Homo sapiens
ggcttcttcctggctcctatta

SEQ ID NO: 9457328 - DNA, 17 bp, Homo sapiens
ggcttcagggagctggg

SEQ ID NO: 9457329 - DNA, 22 bp, Homo sapiens
ggctgggagctggacaggccgg

SEQ ID NO: 9457330 - DNA, 22 bp, Homo sapiens
ggcttggaaattgcaggacaca

SEQ ID NO: 9457331 - DNA, 22 bp, Homo sapiens
ggcttgcacacagcctcagttt

SEQ ID NO: 9457332 - DNA, 22 bp, Homo sapiens
ggcttgagacccgggagccaga

SEQ ID NO: 9457333 - DNA, 22 bp, Homo sapiens
ggcttgagacccgggagccaga

SEQ ID NO: 9457334 - DNA, 22 bp, Homo sapiens
ggcttgagacccgggagccaga

SEQ ID NO: 9457335 - DNA, 22 bp, Homo sapiens
ggcttggaccagtcacagtggt

SEQ ID NO: 9457336 - DNA, 22 bp, Homo sapiens
cagaacagacttaacagggctg

SEQ ID NO: 9457337 - DNA, 22 bp, Homo sapiens
cagaacagacttaacagggctg

SEQ ID NO: 9457338 - DNA, 23 bp, Homo sapiens
ggcttggccctcaagggccctgc

SEQ ID NO: 9457339 - DNA, 22 bp, Homo sapiens
cagaacagacttaacagggctg

SEQ ID NO: 9457340 - DNA, 22 bp, Homo sapiens
cagaacagacttaacagggctg

SEQ ID NO: 9457341 - DNA, 22 bp, Homo sapiens
ggctgctgtgacctcaggtgat

SEQ ID NO: 9457342 - DNA, 22 bp, Homo sapiens
cagaaatagacaatggcagtgg

SEQ ID NO: 9457343 - DNA, 22 bp, Homo sapiens
cagaaatagacaatggcagtgg

SEQ ID NO: 9457344 - DNA, 22 bp, Homo sapiens
cagaaatgcctgcttctctctc

SEQ ID NO: 9457345 - DNA, 22 bp, Homo sapiens
cagaaatgtactgacatgcagt

SEQ ID NO: 9457346 - DNA, 22 bp, Homo sapiens
cagaaatgtactgacatgcagt

SEQ ID NO: 9457347 - DNA, 22 bp, Homo sapiens
cagaaatggtctgttcagctta

SEQ ID NO: 9457348 - DNA, 22 bp, Homo sapiens
cagaaatggagcccaggaatct

SEQ ID NO: 9457349 - DNA, 22 bp, Homo sapiens
cagaaatggagcccaggaatct

SEQ ID NO: 9457350 - DNA, 22 bp, Homo sapiens
cagaaatggaattttccatcac

SEQ ID NO: 9457351 - DNA, 22 bp, Homo sapiens
ggctgctgggtcatgatgcaga

SEQ ID NO: 9457352 - DNA, 22 bp, Homo sapiens
ggctgctgggtcatgatgcaga

SEQ ID NO: 9457353 - DNA, 22 bp, Homo sapiens
ggctgctgggtcatgatgcaga

SEQ ID NO: 9457354 - DNA, 22 bp, Homo sapiens
ggctgctgggtcatgatgcaga

SEQ ID NO: 9457355 - DNA, 22 bp, Homo sapiens
ggctgctgggtcatgatgcaga

SEQ ID NO: 9457356 - DNA, 19 bp, Homo sapiens
ggctgctggttacagaggc

SEQ ID NO: 9457357 - DNA, 22 bp, Homo sapiens
ggctgctgtactgatgtcagtt

SEQ ID NO: 9457358 - DNA, 22 bp, Homo sapiens
ggctgctgtactgatgtcagtt

SEQ ID NO: 9457359 - DNA, 22 bp, Homo sapiens
ggctgctgtactgatgtcagtt

SEQ ID NO: 9457360 - DNA, 21 bp, Homo sapiens
ggctgctgtcaccgctgtcac

SEQ ID NO: 9457361 - DNA, 22 bp, Homo sapiens
ggctgctgtactgatgtcagtt

SEQ ID NO: 9457362 - DNA, 20 bp, Homo sapiens
ggctgctggtttggctctgt

SEQ ID NO: 9457363 - DNA, 20 bp, Homo sapiens
ggctgctggtttggctctgt

SEQ ID NO: 9457364 - DNA, 19 bp, Homo sapiens
ggctgctggttacagaggc

SEQ ID NO: 9457365 - DNA, 19 bp, Homo sapiens
ggctgctggttacagaggc

SEQ ID NO: 9457366 - DNA, 20 bp, Homo sapiens
ggctgctggtttggctctgt

SEQ ID NO: 9457367 - DNA, 22 bp, Homo sapiens
ggctggctttctctccgcacct

SEQ ID NO: 9457368 - DNA, 22 bp, Homo sapiens
ggctggcttggtgagctgtcac

SEQ ID NO: 9457369 - DNA, 22 bp, Homo sapiens
ggctggctttctctccgcacct

SEQ ID NO: 9457370 - DNA, 22 bp, Homo sapiens
ggctgggacgatgaggattagt

SEQ ID NO: 9457371 - DNA, 22 bp, Homo sapiens
ggctgggagccccacagagtca

SEQ ID NO: 9457372 - DNA, 22 bp, Homo sapiens
ggctgggagccccacagagtca

SEQ ID NO: 9457373 - DNA, 23 bp, Homo sapiens
ggctgggagctccgggtgcacgt

SEQ ID NO: 9457374 - DNA, 23 bp, Homo sapiens
ggctgggagctccgggtgcacgt

SEQ ID NO: 9457375 - DNA, 23 bp, Homo sapiens
ggctgggagctccgggtgcacgt

SEQ ID NO: 9457376 - DNA, 23 bp, Homo sapiens
ggctgggagctccgggtgcacgt

SEQ ID NO: 9457377 - DNA, 22 bp, Homo sapiens
cagaaatgtttatgcttttgaa

SEQ ID NO: 9457378 - DNA, 22 bp, Homo sapiens
cagaaatgtttgttaatattgt

SEQ ID NO: 9457379 - DNA, 22 bp, Homo sapiens
cagaaatgtttgttaatattgt

SEQ ID NO: 9457380 - DNA, 22 bp, Homo sapiens
cagaaatgtttgttaatattgt

SEQ ID NO: 9457381 - DNA, 22 bp, Homo sapiens
cagaaatgttctaatgattcag

SEQ ID NO: 9457382 - DNA, 22 bp, Homo sapiens
cagaaatgtgatgtacacacac

SEQ ID NO: 9457383 - DNA, 22 bp, Homo sapiens
cagaaatgtactgacatgcagt

SEQ ID NO: 9457384 - DNA, 22 bp, Homo sapiens
cagaaatgtactgacatgcagt

SEQ ID NO: 9457385 - DNA, 22 bp, Homo sapiens
cagaaatgtactgacatgcagt

SEQ ID NO: 9457386 - DNA, 22 bp, Homo sapiens
cagaacacaggctaaactgaga

SEQ ID NO: 9457387 - DNA, 22 bp, Homo sapiens
cagaaattggaatagagaaata

SEQ ID NO: 9457388 - DNA, 22 bp, Homo sapiens
cagaacagaagtaaaatttacc

SEQ ID NO: 9457389 - DNA, 22 bp, Homo sapiens
ggaggagcacttctgagctcag

SEQ ID NO: 9457390 - DNA, 22 bp, Homo sapiens
ggaggagattcccctctcactt

SEQ ID NO: 9457391 - DNA, 22 bp, Homo sapiens
ggaggagacggagtgattagtg

SEQ ID NO: 9457392 - DNA, 22 bp, Homo sapiens
ggaggagacggagtgattagtg

SEQ ID NO: 9457393 - DNA, 22 bp, Homo sapiens
ggaggagaccctgtgtcagttt

SEQ ID NO: 9457394 - DNA, 22 bp, Homo sapiens
ggaggagacagtaaaaagcacg

SEQ ID NO: 9457395 - DNA, 22 bp, Homo sapiens
ggaggagagaggttgcaaacac

SEQ ID NO: 9457396 - DNA, 22 bp, Homo sapiens
ggaggagacagtaaaaagcacg

SEQ ID NO: 9457397 - DNA, 22 bp, Homo sapiens
ggaggagacagtaaaaagcacg

SEQ ID NO: 9457398 - DNA, 22 bp, Homo sapiens
ggagctggccgcctatgtgcag

SEQ ID NO: 9457399 - DNA, 22 bp, Homo sapiens
ggagcaggagtctcttgaattt

SEQ ID NO: 9457400 - DNA, 20 bp, Homo sapiens
ggagctggcatccagcctct

SEQ ID NO: 9457401 - DNA, 22 bp, Homo sapiens
ggagcagcctgtgtagacgggg

SEQ ID NO: 9457402 - DNA, 22 bp, Homo sapiens
ggagcagcctgtgtagacgggg

SEQ ID NO: 9457403 - DNA, 22 bp, Homo sapiens
ggagcagccgcgtctcagggca

SEQ ID NO: 9457404 - DNA, 22 bp, Homo sapiens
ggagcagcctgtgtagacgggg

SEQ ID NO: 9457405 - DNA, 22 bp, Homo sapiens
ggagcagcttgcatgctcaggg

SEQ ID NO: 9457406 - DNA, 22 bp, Homo sapiens
ggagcagcttgcatgctcaggg

SEQ ID NO: 9457407 - DNA, 22 bp, Homo sapiens
ggagcagcttgcatgctcaggg

SEQ ID NO: 9457408 - DNA, 22 bp, Homo sapiens
ggagcagcttgcatgctcaggg

SEQ ID NO: 9457409 - DNA, 22 bp, Homo sapiens
ggagcagcttgcatgctcaggg

SEQ ID NO: 9457410 - DNA, 22 bp, Homo sapiens
ggagcaggagtctcttgaattt

SEQ ID NO: 9457411 - DNA, 22 bp, Homo sapiens
ggagcaggagtctcttgaattt

SEQ ID NO: 9457412 - DNA, 22 bp, Homo sapiens
ggagcagccacgtctcagggca

SEQ ID NO: 9457413 - DNA, 22 bp, Homo sapiens
ggagcagccacgtctcagggca

SEQ ID NO: 9457414 - DNA, 22 bp, Homo sapiens
ggagcagcactgccacacagag

SEQ ID NO: 9457415 - DNA, 22 bp, Homo sapiens
ggagcagccacgtctcagggca

SEQ ID NO: 9457416 - DNA, 22 bp, Homo sapiens
ggagcagccgcgtctcagggca

SEQ ID NO: 9457417 - DNA, 22 bp, Homo sapiens
ggagcagccgcgtctcagggca

SEQ ID NO: 9457418 - DNA, 22 bp, Homo sapiens
ggagcagccacgtctcagggca

SEQ ID NO: 9457419 - DNA, 22 bp, Homo sapiens
ggagcagccgcgtctcagggca

SEQ ID NO: 9457420 - DNA, 22 bp, Homo sapiens
cacagccctgcgccccagtttg

SEQ ID NO: 9457421 - DNA, 22 bp, Homo sapiens
cacagcccccttgacactctgg

SEQ ID NO: 9457422 - DNA, 22 bp, Homo sapiens
cacagcccccttgacactctgg

SEQ ID NO: 9457423 - DNA, 19 bp, Homo sapiens
cacagccacagccaacctc

SEQ ID NO: 9457424 - DNA, 22 bp, Homo sapiens
cacagcattgccttccaaaagg

SEQ ID NO: 9457425 - DNA, 22 bp, Homo sapiens
cacagcattgccttccaaaagg

SEQ ID NO: 9457426 - DNA, 22 bp, Homo sapiens
cacagcataatgaaatatactt

SEQ ID NO: 9457427 - DNA, 22 bp, Homo sapiens
cacagcataatgaaatatactt

SEQ ID NO: 9457428 - DNA, 22 bp, Homo sapiens
cacagcaggtgcttaatgatta

SEQ ID NO: 9457429 - DNA, 21 bp, Homo sapiens
cacagcagggttcctgggctc

SEQ ID NO: 9457430 - DNA, 22 bp, Homo sapiens
cacagcagtctttcactaaata

SEQ ID NO: 9457431 - DNA, 22 bp, Homo sapiens
cacagcagtctttcactaaata

SEQ ID NO: 9457432 - DNA, 22 bp, Homo sapiens
cacagcagtctttcactaaata

SEQ ID NO: 9457433 - DNA, 22 bp, Homo sapiens
cacagcagtctttcactaaata

SEQ ID NO: 9457434 - DNA, 22 bp, Homo sapiens
cacagcagggcatggctgttgt

SEQ ID NO: 9457435 - DNA, 22 bp, Homo sapiens
cacagcagggatgaatggagtg

SEQ ID NO: 9457436 - DNA, 22 bp, Homo sapiens
cacagcaggcagaacgtgggca

SEQ ID NO: 9457437 - DNA, 22 bp, Homo sapiens
cacagcaggcactatacagggc

SEQ ID NO: 9457438 - DNA, 22 bp, Homo sapiens
ggaggggcagccatggaactcc

SEQ ID NO: 9457439 - DNA, 22 bp, Homo sapiens
ggaggggcatagttcaccatca

SEQ ID NO: 9457440 - DNA, 22 bp, Homo sapiens
ggaggggcatagttcaccatca

SEQ ID NO: 9457441 - DNA, 22 bp, Homo sapiens
ggaggggccggctgcctgccac

SEQ ID NO: 9457442 - DNA, 22 bp, Homo sapiens
ggaggggccggctgcctgccac

SEQ ID NO: 9457443 - DNA, 22 bp, Homo sapiens
cacaggagattgatctattggt

SEQ ID NO: 9457444 - DNA, 22 bp, Homo sapiens
cacaggagattgatctattggt

SEQ ID NO: 9457445 - DNA, 22 bp, Homo sapiens
cacaggagattgatctattggt

SEQ ID NO: 9457446 - DNA, 18 bp, Homo sapiens
cacaggagatgacctgac

SEQ ID NO: 9457447 - DNA, 18 bp, Homo sapiens
cacaggagatgacctgac

SEQ ID NO: 9457448 - DNA, 18 bp, Homo sapiens
cacaggagatgacctgac

SEQ ID NO: 9457449 - DNA, 22 bp, Homo sapiens
cacaggagaggttaatgggggc

SEQ ID NO: 9457450 - DNA, 22 bp, Homo sapiens
cacaggagagctgggaggtgcc

SEQ ID NO: 9457451 - DNA, 22 bp, Homo sapiens
cacaggagaggttaatgggggc

SEQ ID NO: 9457452 - DNA, 22 bp, Homo sapiens
cacaggagaggttaatgggggc

SEQ ID NO: 9457453 - DNA, 22 bp, Homo sapiens
cacaggagaaaggggaagctcg

SEQ ID NO: 9457454 - DNA, 22 bp, Homo sapiens
cacaggagaaaggggaagctcg

SEQ ID NO: 9457455 - DNA, 22 bp, Homo sapiens
ggaggggccggctgcctgccac

SEQ ID NO: 9457456 - DNA, 22 bp, Homo sapiens
cacaggagaacccacagattct

SEQ ID NO: 9457457 - DNA, 22 bp, Homo sapiens
cacaggagagctgggaggtgcc

SEQ ID NO: 9457458 - DNA, 22 bp, Homo sapiens
cacaggagagctgggaggtgcc

SEQ ID NO: 9457459 - DNA, 22 bp, Homo sapiens
cacaggagagctgggaggtgcc

SEQ ID NO: 9457460 - DNA, 22 bp, Homo sapiens
cacagccttactgagatccact

SEQ ID NO: 9457461 - DNA, 22 bp, Homo sapiens
cacagccttgagcgaggacaag

SEQ ID NO: 9457462 - DNA, 22 bp, Homo sapiens
cacagcctcctctggctcacgg

SEQ ID NO: 9457463 - DNA, 22 bp, Homo sapiens
cacagcctcctctggctcacgg

SEQ ID NO: 9457464 - DNA, 22 bp, Homo sapiens
cacagcctccttcagagagcat

SEQ ID NO: 9457465 - DNA, 22 bp, Homo sapiens
cacagcctccttcagagagcat

SEQ ID NO: 9457466 - DNA, 22 bp, Homo sapiens
cacagctacctgcatgcctgct

SEQ ID NO: 9457467 - DNA, 22 bp, Homo sapiens
cacagctagatggatagataga

SEQ ID NO: 9457468 - DNA, 22 bp, Homo sapiens
cacagcgccttccccgggagcg

SEQ ID NO: 9457469 - DNA, 22 bp, Homo sapiens
cacagcctttagggtacacaca

SEQ ID NO: 9457470 - DNA, 22 bp, Homo sapiens
cacagcctttagggtacacaca

SEQ ID NO: 9457471 - DNA, 22 bp, Homo sapiens
cacagccttgagcgaggacaag

SEQ ID NO: 9457472 - DNA, 22 bp, Homo sapiens
ggaggggatggtttgaccctgg

SEQ ID NO: 9457473 - DNA, 22 bp, Homo sapiens
ggaggggatggtttgaccctgg

SEQ ID NO: 9457474 - DNA, 22 bp, Homo sapiens
ggaggggatggtttgaccctgg

SEQ ID NO: 9457475 - DNA, 22 bp, Homo sapiens
ggaggggatggtttgaccctgg

SEQ ID NO: 9457476 - DNA, 22 bp, Homo sapiens
ggaggggatttagtagatgcta

SEQ ID NO: 9457477 - DNA, 22 bp, Homo sapiens
ggaggggatttagtagatgcta

SEQ ID NO: 9457478 - DNA, 22 bp, Homo sapiens
ggaggggatttagtagatgcta

SEQ ID NO: 9457479 - DNA, 22 bp, Homo sapiens
ggaggggatttagtagatgcta

SEQ ID NO: 9457480 - DNA, 19 bp, Homo sapiens
cacagctctgctcagggaa

SEQ ID NO: 9457481 - DNA, 22 bp, Homo sapiens
cacagctaggaggaaagcagag

SEQ ID NO: 9457482 - DNA, 22 bp, Homo sapiens
ggagggagtttcattcctgccc

SEQ ID NO: 9457483 - DNA, 22 bp, Homo sapiens
cacagctgaagtagccatgtgg

SEQ ID NO: 9457484 - DNA, 22 bp, Homo sapiens
ggagggcaacttttcagtaggt

SEQ ID NO: 9457485 - DNA, 22 bp, Homo sapiens
ggacagagggttgacagagtat

SEQ ID NO: 9457486 - DNA, 22 bp, Homo sapiens
ggacagcacagctcttgacaac

SEQ ID NO: 9457487 - DNA, 22 bp, Homo sapiens
ggacacagataatcacacagat

SEQ ID NO: 9457488 - DNA, 22 bp, Homo sapiens
ggacagagggttgacagagtat

SEQ ID NO: 9457489 - DNA, 23 bp, Homo sapiens
ggacacagagataagtgagacaa

SEQ ID NO: 9457490 - DNA, 22 bp, Homo sapiens
ggacacagacctttctgttcta

SEQ ID NO: 9457491 - DNA, 19 bp, Homo sapiens
ggacacagaaagctgcatt

SEQ ID NO: 9457492 - DNA, 19 bp, Homo sapiens
ggacacagaaagctgcatt

SEQ ID NO: 9457493 - DNA, 22 bp, Homo sapiens
ggacaagcctgtgagtgggttt

SEQ ID NO: 9457494 - DNA, 22 bp, Homo sapiens
ggacaagtggcccggtgtgtta

SEQ ID NO: 9457495 - DNA, 22 bp, Homo sapiens
ggacaaattccctatttgcatg

SEQ ID NO: 9457496 - DNA, 22 bp, Homo sapiens
ggacaagcctcagacaaaactc

SEQ ID NO: 9457497 - DNA, 22 bp, Homo sapiens
ggacaaaggtagacagtctctg

SEQ ID NO: 9457498 - DNA, 22 bp, Homo sapiens
ggacaaagggtggagcctctga

SEQ ID NO: 9457499 - DNA, 22 bp, Homo sapiens
ggacaaagggtggagcctctga

SEQ ID NO: 9457500 - DNA, 22 bp, Homo sapiens
ggaaggggtcacctcctgatga

SEQ ID NO: 9457501 - DNA, 22 bp, Homo sapiens
ggaaggggtcacctcctgatga

SEQ ID NO: 9457502 - DNA, 22 bp, Homo sapiens
ggaagagaggttcagccctaag

SEQ ID NO: 9457503 - DNA, 22 bp, Homo sapiens
ggaagagaggttcagccctaag

SEQ ID NO: 9457504 - DNA, 22 bp, Homo sapiens
ggaagagaggttcagccctaag

SEQ ID NO: 9457505 - DNA, 22 bp, Homo sapiens
ggaagagattctttacattcat

SEQ ID NO: 9457506 - DNA, 22 bp, Homo sapiens
ggaagagattctttacattcat

SEQ ID NO: 9457507 - DNA, 19 bp, Homo sapiens
ggaagagaggaaaggtgga

SEQ ID NO: 9457508 - DNA, 22 bp, Homo sapiens
ggaagagagggctgggcctcaa

SEQ ID NO: 9457509 - DNA, 22 bp, Homo sapiens
ggaagagagggctgggcctcaa

SEQ ID NO: 9457510 - DNA, 22 bp, Homo sapiens
ggaagagagggctgggcctcaa

SEQ ID NO: 9457511 - DNA, 19 bp, Homo sapiens
ggaagagaggaaaggtgga

SEQ ID NO: 9457512 - DNA, 22 bp, Homo sapiens
ggaagagagatcccatagatgt

SEQ ID NO: 9457513 - DNA, 22 bp, Homo sapiens
ggaagagaatttctctcttttt

SEQ ID NO: 9457514 - DNA, 22 bp, Homo sapiens
ggaagagaatttctctcttttt

SEQ ID NO: 9457515 - DNA, 22 bp, Homo sapiens
ggaagagaatttctctcttttt

SEQ ID NO: 9457516 - DNA, 22 bp, Homo sapiens
ggaagagaatgatggctatggg

SEQ ID NO: 9457517 - DNA, 22 bp, Homo sapiens
ggaagagagatcccatagatgt

SEQ ID NO: 9457518 - DNA, 19 bp, Homo sapiens
ggaagagaggaaaggtgga

SEQ ID NO: 9457519 - DNA, 22 bp, Homo sapiens
ggaagagagatcccatagatgt

SEQ ID NO: 9457520 - DNA, 22 bp, Homo sapiens
ggaagactgcatggcatagtga

SEQ ID NO: 9457521 - DNA, 22 bp, Homo sapiens
ggaagactgcatggcatagtga

SEQ ID NO: 9457522 - DNA, 22 bp, Homo sapiens
ggaagagaaatgagtcaagact

SEQ ID NO: 9457523 - DNA, 22 bp, Homo sapiens
ggaagagaaatgagtcaagact

SEQ ID NO: 9457524 - DNA, 22 bp, Homo sapiens
ggaagagaatgatggctatggg

SEQ ID NO: 9457525 - DNA, 22 bp, Homo sapiens
ggaagagaaatgagtcaagact

SEQ ID NO: 9457526 - DNA, 22 bp, Homo sapiens
ggaagagaaatgagtcaagact

SEQ ID NO: 9457527 - DNA, 22 bp, Homo sapiens
ggaacagggatttggcctggtt

SEQ ID NO: 9457528 - DNA, 22 bp, Homo sapiens
ggaacaggaaaggagggatgct

SEQ ID NO: 9457529 - DNA, 22 bp, Homo sapiens
ggaacaggaaaggagggatgct

SEQ ID NO: 9457530 - DNA, 18 bp, Homo sapiens
ggaacagctcagggcagc

SEQ ID NO: 9457531 - DNA, 22 bp, Homo sapiens
ggaacaggaaaggagggatgct

SEQ ID NO: 9457532 - DNA, 22 bp, Homo sapiens
ggaacagactgacttcttgaat

SEQ ID NO: 9457533 - DNA, 23 bp, Homo sapiens
ggagatcagagactagggcagtt

SEQ ID NO: 9457534 - DNA, 22 bp, Homo sapiens
ggagatccaggctgagtctttc

SEQ ID NO: 9457535 - DNA, 22 bp, Homo sapiens
ggagatccaggcaaggccgcag

SEQ ID NO: 9457536 - DNA, 19 bp, Homo sapiens
ggagatcccgctgcagatg

SEQ ID NO: 9457537 - DNA, 22 bp, Homo sapiens
ggagatagacttggtgagccac

SEQ ID NO: 9457538 - DNA, 22 bp, Homo sapiens
ggagatagtccaggtgaaggga

SEQ ID NO: 9457539 - DNA, 22 bp, Homo sapiens
cacagagaatactgctcttgct

SEQ ID NO: 9457540 - DNA, 22 bp, Homo sapiens
cacagagaatgatgagtcactg

SEQ ID NO: 9457541 - DNA, 22 bp, Homo sapiens
cacagagaactgtgggagtgtg

SEQ ID NO: 9457542 - DNA, 22 bp, Homo sapiens
cacagagaactgtgggagtgtg

SEQ ID NO: 9457543 - DNA, 22 bp, Homo sapiens
cacagagaactgtgggagtgtg

SEQ ID NO: 9457544 - DNA, 22 bp, Homo sapiens
cacagagaactgtgggagtgtg

SEQ ID NO: 9457545 - DNA, 22 bp, Homo sapiens
cacagagaactgtgggagtgtg

SEQ ID NO: 9457546 - DNA, 22 bp, Homo sapiens
cacagagaatgatgagtcactg

SEQ ID NO: 9457547 - DNA, 22 bp, Homo sapiens
cacagagaatgatgagtcactg

SEQ ID NO: 9457548 - DNA, 22 bp, Homo sapiens
cacagagaattcccatatgtga

SEQ ID NO: 9457549 - DNA, 22 bp, Homo sapiens
cacagagaattcccatatgtga

SEQ ID NO: 9457550 - DNA, 22 bp, Homo sapiens
cacagagacagaagcacttatg

SEQ ID NO: 9457551 - DNA, 22 bp, Homo sapiens
cacagagacagaagcacttatg

SEQ ID NO: 9457552 - DNA, 22 bp, Homo sapiens
cacagagacagatctattttgc

SEQ ID NO: 9457553 - DNA, 22 bp, Homo sapiens
cacagcaaaggcttcggctgat

SEQ ID NO: 9457554 - DNA, 22 bp, Homo sapiens
cacagcaaagacactctcaact

SEQ ID NO: 9457555 - DNA, 22 bp, Homo sapiens
cacagcaaagacactctcaact

SEQ ID NO: 9457556 - DNA, 22 bp, Homo sapiens
cacagagacagatctattttgc

SEQ ID NO: 9457557 - DNA, 22 bp, Homo sapiens
cacagagacagatctattttgc

SEQ ID NO: 9457558 - DNA, 22 bp, Homo sapiens
cacagagacatgatgtcattgc

SEQ ID NO: 9457559 - DNA, 22 bp, Homo sapiens
cacagcaaagacactctcaact

SEQ ID NO: 9457560 - DNA, 22 bp, Homo sapiens
cacagagacatgatgtcattgc

SEQ ID NO: 9457561 - DNA, 22 bp, Homo sapiens
ggacagcgtggctggtggaggg

SEQ ID NO: 9457562 - DNA, 22 bp, Homo sapiens
ggacagcccatacacatgtctg

SEQ ID NO: 9457563 - DNA, 22 bp, Homo sapiens
ggacagcattctactgtaggca

SEQ ID NO: 9457564 - DNA, 22 bp, Homo sapiens
ggacagctgctttcaggccaca

SEQ ID NO: 9457565 - DNA, 22 bp, Homo sapiens
ggacagctctgccaggagctca

SEQ ID NO: 9457566 - DNA, 22 bp, Homo sapiens
ggacagcattctactgtaggca

SEQ ID NO: 9457567 - DNA, 22 bp, Homo sapiens
ggacagcattctactgtaggca

SEQ ID NO: 9457568 - DNA, 22 bp, Homo sapiens
ggacagcattcctagttccaaa

SEQ ID NO: 9457569 - DNA, 22 bp, Homo sapiens
ggacagcattcctagttccaaa

SEQ ID NO: 9457570 - DNA, 22 bp, Homo sapiens
ggacagcatatcagcagggcag

SEQ ID NO: 9457571 - DNA, 22 bp, Homo sapiens
ggacagcatatcagcagggcag

SEQ ID NO: 9457572 - DNA, 22 bp, Homo sapiens
ggacagcacagctcttgacaac

SEQ ID NO: 9457573 - DNA, 22 bp, Homo sapiens
ggacagcatatcagcagggcag

SEQ ID NO: 9457574 - DNA, 22 bp, Homo sapiens
ggacagcagcctcttacatgaa

SEQ ID NO: 9457575 - DNA, 22 bp, Homo sapiens
ggacagcagcctcttacatgaa

SEQ ID NO: 9457576 - DNA, 22 bp, Homo sapiens
ggagagtggattccagctgtat

SEQ ID NO: 9457577 - DNA, 16 bp, Homo sapiens
ggagagtgtctgcaaa

SEQ ID NO: 9457578 - DNA, 17 bp, Homo sapiens
ggagagtgggaatggcc

SEQ ID NO: 9457579 - DNA, 17 bp, Homo sapiens
ggagagtgggaatggcc

SEQ ID NO: 9457580 - DNA, 22 bp, Homo sapiens
ggacagctgctttcaggccaca

SEQ ID NO: 9457581 - DNA, 22 bp, Homo sapiens
ggagagtctgctggccacagtg

SEQ ID NO: 9457582 - DNA, 16 bp, Homo sapiens
gctggagggaggggtt

SEQ ID NO: 9457583 - DNA, 22 bp, Homo sapiens
gctggcagagagctggtgagga

SEQ ID NO: 9457584 - DNA, 22 bp, Homo sapiens
gctggcagagctctgggctggg

SEQ ID NO: 9457585 - DNA, 22 bp, Homo sapiens
gctggcagagctctgggctggg

SEQ ID NO: 9457586 - DNA, 22 bp, Homo sapiens
gctgaggtggagattgcagtga

SEQ ID NO: 9457587 - DNA, 19 bp, Homo sapiens
gctgaggtggaggaaggag

SEQ ID NO: 9457588 - DNA, 22 bp, Homo sapiens
gctggaggctggagtgcagtgg

SEQ ID NO: 9457589 - DNA, 22 bp, Homo sapiens
gctggaggctggagtgcagtgg

SEQ ID NO: 9457590 - DNA, 19 bp, Homo sapiens
gctgaggtggaggaaggag

SEQ ID NO: 9457591 - DNA, 22 bp, Homo sapiens
gctggcagcattagaccctggg

SEQ ID NO: 9457592 - DNA, 20 bp, Homo sapiens
gctggcagatgtcttgagat

SEQ ID NO: 9457593 - DNA, 22 bp, Homo sapiens
gctggcagccaagtgaagaggg

SEQ ID NO: 9457594 - DNA, 22 bp, Homo sapiens
gctggccagtgtcccagggatc

SEQ ID NO: 9457595 - DNA, 22 bp, Homo sapiens
gctggccagtgtggtgaccacc

SEQ ID NO: 9457596 - DNA, 22 bp, Homo sapiens
caaatttaggtaacagtctgta

SEQ ID NO: 9457597 - DNA, 22 bp, Homo sapiens
caaatttaggtaacagtctgta

SEQ ID NO: 9457598 - DNA, 22 bp, Homo sapiens
caaatttaggtaacagtctgta

SEQ ID NO: 9457599 - DNA, 22 bp, Homo sapiens
gctgaggtaggaggttgcagtg

SEQ ID NO: 9457600 - DNA, 22 bp, Homo sapiens
gctgaggtaggaggttgcagtg

SEQ ID NO: 9457601 - DNA, 22 bp, Homo sapiens
gctgaggtcaggagctgtgggg

SEQ ID NO: 9457602 - DNA, 20 bp, Homo sapiens
gctgaggtcattatgcctca

SEQ ID NO: 9457603 - DNA, 23 bp, Homo sapiens
gctgaggtcctgctgagtggtgg

SEQ ID NO: 9457604 - DNA, 20 bp, Homo sapiens
gctgaggtccctgtggtttt

SEQ ID NO: 9457605 - DNA, 20 bp, Homo sapiens
gctgaggtccctgtggtttt

SEQ ID NO: 9457606 - DNA, 20 bp, Homo sapiens
gctgaggtcattatgcctca

SEQ ID NO: 9457607 - DNA, 23 bp, Homo sapiens
caaattctaggcaggctcttttg

SEQ ID NO: 9457608 - DNA, 20 bp, Homo sapiens
caaattctgttgaatacacc

SEQ ID NO: 9457609 - DNA, 18 bp, Homo sapiens
caaattctcattgatttc

SEQ ID NO: 9457610 - DNA, 22 bp, Homo sapiens
caaatttaagttagaaagcaat

SEQ ID NO: 9457611 - DNA, 22 bp, Homo sapiens
caaatttaagttagaaagcaat

SEQ ID NO: 9457612 - DNA, 22 bp, Homo sapiens
caaatttaagttagaaagcaat

SEQ ID NO: 9457613 - DNA, 20 bp, Homo sapiens
caaattctgttgaatacacc

SEQ ID NO: 9457614 - DNA, 20 bp, Homo sapiens
caaattctgttgaatacacc

SEQ ID NO: 9457615 - DNA, 20 bp, Homo sapiens
caaattctgttgaatacacc

SEQ ID NO: 9457616 - DNA, 22 bp, Homo sapiens
gctgggccttccgattctcaag

SEQ ID NO: 9457617 - DNA, 20 bp, Homo sapiens
gctgggctaccactggccct

SEQ ID NO: 9457618 - DNA, 20 bp, Homo sapiens
gctgggctaccactggccct

SEQ ID NO: 9457619 - DNA, 22 bp, Homo sapiens
gctgggccgacctgggctgcag

SEQ ID NO: 9457620 - DNA, 22 bp, Homo sapiens
gctgggccgacctgggctgcag

SEQ ID NO: 9457621 - DNA, 21 bp, Homo sapiens
gctgggcctgtacttgccctg

SEQ ID NO: 9457622 - DNA, 21 bp, Homo sapiens
gctgggcctgtacttgccctg

SEQ ID NO: 9457623 - DNA, 22 bp, Homo sapiens
gctgggccctgggtgccctagc

SEQ ID NO: 9457624 - DNA, 22 bp, Homo sapiens
gctgggccgacctgggctgcag

SEQ ID NO: 9457625 - DNA, 22 bp, Homo sapiens
gctgggccccttgaaaggcgtc

SEQ ID NO: 9457626 - DNA, 22 bp, Homo sapiens
gctgggagccgtacctgtcacg

SEQ ID NO: 9457627 - DNA, 22 bp, Homo sapiens
gctgggagccctggtctgctcc

SEQ ID NO: 9457628 - DNA, 22 bp, Homo sapiens
gctgggaggaatttggggaata

SEQ ID NO: 9457629 - DNA, 22 bp, Homo sapiens
gctgggagccgtacctgtcacg

SEQ ID NO: 9457630 - DNA, 22 bp, Homo sapiens
gctgggaggaatttggggaata

SEQ ID NO: 9457631 - DNA, 22 bp, Homo sapiens
gctgggccagagcagcagcact

SEQ ID NO: 9457632 - DNA, 22 bp, Homo sapiens
gctgggccagagcagcagcact

SEQ ID NO: 9457633 - DNA, 22 bp, Homo sapiens
gctgggccagagcagcagcact

SEQ ID NO: 9457634 - DNA, 22 bp, Homo sapiens
gctgggccagccagacatgtga

SEQ ID NO: 9457635 - DNA, 22 bp, Homo sapiens
gctgggcccagatcccaggatc

SEQ ID NO: 9457636 - DNA, 22 bp, Homo sapiens
gctgggccccatccctcgagca

SEQ ID NO: 9457637 - DNA, 22 bp, Homo sapiens
gctgggcccagatcccaggatc

SEQ ID NO: 9457638 - DNA, 22 bp, Homo sapiens
gctgggcccagatcccaggatc

SEQ ID NO: 9457639 - DNA, 22 bp, Homo sapiens
gctgggcccagatcccaggatc

SEQ ID NO: 9457640 - DNA, 21 bp, Homo sapiens
gctggctgtcccagggaagca

SEQ ID NO: 9457641 - DNA, 21 bp, Homo sapiens
gctggctgtcccagggaagca

SEQ ID NO: 9457642 - DNA, 22 bp, Homo sapiens
gctggcccagcgcccagggcag

SEQ ID NO: 9457643 - DNA, 22 bp, Homo sapiens
gctggcccagcgcccagggcag

SEQ ID NO: 9457644 - DNA, 22 bp, Homo sapiens
gctggcccagcgcccagggcag

SEQ ID NO: 9457645 - DNA, 22 bp, Homo sapiens
gctggccatggggagtgaggag

SEQ ID NO: 9457646 - DNA, 22 bp, Homo sapiens
gctggccatggggagtgaggag

SEQ ID NO: 9457647 - DNA, 22 bp, Homo sapiens
gctggccatggcctgcgccatc

SEQ ID NO: 9457648 - DNA, 22 bp, Homo sapiens
gctggccatggcctgcgccatc

SEQ ID NO: 9457649 - DNA, 22 bp, Homo sapiens
gctggccatatattttgctgtt

SEQ ID NO: 9457650 - DNA, 22 bp, Homo sapiens
gctggccatagaagccaaagag

SEQ ID NO: 9457651 - DNA, 22 bp, Homo sapiens
gctgggagcaaagccatgcata

SEQ ID NO: 9457652 - DNA, 21 bp, Homo sapiens
gctggctgtctcttacacggt

SEQ ID NO: 9457653 - DNA, 22 bp, Homo sapiens
gctgggagccccgagccagcgc

SEQ ID NO: 9457654 - DNA, 22 bp, Homo sapiens
gctgggagccccgagccagcgc

SEQ ID NO: 9457655 - DNA, 22 bp, Homo sapiens
gctgggagccccgagccagcgc

SEQ ID NO: 9457656 - DNA, 22 bp, Homo sapiens
ggaaatgtttgggtttgtgtga

SEQ ID NO: 9457657 - DNA, 18 bp, Homo sapiens
ggaaatgtttggtactag

SEQ ID NO: 9457658 - DNA, 19 bp, Homo sapiens
ggaaatgtggaaacatcct

SEQ ID NO: 9457659 - DNA, 22 bp, Homo sapiens
ggaaatgtgcctgggaattaga

SEQ ID NO: 9457660 - DNA, 22 bp, Homo sapiens
ggaaatgtgggctgtttctgta

SEQ ID NO: 9457661 - DNA, 21 bp, Homo sapiens
ggaaatgtggtctttacttct

SEQ ID NO: 9457662 - DNA, 22 bp, Homo sapiens
ggaaatgtcatagaaatataag

SEQ ID NO: 9457663 - DNA, 22 bp, Homo sapiens
ggaaatgtattatatttggaat

SEQ ID NO: 9457664 - DNA, 22 bp, Homo sapiens
ggaaatggtggaggaaggctta

SEQ ID NO: 9457665 - DNA, 22 bp, Homo sapiens
ggaaatggagagctacattgga

SEQ ID NO: 9457666 - DNA, 22 bp, Homo sapiens
ggaaatggtggaggaaggctta

SEQ ID NO: 9457667 - DNA, 22 bp, Homo sapiens
ggaaatgtaatcacagagggtt

SEQ ID NO: 9457668 - DNA, 17 bp, Homo sapiens
ggaaatgtacctctttt

SEQ ID NO: 9457669 - DNA, 22 bp, Homo sapiens
ggaaatgtatgtattaagcacc

SEQ ID NO: 9457670 - DNA, 22 bp, Homo sapiens
ggaaatgtatgtattaagcacc

SEQ ID NO: 9457671 - DNA, 22 bp, Homo sapiens
ggaaatgtatgattctcatcag

SEQ ID NO: 9457672 - DNA, 22 bp, Homo sapiens
ggaaatgtatgattctcatcag

SEQ ID NO: 9457673 - DNA, 22 bp, Homo sapiens
ggaacacagaagggctgaaaaa

SEQ ID NO: 9457674 - DNA, 22 bp, Homo sapiens
ggaacacagtgccttacaaact

SEQ ID NO: 9457675 - DNA, 22 bp, Homo sapiens
ggaacactcagaaatgctcgtc

SEQ ID NO: 9457676 - DNA, 22 bp, Homo sapiens
ggaacactgccttttattttcc

SEQ ID NO: 9457677 - DNA, 22 bp, Homo sapiens
ggaacactcgtcaaatagcggg

SEQ ID NO: 9457678 - DNA, 17 bp, Homo sapiens
ggaacaaatactatgca

SEQ ID NO: 9457679 - DNA, 17 bp, Homo sapiens
ggaacaaatactatgca

SEQ ID NO: 9457680 - DNA, 18 bp, Homo sapiens
ggaacaaggctctgactc

SEQ ID NO: 9457681 - DNA, 22 bp, Homo sapiens
ggaacacagaagggctgaaaaa

SEQ ID NO: 9457682 - DNA, 22 bp, Homo sapiens
ggaacacaaatgggagagctgg

SEQ ID NO: 9457683 - DNA, 22 bp, Homo sapiens
ggaaaatttccttcaaaatgtg

SEQ ID NO: 9457684 - DNA, 22 bp, Homo sapiens
ggaaacaaaccactcatggtgg

SEQ ID NO: 9457685 - DNA, 22 bp, Homo sapiens
gcttccaggcttcctacctttg

SEQ ID NO: 9457686 - DNA, 22 bp, Homo sapiens
gcttccagggctcagtcactgc

SEQ ID NO: 9457687 - DNA, 22 bp, Homo sapiens
gcttccagggctcagtcactgc

SEQ ID NO: 9457688 - DNA, 20 bp, Homo sapiens
gcttccaggcccggaaaacc

SEQ ID NO: 9457689 - DNA, 19 bp, Homo sapiens
gcttccagcactgcaggag

SEQ ID NO: 9457690 - DNA, 19 bp, Homo sapiens
gcttccagcactgcaggag

SEQ ID NO: 9457691 - DNA, 22 bp, Homo sapiens
gcttccagcaccagcagagggg

SEQ ID NO: 9457692 - DNA, 22 bp, Homo sapiens
caatggcctcccaagcaggggg

SEQ ID NO: 9457693 - DNA, 22 bp, Homo sapiens
caatggcactgcccaaagagaa

SEQ ID NO: 9457694 - DNA, 21 bp, Homo sapiens
caatggcgagatcttggctca

SEQ ID NO: 9457695 - DNA, 22 bp, Homo sapiens
caatggctggagacaatctgct

SEQ ID NO: 9457696 - DNA, 22 bp, Homo sapiens
caatggtggtgtcagaagagat

SEQ ID NO: 9457697 - DNA, 22 bp, Homo sapiens
caatgcttttgttctttactca

SEQ ID NO: 9457698 - DNA, 22 bp, Homo sapiens
caatgcttttagcttcagcttg

SEQ ID NO: 9457699 - DNA, 22 bp, Homo sapiens
caatgcttttagcttcagcttg

SEQ ID NO: 9457700 - DNA, 22 bp, Homo sapiens
caatgctttatttcctcccctt

SEQ ID NO: 9457701 - DNA, 22 bp, Homo sapiens
caatgcttctgagggaattaca

SEQ ID NO: 9457702 - DNA, 22 bp, Homo sapiens
caatgcttctgagggaattaca

SEQ ID NO: 9457703 - DNA, 22 bp, Homo sapiens
caatgcttgctgactccctgtc

SEQ ID NO: 9457704 - DNA, 22 bp, Homo sapiens
caatgcttctcattagccaatg

SEQ ID NO: 9457705 - DNA, 22 bp, Homo sapiens
gcttccagagactgagctcttc

SEQ ID NO: 9457706 - DNA, 22 bp, Homo sapiens
gcttccagacgatcatgtaaga

SEQ ID NO: 9457707 - DNA, 20 bp, Homo sapiens
gcttccagaggaggccccgt

SEQ ID NO: 9457708 - DNA, 20 bp, Homo sapiens
gcttccagaggaggccccgt

SEQ ID NO: 9457709 - DNA, 22 bp, Homo sapiens
gcttccagatcccatgctctta

SEQ ID NO: 9457710 - DNA, 22 bp, Homo sapiens
caatgtaaatattttctaatca

SEQ ID NO: 9457711 - DNA, 22 bp, Homo sapiens
caatgtacaaaataattacaca

SEQ ID NO: 9457712 - DNA, 22 bp, Homo sapiens
caatgtatcaaccagaaagttc

SEQ ID NO: 9457713 - DNA, 23 bp, Homo sapiens
gcttccagaagactcattgacat

SEQ ID NO: 9457714 - DNA, 22 bp, Homo sapiens
gcttccacctactaaatgccac

SEQ ID NO: 9457715 - DNA, 22 bp, Homo sapiens
gcttccacctactaaatgccac

SEQ ID NO: 9457716 - DNA, 22 bp, Homo sapiens
caatgattgctatttacataaa

SEQ ID NO: 9457717 - DNA, 22 bp, Homo sapiens
caatgcaagcaagatggtcaca

SEQ ID NO: 9457718 - DNA, 22 bp, Homo sapiens
caatgcaagcaagatggtcaca

SEQ ID NO: 9457719 - DNA, 22 bp, Homo sapiens
caatctatagagctttagacta

SEQ ID NO: 9457720 - DNA, 22 bp, Homo sapiens
caatctatcctctgattttgta

SEQ ID NO: 9457721 - DNA, 22 bp, Homo sapiens
caatgcatacttcgaaatttca

SEQ ID NO: 9457722 - DNA, 22 bp, Homo sapiens
caatgcacatggacatcaggct

SEQ ID NO: 9457723 - DNA, 22 bp, Homo sapiens
caatgcacgctcagatttgacc

SEQ ID NO: 9457724 - DNA, 22 bp, Homo sapiens
caatgcaatgcaatgcaatgca

SEQ ID NO: 9457725 - DNA, 22 bp, Homo sapiens
caatgcaatgcaatgcaatgca

SEQ ID NO: 9457726 - DNA, 22 bp, Homo sapiens
caatgcaatgcaatgcaatgca

SEQ ID NO: 9457727 - DNA, 22 bp, Homo sapiens
gctggttagaaaacagagctca

SEQ ID NO: 9457728 - DNA, 22 bp, Homo sapiens
gctggtggttaccgtgctaatg

SEQ ID NO: 9457729 - DNA, 22 bp, Homo sapiens
gctggtggttaccgtgctaatg

SEQ ID NO: 9457730 - DNA, 22 bp, Homo sapiens
gctggtgtgtgaacctagggac

SEQ ID NO: 9457731 - DNA, 22 bp, Homo sapiens
gctggtgcattagctgcagttc

SEQ ID NO: 9457732 - DNA, 22 bp, Homo sapiens
gctggtggcagagacatcaggt

SEQ ID NO: 9457733 - DNA, 22 bp, Homo sapiens
gctggtgctctgggccctgagg

SEQ ID NO: 9457734 - DNA, 20 bp, Homo sapiens
gctggtgggggcttgacatg

SEQ ID NO: 9457735 - DNA, 20 bp, Homo sapiens
gctggtgggggcttgacatg

SEQ ID NO: 9457736 - DNA, 22 bp, Homo sapiens
gctggtgagcaaaggagaagga

SEQ ID NO: 9457737 - DNA, 22 bp, Homo sapiens
gctggtcctcaagggcacagcc

SEQ ID NO: 9457738 - DNA, 22 bp, Homo sapiens
gctggtcctcaagggcacagcc

SEQ ID NO: 9457739 - DNA, 17 bp, Homo sapiens
gctggtccttggtaact

SEQ ID NO: 9457740 - DNA, 22 bp, Homo sapiens
gctggtctagggatgggcgtat

SEQ ID NO: 9457741 - DNA, 22 bp, Homo sapiens
caagttcacgttgctttttgag

SEQ ID NO: 9457742 - DNA, 22 bp, Homo sapiens
caagttacattagaaatcatgc

SEQ ID NO: 9457743 - DNA, 22 bp, Homo sapiens
caagttatcagaaggcactttt

SEQ ID NO: 9457744 - DNA, 22 bp, Homo sapiens
caagttgttgggagggttggtt

SEQ ID NO: 9457745 - DNA, 21 bp, Homo sapiens
caagttctgtgtcttactcct

SEQ ID NO: 9457746 - DNA, 22 bp, Homo sapiens
caagttcacttgtctacaaggg

SEQ ID NO: 9457747 - DNA, 22 bp, Homo sapiens
caagttcattgtagcattattg

SEQ ID NO: 9457748 - DNA, 22 bp, Homo sapiens
caagttctactgggacatcagt

SEQ ID NO: 9457749 - DNA, 21 bp, Homo sapiens
caagttctgctgaatcttctt

SEQ ID NO: 9457750 - DNA, 22 bp, Homo sapiens
caagtcaatgattataagagtc

SEQ ID NO: 9457751 - DNA, 22 bp, Homo sapiens
caagtcaatgattataagagtc

SEQ ID NO: 9457752 - DNA, 22 bp, Homo sapiens
caagtcacatggccaactgatg

SEQ ID NO: 9457753 - DNA, 22 bp, Homo sapiens
caagtgcatggtggcaaagaat

SEQ ID NO: 9457754 - DNA, 21 bp, Homo sapiens
caagtgtggatgtggaaggta

SEQ ID NO: 9457755 - DNA, 22 bp, Homo sapiens
caagtgtgactattttttcata

SEQ ID NO: 9457756 - DNA, 18 bp, Homo sapiens
ccagagggtgcgtcagct

SEQ ID NO: 9457757 - DNA, 18 bp, Homo sapiens
ccagagggtgcgtcagct

SEQ ID NO: 9457758 - DNA, 18 bp, Homo sapiens
ccagagggtgcgtcagct

SEQ ID NO: 9457759 - DNA, 22 bp, Homo sapiens
ccagaggtcccctgccaggagg

SEQ ID NO: 9457760 - DNA, 22 bp, Homo sapiens
tctctgggataaactgggccag

SEQ ID NO: 9457761 - DNA, 22 bp, Homo sapiens
tctctgggataaactgggccag

SEQ ID NO: 9457762 - DNA, 22 bp, Homo sapiens
ccagagggccctggtctcagct

SEQ ID NO: 9457763 - DNA, 22 bp, Homo sapiens
ccagagggccctggtctcagct

SEQ ID NO: 9457764 - DNA, 22 bp, Homo sapiens
ccagagggagccaccagggtgt

SEQ ID NO: 9457765 - DNA, 22 bp, Homo sapiens
ccagagggcaaaatgaagctta

SEQ ID NO: 9457766 - DNA, 22 bp, Homo sapiens
ccagagggcctttggagttatc

SEQ ID NO: 9457767 - DNA, 22 bp, Homo sapiens
ccagagggcttggtttgggcca

SEQ ID NO: 9457768 - DNA, 22 bp, Homo sapiens
ccagaggggcacaaaagtagaa

SEQ ID NO: 9457769 - DNA, 20 bp, Homo sapiens
ccagagggtagggccgcccc

SEQ ID NO: 9457770 - DNA, 20 bp, Homo sapiens
ccagagggtagggccgcccc

SEQ ID NO: 9457771 - DNA, 22 bp, Homo sapiens
ccagaggggctgagcaggtcac

SEQ ID NO: 9457772 - DNA, 22 bp, Homo sapiens
ccagaggggtgggcctggttta

SEQ ID NO: 9457773 - DNA, 22 bp, Homo sapiens
ccagaggggtgggcctggttta

SEQ ID NO: 9457774 - DNA, 22 bp, Homo sapiens
ccagaggggctgagcaggtcac

SEQ ID NO: 9457775 - DNA, 23 bp, Homo sapiens
tctctgtacagatgaggacacac

SEQ ID NO: 9457776 - DNA, 22 bp, Homo sapiens
tctctgtacagtacatgccgtg

SEQ ID NO: 9457777 - DNA, 22 bp, Homo sapiens
tctctgtagacctgaccagcac

SEQ ID NO: 9457778 - DNA, 22 bp, Homo sapiens
tctctgtaaaatgtggatgata

SEQ ID NO: 9457779 - DNA, 22 bp, Homo sapiens
tctctgtaaaatgtggatgata

SEQ ID NO: 9457780 - DNA, 22 bp, Homo sapiens
tctctgtaaaatgtggatgata

SEQ ID NO: 9457781 - DNA, 22 bp, Homo sapiens
tctctgggataaactgggccag

SEQ ID NO: 9457782 - DNA, 22 bp, Homo sapiens
tctctgggataaactgggccag

SEQ ID NO: 9457783 - DNA, 22 bp, Homo sapiens
tctctgggataaactgggccag

SEQ ID NO: 9457784 - DNA, 22 bp, Homo sapiens
tctctgtagttgggcagctgct

SEQ ID NO: 9457785 - DNA, 22 bp, Homo sapiens
tctctgtagggctgcttgagta

SEQ ID NO: 9457786 - DNA, 22 bp, Homo sapiens
tctctgtagttgggcagctgct

SEQ ID NO: 9457787 - DNA, 22 bp, Homo sapiens
tctctgtatcagcacctgctgg

SEQ ID NO: 9457788 - DNA, 22 bp, Homo sapiens
tctctgtagagacagcactgtg

SEQ ID NO: 9457789 - DNA, 22 bp, Homo sapiens
tctctgtagagacagcactgtg

SEQ ID NO: 9457790 - DNA, 22 bp, Homo sapiens
ccagatgtccctctcaggtttg

SEQ ID NO: 9457791 - DNA, 22 bp, Homo sapiens
tctctgtattctgatattcact

SEQ ID NO: 9457792 - DNA, 22 bp, Homo sapiens
tctctgtattctgatattcact

SEQ ID NO: 9457793 - DNA, 21 bp, Homo sapiens
tctctgtatccatgggttcca

SEQ ID NO: 9457794 - DNA, 22 bp, Homo sapiens
tctctgtatcccagaaccaaaa

SEQ ID NO: 9457795 - DNA, 22 bp, Homo sapiens
tctctgtatcccagaaccaaaa

SEQ ID NO: 9457796 - DNA, 22 bp, Homo sapiens
ccagcaagtgcagatggccaag

SEQ ID NO: 9457797 - DNA, 22 bp, Homo sapiens
ccagcaagtgcagatggccaag

SEQ ID NO: 9457798 - DNA, 22 bp, Homo sapiens
ccagcaagtgcagatggccaag

SEQ ID NO: 9457799 - DNA, 22 bp, Homo sapiens
ccagcaaggtccagcataggga

SEQ ID NO: 9457800 - DNA, 22 bp, Homo sapiens
ccagcaaggtccagcataggga

SEQ ID NO: 9457801 - DNA, 22 bp, Homo sapiens
ccagcaagccaggtctgtggct

SEQ ID NO: 9457802 - DNA, 23 bp, Homo sapiens
ccagatttgccacgagagaggct

SEQ ID NO: 9457803 - DNA, 22 bp, Homo sapiens
ccagatttgtaggggctcttac

SEQ ID NO: 9457804 - DNA, 22 bp, Homo sapiens
ccagcaaggtccagcataggga

SEQ ID NO: 9457805 - DNA, 22 bp, Homo sapiens
ccagcaagccaggtctgtggct

SEQ ID NO: 9457806 - DNA, 20 bp, Homo sapiens
ccagcaccctctcagctgaa

SEQ ID NO: 9457807 - DNA, 20 bp, Homo sapiens
ccagcaccctctcagctgaa

SEQ ID NO: 9457808 - DNA, 20 bp, Homo sapiens
ccagcaccctctcagctgaa

SEQ ID NO: 9457809 - DNA, 22 bp, Homo sapiens
ccagcaagtgcagatggccaag

SEQ ID NO: 9457810 - DNA, 22 bp, Homo sapiens
ccagcacacagtgggtgcccag

SEQ ID NO: 9457811 - DNA, 22 bp, Homo sapiens
ccagatgtccctctcaggtttg

SEQ ID NO: 9457812 - DNA, 22 bp, Homo sapiens
ccagatgtccctctcaggtttg

SEQ ID NO: 9457813 - DNA, 22 bp, Homo sapiens
ccagatgtccctctcaggtttg

SEQ ID NO: 9457814 - DNA, 22 bp, Homo sapiens
ccagatttgagcgtcttaaacc

SEQ ID NO: 9457815 - DNA, 22 bp, Homo sapiens
ccagatttgagcgtcttaaacc

SEQ ID NO: 9457816 - DNA, 22 bp, Homo sapiens
ccagattgaactaaaggttata

SEQ ID NO: 9457817 - DNA, 22 bp, Homo sapiens
ccagattcatagaaactcatag

SEQ ID NO: 9457818 - DNA, 22 bp, Homo sapiens
ccagatgttcccctggaggcct

SEQ ID NO: 9457819 - DNA, 22 bp, Homo sapiens
ccagagcatgaagggcaatgac

SEQ ID NO: 9457820 - DNA, 22 bp, Homo sapiens
ccagagccagagaggtgcctgc

SEQ ID NO: 9457821 - DNA, 22 bp, Homo sapiens
ccagagccagagaggtgcctgc

SEQ ID NO: 9457822 - DNA, 22 bp, Homo sapiens
ccagagcccagcacacggtgct

SEQ ID NO: 9457823 - DNA, 22 bp, Homo sapiens
ccagagccagagaggtgcctgc

SEQ ID NO: 9457824 - DNA, 22 bp, Homo sapiens
ccagagcccagggtcatgcagg

SEQ ID NO: 9457825 - DNA, 22 bp, Homo sapiens
ccagagcccagcacacggtgct

SEQ ID NO: 9457826 - DNA, 22 bp, Homo sapiens
ccagagcagggcagcagggctc

SEQ ID NO: 9457827 - DNA, 22 bp, Homo sapiens
ccagagcagggcagcagggctc

SEQ ID NO: 9457828 - DNA, 22 bp, Homo sapiens
ccagagcagggcagcagggctc

SEQ ID NO: 9457829 - DNA, 22 bp, Homo sapiens
ccagagcagggcagcagggctc

SEQ ID NO: 9457830 - DNA, 22 bp, Homo sapiens
ccagagcagggcagcagggctc

SEQ ID NO: 9457831 - DNA, 20 bp, Homo sapiens
ccagagcagccactgaagtt

SEQ ID NO: 9457832 - DNA, 19 bp, Homo sapiens
ccagagcccgccagatggg

SEQ ID NO: 9457833 - DNA, 22 bp, Homo sapiens
ccagagcccagggtcatgcagg

SEQ ID NO: 9457834 - DNA, 22 bp, Homo sapiens
ccagagcccgggacctggactt

SEQ ID NO: 9457835 - DNA, 22 bp, Homo sapiens
ccagagcccgggacctggactt

SEQ ID NO: 9457836 - DNA, 19 bp, Homo sapiens
ccagagcccgccagatggg

SEQ ID NO: 9457837 - DNA, 22 bp, Homo sapiens
ccagagccggctccctcagctt

SEQ ID NO: 9457838 - DNA, 22 bp, Homo sapiens
ccagagccggctccctcagctt

SEQ ID NO: 9457839 - DNA, 22 bp, Homo sapiens
ccagagccggctccctcagctt

SEQ ID NO: 9457840 - DNA, 22 bp, Homo sapiens
ccagagccggctccctcagctt

SEQ ID NO: 9457841 - DNA, 22 bp, Homo sapiens
ccagagggaactgggcctcatt

SEQ ID NO: 9457842 - DNA, 22 bp, Homo sapiens
ccagagggaactgggcctcatt

SEQ ID NO: 9457843 - DNA, 22 bp, Homo sapiens
ccagagggagccaccagggtgt

SEQ ID NO: 9457844 - DNA, 22 bp, Homo sapiens
ccagagggagccaccagggtgt

SEQ ID NO: 9457845 - DNA, 22 bp, Homo sapiens
ccagagggacgttaccagttca

SEQ ID NO: 9457846 - DNA, 22 bp, Homo sapiens
ccagaggctggcagccagctga

SEQ ID NO: 9457847 - DNA, 22 bp, Homo sapiens
ccagaggctggcagccagctga

SEQ ID NO: 9457848 - DNA, 22 bp, Homo sapiens
ccagaggctggcagccagctga

SEQ ID NO: 9457849 - DNA, 22 bp, Homo sapiens
ccagaggctggggaaggataca

SEQ ID NO: 9457850 - DNA, 22 bp, Homo sapiens
ccagaggctggggaaggataca

SEQ ID NO: 9457851 - DNA, 22 bp, Homo sapiens
ccagaggctgggttcacctcag

SEQ ID NO: 9457852 - DNA, 22 bp, Homo sapiens
ccagaggctgggttcacctcag

SEQ ID NO: 9457853 - DNA, 22 bp, Homo sapiens
ccagaggctgggttcacctcag

SEQ ID NO: 9457854 - DNA, 22 bp, Homo sapiens
ccagaggctggggaaggataca

SEQ ID NO: 9457855 - DNA, 22 bp, Homo sapiens
ccagaggctgggttcacctcag

SEQ ID NO: 9457856 - DNA, 22 bp, Homo sapiens
ccagaggctgggttcacctcag

SEQ ID NO: 9457857 - DNA, 22 bp, Homo sapiens
ccagaggatcagtactggctgg

SEQ ID NO: 9457858 - DNA, 22 bp, Homo sapiens
ccagaggatcagtactggctgg

SEQ ID NO: 9457859 - DNA, 22 bp, Homo sapiens
ccagaggctggcaagggctcct

SEQ ID NO: 9457860 - DNA, 22 bp, Homo sapiens
ccagaggctggcaagggctcct

SEQ ID NO: 9457861 - DNA, 22 bp, Homo sapiens
ccagaggctggcagccagctga

SEQ ID NO: 9457862 - DNA, 22 bp, Homo sapiens
ccagagcctcttatgaagatcg

SEQ ID NO: 9457863 - DNA, 21 bp, Homo sapiens
ccagagcctgagaggattatg

SEQ ID NO: 9457864 - DNA, 22 bp, Homo sapiens
ccagagcctcttatgaagatcg

SEQ ID NO: 9457865 - DNA, 22 bp, Homo sapiens
ccagagcctcaacacaggtcct

SEQ ID NO: 9457866 - DNA, 22 bp, Homo sapiens
ccagagcctaagatctgatcct

SEQ ID NO: 9457867 - DNA, 22 bp, Homo sapiens
ccagagcctcgcccggagcctc

SEQ ID NO: 9457868 - DNA, 22 bp, Homo sapiens
ccagagcctcaacacaggtcct

SEQ ID NO: 9457869 - DNA, 22 bp, Homo sapiens
ccagagcctcgcccggagcctc

SEQ ID NO: 9457870 - DNA, 22 bp, Homo sapiens
ccagagcctcgcccggagcctc

SEQ ID NO: 9457871 - DNA, 17 bp, Homo sapiens
tctcaggcacgtgtggc

SEQ ID NO: 9457872 - DNA, 22 bp, Homo sapiens
tctcaggcactgggtgccaact

SEQ ID NO: 9457873 - DNA, 22 bp, Homo sapiens
tctcaggcactgggtgccaact

SEQ ID NO: 9457874 - DNA, 22 bp, Homo sapiens
tctcaggcatctgtgtggcaca

SEQ ID NO: 9457875 - DNA, 22 bp, Homo sapiens
tctcaggcatctgtgtggcaca

SEQ ID NO: 9457876 - DNA, 22 bp, Homo sapiens
tctcaggcatggtttgttcatc

SEQ ID NO: 9457877 - DNA, 22 bp, Homo sapiens
tctcagtggatctcagaatttt

SEQ ID NO: 9457878 - DNA, 22 bp, Homo sapiens
tctcagtggatctcagaatttt

SEQ ID NO: 9457879 - DNA, 22 bp, Homo sapiens
tctcaggcccactgtgttgaaa

SEQ ID NO: 9457880 - DNA, 22 bp, Homo sapiens
tctcaggcattcccacatagaa

SEQ ID NO: 9457881 - DNA, 23 bp, Homo sapiens
tctcaggcaaaccaggacaagtt

SEQ ID NO: 9457882 - DNA, 17 bp, Homo sapiens
tctcaggcacgtgtggc

SEQ ID NO: 9457883 - DNA, 22 bp, Homo sapiens
tctcaggactttgggaagctca

SEQ ID NO: 9457884 - DNA, 22 bp, Homo sapiens
ccagagaggccttggcaagaca

SEQ ID NO: 9457885 - DNA, 22 bp, Homo sapiens
ccagagaggccttggcaagaca

SEQ ID NO: 9457886 - DNA, 22 bp, Homo sapiens
ccagagaggccttggcaagaca

SEQ ID NO: 9457887 - DNA, 22 bp, Homo sapiens
ccagagaggccttggcaagaca

SEQ ID NO: 9457888 - DNA, 22 bp, Homo sapiens
tctcagtgtttaaaaagatttc

SEQ ID NO: 9457889 - DNA, 22 bp, Homo sapiens
tctcagtgtttaaaaagatttc

SEQ ID NO: 9457890 - DNA, 22 bp, Homo sapiens
tctcagtgttgttctgcagatg

SEQ ID NO: 9457891 - DNA, 22 bp, Homo sapiens
tctcagtgtgttttctctcaga

SEQ ID NO: 9457892 - DNA, 22 bp, Homo sapiens
tctcagtggtgttttgagtcca

SEQ ID NO: 9457893 - DNA, 22 bp, Homo sapiens
tctcagtgtggtgcttaggata

SEQ ID NO: 9457894 - DNA, 22 bp, Homo sapiens
tctcagtgtggtgcttaggata

SEQ ID NO: 9457895 - DNA, 22 bp, Homo sapiens
tctcagtgtgttgagaggtctg

SEQ ID NO: 9457896 - DNA, 22 bp, Homo sapiens
tctcagtgtgttgagaggtctg

SEQ ID NO: 9457897 - DNA, 22 bp, Homo sapiens
tctcagtgggttaaaagagaag

SEQ ID NO: 9457898 - DNA, 22 bp, Homo sapiens
tctcagtgggaagggcacagtt

SEQ ID NO: 9457899 - DNA, 22 bp, Homo sapiens
tctcagtgggaagggcacagtt

SEQ ID NO: 9457900 - DNA, 22 bp, Homo sapiens
tctcagtgggaagggcacagtt

SEQ ID NO: 9457901 - DNA, 22 bp, Homo sapiens
tctcagtggcttcctcactttt

SEQ ID NO: 9457902 - DNA, 22 bp, Homo sapiens
tctcagctgcctgccctgctcc

SEQ ID NO: 9457903 - DNA, 22 bp, Homo sapiens
tctcagcttgagtggatgagct

SEQ ID NO: 9457904 - DNA, 22 bp, Homo sapiens
tctatacacacaaagaatgctt

SEQ ID NO: 9457905 - DNA, 22 bp, Homo sapiens
tctatacatgtgcacacacatc

SEQ ID NO: 9457906 - DNA, 22 bp, Homo sapiens
tctatacatgtgcacacacatc

SEQ ID NO: 9457907 - DNA, 23 bp, Homo sapiens
tctatacatactgcagcctctgg

SEQ ID NO: 9457908 - DNA, 22 bp, Homo sapiens
tctatagacttggacatatagt

SEQ ID NO: 9457909 - DNA, 22 bp, Homo sapiens
tctatagatcagtaaatatctc

SEQ ID NO: 9457910 - DNA, 22 bp, Homo sapiens
tctatactgatgggatactatt

SEQ ID NO: 9457911 - DNA, 22 bp, Homo sapiens
tctataaatgcagatatgtgtg

SEQ ID NO: 9457912 - DNA, 21 bp, Homo sapiens
tctagaatcctgtataagact

SEQ ID NO: 9457913 - DNA, 21 bp, Homo sapiens
tctataactatagtgacagat

SEQ ID NO: 9457914 - DNA, 22 bp, Homo sapiens
tctataaattatgcagtctcag

SEQ ID NO: 9457915 - DNA, 22 bp, Homo sapiens
tctatacaagtttcactttgac

SEQ ID NO: 9457916 - DNA, 21 bp, Homo sapiens
tctataatatgcaggtcatca

SEQ ID NO: 9457917 - DNA, 22 bp, Homo sapiens
tctataatcctatttcaactgc

SEQ ID NO: 9457918 - DNA, 22 bp, Homo sapiens
tcctgtggtcagacattgccaa

SEQ ID NO: 9457919 - DNA, 22 bp, Homo sapiens
tcctgtggtcattcttctgccc

SEQ ID NO: 9457920 - DNA, 20 bp, Homo sapiens
ccaccctgctaagaatacac

SEQ ID NO: 9457921 - DNA, 22 bp, Homo sapiens
ccaccctgccttgggccagtga

SEQ ID NO: 9457922 - DNA, 22 bp, Homo sapiens
ccaccctgccttgggccagtga

SEQ ID NO: 9457923 - DNA, 22 bp, Homo sapiens
tcctgtgttaaagggggtgcta

SEQ ID NO: 9457924 - DNA, 22 bp, Homo sapiens
tcctgtgtctcagcgtgaagca

SEQ ID NO: 9457925 - DNA, 22 bp, Homo sapiens
tcctgtgtgggcaggatgagaa

SEQ ID NO: 9457926 - DNA, 22 bp, Homo sapiens
tcctgtggtcattcttctgccc

SEQ ID NO: 9457927 - DNA, 22 bp, Homo sapiens
tcctgtggtcattcttctgccc

SEQ ID NO: 9457928 - DNA, 22 bp, Homo sapiens
tcctgtggtctggaaggaatgg

SEQ ID NO: 9457929 - DNA, 22 bp, Homo sapiens
tcctgtgtaaatagatctggtt

SEQ ID NO: 9457930 - DNA, 22 bp, Homo sapiens
tcctgtggtctggaaggaatgg

SEQ ID NO: 9457931 - DNA, 19 bp, Homo sapiens
ccacccctttgctgggccc

SEQ ID NO: 9457932 - DNA, 20 bp, Homo sapiens
ccaccctccaggaacacata

SEQ ID NO: 9457933 - DNA, 22 bp, Homo sapiens
ccacccctgggtgcagggagcg

SEQ ID NO: 9457934 - DNA, 19 bp, Homo sapiens
ccacccctttgctgggccc

SEQ ID NO: 9457935 - DNA, 22 bp, Homo sapiens
ccacccctgtagagggacagac

SEQ ID NO: 9457936 - DNA, 18 bp, Homo sapiens
ccacccagggggagagga

SEQ ID NO: 9457937 - DNA, 18 bp, Homo sapiens
ccacccagggggagagga

SEQ ID NO: 9457938 - DNA, 22 bp, Homo sapiens
ccaccaggcactcacagggaag

SEQ ID NO: 9457939 - DNA, 22 bp, Homo sapiens
ccacccatgtgactacctcatg

SEQ ID NO: 9457940 - DNA, 22 bp, Homo sapiens
ccacccctgggtgcagggagcg

SEQ ID NO: 9457941 - DNA, 22 bp, Homo sapiens
ccacccctgggtgcagggagcg

SEQ ID NO: 9457942 - DNA, 22 bp, Homo sapiens
tctagaagatacctgctgccaa

SEQ ID NO: 9457943 - DNA, 22 bp, Homo sapiens
tctagaaattttgccttgtatt

SEQ ID NO: 9457944 - DNA, 18 bp, Homo sapiens
tctagaaacccagactct

SEQ ID NO: 9457945 - DNA, 18 bp, Homo sapiens
tctagaaacccagactct

SEQ ID NO: 9457946 - DNA, 22 bp, Homo sapiens
tctagaaagtactagagctggt

SEQ ID NO: 9457947 - DNA, 22 bp, Homo sapiens
tctagaaacatgacattgatct

SEQ ID NO: 9457948 - DNA, 22 bp, Homo sapiens
tcctgtttatctgtgtgactcg

SEQ ID NO: 9457949 - DNA, 22 bp, Homo sapiens
tcctgttagcatgctgatcata

SEQ ID NO: 9457950 - DNA, 17 bp, Homo sapiens
tcctgtttatcattgat

SEQ ID NO: 9457951 - DNA, 22 bp, Homo sapiens
tcctgccttagagcaaggaaaa

SEQ ID NO: 9457952 - DNA, 21 bp, Homo sapiens
tcctgccttagtccagagcag

SEQ ID NO: 9457953 - DNA, 21 bp, Homo sapiens
tcctgccttagtccagagcag

SEQ ID NO: 9457954 - DNA, 22 bp, Homo sapiens
tcctgccttagagcaaggaaaa

SEQ ID NO: 9457955 - DNA, 21 bp, Homo sapiens
tcctgccttagtccagagcag

SEQ ID NO: 9457956 - DNA, 21 bp, Homo sapiens
tcctgccttagtccagagcag

SEQ ID NO: 9457957 - DNA, 19 bp, Homo sapiens
tcctgcccaccagccaggg

SEQ ID NO: 9457958 - DNA, 22 bp, Homo sapiens
ccaagagggttgccctgagcgt

SEQ ID NO: 9457959 - DNA, 22 bp, Homo sapiens
ccaagaggtatcttgccataaa

SEQ ID NO: 9457960 - DNA, 22 bp, Homo sapiens
ccaagaggggcagagggctgca

SEQ ID NO: 9457961 - DNA, 22 bp, Homo sapiens
ccaagaggggcagagggctgca

SEQ ID NO: 9457962 - DNA, 22 bp, Homo sapiens
ccaagaggggaagggccgcagc

SEQ ID NO: 9457963 - DNA, 22 bp, Homo sapiens
tcctgccttgcctgggacatca

SEQ ID NO: 9457964 - DNA, 22 bp, Homo sapiens
tcctgccttgcctgggacatca

SEQ ID NO: 9457965 - DNA, 22 bp, Homo sapiens
tcctgccttcatactgctgtat

SEQ ID NO: 9457966 - DNA, 22 bp, Homo sapiens
tcctgccttcatactgctgtat

SEQ ID NO: 9457967 - DNA, 22 bp, Homo sapiens
tcctggagccacggagctttca

SEQ ID NO: 9457968 - DNA, 22 bp, Homo sapiens
tcctgctccaccgtgggctgga

SEQ ID NO: 9457969 - DNA, 22 bp, Homo sapiens
tcctggagccaatgtgctgctg

SEQ ID NO: 9457970 - DNA, 22 bp, Homo sapiens
tcctggagccaatgtgctgctg

SEQ ID NO: 9457971 - DNA, 20 bp, Homo sapiens
ccaagagcatgcatgaggaa

SEQ ID NO: 9457972 - DNA, 22 bp, Homo sapiens
ccaagagcttcccatagcttct

SEQ ID NO: 9457973 - DNA, 22 bp, Homo sapiens
ccaagaggcagaatgcagagaa

SEQ ID NO: 9457974 - DNA, 22 bp, Homo sapiens
ccaagaggaccttgccagggca

SEQ ID NO: 9457975 - DNA, 22 bp, Homo sapiens
ccaacagtccagatgagatggt

SEQ ID NO: 9457976 - DNA, 22 bp, Homo sapiens
ccaacaggttgagagtctgaat

SEQ ID NO: 9457977 - DNA, 19 bp, Homo sapiens
ccaacagtactgaagcact

SEQ ID NO: 9457978 - DNA, 22 bp, Homo sapiens
ccaacaggttgagagtctgaat

SEQ ID NO: 9457979 - DNA, 22 bp, Homo sapiens
ccaacaccatctgagctccagc

SEQ ID NO: 9457980 - DNA, 22 bp, Homo sapiens
ccaacctgaggcaggctgcagc

SEQ ID NO: 9457981 - DNA, 22 bp, Homo sapiens
ccaacctgaggcaggctgcagc

SEQ ID NO: 9457982 - DNA, 22 bp, Homo sapiens
ccaaccagctatggaatcttgt

SEQ ID NO: 9457983 - DNA, 23 bp, Homo sapiens
ccaagactgttaggagtggggag

SEQ ID NO: 9457984 - DNA, 22 bp, Homo sapiens
tcctgaggtgctcagccaggaa

SEQ ID NO: 9457985 - DNA, 22 bp, Homo sapiens
tcctgaggtggattgagcagag

SEQ ID NO: 9457986 - DNA, 22 bp, Homo sapiens
tcctgaggtggattgagcagag

SEQ ID NO: 9457987 - DNA, 22 bp, Homo sapiens
ccaaattctgtgttcaaactca

SEQ ID NO: 9457988 - DNA, 22 bp, Homo sapiens
ccaaattaaatcatacagacag

SEQ ID NO: 9457989 - DNA, 22 bp, Homo sapiens
ccaaattaaatcatacagacag

SEQ ID NO: 9457990 - DNA, 22 bp, Homo sapiens
tcctgaggtggattgagcagag

SEQ ID NO: 9457991 - DNA, 22 bp, Homo sapiens
ccaaattaaatcatacagacag

SEQ ID NO: 9457992 - DNA, 23 bp, Homo sapiens
tcctgagggtttcccagccttgg

SEQ ID NO: 9457993 - DNA, 22 bp, Homo sapiens
tcctgagggctgcagtcatagg

SEQ ID NO: 9457994 - DNA, 22 bp, Homo sapiens
tcctgagggctgcagtcatagg

SEQ ID NO: 9457995 - DNA, 23 bp, Homo sapiens
tcctgagggtttcccagccttgg

SEQ ID NO: 9457996 - DNA, 23 bp, Homo sapiens
tcctgagggtttcccagccttgg

SEQ ID NO: 9457997 - DNA, 22 bp, Homo sapiens
ccaccaggacagccctgagggg

SEQ ID NO: 9457998 - DNA, 22 bp, Homo sapiens
tcctggctccactgagcaggcc

SEQ ID NO: 9457999 - DNA, 22 bp, Homo sapiens
tcctggctccactgagcaggcc

SEQ ID NO: 9458000 - DNA, 22 bp, Homo sapiens
tcctggctcaggcccctggtgc

SEQ ID NO: 9458001 - DNA, 22 bp, Homo sapiens
tcctggctagttttgctgaaat

SEQ ID NO: 9458002 - DNA, 22 bp, Homo sapiens
tcctggccttgcgtcttgggag

SEQ ID NO: 9458003 - DNA, 22 bp, Homo sapiens
tcctggccttgctcctgatgcc

SEQ ID NO: 9458004 - DNA, 22 bp, Homo sapiens
tcctggccttgctcctgatgcc

SEQ ID NO: 9458005 - DNA, 22 bp, Homo sapiens
tcctggccttgcgtcttgggag

SEQ ID NO: 9458006 - DNA, 22 bp, Homo sapiens
tcctggctaacacggtgacacc

SEQ ID NO: 9458007 - DNA, 22 bp, Homo sapiens
tcctggctaacacggtgacacc

SEQ ID NO: 9458008 - DNA, 22 bp, Homo sapiens
tcctggccttgctcctgatgcc

SEQ ID NO: 9458009 - DNA, 16 bp, Homo sapiens
tcctggcctttggaag

SEQ ID NO: 9458010 - DNA, 22 bp, Homo sapiens
ccacaggggcccacgagccgct

SEQ ID NO: 9458011 - DNA, 21 bp, Homo sapiens
ccacaggggctcccctgtcag

SEQ ID NO: 9458012 - DNA, 22 bp, Homo sapiens
ccacagggctctaggcgcttcc

SEQ ID NO: 9458013 - DNA, 22 bp, Homo sapiens
ccacagggcctttcctgctggc

SEQ ID NO: 9458014 - DNA, 17 bp, Homo sapiens
tcctggcctggtgtgtg

SEQ ID NO: 9458015 - DNA, 22 bp, Homo sapiens
ccacaggggtctctgtagctga

SEQ ID NO: 9458016 - DNA, 21 bp, Homo sapiens
ccacaggggctcccctgtcag

SEQ ID NO: 9458017 - DNA, 21 bp, Homo sapiens
ccacaggggctcccctgtcag

SEQ ID NO: 9458018 - DNA, 20 bp, Homo sapiens
tcctggccttctcgggcagt

SEQ ID NO: 9458019 - DNA, 20 bp, Homo sapiens
tcctggccttctcgggcagt

SEQ ID NO: 9458020 - DNA, 22 bp, Homo sapiens
tcctggccttatccccaaactg

SEQ ID NO: 9458021 - DNA, 22 bp, Homo sapiens
tcctggccttagcgaggcggtc

SEQ ID NO: 9458022 - DNA, 22 bp, Homo sapiens
tcctggccttagcgaggcggtc

SEQ ID NO: 9458023 - DNA, 22 bp, Homo sapiens
tcctggcctgtctggagtagct

SEQ ID NO: 9458024 - DNA, 22 bp, Homo sapiens
tcctggcctgtctggagtagct

SEQ ID NO: 9458025 - DNA, 22 bp, Homo sapiens
ccacagggcacagacaggaagc

SEQ ID NO: 9458026 - DNA, 22 bp, Homo sapiens
ccacagggcctttcctgctggc

SEQ ID NO: 9458027 - DNA, 22 bp, Homo sapiens
ccacagggcctttcctgctggc

SEQ ID NO: 9458028 - DNA, 22 bp, Homo sapiens
ccacagggcctttcctgctggc

SEQ ID NO: 9458029 - DNA, 22 bp, Homo sapiens
ccacagggcctttcctgctggc

SEQ ID NO: 9458030 - DNA, 22 bp, Homo sapiens
ccacaggctgctgcaggtcccg

SEQ ID NO: 9458031 - DNA, 22 bp, Homo sapiens
ccacaggcggagtggcgggcag

SEQ ID NO: 9458032 - DNA, 22 bp, Homo sapiens
ccacagggactgttaaaaccct

SEQ ID NO: 9458033 - DNA, 22 bp, Homo sapiens
ccacagggaacatgacagcctt

SEQ ID NO: 9458034 - DNA, 22 bp, Homo sapiens
ccacaggctgctgcaggtcccg

SEQ ID NO: 9458035 - DNA, 22 bp, Homo sapiens
ccacagggaacatgacagcctt

SEQ ID NO: 9458036 - DNA, 22 bp, Homo sapiens
ccacaggcggagtggcgggcag

SEQ ID NO: 9458037 - DNA, 22 bp, Homo sapiens
ccacaggcggagtggcgggcag

SEQ ID NO: 9458038 - DNA, 22 bp, Homo sapiens
tcctggagcttccttcatggta

SEQ ID NO: 9458039 - DNA, 22 bp, Homo sapiens
tcctggagcttccttcatggta

SEQ ID NO: 9458040 - DNA, 22 bp, Homo sapiens
tcctggaggaataagttttcca

SEQ ID NO: 9458041 - DNA, 22 bp, Homo sapiens
tcctggagcttcagtttccttt

SEQ ID NO: 9458042 - DNA, 22 bp, Homo sapiens
tcctggagcctcattcaaacac

SEQ ID NO: 9458043 - DNA, 22 bp, Homo sapiens
tcctggagctgactccgtttga

SEQ ID NO: 9458044 - DNA, 22 bp, Homo sapiens
tcctggagccaggacccttccc

SEQ ID NO: 9458045 - DNA, 22 bp, Homo sapiens
tcctggagccatgattcccctc

SEQ ID NO: 9458046 - DNA, 22 bp, Homo sapiens
tcctggagcttcagtttccttt

SEQ ID NO: 9458047 - DNA, 22 bp, Homo sapiens
tcctggagcttcagtttccttt

SEQ ID NO: 9458048 - DNA, 22 bp, Homo sapiens
tcctggagctggtgtctttccc

SEQ ID NO: 9458049 - DNA, 20 bp, Homo sapiens
tcctggagctgcttgaattc

SEQ ID NO: 9458050 - DNA, 19 bp, Homo sapiens
cattttcccatcatccttt

SEQ ID NO: 9458051 - DNA, 22 bp, Homo sapiens
cattttcctctgctggtgttca

SEQ ID NO: 9458052 - DNA, 22 bp, Homo sapiens
cattttcctctgctggtgttca

SEQ ID NO: 9458053 - DNA, 22 bp, Homo sapiens
cattttccacaggcctatttcc

SEQ ID NO: 9458054 - DNA, 19 bp, Homo sapiens
cattttcccatcatccttt

SEQ ID NO: 9458055 - DNA, 22 bp, Homo sapiens
cattttccacaggcctatttcc

SEQ ID NO: 9458056 - DNA, 19 bp, Homo sapiens
cattttcccatcatccttt

SEQ ID NO: 9458057 - DNA, 19 bp, Homo sapiens
cattttcccatcatccttt

SEQ ID NO: 9458058 - DNA, 22 bp, Homo sapiens
cattttcatgagtttctgttca

SEQ ID NO: 9458059 - DNA, 22 bp, Homo sapiens
cattttcatgagtttctgttca

SEQ ID NO: 9458060 - DNA, 22 bp, Homo sapiens
cattttccacaggcctatttcc

SEQ ID NO: 9458061 - DNA, 22 bp, Homo sapiens
cattttgtgcacacgtggagtt

SEQ ID NO: 9458062 - DNA, 22 bp, Homo sapiens
cattttgtgctagacactatgg

SEQ ID NO: 9458063 - DNA, 22 bp, Homo sapiens
cattttgtaagtctctcttgtt

SEQ ID NO: 9458064 - DNA, 22 bp, Homo sapiens
ccaaaaattagatacacatata

SEQ ID NO: 9458065 - DNA, 22 bp, Homo sapiens
ccaaaaagctcagagatatgtt

SEQ ID NO: 9458066 - DNA, 22 bp, Homo sapiens
ccaaaaagctcagagatatgtt

SEQ ID NO: 9458067 - DNA, 22 bp, Homo sapiens
ccaaaaagctcagagatatgtt

SEQ ID NO: 9458068 - DNA, 22 bp, Homo sapiens
ccaaaaagtacatttaggtgtg

SEQ ID NO: 9458069 - DNA, 22 bp, Homo sapiens
ccaaaaagtacatttaggtgtg

SEQ ID NO: 9458070 - DNA, 22 bp, Homo sapiens
tcctgagaaggcacagcttgca

SEQ ID NO: 9458071 - DNA, 22 bp, Homo sapiens
tcctgacttggctgttggccct

SEQ ID NO: 9458072 - DNA, 22 bp, Homo sapiens
tcctgagaaggcacagcttgca

SEQ ID NO: 9458073 - DNA, 20 bp, Homo sapiens
tcctgaggcttcgccagtgt

SEQ ID NO: 9458074 - DNA, 22 bp, Homo sapiens
tcctgagggactggttcctcgc

SEQ ID NO: 9458075 - DNA, 22 bp, Homo sapiens
tcctgagggcgattcagcaggt

SEQ ID NO: 9458076 - DNA, 22 bp, Homo sapiens
tcctgagggcgattcagcaggt

SEQ ID NO: 9458077 - DNA, 22 bp, Homo sapiens
tcctgagggactggttcctcgc

SEQ ID NO: 9458078 - DNA, 22 bp, Homo sapiens
tcctgagggctcggggctcatg

SEQ ID NO: 9458079 - DNA, 22 bp, Homo sapiens
tcctgagggctcggggctcatg

SEQ ID NO: 9458080 - DNA, 22 bp, Homo sapiens
tcctgagggctcggggctcatg

SEQ ID NO: 9458081 - DNA, 22 bp, Homo sapiens
tcctgagggcgattcagcaggt

SEQ ID NO: 9458082 - DNA, 22 bp, Homo sapiens
cattttaagatgacctggtttc

SEQ ID NO: 9458083 - DNA, 22 bp, Homo sapiens
cattttaaatgatttaagccaa

SEQ ID NO: 9458084 - DNA, 22 bp, Homo sapiens
cattttaaatgatttaagccaa

SEQ ID NO: 9458085 - DNA, 22 bp, Homo sapiens
cattttaaatgatttaagccaa

SEQ ID NO: 9458086 - DNA, 22 bp, Homo sapiens
cattttaagatgacctggtttc

SEQ ID NO: 9458087 - DNA, 22 bp, Homo sapiens
cattttaagatgacctggtttc

SEQ ID NO: 9458088 - DNA, 19 bp, Homo sapiens
cattttaagcatccccagt

SEQ ID NO: 9458089 - DNA, 19 bp, Homo sapiens
cattttaagcatccccagt

SEQ ID NO: 9458090 - DNA, 19 bp, Homo sapiens
cattttaagcatccccagt

SEQ ID NO: 9458091 - DNA, 22 bp, Homo sapiens
catttgtgcttttataaaatag

SEQ ID NO: 9458092 - DNA, 22 bp, Homo sapiens
catttgtgtgggaacccatcag

SEQ ID NO: 9458093 - DNA, 21 bp, Homo sapiens
catttctattgatgagaaaag

SEQ ID NO: 9458094 - DNA, 22 bp, Homo sapiens
catttgtcatcactgagctgcc

SEQ ID NO: 9458095 - DNA, 22 bp, Homo sapiens
catttctagggatcataaagta

SEQ ID NO: 9458096 - DNA, 22 bp, Homo sapiens
catttctatggcaatgggaaaa

SEQ ID NO: 9458097 - DNA, 21 bp, Homo sapiens
catttctattgatgagaaaag

SEQ ID NO: 9458098 - DNA, 21 bp, Homo sapiens
catttctattgatgagaaaag

SEQ ID NO: 9458099 - DNA, 23 bp, Homo sapiens
catttctaggtgtgtttggccat

SEQ ID NO: 9458100 - DNA, 22 bp, Homo sapiens
catttctatggcaatgggaaaa

SEQ ID NO: 9458101 - DNA, 22 bp, Homo sapiens
cattttatcctctgggaagcta

SEQ ID NO: 9458102 - DNA, 22 bp, Homo sapiens
cattttactgactcttgaatta

SEQ ID NO: 9458103 - DNA, 22 bp, Homo sapiens
cattttatgtttatggagtgct

SEQ ID NO: 9458104 - DNA, 22 bp, Homo sapiens
cattttatgtttatggagtgct

SEQ ID NO: 9458105 - DNA, 22 bp, Homo sapiens
cattttatgtttatggagtgct

SEQ ID NO: 9458106 - DNA, 22 bp, Homo sapiens
cattttcagcacccatctgaaa

SEQ ID NO: 9458107 - DNA, 22 bp, Homo sapiens
cattttcagcacccatctgaaa

SEQ ID NO: 9458108 - DNA, 22 bp, Homo sapiens
cattttcagcacccatctgaaa

SEQ ID NO: 9458109 - DNA, 22 bp, Homo sapiens
tccatacagtgactcaggaatc

SEQ ID NO: 9458110 - DNA, 21 bp, Homo sapiens
tccataagagaccatctccta

SEQ ID NO: 9458111 - DNA, 22 bp, Homo sapiens
tccataagcaggttcttcctga

SEQ ID NO: 9458112 - DNA, 19 bp, Homo sapiens
tccataagcttgtgttcat

SEQ ID NO: 9458113 - DNA, 18 bp, Homo sapiens
tccaggtcccaggggaag

SEQ ID NO: 9458114 - DNA, 18 bp, Homo sapiens
tccaggtcccaggggaag

SEQ ID NO: 9458115 - DNA, 22 bp, Homo sapiens
tccaggtccctggggagatttt

SEQ ID NO: 9458116 - DNA, 22 bp, Homo sapiens
tccagtttctctcaatcaatta

SEQ ID NO: 9458117 - DNA, 20 bp, Homo sapiens
tccagttttggagacattct

SEQ ID NO: 9458118 - DNA, 20 bp, Homo sapiens
tccagttttggagacattct

SEQ ID NO: 9458119 - DNA, 22 bp, Homo sapiens
tccagtttgggtgtgagctgcg

SEQ ID NO: 9458120 - DNA, 18 bp, Homo sapiens
tccagttttcccagcatc

SEQ ID NO: 9458121 - DNA, 22 bp, Homo sapiens
catttattggcatgtagtaggt

SEQ ID NO: 9458122 - DNA, 22 bp, Homo sapiens
catttcactattcactaaaagg

SEQ ID NO: 9458123 - DNA, 22 bp, Homo sapiens
catttcacgcacactcattact

SEQ ID NO: 9458124 - DNA, 22 bp, Homo sapiens
catttcacagtatattcaaaat

SEQ ID NO: 9458125 - DNA, 22 bp, Homo sapiens
tccatagtgaatgggtaatgca

SEQ ID NO: 9458126 - DNA, 22 bp, Homo sapiens
tccatagtagaaaatgggacag

SEQ ID NO: 9458127 - DNA, 23 bp, Homo sapiens
tccatactctaaacatgttattt

SEQ ID NO: 9458128 - DNA, 22 bp, Homo sapiens
tccatagtgaatgggtaatgca

SEQ ID NO: 9458129 - DNA, 22 bp, Homo sapiens
tccatacccagctttctcacac

SEQ ID NO: 9458130 - DNA, 22 bp, Homo sapiens
tccatacatatccaaagagaag

SEQ ID NO: 9458131 - DNA, 22 bp, Homo sapiens
tccatactcagaaagtattgca

SEQ ID NO: 9458132 - DNA, 22 bp, Homo sapiens
tccatacatatccaaagagaag

SEQ ID NO: 9458133 - DNA, 22 bp, Homo sapiens
tccatacatacagatatgcatt

SEQ ID NO: 9458134 - DNA, 22 bp, Homo sapiens
tccatacatacagatatgcatt

SEQ ID NO: 9458135 - DNA, 21 bp, Homo sapiens
catttcatgattatagaaatg

SEQ ID NO: 9458136 - DNA, 21 bp, Homo sapiens
catttcagtaaggaagcctgt

SEQ ID NO: 9458137 - DNA, 22 bp, Homo sapiens
catttcactattcactaaaagg

SEQ ID NO: 9458138 - DNA, 22 bp, Homo sapiens
catttcagtgtcttgtgatgaa

SEQ ID NO: 9458139 - DNA, 22 bp, Homo sapiens
catttcatagttgtcacaataa

SEQ ID NO: 9458140 - DNA, 22 bp, Homo sapiens
catttctacagcttcttcagaa

SEQ ID NO: 9458141 - DNA, 21 bp, Homo sapiens
catttctaagcctggctatag

SEQ ID NO: 9458142 - DNA, 21 bp, Homo sapiens
catttctaagcctggctatag

SEQ ID NO: 9458143 - DNA, 21 bp, Homo sapiens
catttctaagcctggctatag

SEQ ID NO: 9458144 - DNA, 22 bp, Homo sapiens
catttctaagaaggctgcacat

SEQ ID NO: 9458145 - DNA, 22 bp, Homo sapiens
catttctaagaaggctgcacat

SEQ ID NO: 9458146 - DNA, 22 bp, Homo sapiens
catttctaagaaggctgcacat

SEQ ID NO: 9458147 - DNA, 22 bp, Homo sapiens
catttctagagtcccaagaggt

SEQ ID NO: 9458148 - DNA, 22 bp, Homo sapiens
catttctaccaaatgtgactgg

SEQ ID NO: 9458149 - DNA, 22 bp, Homo sapiens
catttctaccaaatgtgactgg

SEQ ID NO: 9458150 - DNA, 22 bp, Homo sapiens
catttctagacaagtcctggag

SEQ ID NO: 9458151 - DNA, 22 bp, Homo sapiens
catttccttcctgctgctcctc

SEQ ID NO: 9458152 - DNA, 22 bp, Homo sapiens
catttctaagaagatctgggta

SEQ ID NO: 9458153 - DNA, 22 bp, Homo sapiens
catttctaagaagatctgggta

SEQ ID NO: 9458154 - DNA, 22 bp, Homo sapiens
catttccacttctgaaaactgg

SEQ ID NO: 9458155 - DNA, 19 bp, Homo sapiens
tcataaggagagaggaaat

SEQ ID NO: 9458156 - DNA, 22 bp, Homo sapiens
tcataagctagctgcaccatat

SEQ ID NO: 9458157 - DNA, 22 bp, Homo sapiens
tcataacaggctgagaggattt

SEQ ID NO: 9458158 - DNA, 22 bp, Homo sapiens
tcataacaggctgagaggattt

SEQ ID NO: 9458159 - DNA, 22 bp, Homo sapiens
tcataacactggtgattaagaa

SEQ ID NO: 9458160 - DNA, 22 bp, Homo sapiens
tcagtttcacagtctgtgcaga

SEQ ID NO: 9458161 - DNA, 22 bp, Homo sapiens
tcagtttcacttgaagaaaaga

SEQ ID NO: 9458162 - DNA, 22 bp, Homo sapiens
tcagtttcctcatctacaaaag

SEQ ID NO: 9458163 - DNA, 22 bp, Homo sapiens
tcagtttcctggttgtgatatt

SEQ ID NO: 9458164 - DNA, 22 bp, Homo sapiens
tcagtttcctcatctacaaaag

SEQ ID NO: 9458165 - DNA, 22 bp, Homo sapiens
tcagtttcctggttttaatatt

SEQ ID NO: 9458166 - DNA, 22 bp, Homo sapiens
tcataaattgggttggctgggt

SEQ ID NO: 9458167 - DNA, 22 bp, Homo sapiens
tcataaattgggttggctgggt

SEQ ID NO: 9458168 - DNA, 22 bp, Homo sapiens
catctacctccaccctatatat

SEQ ID NO: 9458169 - DNA, 22 bp, Homo sapiens
catctacatgcttgccactgct

SEQ ID NO: 9458170 - DNA, 22 bp, Homo sapiens
catctactttaaggattctggg

SEQ ID NO: 9458171 - DNA, 23 bp, Homo sapiens
catctagcatccagtgagtagtg

SEQ ID NO: 9458172 - DNA, 22 bp, Homo sapiens
catctactttaaggattctggg

SEQ ID NO: 9458173 - DNA, 22 bp, Homo sapiens
catctaaatttgactccaagga

SEQ ID NO: 9458174 - DNA, 22 bp, Homo sapiens
catctaaccagtcgtttttgga

SEQ ID NO: 9458175 - DNA, 18 bp, Homo sapiens
catctacaaatgccagaa

SEQ ID NO: 9458176 - DNA, 22 bp, Homo sapiens
catctacaggagaatgtcactg

SEQ ID NO: 9458177 - DNA, 17 bp, Homo sapiens
catccgtgagctcggca

SEQ ID NO: 9458178 - DNA, 22 bp, Homo sapiens
catcctgacaagaaagccagaa

SEQ ID NO: 9458179 - DNA, 19 bp, Homo sapiens
tcagtgtgtgggaggtggt

SEQ ID NO: 9458180 - DNA, 22 bp, Homo sapiens
catccctgtctgccactctgaa

SEQ ID NO: 9458181 - DNA, 19 bp, Homo sapiens
tcagtgtgtgggaggtggt

SEQ ID NO: 9458182 - DNA, 22 bp, Homo sapiens
catccttcaaaggctacaatta

SEQ ID NO: 9458183 - DNA, 22 bp, Homo sapiens
catccttctcaaagagtgcatg

SEQ ID NO: 9458184 - DNA, 22 bp, Homo sapiens
catcctgagaggtctctctacc

SEQ ID NO: 9458185 - DNA, 22 bp, Homo sapiens
catcctgcggggagcagagggc

SEQ ID NO: 9458186 - DNA, 22 bp, Homo sapiens
catcctgacccatgggagggga

SEQ ID NO: 9458187 - DNA, 22 bp, Homo sapiens
catcctgactgggtaaagctta

SEQ ID NO: 9458188 - DNA, 22 bp, Homo sapiens
catcctgactgtaactaagaga

SEQ ID NO: 9458189 - DNA, 22 bp, Homo sapiens
catcctgagaaaataaaggaga

SEQ ID NO: 9458190 - DNA, 22 bp, Homo sapiens
tcatacaactaagagtttcaga

SEQ ID NO: 9458191 - DNA, 22 bp, Homo sapiens
tcatacaaggagggtgttcaaa

SEQ ID NO: 9458192 - DNA, 22 bp, Homo sapiens
tcatacacaagagcatgtaaca

SEQ ID NO: 9458193 - DNA, 22 bp, Homo sapiens
tcatacaattcaatctctgatt

SEQ ID NO: 9458194 - DNA, 20 bp, Homo sapiens
tcatacacatgagcatgcag

SEQ ID NO: 9458195 - DNA, 20 bp, Homo sapiens
tcatacacatgagcatgcag

SEQ ID NO: 9458196 - DNA, 22 bp, Homo sapiens
tcatacacattcttattacttt

SEQ ID NO: 9458197 - DNA, 20 bp, Homo sapiens
tcatacacatgagcatgcag

SEQ ID NO: 9458198 - DNA, 22 bp, Homo sapiens
tcatacacctatctctctgtgc

SEQ ID NO: 9458199 - DNA, 22 bp, Homo sapiens
tcataattgtatacatttatgg

SEQ ID NO: 9458200 - DNA, 22 bp, Homo sapiens
tcataattgtatacatttatgg

SEQ ID NO: 9458201 - DNA, 22 bp, Homo sapiens
tcataattgtatacatttatgg

SEQ ID NO: 9458202 - DNA, 22 bp, Homo sapiens
tcataattgtatacatttatgg

SEQ ID NO: 9458203 - DNA, 22 bp, Homo sapiens
tcataagtggtttatatgcttg

SEQ ID NO: 9458204 - DNA, 22 bp, Homo sapiens
tcataagtaatttaaacattcc

SEQ ID NO: 9458205 - DNA, 22 bp, Homo sapiens
tcataatgaccccagagtccgc

SEQ ID NO: 9458206 - DNA, 22 bp, Homo sapiens
tcataatgtagttcatggctgg

SEQ ID NO: 9458207 - DNA, 22 bp, Homo sapiens
tcataatgacaaacatactcag

SEQ ID NO: 9458208 - DNA, 22 bp, Homo sapiens
tcatacataacttgtacagtga

SEQ ID NO: 9458209 - DNA, 22 bp, Homo sapiens
tcatacataacttgtacagtga

SEQ ID NO: 9458210 - DNA, 22 bp, Homo sapiens
tcatacataaataagagtttag

SEQ ID NO: 9458211 - DNA, 22 bp, Homo sapiens
tcatacataaataagagtttag

SEQ ID NO: 9458212 - DNA, 22 bp, Homo sapiens
tcatacaggctcaagctatacg

SEQ ID NO: 9458213 - DNA, 22 bp, Homo sapiens
tcatacaggctcaagctatacg

SEQ ID NO: 9458214 - DNA, 22 bp, Homo sapiens
tcatcacaattttatgaccctc

SEQ ID NO: 9458215 - DNA, 22 bp, Homo sapiens
tcatcaaagtcaaagaatgact

SEQ ID NO: 9458216 - DNA, 22 bp, Homo sapiens
tcatcacatatgtcatgatttg

SEQ ID NO: 9458217 - DNA, 22 bp, Homo sapiens
tcatcagcaccctatgtccttt

SEQ ID NO: 9458218 - DNA, 22 bp, Homo sapiens
tcatcagctcatctgctcctag

SEQ ID NO: 9458219 - DNA, 20 bp, Homo sapiens
tcatcagataggttagtaca

SEQ ID NO: 9458220 - DNA, 19 bp, Homo sapiens
tcatcacttcagaggaaaa

SEQ ID NO: 9458221 - DNA, 22 bp, Homo sapiens
tcatcacatgtgtagtcatccc

SEQ ID NO: 9458222 - DNA, 22 bp, Homo sapiens
tcatcactcattggacaacaga

SEQ ID NO: 9458223 - DNA, 22 bp, Homo sapiens
catcagctttggcgctgagcat

SEQ ID NO: 9458224 - DNA, 22 bp, Homo sapiens
catcagcttttctatgtggtga

SEQ ID NO: 9458225 - DNA, 22 bp, Homo sapiens
catcagcaggcaacactcttgg

SEQ ID NO: 9458226 - DNA, 22 bp, Homo sapiens
catcagcaggcaacactcttgg

SEQ ID NO: 9458227 - DNA, 22 bp, Homo sapiens
catcagcactatgattaaagta

SEQ ID NO: 9458228 - DNA, 22 bp, Homo sapiens
catcagagtggtggcctggtgt

SEQ ID NO: 9458229 - DNA, 22 bp, Homo sapiens
catcagctgagggtgagcagaa

SEQ ID NO: 9458230 - DNA, 22 bp, Homo sapiens
catcagctcttcattcttgatt

SEQ ID NO: 9458231 - DNA, 22 bp, Homo sapiens
catcagctcttcattcttgatt

SEQ ID NO: 9458232 - DNA, 22 bp, Homo sapiens
catcagctgagggtgagcagaa

SEQ ID NO: 9458233 - DNA, 22 bp, Homo sapiens
catcagcagtcacatgatgctg

SEQ ID NO: 9458234 - DNA, 22 bp, Homo sapiens
catcagtgcggcatctgtcatc

SEQ ID NO: 9458235 - DNA, 22 bp, Homo sapiens
catcagtggatatagattagcg

SEQ ID NO: 9458236 - DNA, 22 bp, Homo sapiens
catcagtggtaactgaatggtt

SEQ ID NO: 9458237 - DNA, 22 bp, Homo sapiens
catcagtgtctctctggtactt

SEQ ID NO: 9458238 - DNA, 22 bp, Homo sapiens
catcagtgtggcagttcactgt

SEQ ID NO: 9458239 - DNA, 22 bp, Homo sapiens
catcagtgttggcttctcagag

SEQ ID NO: 9458240 - DNA, 22 bp, Homo sapiens
catcagtgttgatccaccagca

SEQ ID NO: 9458241 - DNA, 22 bp, Homo sapiens
catcagtgtgttgccttgctca

SEQ ID NO: 9458242 - DNA, 22 bp, Homo sapiens
catcagtgttcactattccttc

SEQ ID NO: 9458243 - DNA, 22 bp, Homo sapiens
catcagtgttcactattccttc

SEQ ID NO: 9458244 - DNA, 20 bp, Homo sapiens
catcagtgcctgacaggtcc

SEQ ID NO: 9458245 - DNA, 22 bp, Homo sapiens
catcagtgcccttggggatgcc

SEQ ID NO: 9458246 - DNA, 20 bp, Homo sapiens
catcagtgcctgacaggtcc

SEQ ID NO: 9458247 - DNA, 22 bp, Homo sapiens
catcagtgagccccttgatgag

SEQ ID NO: 9458248 - DNA, 23 bp, Homo sapiens
catcagtgagggggaatcactaa

SEQ ID NO: 9458249 - DNA, 22 bp, Homo sapiens
catcagtgaaagtgaatgttct

SEQ ID NO: 9458250 - DNA, 23 bp, Homo sapiens
tcagtgtgcaagaatggagaagc

SEQ ID NO: 9458251 - DNA, 22 bp, Homo sapiens
tcagtgtggcccagggaagcag

SEQ ID NO: 9458252 - DNA, 22 bp, Homo sapiens
tcagtgtgcactctgtgaccca

SEQ ID NO: 9458253 - DNA, 22 bp, Homo sapiens
tcagtgtgtacactgagcattt

SEQ ID NO: 9458254 - DNA, 22 bp, Homo sapiens
tcagtgtgtagtaaattgtagg

SEQ ID NO: 9458255 - DNA, 22 bp, Homo sapiens
tcagtgtgtacactgagcattt

SEQ ID NO: 9458256 - DNA, 20 bp, Homo sapiens
tcagtgtggcggggacctca

SEQ ID NO: 9458257 - DNA, 22 bp, Homo sapiens
tcagtgtgaggggctgggtcct

SEQ ID NO: 9458258 - DNA, 22 bp, Homo sapiens
tcagtgtgaattcaggagccta

SEQ ID NO: 9458259 - DNA, 22 bp, Homo sapiens
tcagtgtcttgggcttgaatgc

SEQ ID NO: 9458260 - DNA, 22 bp, Homo sapiens
tcagtgctgctttatgacagtt

SEQ ID NO: 9458261 - DNA, 22 bp, Homo sapiens
catcatcacctgctatacgatc

SEQ ID NO: 9458262 - DNA, 22 bp, Homo sapiens
tcagtgctgtaaacaaaaggaa

SEQ ID NO: 9458263 - DNA, 22 bp, Homo sapiens
tcagtgctgctttatgacagtt

SEQ ID NO: 9458264 - DNA, 22 bp, Homo sapiens
tcagtgctgtgtaaatgtatta

SEQ ID NO: 9458265 - DNA, 22 bp, Homo sapiens
tcagtgctgtgtaaatgtatta

SEQ ID NO: 9458266 - DNA, 22 bp, Homo sapiens
tcagtgtcttctctttcctacc

SEQ ID NO: 9458267 - DNA, 22 bp, Homo sapiens
tcagtgtcttctctttcctacc

SEQ ID NO: 9458268 - DNA, 22 bp, Homo sapiens
tcagtgtcttctctttcctacc

SEQ ID NO: 9458269 - DNA, 22 bp, Homo sapiens
tcagtgtcttgacctgggtgtg

SEQ ID NO: 9458270 - DNA, 22 bp, Homo sapiens
catcataaaattgagataactg

SEQ ID NO: 9458271 - DNA, 22 bp, Homo sapiens
catcataataacccagacacag

SEQ ID NO: 9458272 - DNA, 22 bp, Homo sapiens
catcatcaaaagtgacagagaa

SEQ ID NO: 9458273 - DNA, 22 bp, Homo sapiens
catcatatatttctacaagtgc

SEQ ID NO: 9458274 - DNA, 22 bp, Homo sapiens
tcaggcagagctgtggagctct

SEQ ID NO: 9458275 - DNA, 22 bp, Homo sapiens
catatgtatttctcataattag

SEQ ID NO: 9458276 - DNA, 22 bp, Homo sapiens
tcaggcagagggagaagccaag

SEQ ID NO: 9458277 - DNA, 22 bp, Homo sapiens
tcaggcagagggagaagccaag

SEQ ID NO: 9458278 - DNA, 22 bp, Homo sapiens
tcaggcagaccaccgtgggcag

SEQ ID NO: 9458279 - DNA, 22 bp, Homo sapiens
tcaggcagaccaccgtgggcag

SEQ ID NO: 9458280 - DNA, 22 bp, Homo sapiens
tcaggcagaccaccgtgggcag

SEQ ID NO: 9458281 - DNA, 22 bp, Homo sapiens
tcaggcagaattatcaaaagat

SEQ ID NO: 9458282 - DNA, 22 bp, Homo sapiens
tcaggcagaattatcaaaagat

SEQ ID NO: 9458283 - DNA, 22 bp, Homo sapiens
tcaggcagagctgtggagctct

SEQ ID NO: 9458284 - DNA, 19 bp, Homo sapiens
catatttttgggctggcat

SEQ ID NO: 9458285 - DNA, 21 bp, Homo sapiens
catattaaatcggtgccttta

SEQ ID NO: 9458286 - DNA, 21 bp, Homo sapiens
catattaaatcggtgccttta

SEQ ID NO: 9458287 - DNA, 22 bp, Homo sapiens
catcaaaattagacattgttga

SEQ ID NO: 9458288 - DNA, 22 bp, Homo sapiens
catcaaagcttttttctgtgtt

SEQ ID NO: 9458289 - DNA, 22 bp, Homo sapiens
catcaaagggcctgtggtgcag

SEQ ID NO: 9458290 - DNA, 22 bp, Homo sapiens
catcaaaattagacattgttga

SEQ ID NO: 9458291 - DNA, 17 bp, Homo sapiens
catcaaagaaatttcca

SEQ ID NO: 9458292 - DNA, 22 bp, Homo sapiens
catcaaatggcaagtgaaagct

SEQ ID NO: 9458293 - DNA, 22 bp, Homo sapiens
catcaaagttggtatatttgca

SEQ ID NO: 9458294 - DNA, 22 bp, Homo sapiens
catcaaagttgatatccaatta

SEQ ID NO: 9458295 - DNA, 22 bp, Homo sapiens
catcaaagttgatatccaatta

SEQ ID NO: 9458296 - DNA, 22 bp, Homo sapiens
catcaaagttggtatatttgca

SEQ ID NO: 9458297 - DNA, 22 bp, Homo sapiens
catcaaataggaatatttggca

SEQ ID NO: 9458298 - DNA, 22 bp, Homo sapiens
tcaggctgcccgttcagggctc

SEQ ID NO: 9458299 - DNA, 18 bp, Homo sapiens
tcaggctgccctgtgtct

SEQ ID NO: 9458300 - DNA, 22 bp, Homo sapiens
tcaggctgcctatcagactgtg

SEQ ID NO: 9458301 - DNA, 22 bp, Homo sapiens
catcacattagtctcaagagaa

SEQ ID NO: 9458302 - DNA, 22 bp, Homo sapiens
catcacattagtctcaagagaa

SEQ ID NO: 9458303 - DNA, 22 bp, Homo sapiens
catcagagtcagagctctttct

SEQ ID NO: 9458304 - DNA, 21 bp, Homo sapiens
catcacattactcaaagtcct

SEQ ID NO: 9458305 - DNA, 21 bp, Homo sapiens
catcacattactcaaagtcct

SEQ ID NO: 9458306 - DNA, 22 bp, Homo sapiens
tcaggctgcagctgtcagcagc

SEQ ID NO: 9458307 - DNA, 22 bp, Homo sapiens
catcaacagtgtcagatgatgc

SEQ ID NO: 9458308 - DNA, 22 bp, Homo sapiens
catcaagagtcttactatcagt

SEQ ID NO: 9458309 - DNA, 20 bp, Homo sapiens
catcaacaccttgtcagcct

SEQ ID NO: 9458310 - DNA, 20 bp, Homo sapiens
catcaacaccttgtcagcct

SEQ ID NO: 9458311 - DNA, 21 bp, Homo sapiens
catcaactcttgtgctcacac

SEQ ID NO: 9458312 - DNA, 23 bp, Homo sapiens
catcaagtacttttgacaagtgt

SEQ ID NO: 9458313 - DNA, 22 bp, Homo sapiens
catcaagtcatcaaagaattca

SEQ ID NO: 9458314 - DNA, 22 bp, Homo sapiens
catcaatgtgcagagatgaacg

SEQ ID NO: 9458315 - DNA, 22 bp, Homo sapiens
tcaggaggcggaggttgcagtg

SEQ ID NO: 9458316 - DNA, 22 bp, Homo sapiens
tcaggaatgaggataaacattg

SEQ ID NO: 9458317 - DNA, 22 bp, Homo sapiens
tcaggaggccaccaggacctgt

SEQ ID NO: 9458318 - DNA, 22 bp, Homo sapiens
tcaggaggccaccaggacctgt

SEQ ID NO: 9458319 - DNA, 22 bp, Homo sapiens
tcaggaggctcaagacctggca

SEQ ID NO: 9458320 - DNA, 22 bp, Homo sapiens
tcaggaggcgtctcgctggggc

SEQ ID NO: 9458321 - DNA, 22 bp, Homo sapiens
tcaggcagaaaaatcactaatt

SEQ ID NO: 9458322 - DNA, 22 bp, Homo sapiens
tcaggcagaattatcaaaagat

SEQ ID NO: 9458323 - DNA, 22 bp, Homo sapiens
tcaggcagaattatcaaaagat

SEQ ID NO: 9458324 - DNA, 22 bp, Homo sapiens
tcaggcagaattatcaaaagat

SEQ ID NO: 9458325 - DNA, 22 bp, Homo sapiens
cagtgtcaccaggcgagtctcc

SEQ ID NO: 9458326 - DNA, 22 bp, Homo sapiens
cagtgtacttggaatgtaacag

SEQ ID NO: 9458327 - DNA, 22 bp, Homo sapiens
cagtggtttccaaacttgttcc

SEQ ID NO: 9458328 - DNA, 22 bp, Homo sapiens
cagtggtttctgaacagtgtgc

SEQ ID NO: 9458329 - DNA, 22 bp, Homo sapiens
cagtggttttgagattcagggt

SEQ ID NO: 9458330 - DNA, 22 bp, Homo sapiens
cagtggttttatatctaagctt

SEQ ID NO: 9458331 - DNA, 22 bp, Homo sapiens
cagtgtcaggatcagtatattt

SEQ ID NO: 9458332 - DNA, 22 bp, Homo sapiens
cagtgtcaggatcagtatattt

SEQ ID NO: 9458333 - DNA, 22 bp, Homo sapiens
cagtgtctacagtggctggagg

SEQ ID NO: 9458334 - DNA, 22 bp, Homo sapiens
cagtgtctcaaaacaagttgct

SEQ ID NO: 9458335 - DNA, 22 bp, Homo sapiens
tcacttatgtgtgattgatgcc

SEQ ID NO: 9458336 - DNA, 22 bp, Homo sapiens
tcacttattgctcatctcatgc

SEQ ID NO: 9458337 - DNA, 22 bp, Homo sapiens
tcacttattgctcatctcatgc

SEQ ID NO: 9458338 - DNA, 22 bp, Homo sapiens
tcacttcacacccactatcatg

SEQ ID NO: 9458339 - DNA, 22 bp, Homo sapiens
tcactgtttcctgtactggaca

SEQ ID NO: 9458340 - DNA, 22 bp, Homo sapiens
tcacttaaaaattctagttatg

SEQ ID NO: 9458341 - DNA, 22 bp, Homo sapiens
tcacttaaaaattctagttatg

SEQ ID NO: 9458342 - DNA, 22 bp, Homo sapiens
tcacttagatggggatcatcac

SEQ ID NO: 9458343 - DNA, 21 bp, Homo sapiens
tcacttataatgtatttgctg

SEQ ID NO: 9458344 - DNA, 22 bp, Homo sapiens
tcacttataaaatgcaagatct

SEQ ID NO: 9458345 - DNA, 22 bp, Homo sapiens
tcacttagatggggatcatcac

SEQ ID NO: 9458346 - DNA, 22 bp, Homo sapiens
tcacttagatggggatcatcac

SEQ ID NO: 9458347 - DNA, 22 bp, Homo sapiens
catgctggtcagccagtggatg

SEQ ID NO: 9458348 - DNA, 22 bp, Homo sapiens
catgctggtcagccagtggatg

SEQ ID NO: 9458349 - DNA, 22 bp, Homo sapiens
catgctggtcagccagtggatg

SEQ ID NO: 9458350 - DNA, 22 bp, Homo sapiens
catgctgtcctgaaaagatatt

SEQ ID NO: 9458351 - DNA, 22 bp, Homo sapiens
catgctgtggtaaatcactgaa

SEQ ID NO: 9458352 - DNA, 22 bp, Homo sapiens
tccaagaagcttacaatctaat

SEQ ID NO: 9458353 - DNA, 22 bp, Homo sapiens
catgctctgcagcagacctgtg

SEQ ID NO: 9458354 - DNA, 22 bp, Homo sapiens
catgctctgcagcagacctgtg

SEQ ID NO: 9458355 - DNA, 22 bp, Homo sapiens
catgctgagcacattctgtatt

SEQ ID NO: 9458356 - DNA, 22 bp, Homo sapiens
catgctgagcacattctgtatt

SEQ ID NO: 9458357 - DNA, 22 bp, Homo sapiens
catgctgattcttcctgagctt

SEQ ID NO: 9458358 - DNA, 22 bp, Homo sapiens
tcatcagggatattggcctgaa

SEQ ID NO: 9458359 - DNA, 22 bp, Homo sapiens
tcatcagctcatctgctcctag

SEQ ID NO: 9458360 - DNA, 22 bp, Homo sapiens
catgcattttctattcactcag

SEQ ID NO: 9458361 - DNA, 22 bp, Homo sapiens
catgctccaaaaacaagagaat

SEQ ID NO: 9458362 - DNA, 22 bp, Homo sapiens
catgctctctggcaacttgtgt

SEQ ID NO: 9458363 - DNA, 22 bp, Homo sapiens
catgctctctggcaacttgtgt

SEQ ID NO: 9458364 - DNA, 22 bp, Homo sapiens
catgctctagattctctctaat

SEQ ID NO: 9458365 - DNA, 22 bp, Homo sapiens
catgctctccattggacacaga

SEQ ID NO: 9458366 - DNA, 22 bp, Homo sapiens
tccaagaggagacactgggatg

SEQ ID NO: 9458367 - DNA, 22 bp, Homo sapiens
tccaagagttcaaggctacagt

SEQ ID NO: 9458368 - DNA, 22 bp, Homo sapiens
tccaagatctacagcagtttag

SEQ ID NO: 9458369 - DNA, 22 bp, Homo sapiens
tccaagatctacagcagtttag

SEQ ID NO: 9458370 - DNA, 22 bp, Homo sapiens
tccaagatctacagcagtttag

SEQ ID NO: 9458371 - DNA, 22 bp, Homo sapiens
tccaagaatacagatttgtgaa

SEQ ID NO: 9458372 - DNA, 22 bp, Homo sapiens
tccaagaatcactgacacagct

SEQ ID NO: 9458373 - DNA, 22 bp, Homo sapiens
tccaagagaatactggagagta

SEQ ID NO: 9458374 - DNA, 23 bp, Homo sapiens
tccaagaagtagggcctggactt

SEQ ID NO: 9458375 - DNA, 22 bp, Homo sapiens
tccaagaagtttcgttaaatgt

SEQ ID NO: 9458376 - DNA, 22 bp, Homo sapiens
tccaagaagtcatctaaactgt

SEQ ID NO: 9458377 - DNA, 22 bp, Homo sapiens
tccaagcatgtggtcaggagcc

SEQ ID NO: 9458378 - DNA, 22 bp, Homo sapiens
tccaagcactgttaattaaact

SEQ ID NO: 9458379 - DNA, 22 bp, Homo sapiens
tccaagcaacaactaatttaca

SEQ ID NO: 9458380 - DNA, 18 bp, Homo sapiens
tccagagagggagaagtg

SEQ ID NO: 9458381 - DNA, 22 bp, Homo sapiens
tccagaggtatgtagagagtat

SEQ ID NO: 9458382 - DNA, 18 bp, Homo sapiens
tccagagagggagaagtg

SEQ ID NO: 9458383 - DNA, 22 bp, Homo sapiens
tccagaggtatgtagagagtat

SEQ ID NO: 9458384 - DNA, 18 bp, Homo sapiens
tccagagagggagaagtg

SEQ ID NO: 9458385 - DNA, 17 bp, Homo sapiens
tccagagaggcttccct

SEQ ID NO: 9458386 - DNA, 18 bp, Homo sapiens
tccagaggtgttggagcc

SEQ ID NO: 9458387 - DNA, 22 bp, Homo sapiens
tccagatagagtcctgttagta

SEQ ID NO: 9458388 - DNA, 22 bp, Homo sapiens
tccagaggtgaacacccaggca

SEQ ID NO: 9458389 - DNA, 22 bp, Homo sapiens
tccagaggtgaacacccaggca

SEQ ID NO: 9458390 - DNA, 22 bp, Homo sapiens
tccagaggtgaacacccaggca

SEQ ID NO: 9458391 - DNA, 18 bp, Homo sapiens
tccagaggtgttggagcc

SEQ ID NO: 9458392 - DNA, 18 bp, Homo sapiens
tccagaggtgttggagcc

SEQ ID NO: 9458393 - DNA, 23 bp, Homo sapiens
catggaaaactgaaagctgacct

SEQ ID NO: 9458394 - DNA, 22 bp, Homo sapiens
catgggctctctgagctccagg

SEQ ID NO: 9458395 - DNA, 22 bp, Homo sapiens
catggaacaaggaagatgtttg

SEQ ID NO: 9458396 - DNA, 22 bp, Homo sapiens
catgggctcttctggactgcac

SEQ ID NO: 9458397 - DNA, 22 bp, Homo sapiens
catgggctcttctggactgcac

SEQ ID NO: 9458398 - DNA, 19 bp, Homo sapiens
catggtgaaaccccgtctc

SEQ ID NO: 9458399 - DNA, 19 bp, Homo sapiens
catggtgaaaccccgtctc

SEQ ID NO: 9458400 - DNA, 19 bp, Homo sapiens
catggtgaaaccccgtctc

SEQ ID NO: 9458401 - DNA, 22 bp, Homo sapiens
catggtttcatgagaattaccc

SEQ ID NO: 9458402 - DNA, 22 bp, Homo sapiens
catggtgaggggtgaagggcag

SEQ ID NO: 9458403 - DNA, 19 bp, Homo sapiens
catggtgaaaccccgtctc

SEQ ID NO: 9458404 - DNA, 22 bp, Homo sapiens
catgtaaaccattgtgagcatc

SEQ ID NO: 9458405 - DNA, 22 bp, Homo sapiens
catgtaaaacactcagaacagt

SEQ ID NO: 9458406 - DNA, 22 bp, Homo sapiens
catgtaaaaagaagaatctgga

SEQ ID NO: 9458407 - DNA, 22 bp, Homo sapiens
catgtaaaacactcagaacagt

SEQ ID NO: 9458408 - DNA, 22 bp, Homo sapiens
catgtaaaaagaagaatctgga

SEQ ID NO: 9458409 - DNA, 22 bp, Homo sapiens
catgtaaaaaattaggtcatct

SEQ ID NO: 9458410 - DNA, 22 bp, Homo sapiens
catgtaaaaaattaggtcatct

SEQ ID NO: 9458411 - DNA, 22 bp, Homo sapiens
catgtacaaaaggcaaatgcct

SEQ ID NO: 9458412 - DNA, 22 bp, Homo sapiens
catgtaaatccttctttaggcc

SEQ ID NO: 9458413 - DNA, 22 bp, Homo sapiens
catgtaaagcatccttctaggg

SEQ ID NO: 9458414 - DNA, 22 bp, Homo sapiens
catgtaaagcatccttctaggg

SEQ ID NO: 9458415 - DNA, 22 bp, Homo sapiens
catgtaaagaatttcacacaag

SEQ ID NO: 9458416 - DNA, 22 bp, Homo sapiens
catgtaaagcacttcataacag

SEQ ID NO: 9458417 - DNA, 22 bp, Homo sapiens
catgtaaagcacttcataacag

SEQ ID NO: 9458418 - DNA, 22 bp, Homo sapiens
catgtaaagaatttcacacaag

SEQ ID NO: 9458419 - DNA, 22 bp, Homo sapiens
catgtaaagaatttcacacaag

SEQ ID NO: 9458420 - DNA, 22 bp, Homo sapiens
catgtaaaccattgtgagcatc

SEQ ID NO: 9458421 - DNA, 22 bp, Homo sapiens
catgctttttgacaacaagctg

SEQ ID NO: 9458422 - DNA, 22 bp, Homo sapiens
catgcttttttctagtataaat

SEQ ID NO: 9458423 - DNA, 23 bp, Homo sapiens
catggaaaactgaaagctgacct

SEQ ID NO: 9458424 - DNA, 22 bp, Homo sapiens
catgcttttttctagtataaat

SEQ ID NO: 9458425 - DNA, 22 bp, Homo sapiens
catgctttctgtccaaatgtta

SEQ ID NO: 9458426 - DNA, 22 bp, Homo sapiens
catgcttttcaatctatcttaa

SEQ ID NO: 9458427 - DNA, 22 bp, Homo sapiens
catgctttgggtcagaaatgcc

SEQ ID NO: 9458428 - DNA, 22 bp, Homo sapiens
catgctttgggtcagaaatgcc

SEQ ID NO: 9458429 - DNA, 22 bp, Homo sapiens
catgctttgggtcagaaatgcc

SEQ ID NO: 9458430 - DNA, 22 bp, Homo sapiens
catgctttaccaaagcagtgat

SEQ ID NO: 9458431 - DNA, 22 bp, Homo sapiens
catgcttcctccaaactaccct

SEQ ID NO: 9458432 - DNA, 22 bp, Homo sapiens
catgcttcatgcaaaattctga

SEQ ID NO: 9458433 - DNA, 22 bp, Homo sapiens
catgcttcctccaaactaccct

SEQ ID NO: 9458434 - DNA, 22 bp, Homo sapiens
catgcttcacacactgaatgac

SEQ ID NO: 9458435 - DNA, 22 bp, Homo sapiens
catgcttcacacactgaatgac

SEQ ID NO: 9458436 - DNA, 22 bp, Homo sapiens
catgcttcatgcaaaattctga

SEQ ID NO: 9458437 - DNA, 22 bp, Homo sapiens
catgcttatatggaaaggaaga

SEQ ID NO: 9458438 - DNA, 22 bp, Homo sapiens
catgcttacttgtctcagcaga

SEQ ID NO: 9458439 - DNA, 22 bp, Homo sapiens
catgcttacttgtctcagcaga

SEQ ID NO: 9458440 - DNA, 22 bp, Homo sapiens
catgcttatgatttgctaagcc

SEQ ID NO: 9458441 - DNA, 22 bp, Homo sapiens
catgcttattcattctgctaac

SEQ ID NO: 9458442 - DNA, 22 bp, Homo sapiens
catgcttacctgccaaagcact

SEQ ID NO: 9458443 - DNA, 22 bp, Homo sapiens
catgcttaattggagcattcat

SEQ ID NO: 9458444 - DNA, 22 bp, Homo sapiens
catgcttaaaaatgcagagagt

SEQ ID NO: 9458445 - DNA, 22 bp, Homo sapiens
tccagcaaagtgataggatttc

SEQ ID NO: 9458446 - DNA, 22 bp, Homo sapiens
tccagatggatttaagacctaa

SEQ ID NO: 9458447 - DNA, 22 bp, Homo sapiens
tccagcacagaatttcctagct

SEQ ID NO: 9458448 - DNA, 22 bp, Homo sapiens
tccagcacagaatttcctagct

SEQ ID NO: 9458449 - DNA, 20 bp, Homo sapiens
tccagcaccctcacagagaa

SEQ ID NO: 9458450 - DNA, 22 bp, Homo sapiens
tccagcacccaatgtggctaag

SEQ ID NO: 9458451 - DNA, 22 bp, Homo sapiens
tccagcacctggaggcgtcccc

SEQ ID NO: 9458452 - DNA, 22 bp, Homo sapiens
tccagcactcgcccagggcttg

SEQ ID NO: 9458453 - DNA, 20 bp, Homo sapiens
tccagcaccctcacagagaa

SEQ ID NO: 9458454 - DNA, 22 bp, Homo sapiens
tccagcagaaaagaggtaggga

SEQ ID NO: 9458455 - DNA, 22 bp, Homo sapiens
tccagcagaaccagagacctgg

SEQ ID NO: 9458456 - DNA, 22 bp, Homo sapiens
tccagcagaaaagaggtaggga

SEQ ID NO: 9458457 - DNA, 22 bp, Homo sapiens
tccagcactcgcccagggcttg

SEQ ID NO: 9458458 - DNA, 22 bp, Homo sapiens
catgtgggttattgggttctag

SEQ ID NO: 9458459 - DNA, 22 bp, Homo sapiens
catgtgggacaatctcaggtat

SEQ ID NO: 9458460 - DNA, 22 bp, Homo sapiens
catgtgggaagaggccagctgg

SEQ ID NO: 9458461 - DNA, 22 bp, Homo sapiens
catgttttctaggctttcacaa

SEQ ID NO: 9458462 - DNA, 22 bp, Homo sapiens
cattaagtatttcagttactgt

SEQ ID NO: 9458463 - DNA, 22 bp, Homo sapiens
catgtgtcacagccttttattg

SEQ ID NO: 9458464 - DNA, 22 bp, Homo sapiens
catgtggctttggcatgtgccc

SEQ ID NO: 9458465 - DNA, 22 bp, Homo sapiens
catgtggctttggcatgtgccc

SEQ ID NO: 9458466 - DNA, 22 bp, Homo sapiens
catgtgctgtagcagagaggaa

SEQ ID NO: 9458467 - DNA, 22 bp, Homo sapiens
tccaggctttttcatgctgtct

SEQ ID NO: 9458468 - DNA, 22 bp, Homo sapiens
tccaggcttgagaccaggctct

SEQ ID NO: 9458469 - DNA, 22 bp, Homo sapiens
tccaggcttgagaccaggctct

SEQ ID NO: 9458470 - DNA, 22 bp, Homo sapiens
tccaggctttggggcaggagcg

SEQ ID NO: 9458471 - DNA, 22 bp, Homo sapiens
tccaggctttggggcaggagcg

SEQ ID NO: 9458472 - DNA, 22 bp, Homo sapiens
tccaggctttggggcaggagcg

SEQ ID NO: 9458473 - DNA, 22 bp, Homo sapiens
catgtacaaggatgctcagagt

SEQ ID NO: 9458474 - DNA, 22 bp, Homo sapiens
catgtacaaggatgctcagagt

SEQ ID NO: 9458475 - DNA, 22 bp, Homo sapiens
catgtacacacaaagggacaat

SEQ ID NO: 9458476 - DNA, 23 bp, Homo sapiens
catgtacacacagctgtacagtg

SEQ ID NO: 9458477 - DNA, 23 bp, Homo sapiens
catgtacacacagctgtacagtg

SEQ ID NO: 9458478 - DNA, 23 bp, Homo sapiens
catgtacacacagctgtacagtg

SEQ ID NO: 9458479 - DNA, 23 bp, Homo sapiens
catgtacacacagctgtacagtg

SEQ ID NO: 9458480 - DNA, 23 bp, Homo sapiens
catgtacacacagctgtacagtg

SEQ ID NO: 9458481 - DNA, 23 bp, Homo sapiens
catgtacagagtttgataaagtg

SEQ ID NO: 9458482 - DNA, 23 bp, Homo sapiens
catgtacagagtttgataaagtg

SEQ ID NO: 9458483 - DNA, 22 bp, Homo sapiens
catgtacagccagggttgagaa

SEQ ID NO: 9458484 - DNA, 23 bp, Homo sapiens
catgtacagagtttgataaagtg

SEQ ID NO: 9458485 - DNA, 22 bp, Homo sapiens
catgtacactcatgtaactata

SEQ ID NO: 9458486 - DNA, 22 bp, Homo sapiens
catgtacactcatgtaactata

SEQ ID NO: 9458487 - DNA, 22 bp, Homo sapiens
catgtacactcatgtaactata

SEQ ID NO: 9458488 - DNA, 23 bp, Homo sapiens
catgtacagagtttgataaagtg

SEQ ID NO: 9458489 - DNA, 22 bp, Homo sapiens
catgtacactcatgtaactata

SEQ ID NO: 9458490 - DNA, 23 bp, Homo sapiens
catgtacacacagctgtacagtg

SEQ ID NO: 9458491 - DNA, 22 bp, Homo sapiens
catgtacactcatgtaactata

SEQ ID NO: 9458492 - DNA, 22 bp, Homo sapiens
catgtacactcatgtaactata

SEQ ID NO: 9458493 - DNA, 22 bp, Homo sapiens
catgtacagtttttctgtcctg

SEQ ID NO: 9458494 - DNA, 22 bp, Homo sapiens
catgtacatgcatgggcactgt

SEQ ID NO: 9458495 - DNA, 22 bp, Homo sapiens
tccaggctgggctgaagggtgc

SEQ ID NO: 9458496 - DNA, 22 bp, Homo sapiens
tccaggctgtgcatgagtttag

SEQ ID NO: 9458497 - DNA, 22 bp, Homo sapiens
tccaggcttcacgtctgccctc

SEQ ID NO: 9458498 - DNA, 21 bp, Homo sapiens
tccagggtcagaagttcagtg

SEQ ID NO: 9458499 - DNA, 21 bp, Homo sapiens
tccagggtcagaagttcagtg

SEQ ID NO: 9458500 - DNA, 22 bp, Homo sapiens
tccaggggtgatttttgacttg

SEQ ID NO: 9458501 - DNA, 19 bp, Homo sapiens
tccaggggctccacctcct

SEQ ID NO: 9458502 - DNA, 22 bp, Homo sapiens
tccaggggctgtcttggaatct

SEQ ID NO: 9458503 - DNA, 22 bp, Homo sapiens
tccaggggtaccggccaggcag

SEQ ID NO: 9458504 - DNA, 22 bp, Homo sapiens
tccaggggtaccggccaggcag

SEQ ID NO: 9458505 - DNA, 22 bp, Homo sapiens
tccaggtattactaagtgttaa

SEQ ID NO: 9458506 - DNA, 22 bp, Homo sapiens
tccaggtcagacttctgtgccc

SEQ ID NO: 9458507 - DNA, 22 bp, Homo sapiens
tccaggtcatcttggagagctg

SEQ ID NO: 9458508 - DNA, 22 bp, Homo sapiens
tccaggtcccagactgggcagc

SEQ ID NO: 9458509 - DNA, 18 bp, Homo sapiens
tccaggtcccaggggaag

SEQ ID NO: 9458510 - DNA, 22 bp, Homo sapiens
tccagggcatggggagagagtg

SEQ ID NO: 9458511 - DNA, 22 bp, Homo sapiens
tccaggggacactgtttctcca

SEQ ID NO: 9458512 - DNA, 22 bp, Homo sapiens
tccagggcatggggagagagtg

SEQ ID NO: 9458513 - DNA, 22 bp, Homo sapiens
tccaggggagactagacccaca

SEQ ID NO: 9458514 - DNA, 22 bp, Homo sapiens
tccaggggagtgctacgcacag

SEQ ID NO: 9458515 - DNA, 21 bp, Homo sapiens
tccaggggccagcacccaagc

SEQ ID NO: 9458516 - DNA, 22 bp, Homo sapiens
tccagggcatccacgcgtgggg

SEQ ID NO: 9458517 - DNA, 23 bp, Homo sapiens
tccagggcagtggctgggtctgc

SEQ ID NO: 9458518 - DNA, 23 bp, Homo sapiens
tccagggcagtggctgggtctgc

SEQ ID NO: 9458519 - DNA, 22 bp, Homo sapiens
tccagggcatccacgcgtgggg

SEQ ID NO: 9458520 - DNA, 22 bp, Homo sapiens
tccagggcatccacgcgtgggg

SEQ ID NO: 9458521 - DNA, 22 bp, Homo sapiens
tccagggcatccacgcgtgggg

SEQ ID NO: 9458522 - DNA, 23 bp, Homo sapiens
tccagggcagtggctgggtctgc

SEQ ID NO: 9458523 - DNA, 22 bp, Homo sapiens
tccagggcatgctcagactcag

SEQ ID NO: 9458524 - DNA, 22 bp, Homo sapiens
tccagggcatgctcagactcag

SEQ ID NO: 9458525 - DNA, 22 bp, Homo sapiens
tccagggcatgctcagactcag

SEQ ID NO: 9458526 - DNA, 22 bp, Homo sapiens
tccagggcatgctcagactcag

SEQ ID NO: 9458527 - DNA, 22 bp, Homo sapiens
cattacaacaatctgccatggc

SEQ ID NO: 9458528 - DNA, 19 bp, Homo sapiens
cattacaaatttgtaggga

SEQ ID NO: 9458529 - DNA, 19 bp, Homo sapiens
cattacaaatttgtaggga

SEQ ID NO: 9458530 - DNA, 22 bp, Homo sapiens
cattacaaagttataaacagtt

SEQ ID NO: 9458531 - DNA, 22 bp, Homo sapiens
cattacaaagttataaacagtt

SEQ ID NO: 9458532 - DNA, 22 bp, Homo sapiens
cattacaaagttataaacagtt

SEQ ID NO: 9458533 - DNA, 22 bp, Homo sapiens
cattacaaagttataaacagtt

SEQ ID NO: 9458534 - DNA, 22 bp, Homo sapiens
cattacaaagttataaacagtt

SEQ ID NO: 9458535 - DNA, 22 bp, Homo sapiens
cattacaaacatgttaagattt

SEQ ID NO: 9458536 - DNA, 22 bp, Homo sapiens
cattaatttaatattcaaagaa

SEQ ID NO: 9458537 - DNA, 22 bp, Homo sapiens
cattaatttaatattcaaagaa

SEQ ID NO: 9458538 - DNA, 22 bp, Homo sapiens
cattacaaacatgttaagattt

SEQ ID NO: 9458539 - DNA, 22 bp, Homo sapiens
cattacaaacatgttaagattt

SEQ ID NO: 9458540 - DNA, 22 bp, Homo sapiens
cattaattgtatttttcaaagt

SEQ ID NO: 9458541 - DNA, 22 bp, Homo sapiens
cattaatattgttcttctttag

SEQ ID NO: 9458542 - DNA, 22 bp, Homo sapiens
cattaataaacatttcagaaga

SEQ ID NO: 9458543 - DNA, 22 bp, Homo sapiens
cattaataaacatttcagaaga

SEQ ID NO: 9458544 - DNA, 22 bp, Homo sapiens
cattaataaacatttcagaaga

SEQ ID NO: 9458545 - DNA, 22 bp, Homo sapiens
cattaataaacatttcagaaga

SEQ ID NO: 9458546 - DNA, 22 bp, Homo sapiens
cattacaaccccaaattacaaa

SEQ ID NO: 9458547 - DNA, 22 bp, Homo sapiens
cattacaaccccaaattacaaa

SEQ ID NO: 9458548 - DNA, 22 bp, Homo sapiens
cattacaaccccaaattacaaa

SEQ ID NO: 9458549 - DNA, 22 bp, Homo sapiens
tccagggcagggtgcgcatggg

SEQ ID NO: 9458550 - DNA, 22 bp, Homo sapiens
tccagggcagggtgcgcatggg

SEQ ID NO: 9458551 - DNA, 22 bp, Homo sapiens
tccagggcagggtgcgcatggg

SEQ ID NO: 9458552 - DNA, 21 bp, Homo sapiens
cattacaagatttccaatttg

SEQ ID NO: 9458553 - DNA, 22 bp, Homo sapiens
tccagggcagtgactacagcgg

SEQ ID NO: 9458554 - DNA, 22 bp, Homo sapiens
tccagggcagtgactacagcgg

SEQ ID NO: 9458555 - DNA, 22 bp, Homo sapiens
tccagggcagtgactacagcgg

SEQ ID NO: 9458556 - DNA, 22 bp, Homo sapiens
tccagggcagtgactacagcgg

SEQ ID NO: 9458557 - DNA, 22 bp, Homo sapiens
tccagggcagtgactacagcgg

SEQ ID NO: 9458558 - DNA, 22 bp, Homo sapiens
tccagggcagtgactacagcgg

SEQ ID NO: 9458559 - DNA, 22 bp, Homo sapiens
tccagggcaggtgctgggctct

SEQ ID NO: 9458560 - DNA, 22 bp, Homo sapiens
tccagggcaggtgctgggctct

SEQ ID NO: 9458561 - DNA, 22 bp, Homo sapiens
tccagggcagggtgcgcatggg

SEQ ID NO: 9458562 - DNA, 22 bp, Homo sapiens
tccagggcaggtgctgggctct

SEQ ID NO: 9458563 - DNA, 22 bp, Homo sapiens
tccagggcaggtgctgggctct

SEQ ID NO: 9458564 - DNA, 22 bp, Homo sapiens
tccagggcaggtgctgggctct

SEQ ID NO: 9458565 - DNA, 22 bp, Homo sapiens
tcacattcttccctgacttctt

SEQ ID NO: 9458566 - DNA, 22 bp, Homo sapiens
tcactctctaagcatgacagac

SEQ ID NO: 9458567 - DNA, 22 bp, Homo sapiens
tcactgcaacctccacctcctg

SEQ ID NO: 9458568 - DNA, 22 bp, Homo sapiens
tcactgcaacctccacctcctg

SEQ ID NO: 9458569 - DNA, 22 bp, Homo sapiens
tcactgcaacctccacctcctg

SEQ ID NO: 9458570 - DNA, 22 bp, Homo sapiens
tcactgcaacctccacctcctg

SEQ ID NO: 9458571 - DNA, 22 bp, Homo sapiens
tcacatgtatatgcagcacagc

SEQ ID NO: 9458572 - DNA, 22 bp, Homo sapiens
tcacatgtcaaaaactacataa

SEQ ID NO: 9458573 - DNA, 22 bp, Homo sapiens
tcacatgtcaaaaactacataa

SEQ ID NO: 9458574 - DNA, 22 bp, Homo sapiens
tcacatgtcaagaagataattt

SEQ ID NO: 9458575 - DNA, 22 bp, Homo sapiens
tcacatgtcaagaagataattt

SEQ ID NO: 9458576 - DNA, 22 bp, Homo sapiens
tcacatgtcacaaaacactgcc

SEQ ID NO: 9458577 - DNA, 22 bp, Homo sapiens
tcacatgtcacaaaacactgcc

SEQ ID NO: 9458578 - DNA, 22 bp, Homo sapiens
tcacatgtcacaaaacactgcc

SEQ ID NO: 9458579 - DNA, 22 bp, Homo sapiens
tcacatgtcagaataagtgcat

SEQ ID NO: 9458580 - DNA, 22 bp, Homo sapiens
tcacatgtcagtcttaaacaga

SEQ ID NO: 9458581 - DNA, 22 bp, Homo sapiens
tcacatgtcagtcttaaacaga

SEQ ID NO: 9458582 - DNA, 22 bp, Homo sapiens
tcacatgtgtacagtcctccca

SEQ ID NO: 9458583 - DNA, 22 bp, Homo sapiens
tcacatgtgtggcagtgcaagt

SEQ ID NO: 9458584 - DNA, 22 bp, Homo sapiens
tcacattctcagcatctataca

SEQ ID NO: 9458585 - DNA, 22 bp, Homo sapiens
tcacattctagaatgttatcgt

SEQ ID NO: 9458586 - DNA, 19 bp, Homo sapiens
tcacattcagccttgctga

SEQ ID NO: 9458587 - DNA, 19 bp, Homo sapiens
tcacattcagccttgctga

SEQ ID NO: 9458588 - DNA, 22 bp, Homo sapiens
tcacattcatggtgctaataaa

SEQ ID NO: 9458589 - DNA, 18 bp, Homo sapiens
tcacattataatgtaaca

SEQ ID NO: 9458590 - DNA, 22 bp, Homo sapiens
tcacatgttaggtcgggcaagg

SEQ ID NO: 9458591 - DNA, 22 bp, Homo sapiens
tcacatgtgtggcagtgcaagt

SEQ ID NO: 9458592 - DNA, 22 bp, Homo sapiens
tcacatgtgttttctcaccaac

SEQ ID NO: 9458593 - DNA, 22 bp, Homo sapiens
tcacatgtgttttctcaccaac

SEQ ID NO: 9458594 - DNA, 22 bp, Homo sapiens
cagtggcaatgggacagagcac

SEQ ID NO: 9458595 - DNA, 22 bp, Homo sapiens
cagtggcacatggaccttgtca

SEQ ID NO: 9458596 - DNA, 22 bp, Homo sapiens
cagtggcacccacgggctgggc

SEQ ID NO: 9458597 - DNA, 22 bp, Homo sapiens
tcactgcaggtttttcaggagg

SEQ ID NO: 9458598 - DNA, 21 bp, Homo sapiens
cagtggcacgatttcggctca

SEQ ID NO: 9458599 - DNA, 22 bp, Homo sapiens
cagtggcacccacgggctgggc

SEQ ID NO: 9458600 - DNA, 22 bp, Homo sapiens
tcactgcaggtttttcaggagg

SEQ ID NO: 9458601 - DNA, 21 bp, Homo sapiens
tcactgcaatgctaggagaaa

SEQ ID NO: 9458602 - DNA, 22 bp, Homo sapiens
tcactgcactccagcactcagg

SEQ ID NO: 9458603 - DNA, 22 bp, Homo sapiens
cagtggcagagaacagagacct

SEQ ID NO: 9458604 - DNA, 22 bp, Homo sapiens
cagtggcacttgtcatttctga

SEQ ID NO: 9458605 - DNA, 17 bp, Homo sapiens
cagtggcagatcttctc

SEQ ID NO: 9458606 - DNA, 22 bp, Homo sapiens
cagtgggtgaaagatggctaag

SEQ ID NO: 9458607 - DNA, 22 bp, Homo sapiens
cagtgggtcctgcgtctgccag

SEQ ID NO: 9458608 - DNA, 21 bp, Homo sapiens
cagtggttgctgaattagtgg

SEQ ID NO: 9458609 - DNA, 22 bp, Homo sapiens
cagtgggtgatgagtcctgggg

SEQ ID NO: 9458610 - DNA, 22 bp, Homo sapiens
cagtggttggtagatacttgag

SEQ ID NO: 9458611 - DNA, 22 bp, Homo sapiens
cagtggttgcttgcatggctcc

SEQ ID NO: 9458612 - DNA, 22 bp, Homo sapiens
cagtggtttaggtcaaggggag

SEQ ID NO: 9458613 - DNA, 22 bp, Homo sapiens
cagtggttgtcagcaacaatat

SEQ ID NO: 9458614 - DNA, 22 bp, Homo sapiens
tcacatgtactgtctgtgacat

SEQ ID NO: 9458615 - DNA, 22 bp, Homo sapiens
cagtggcaatgggacagagcac

SEQ ID NO: 9458616 - DNA, 22 bp, Homo sapiens
cagtggcaaggacagtaataat

SEQ ID NO: 9458617 - DNA, 22 bp, Homo sapiens
cagtggattagccagagctgga

SEQ ID NO: 9458618 - DNA, 22 bp, Homo sapiens
cagtggcaagaacagtaataat

SEQ ID NO: 9458619 - DNA, 22 bp, Homo sapiens
cagtggaggctcaagtgtgctt

SEQ ID NO: 9458620 - DNA, 22 bp, Homo sapiens
cagtggaggccttgggaccttt

SEQ ID NO: 9458621 - DNA, 22 bp, Homo sapiens
cagtggaggccttgggaccttt

SEQ ID NO: 9458622 - DNA, 22 bp, Homo sapiens
cagtggaggccttgggaccttt

SEQ ID NO: 9458623 - DNA, 22 bp, Homo sapiens
cagtggagtgggactggtctga

SEQ ID NO: 9458624 - DNA, 22 bp, Homo sapiens
cagtggaggctcaagtgtgctt

SEQ ID NO: 9458625 - DNA, 22 bp, Homo sapiens
cagtggagtgggactggtctga

SEQ ID NO: 9458626 - DNA, 22 bp, Homo sapiens
tcacactgtgaagagacaagca

SEQ ID NO: 9458627 - DNA, 22 bp, Homo sapiens
cagtgctgttgtaagctcattg

SEQ ID NO: 9458628 - DNA, 22 bp, Homo sapiens
cagtgctgttgtaagctcattg

SEQ ID NO: 9458629 - DNA, 19 bp, Homo sapiens
cagtggagattggaggagg

SEQ ID NO: 9458630 - DNA, 22 bp, Homo sapiens
tcacactggcagtgctgaaggc

SEQ ID NO: 9458631 - DNA, 22 bp, Homo sapiens
tcacactgtgaagagacaagca

SEQ ID NO: 9458632 - DNA, 23 bp, Homo sapiens
tcacactggatacacatgcaaga

SEQ ID NO: 9458633 - DNA, 22 bp, Homo sapiens
tcacactaggatgttgtttcta

SEQ ID NO: 9458634 - DNA, 22 bp, Homo sapiens
tcacaccttgctggctgagtgc

SEQ ID NO: 9458635 - DNA, 22 bp, Homo sapiens
tcacactaagacaaaataattt

SEQ ID NO: 9458636 - DNA, 22 bp, Homo sapiens
tcacactaagacaaaataattt

SEQ ID NO: 9458637 - DNA, 22 bp, Homo sapiens
tcacacattctaggtatgttga

SEQ ID NO: 9458638 - DNA, 22 bp, Homo sapiens
tcacacattgttgcttaagttg

SEQ ID NO: 9458639 - DNA, 22 bp, Homo sapiens
tcacaccaggagcagtgccaga

SEQ ID NO: 9458640 - DNA, 22 bp, Homo sapiens
cagtgcagtttcccagatgctg

SEQ ID NO: 9458641 - DNA, 22 bp, Homo sapiens
cagtgcagtttcccagatgctg

SEQ ID NO: 9458642 - DNA, 22 bp, Homo sapiens
cagtgcagtttcccagatgctg

SEQ ID NO: 9458643 - DNA, 22 bp, Homo sapiens
cagtgcatagagagctcctgac

SEQ ID NO: 9458644 - DNA, 20 bp, Homo sapiens
tcacacatggtaagctatga

SEQ ID NO: 9458645 - DNA, 22 bp, Homo sapiens
cagtgcagaggtgcaagcatgt

SEQ ID NO: 9458646 - DNA, 22 bp, Homo sapiens
cagtgcaggtggcagaggacag

SEQ ID NO: 9458647 - DNA, 22 bp, Homo sapiens
cagtgcaggtttagggctgggg

SEQ ID NO: 9458648 - DNA, 22 bp, Homo sapiens
cagtgcagttggtggcaggggt

SEQ ID NO: 9458649 - DNA, 22 bp, Homo sapiens
cagtgcagttggtggcaggggt

SEQ ID NO: 9458650 - DNA, 22 bp, Homo sapiens
cagtgcagtcaaggaagaacca

SEQ ID NO: 9458651 - DNA, 22 bp, Homo sapiens
cagtgcagtcaaggaagaacca

SEQ ID NO: 9458652 - DNA, 22 bp, Homo sapiens
cagtgcagtcaaggaagaacca

SEQ ID NO: 9458653 - DNA, 22 bp, Homo sapiens
cagtcccagctgctcagaaggc

SEQ ID NO: 9458654 - DNA, 15 bp, Homo sapiens
cagtcccagggaccc

SEQ ID NO: 9458655 - DNA, 22 bp, Homo sapiens
cagtcccagacccagaaggtgg

SEQ ID NO: 9458656 - DNA, 22 bp, Homo sapiens
cagtcccagctgctcagaaggc

SEQ ID NO: 9458657 - DNA, 22 bp, Homo sapiens
cagtcccagggttggttcagct

SEQ ID NO: 9458658 - DNA, 15 bp, Homo sapiens
cagtcccagggaccc

SEQ ID NO: 9458659 - DNA, 22 bp, Homo sapiens
cagtcccagtttgagactctgg

SEQ ID NO: 9458660 - DNA, 22 bp, Homo sapiens
cagtcccagtttgagactctgg

SEQ ID NO: 9458661 - DNA, 22 bp, Homo sapiens
cagtcccagggttggttcagct

SEQ ID NO: 9458662 - DNA, 22 bp, Homo sapiens
cagtcccatctcccaggtggct

SEQ ID NO: 9458663 - DNA, 22 bp, Homo sapiens
cagtcccagtttgagactctgg

SEQ ID NO: 9458664 - DNA, 22 bp, Homo sapiens
cagtcccatctcccaggtggct

SEQ ID NO: 9458665 - DNA, 22 bp, Homo sapiens
cagtcccatctcccaggtggct

SEQ ID NO: 9458666 - DNA, 22 bp, Homo sapiens
cagtccctgggggagtcaccag

SEQ ID NO: 9458667 - DNA, 22 bp, Homo sapiens
cagtccctagtggagctcacag

SEQ ID NO: 9458668 - DNA, 22 bp, Homo sapiens
cagtccctgggggagtcaccag

SEQ ID NO: 9458669 - DNA, 22 bp, Homo sapiens
cagtcccatgagcccagaacat

SEQ ID NO: 9458670 - DNA, 22 bp, Homo sapiens
cagtccctagtggagctcacag

SEQ ID NO: 9458671 - DNA, 22 bp, Homo sapiens
cagtcccatgagcccagaacat

SEQ ID NO: 9458672 - DNA, 22 bp, Homo sapiens
cagtctctaaatcaatctgaat

SEQ ID NO: 9458673 - DNA, 22 bp, Homo sapiens
cagtctctcagctttcagctgt

SEQ ID NO: 9458674 - DNA, 22 bp, Homo sapiens
cagtctggaggtcagctggctt

SEQ ID NO: 9458675 - DNA, 22 bp, Homo sapiens
cagtctggaggtcagctggctt

SEQ ID NO: 9458676 - DNA, 22 bp, Homo sapiens
cagtctggcacagcacactgaa

SEQ ID NO: 9458677 - DNA, 22 bp, Homo sapiens
cagtctggctcagcacaaaggg

SEQ ID NO: 9458678 - DNA, 22 bp, Homo sapiens
cagtctggatctgtgctgctgt

SEQ ID NO: 9458679 - DNA, 22 bp, Homo sapiens
cagtctgggactgagctccacc

SEQ ID NO: 9458680 - DNA, 22 bp, Homo sapiens
cagtcttagaggtgactgtgga

SEQ ID NO: 9458681 - DNA, 22 bp, Homo sapiens
cagtcttagccttccctcaccc

SEQ ID NO: 9458682 - DNA, 22 bp, Homo sapiens
tcaaattatttaggatagtgct

SEQ ID NO: 9458683 - DNA, 22 bp, Homo sapiens
tcaaattagtggaataataatg

SEQ ID NO: 9458684 - DNA, 22 bp, Homo sapiens
tcaaattatttaggatagtgct

SEQ ID NO: 9458685 - DNA, 22 bp, Homo sapiens
tcaaattagtggaataataatg

SEQ ID NO: 9458686 - DNA, 22 bp, Homo sapiens
tcaaattagtggaataataatg

SEQ ID NO: 9458687 - DNA, 22 bp, Homo sapiens
tcaaattagtggaataataatg

SEQ ID NO: 9458688 - DNA, 17 bp, Homo sapiens
tcaaatgtacagaacta

SEQ ID NO: 9458689 - DNA, 22 bp, Homo sapiens
tcaaattagtggaataataatg

SEQ ID NO: 9458690 - DNA, 22 bp, Homo sapiens
tcaaattagtggaataataatg

SEQ ID NO: 9458691 - DNA, 17 bp, Homo sapiens
tcaaatgtacagaacta

SEQ ID NO: 9458692 - DNA, 22 bp, Homo sapiens
cagtctttgttcccattactga

SEQ ID NO: 9458693 - DNA, 22 bp, Homo sapiens
cagtctttgatgcatcctagcc

SEQ ID NO: 9458694 - DNA, 22 bp, Homo sapiens
cagtcttttgtatattagcaga

SEQ ID NO: 9458695 - DNA, 22 bp, Homo sapiens
cagtcttttgtatattagcaga

SEQ ID NO: 9458696 - DNA, 22 bp, Homo sapiens
cagtctttgttcccattactga

SEQ ID NO: 9458697 - DNA, 22 bp, Homo sapiens
cagtcttttgtatattagcaga

SEQ ID NO: 9458698 - DNA, 22 bp, Homo sapiens
cagtctttgatgcatcctagcc

SEQ ID NO: 9458699 - DNA, 22 bp, Homo sapiens
cagtctttgacaagccctttca

SEQ ID NO: 9458700 - DNA, 22 bp, Homo sapiens
tcaaatgctgcctttgtgtgcc

SEQ ID NO: 9458701 - DNA, 19 bp, Homo sapiens
tcaaatgccaatgtcacag

SEQ ID NO: 9458702 - DNA, 22 bp, Homo sapiens
tcaaaggataactgagggcagt

SEQ ID NO: 9458703 - DNA, 22 bp, Homo sapiens
tcaaaggagtttaagttactgg

SEQ ID NO: 9458704 - DNA, 23 bp, Homo sapiens
tcaaaggaggcatcgttctgcag

SEQ ID NO: 9458705 - DNA, 22 bp, Homo sapiens
cagtcccagacccagaaggtgg

SEQ ID NO: 9458706 - DNA, 22 bp, Homo sapiens
tcaaaggaatttgattttgatg

SEQ ID NO: 9458707 - DNA, 22 bp, Homo sapiens
tcaaagcatggttttgaaagac

SEQ ID NO: 9458708 - DNA, 22 bp, Homo sapiens
tcaaagcatcagtcaatttagg

SEQ ID NO: 9458709 - DNA, 22 bp, Homo sapiens
tcaaagcagcacattcgcaagc

SEQ ID NO: 9458710 - DNA, 22 bp, Homo sapiens
tattcctatttctaaacatatg

SEQ ID NO: 9458711 - DNA, 22 bp, Homo sapiens
tcaaaacctaggctctctgctt

SEQ ID NO: 9458712 - DNA, 22 bp, Homo sapiens
tcaaaacccagccatcaggact

SEQ ID NO: 9458713 - DNA, 21 bp, Homo sapiens
tcaaagcacatatttgcacat

SEQ ID NO: 9458714 - DNA, 22 bp, Homo sapiens
tcaaagcagcacattcgcaagc

SEQ ID NO: 9458715 - DNA, 22 bp, Homo sapiens
tcaaagcaatttcaccagtgcc

SEQ ID NO: 9458716 - DNA, 19 bp, Homo sapiens
tcaaagcaagcatgttctg

SEQ ID NO: 9458717 - DNA, 22 bp, Homo sapiens
tcaaagcacacttagtggtaga

SEQ ID NO: 9458718 - DNA, 22 bp, Homo sapiens
tattccagaaatcaccatttcc

SEQ ID NO: 9458719 - DNA, 22 bp, Homo sapiens
tattccaacttcactattgtct

SEQ ID NO: 9458720 - DNA, 22 bp, Homo sapiens
tattccatgccagagtttattg

SEQ ID NO: 9458721 - DNA, 22 bp, Homo sapiens
tattccagttcaccttttcatc

SEQ ID NO: 9458722 - DNA, 17 bp, Homo sapiens
tattccaggaaataaag

SEQ ID NO: 9458723 - DNA, 22 bp, Homo sapiens
cagtagcagggattattttagg

SEQ ID NO: 9458724 - DNA, 22 bp, Homo sapiens
tattccaactgtcatagtcata

SEQ ID NO: 9458725 - DNA, 22 bp, Homo sapiens
cagtagcatgcaccaggagggt

SEQ ID NO: 9458726 - DNA, 22 bp, Homo sapiens
cagtagcaggatttgggattat

SEQ ID NO: 9458727 - DNA, 22 bp, Homo sapiens
cagtagcaggcactcagcacgt

SEQ ID NO: 9458728 - DNA, 22 bp, Homo sapiens
cagtagcaggcaggtgcttttg

SEQ ID NO: 9458729 - DNA, 20 bp, Homo sapiens
cagtagcaataattagaagc

SEQ ID NO: 9458730 - DNA, 22 bp, Homo sapiens
cagtagcactagatatgtgtgg

SEQ ID NO: 9458731 - DNA, 22 bp, Homo sapiens
cagtagcactctgtcagtgaag

SEQ ID NO: 9458732 - DNA, 22 bp, Homo sapiens
cagtagcactctgtcagtgaag

SEQ ID NO: 9458733 - DNA, 22 bp, Homo sapiens
cagtagaagcttgtttttcaga

SEQ ID NO: 9458734 - DNA, 22 bp, Homo sapiens
cagtacttttctggctttctac

SEQ ID NO: 9458735 - DNA, 22 bp, Homo sapiens
cagtagatttggtaaactagga

SEQ ID NO: 9458736 - DNA, 22 bp, Homo sapiens
cagtacttgtcctcaggtgtta

SEQ ID NO: 9458737 - DNA, 22 bp, Homo sapiens
tatgatggcagcgattgctgag

SEQ ID NO: 9458738 - DNA, 22 bp, Homo sapiens
tatgaagatatatctgatctct

SEQ ID NO: 9458739 - DNA, 22 bp, Homo sapiens
tatgatatgcactttatcagaa

SEQ ID NO: 9458740 - DNA, 22 bp, Homo sapiens
tatgaagacaatgatagcatga

SEQ ID NO: 9458741 - DNA, 22 bp, Homo sapiens
tatgaagatatatctgatctct

SEQ ID NO: 9458742 - DNA, 22 bp, Homo sapiens
tatgaagaagttctgtgaaatg

SEQ ID NO: 9458743 - DNA, 22 bp, Homo sapiens
tatgaagaagttctgtgaaatg

SEQ ID NO: 9458744 - DNA, 22 bp, Homo sapiens
tatgcaaacagttcaggtgaca

SEQ ID NO: 9458745 - DNA, 23 bp, Homo sapiens
tatgatggtatcaggagatgggg

SEQ ID NO: 9458746 - DNA, 22 bp, Homo sapiens
tatgatgtgtacctaagtcacc

SEQ ID NO: 9458747 - DNA, 22 bp, Homo sapiens
tatgcaaagtcctaagaaagaa

SEQ ID NO: 9458748 - DNA, 22 bp, Homo sapiens
tatgcaaagtcctaagaaagaa

SEQ ID NO: 9458749 - DNA, 22 bp, Homo sapiens
tatgcaaagccacccagggacg

SEQ ID NO: 9458750 - DNA, 22 bp, Homo sapiens
tatgcaaagccacccagggacg

SEQ ID NO: 9458751 - DNA, 22 bp, Homo sapiens
tatgcaaacagttcaggtgaca

SEQ ID NO: 9458752 - DNA, 22 bp, Homo sapiens
tatgcaaacagttcaggtgaca

SEQ ID NO: 9458753 - DNA, 22 bp, Homo sapiens
tatgcaaacagttcaggtgaca

SEQ ID NO: 9458754 - DNA, 22 bp, Homo sapiens
tatgcaaactaagttgtttcct

SEQ ID NO: 9458755 - DNA, 22 bp, Homo sapiens
tatgcaaatgactggtatgttt

SEQ ID NO: 9458756 - DNA, 22 bp, Homo sapiens
tatgcaaatgactggtatgttt

SEQ ID NO: 9458757 - DNA, 22 bp, Homo sapiens
tatgcaaatcattagatttcct

SEQ ID NO: 9458758 - DNA, 22 bp, Homo sapiens
tatgcaaatgactggtatgttt

SEQ ID NO: 9458759 - DNA, 22 bp, Homo sapiens
tatgcaaatcattagatttcct

SEQ ID NO: 9458760 - DNA, 22 bp, Homo sapiens
tatgcaaatcattagatttcct

SEQ ID NO: 9458761 - DNA, 22 bp, Homo sapiens
tatgcaaatcattagatttcct

SEQ ID NO: 9458762 - DNA, 21 bp, Homo sapiens
tatgaacatgaccaatagtcc

SEQ ID NO: 9458763 - DNA, 23 bp, Homo sapiens
tatctgtatttgttcactgctgt

SEQ ID NO: 9458764 - DNA, 22 bp, Homo sapiens
tatctgtattctgacagtcact

SEQ ID NO: 9458765 - DNA, 22 bp, Homo sapiens
tatctgtatccccatctagcta

SEQ ID NO: 9458766 - DNA, 22 bp, Homo sapiens
tatctgtagtctcatggttcct

SEQ ID NO: 9458767 - DNA, 22 bp, Homo sapiens
tatctgtagtctcatggttcct

SEQ ID NO: 9458768 - DNA, 22 bp, Homo sapiens
tatctgtatccccatctagcta

SEQ ID NO: 9458769 - DNA, 17 bp, Homo sapiens
tatctgtatgatggata

SEQ ID NO: 9458770 - DNA, 22 bp, Homo sapiens
tatgaactgtactgtactaagc

SEQ ID NO: 9458771 - DNA, 22 bp, Homo sapiens
tatgaactgtactgtactaagc

SEQ ID NO: 9458772 - DNA, 22 bp, Homo sapiens
tatgaactgtgagtgtgatggg

SEQ ID NO: 9458773 - DNA, 22 bp, Homo sapiens
tatgaacttttgatgtgacatg

SEQ ID NO: 9458774 - DNA, 22 bp, Homo sapiens
tatgaacttttgatgtgacatg

SEQ ID NO: 9458775 - DNA, 22 bp, Homo sapiens
tatgaagaaacctatcctctag

SEQ ID NO: 9458776 - DNA, 22 bp, Homo sapiens
tatattctgattccatctgtgt

SEQ ID NO: 9458777 - DNA, 22 bp, Homo sapiens
tatattctattgtacctctcct

SEQ ID NO: 9458778 - DNA, 18 bp, Homo sapiens
tatattctgtgccctggt

SEQ ID NO: 9458779 - DNA, 22 bp, Homo sapiens
tatattccagttcatctcttga

SEQ ID NO: 9458780 - DNA, 22 bp, Homo sapiens
tatattcattttaaagccatct

SEQ ID NO: 9458781 - DNA, 22 bp, Homo sapiens
tatattcattttaaagccatct

SEQ ID NO: 9458782 - DNA, 22 bp, Homo sapiens
tatattccagttcatctcttga

SEQ ID NO: 9458783 - DNA, 22 bp, Homo sapiens
tatattcattttaaagccatct

SEQ ID NO: 9458784 - DNA, 22 bp, Homo sapiens
tatattgtagctgatgacaaat

SEQ ID NO: 9458785 - DNA, 22 bp, Homo sapiens
tatattgtagctgatgacaaat

SEQ ID NO: 9458786 - DNA, 22 bp, Homo sapiens
tatattgtagctgatgacaaat

SEQ ID NO: 9458787 - DNA, 22 bp, Homo sapiens
tatattcttaccagtgtatgta

SEQ ID NO: 9458788 - DNA, 22 bp, Homo sapiens
tatattctttcaccttcttcct

SEQ ID NO: 9458789 - DNA, 22 bp, Homo sapiens
tatgtacatcttgagcaatgaa

SEQ ID NO: 9458790 - DNA, 22 bp, Homo sapiens
tatgtacatcttgagcaatgaa

SEQ ID NO: 9458791 - DNA, 22 bp, Homo sapiens
tatgtacatcttgagcaatgaa

SEQ ID NO: 9458792 - DNA, 22 bp, Homo sapiens
tatgtacatcttgagcaatgaa

SEQ ID NO: 9458793 - DNA, 22 bp, Homo sapiens
tatgtacatcttgagcaatgaa

SEQ ID NO: 9458794 - DNA, 22 bp, Homo sapiens
tatgtacatgatttcatttgct

SEQ ID NO: 9458795 - DNA, 22 bp, Homo sapiens
tatgtacatgatttcatttgct

SEQ ID NO: 9458796 - DNA, 22 bp, Homo sapiens
tatgtacatgatttcatttgct

SEQ ID NO: 9458797 - DNA, 22 bp, Homo sapiens
tatgtacatgatttcatttgct

SEQ ID NO: 9458798 - DNA, 22 bp, Homo sapiens
tatgtacatggagagcaattga

SEQ ID NO: 9458799 - DNA, 22 bp, Homo sapiens
tatgtacatggagagcaattga

SEQ ID NO: 9458800 - DNA, 22 bp, Homo sapiens
tatgtacatggagagcaattga

SEQ ID NO: 9458801 - DNA, 22 bp, Homo sapiens
tatgtacatggagagcaattga

SEQ ID NO: 9458802 - DNA, 22 bp, Homo sapiens
tatgtacatggagagcaattga

SEQ ID NO: 9458803 - DNA, 22 bp, Homo sapiens
cagtaaaagatggaaatagaat

SEQ ID NO: 9458804 - DNA, 22 bp, Homo sapiens
cagtaaaagatggaaatagaat

SEQ ID NO: 9458805 - DNA, 22 bp, Homo sapiens
tatgtacatggagagcaattga

SEQ ID NO: 9458806 - DNA, 22 bp, Homo sapiens
tatgtacatgttaaagggcaaa

SEQ ID NO: 9458807 - DNA, 22 bp, Homo sapiens
cagtaattccaagtgcttatac

SEQ ID NO: 9458808 - DNA, 22 bp, Homo sapiens
cagtaataggtaacattgccct

SEQ ID NO: 9458809 - DNA, 22 bp, Homo sapiens
cagtaatattttactctaggcc

SEQ ID NO: 9458810 - DNA, 22 bp, Homo sapiens
cagtaatatctgttgaagctat

SEQ ID NO: 9458811 - DNA, 22 bp, Homo sapiens
cagtaatagcagagtcttccat

SEQ ID NO: 9458812 - DNA, 22 bp, Homo sapiens
cagtaatagcagagtcttccat

SEQ ID NO: 9458813 - DNA, 22 bp, Homo sapiens
cagtaaaagatggaaatagaat

SEQ ID NO: 9458814 - DNA, 22 bp, Homo sapiens
cagtaattccaagtgcttatac

SEQ ID NO: 9458815 - DNA, 22 bp, Homo sapiens
cagtacaagaggccacctgccc

SEQ ID NO: 9458816 - DNA, 22 bp, Homo sapiens
cagtaccagtcaccacattgat

SEQ ID NO: 9458817 - DNA, 22 bp, Homo sapiens
cagtactaagactccacctagc

SEQ ID NO: 9458818 - DNA, 22 bp, Homo sapiens
cagtactgcttgtgggagcaga

SEQ ID NO: 9458819 - DNA, 22 bp, Homo sapiens
cagtacatttcatatgattcta

SEQ ID NO: 9458820 - DNA, 22 bp, Homo sapiens
cagtacatttcatatgattcta

SEQ ID NO: 9458821 - DNA, 22 bp, Homo sapiens
cagtacatttcatatgattcta

SEQ ID NO: 9458822 - DNA, 22 bp, Homo sapiens
tatgcacacatgtatgcatgtg

SEQ ID NO: 9458823 - DNA, 22 bp, Homo sapiens
caggtgggcgtggcgagaaggc

SEQ ID NO: 9458824 - DNA, 22 bp, Homo sapiens
caggtgggctgcctctccagct

SEQ ID NO: 9458825 - DNA, 22 bp, Homo sapiens
caggtgggcttgggagaacact

SEQ ID NO: 9458826 - DNA, 22 bp, Homo sapiens
caggtgggcttgggagaacact

SEQ ID NO: 9458827 - DNA, 22 bp, Homo sapiens
caggtggggagagtgtggagca

SEQ ID NO: 9458828 - DNA, 22 bp, Homo sapiens
caggtggggagagtgtggagca

SEQ ID NO: 9458829 - DNA, 22 bp, Homo sapiens
caggtggggagagtgtggagca

SEQ ID NO: 9458830 - DNA, 22 bp, Homo sapiens
caggtggggagagtgtggagca

SEQ ID NO: 9458831 - DNA, 22 bp, Homo sapiens
caggtggggcagctgtgggagc

SEQ ID NO: 9458832 - DNA, 22 bp, Homo sapiens
caggtggggcagctgtgggagc

SEQ ID NO: 9458833 - DNA, 22 bp, Homo sapiens
caggtggggcgccctcaggcag

SEQ ID NO: 9458834 - DNA, 22 bp, Homo sapiens
caggtggggggcttccgagcct

SEQ ID NO: 9458835 - DNA, 22 bp, Homo sapiens
caggtggggggcttccgagcct

SEQ ID NO: 9458836 - DNA, 22 bp, Homo sapiens
caggtggggcgccctcaggcag

SEQ ID NO: 9458837 - DNA, 22 bp, Homo sapiens
tatgtacatcgttgaattcaaa

SEQ ID NO: 9458838 - DNA, 22 bp, Homo sapiens
tatgtacatcgttgaattcaaa

SEQ ID NO: 9458839 - DNA, 22 bp, Homo sapiens
tatgtacatcgttgaattcaaa

SEQ ID NO: 9458840 - DNA, 22 bp, Homo sapiens
tatgtacatcgttgaattcaaa

SEQ ID NO: 9458841 - DNA, 22 bp, Homo sapiens
tatgtacatcgttgaattcaaa

SEQ ID NO: 9458842 - DNA, 22 bp, Homo sapiens
cagggctgaggacacaagtaaa

SEQ ID NO: 9458843 - DNA, 22 bp, Homo sapiens
cagggctgagaatttagagaca

SEQ ID NO: 9458844 - DNA, 22 bp, Homo sapiens
tagtacagaaaacctcagggtc

SEQ ID NO: 9458845 - DNA, 22 bp, Homo sapiens
tagtacagtggcattcaaactt

SEQ ID NO: 9458846 - DNA, 22 bp, Homo sapiens
tagtgtctattgaccggaaaga

SEQ ID NO: 9458847 - DNA, 22 bp, Homo sapiens
tagtgtctagtgagtttgatgc

SEQ ID NO: 9458848 - DNA, 22 bp, Homo sapiens
tagtgtctgaatgcacctgttt

SEQ ID NO: 9458849 - DNA, 22 bp, Homo sapiens
tagtgtctcttcctgtttgaaa

SEQ ID NO: 9458850 - DNA, 22 bp, Homo sapiens
tagtgtctcggggcccaggatt

SEQ ID NO: 9458851 - DNA, 22 bp, Homo sapiens
tagtgattgctgatattccatt

SEQ ID NO: 9458852 - DNA, 22 bp, Homo sapiens
tagtgattttcatattacatta

SEQ ID NO: 9458853 - DNA, 22 bp, Homo sapiens
cagggctgctggccgtgccctc

SEQ ID NO: 9458854 - DNA, 22 bp, Homo sapiens
cagggctgctggccgtgccctc

SEQ ID NO: 9458855 - DNA, 22 bp, Homo sapiens
cagggctgctggccgtgccctc

SEQ ID NO: 9458856 - DNA, 22 bp, Homo sapiens
cagggctgctggccgtgccctc

SEQ ID NO: 9458857 - DNA, 22 bp, Homo sapiens
cagggctggatcctccagactc

SEQ ID NO: 9458858 - DNA, 22 bp, Homo sapiens
tagtaacaacaactagcatttt

SEQ ID NO: 9458859 - DNA, 22 bp, Homo sapiens
tagtaaattaaaatattgactt

SEQ ID NO: 9458860 - DNA, 22 bp, Homo sapiens
tagtaaattaaaatattgactt

SEQ ID NO: 9458861 - DNA, 17 bp, Homo sapiens
tagtaaatgagtagagc

SEQ ID NO: 9458862 - DNA, 17 bp, Homo sapiens
tagtaaatgagtagagc

SEQ ID NO: 9458863 - DNA, 17 bp, Homo sapiens
tagtaaatgagtagagc

SEQ ID NO: 9458864 - DNA, 22 bp, Homo sapiens
taggtatacagagatttctggg

SEQ ID NO: 9458865 - DNA, 22 bp, Homo sapiens
taggtataggattctaggttgg

SEQ ID NO: 9458866 - DNA, 22 bp, Homo sapiens
tagtaaatctcagaaaaagatc

SEQ ID NO: 9458867 - DNA, 22 bp, Homo sapiens
tagtaaatctcagaaaaagatc

SEQ ID NO: 9458868 - DNA, 22 bp, Homo sapiens
tagtaaatctcagaaaaagatc

SEQ ID NO: 9458869 - DNA, 22 bp, Homo sapiens
tagtaaatacacagtggaaaaa

SEQ ID NO: 9458870 - DNA, 22 bp, Homo sapiens
tagtaacagatttatacagtct

SEQ ID NO: 9458871 - DNA, 22 bp, Homo sapiens
tagtaacccacacaacagtaga

SEQ ID NO: 9458872 - DNA, 22 bp, Homo sapiens
tagtaacttttgttataaatca

SEQ ID NO: 9458873 - DNA, 22 bp, Homo sapiens
tagtaagttctcgcattgttat

SEQ ID NO: 9458874 - DNA, 22 bp, Homo sapiens
tagtaagtagctaatatttact

SEQ ID NO: 9458875 - DNA, 22 bp, Homo sapiens
tagtaagttctcgcattgttat

SEQ ID NO: 9458876 - DNA, 22 bp, Homo sapiens
tagtaatcagaggtaaacttta

SEQ ID NO: 9458877 - DNA, 21 bp, Homo sapiens
cagggccaatcctgacctcta

SEQ ID NO: 9458878 - DNA, 21 bp, Homo sapiens
cagggccaatcctgacctcta

SEQ ID NO: 9458879 - DNA, 22 bp, Homo sapiens
cagggccacacggaagggaaca

SEQ ID NO: 9458880 - DNA, 22 bp, Homo sapiens
cagggccaccctctgctgggtg

SEQ ID NO: 9458881 - DNA, 22 bp, Homo sapiens
cagggccaccctctgctgggtg

SEQ ID NO: 9458882 - DNA, 22 bp, Homo sapiens
cagggccaccgtgtttgctgct

SEQ ID NO: 9458883 - DNA, 22 bp, Homo sapiens
taggtataatattttgaagaaa

SEQ ID NO: 9458884 - DNA, 22 bp, Homo sapiens
tatatacaaggtaggtttaggt

SEQ ID NO: 9458885 - DNA, 22 bp, Homo sapiens
tatataattttctgccatatcc

SEQ ID NO: 9458886 - DNA, 22 bp, Homo sapiens
tatataatttgtaaaagcacct

SEQ ID NO: 9458887 - DNA, 22 bp, Homo sapiens
tatataatttgtaaaagcacct

SEQ ID NO: 9458888 - DNA, 22 bp, Homo sapiens
tagttttagcagcaatgggatg

SEQ ID NO: 9458889 - DNA, 22 bp, Homo sapiens
tagttttagtcccattttacag

SEQ ID NO: 9458890 - DNA, 22 bp, Homo sapiens
tagttttagcagcaatgggatg

SEQ ID NO: 9458891 - DNA, 21 bp, Homo sapiens
tatacatgtgcacacacatgc

SEQ ID NO: 9458892 - DNA, 22 bp, Homo sapiens
tatacatcagtatgtttagata

SEQ ID NO: 9458893 - DNA, 21 bp, Homo sapiens
tatacatgtgtgcatacgtgt

SEQ ID NO: 9458894 - DNA, 21 bp, Homo sapiens
tatacatgtgtgcatacgtgt

SEQ ID NO: 9458895 - DNA, 21 bp, Homo sapiens
tatacatgtgtgcatacgtgt

SEQ ID NO: 9458896 - DNA, 22 bp, Homo sapiens
tatatatatgcacacacaccta

SEQ ID NO: 9458897 - DNA, 22 bp, Homo sapiens
tatattcaatgattagtatcag

SEQ ID NO: 9458898 - DNA, 22 bp, Homo sapiens
tatattcaatgattagtatcag

SEQ ID NO: 9458899 - DNA, 22 bp, Homo sapiens
tatattcaatgattagtatcag

SEQ ID NO: 9458900 - DNA, 22 bp, Homo sapiens
tatatactttcttcctgggtag

SEQ ID NO: 9458901 - DNA, 22 bp, Homo sapiens
tatatactatgcgattcctgcc

SEQ ID NO: 9458902 - DNA, 22 bp, Homo sapiens
tatatagaaaagcagatgttgg

SEQ ID NO: 9458903 - DNA, 22 bp, Homo sapiens
tatatactatgcgattcctgcc

SEQ ID NO: 9458904 - DNA, 22 bp, Homo sapiens
tagtgtctgtccatcagtaact

SEQ ID NO: 9458905 - DNA, 21 bp, Homo sapiens
tagtgtcttaagagccttgca

SEQ ID NO: 9458906 - DNA, 22 bp, Homo sapiens
tagtgtctgttgcttttgttca

SEQ ID NO: 9458907 - DNA, 22 bp, Homo sapiens
tagtgtctgttgcttttgttca

SEQ ID NO: 9458908 - DNA, 22 bp, Homo sapiens
tagtgtctgatccgtagttaca

SEQ ID NO: 9458909 - DNA, 22 bp, Homo sapiens
tagtgtctgacatttaagagca

SEQ ID NO: 9458910 - DNA, 22 bp, Homo sapiens
tagtgtctgaatgcacctgttt

SEQ ID NO: 9458911 - DNA, 22 bp, Homo sapiens
tagtgtctgaatgcacctgttt

SEQ ID NO: 9458912 - DNA, 22 bp, Homo sapiens
tagtgtctgacatttaagagca

SEQ ID NO: 9458913 - DNA, 22 bp, Homo sapiens
tagtgtcttccaggacatggta

SEQ ID NO: 9458914 - DNA, 22 bp, Homo sapiens
tagtgtcttcaggagatatgag

SEQ ID NO: 9458915 - DNA, 22 bp, Homo sapiens
tagtgtggtatcttctatggaa

SEQ ID NO: 9458916 - DNA, 22 bp, Homo sapiens
tagtgtggccccaagaggatct

SEQ ID NO: 9458917 - DNA, 22 bp, Homo sapiens
tagtgtgtccctggggagtgtt

SEQ ID NO: 9458918 - DNA, 22 bp, Homo sapiens
tagtgtgtgggcttcagggact

SEQ ID NO: 9458919 - DNA, 22 bp, Homo sapiens
tagtgttccagaagcaaacaag

SEQ ID NO: 9458920 - DNA, 22 bp, Homo sapiens
tagtgtgtccctggggagtgtt

SEQ ID NO: 9458921 - DNA, 22 bp, Homo sapiens
tagtgtgtatggtaatgatgaa

SEQ ID NO: 9458922 - DNA, 22 bp, Homo sapiens
tagtgtgtatggtaatgatgaa

SEQ ID NO: 9458923 - DNA, 22 bp, Homo sapiens
tagtttctagtcaatcttcttt

SEQ ID NO: 9458924 - DNA, 21 bp, Homo sapiens
tagtttctacccagttaatgg

SEQ ID NO: 9458925 - DNA, 22 bp, Homo sapiens
tagtttctagacagtaagaatt

SEQ ID NO: 9458926 - DNA, 22 bp, Homo sapiens
tagtgttctaagaacatccatg

SEQ ID NO: 9458927 - DNA, 22 bp, Homo sapiens
tagtgttctaagaacatccatg

SEQ ID NO: 9458928 - DNA, 22 bp, Homo sapiens
tagttttacatcagccattgtt

SEQ ID NO: 9458929 - DNA, 22 bp, Homo sapiens
tagtttgtagaaatctagaaat

SEQ ID NO: 9458930 - DNA, 22 bp, Homo sapiens
tagtttgtagaaatctagaaat

SEQ ID NO: 9458931 - DNA, 22 bp, Homo sapiens
tagtttctttcacgtagtaata

SEQ ID NO: 9458932 - DNA, 22 bp, Homo sapiens
tagtttgtaatgaggagaagta

SEQ ID NO: 9458933 - DNA, 22 bp, Homo sapiens
tagttttacttgcgatgataat

SEQ ID NO: 9458934 - DNA, 22 bp, Homo sapiens
tagttttacttgcgatgataat

SEQ ID NO: 9458935 - DNA, 22 bp, Homo sapiens
tagttttacttgcgatgataat

SEQ ID NO: 9458936 - DNA, 22 bp, Homo sapiens
tagtttcttgattagccacttt

SEQ ID NO: 9458937 - DNA, 22 bp, Homo sapiens
tagtttcttcacctgtaaaatg

SEQ ID NO: 9458938 - DNA, 22 bp, Homo sapiens
tagtttcttcacctgtaaaatg

SEQ ID NO: 9458939 - DNA, 22 bp, Homo sapiens
tagtttctgaggattgaaagat

SEQ ID NO: 9458940 - DNA, 22 bp, Homo sapiens
tagtttctcagggaggaaagaa

SEQ ID NO: 9458941 - DNA, 22 bp, Homo sapiens
tagtttctgcctcggaagctga

SEQ ID NO: 9458942 - DNA, 22 bp, Homo sapiens
tagtttctgggttggcttctac

SEQ ID NO: 9458943 - DNA, 22 bp, Homo sapiens
tacagagactttatggcacaaa

SEQ ID NO: 9458944 - DNA, 22 bp, Homo sapiens
tacagcatatacagaatgaaca

SEQ ID NO: 9458945 - DNA, 22 bp, Homo sapiens
tacagcagcccaccttcttctg

SEQ ID NO: 9458946 - DNA, 22 bp, Homo sapiens
tacagcagggcgctgtgatgaa

SEQ ID NO: 9458947 - DNA, 22 bp, Homo sapiens
tacagcagggcgctgtgatgaa

SEQ ID NO: 9458948 - DNA, 22 bp, Homo sapiens
tacagagagctccggacattca

SEQ ID NO: 9458949 - DNA, 22 bp, Homo sapiens
tacagcattgtgtcttcactca

SEQ ID NO: 9458950 - DNA, 22 bp, Homo sapiens
tacagccatcatgtatgtatat

SEQ ID NO: 9458951 - DNA, 22 bp, Homo sapiens
tacagcatgtccttagcaaggc

SEQ ID NO: 9458952 - DNA, 22 bp, Homo sapiens
tacagccatggttaatttacct

SEQ ID NO: 9458953 - DNA, 22 bp, Homo sapiens
tacagcccaagaagtttatacg

SEQ ID NO: 9458954 - DNA, 22 bp, Homo sapiens
tacagcctccacaggccaagtg

SEQ ID NO: 9458955 - DNA, 20 bp, Homo sapiens
tacagcctattcaccacata

SEQ ID NO: 9458956 - DNA, 22 bp, Homo sapiens
tacagctcagaacctcactgtc

SEQ ID NO: 9458957 - DNA, 22 bp, Homo sapiens
tacagctccaaaaatcactgtt

SEQ ID NO: 9458958 - DNA, 22 bp, Homo sapiens
tacagctcccggggagcttcgt

SEQ ID NO: 9458959 - DNA, 22 bp, Homo sapiens
tacagcctcgaactcctgcatt

SEQ ID NO: 9458960 - DNA, 22 bp, Homo sapiens
tacagccttcatctttgccttg

SEQ ID NO: 9458961 - DNA, 22 bp, Homo sapiens
tacagctgctggtgctccatgc

SEQ ID NO: 9458962 - DNA, 22 bp, Homo sapiens
tacagctggactggtagctgtg

SEQ ID NO: 9458963 - DNA, 23 bp, Homo sapiens
tacagctgcagaatcaggctaag

SEQ ID NO: 9458964 - DNA, 23 bp, Homo sapiens
tacagctgcagaatcaggctaag

SEQ ID NO: 9458965 - DNA, 21 bp, Homo sapiens
tacagctcggcagataaagcc

SEQ ID NO: 9458966 - DNA, 22 bp, Homo sapiens
tacagctgcaagggtttctggg

SEQ ID NO: 9458967 - DNA, 22 bp, Homo sapiens
tacagctgagtttaggtacagg

SEQ ID NO: 9458968 - DNA, 22 bp, Homo sapiens
tacagctgagtttaggtacagg

SEQ ID NO: 9458969 - DNA, 22 bp, Homo sapiens
caggcctgtctgcacatgaggc

SEQ ID NO: 9458970 - DNA, 22 bp, Homo sapiens
caggcctgtctgcacatgaggc

SEQ ID NO: 9458971 - DNA, 22 bp, Homo sapiens
caggcctgtgacaccgtgtctg

SEQ ID NO: 9458972 - DNA, 22 bp, Homo sapiens
caggcctgtgacaccgtgtctg

SEQ ID NO: 9458973 - DNA, 22 bp, Homo sapiens
caggcctgtctgcacatgaggc

SEQ ID NO: 9458974 - DNA, 22 bp, Homo sapiens
caggcctgtgagttgaggcccc

SEQ ID NO: 9458975 - DNA, 22 bp, Homo sapiens
caggcctgtgagttgaggcccc

SEQ ID NO: 9458976 - DNA, 22 bp, Homo sapiens
caggccttaaggactcggagaa

SEQ ID NO: 9458977 - DNA, 22 bp, Homo sapiens
caggccttgagttttgggcttt

SEQ ID NO: 9458978 - DNA, 22 bp, Homo sapiens
caggccttgcgtcccatggcct

SEQ ID NO: 9458979 - DNA, 22 bp, Homo sapiens
caggccttgggacccagactgg

SEQ ID NO: 9458980 - DNA, 22 bp, Homo sapiens
caggccttctccctccctcaac

SEQ ID NO: 9458981 - DNA, 22 bp, Homo sapiens
caggccttgaaggcctgcggga

SEQ ID NO: 9458982 - DNA, 22 bp, Homo sapiens
caggccttgaaggcctgcggga

SEQ ID NO: 9458983 - DNA, 17 bp, Homo sapiens
caggccttgagccttta

SEQ ID NO: 9458984 - DNA, 22 bp, Homo sapiens
caggccttagtaggtgctccct

SEQ ID NO: 9458985 - DNA, 22 bp, Homo sapiens
caggccttatctccaccctgca

SEQ ID NO: 9458986 - DNA, 22 bp, Homo sapiens
caggctcccaccctcctgcagc

SEQ ID NO: 9458987 - DNA, 22 bp, Homo sapiens
caggctcccacttggcttaaag

SEQ ID NO: 9458988 - DNA, 22 bp, Homo sapiens
caggctcccgaaatcacccatg

SEQ ID NO: 9458989 - DNA, 22 bp, Homo sapiens
caggctcccgaaatcacccatg

SEQ ID NO: 9458990 - DNA, 22 bp, Homo sapiens
caggctcccacaagctcccagc

SEQ ID NO: 9458991 - DNA, 22 bp, Homo sapiens
caggctccattaatcatcctgc

SEQ ID NO: 9458992 - DNA, 22 bp, Homo sapiens
caggctcccacaagctcccagc

SEQ ID NO: 9458993 - DNA, 22 bp, Homo sapiens
caggctccagcttcctgctcag

SEQ ID NO: 9458994 - DNA, 22 bp, Homo sapiens
caggctccagcttcctgctcag

SEQ ID NO: 9458995 - DNA, 22 bp, Homo sapiens
caggctccactgtaggcagctc

SEQ ID NO: 9458996 - DNA, 22 bp, Homo sapiens
caggctccactgtaggcagctc

SEQ ID NO: 9458997 - DNA, 22 bp, Homo sapiens
caggctccagcttcctgctcag

SEQ ID NO: 9458998 - DNA, 22 bp, Homo sapiens
caggctcaaggctgacttccat

SEQ ID NO: 9458999 - DNA, 22 bp, Homo sapiens
caggctccactgtaggcagctc

SEQ ID NO: 9459000 - DNA, 22 bp, Homo sapiens
tacagttccaggatcatagggt

SEQ ID NO: 9459001 - DNA, 22 bp, Homo sapiens
tacagttccaggatcatagggt

SEQ ID NO: 9459002 - DNA, 22 bp, Homo sapiens
tacagttcctctcgtggaggtg

SEQ ID NO: 9459003 - DNA, 22 bp, Homo sapiens
tacagttctttgaaggatctag

SEQ ID NO: 9459004 - DNA, 22 bp, Homo sapiens
tacagtttcccagcagatgcaa

SEQ ID NO: 9459005 - DNA, 22 bp, Homo sapiens
tacagtttctcattatgctctc

SEQ ID NO: 9459006 - DNA, 22 bp, Homo sapiens
tacagtttacatgagaggaagc

SEQ ID NO: 9459007 - DNA, 22 bp, Homo sapiens
tacagtttagaaccatagatgg

SEQ ID NO: 9459008 - DNA, 22 bp, Homo sapiens
tacagtttccaagggcttgaag

SEQ ID NO: 9459009 - DNA, 22 bp, Homo sapiens
tacagtttagaaccatagatgg

SEQ ID NO: 9459010 - DNA, 22 bp, Homo sapiens
caggctccctgccagggccggc

SEQ ID NO: 9459011 - DNA, 22 bp, Homo sapiens
caggctccctgccagggccggc

SEQ ID NO: 9459012 - DNA, 22 bp, Homo sapiens
caggctccctgcaggccagtga

SEQ ID NO: 9459013 - DNA, 22 bp, Homo sapiens
caggctccctgggcagtggcag

SEQ ID NO: 9459014 - DNA, 22 bp, Homo sapiens
caggctcccttctcggaattct

SEQ ID NO: 9459015 - DNA, 22 bp, Homo sapiens
caggctccctgggcagtggcag

SEQ ID NO: 9459016 - DNA, 22 bp, Homo sapiens
caggctccctgggcagtggcag

SEQ ID NO: 9459017 - DNA, 22 bp, Homo sapiens
caggctccctaagtcagcagcc

SEQ ID NO: 9459018 - DNA, 22 bp, Homo sapiens
caggctccctaagtcagcagcc

SEQ ID NO: 9459019 - DNA, 22 bp, Homo sapiens
caggctccctaagtcagcagcc

SEQ ID NO: 9459020 - DNA, 22 bp, Homo sapiens
caggctccctaagtcagcagcc

SEQ ID NO: 9459021 - DNA, 23 bp, Homo sapiens
caggctcccggaccaggatccgc

SEQ ID NO: 9459022 - DNA, 23 bp, Homo sapiens
caggctcccggaccaggatccgc

SEQ ID NO: 9459023 - DNA, 22 bp, Homo sapiens
caggctcccgaaatcacccatg

SEQ ID NO: 9459024 - DNA, 22 bp, Homo sapiens
caggctcccgctccactgggca

SEQ ID NO: 9459025 - DNA, 22 bp, Homo sapiens
caggctcccgctccactgggca

SEQ ID NO: 9459026 - DNA, 22 bp, Homo sapiens
caggctcccgctccactgggca

SEQ ID NO: 9459027 - DNA, 20 bp, Homo sapiens
caggctccgcaggactaggg

SEQ ID NO: 9459028 - DNA, 22 bp, Homo sapiens
caggctcctcactcatgctccc

SEQ ID NO: 9459029 - DNA, 20 bp, Homo sapiens
caggctccgcaggactaggg

SEQ ID NO: 9459030 - DNA, 20 bp, Homo sapiens
caggctccgcaggactaggg

SEQ ID NO: 9459031 - DNA, 22 bp, Homo sapiens
caggctcctcactcatgctccc

SEQ ID NO: 9459032 - DNA, 22 bp, Homo sapiens
caggctccttatcttacaactt

SEQ ID NO: 9459033 - DNA, 22 bp, Homo sapiens
caggctcctcactcatgctccc

SEQ ID NO: 9459034 - DNA, 22 bp, Homo sapiens
caggctcctcactcatgctccc

SEQ ID NO: 9459035 - DNA, 22 bp, Homo sapiens
caggctccttatcttacaactt

SEQ ID NO: 9459036 - DNA, 17 bp, Homo sapiens
caggctccttccagatt

SEQ ID NO: 9459037 - DNA, 17 bp, Homo sapiens
caggctccttccagatt

SEQ ID NO: 9459038 - DNA, 17 bp, Homo sapiens
caggctccttccagatt

SEQ ID NO: 9459039 - DNA, 22 bp, Homo sapiens
caggctcggtccagtggcaccc

SEQ ID NO: 9459040 - DNA, 22 bp, Homo sapiens
caggctcggaagtgctggcttt

SEQ ID NO: 9459041 - DNA, 22 bp, Homo sapiens
caggctccttcccagggatggt

SEQ ID NO: 9459042 - DNA, 22 bp, Homo sapiens
caggctccttcccagggatggt

SEQ ID NO: 9459043 - DNA, 22 bp, Homo sapiens
caggctccttcccagggatggt

SEQ ID NO: 9459044 - DNA, 22 bp, Homo sapiens
caggctccttcccagggatggt

SEQ ID NO: 9459045 - DNA, 22 bp, Homo sapiens
caggccctgccttggcatgtgt

SEQ ID NO: 9459046 - DNA, 22 bp, Homo sapiens
caggccctgccttgagggacct

SEQ ID NO: 9459047 - DNA, 22 bp, Homo sapiens
caggccctgccttgagggacct

SEQ ID NO: 9459048 - DNA, 22 bp, Homo sapiens
caggccctgccttggcatgtgt

SEQ ID NO: 9459049 - DNA, 22 bp, Homo sapiens
tacactggacaggagtaggaag

SEQ ID NO: 9459050 - DNA, 22 bp, Homo sapiens
tacactgctgctttgcccgtga

SEQ ID NO: 9459051 - DNA, 22 bp, Homo sapiens
tacactgctgggcagtgaatga

SEQ ID NO: 9459052 - DNA, 22 bp, Homo sapiens
tacactgtacgctctgcttcaa

SEQ ID NO: 9459053 - DNA, 22 bp, Homo sapiens
tacactgtaggtggcaggcagc

SEQ ID NO: 9459054 - DNA, 22 bp, Homo sapiens
tacactggggctctgggagtga

SEQ ID NO: 9459055 - DNA, 22 bp, Homo sapiens
tacactggggctctgggagtga

SEQ ID NO: 9459056 - DNA, 22 bp, Homo sapiens
tacactggctgttttgcagaaa

SEQ ID NO: 9459057 - DNA, 22 bp, Homo sapiens
tacactggagcccttggggtct

SEQ ID NO: 9459058 - DNA, 22 bp, Homo sapiens
tacactggattagctgtcctac

SEQ ID NO: 9459059 - DNA, 22 bp, Homo sapiens
tacactggccaaatgcctttgg

SEQ ID NO: 9459060 - DNA, 22 bp, Homo sapiens
tacactggccccagggcggggc

SEQ ID NO: 9459061 - DNA, 22 bp, Homo sapiens
tacactgtgtaaaatgcacttt

SEQ ID NO: 9459062 - DNA, 22 bp, Homo sapiens
tacactgtgtaaaatgcacttt

SEQ ID NO: 9459063 - DNA, 22 bp, Homo sapiens
tacactgtgtaaaatgcacttt

SEQ ID NO: 9459064 - DNA, 22 bp, Homo sapiens
tacactgtggtaaactcaaagt

SEQ ID NO: 9459065 - DNA, 22 bp, Homo sapiens
tacactgtggtaaactcaaagt

SEQ ID NO: 9459066 - DNA, 22 bp, Homo sapiens
tacactgtgaggtttccaaggg

SEQ ID NO: 9459067 - DNA, 22 bp, Homo sapiens
tacactgtgaggtttccaaggg

SEQ ID NO: 9459068 - DNA, 22 bp, Homo sapiens
tacactgtgacaatcatgacag

SEQ ID NO: 9459069 - DNA, 22 bp, Homo sapiens
tacactgtgacaatcatgacag

SEQ ID NO: 9459070 - DNA, 22 bp, Homo sapiens
tacactgtgacaatcatgacag

SEQ ID NO: 9459071 - DNA, 22 bp, Homo sapiens
tacactgtcagatttcgattgc

SEQ ID NO: 9459072 - DNA, 22 bp, Homo sapiens
tacactgtcttagaaaggggca

SEQ ID NO: 9459073 - DNA, 22 bp, Homo sapiens
tacagacatttactccactcct

SEQ ID NO: 9459074 - DNA, 22 bp, Homo sapiens
tacagaccagtagttctcagcg

SEQ ID NO: 9459075 - DNA, 22 bp, Homo sapiens
tacagagaataataggacaggt

SEQ ID NO: 9459076 - DNA, 22 bp, Homo sapiens
tacagagaactcatagaaagaa

SEQ ID NO: 9459077 - DNA, 22 bp, Homo sapiens
tacagacattcaattttgaccc

SEQ ID NO: 9459078 - DNA, 22 bp, Homo sapiens
tacactttcgtttgtggattag

SEQ ID NO: 9459079 - DNA, 22 bp, Homo sapiens
tacactgtttttggaaagaaga

SEQ ID NO: 9459080 - DNA, 22 bp, Homo sapiens
tacactgtttgaactgtggtcg

SEQ ID NO: 9459081 - DNA, 22 bp, Homo sapiens
caggccctcgtggtgagctggg

SEQ ID NO: 9459082 - DNA, 22 bp, Homo sapiens
caggccctctgcaccctcgtct

SEQ ID NO: 9459083 - DNA, 22 bp, Homo sapiens
caggccctgcacagtggtcctg

SEQ ID NO: 9459084 - DNA, 22 bp, Homo sapiens
caggccctgccttgagggacct

SEQ ID NO: 9459085 - DNA, 22 bp, Homo sapiens
caggccctgcactaggccctgg

SEQ ID NO: 9459086 - DNA, 22 bp, Homo sapiens
caggccctcgcccgcagcgacc

SEQ ID NO: 9459087 - DNA, 22 bp, Homo sapiens
caggccctcgcccgcagcgacc

SEQ ID NO: 9459088 - DNA, 22 bp, Homo sapiens
caggccctcgtggtgagctggg

SEQ ID NO: 9459089 - DNA, 22 bp, Homo sapiens
caggccctcgtggtgagctggg

SEQ ID NO: 9459090 - DNA, 22 bp, Homo sapiens
caggccctcctgtgatctgcct

SEQ ID NO: 9459091 - DNA, 22 bp, Homo sapiens
caggccctcaggcaagggctct

SEQ ID NO: 9459092 - DNA, 22 bp, Homo sapiens
caggccctcctgtgatctgcct

SEQ ID NO: 9459093 - DNA, 22 bp, Homo sapiens
caggccctcgcccgcagcgacc

SEQ ID NO: 9459094 - DNA, 22 bp, Homo sapiens
caggccacagctaaagaggatt

SEQ ID NO: 9459095 - DNA, 22 bp, Homo sapiens
caggccaccagatacatgcccc

SEQ ID NO: 9459096 - DNA, 22 bp, Homo sapiens
caggccaccagatacatgcccc

SEQ ID NO: 9459097 - DNA, 22 bp, Homo sapiens
caggccaccagatacatgcccc

SEQ ID NO: 9459098 - DNA, 22 bp, Homo sapiens
caggccacacggcggctccctg

SEQ ID NO: 9459099 - DNA, 22 bp, Homo sapiens
caggccacagctaaagaggatt

SEQ ID NO: 9459100 - DNA, 22 bp, Homo sapiens
caggccacacggcggctccctg

SEQ ID NO: 9459101 - DNA, 22 bp, Homo sapiens
caggccacacggcggctccctg

SEQ ID NO: 9459102 - DNA, 22 bp, Homo sapiens
caggccacaagttgggttcaag

SEQ ID NO: 9459103 - DNA, 22 bp, Homo sapiens
caggccaatatcacatgctatg

SEQ ID NO: 9459104 - DNA, 22 bp, Homo sapiens
caggccaatatcacatgctatg

SEQ ID NO: 9459105 - DNA, 22 bp, Homo sapiens
caggccaatatcacatgctatg

SEQ ID NO: 9459106 - DNA, 22 bp, Homo sapiens
caggcccaggggtctggcccac

SEQ ID NO: 9459107 - DNA, 22 bp, Homo sapiens
caggcccaggggtctggcccac

SEQ ID NO: 9459108 - DNA, 22 bp, Homo sapiens
caggcccaggggtctggcccac

SEQ ID NO: 9459109 - DNA, 22 bp, Homo sapiens
caggccctcaggcaagggctct

SEQ ID NO: 9459110 - DNA, 22 bp, Homo sapiens
caggccccattcctcttgggac

SEQ ID NO: 9459111 - DNA, 22 bp, Homo sapiens
caggccacgccccggcgtgtga

SEQ ID NO: 9459112 - DNA, 22 bp, Homo sapiens
caggccaccagatacatgcccc

SEQ ID NO: 9459113 - DNA, 22 bp, Homo sapiens
caggccacgccccggcgtgtga

SEQ ID NO: 9459114 - DNA, 22 bp, Homo sapiens
caggccaaaattcaggcattct

SEQ ID NO: 9459115 - DNA, 22 bp, Homo sapiens
caggccaaagatcccattgaca

SEQ ID NO: 9459116 - DNA, 22 bp, Homo sapiens
caggccaaagatcccattgaca

SEQ ID NO: 9459117 - DNA, 22 bp, Homo sapiens
caggccaactgcatggtgacca

SEQ ID NO: 9459118 - DNA, 22 bp, Homo sapiens
caggccaactgcatggtgacca

SEQ ID NO: 9459119 - DNA, 22 bp, Homo sapiens
caggccaagtcccaagtgcggg

SEQ ID NO: 9459120 - DNA, 22 bp, Homo sapiens
caggccaataaatgtgatggcc

SEQ ID NO: 9459121 - DNA, 22 bp, Homo sapiens
caggccaataaatgtgatggcc

SEQ ID NO: 9459122 - DNA, 22 bp, Homo sapiens
caggccaagcctccccagctcc

SEQ ID NO: 9459123 - DNA, 22 bp, Homo sapiens
caggccaagtcccaagtgcggg

SEQ ID NO: 9459124 - DNA, 22 bp, Homo sapiens
caggccaactgcatggtgacca

SEQ ID NO: 9459125 - DNA, 22 bp, Homo sapiens
tacacagaggctgatgtcttag

SEQ ID NO: 9459126 - DNA, 22 bp, Homo sapiens
tacacagaggctgatgtcttag

SEQ ID NO: 9459127 - DNA, 22 bp, Homo sapiens
tacacagatatgtgatcaatca

SEQ ID NO: 9459128 - DNA, 22 bp, Homo sapiens
tacacagactcttcaattcaga

SEQ ID NO: 9459129 - DNA, 22 bp, Homo sapiens
tacacagaagccagaaggcctg

SEQ ID NO: 9459130 - DNA, 22 bp, Homo sapiens
tacacagaacctggtgtacagt

SEQ ID NO: 9459131 - DNA, 22 bp, Homo sapiens
tacaatagggcttttgtttatg

SEQ ID NO: 9459132 - DNA, 22 bp, Homo sapiens
gtggagaggagcagctacctca

SEQ ID NO: 9459133 - DNA, 20 bp, Homo sapiens
gtggagaggctggcgggact

SEQ ID NO: 9459134 - DNA, 22 bp, Homo sapiens
gtggagcaatcagagggtcagt

SEQ ID NO: 9459135 - DNA, 22 bp, Homo sapiens
gtggagcaatcagagggtcagt

SEQ ID NO: 9459136 - DNA, 22 bp, Homo sapiens
gtggagcaggactagctgagaa

SEQ ID NO: 9459137 - DNA, 22 bp, Homo sapiens
gtggagcaggactagctgagaa

SEQ ID NO: 9459138 - DNA, 22 bp, Homo sapiens
gtggagcaggactagctgagaa

SEQ ID NO: 9459139 - DNA, 22 bp, Homo sapiens
gtggagcaggactagctgagaa

SEQ ID NO: 9459140 - DNA, 22 bp, Homo sapiens
gtggagcataacacactagcct

SEQ ID NO: 9459141 - DNA, 22 bp, Homo sapiens
gtggagcataacacactagcct

SEQ ID NO: 9459142 - DNA, 22 bp, Homo sapiens
gtggagcatgtgaggactgagt

SEQ ID NO: 9459143 - DNA, 22 bp, Homo sapiens
gtggagcatgtgaggactgagt

SEQ ID NO: 9459144 - DNA, 22 bp, Homo sapiens
gtggagccaggatctccgcaca

SEQ ID NO: 9459145 - DNA, 23 bp, Homo sapiens
gtggagccacatcacaggctcct

SEQ ID NO: 9459146 - DNA, 22 bp, Homo sapiens
cagctctgccatcatctgcctt

SEQ ID NO: 9459147 - DNA, 22 bp, Homo sapiens
cagctctgccacttcctagcta

SEQ ID NO: 9459148 - DNA, 17 bp, Homo sapiens
cagctctgcatcttcct

SEQ ID NO: 9459149 - DNA, 22 bp, Homo sapiens
cagctctgccacttcctagcta

SEQ ID NO: 9459150 - DNA, 22 bp, Homo sapiens
cagctctgccatcatctgcctt

SEQ ID NO: 9459151 - DNA, 22 bp, Homo sapiens
cagctctgcctctggggctgag

SEQ ID NO: 9459152 - DNA, 22 bp, Homo sapiens
cagctctgcctctggggctgag

SEQ ID NO: 9459153 - DNA, 22 bp, Homo sapiens
tagacatttgaatgtgaaatga

SEQ ID NO: 9459154 - DNA, 22 bp, Homo sapiens
tagacatttggagttttatgac

SEQ ID NO: 9459155 - DNA, 22 bp, Homo sapiens
tagacatttctggttattgaca

SEQ ID NO: 9459156 - DNA, 22 bp, Homo sapiens
tagacatttctggttattgaca

SEQ ID NO: 9459157 - DNA, 22 bp, Homo sapiens
tagacatttgtcaagaatgact

SEQ ID NO: 9459158 - DNA, 22 bp, Homo sapiens
tagacatttgtcaagaatgact

SEQ ID NO: 9459159 - DNA, 22 bp, Homo sapiens
tagacatttggcatggttttca

SEQ ID NO: 9459160 - DNA, 22 bp, Homo sapiens
tagacatttctggttattgaca

SEQ ID NO: 9459161 - DNA, 22 bp, Homo sapiens
tagacatttatctccatgtgga

SEQ ID NO: 9459162 - DNA, 22 bp, Homo sapiens
tagacattggccattcctgtgg

SEQ ID NO: 9459163 - DNA, 22 bp, Homo sapiens
tagacatttagatatctcgctg

SEQ ID NO: 9459164 - DNA, 22 bp, Homo sapiens
tagacattatgtattaagttct

SEQ ID NO: 9459165 - DNA, 22 bp, Homo sapiens
tagacattatgtattaagttct

SEQ ID NO: 9459166 - DNA, 22 bp, Homo sapiens
tagacattatttctacccacaa

SEQ ID NO: 9459167 - DNA, 22 bp, Homo sapiens
tagacattggccattcctgtgg

SEQ ID NO: 9459168 - DNA, 22 bp, Homo sapiens
tagacagtgagctatgagtggt

SEQ ID NO: 9459169 - DNA, 22 bp, Homo sapiens
tagacaggagtcaggctagaat

SEQ ID NO: 9459170 - DNA, 22 bp, Homo sapiens
tagacattaggtaggttcatgg

SEQ ID NO: 9459171 - DNA, 22 bp, Homo sapiens
tagacattatgtattaagttct

SEQ ID NO: 9459172 - DNA, 22 bp, Homo sapiens
tagacattaggtaggttcatgg

SEQ ID NO: 9459173 - DNA, 22 bp, Homo sapiens
cagggagaggctggtggagtaa

SEQ ID NO: 9459174 - DNA, 22 bp, Homo sapiens
cagggagaggcctctgttgccc

SEQ ID NO: 9459175 - DNA, 22 bp, Homo sapiens
cagggagaggcctctgttgccc

SEQ ID NO: 9459176 - DNA, 22 bp, Homo sapiens
cagggagaggcctctgttgccc

SEQ ID NO: 9459177 - DNA, 22 bp, Homo sapiens
cagggagaggcctctgttgccc

SEQ ID NO: 9459178 - DNA, 22 bp, Homo sapiens
cagggagaggcctctgttgccc

SEQ ID NO: 9459179 - DNA, 22 bp, Homo sapiens
cagggagaggctggtggagtaa

SEQ ID NO: 9459180 - DNA, 22 bp, Homo sapiens
cagggagaggctggtggagtaa

SEQ ID NO: 9459181 - DNA, 22 bp, Homo sapiens
cagggagatcttggctcctggt

SEQ ID NO: 9459182 - DNA, 22 bp, Homo sapiens
cagggagatcttggctcctggt

SEQ ID NO: 9459183 - DNA, 22 bp, Homo sapiens
cagggagaagtctggtcagtcc

SEQ ID NO: 9459184 - DNA, 22 bp, Homo sapiens
cagggagaggcatcatagggaa

SEQ ID NO: 9459185 - DNA, 22 bp, Homo sapiens
cagggagaggcatcatagggaa

SEQ ID NO: 9459186 - DNA, 22 bp, Homo sapiens
cagggagaggcatcatagggaa

SEQ ID NO: 9459187 - DNA, 22 bp, Homo sapiens
cagggagaggcctctgttgccc

SEQ ID NO: 9459188 - DNA, 22 bp, Homo sapiens
cagggagaggcatcatagggaa

SEQ ID NO: 9459189 - DNA, 22 bp, Homo sapiens
cagggagaagtctggtcagtcc

SEQ ID NO: 9459190 - DNA, 22 bp, Homo sapiens
cagggagaagtctggtcagtcc

SEQ ID NO: 9459191 - DNA, 22 bp, Homo sapiens
cagggagaagtctggtcagtcc

SEQ ID NO: 9459192 - DNA, 22 bp, Homo sapiens
cagggagaaatctccaggaggt

SEQ ID NO: 9459193 - DNA, 22 bp, Homo sapiens
cagggagaaatctccaggaggt

SEQ ID NO: 9459194 - DNA, 22 bp, Homo sapiens
cagggagaagtctggtcagtcc

SEQ ID NO: 9459195 - DNA, 22 bp, Homo sapiens
tagaacataagtcattcatttg

SEQ ID NO: 9459196 - DNA, 22 bp, Homo sapiens
cagggacagccttggggtggcg

SEQ ID NO: 9459197 - DNA, 22 bp, Homo sapiens
tagaacagtataggctaaacat

SEQ ID NO: 9459198 - DNA, 22 bp, Homo sapiens
tagaacaggaataagggaaata

SEQ ID NO: 9459199 - DNA, 22 bp, Homo sapiens
tagaacagcatttggctattaa

SEQ ID NO: 9459200 - DNA, 22 bp, Homo sapiens
tagaacaggctgtcagagcggg

SEQ ID NO: 9459201 - DNA, 22 bp, Homo sapiens
tagaacaggctgtcagagcggg

SEQ ID NO: 9459202 - DNA, 22 bp, Homo sapiens
tagaacagagggttgcccagat

SEQ ID NO: 9459203 - DNA, 22 bp, Homo sapiens
tagaacagaaggcaccttctct

SEQ ID NO: 9459204 - DNA, 22 bp, Homo sapiens
tagaacagagttccagtgatca

SEQ ID NO: 9459205 - DNA, 22 bp, Homo sapiens
tagaacagagggttgcccagat

SEQ ID NO: 9459206 - DNA, 22 bp, Homo sapiens
tagaacagagttccagtgatca

SEQ ID NO: 9459207 - DNA, 22 bp, Homo sapiens
tagaacagagttccagtgatca

SEQ ID NO: 9459208 - DNA, 22 bp, Homo sapiens
tagaaatgtaggcttcctgaca

SEQ ID NO: 9459209 - DNA, 22 bp, Homo sapiens
tagaaagcatgcaagtttgatg

SEQ ID NO: 9459210 - DNA, 22 bp, Homo sapiens
tagaaagcagtatctccatttt

SEQ ID NO: 9459211 - DNA, 22 bp, Homo sapiens
tagaaatgtgataatagcttaa

SEQ ID NO: 9459212 - DNA, 22 bp, Homo sapiens
tagaaatgtgataatagcttaa

SEQ ID NO: 9459213 - DNA, 22 bp, Homo sapiens
tagaaattcaatgctctgagta

SEQ ID NO: 9459214 - DNA, 22 bp, Homo sapiens
tagaaatgttggtattaacatt

SEQ ID NO: 9459215 - DNA, 22 bp, Homo sapiens
tagaaatgttggtattaacatt

SEQ ID NO: 9459216 - DNA, 22 bp, Homo sapiens
tagaaatgtgataatagcttaa

SEQ ID NO: 9459217 - DNA, 22 bp, Homo sapiens
tagaaatgttagatgtattgag

SEQ ID NO: 9459218 - DNA, 22 bp, Homo sapiens
tagaaatgttggtattaacatt

SEQ ID NO: 9459219 - DNA, 22 bp, Homo sapiens
caggctgcagcagcagtggccc

SEQ ID NO: 9459220 - DNA, 22 bp, Homo sapiens
caggctgatcagggctgggatg

SEQ ID NO: 9459221 - DNA, 22 bp, Homo sapiens
caggctgattaggcctcgtcca

SEQ ID NO: 9459222 - DNA, 22 bp, Homo sapiens
caggctgatcagggctgggatg

SEQ ID NO: 9459223 - DNA, 22 bp, Homo sapiens
caggctgatcagggctgggatg

SEQ ID NO: 9459224 - DNA, 22 bp, Homo sapiens
caggctgatagggtccaaagtt

SEQ ID NO: 9459225 - DNA, 22 bp, Homo sapiens
caggctgaggcagtagggtttg

SEQ ID NO: 9459226 - DNA, 22 bp, Homo sapiens
caggctgagggttaggccttag

SEQ ID NO: 9459227 - DNA, 22 bp, Homo sapiens
taccctggagcaagtttcctca

SEQ ID NO: 9459228 - DNA, 22 bp, Homo sapiens
taccctctcccggtccagcttt

SEQ ID NO: 9459229 - DNA, 22 bp, Homo sapiens
taccctgaagtagctctttccc

SEQ ID NO: 9459230 - DNA, 20 bp, Homo sapiens
taccctggctatgcttctga

SEQ ID NO: 9459231 - DNA, 22 bp, Homo sapiens
tacctacagatgtaaatgaaac

SEQ ID NO: 9459232 - DNA, 22 bp, Homo sapiens
tacccagttcagtgtttaaaaa

SEQ ID NO: 9459233 - DNA, 22 bp, Homo sapiens
tacccagttattttgtctttgt

SEQ ID NO: 9459234 - DNA, 22 bp, Homo sapiens
tacccagttccacacactgatg

SEQ ID NO: 9459235 - DNA, 22 bp, Homo sapiens
taccccaagagtgtctgccatg

SEQ ID NO: 9459236 - DNA, 22 bp, Homo sapiens
taccccaagagtgtctgccatg

SEQ ID NO: 9459237 - DNA, 19 bp, Homo sapiens
taccctcagggcctcattt

SEQ ID NO: 9459238 - DNA, 22 bp, Homo sapiens
taccctctcccggtccagcttt

SEQ ID NO: 9459239 - DNA, 22 bp, Homo sapiens
tacccagcttcaagtcaggact

SEQ ID NO: 9459240 - DNA, 22 bp, Homo sapiens
tacccagtgcaactggagtctc

SEQ ID NO: 9459241 - DNA, 22 bp, Homo sapiens
tacccagtgcaactggagtctc

SEQ ID NO: 9459242 - DNA, 20 bp, Homo sapiens
tacccagtggtggatggtaa

SEQ ID NO: 9459243 - DNA, 22 bp, Homo sapiens
tacccagtgccaccctctgagg

SEQ ID NO: 9459244 - DNA, 22 bp, Homo sapiens
tacccagtctggagtgcagtga

SEQ ID NO: 9459245 - DNA, 22 bp, Homo sapiens
tagaaacaagtttctctttggg

SEQ ID NO: 9459246 - DNA, 22 bp, Homo sapiens
tagaaagaacttcatgtaaaac

SEQ ID NO: 9459247 - DNA, 22 bp, Homo sapiens
tagaaacaagtttctctttggg

SEQ ID NO: 9459248 - DNA, 22 bp, Homo sapiens
tagaaacaagggagaggattct

SEQ ID NO: 9459249 - DNA, 22 bp, Homo sapiens
tagaaacaagggagaggattct

SEQ ID NO: 9459250 - DNA, 22 bp, Homo sapiens
tagaaagaacttcatgtaaaac

SEQ ID NO: 9459251 - DNA, 22 bp, Homo sapiens
tagaaagaacttcatgtaaaac

SEQ ID NO: 9459252 - DNA, 22 bp, Homo sapiens
tagaaagacagaggttttgtct

SEQ ID NO: 9459253 - DNA, 22 bp, Homo sapiens
tagaaagacaatgggaagtgct

SEQ ID NO: 9459254 - DNA, 22 bp, Homo sapiens
tacctcaagttccaggaaagcg

SEQ ID NO: 9459255 - DNA, 22 bp, Homo sapiens
tacctcaagttccaggaaagcg

SEQ ID NO: 9459256 - DNA, 22 bp, Homo sapiens
tacctataggtacaattacaag

SEQ ID NO: 9459257 - DNA, 22 bp, Homo sapiens
tacctctcggggtctgtttgtg

SEQ ID NO: 9459258 - DNA, 22 bp, Homo sapiens
tacctctctaaacccagggaca

SEQ ID NO: 9459259 - DNA, 22 bp, Homo sapiens
tagaaagactgtccagatttca

SEQ ID NO: 9459260 - DNA, 22 bp, Homo sapiens
tagaaagactgtccagatttca

SEQ ID NO: 9459261 - DNA, 22 bp, Homo sapiens
tagaaagagcatagtattataa

SEQ ID NO: 9459262 - DNA, 22 bp, Homo sapiens
tagaaagcagaaaccatcagag

SEQ ID NO: 9459263 - DNA, 22 bp, Homo sapiens
tagaaagcagaaaccatcagag

SEQ ID NO: 9459264 - DNA, 22 bp, Homo sapiens
tagaaagcaaaatcctaccaag

SEQ ID NO: 9459265 - DNA, 22 bp, Homo sapiens
tagcattaaaggtaagacatta

SEQ ID NO: 9459266 - DNA, 22 bp, Homo sapiens
tagcatctttttctgtcttcta

SEQ ID NO: 9459267 - DNA, 22 bp, Homo sapiens
tagcatgtcagtcgccacacgt

SEQ ID NO: 9459268 - DNA, 22 bp, Homo sapiens
tagcatcatgatcagaactgtt

SEQ ID NO: 9459269 - DNA, 22 bp, Homo sapiens
tagcatcagccacaccttgtac

SEQ ID NO: 9459270 - DNA, 22 bp, Homo sapiens
tagcatctgaactgttgaaaag

SEQ ID NO: 9459271 - DNA, 22 bp, Homo sapiens
tagcatctgttctttcattaaa

SEQ ID NO: 9459272 - DNA, 22 bp, Homo sapiens
tagcatcagccacaccttgtac

SEQ ID NO: 9459273 - DNA, 22 bp, Homo sapiens
tagcataatttgtagaaaatca

SEQ ID NO: 9459274 - DNA, 22 bp, Homo sapiens
tagcataacaggtaagagtgag

SEQ ID NO: 9459275 - DNA, 22 bp, Homo sapiens
tagcataacaggtaagagtgag

SEQ ID NO: 9459276 - DNA, 22 bp, Homo sapiens
tagcagtgtctaggtaggccat

SEQ ID NO: 9459277 - DNA, 22 bp, Homo sapiens
tagcagcaggggaaacagctgt

SEQ ID NO: 9459278 - DNA, 18 bp, Homo sapiens
tagcagcactggccgctt

SEQ ID NO: 9459279 - DNA, 22 bp, Homo sapiens
tagcagcacctacacgtcagag

SEQ ID NO: 9459280 - DNA, 22 bp, Homo sapiens
tagcagcactatttgttgtagt

SEQ ID NO: 9459281 - DNA, 22 bp, Homo sapiens
tagcagcactatttgttgtagt

SEQ ID NO: 9459282 - DNA, 22 bp, Homo sapiens
cagggcaggacagatacattac

SEQ ID NO: 9459283 - DNA, 22 bp, Homo sapiens
cagggcaggacagatacattac

SEQ ID NO: 9459284 - DNA, 22 bp, Homo sapiens
cagggcagtaccgccctctggc

SEQ ID NO: 9459285 - DNA, 22 bp, Homo sapiens
cagggcagtaccgccctctggc

SEQ ID NO: 9459286 - DNA, 22 bp, Homo sapiens
cagggcagtaccgccctctggc

SEQ ID NO: 9459287 - DNA, 22 bp, Homo sapiens
cagggcagtaccgccctctggc

SEQ ID NO: 9459288 - DNA, 22 bp, Homo sapiens
cagggcagtaccgccctctggc

SEQ ID NO: 9459289 - DNA, 22 bp, Homo sapiens
cagggcagtaccgccctctggc

SEQ ID NO: 9459290 - DNA, 22 bp, Homo sapiens
cagggcagtttgtgcctatgag

SEQ ID NO: 9459291 - DNA, 22 bp, Homo sapiens
cagggcagtgaagaacacacgt

SEQ ID NO: 9459292 - DNA, 22 bp, Homo sapiens
cagggcagtgaagaacacacgt

SEQ ID NO: 9459293 - DNA, 22 bp, Homo sapiens
cagggcagtgaagaacacacgt

SEQ ID NO: 9459294 - DNA, 22 bp, Homo sapiens
cagggcagtgaagaacacacgt

SEQ ID NO: 9459295 - DNA, 22 bp, Homo sapiens
cagggcagtgaagaacacacgt

SEQ ID NO: 9459296 - DNA, 22 bp, Homo sapiens
cagggcagtgaagaacacacgt

SEQ ID NO: 9459297 - DNA, 22 bp, Homo sapiens
cagggcagtaccgccctctggc

SEQ ID NO: 9459298 - DNA, 22 bp, Homo sapiens
cagggcagtttgtgcctatgag

SEQ ID NO: 9459299 - DNA, 22 bp, Homo sapiens
cagggcagtttgtgcctatgag

SEQ ID NO: 9459300 - DNA, 22 bp, Homo sapiens
cagggcagtttgtgcctatgag

SEQ ID NO: 9459301 - DNA, 22 bp, Homo sapiens
cagggcagtttgtgcctatgag

SEQ ID NO: 9459302 - DNA, 22 bp, Homo sapiens
cagggcagttttacttctctct

SEQ ID NO: 9459303 - DNA, 22 bp, Homo sapiens
cagggcagttttacttctctct

SEQ ID NO: 9459304 - DNA, 22 bp, Homo sapiens
cagggcagttttacttctctct

SEQ ID NO: 9459305 - DNA, 22 bp, Homo sapiens
cagggcagttttacttctctct

SEQ ID NO: 9459306 - DNA, 22 bp, Homo sapiens
cagggcagttttacttctctct

SEQ ID NO: 9459307 - DNA, 22 bp, Homo sapiens
cagggcataagatgaggctgta

SEQ ID NO: 9459308 - DNA, 22 bp, Homo sapiens
cagggcatgaggtgtgcttctc

SEQ ID NO: 9459309 - DNA, 22 bp, Homo sapiens
cagggcatctggagtcgggcgg

SEQ ID NO: 9459310 - DNA, 22 bp, Homo sapiens
cagggcatctggagtcgggcgg

SEQ ID NO: 9459311 - DNA, 22 bp, Homo sapiens
cagggcatccgtgctccatgct

SEQ ID NO: 9459312 - DNA, 22 bp, Homo sapiens
cagggcatccgtgctccatgct

SEQ ID NO: 9459313 - DNA, 22 bp, Homo sapiens
cagggcataagatgaggctgta

SEQ ID NO: 9459314 - DNA, 22 bp, Homo sapiens
cagggcataagatgaggctgta

SEQ ID NO: 9459315 - DNA, 22 bp, Homo sapiens
cagggcatgaggtgtgcttctc

SEQ ID NO: 9459316 - DNA, 22 bp, Homo sapiens
tagcacaaagagtctttcagag

SEQ ID NO: 9459317 - DNA, 22 bp, Homo sapiens
tagcagagtttggtacctgggg

SEQ ID NO: 9459318 - DNA, 22 bp, Homo sapiens
tagcagcaaaatgaccttctaa

SEQ ID NO: 9459319 - DNA, 22 bp, Homo sapiens
cagggatggcctggcgggccac

SEQ ID NO: 9459320 - DNA, 22 bp, Homo sapiens
tagcaatgtgttgacttggtca

SEQ ID NO: 9459321 - DNA, 22 bp, Homo sapiens
tagcaatgtgttgacttggtca

SEQ ID NO: 9459322 - DNA, 21 bp, Homo sapiens
tagcaattatagatgtctaaa

SEQ ID NO: 9459323 - DNA, 21 bp, Homo sapiens
tagcaattatagatgtctaaa

SEQ ID NO: 9459324 - DNA, 22 bp, Homo sapiens
tagcagcaattcaggtgtgatg

SEQ ID NO: 9459325 - DNA, 22 bp, Homo sapiens
tagcagcaattcaggtgtgatg

SEQ ID NO: 9459326 - DNA, 22 bp, Homo sapiens
tagcagcacagaaagcctggag

SEQ ID NO: 9459327 - DNA, 22 bp, Homo sapiens
tagcagcaatttcagaagtttg

SEQ ID NO: 9459328 - DNA, 22 bp, Homo sapiens
cagggatgagagatggcacaga

SEQ ID NO: 9459329 - DNA, 22 bp, Homo sapiens
cagggatgagagatggcacaga

SEQ ID NO: 9459330 - DNA, 22 bp, Homo sapiens
cagggatgagagatggcacaga

SEQ ID NO: 9459331 - DNA, 22 bp, Homo sapiens
cagggatgagagatggcacaga

SEQ ID NO: 9459332 - DNA, 22 bp, Homo sapiens
cagggatgagcagatggagcaa

SEQ ID NO: 9459333 - DNA, 22 bp, Homo sapiens
cagggatgagcagatggagcaa

SEQ ID NO: 9459334 - DNA, 22 bp, Homo sapiens
cagggatgagcagatggagcaa

SEQ ID NO: 9459335 - DNA, 22 bp, Homo sapiens
cagggatgagcagatggagcaa

SEQ ID NO: 9459336 - DNA, 22 bp, Homo sapiens
cagggatggcctggcgggccac

SEQ ID NO: 9459337 - DNA, 22 bp, Homo sapiens
cagggatggcctggcgggccac

SEQ ID NO: 9459338 - DNA, 22 bp, Homo sapiens
cagggatggagagactactggc

SEQ ID NO: 9459339 - DNA, 22 bp, Homo sapiens
cagggatgctgcttaggcagtt

SEQ ID NO: 9459340 - DNA, 22 bp, Homo sapiens
cagggatgagcagatggagcaa

SEQ ID NO: 9459341 - DNA, 22 bp, Homo sapiens
cagggatgctgcttaggcagtt

SEQ ID NO: 9459342 - DNA, 22 bp, Homo sapiens
cagggatgctgcttaggcagtt

SEQ ID NO: 9459343 - DNA, 22 bp, Homo sapiens
cagggatgctgcttaggcagtt

SEQ ID NO: 9459344 - DNA, 22 bp, Homo sapiens
cagggatgctgcttaggcagtt

SEQ ID NO: 9459345 - DNA, 22 bp, Homo sapiens
cagggagctttcccaggaccct

SEQ ID NO: 9459346 - DNA, 22 bp, Homo sapiens
cagggagctttcccaggaccct

SEQ ID NO: 9459347 - DNA, 22 bp, Homo sapiens
cagggagctttgtcttctcatt

SEQ ID NO: 9459348 - DNA, 22 bp, Homo sapiens
tagacatttgtcaagaatgact

SEQ ID NO: 9459349 - DNA, 22 bp, Homo sapiens
tagacatttgtcaagaatgact

SEQ ID NO: 9459350 - DNA, 22 bp, Homo sapiens
cagggagcctgaatgttccagg

SEQ ID NO: 9459351 - DNA, 22 bp, Homo sapiens
cagggaggctgtcttatgcctg

SEQ ID NO: 9459352 - DNA, 22 bp, Homo sapiens
cagggaggctgtcttatgcctg

SEQ ID NO: 9459353 - DNA, 22 bp, Homo sapiens
cagggaggctgtcttatgcctg

SEQ ID NO: 9459354 - DNA, 22 bp, Homo sapiens
cagggaggatgggctgttttgc

SEQ ID NO: 9459355 - DNA, 22 bp, Homo sapiens
cagggaggatgggctgttttgc

SEQ ID NO: 9459356 - DNA, 23 bp, Homo sapiens
cagggaggagatactgtgtatct

SEQ ID NO: 9459357 - DNA, 22 bp, Homo sapiens
cagggaggatgggctgttttgc

SEQ ID NO: 9459358 - DNA, 22 bp, Homo sapiens
cagggaggatgggctgttttgc

SEQ ID NO: 9459359 - DNA, 23 bp, Homo sapiens
cagggaggagatactgtgtatct

SEQ ID NO: 9459360 - DNA, 23 bp, Homo sapiens
cagggaggagatactgtgtatct

SEQ ID NO: 9459361 - DNA, 22 bp, Homo sapiens
cagggagtttttgttcctctag

SEQ ID NO: 9459362 - DNA, 22 bp, Homo sapiens
cagggatgagaaagctctctaa

SEQ ID NO: 9459363 - DNA, 22 bp, Homo sapiens
cagggatgaccagagggatgtg

SEQ ID NO: 9459364 - DNA, 22 bp, Homo sapiens
cagggatgaccagagggatgtg

SEQ ID NO: 9459365 - DNA, 22 bp, Homo sapiens
cagggatgaccagagggatgtg

SEQ ID NO: 9459366 - DNA, 22 bp, Homo sapiens
cagggagggacaattgtcacct

SEQ ID NO: 9459367 - DNA, 22 bp, Homo sapiens
cagggagggacaattgtcacct

SEQ ID NO: 9459368 - DNA, 22 bp, Homo sapiens
cagggaggctgtcttatgcctg

SEQ ID NO: 9459369 - DNA, 22 bp, Homo sapiens
cagggaggctgtcttatgcctg

SEQ ID NO: 9459370 - DNA, 22 bp, Homo sapiens
cagggagggacaattgtcacct

SEQ ID NO: 9459371 - DNA, 22 bp, Homo sapiens
cagggagggaggaaaatttgct

SEQ ID NO: 9459372 - DNA, 22 bp, Homo sapiens
cagggagggacaattgtcacct

SEQ ID NO: 9459373 - DNA, 22 bp, Homo sapiens
cagggagggaggaaaatttgct

SEQ ID NO: 9459374 - DNA, 22 bp, Homo sapiens
cagggagggaggaaaatttgct

SEQ ID NO: 9459375 - DNA, 22 bp, Homo sapiens
tggaaactataaaagcaccttc

SEQ ID NO: 9459376 - DNA, 22 bp, Homo sapiens
tggaaactaggatggaagaaat

SEQ ID NO: 9459377 - DNA, 22 bp, Homo sapiens
tggaaactcagggccagaagga

SEQ ID NO: 9459378 - DNA, 22 bp, Homo sapiens
tggaaactatcctcacaactag

SEQ ID NO: 9459379 - DNA, 22 bp, Homo sapiens
tggaaactatagtcacaataga

SEQ ID NO: 9459380 - DNA, 22 bp, Homo sapiens
tggaaactaagactagagagac

SEQ ID NO: 9459381 - DNA, 22 bp, Homo sapiens
tggaaactaacaacagagcaga

SEQ ID NO: 9459382 - DNA, 22 bp, Homo sapiens
tggaaactaacaacagagcaga

SEQ ID NO: 9459383 - DNA, 22 bp, Homo sapiens
tggaaactagagagtttgtatt

SEQ ID NO: 9459384 - DNA, 22 bp, Homo sapiens
tggaaactagccttttaggttg

SEQ ID NO: 9459385 - DNA, 22 bp, Homo sapiens
tggaaactagagtgtgggaagc

SEQ ID NO: 9459386 - DNA, 21 bp, Homo sapiens
tggaaacttctagcttacgta

SEQ ID NO: 9459387 - DNA, 22 bp, Homo sapiens
tggaaacttggaacgtcttcag

SEQ ID NO: 9459388 - DNA, 22 bp, Homo sapiens
tggaaacttaccgtttggggaa

SEQ ID NO: 9459389 - DNA, 22 bp, Homo sapiens
tggaaacttatctgacacgaac

SEQ ID NO: 9459390 - DNA, 23 bp, Homo sapiens
tggaaacttaagggggagatgtc

SEQ ID NO: 9459391 - DNA, 22 bp, Homo sapiens
tggaaactctacctctctaaga

SEQ ID NO: 9459392 - DNA, 19 bp, Homo sapiens
tggaaactcctgatattag

SEQ ID NO: 9459393 - DNA, 22 bp, Homo sapiens
tggaaactgcagttcccgggga

SEQ ID NO: 9459394 - DNA, 22 bp, Homo sapiens
tggaaactgggagttaaatgta

SEQ ID NO: 9459395 - DNA, 22 bp, Homo sapiens
tggaaactgtggtatttcttta

SEQ ID NO: 9459396 - DNA, 22 bp, Homo sapiens
ccctcctcaactctggcttcca

SEQ ID NO: 9459397 - DNA, 22 bp, Homo sapiens
ccctccctttgtctttatgaac

SEQ ID NO: 9459398 - DNA, 22 bp, Homo sapiens
ccctccctttgcagcagtgcat

SEQ ID NO: 9459399 - DNA, 23 bp, Homo sapiens
tggaaacattctgaatgtccatc

SEQ ID NO: 9459400 - DNA, 22 bp, Homo sapiens
ccctcctcaactctggcttcca

SEQ ID NO: 9459401 - DNA, 22 bp, Homo sapiens
ccctccctgtgtgcctcatttg

SEQ ID NO: 9459402 - DNA, 22 bp, Homo sapiens
ccctcccttccaagttgaggac

SEQ ID NO: 9459403 - DNA, 22 bp, Homo sapiens
ccctcccttccaagttgaggac

SEQ ID NO: 9459404 - DNA, 22 bp, Homo sapiens
ccctccctttgcagcagtgcat

SEQ ID NO: 9459405 - DNA, 22 bp, Homo sapiens
ccctccctgtgtgcctcatttg

SEQ ID NO: 9459406 - DNA, 22 bp, Homo sapiens
ccctccctgaagaagttactct

SEQ ID NO: 9459407 - DNA, 22 bp, Homo sapiens
ccctccctgaagaagttactct

SEQ ID NO: 9459408 - DNA, 22 bp, Homo sapiens
tggagactcagaaggggaagca

SEQ ID NO: 9459409 - DNA, 22 bp, Homo sapiens
tggagactctgcatctgtgaca

SEQ ID NO: 9459410 - DNA, 22 bp, Homo sapiens
tggagactgactgcctgtattt

SEQ ID NO: 9459411 - DNA, 22 bp, Homo sapiens
tggagactgtgctaagggagtt

SEQ ID NO: 9459412 - DNA, 22 bp, Homo sapiens
tggagactgataaaggctattg

SEQ ID NO: 9459413 - DNA, 19 bp, Homo sapiens
tggagactgagagtgagca

SEQ ID NO: 9459414 - DNA, 22 bp, Homo sapiens
tggagatgaatatgtgtacctg

SEQ ID NO: 9459415 - DNA, 22 bp, Homo sapiens
tggagatgaggacatggacgtc

SEQ ID NO: 9459416 - DNA, 22 bp, Homo sapiens
tggagatgaggacatggacgtc

SEQ ID NO: 9459417 - DNA, 22 bp, Homo sapiens
tggagagaaaaaagacagttct

SEQ ID NO: 9459418 - DNA, 22 bp, Homo sapiens
tggagagtttagcctactggaa

SEQ ID NO: 9459419 - DNA, 22 bp, Homo sapiens
tggagaattctatgttgagggg

SEQ ID NO: 9459420 - DNA, 22 bp, Homo sapiens
tggagaattctatgttgagggg

SEQ ID NO: 9459421 - DNA, 22 bp, Homo sapiens
tggagaatctggaaactgttga

SEQ ID NO: 9459422 - DNA, 22 bp, Homo sapiens
tggagaatctggaaactgttga

SEQ ID NO: 9459423 - DNA, 22 bp, Homo sapiens
tggaaagaaagtaaaggcgtat

SEQ ID NO: 9459424 - DNA, 18 bp, Homo sapiens
tggagacatagacaatgt

SEQ ID NO: 9459425 - DNA, 22 bp, Homo sapiens
tggagaattctatgttgagggg

SEQ ID NO: 9459426 - DNA, 22 bp, Homo sapiens
tggagaattctatgttgagggg

SEQ ID NO: 9459427 - DNA, 22 bp, Homo sapiens
tggagaattctatgttgagggg

SEQ ID NO: 9459428 - DNA, 20 bp, Homo sapiens
tggagacaattgcccttttt

SEQ ID NO: 9459429 - DNA, 23 bp, Homo sapiens
tggagaatttagagtctctagga

SEQ ID NO: 9459430 - DNA, 22 bp, Homo sapiens
tggaggcatcagagtgcttggc

SEQ ID NO: 9459431 - DNA, 22 bp, Homo sapiens
tggaggcatcagagtgcttggc

SEQ ID NO: 9459432 - DNA, 22 bp, Homo sapiens
tggaggcatgacagtgtctgga

SEQ ID NO: 9459433 - DNA, 22 bp, Homo sapiens
tggaggcataggcctgggccct

SEQ ID NO: 9459434 - DNA, 22 bp, Homo sapiens
tggaggcagtttaagtctgaga

SEQ ID NO: 9459435 - DNA, 22 bp, Homo sapiens
tggaggacgtgtccaccatgaa

SEQ ID NO: 9459436 - DNA, 22 bp, Homo sapiens
tggaggacaggactggacagcc

SEQ ID NO: 9459437 - DNA, 22 bp, Homo sapiens
tggaggcatttgatgttcataa

SEQ ID NO: 9459438 - DNA, 22 bp, Homo sapiens
tggaggcatttgatgttcataa

SEQ ID NO: 9459439 - DNA, 22 bp, Homo sapiens
tggaggcattgtgactgctgaa

SEQ ID NO: 9459440 - DNA, 22 bp, Homo sapiens
tggaggcattgtgactgctgaa

SEQ ID NO: 9459441 - DNA, 22 bp, Homo sapiens
tggaggcatgacagtgtctgga

SEQ ID NO: 9459442 - DNA, 22 bp, Homo sapiens
ccctggagggatttctcaatca

SEQ ID NO: 9459443 - DNA, 22 bp, Homo sapiens
ccctggagggacagctgctcta

SEQ ID NO: 9459444 - DNA, 22 bp, Homo sapiens
ccctggaggaccccaatgtggc

SEQ ID NO: 9459445 - DNA, 22 bp, Homo sapiens
ccctggaggaagaaacaatggc

SEQ ID NO: 9459446 - DNA, 22 bp, Homo sapiens
ccctggaggaagaaacaatggc

SEQ ID NO: 9459447 - DNA, 22 bp, Homo sapiens
tggaggaatcagggcttaggct

SEQ ID NO: 9459448 - DNA, 22 bp, Homo sapiens
tggaggacaggactggacagcc

SEQ ID NO: 9459449 - DNA, 18 bp, Homo sapiens
tggaggaatcacaatggc

SEQ ID NO: 9459450 - DNA, 22 bp, Homo sapiens
tggaggaataacagcaacctta

SEQ ID NO: 9459451 - DNA, 18 bp, Homo sapiens
tggaggaatcacaatggc

SEQ ID NO: 9459452 - DNA, 18 bp, Homo sapiens
tggaggaatcacaatggc

SEQ ID NO: 9459453 - DNA, 23 bp, Homo sapiens
tggaggaaacacatcagaagacc

SEQ ID NO: 9459454 - DNA, 23 bp, Homo sapiens
tggaggaaacacatcagaagacc

SEQ ID NO: 9459455 - DNA, 19 bp, Homo sapiens
tggaggaagtatatttcat

SEQ ID NO: 9459456 - DNA, 19 bp, Homo sapiens
tggaggaagtatatttcat

SEQ ID NO: 9459457 - DNA, 22 bp, Homo sapiens
tggaggaagtggacagttgtgt

SEQ ID NO: 9459458 - DNA, 22 bp, Homo sapiens
tggaggaagttgctggaagtca

SEQ ID NO: 9459459 - DNA, 22 bp, Homo sapiens
tggagatgggttaatggagaga

SEQ ID NO: 9459460 - DNA, 22 bp, Homo sapiens
tggagatgggaaaaaggaggta

SEQ ID NO: 9459461 - DNA, 22 bp, Homo sapiens
tggagatggcctcaggccctca

SEQ ID NO: 9459462 - DNA, 22 bp, Homo sapiens
tggagatggcctcaggccctca

SEQ ID NO: 9459463 - DNA, 22 bp, Homo sapiens
tggagatgcacgagcaggtgga

SEQ ID NO: 9459464 - DNA, 22 bp, Homo sapiens
tggagatgcacgagcaggtgga

SEQ ID NO: 9459465 - DNA, 22 bp, Homo sapiens
tggagatgcacgagcaggtgga

SEQ ID NO: 9459466 - DNA, 23 bp, Homo sapiens
tggagatgccccactccctgtct

SEQ ID NO: 9459467 - DNA, 22 bp, Homo sapiens
tggagatgcacgagcaggtgga

SEQ ID NO: 9459468 - DNA, 22 bp, Homo sapiens
tggagatgggttaatggagaga

SEQ ID NO: 9459469 - DNA, 18 bp, Homo sapiens
tggagctgagggcaatgc

SEQ ID NO: 9459470 - DNA, 18 bp, Homo sapiens
tggagctgagggcaatgc

SEQ ID NO: 9459471 - DNA, 22 bp, Homo sapiens
tggagatgtaaagcaaggctta

SEQ ID NO: 9459472 - DNA, 18 bp, Homo sapiens
tggagctgagggcaatgc

SEQ ID NO: 9459473 - DNA, 22 bp, Homo sapiens
tggaggaaaattactggggtct

SEQ ID NO: 9459474 - DNA, 22 bp, Homo sapiens
tggagctgaggggaatgctgag

SEQ ID NO: 9459475 - DNA, 22 bp, Homo sapiens
tggagctgaggggaatgctgag

SEQ ID NO: 9459476 - DNA, 23 bp, Homo sapiens
tggaggaaacacatcagaagacc

SEQ ID NO: 9459477 - DNA, 22 bp, Homo sapiens
tggaggaaaattactggggtct

SEQ ID NO: 9459478 - DNA, 22 bp, Homo sapiens
tggcagagaacacacatgattc

SEQ ID NO: 9459479 - DNA, 22 bp, Homo sapiens
ccctggctgctaccaggtagct

SEQ ID NO: 9459480 - DNA, 22 bp, Homo sapiens
ccctggctgctaccaggtagct

SEQ ID NO: 9459481 - DNA, 22 bp, Homo sapiens
ccctggctgctaccaggtagct

SEQ ID NO: 9459482 - DNA, 21 bp, Homo sapiens
tggcagacaggaggagctcac

SEQ ID NO: 9459483 - DNA, 22 bp, Homo sapiens
tggcagacactgtcgaagccta

SEQ ID NO: 9459484 - DNA, 22 bp, Homo sapiens
tggcagactttagggtctacat

SEQ ID NO: 9459485 - DNA, 22 bp, Homo sapiens
tggcagactttagggtctacat

SEQ ID NO: 9459486 - DNA, 22 bp, Homo sapiens
tggcagacctgaaggttcggcg

SEQ ID NO: 9459487 - DNA, 22 bp, Homo sapiens
tggcagacctgaaggttcggcg

SEQ ID NO: 9459488 - DNA, 22 bp, Homo sapiens
tggcagaatttctagcagattc

SEQ ID NO: 9459489 - DNA, 22 bp, Homo sapiens
tggcagaatgaagactggggcc

SEQ ID NO: 9459490 - DNA, 22 bp, Homo sapiens
tggcacagtgctggatggtgct

SEQ ID NO: 9459491 - DNA, 22 bp, Homo sapiens
tggcacagtgctggatggtgct

SEQ ID NO: 9459492 - DNA, 22 bp, Homo sapiens
ccctggagtgtgacgaggcatt

SEQ ID NO: 9459493 - DNA, 22 bp, Homo sapiens
ccctggagtgtgacgaggcatt

SEQ ID NO: 9459494 - DNA, 22 bp, Homo sapiens
ccctggagtgtgacgaggcatt

SEQ ID NO: 9459495 - DNA, 22 bp, Homo sapiens
tggcacttgtcacctgctttca

SEQ ID NO: 9459496 - DNA, 22 bp, Homo sapiens
tggcacttgggagtcgtggcga

SEQ ID NO: 9459497 - DNA, 22 bp, Homo sapiens
tggcactttacacccatttggc

SEQ ID NO: 9459498 - DNA, 22 bp, Homo sapiens
tggcagaagtacacaagcatgc

SEQ ID NO: 9459499 - DNA, 22 bp, Homo sapiens
tggcagaagtacacaagcatgc

SEQ ID NO: 9459500 - DNA, 22 bp, Homo sapiens
tggcagaagttcactagtagct

SEQ ID NO: 9459501 - DNA, 22 bp, Homo sapiens
tggcagaatgaagactggggcc

SEQ ID NO: 9459502 - DNA, 22 bp, Homo sapiens
ccctggaggttgaggctgcagt

SEQ ID NO: 9459503 - DNA, 23 bp, Homo sapiens
ccctggagtaaattcttggaagg

SEQ ID NO: 9459504 - DNA, 22 bp, Homo sapiens
ccctggagtccggagctcacct

SEQ ID NO: 9459505 - DNA, 22 bp, Homo sapiens
ccctggagtcctggcagttgat

SEQ ID NO: 9459506 - DNA, 22 bp, Homo sapiens
ccctggagtgccggaatcaaga

SEQ ID NO: 9459507 - DNA, 22 bp, Homo sapiens
ccctggagtccggagctcacct

SEQ ID NO: 9459508 - DNA, 22 bp, Homo sapiens
ccctggagtccggagctcacct

SEQ ID NO: 9459509 - DNA, 22 bp, Homo sapiens
ccctggaggtggaggttgcagg

SEQ ID NO: 9459510 - DNA, 22 bp, Homo sapiens
ccctggaggtggaggttgcagg

SEQ ID NO: 9459511 - DNA, 22 bp, Homo sapiens
ccctggaggtggaggttgcagg

SEQ ID NO: 9459512 - DNA, 22 bp, Homo sapiens
ccctggaggttgaggctgcagt

SEQ ID NO: 9459513 - DNA, 22 bp, Homo sapiens
ccctggaggttgaggctgcagt

SEQ ID NO: 9459514 - DNA, 22 bp, Homo sapiens
ccctggagggcagacagatgcc

SEQ ID NO: 9459515 - DNA, 22 bp, Homo sapiens
ccctggagggcagacagatgcc

SEQ ID NO: 9459516 - DNA, 22 bp, Homo sapiens
ccctggagggcagacagatgcc

SEQ ID NO: 9459517 - DNA, 22 bp, Homo sapiens
ccctggaggtcagaggcctggg

SEQ ID NO: 9459518 - DNA, 22 bp, Homo sapiens
cccttgggccccagctcagggc

SEQ ID NO: 9459519 - DNA, 22 bp, Homo sapiens
cccttggggatgctgtgtctgg

SEQ ID NO: 9459520 - DNA, 22 bp, Homo sapiens
cccttggggtggaggttgcagt

SEQ ID NO: 9459521 - DNA, 22 bp, Homo sapiens
cccttggggtggaggttgcagt

SEQ ID NO: 9459522 - DNA, 22 bp, Homo sapiens
cccttggctttagtttctaaag

SEQ ID NO: 9459523 - DNA, 22 bp, Homo sapiens
cccttgggccccagctcagggc

SEQ ID NO: 9459524 - DNA, 22 bp, Homo sapiens
cccttggaggaagctctaggct

SEQ ID NO: 9459525 - DNA, 22 bp, Homo sapiens
cccttggaaggtagctggcagt

SEQ ID NO: 9459526 - DNA, 22 bp, Homo sapiens
cccttggaaggtagctggcagt

SEQ ID NO: 9459527 - DNA, 22 bp, Homo sapiens
cccttggaaggtagctggcagt

SEQ ID NO: 9459528 - DNA, 22 bp, Homo sapiens
ccctttaattccaacacaggaa

SEQ ID NO: 9459529 - DNA, 22 bp, Homo sapiens
ccctttagcccctgcagagact

SEQ ID NO: 9459530 - DNA, 22 bp, Homo sapiens
ccctttaaagttttaccagcag

SEQ ID NO: 9459531 - DNA, 20 bp, Homo sapiens
ccctttaagctttagtatgc

SEQ ID NO: 9459532 - DNA, 22 bp, Homo sapiens
ccctttaagtagaatatattat

SEQ ID NO: 9459533 - DNA, 22 bp, Homo sapiens
ccctttaaggtctgattttcag

SEQ ID NO: 9459534 - DNA, 22 bp, Homo sapiens
tggcagggaatacagatgttta

SEQ ID NO: 9459535 - DNA, 22 bp, Homo sapiens
tggcagggaatacagatgttta

SEQ ID NO: 9459536 - DNA, 19 bp, Homo sapiens
tggcagggagagtttgaag

SEQ ID NO: 9459537 - DNA, 21 bp, Homo sapiens
cccttgcaaagtgctttccca

SEQ ID NO: 9459538 - DNA, 22 bp, Homo sapiens
cccttgcatcccatgtgtggcc

SEQ ID NO: 9459539 - DNA, 22 bp, Homo sapiens
cccttgcacatttgtctttaat

SEQ ID NO: 9459540 - DNA, 22 bp, Homo sapiens
tggcagggagccaccggtcatg

SEQ ID NO: 9459541 - DNA, 22 bp, Homo sapiens
cccttgaagactagaatgagga

SEQ ID NO: 9459542 - DNA, 22 bp, Homo sapiens
ccctggcttggcactctccact

SEQ ID NO: 9459543 - DNA, 22 bp, Homo sapiens
ccctggctggaaattaagtagt

SEQ ID NO: 9459544 - DNA, 22 bp, Homo sapiens
ccctgggaagtattccagctat

SEQ ID NO: 9459545 - DNA, 22 bp, Homo sapiens
ccctggcttggcactctccact

SEQ ID NO: 9459546 - DNA, 22 bp, Homo sapiens
ccctgggagaagttgagggctg

SEQ ID NO: 9459547 - DNA, 22 bp, Homo sapiens
ccctgggacccgctgcagaggc

SEQ ID NO: 9459548 - DNA, 22 bp, Homo sapiens
ccctgggacccgctgcagaggc

SEQ ID NO: 9459549 - DNA, 22 bp, Homo sapiens
ccctgggacccgctgcagaggc

SEQ ID NO: 9459550 - DNA, 22 bp, Homo sapiens
ccctgggagaagttgagggctg

SEQ ID NO: 9459551 - DNA, 22 bp, Homo sapiens
ccctgggagaagttgagggctg

SEQ ID NO: 9459552 - DNA, 22 bp, Homo sapiens
ccctgggagctgcctggctgac

SEQ ID NO: 9459553 - DNA, 22 bp, Homo sapiens
tggcaggcggaggttgcagtga

SEQ ID NO: 9459554 - DNA, 22 bp, Homo sapiens
tggcaggcggaggttgcagtga

SEQ ID NO: 9459555 - DNA, 19 bp, Homo sapiens
tggcaggcccaggatggac

SEQ ID NO: 9459556 - DNA, 22 bp, Homo sapiens
tggcaggctgagttggcctggt

SEQ ID NO: 9459557 - DNA, 22 bp, Homo sapiens
tggcaggctgagttggcctggt

SEQ ID NO: 9459558 - DNA, 22 bp, Homo sapiens
tggcaggctgagttggcctggt

SEQ ID NO: 9459559 - DNA, 19 bp, Homo sapiens
tggcaggcccaggatggac

SEQ ID NO: 9459560 - DNA, 22 bp, Homo sapiens
tggcaggcattgatgcgagttc

SEQ ID NO: 9459561 - DNA, 22 bp, Homo sapiens
tggcaggaaaaacattggagat

SEQ ID NO: 9459562 - DNA, 22 bp, Homo sapiens
tggcaggaaaaacattggagat

SEQ ID NO: 9459563 - DNA, 22 bp, Homo sapiens
ccctgggaggcttccaggcaga

SEQ ID NO: 9459564 - DNA, 22 bp, Homo sapiens
ccctgggaggcttccaggcaga

SEQ ID NO: 9459565 - DNA, 22 bp, Homo sapiens
tgctcaggagcttagagcacag

SEQ ID NO: 9459566 - DNA, 22 bp, Homo sapiens
tgctcaggacagtggaacctaa

SEQ ID NO: 9459567 - DNA, 22 bp, Homo sapiens
tgctcaggaaataatgtctgtg

SEQ ID NO: 9459568 - DNA, 22 bp, Homo sapiens
tgctcaggaggaggctgtgagg

SEQ ID NO: 9459569 - DNA, 22 bp, Homo sapiens
tgctcaggaggaggctgtgagg

SEQ ID NO: 9459570 - DNA, 22 bp, Homo sapiens
tgctcagggagcttcctggtgg

SEQ ID NO: 9459571 - DNA, 22 bp, Homo sapiens
tgctcagggacaatggagaggg

SEQ ID NO: 9459572 - DNA, 22 bp, Homo sapiens
tgctcaggccctgggccatcct

SEQ ID NO: 9459573 - DNA, 22 bp, Homo sapiens
tgctagccaagcccatcccttt

SEQ ID NO: 9459574 - DNA, 22 bp, Homo sapiens
tgctaggcagtgcttccctgac

SEQ ID NO: 9459575 - DNA, 22 bp, Homo sapiens
tgctaggcattgtctgggagta

SEQ ID NO: 9459576 - DNA, 22 bp, Homo sapiens
tgctaggcattgtctgggagta

SEQ ID NO: 9459577 - DNA, 22 bp, Homo sapiens
tgctagggaagaacgagggaat

SEQ ID NO: 9459578 - DNA, 22 bp, Homo sapiens
tgctaggtgctcctccctaatt

SEQ ID NO: 9459579 - DNA, 22 bp, Homo sapiens
tgctagggatgtagcagtgaag

SEQ ID NO: 9459580 - DNA, 17 bp, Homo sapiens
tgctagggggagagtag

SEQ ID NO: 9459581 - DNA, 22 bp, Homo sapiens
tgctagggatacagtggtgaat

SEQ ID NO: 9459582 - DNA, 22 bp, Homo sapiens
tgctagggatatagtggcgagt

SEQ ID NO: 9459583 - DNA, 22 bp, Homo sapiens
tgctagggatatagtggcgagt

SEQ ID NO: 9459584 - DNA, 22 bp, Homo sapiens
tgctagaaatctgaaactagca

SEQ ID NO: 9459585 - DNA, 22 bp, Homo sapiens
tgctactacttgtcaacggtca

SEQ ID NO: 9459586 - DNA, 19 bp, Homo sapiens
tgctaccgtgggatgctta

SEQ ID NO: 9459587 - DNA, 22 bp, Homo sapiens
tgctagaatttgcagaagcata

SEQ ID NO: 9459588 - DNA, 22 bp, Homo sapiens
tgctagaagatagctagaagat

SEQ ID NO: 9459589 - DNA, 22 bp, Homo sapiens
tgctagaattaggttaaacaaa

SEQ ID NO: 9459590 - DNA, 22 bp, Homo sapiens
tgctacagagccaggaagagtg

SEQ ID NO: 9459591 - DNA, 22 bp, Homo sapiens
tgctacacttaaatcagtcacc

SEQ ID NO: 9459592 - DNA, 22 bp, Homo sapiens
tgctacactcaatcagtgctat

SEQ ID NO: 9459593 - DNA, 22 bp, Homo sapiens
tgctaatgtttcatttttagat

SEQ ID NO: 9459594 - DNA, 22 bp, Homo sapiens
tgctacataccacgatgcagta

SEQ ID NO: 9459595 - DNA, 22 bp, Homo sapiens
tgctacatgcactgtgatctag

SEQ ID NO: 9459596 - DNA, 21 bp, Homo sapiens
tgctacattgctggttatgtt

SEQ ID NO: 9459597 - DNA, 22 bp, Homo sapiens
tgcaggtgctgtgtcaagagag

SEQ ID NO: 9459598 - DNA, 22 bp, Homo sapiens
tgcaggtgctgtgtcaagagag

SEQ ID NO: 9459599 - DNA, 22 bp, Homo sapiens
tgccttctcccttggaccctga

SEQ ID NO: 9459600 - DNA, 22 bp, Homo sapiens
tgccttctcttccctgggagct

SEQ ID NO: 9459601 - DNA, 22 bp, Homo sapiens
tgctaagctgaggaagatgaga

SEQ ID NO: 9459602 - DNA, 22 bp, Homo sapiens
tgccttcttctccctggctcag

SEQ ID NO: 9459603 - DNA, 22 bp, Homo sapiens
tgctaatgtcctgaccgttctg

SEQ ID NO: 9459604 - DNA, 22 bp, Homo sapiens
tgcaggtgccatcgctgctcat

SEQ ID NO: 9459605 - DNA, 22 bp, Homo sapiens
tgcagggctaagtcagagcctg

SEQ ID NO: 9459606 - DNA, 22 bp, Homo sapiens
tgcagggctaagtcagagcctg

SEQ ID NO: 9459607 - DNA, 22 bp, Homo sapiens
tgcaggtgcgttttcaagcctc

SEQ ID NO: 9459608 - DNA, 22 bp, Homo sapiens
tgcaggtgcgttttcaagcctc

SEQ ID NO: 9459609 - DNA, 22 bp, Homo sapiens
tgcaggtgctacaagaactcac

SEQ ID NO: 9459610 - DNA, 22 bp, Homo sapiens
tgcaggtgcgttttcaagcctc

SEQ ID NO: 9459611 - DNA, 22 bp, Homo sapiens
tgcaggtgctccgggggtgccc

SEQ ID NO: 9459612 - DNA, 22 bp, Homo sapiens
tgcaggtgctccgggggtgccc

SEQ ID NO: 9459613 - DNA, 22 bp, Homo sapiens
tgcaggtgctccgggggtgccc

SEQ ID NO: 9459614 - DNA, 22 bp, Homo sapiens
tgcaggtgctccgggggtgccc

SEQ ID NO: 9459615 - DNA, 22 bp, Homo sapiens
cccagtccaaaagtaggttcta

SEQ ID NO: 9459616 - DNA, 22 bp, Homo sapiens
cccaggtctcctgcttcccagg

SEQ ID NO: 9459617 - DNA, 22 bp, Homo sapiens
cccagtccagaccatgacctca

SEQ ID NO: 9459618 - DNA, 22 bp, Homo sapiens
cccagtccagaccatgacctca

SEQ ID NO: 9459619 - DNA, 22 bp, Homo sapiens
cccaggtctccctgcagccctg

SEQ ID NO: 9459620 - DNA, 22 bp, Homo sapiens
cccaggtctcctgcttcccagg

SEQ ID NO: 9459621 - DNA, 22 bp, Homo sapiens
cccaggtctgccagcctgtggg

SEQ ID NO: 9459622 - DNA, 22 bp, Homo sapiens
cccaggtctccttctttagctg

SEQ ID NO: 9459623 - DNA, 22 bp, Homo sapiens
tgctcaggtgccttggctgctg

SEQ ID NO: 9459624 - DNA, 22 bp, Homo sapiens
cccaggtctccctgcagccctg

SEQ ID NO: 9459625 - DNA, 22 bp, Homo sapiens
tgctcaggtcgttctgcccctt

SEQ ID NO: 9459626 - DNA, 22 bp, Homo sapiens
tgctcagggagcttcctggtgg

SEQ ID NO: 9459627 - DNA, 22 bp, Homo sapiens
cccagtccagaccatgacctca

SEQ ID NO: 9459628 - DNA, 22 bp, Homo sapiens
cccagtccagaccatgacctca

SEQ ID NO: 9459629 - DNA, 22 bp, Homo sapiens
cccagtcctaaagcagacgcca

SEQ ID NO: 9459630 - DNA, 22 bp, Homo sapiens
cccagtcctaaagcagacgcca

SEQ ID NO: 9459631 - DNA, 19 bp, Homo sapiens
cccagtccttgtcctgggc

SEQ ID NO: 9459632 - DNA, 19 bp, Homo sapiens
cccagtccttgtcctgggc

SEQ ID NO: 9459633 - DNA, 19 bp, Homo sapiens
cccagtccttgtcctgggc

SEQ ID NO: 9459634 - DNA, 19 bp, Homo sapiens
cccagtccttgtcctgggc

SEQ ID NO: 9459635 - DNA, 22 bp, Homo sapiens
cccagtgccaggcacaggcagc

SEQ ID NO: 9459636 - DNA, 22 bp, Homo sapiens
cccagtgccaggcacaggcagc

SEQ ID NO: 9459637 - DNA, 20 bp, Homo sapiens
cccagtgaagcatggaagag

SEQ ID NO: 9459638 - DNA, 19 bp, Homo sapiens
cccagtctaggtcctagga

SEQ ID NO: 9459639 - DNA, 22 bp, Homo sapiens
tgctctgaaggggaagggatgg

SEQ ID NO: 9459640 - DNA, 22 bp, Homo sapiens
tgctctgaaggggaagggatgg

SEQ ID NO: 9459641 - DNA, 19 bp, Homo sapiens
tgctctctggtgcttcatg

SEQ ID NO: 9459642 - DNA, 22 bp, Homo sapiens
tgctctgaactgaacttagggt

SEQ ID NO: 9459643 - DNA, 19 bp, Homo sapiens
tgctctctggtgcttcatg

SEQ ID NO: 9459644 - DNA, 22 bp, Homo sapiens
tgctctgaggcacatgccatcg

SEQ ID NO: 9459645 - DNA, 22 bp, Homo sapiens
tgctctgaggcacatgccatcg

SEQ ID NO: 9459646 - DNA, 22 bp, Homo sapiens
tgctctgatggggtggacatag

SEQ ID NO: 9459647 - DNA, 22 bp, Homo sapiens
cccagtgctatgcctattacat

SEQ ID NO: 9459648 - DNA, 18 bp, Homo sapiens
cccagtgctcactgcctc

SEQ ID NO: 9459649 - DNA, 18 bp, Homo sapiens
cccagtgctcactgcctc

SEQ ID NO: 9459650 - DNA, 22 bp, Homo sapiens
cccagtggaaggagtagaagac

SEQ ID NO: 9459651 - DNA, 18 bp, Homo sapiens
cccagtgctcactgcctc

SEQ ID NO: 9459652 - DNA, 22 bp, Homo sapiens
cccagtggagataggagtgtgg

SEQ ID NO: 9459653 - DNA, 22 bp, Homo sapiens
cccagtggcaaagcagcttaga

SEQ ID NO: 9459654 - DNA, 22 bp, Homo sapiens
tgctctggacgctgagtggttt

SEQ ID NO: 9459655 - DNA, 19 bp, Homo sapiens
tgctctggagccagctctc

SEQ ID NO: 9459656 - DNA, 19 bp, Homo sapiens
tgctctggagccagctctc

SEQ ID NO: 9459657 - DNA, 22 bp, Homo sapiens
tgctctggacgctgagtggttt

SEQ ID NO: 9459658 - DNA, 22 bp, Homo sapiens
tgctctggagggtgaagctttt

SEQ ID NO: 9459659 - DNA, 22 bp, Homo sapiens
tgctctggagggtgaagctttt

SEQ ID NO: 9459660 - DNA, 22 bp, Homo sapiens
tgctctggagtggcttgtgcac

SEQ ID NO: 9459661 - DNA, 22 bp, Homo sapiens
tgctctggagtggcttgtgcac

SEQ ID NO: 9459662 - DNA, 19 bp, Homo sapiens
tgctgcaggatgctgctgg

SEQ ID NO: 9459663 - DNA, 22 bp, Homo sapiens
tgctgcaggcaatagaaaacct

SEQ ID NO: 9459664 - DNA, 19 bp, Homo sapiens
tgctgcaggatgctgctgg

SEQ ID NO: 9459665 - DNA, 22 bp, Homo sapiens
tgctctggaaataaatgattta

SEQ ID NO: 9459666 - DNA, 20 bp, Homo sapiens
tgctctggaaatggtctgag

SEQ ID NO: 9459667 - DNA, 20 bp, Homo sapiens
tgctctggaaatggtctgag

SEQ ID NO: 9459668 - DNA, 22 bp, Homo sapiens
tgctctggaccatgactatgtg

SEQ ID NO: 9459669 - DNA, 22 bp, Homo sapiens
tgctctggaccatgactatgtg

SEQ ID NO: 9459670 - DNA, 22 bp, Homo sapiens
tgctctggaatagtcctaggca

SEQ ID NO: 9459671 - DNA, 22 bp, Homo sapiens
tgctgcctctgctgatatggcc

SEQ ID NO: 9459672 - DNA, 22 bp, Homo sapiens
tgctgcctgctacgagggaaga

SEQ ID NO: 9459673 - DNA, 22 bp, Homo sapiens
tgctgcctgctacgagggaaga

SEQ ID NO: 9459674 - DNA, 22 bp, Homo sapiens
tgctgcctgtgccaggagggtc

SEQ ID NO: 9459675 - DNA, 22 bp, Homo sapiens
tgctgcctgttgtggggccacg

SEQ ID NO: 9459676 - DNA, 22 bp, Homo sapiens
tgctgccttctaggcgtgccct

SEQ ID NO: 9459677 - DNA, 22 bp, Homo sapiens
tgctgccttagcagccaggcaa

SEQ ID NO: 9459678 - DNA, 22 bp, Homo sapiens
tgctgcctttctgaatggtgga

SEQ ID NO: 9459679 - DNA, 22 bp, Homo sapiens
tgctgcctttgcttagcgaata

SEQ ID NO: 9459680 - DNA, 22 bp, Homo sapiens
tgctgccttgacctcctgggct

SEQ ID NO: 9459681 - DNA, 22 bp, Homo sapiens
tgcttaaaaacagtatggtagt

SEQ ID NO: 9459682 - DNA, 22 bp, Homo sapiens
tgctgtttcattttcctcatcc

SEQ ID NO: 9459683 - DNA, 22 bp, Homo sapiens
tgctgtttcattttcctcatcc

SEQ ID NO: 9459684 - DNA, 22 bp, Homo sapiens
ccccaggcagggcctaacagag

SEQ ID NO: 9459685 - DNA, 22 bp, Homo sapiens
ccccaggagatttgggagcaca

SEQ ID NO: 9459686 - DNA, 22 bp, Homo sapiens
ccccaggagatttgggagcaca

SEQ ID NO: 9459687 - DNA, 22 bp, Homo sapiens
ccccaggagaaatcttaaacta

SEQ ID NO: 9459688 - DNA, 22 bp, Homo sapiens
ccccaggacgtggccctcatag

SEQ ID NO: 9459689 - DNA, 22 bp, Homo sapiens
tgcttcctatccacacaatgcc

SEQ ID NO: 9459690 - DNA, 22 bp, Homo sapiens
tgcttcctatccacacaatgcc

SEQ ID NO: 9459691 - DNA, 22 bp, Homo sapiens
tgcttccgctaaaaattaatcc

SEQ ID NO: 9459692 - DNA, 22 bp, Homo sapiens
tgcttcctgctaaggctgcctg

SEQ ID NO: 9459693 - DNA, 22 bp, Homo sapiens
tgcttcctgctaaggctgcctg

SEQ ID NO: 9459694 - DNA, 20 bp, Homo sapiens
tgcttcctggccactgcggg

SEQ ID NO: 9459695 - DNA, 22 bp, Homo sapiens
tgcttccttgatcattcccaaa

SEQ ID NO: 9459696 - DNA, 22 bp, Homo sapiens
tgcttccttgagctctccaatc

SEQ ID NO: 9459697 - DNA, 22 bp, Homo sapiens
tgcttgtcaggataagctctgg

SEQ ID NO: 9459698 - DNA, 22 bp, Homo sapiens
tgcttgtcagtgtgctagaaac

SEQ ID NO: 9459699 - DNA, 20 bp, Homo sapiens
tgcttgtcatgcactcaggc

SEQ ID NO: 9459700 - DNA, 22 bp, Homo sapiens
ccctccagtgtcccagtgggga

SEQ ID NO: 9459701 - DNA, 22 bp, Homo sapiens
ccctccagtgtcccagtgggga

SEQ ID NO: 9459702 - DNA, 22 bp, Homo sapiens
ccctccagtgtcccagtgggga

SEQ ID NO: 9459703 - DNA, 22 bp, Homo sapiens
ccctccagtgtcccagtgggga

SEQ ID NO: 9459704 - DNA, 22 bp, Homo sapiens
ccctccccacaaagcttcacac

SEQ ID NO: 9459705 - DNA, 22 bp, Homo sapiens
ccctccccacaaagcttcacac

SEQ ID NO: 9459706 - DNA, 22 bp, Homo sapiens
ccctccccagggtcatattgaa

SEQ ID NO: 9459707 - DNA, 22 bp, Homo sapiens
ccctccccagggtcatattgaa

SEQ ID NO: 9459708 - DNA, 22 bp, Homo sapiens
ccctccccagggtcatattgaa

SEQ ID NO: 9459709 - DNA, 22 bp, Homo sapiens
ccctccccacaaagcttcacac

SEQ ID NO: 9459710 - DNA, 22 bp, Homo sapiens
ccctccccagggtcatattgaa

SEQ ID NO: 9459711 - DNA, 22 bp, Homo sapiens
ccctccctctgctgggtgtaga

SEQ ID NO: 9459712 - DNA, 22 bp, Homo sapiens
ccctccctatgtagatgatgtt

SEQ ID NO: 9459713 - DNA, 22 bp, Homo sapiens
tgcttgctgggccaatggcaat

SEQ ID NO: 9459714 - DNA, 22 bp, Homo sapiens
tgcttgctgggccaatggcaat

SEQ ID NO: 9459715 - DNA, 22 bp, Homo sapiens
tgcttggctagcttggcagctc

SEQ ID NO: 9459716 - DNA, 22 bp, Homo sapiens
tgcttggctagcttggcagctc

SEQ ID NO: 9459717 - DNA, 22 bp, Homo sapiens
tgcttggctagcttggcagctc

SEQ ID NO: 9459718 - DNA, 22 bp, Homo sapiens
tgcttgggcggccagcatggcg

SEQ ID NO: 9459719 - DNA, 22 bp, Homo sapiens
tgcttgggcggccagcatggcg

SEQ ID NO: 9459720 - DNA, 22 bp, Homo sapiens
tgcttgggcggccagcatggcg

SEQ ID NO: 9459721 - DNA, 22 bp, Homo sapiens
tgcttgggcggccagcatggcg

SEQ ID NO: 9459722 - DNA, 22 bp, Homo sapiens
tgcttgggaatgtggagtcaga

SEQ ID NO: 9459723 - DNA, 22 bp, Homo sapiens
tgcttgtcacatacaggagcat

SEQ ID NO: 9459724 - DNA, 22 bp, Homo sapiens
tgcttgtcacatacaggagcat

SEQ ID NO: 9459725 - DNA, 22 bp, Homo sapiens
tgcttgtcaccctgcctgagtg

SEQ ID NO: 9459726 - DNA, 21 bp, Homo sapiens
tgcttgggggcttcaggagct

SEQ ID NO: 9459727 - DNA, 21 bp, Homo sapiens
tgcttgggggcttcaggagct

SEQ ID NO: 9459728 - DNA, 22 bp, Homo sapiens
ccccagctcagtgcagggacat

SEQ ID NO: 9459729 - DNA, 22 bp, Homo sapiens
ccccagctgcatacttgccaag

SEQ ID NO: 9459730 - DNA, 22 bp, Homo sapiens
ccccagctgcatacttgccaag

SEQ ID NO: 9459731 - DNA, 18 bp, Homo sapiens
tgctggggtagaatccac

SEQ ID NO: 9459732 - DNA, 22 bp, Homo sapiens
tgctgggggttcagatgagtaa

SEQ ID NO: 9459733 - DNA, 22 bp, Homo sapiens
tgctgggggttcagatgagtaa

SEQ ID NO: 9459734 - DNA, 22 bp, Homo sapiens
tgctgggggtgtctcaccaggc

SEQ ID NO: 9459735 - DNA, 22 bp, Homo sapiens
tgctgggggttcagatgagtaa

SEQ ID NO: 9459736 - DNA, 22 bp, Homo sapiens
tgctgggggtagctctgcgtag

SEQ ID NO: 9459737 - DNA, 22 bp, Homo sapiens
tgctgggggctttctggatacc

SEQ ID NO: 9459738 - DNA, 22 bp, Homo sapiens
tgctgggggctttctggatacc

SEQ ID NO: 9459739 - DNA, 22 bp, Homo sapiens
tgctgggggctttctggatacc

SEQ ID NO: 9459740 - DNA, 22 bp, Homo sapiens
cccagtgtctgggcctgcaggg

SEQ ID NO: 9459741 - DNA, 22 bp, Homo sapiens
cccagttgttgccggctctgga

SEQ ID NO: 9459742 - DNA, 22 bp, Homo sapiens
tgctgggcaccagtgcctgcag

SEQ ID NO: 9459743 - DNA, 22 bp, Homo sapiens
tgctgctccatctgaccattcc

SEQ ID NO: 9459744 - DNA, 22 bp, Homo sapiens
cccagtggctgtccccatgggc

SEQ ID NO: 9459745 - DNA, 22 bp, Homo sapiens
tgctgctcaatgagatgccatc

SEQ ID NO: 9459746 - DNA, 22 bp, Homo sapiens
tgctgctcagaacccctgggct

SEQ ID NO: 9459747 - DNA, 22 bp, Homo sapiens
tgctgctcacacacagtgaatg

SEQ ID NO: 9459748 - DNA, 22 bp, Homo sapiens
tgctgctcaatgagatgccatc

SEQ ID NO: 9459749 - DNA, 22 bp, Homo sapiens
tgctgcctttgtggggtcactg

SEQ ID NO: 9459750 - DNA, 22 bp, Homo sapiens
tgctgctcaagctgcagcaaaa

SEQ ID NO: 9459751 - DNA, 22 bp, Homo sapiens
tgctgcgaggggaaataattta

SEQ ID NO: 9459752 - DNA, 22 bp, Homo sapiens
cccagtggtttgcagaaccaag

SEQ ID NO: 9459753 - DNA, 22 bp, Homo sapiens
cccagtgggtcactgcatctca

SEQ ID NO: 9459754 - DNA, 22 bp, Homo sapiens
cccagtggcttttgcccaggtt

SEQ ID NO: 9459755 - DNA, 22 bp, Homo sapiens
cctcctggcttttcccattgaa

SEQ ID NO: 9459756 - DNA, 22 bp, Homo sapiens
cctcctgggacaggctggcaca

SEQ ID NO: 9459757 - DNA, 22 bp, Homo sapiens
cctcctgggactcattagcacc

SEQ ID NO: 9459758 - DNA, 22 bp, Homo sapiens
cctcctgggactcattagcacc

SEQ ID NO: 9459759 - DNA, 22 bp, Homo sapiens
cctcctgggacaggctggcaca

SEQ ID NO: 9459760 - DNA, 22 bp, Homo sapiens
cctcctgggacaggctggcaca

SEQ ID NO: 9459761 - DNA, 22 bp, Homo sapiens
cctcctggcctgtgcagagccc

SEQ ID NO: 9459762 - DNA, 22 bp, Homo sapiens
cctcctggcctgtgcagagccc

SEQ ID NO: 9459763 - DNA, 22 bp, Homo sapiens
cctcctggcctgtgcagagccc

SEQ ID NO: 9459764 - DNA, 22 bp, Homo sapiens
cctcctctgtgcagctgtgggt

SEQ ID NO: 9459765 - DNA, 22 bp, Homo sapiens
cctcctctgtgcagctgtgggt

SEQ ID NO: 9459766 - DNA, 22 bp, Homo sapiens
cctcctggccctgggcctggaa

SEQ ID NO: 9459767 - DNA, 22 bp, Homo sapiens
cctcctgggccttgctctgtga

SEQ ID NO: 9459768 - DNA, 22 bp, Homo sapiens
cctcctgggccttgctctgtga

SEQ ID NO: 9459769 - DNA, 22 bp, Homo sapiens
cctcctgggccttgctctgtga

SEQ ID NO: 9459770 - DNA, 22 bp, Homo sapiens
cctcctgggctcctgtctgcac

SEQ ID NO: 9459771 - DNA, 22 bp, Homo sapiens
cctcctggggtgaaggatggga

SEQ ID NO: 9459772 - DNA, 22 bp, Homo sapiens
cctcctgggctcctgtctgcac

SEQ ID NO: 9459773 - DNA, 22 bp, Homo sapiens
cctcctgggctcctgtctgcac

SEQ ID NO: 9459774 - DNA, 22 bp, Homo sapiens
cctcctgggctcctgtctgcac

SEQ ID NO: 9459775 - DNA, 22 bp, Homo sapiens
cctcctgggagagcacggaggg

SEQ ID NO: 9459776 - DNA, 22 bp, Homo sapiens
cctcctgggagagcacggaggg

SEQ ID NO: 9459777 - DNA, 22 bp, Homo sapiens
cctcctgggagagcacggaggg

SEQ ID NO: 9459778 - DNA, 22 bp, Homo sapiens
cctcctgggagagcacggaggg

SEQ ID NO: 9459779 - DNA, 23 bp, Homo sapiens
cctcctgggcacaggcctgatgg

SEQ ID NO: 9459780 - DNA, 23 bp, Homo sapiens
cctcctgggcacaggcctgatgg

SEQ ID NO: 9459781 - DNA, 23 bp, Homo sapiens
cctcctgggcacaggcctgatgg

SEQ ID NO: 9459782 - DNA, 22 bp, Homo sapiens
cctcccacattgaggacatgct

SEQ ID NO: 9459783 - DNA, 22 bp, Homo sapiens
cctcccaccatttagagagagc

SEQ ID NO: 9459784 - DNA, 22 bp, Homo sapiens
cctcccacattgaggacatgct

SEQ ID NO: 9459785 - DNA, 22 bp, Homo sapiens
cctcccacattgaggacatgct

SEQ ID NO: 9459786 - DNA, 22 bp, Homo sapiens
cctcccaccatttagagagagc

SEQ ID NO: 9459787 - DNA, 22 bp, Homo sapiens
cctcccaccatttagagagagc

SEQ ID NO: 9459788 - DNA, 22 bp, Homo sapiens
cctcccaccgtatctcagtggc

SEQ ID NO: 9459789 - DNA, 23 bp, Homo sapiens
cctcccacctatttcactttctt

SEQ ID NO: 9459790 - DNA, 22 bp, Homo sapiens
cctcccaccgtatctcagtggc

SEQ ID NO: 9459791 - DNA, 23 bp, Homo sapiens
cctcccacctatttcactttctt

SEQ ID NO: 9459792 - DNA, 22 bp, Homo sapiens
cctcctctggtgctgccaaccc

SEQ ID NO: 9459793 - DNA, 22 bp, Homo sapiens
cctcccacttcttgctgaggtc

SEQ ID NO: 9459794 - DNA, 22 bp, Homo sapiens
cctcccacttcttgctgaggtc

SEQ ID NO: 9459795 - DNA, 22 bp, Homo sapiens
cctcccacttcttgctgaggtc

SEQ ID NO: 9459796 - DNA, 22 bp, Homo sapiens
cctcccacttcttgctgaggtc

SEQ ID NO: 9459797 - DNA, 22 bp, Homo sapiens
cctccatgtaaaggtcccctca

SEQ ID NO: 9459798 - DNA, 22 bp, Homo sapiens
cctccatgtaaaggtcccctca

SEQ ID NO: 9459799 - DNA, 17 bp, Homo sapiens
cctcccacaccgccctg

SEQ ID NO: 9459800 - DNA, 17 bp, Homo sapiens
cctcccacaccgccctg

SEQ ID NO: 9459801 - DNA, 17 bp, Homo sapiens
cctcccacaccgccctg

SEQ ID NO: 9459802 - DNA, 17 bp, Homo sapiens
cctcccacaccgccctg

SEQ ID NO: 9459803 - DNA, 17 bp, Homo sapiens
cctcccacaccgccctg

SEQ ID NO: 9459804 - DNA, 22 bp, Homo sapiens
cctcccacatcctagctctgct

SEQ ID NO: 9459805 - DNA, 22 bp, Homo sapiens
cctccagtcacctggatgagaa

SEQ ID NO: 9459806 - DNA, 22 bp, Homo sapiens
cctccagtactccagtccagcg

SEQ ID NO: 9459807 - DNA, 22 bp, Homo sapiens
cctccagtactccagtccagcg

SEQ ID NO: 9459808 - DNA, 22 bp, Homo sapiens
cctccagtactccagtccagcg

SEQ ID NO: 9459809 - DNA, 22 bp, Homo sapiens
cctccaggtgttacatatgact

SEQ ID NO: 9459810 - DNA, 21 bp, Homo sapiens
cctccaggtgattccgtgctc

SEQ ID NO: 9459811 - DNA, 22 bp, Homo sapiens
tggcatttctgttagactctca

SEQ ID NO: 9459812 - DNA, 22 bp, Homo sapiens
tggcagtgtgggaggaaggtac

SEQ ID NO: 9459813 - DNA, 19 bp, Homo sapiens
tggcagtgtggcttccaga

SEQ ID NO: 9459814 - DNA, 22 bp, Homo sapiens
tggcagtgtcttgctggggcag

SEQ ID NO: 9459815 - DNA, 22 bp, Homo sapiens
tggcagtgtcctactggttggt

SEQ ID NO: 9459816 - DNA, 22 bp, Homo sapiens
tggcagtgtataggtggctcct

SEQ ID NO: 9459817 - DNA, 22 bp, Homo sapiens
tggcagtgtataggtggctcct

SEQ ID NO: 9459818 - DNA, 22 bp, Homo sapiens
tggcagtgtataggtggctcct

SEQ ID NO: 9459819 - DNA, 22 bp, Homo sapiens
tggcagtggtgtctgcacaggc

SEQ ID NO: 9459820 - DNA, 22 bp, Homo sapiens
tggcagtgtcttgctggggcag

SEQ ID NO: 9459821 - DNA, 22 bp, Homo sapiens
tggcagtgggaagctggaagtc

SEQ ID NO: 9459822 - DNA, 22 bp, Homo sapiens
tggcagtggtaccggctctcag

SEQ ID NO: 9459823 - DNA, 22 bp, Homo sapiens
tggcagtggctcagagtgcaga

SEQ ID NO: 9459824 - DNA, 22 bp, Homo sapiens
tggcagtggctcagagtgcaga

SEQ ID NO: 9459825 - DNA, 22 bp, Homo sapiens
tggcagtggctttgctggtgga

SEQ ID NO: 9459826 - DNA, 22 bp, Homo sapiens
tggccaagccactgctgggtct

SEQ ID NO: 9459827 - DNA, 22 bp, Homo sapiens
tggccaagccactgctgggtct

SEQ ID NO: 9459828 - DNA, 22 bp, Homo sapiens
tggccaagatgcgacctctcag

SEQ ID NO: 9459829 - DNA, 21 bp, Homo sapiens
tggccaaactggagcatttga

SEQ ID NO: 9459830 - DNA, 22 bp, Homo sapiens
cctccaggctggttatcagctg

SEQ ID NO: 9459831 - DNA, 22 bp, Homo sapiens
cctccagctgcctcagtctctt

SEQ ID NO: 9459832 - DNA, 22 bp, Homo sapiens
cctccaggctggttatcagctg

SEQ ID NO: 9459833 - DNA, 22 bp, Homo sapiens
cctccaggctggttatcagctg

SEQ ID NO: 9459834 - DNA, 22 bp, Homo sapiens
cctccagcgcgatccactccgg

SEQ ID NO: 9459835 - DNA, 22 bp, Homo sapiens
cctccagcgcgatccactccgg

SEQ ID NO: 9459836 - DNA, 20 bp, Homo sapiens
tggccaagtatccaactgga

SEQ ID NO: 9459837 - DNA, 20 bp, Homo sapiens
tggccaagtatccaactgga

SEQ ID NO: 9459838 - DNA, 20 bp, Homo sapiens
tggccaagtatccaactgga

SEQ ID NO: 9459839 - DNA, 22 bp, Homo sapiens
cctccagggcccctctcactgg

SEQ ID NO: 9459840 - DNA, 22 bp, Homo sapiens
cctccagggcccctctcactgg

SEQ ID NO: 9459841 - DNA, 22 bp, Homo sapiens
cctccagggcagacggggagca

SEQ ID NO: 9459842 - DNA, 22 bp, Homo sapiens
cctccagggcagacggggagca

SEQ ID NO: 9459843 - DNA, 22 bp, Homo sapiens
tgggcagactaaggtcaaagct

SEQ ID NO: 9459844 - DNA, 22 bp, Homo sapiens
tgggcagactaaggtcaaagct

SEQ ID NO: 9459845 - DNA, 22 bp, Homo sapiens
tgggcagacgggagcttgcctt

SEQ ID NO: 9459846 - DNA, 22 bp, Homo sapiens
tgggcagacgggagcttgcctt

SEQ ID NO: 9459847 - DNA, 22 bp, Homo sapiens
tgggcagaattgtggtagttaa

SEQ ID NO: 9459848 - DNA, 22 bp, Homo sapiens
tgggcagacattgagtttgttc

SEQ ID NO: 9459849 - DNA, 22 bp, Homo sapiens
tgggcagacgctgttggaaggc

SEQ ID NO: 9459850 - DNA, 22 bp, Homo sapiens
tgggcagacgctgttggaaggc

SEQ ID NO: 9459851 - DNA, 22 bp, Homo sapiens
tgggcagacattgagtttgttc

SEQ ID NO: 9459852 - DNA, 22 bp, Homo sapiens
tgggcagaaggaagagccacct

SEQ ID NO: 9459853 - DNA, 22 bp, Homo sapiens
tgggcagaaatcagtatcagat

SEQ ID NO: 9459854 - DNA, 22 bp, Homo sapiens
tgggcagaaatcagtatcagat

SEQ ID NO: 9459855 - DNA, 22 bp, Homo sapiens
tgggcagaatgtgggatccaga

SEQ ID NO: 9459856 - DNA, 22 bp, Homo sapiens
tgggcagaaggaagagccacct

SEQ ID NO: 9459857 - DNA, 22 bp, Homo sapiens
tgggcagaaggaagagccacct

SEQ ID NO: 9459858 - DNA, 22 bp, Homo sapiens
tgggcagaattgtggtagttaa

SEQ ID NO: 9459859 - DNA, 22 bp, Homo sapiens
tgggcagaatgtgggatccaga

SEQ ID NO: 9459860 - DNA, 22 bp, Homo sapiens
tgggcagaatgtgggatccaga

SEQ ID NO: 9459861 - DNA, 22 bp, Homo sapiens
tgggagagcagagaaccctctt

SEQ ID NO: 9459862 - DNA, 22 bp, Homo sapiens
tgggagagcagagaaccctctt

SEQ ID NO: 9459863 - DNA, 22 bp, Homo sapiens
tgggataataaatagaggcaga

SEQ ID NO: 9459864 - DNA, 22 bp, Homo sapiens
tgggcactgtagctggtgctgg

SEQ ID NO: 9459865 - DNA, 22 bp, Homo sapiens
tgggacagattataagtctgca

SEQ ID NO: 9459866 - DNA, 22 bp, Homo sapiens
tgggacagattataagtctgca

SEQ ID NO: 9459867 - DNA, 22 bp, Homo sapiens
tgggacagattataagtctgca

SEQ ID NO: 9459868 - DNA, 22 bp, Homo sapiens
tgggacagattataagtctgca

SEQ ID NO: 9459869 - DNA, 22 bp, Homo sapiens
tgggacaggaggcctctggaga

SEQ ID NO: 9459870 - DNA, 22 bp, Homo sapiens
tgggacagattataagtctgca

SEQ ID NO: 9459871 - DNA, 22 bp, Homo sapiens
tgggacagattataagtctgca

SEQ ID NO: 9459872 - DNA, 22 bp, Homo sapiens
tgggacagagtgagctttggcc

SEQ ID NO: 9459873 - DNA, 22 bp, Homo sapiens
tgggacagagtgagctttggcc

SEQ ID NO: 9459874 - DNA, 22 bp, Homo sapiens
tgggacagagtgagctttggcc

SEQ ID NO: 9459875 - DNA, 22 bp, Homo sapiens
tgggacaggatgaccagaaggt

SEQ ID NO: 9459876 - DNA, 22 bp, Homo sapiens
tgggacaggatgaccagaaggt

SEQ ID NO: 9459877 - DNA, 22 bp, Homo sapiens
tgggacaggatgaccagaaggt

SEQ ID NO: 9459878 - DNA, 22 bp, Homo sapiens
tgggacaggatgaccagaaggt

SEQ ID NO: 9459879 - DNA, 22 bp, Homo sapiens
tgggacaggaggcctctggaga

SEQ ID NO: 9459880 - DNA, 22 bp, Homo sapiens
tgggacaggaggcctctggaga

SEQ ID NO: 9459881 - DNA, 22 bp, Homo sapiens
tgggacaggaggcctctggaga

SEQ ID NO: 9459882 - DNA, 22 bp, Homo sapiens
tgggagagcactgcagccccgg

SEQ ID NO: 9459883 - DNA, 22 bp, Homo sapiens
tgggacagggaatctgatcccc

SEQ ID NO: 9459884 - DNA, 22 bp, Homo sapiens
tgggacagggaatctgatcccc

SEQ ID NO: 9459885 - DNA, 22 bp, Homo sapiens
tgggagagaataatcaataggt

SEQ ID NO: 9459886 - DNA, 22 bp, Homo sapiens
tgggacagggaatctgatcccc

SEQ ID NO: 9459887 - DNA, 22 bp, Homo sapiens
tgggagagaattctggtgactg

SEQ ID NO: 9459888 - DNA, 22 bp, Homo sapiens
tgggagagaattctggtgactg

SEQ ID NO: 9459889 - DNA, 22 bp, Homo sapiens
cctcctggggtgaaggatggga

SEQ ID NO: 9459890 - DNA, 22 bp, Homo sapiens
cctcctggggtgaaggatggga

SEQ ID NO: 9459891 - DNA, 22 bp, Homo sapiens
cctcctggtaattagcgaaagg

SEQ ID NO: 9459892 - DNA, 22 bp, Homo sapiens
cctcctgggttcaagcgattct

SEQ ID NO: 9459893 - DNA, 22 bp, Homo sapiens
cctcctggtaattagcgaaagg

SEQ ID NO: 9459894 - DNA, 22 bp, Homo sapiens
cctcctgggttcaagcgattct

SEQ ID NO: 9459895 - DNA, 20 bp, Homo sapiens
cctcctggtcaggtgtgcag

SEQ ID NO: 9459896 - DNA, 20 bp, Homo sapiens
cctcctggtcaggtgtgcag

SEQ ID NO: 9459897 - DNA, 20 bp, Homo sapiens
cctcctggtcaggtgtgcag

SEQ ID NO: 9459898 - DNA, 22 bp, Homo sapiens
tggcttcttgtttggtttaaga

SEQ ID NO: 9459899 - DNA, 22 bp, Homo sapiens
tggcttcttgtctaatttgtta

SEQ ID NO: 9459900 - DNA, 22 bp, Homo sapiens
tggcttctttccactgtcctgt

SEQ ID NO: 9459901 - DNA, 22 bp, Homo sapiens
tggcttctttccactgtcctgt

SEQ ID NO: 9459902 - DNA, 22 bp, Homo sapiens
tggcttctttccactgtcctgt

SEQ ID NO: 9459903 - DNA, 22 bp, Homo sapiens
cctcctggtccagcatctcttt

SEQ ID NO: 9459904 - DNA, 22 bp, Homo sapiens
cctcctggtccagcatctcttt

SEQ ID NO: 9459905 - DNA, 22 bp, Homo sapiens
cctcctggtccagcatctcttt

SEQ ID NO: 9459906 - DNA, 22 bp, Homo sapiens
tggcttcccaggaaaggagaag

SEQ ID NO: 9459907 - DNA, 22 bp, Homo sapiens
tggcttgctactgaggtgtcag

SEQ ID NO: 9459908 - DNA, 22 bp, Homo sapiens
tggcttctttgtgacagctctt

SEQ ID NO: 9459909 - DNA, 22 bp, Homo sapiens
tggcttctttgtagaaattgaa

SEQ ID NO: 9459910 - DNA, 22 bp, Homo sapiens
tggcttctttctttccatgtgt

SEQ ID NO: 9459911 - DNA, 22 bp, Homo sapiens
tggcttctttccactgtcctgt

SEQ ID NO: 9459912 - DNA, 22 bp, Homo sapiens
tggcttggtaaggaccagcagg

SEQ ID NO: 9459913 - DNA, 22 bp, Homo sapiens
tggcttgtcatgtatctgaggc

SEQ ID NO: 9459914 - DNA, 22 bp, Homo sapiens
tgggaaggcagtcactgtccta

SEQ ID NO: 9459915 - DNA, 22 bp, Homo sapiens
cctctcccgggtgccgctgggc

SEQ ID NO: 9459916 - DNA, 22 bp, Homo sapiens
cctctcccgggtgccgctgggc

SEQ ID NO: 9459917 - DNA, 22 bp, Homo sapiens
cctctcccgggtgccgctgggc

SEQ ID NO: 9459918 - DNA, 22 bp, Homo sapiens
cctctcccgggtgccgctgggc

SEQ ID NO: 9459919 - DNA, 22 bp, Homo sapiens
tgggacacggaggccccagcac

SEQ ID NO: 9459920 - DNA, 22 bp, Homo sapiens
tgggacacctcagatagtgtct

SEQ ID NO: 9459921 - DNA, 22 bp, Homo sapiens
tgggaaggcgtggaagtagaag

SEQ ID NO: 9459922 - DNA, 22 bp, Homo sapiens
tgggaaggcgtggaagtagaag

SEQ ID NO: 9459923 - DNA, 22 bp, Homo sapiens
tgggaaggcagtcactgtccta

SEQ ID NO: 9459924 - DNA, 22 bp, Homo sapiens
cctctcccctcccaaggcggga

SEQ ID NO: 9459925 - DNA, 22 bp, Homo sapiens
cctctcccctcccaaggcggga

SEQ ID NO: 9459926 - DNA, 19 bp, Homo sapiens
cctctcccatgcttacctc

SEQ ID NO: 9459927 - DNA, 19 bp, Homo sapiens
cctctcccatgcttacctc

SEQ ID NO: 9459928 - DNA, 19 bp, Homo sapiens
cctctcccatgcttacctc

SEQ ID NO: 9459929 - DNA, 19 bp, Homo sapiens
cctctcccatgcttacctc

SEQ ID NO: 9459930 - DNA, 19 bp, Homo sapiens
cctctcccatgcttacctc

SEQ ID NO: 9459931 - DNA, 19 bp, Homo sapiens
cctctcccatgcttacctc

SEQ ID NO: 9459932 - DNA, 22 bp, Homo sapiens
cctctcccagggagagcctgag

SEQ ID NO: 9459933 - DNA, 22 bp, Homo sapiens
cctctcccagggagagcctgag

SEQ ID NO: 9459934 - DNA, 22 bp, Homo sapiens
cctctcccagggagagcctgag

SEQ ID NO: 9459935 - DNA, 22 bp, Homo sapiens
cctctcccagggagagcctgag

SEQ ID NO: 9459936 - DNA, 22 bp, Homo sapiens
tggctttacttaaactgaatca

SEQ ID NO: 9459937 - DNA, 22 bp, Homo sapiens
tggctttactgtcattcttatg

SEQ ID NO: 9459938 - DNA, 22 bp, Homo sapiens
cctctccagcggcctcagggcc

SEQ ID NO: 9459939 - DNA, 22 bp, Homo sapiens
cctctccagcggcctcagggcc

SEQ ID NO: 9459940 - DNA, 22 bp, Homo sapiens
cctctcccagggagagcctgag

SEQ ID NO: 9459941 - DNA, 22 bp, Homo sapiens
cctctcccaggcgcggcggcag

SEQ ID NO: 9459942 - DNA, 22 bp, Homo sapiens
cctctcccacgtggcagaggct

SEQ ID NO: 9459943 - DNA, 22 bp, Homo sapiens
cctctcccaggcgcggcggcag

SEQ ID NO: 9459944 - DNA, 22 bp, Homo sapiens
cctctcccacgtggcagaggct

SEQ ID NO: 9459945 - DNA, 22 bp, Homo sapiens
cctctcccacgtggcagaggct

SEQ ID NO: 9459946 - DNA, 22 bp, Homo sapiens
cctctcccacgtggcagaggct

SEQ ID NO: 9459947 - DNA, 22 bp, Homo sapiens
cctctcccacgtggcagaggct

SEQ ID NO: 9459948 - DNA, 22 bp, Homo sapiens
cctctccagttttaacgtgacc

SEQ ID NO: 9459949 - DNA, 22 bp, Homo sapiens
cctctccagttttaacgtgacc

SEQ ID NO: 9459950 - DNA, 22 bp, Homo sapiens
tgggctcatggcccagcactgg

SEQ ID NO: 9459951 - DNA, 22 bp, Homo sapiens
tgggctcatgtttctttgagga

SEQ ID NO: 9459952 - DNA, 22 bp, Homo sapiens
tgggctccagcacctgtgctct

SEQ ID NO: 9459953 - DNA, 19 bp, Homo sapiens
tgggctcattcaggtggtt

SEQ ID NO: 9459954 - DNA, 22 bp, Homo sapiens
tgggctccagcacctgtgctct

SEQ ID NO: 9459955 - DNA, 22 bp, Homo sapiens
tgggctccagcacctgtgctct

SEQ ID NO: 9459956 - DNA, 22 bp, Homo sapiens
tgggctccggcggcctcaggct

SEQ ID NO: 9459957 - DNA, 22 bp, Homo sapiens
tgggctccagcacctgtgctct

SEQ ID NO: 9459958 - DNA, 22 bp, Homo sapiens
tgggctccggcggcctcaggct

SEQ ID NO: 9459959 - DNA, 22 bp, Homo sapiens
tgggctccggcggcctcaggct

SEQ ID NO: 9459960 - DNA, 22 bp, Homo sapiens
tgggctccggcggcctcaggct

SEQ ID NO: 9459961 - DNA, 22 bp, Homo sapiens
tgggctccggcggcctcaggct

SEQ ID NO: 9459962 - DNA, 22 bp, Homo sapiens
tgggctccgttgcctggggcag

SEQ ID NO: 9459963 - DNA, 22 bp, Homo sapiens
tgggctcctcgtcactcgctgt

SEQ ID NO: 9459964 - DNA, 22 bp, Homo sapiens
tgggcctggccctgtggaggag

SEQ ID NO: 9459965 - DNA, 22 bp, Homo sapiens
tgggcctggccctgtggaggag

SEQ ID NO: 9459966 - DNA, 23 bp, Homo sapiens
tgggcctggcctcccagtccagc

SEQ ID NO: 9459967 - DNA, 23 bp, Homo sapiens
tgggcctggcctcccagtccagc

SEQ ID NO: 9459968 - DNA, 22 bp, Homo sapiens
tgggcctggagtttgtccagag

SEQ ID NO: 9459969 - DNA, 22 bp, Homo sapiens
tgggcctggccctgtggaggag

SEQ ID NO: 9459970 - DNA, 22 bp, Homo sapiens
tgggcctggccctgtggaggag

SEQ ID NO: 9459971 - DNA, 22 bp, Homo sapiens
tgggcctgggagggcagacgct

SEQ ID NO: 9459972 - DNA, 22 bp, Homo sapiens
tgggctcatgctggagatgaga

SEQ ID NO: 9459973 - DNA, 22 bp, Homo sapiens
tgggcctgggagggcagacgct

SEQ ID NO: 9459974 - DNA, 23 bp, Homo sapiens
tgggcctggcctcccagtccagc

SEQ ID NO: 9459975 - DNA, 22 bp, Homo sapiens
tgggcaggataatatctcatgt

SEQ ID NO: 9459976 - DNA, 22 bp, Homo sapiens
tgggcaggataatatctcatgt

SEQ ID NO: 9459977 - DNA, 22 bp, Homo sapiens
tgggcaggataatatctcatgt

SEQ ID NO: 9459978 - DNA, 22 bp, Homo sapiens
tgggcaggataatatctcatgt

SEQ ID NO: 9459979 - DNA, 22 bp, Homo sapiens
tgggcaggagagaagctaaaga

SEQ ID NO: 9459980 - DNA, 22 bp, Homo sapiens
tgggcaggagagaagctaaaga

SEQ ID NO: 9459981 - DNA, 22 bp, Homo sapiens
tgggcaggatgcgttgattctt

SEQ ID NO: 9459982 - DNA, 22 bp, Homo sapiens
tgggcaggcaagtgaatacctt

SEQ ID NO: 9459983 - DNA, 22 bp, Homo sapiens
tgggcaggatgcgttgattctt

SEQ ID NO: 9459984 - DNA, 22 bp, Homo sapiens
tgggcaggatgcgttgattctt

SEQ ID NO: 9459985 - DNA, 22 bp, Homo sapiens
tgggcaggcaagtgaatacctt

SEQ ID NO: 9459986 - DNA, 22 bp, Homo sapiens
tgggcaggcaagtgaatacctt

SEQ ID NO: 9459987 - DNA, 22 bp, Homo sapiens
tgggcaggcaagtgaatacctt

SEQ ID NO: 9459988 - DNA, 22 bp, Homo sapiens
tgggcaggcaagtgaatacctt

SEQ ID NO: 9459989 - DNA, 22 bp, Homo sapiens
tgggcaggcaagtgaatacctt

SEQ ID NO: 9459990 - DNA, 22 bp, Homo sapiens
tgggcctggagccctggagagt

SEQ ID NO: 9459991 - DNA, 22 bp, Homo sapiens
tgggcctggagccctggagagt

SEQ ID NO: 9459992 - DNA, 22 bp, Homo sapiens
tgggcctggagccctggagagt

SEQ ID NO: 9459993 - DNA, 22 bp, Homo sapiens
tgggcctggagtttgtccagag

SEQ ID NO: 9459994 - DNA, 22 bp, Homo sapiens
tgggcctggagtttgtccagag

SEQ ID NO: 9459995 - DNA, 22 bp, Homo sapiens
tgggcctggagtttgtccagag

SEQ ID NO: 9459996 - DNA, 21 bp, Homo sapiens
tgggcctcaagtgggtggcag

SEQ ID NO: 9459997 - DNA, 22 bp, Homo sapiens
tgggccgtggagcactctgaga

SEQ ID NO: 9459998 - DNA, 22 bp, Homo sapiens
tgggcctggacaaggccactag

SEQ ID NO: 9459999 - DNA, 22 bp, Homo sapiens
cctgaggtcatggtccagtgtt

SEQ ID NO: 9460000 - DNA, 21 bp, Homo sapiens
cctgagtgagacctggcccgt

SEQ ID NO: 9460001 - DNA, 22 bp, Homo sapiens
cctgagtgaattccctcactgt

SEQ ID NO: 9460002 - DNA, 22 bp, Homo sapiens
cctgagtgccatgagagcaccc

SEQ ID NO: 9460003 - DNA, 22 bp, Homo sapiens
cctgagtggccaggcagctgtg

SEQ ID NO: 9460004 - DNA, 17 bp, Homo sapiens
cctgagtgggagaggaa

SEQ ID NO: 9460005 - DNA, 22 bp, Homo sapiens
cctgagtggggagctaagtgag

SEQ ID NO: 9460006 - DNA, 22 bp, Homo sapiens
cctgagtggccaggcagctgtg

SEQ ID NO: 9460007 - DNA, 17 bp, Homo sapiens
cctgagtgggagaggaa

SEQ ID NO: 9460008 - DNA, 22 bp, Homo sapiens
cctgagtgtaataatgaaggca

SEQ ID NO: 9460009 - DNA, 22 bp, Homo sapiens
cctgagtgtaataatgaaggca

SEQ ID NO: 9460010 - DNA, 22 bp, Homo sapiens
cctgagtggtgctaagcagata

SEQ ID NO: 9460011 - DNA, 22 bp, Homo sapiens
cctgagtggtgctaagcagata

SEQ ID NO: 9460012 - DNA, 22 bp, Homo sapiens
tggggagagaccggaatgtttc

SEQ ID NO: 9460013 - DNA, 22 bp, Homo sapiens
tggggagagaccggaatgtttc

SEQ ID NO: 9460014 - DNA, 22 bp, Homo sapiens
tggggagactggccgagatcct

SEQ ID NO: 9460015 - DNA, 22 bp, Homo sapiens
tggggagaagcaatagactcta

SEQ ID NO: 9460016 - DNA, 22 bp, Homo sapiens
tggggagaagcaatagactcta

SEQ ID NO: 9460017 - DNA, 22 bp, Homo sapiens
cctgatggagccctgctgcatg

SEQ ID NO: 9460018 - DNA, 22 bp, Homo sapiens
tggggagaagcaatagactcta

SEQ ID NO: 9460019 - DNA, 22 bp, Homo sapiens
tggggacttgccttgttgctca

SEQ ID NO: 9460020 - DNA, 22 bp, Homo sapiens
cctgagttcttatttccagtca

SEQ ID NO: 9460021 - DNA, 19 bp, Homo sapiens
cctgagttgggtgaagaga

SEQ ID NO: 9460022 - DNA, 22 bp, Homo sapiens
cctgagttgtcagttgctgtag

SEQ ID NO: 9460023 - DNA, 19 bp, Homo sapiens
cctgagtgtttcagagaca

SEQ ID NO: 9460024 - DNA, 19 bp, Homo sapiens
cctgagtgtttcagagaca

SEQ ID NO: 9460025 - DNA, 22 bp, Homo sapiens
cctgagttagttgctgtgtctc

SEQ ID NO: 9460026 - DNA, 22 bp, Homo sapiens
cctgagttagttgctgtgtctc

SEQ ID NO: 9460027 - DNA, 22 bp, Homo sapiens
cctgataacacagatacaagat

SEQ ID NO: 9460028 - DNA, 22 bp, Homo sapiens
cctgatcaaagaggtcagcatt

SEQ ID NO: 9460029 - DNA, 22 bp, Homo sapiens
tggggagaggtatcattgagat

SEQ ID NO: 9460030 - DNA, 22 bp, Homo sapiens
tggggagaggtatcattgagat

SEQ ID NO: 9460031 - DNA, 22 bp, Homo sapiens
tggggagaggaatttgaatgat

SEQ ID NO: 9460032 - DNA, 22 bp, Homo sapiens
tggggagagattgaggagtttt

SEQ ID NO: 9460033 - DNA, 22 bp, Homo sapiens
tggggagagattgaggagtttt

SEQ ID NO: 9460034 - DNA, 22 bp, Homo sapiens
tggggagagattgaggagtttt

SEQ ID NO: 9460035 - DNA, 23 bp, Homo sapiens
tggggagagttaccctggaagcg

SEQ ID NO: 9460036 - DNA, 22 bp, Homo sapiens
tggggagagttacaaggaatct

SEQ ID NO: 9460037 - DNA, 22 bp, Homo sapiens
tggggagcacggtagggaaatg

SEQ ID NO: 9460038 - DNA, 22 bp, Homo sapiens
tggggagcacggtagggaaatg

SEQ ID NO: 9460039 - DNA, 22 bp, Homo sapiens
tggggagcacggtagggaaatg

SEQ ID NO: 9460040 - DNA, 22 bp, Homo sapiens
cctgcagacacttgtccagcaa

SEQ ID NO: 9460041 - DNA, 23 bp, Homo sapiens
cctgcagctgctggggctccacc

SEQ ID NO: 9460042 - DNA, 23 bp, Homo sapiens
cctgcagctgctggggctccacc

SEQ ID NO: 9460043 - DNA, 22 bp, Homo sapiens
cctgcagaccacactcagtcct

SEQ ID NO: 9460044 - DNA, 22 bp, Homo sapiens
cctgcagaccacactcagtcct

SEQ ID NO: 9460045 - DNA, 22 bp, Homo sapiens
cctgcagctgtaggagaaggcg

SEQ ID NO: 9460046 - DNA, 22 bp, Homo sapiens
cctgcagctgtaggagaaggcg

SEQ ID NO: 9460047 - DNA, 22 bp, Homo sapiens
cctgcaggctgcaggccagttc

SEQ ID NO: 9460048 - DNA, 22 bp, Homo sapiens
cctgcagctttgcctcctgaac

SEQ ID NO: 9460049 - DNA, 22 bp, Homo sapiens
cctgcagctttgcctcctgaac

SEQ ID NO: 9460050 - DNA, 22 bp, Homo sapiens
cctgcagctttgcctcctgaac

SEQ ID NO: 9460051 - DNA, 22 bp, Homo sapiens
cctgcaggctgcaggccagttc

SEQ ID NO: 9460052 - DNA, 22 bp, Homo sapiens
cctgcaggctgcaggccagttc

SEQ ID NO: 9460053 - DNA, 22 bp, Homo sapiens
cctgcagggaatcgaggcagaa

SEQ ID NO: 9460054 - DNA, 22 bp, Homo sapiens
cctgcagggaatcgaggcagaa

SEQ ID NO: 9460055 - DNA, 22 bp, Homo sapiens
tgggtcagtttgggggccagcc

SEQ ID NO: 9460056 - DNA, 22 bp, Homo sapiens
cctgcatgtggtcagcactcct

SEQ ID NO: 9460057 - DNA, 22 bp, Homo sapiens
cctgcattaaatcctgttctgc

SEQ ID NO: 9460058 - DNA, 22 bp, Homo sapiens
cctgccactgtaggtgacagtt

SEQ ID NO: 9460059 - DNA, 22 bp, Homo sapiens
cctgcatttttcccactctgtc

SEQ ID NO: 9460060 - DNA, 22 bp, Homo sapiens
cctgcattgctcttctgttcct

SEQ ID NO: 9460061 - DNA, 22 bp, Homo sapiens
cctgcaggtccccggatgcgca

SEQ ID NO: 9460062 - DNA, 22 bp, Homo sapiens
cctgcaggttgcagaggcggaa

SEQ ID NO: 9460063 - DNA, 22 bp, Homo sapiens
cctgcaggttgcagaggcggaa

SEQ ID NO: 9460064 - DNA, 19 bp, Homo sapiens
cctgcagggatgagaggtt

SEQ ID NO: 9460065 - DNA, 19 bp, Homo sapiens
cctgcagggatgagaggtt

SEQ ID NO: 9460066 - DNA, 22 bp, Homo sapiens
cctgcagggtgctgccacagat

SEQ ID NO: 9460067 - DNA, 22 bp, Homo sapiens
tgggtggcagcttcagcatgtt

SEQ ID NO: 9460068 - DNA, 22 bp, Homo sapiens
tgggtggcagcttcagcatgtt

SEQ ID NO: 9460069 - DNA, 22 bp, Homo sapiens
tgggtggcacttctggggtcca

SEQ ID NO: 9460070 - DNA, 22 bp, Homo sapiens
tgggtggcacttctggggtcca

SEQ ID NO: 9460071 - DNA, 22 bp, Homo sapiens
tgggtggcacttctggggtcca

SEQ ID NO: 9460072 - DNA, 18 bp, Homo sapiens
tgggtggctagggagttt

SEQ ID NO: 9460073 - DNA, 18 bp, Homo sapiens
tgggtggctagggagttt

SEQ ID NO: 9460074 - DNA, 18 bp, Homo sapiens
tgggtggctagggagttt

SEQ ID NO: 9460075 - DNA, 22 bp, Homo sapiens
tgggtggagctccacaacctgt

SEQ ID NO: 9460076 - DNA, 22 bp, Homo sapiens
tgggtggcaaaggcccattgtc

SEQ ID NO: 9460077 - DNA, 22 bp, Homo sapiens
tgggtggcacttctggggtcca

SEQ ID NO: 9460078 - DNA, 22 bp, Homo sapiens
tgggtggagaagtggacctgct

SEQ ID NO: 9460079 - DNA, 22 bp, Homo sapiens
tgggtggaataaatcagttctg

SEQ ID NO: 9460080 - DNA, 22 bp, Homo sapiens
tgggtccacaaacatcagatat

SEQ ID NO: 9460081 - DNA, 22 bp, Homo sapiens
tggtaattatggatacttaaat

SEQ ID NO: 9460082 - DNA, 22 bp, Homo sapiens
tggtaatttcatgcatctaaat

SEQ ID NO: 9460083 - DNA, 18 bp, Homo sapiens
tgggtggctagggagttt

SEQ ID NO: 9460084 - DNA, 18 bp, Homo sapiens
tgggtggctagggagttt

SEQ ID NO: 9460085 - DNA, 22 bp, Homo sapiens
tgggtgggagcaccctgtctgg

SEQ ID NO: 9460086 - DNA, 22 bp, Homo sapiens
tgggtgggagcaccctgtctgg

SEQ ID NO: 9460087 - DNA, 22 bp, Homo sapiens
tgggtgggagcaccctgtctgg

SEQ ID NO: 9460088 - DNA, 22 bp, Homo sapiens
tgggtgggagcaccctgtctgg

SEQ ID NO: 9460089 - DNA, 22 bp, Homo sapiens
tgggtgggagcaccctgtctgg

SEQ ID NO: 9460090 - DNA, 23 bp, Homo sapiens
tggtaatagggagcagaaggtag

SEQ ID NO: 9460091 - DNA, 22 bp, Homo sapiens
cctgccctgtcactggctaggg

SEQ ID NO: 9460092 - DNA, 22 bp, Homo sapiens
cctgccctgtcactggctaggg

SEQ ID NO: 9460093 - DNA, 22 bp, Homo sapiens
cctgccctgtcactggctaggg

SEQ ID NO: 9460094 - DNA, 22 bp, Homo sapiens
tggtagcaacatctcagtggct

SEQ ID NO: 9460095 - DNA, 22 bp, Homo sapiens
tggtagcaacatctcagtggct

SEQ ID NO: 9460096 - DNA, 22 bp, Homo sapiens
cctgcccagcttcacctcaggc

SEQ ID NO: 9460097 - DNA, 22 bp, Homo sapiens
cctgcccagagcccctttcact

SEQ ID NO: 9460098 - DNA, 22 bp, Homo sapiens
tggtaccatttcccaggagtgt

SEQ ID NO: 9460099 - DNA, 22 bp, Homo sapiens
tggtacacatgtccaaggtcag

SEQ ID NO: 9460100 - DNA, 22 bp, Homo sapiens
tggtacacatgtccaaggtcag

SEQ ID NO: 9460101 - DNA, 21 bp, Homo sapiens
tggtacaccttgcctgtcaga

SEQ ID NO: 9460102 - DNA, 17 bp, Homo sapiens
tggtacaggctgaggga

SEQ ID NO: 9460103 - DNA, 22 bp, Homo sapiens
cctgcctatgagacgttttgcc

SEQ ID NO: 9460104 - DNA, 22 bp, Homo sapiens
cctgcctactgagttttatatt

SEQ ID NO: 9460105 - DNA, 22 bp, Homo sapiens
cctgcctcaggactctgcatat

SEQ ID NO: 9460106 - DNA, 22 bp, Homo sapiens
cctgcccttctttccccagcat

SEQ ID NO: 9460107 - DNA, 22 bp, Homo sapiens
cctgcccttctttccccagcat

SEQ ID NO: 9460108 - DNA, 22 bp, Homo sapiens
cctgcccttctttccccagcat

SEQ ID NO: 9460109 - DNA, 22 bp, Homo sapiens
cctgcccttctttccccagcat

SEQ ID NO: 9460110 - DNA, 22 bp, Homo sapiens
cctgcccttctttccccagcat

SEQ ID NO: 9460111 - DNA, 22 bp, Homo sapiens
cctgccctgtgtttggggacta

SEQ ID NO: 9460112 - DNA, 22 bp, Homo sapiens
cctgccctgtgtttggggacta

SEQ ID NO: 9460113 - DNA, 22 bp, Homo sapiens
cctgccctgtcactggctaggg

SEQ ID NO: 9460114 - DNA, 22 bp, Homo sapiens
cctgcctgaaggtcagccaccc

SEQ ID NO: 9460115 - DNA, 22 bp, Homo sapiens
cctgcctcccagaggtcctcta

SEQ ID NO: 9460116 - DNA, 23 bp, Homo sapiens
cctgcctccccatcagttataca

SEQ ID NO: 9460117 - DNA, 22 bp, Homo sapiens
cctgcctcccagaggtcctcta

SEQ ID NO: 9460118 - DNA, 22 bp, Homo sapiens
cctgcctgaaggtcagccaccc

SEQ ID NO: 9460119 - DNA, 22 bp, Homo sapiens
cctgcctgacagagaaggttca

SEQ ID NO: 9460120 - DNA, 19 bp, Homo sapiens
cctgcctgaccccggctac

SEQ ID NO: 9460121 - DNA, 19 bp, Homo sapiens
cctgcctgagctgtccctc

SEQ ID NO: 9460122 - DNA, 19 bp, Homo sapiens
cctgcctgagctgtccctc

SEQ ID NO: 9460123 - DNA, 19 bp, Homo sapiens
cctgcctgagctgtccctc

SEQ ID NO: 9460124 - DNA, 17 bp, Homo sapiens
cctgcctgagccatagc

SEQ ID NO: 9460125 - DNA, 17 bp, Homo sapiens
cctgcctgagccatagc

SEQ ID NO: 9460126 - DNA, 17 bp, Homo sapiens
cctgcctgagccatagc

SEQ ID NO: 9460127 - DNA, 22 bp, Homo sapiens
cctgcctgattccaggatggct

SEQ ID NO: 9460128 - DNA, 22 bp, Homo sapiens
cctgcctgcaaaatgggacaag

SEQ ID NO: 9460129 - DNA, 22 bp, Homo sapiens
cctgcctgcaaaatgggacaag

SEQ ID NO: 9460130 - DNA, 22 bp, Homo sapiens
cctgcctgattccaggatggct

SEQ ID NO: 9460131 - DNA, 22 bp, Homo sapiens
cctgcctgcagaaagtatctcc

SEQ ID NO: 9460132 - DNA, 22 bp, Homo sapiens
cctgcctgcaccttctctgggg

SEQ ID NO: 9460133 - DNA, 22 bp, Homo sapiens
cctgcctgcaccttctctgggg

SEQ ID NO: 9460134 - DNA, 22 bp, Homo sapiens
cctgcctgcagaaagtatctcc

SEQ ID NO: 9460135 - DNA, 22 bp, Homo sapiens
tggttagacacatgcatgtcat

SEQ ID NO: 9460136 - DNA, 22 bp, Homo sapiens
tggttacagagatttttaagat

SEQ ID NO: 9460137 - DNA, 22 bp, Homo sapiens
tggttacataagaatagcactg

SEQ ID NO: 9460138 - DNA, 22 bp, Homo sapiens
tcttacaagaaggaaaagggag

SEQ ID NO: 9460139 - DNA, 20 bp, Homo sapiens
tcttacaatcgttacatcca

SEQ ID NO: 9460140 - DNA, 22 bp, Homo sapiens
tcttacaagaaggaaaagggag

SEQ ID NO: 9460141 - DNA, 22 bp, Homo sapiens
tcttacaagtcacccgctttct

SEQ ID NO: 9460142 - DNA, 20 bp, Homo sapiens
tcttacaatcgttacatcca

SEQ ID NO: 9460143 - DNA, 22 bp, Homo sapiens
ccaggcagagtgctccagaaag

SEQ ID NO: 9460144 - DNA, 20 bp, Homo sapiens
tcttacaatcgttacatcca

SEQ ID NO: 9460145 - DNA, 20 bp, Homo sapiens
tcttacaatcgttacatcca

SEQ ID NO: 9460146 - DNA, 20 bp, Homo sapiens
tcttacaatcgttacatcca

SEQ ID NO: 9460147 - DNA, 22 bp, Homo sapiens
tcttacatatacgtcatttagt

SEQ ID NO: 9460148 - DNA, 22 bp, Homo sapiens
tcttacatatagcatgagtaca

SEQ ID NO: 9460149 - DNA, 22 bp, Homo sapiens
tcttacccggcaacgtgtgtcg

SEQ ID NO: 9460150 - DNA, 22 bp, Homo sapiens
tcttaattgagaacagtgtagg

SEQ ID NO: 9460151 - DNA, 22 bp, Homo sapiens
tcttaattctgtgtcttcacta

SEQ ID NO: 9460152 - DNA, 22 bp, Homo sapiens
tcttacaagaaataagccaatg

SEQ ID NO: 9460153 - DNA, 22 bp, Homo sapiens
tcttacaagaaataagccaatg

SEQ ID NO: 9460154 - DNA, 22 bp, Homo sapiens
tcttacaagaaataagccaatg

SEQ ID NO: 9460155 - DNA, 22 bp, Homo sapiens
tcttacaagaaggaaaagggag

SEQ ID NO: 9460156 - DNA, 22 bp, Homo sapiens
ccaggcagcaaattttctgaat

SEQ ID NO: 9460157 - DNA, 22 bp, Homo sapiens
tcttaatgctagccaatagaga

SEQ ID NO: 9460158 - DNA, 22 bp, Homo sapiens
tcttaatgctagccaatagaga

SEQ ID NO: 9460159 - DNA, 22 bp, Homo sapiens
ccaggcagagggaatagcaagt

SEQ ID NO: 9460160 - DNA, 22 bp, Homo sapiens
ccaggcagagggaatagcaagt

SEQ ID NO: 9460161 - DNA, 22 bp, Homo sapiens
ccaggcagagggaatagcaagt

SEQ ID NO: 9460162 - DNA, 22 bp, Homo sapiens
ccaggcagagggatccccatcc

SEQ ID NO: 9460163 - DNA, 22 bp, Homo sapiens
ccaggcagagggatccccatcc

SEQ ID NO: 9460164 - DNA, 22 bp, Homo sapiens
ccaggcagagtgctccagaaag

SEQ ID NO: 9460165 - DNA, 22 bp, Homo sapiens
ccaggcagagtgctccagaaag

SEQ ID NO: 9460166 - DNA, 22 bp, Homo sapiens
ccaggcagatgggccggcttca

SEQ ID NO: 9460167 - DNA, 22 bp, Homo sapiens
ccaggcagagtgctccagaaag

SEQ ID NO: 9460168 - DNA, 22 bp, Homo sapiens
ccaggcagagtgctccagaaag

SEQ ID NO: 9460169 - DNA, 22 bp, Homo sapiens
ccaggcagaatgaaacccctgt

SEQ ID NO: 9460170 - DNA, 21 bp, Homo sapiens
ccaggcagagctgtgagttct

SEQ ID NO: 9460171 - DNA, 22 bp, Homo sapiens
ccaggcagaatgaaacccctgt

SEQ ID NO: 9460172 - DNA, 22 bp, Homo sapiens
ccaggcacttgtttgccaggca

SEQ ID NO: 9460173 - DNA, 22 bp, Homo sapiens
ccaggcacttgtttgccaggca

SEQ ID NO: 9460174 - DNA, 22 bp, Homo sapiens
ccaggcagaatgaaacccctgt

SEQ ID NO: 9460175 - DNA, 22 bp, Homo sapiens
ccaggaggcggaggttgcagcg

SEQ ID NO: 9460176 - DNA, 22 bp, Homo sapiens
ccaggaggcggaggttgcagtg

SEQ ID NO: 9460177 - DNA, 22 bp, Homo sapiens
ccaggaggcggaggttgcagtg

SEQ ID NO: 9460178 - DNA, 22 bp, Homo sapiens
ccaggaggctctgactggaccc

SEQ ID NO: 9460179 - DNA, 22 bp, Homo sapiens
ccaggaggctctgactggaccc

SEQ ID NO: 9460180 - DNA, 22 bp, Homo sapiens
ccaggaggctctgactggaccc

SEQ ID NO: 9460181 - DNA, 22 bp, Homo sapiens
tcttcctatggggctgcaggaa

SEQ ID NO: 9460182 - DNA, 22 bp, Homo sapiens
tcttagaaattccccagtggct

SEQ ID NO: 9460183 - DNA, 22 bp, Homo sapiens
tcttagaaactgtatcgattag

SEQ ID NO: 9460184 - DNA, 22 bp, Homo sapiens
tcttctctcctgcttggcagaa

SEQ ID NO: 9460185 - DNA, 22 bp, Homo sapiens
tcttctctgtggcctggtggtg

SEQ ID NO: 9460186 - DNA, 22 bp, Homo sapiens
tcttctctgtggcctggtggtg

SEQ ID NO: 9460187 - DNA, 22 bp, Homo sapiens
tcttctctgtggcctggtggtg

SEQ ID NO: 9460188 - DNA, 17 bp, Homo sapiens
tcttctcttccagtctt

SEQ ID NO: 9460189 - DNA, 17 bp, Homo sapiens
tcttctcttccagtctt

SEQ ID NO: 9460190 - DNA, 17 bp, Homo sapiens
tcttctcttccagtctt

SEQ ID NO: 9460191 - DNA, 17 bp, Homo sapiens
tcttctcttccagtctt

SEQ ID NO: 9460192 - DNA, 17 bp, Homo sapiens
tcttctcttccagtctt

SEQ ID NO: 9460193 - DNA, 17 bp, Homo sapiens
tcttctcttccagtctt

SEQ ID NO: 9460194 - DNA, 22 bp, Homo sapiens
tcttctggatcgatcacattgt

SEQ ID NO: 9460195 - DNA, 22 bp, Homo sapiens
tcttctgaaggtaggaagcatt

SEQ ID NO: 9460196 - DNA, 19 bp, Homo sapiens
tcttctgacttcaagaaac

SEQ ID NO: 9460197 - DNA, 22 bp, Homo sapiens
tcttctgagacttctctttggt

SEQ ID NO: 9460198 - DNA, 22 bp, Homo sapiens
ccaggcaggcgatggtgcagtg

SEQ ID NO: 9460199 - DNA, 22 bp, Homo sapiens
ccaggcaggcgatggtgcagtg

SEQ ID NO: 9460200 - DNA, 22 bp, Homo sapiens
ccaggcaggcagcgttctcagg

SEQ ID NO: 9460201 - DNA, 22 bp, Homo sapiens
ccaggcaggcagcgttctcagg

SEQ ID NO: 9460202 - DNA, 22 bp, Homo sapiens
ccaggcaggcagcgttctcagg

SEQ ID NO: 9460203 - DNA, 22 bp, Homo sapiens
ccaggcaggcagcgttctcagg

SEQ ID NO: 9460204 - DNA, 22 bp, Homo sapiens
ccaggcagcctgctccattctg

SEQ ID NO: 9460205 - DNA, 22 bp, Homo sapiens
ccaggcagcctgctccattctg

SEQ ID NO: 9460206 - DNA, 19 bp, Homo sapiens
ccaggcctcctgggaggtc

SEQ ID NO: 9460207 - DNA, 19 bp, Homo sapiens
ccaggcctcctgggaggtc

SEQ ID NO: 9460208 - DNA, 22 bp, Homo sapiens
ccaggcctcctgtgagtggacc

SEQ ID NO: 9460209 - DNA, 22 bp, Homo sapiens
ccaggcctcctgtgagtggacc

SEQ ID NO: 9460210 - DNA, 22 bp, Homo sapiens
ccaggcctcctgtgagtggacc

SEQ ID NO: 9460211 - DNA, 22 bp, Homo sapiens
ccaggcaggcgatggtgcagtg

SEQ ID NO: 9460212 - DNA, 22 bp, Homo sapiens
ccaggcaggcgatggtgcagtg

SEQ ID NO: 9460213 - DNA, 22 bp, Homo sapiens
ccaggcaggcgatggtgcagtg

SEQ ID NO: 9460214 - DNA, 22 bp, Homo sapiens
ccaggcccccgagcagaagaca

SEQ ID NO: 9460215 - DNA, 22 bp, Homo sapiens
ccaggcccccgagcagaagaca

SEQ ID NO: 9460216 - DNA, 22 bp, Homo sapiens
ccaggcccccgagcagaagaca

SEQ ID NO: 9460217 - DNA, 22 bp, Homo sapiens
tctggggagtgcctaagtggaa

SEQ ID NO: 9460218 - DNA, 22 bp, Homo sapiens
tctggggagggagccacaggtc

SEQ ID NO: 9460219 - DNA, 22 bp, Homo sapiens
tctggggagtcaaagagacctg

SEQ ID NO: 9460220 - DNA, 22 bp, Homo sapiens
tctggggataagacccaggtat

SEQ ID NO: 9460221 - DNA, 22 bp, Homo sapiens
tctggggataagacccaggtat

SEQ ID NO: 9460222 - DNA, 22 bp, Homo sapiens
tctggggagtgcctaagtggaa

SEQ ID NO: 9460223 - DNA, 22 bp, Homo sapiens
tctggggatgaggacctagatg

SEQ ID NO: 9460224 - DNA, 22 bp, Homo sapiens
tctggggatgaggacctagatg

SEQ ID NO: 9460225 - DNA, 22 bp, Homo sapiens
ccaggagcaacttgaaggcaag

SEQ ID NO: 9460226 - DNA, 22 bp, Homo sapiens
ccaggagcaacttgaaggcaag

SEQ ID NO: 9460227 - DNA, 22 bp, Homo sapiens
ccaggagcaaagatcactggga

SEQ ID NO: 9460228 - DNA, 22 bp, Homo sapiens
ccaggagcaacttgaaggcaag

SEQ ID NO: 9460229 - DNA, 22 bp, Homo sapiens
ccaggagagcaaaggtcactct

SEQ ID NO: 9460230 - DNA, 22 bp, Homo sapiens
ccaggagagcaaaggtcactct

SEQ ID NO: 9460231 - DNA, 22 bp, Homo sapiens
tctggggagcagccctggtgag

SEQ ID NO: 9460232 - DNA, 22 bp, Homo sapiens
tctggggagggagccacaggtc

SEQ ID NO: 9460233 - DNA, 22 bp, Homo sapiens
tctggggagggagccacaggtc

SEQ ID NO: 9460234 - DNA, 22 bp, Homo sapiens
tctggggaccatggcatctaaa

SEQ ID NO: 9460235 - DNA, 22 bp, Homo sapiens
tctggggaccatggcatctaaa

SEQ ID NO: 9460236 - DNA, 22 bp, Homo sapiens
tctggggaccatggcatctaaa

SEQ ID NO: 9460237 - DNA, 22 bp, Homo sapiens
tctggggaccatggcatctaaa

SEQ ID NO: 9460238 - DNA, 22 bp, Homo sapiens
tctggggacggggcccagcaat

SEQ ID NO: 9460239 - DNA, 22 bp, Homo sapiens
tctggggacggggcccagcaat

SEQ ID NO: 9460240 - DNA, 22 bp, Homo sapiens
tctggggacggggcccagcaat

SEQ ID NO: 9460241 - DNA, 22 bp, Homo sapiens
tctggggacggggcccagcaat

SEQ ID NO: 9460242 - DNA, 22 bp, Homo sapiens
tctgggcttttgcactggccat

SEQ ID NO: 9460243 - DNA, 22 bp, Homo sapiens
tctgggcttttccatgcctgtg

SEQ ID NO: 9460244 - DNA, 22 bp, Homo sapiens
tctgggcttttccatgcctgtg

SEQ ID NO: 9460245 - DNA, 22 bp, Homo sapiens
tctgggctctgtcagcacctct

SEQ ID NO: 9460246 - DNA, 21 bp, Homo sapiens
tctggggaagacatctaggat

SEQ ID NO: 9460247 - DNA, 22 bp, Homo sapiens
tctggggaatgttcatttctga

SEQ ID NO: 9460248 - DNA, 22 bp, Homo sapiens
tctggggaatgttcatttctga

SEQ ID NO: 9460249 - DNA, 22 bp, Homo sapiens
tctgggccggagccgacggcag

SEQ ID NO: 9460250 - DNA, 22 bp, Homo sapiens
tctgggccggagccgacggcag

SEQ ID NO: 9460251 - DNA, 22 bp, Homo sapiens
tctgggccctgagatgttcttc

SEQ ID NO: 9460252 - DNA, 22 bp, Homo sapiens
tctgggccgctgcgttccatga

SEQ ID NO: 9460253 - DNA, 22 bp, Homo sapiens
tctgggccctaaaccagctcta

SEQ ID NO: 9460254 - DNA, 22 bp, Homo sapiens
tctgggaggctgggtcccgtcc

SEQ ID NO: 9460255 - DNA, 22 bp, Homo sapiens
ccagcaccttgatcttggagtt

SEQ ID NO: 9460256 - DNA, 22 bp, Homo sapiens
tctgggctctgggaattaggga

SEQ ID NO: 9460257 - DNA, 22 bp, Homo sapiens
tctgggctctgggaattaggga

SEQ ID NO: 9460258 - DNA, 22 bp, Homo sapiens
tctgggctctgcgaagcccttc

SEQ ID NO: 9460259 - DNA, 22 bp, Homo sapiens
tctgggctcacgagtctggaca

SEQ ID NO: 9460260 - DNA, 22 bp, Homo sapiens
tctgggctatatggtctctgct

SEQ ID NO: 9460261 - DNA, 22 bp, Homo sapiens
tctgggctcacgagtctggaca

SEQ ID NO: 9460262 - DNA, 22 bp, Homo sapiens
tctgggctcacgagtctggaca

SEQ ID NO: 9460263 - DNA, 22 bp, Homo sapiens
tctgggcctgatggctaaagcc

SEQ ID NO: 9460264 - DNA, 22 bp, Homo sapiens
tctgggcctcacctgctgctca

SEQ ID NO: 9460265 - DNA, 22 bp, Homo sapiens
tctgggcctcagtttcttcatc

SEQ ID NO: 9460266 - DNA, 22 bp, Homo sapiens
tctgggcctgtctcagagctgg

SEQ ID NO: 9460267 - DNA, 22 bp, Homo sapiens
tctgggcctgtctcagagctgg

SEQ ID NO: 9460268 - DNA, 22 bp, Homo sapiens
tctgggcctgtctcagagctgg

SEQ ID NO: 9460269 - DNA, 22 bp, Homo sapiens
tctgttcatgtctttttaagtg

SEQ ID NO: 9460270 - DNA, 17 bp, Homo sapiens
tctgttcatgcatacct

SEQ ID NO: 9460271 - DNA, 22 bp, Homo sapiens
tctgttccatgttttgttccat

SEQ ID NO: 9460272 - DNA, 22 bp, Homo sapiens
tctgttctaagcattctatgtg

SEQ ID NO: 9460273 - DNA, 22 bp, Homo sapiens
tctgttctaagcattctatgtg

SEQ ID NO: 9460274 - DNA, 22 bp, Homo sapiens
tctgttctaagcattctatgtg

SEQ ID NO: 9460275 - DNA, 22 bp, Homo sapiens
tctgttcctgcatagtacctca

SEQ ID NO: 9460276 - DNA, 22 bp, Homo sapiens
tctgttcttgcttttctccaac

SEQ ID NO: 9460277 - DNA, 22 bp, Homo sapiens
tctgttcttgcttttctccaac

SEQ ID NO: 9460278 - DNA, 22 bp, Homo sapiens
tctgttcttgcttttctccaac

SEQ ID NO: 9460279 - DNA, 22 bp, Homo sapiens
tctgttcttctccactgtatgt

SEQ ID NO: 9460280 - DNA, 22 bp, Homo sapiens
tctgttcttcctacattcacat

SEQ ID NO: 9460281 - DNA, 22 bp, Homo sapiens
tctgttctattggtctatgtgt

SEQ ID NO: 9460282 - DNA, 22 bp, Homo sapiens
tctgttctattggtctatgtgt

SEQ ID NO: 9460283 - DNA, 22 bp, Homo sapiens
tctgttcttaaagcattcttgc

SEQ ID NO: 9460284 - DNA, 22 bp, Homo sapiens
tctgttctattggtctatgtgt

SEQ ID NO: 9460285 - DNA, 22 bp, Homo sapiens
tctgttcttcctacattcacat

SEQ ID NO: 9460286 - DNA, 22 bp, Homo sapiens
tctgttcttaaagcattcttgc

SEQ ID NO: 9460287 - DNA, 22 bp, Homo sapiens
tctgttcttaaagcattcttgc

SEQ ID NO: 9460288 - DNA, 22 bp, Homo sapiens
tctgttcagttgattagacaga

SEQ ID NO: 9460289 - DNA, 22 bp, Homo sapiens
tctgttcagttgatgtagtttt

SEQ ID NO: 9460290 - DNA, 22 bp, Homo sapiens
tctgttcatagtagtgtatatg

SEQ ID NO: 9460291 - DNA, 22 bp, Homo sapiens
tctgttcatacagagtatagta

SEQ ID NO: 9460292 - DNA, 22 bp, Homo sapiens
tctgttcagacactttacatgt

SEQ ID NO: 9460293 - DNA, 22 bp, Homo sapiens
tctgttattctgtctattgcca

SEQ ID NO: 9460294 - DNA, 22 bp, Homo sapiens
ccaggagccctgccacaatggt

SEQ ID NO: 9460295 - DNA, 22 bp, Homo sapiens
ccaggagcaggagctggacaga

SEQ ID NO: 9460296 - DNA, 22 bp, Homo sapiens
ccaggagcaggagctggacaga

SEQ ID NO: 9460297 - DNA, 19 bp, Homo sapiens
ccaggagcagtggtgagct

SEQ ID NO: 9460298 - DNA, 22 bp, Homo sapiens
ccaggagcagggctggctgcac

SEQ ID NO: 9460299 - DNA, 19 bp, Homo sapiens
ccaggagcagtggtgagct

SEQ ID NO: 9460300 - DNA, 19 bp, Homo sapiens
ccaggagcagtggtgagct

SEQ ID NO: 9460301 - DNA, 22 bp, Homo sapiens
ccaggagcattaagagaacata

SEQ ID NO: 9460302 - DNA, 22 bp, Homo sapiens
ccaggagcattaagagaacata

SEQ ID NO: 9460303 - DNA, 22 bp, Homo sapiens
ccaggagcattaagagaacata

SEQ ID NO: 9460304 - DNA, 22 bp, Homo sapiens
ccaggagcattaagagaacata

SEQ ID NO: 9460305 - DNA, 22 bp, Homo sapiens
ccaggagcattaagagaacata

SEQ ID NO: 9460306 - DNA, 22 bp, Homo sapiens
ccaggagcattaagagaacata

SEQ ID NO: 9460307 - DNA, 22 bp, Homo sapiens
ccaggagccactcaggcccaca

SEQ ID NO: 9460308 - DNA, 22 bp, Homo sapiens
ccaggagcaggagctggacaga

SEQ ID NO: 9460309 - DNA, 22 bp, Homo sapiens
ccaggagcagccggcccacctg

SEQ ID NO: 9460310 - DNA, 22 bp, Homo sapiens
ccaggagcaggagctgcagctg

SEQ ID NO: 9460311 - DNA, 22 bp, Homo sapiens
ccaggagcagatatggacataa

SEQ ID NO: 9460312 - DNA, 22 bp, Homo sapiens
ccaggagcagatatggacataa

SEQ ID NO: 9460313 - DNA, 22 bp, Homo sapiens
ccaggagcagatatggacataa

SEQ ID NO: 9460314 - DNA, 22 bp, Homo sapiens
ccaggagcaccaggcctgtgcc

SEQ ID NO: 9460315 - DNA, 22 bp, Homo sapiens
ccaggagcaccaggcctgtgcc

SEQ ID NO: 9460316 - DNA, 22 bp, Homo sapiens
ccagggcagggaccacgtgtct

SEQ ID NO: 9460317 - DNA, 22 bp, Homo sapiens
ccagggcaggggctggagttca

SEQ ID NO: 9460318 - DNA, 22 bp, Homo sapiens
ccagggcaggggctggagttca

SEQ ID NO: 9460319 - DNA, 22 bp, Homo sapiens
ccagggcaggagaaagactcac

SEQ ID NO: 9460320 - DNA, 22 bp, Homo sapiens
ccagggcacgttgggacagtac

SEQ ID NO: 9460321 - DNA, 22 bp, Homo sapiens
ccagggcacgttgggacagtac

SEQ ID NO: 9460322 - DNA, 22 bp, Homo sapiens
ccagggcacgttgggacagtac

SEQ ID NO: 9460323 - DNA, 22 bp, Homo sapiens
ccagggcacgttgggacagtac

SEQ ID NO: 9460324 - DNA, 22 bp, Homo sapiens
ccagggcacgttgggacagtac

SEQ ID NO: 9460325 - DNA, 22 bp, Homo sapiens
ccagggcacgttgggacagtac

SEQ ID NO: 9460326 - DNA, 22 bp, Homo sapiens
ccagggcacgttgggacagtac

SEQ ID NO: 9460327 - DNA, 22 bp, Homo sapiens
ccagggcacgttgggacagtac

SEQ ID NO: 9460328 - DNA, 22 bp, Homo sapiens
ccagggcaggagaaagactcac

SEQ ID NO: 9460329 - DNA, 22 bp, Homo sapiens
ccagggcaggagaaagactcac

SEQ ID NO: 9460330 - DNA, 22 bp, Homo sapiens
ccagggcaattatttggagggt

SEQ ID NO: 9460331 - DNA, 22 bp, Homo sapiens
ccagggcaacgctgtctcagag

SEQ ID NO: 9460332 - DNA, 22 bp, Homo sapiens
ccagggcaattatttggagggt

SEQ ID NO: 9460333 - DNA, 22 bp, Homo sapiens
ccagggcaaatgagatcatagc

SEQ ID NO: 9460334 - DNA, 22 bp, Homo sapiens
ccagggatgtggcagcaccata

SEQ ID NO: 9460335 - DNA, 21 bp, Homo sapiens
ccagggatgttgaactgaaag

SEQ ID NO: 9460336 - DNA, 22 bp, Homo sapiens
ccagggcaaatgagatcatagc

SEQ ID NO: 9460337 - DNA, 22 bp, Homo sapiens
ccagggagggtcctgtggcttc

SEQ ID NO: 9460338 - DNA, 22 bp, Homo sapiens
ccagggagggtcctgtggcttc

SEQ ID NO: 9460339 - DNA, 22 bp, Homo sapiens
ccagggagggtcctgtggcttc

SEQ ID NO: 9460340 - DNA, 22 bp, Homo sapiens
ccagggagggtcctgtggcttc

SEQ ID NO: 9460341 - DNA, 23 bp, Homo sapiens
ccagggaggttgattggttaccc

SEQ ID NO: 9460342 - DNA, 23 bp, Homo sapiens
ccagggaggttgattggttaccc

SEQ ID NO: 9460343 - DNA, 22 bp, Homo sapiens
ccagggagggtcctgtggcttc

SEQ ID NO: 9460344 - DNA, 17 bp, Homo sapiens
ccagggaggggccgcgc

SEQ ID NO: 9460345 - DNA, 22 bp, Homo sapiens
ccagggagggtcctgtggcttc

SEQ ID NO: 9460346 - DNA, 17 bp, Homo sapiens
ccagggaggggccgcgc

SEQ ID NO: 9460347 - DNA, 23 bp, Homo sapiens
ccagggagtgctactatcaagcc

SEQ ID NO: 9460348 - DNA, 23 bp, Homo sapiens
ccagggagtgctactatcaagcc

SEQ ID NO: 9460349 - DNA, 22 bp, Homo sapiens
ccagggagtttccaatctgaga

SEQ ID NO: 9460350 - DNA, 22 bp, Homo sapiens
ccagggatgcagaggttgcagt

SEQ ID NO: 9460351 - DNA, 22 bp, Homo sapiens
ccagggatgctttcccaggact

SEQ ID NO: 9460352 - DNA, 22 bp, Homo sapiens
ccagggatgccaagctttacca

SEQ ID NO: 9460353 - DNA, 22 bp, Homo sapiens
tgaaatgagataatttaagtgc

SEQ ID NO: 9460354 - DNA, 22 bp, Homo sapiens
tgaaatgagatagataatcagg

SEQ ID NO: 9460355 - DNA, 22 bp, Homo sapiens
tgaaatgatatctgataacaaa

SEQ ID NO: 9460356 - DNA, 22 bp, Homo sapiens
tgaaatgatgtacaagaaggca

SEQ ID NO: 9460357 - DNA, 22 bp, Homo sapiens
tgaaatgatatctgataacaaa

SEQ ID NO: 9460358 - DNA, 22 bp, Homo sapiens
ccagggaagattagaagccact

SEQ ID NO: 9460359 - DNA, 17 bp, Homo sapiens
ccagggaggggccgcgc

SEQ ID NO: 9460360 - DNA, 22 bp, Homo sapiens
tgaagtatctatggatataaga

SEQ ID NO: 9460361 - DNA, 22 bp, Homo sapiens
tgaagtcctaacttccagtaca

SEQ ID NO: 9460362 - DNA, 22 bp, Homo sapiens
tgaagtctattctatgccaggt

SEQ ID NO: 9460363 - DNA, 22 bp, Homo sapiens
tgaagtatccatcttgttctag

SEQ ID NO: 9460364 - DNA, 22 bp, Homo sapiens
tgaagtacccgtttttattgca

SEQ ID NO: 9460365 - DNA, 22 bp, Homo sapiens
tgaagtaactgtccaggatcca

SEQ ID NO: 9460366 - DNA, 23 bp, Homo sapiens
tgaagtgaaatttcacaagggac

SEQ ID NO: 9460367 - DNA, 22 bp, Homo sapiens
tgaagtgacctggggcagtgta

SEQ ID NO: 9460368 - DNA, 22 bp, Homo sapiens
tgaagtggaccctggacagacc

SEQ ID NO: 9460369 - DNA, 22 bp, Homo sapiens
ccagggcagtgggagaaggtgc

SEQ ID NO: 9460370 - DNA, 22 bp, Homo sapiens
ccagggcagtgggagaaggtgc

SEQ ID NO: 9460371 - DNA, 22 bp, Homo sapiens
ccagggcagtgggagaaggtgc

SEQ ID NO: 9460372 - DNA, 22 bp, Homo sapiens
ccagggcatcctcacatcgcag

SEQ ID NO: 9460373 - DNA, 22 bp, Homo sapiens
tgaaggtggggcttaggaatct

SEQ ID NO: 9460374 - DNA, 22 bp, Homo sapiens
ccagggcatcctcacatcgcag

SEQ ID NO: 9460375 - DNA, 19 bp, Homo sapiens
tgaaggtgtatgtgctggg

SEQ ID NO: 9460376 - DNA, 22 bp, Homo sapiens
tgaaggtgtatgctgtgggtca

SEQ ID NO: 9460377 - DNA, 22 bp, Homo sapiens
tgaaggtggggcttaggaatct

SEQ ID NO: 9460378 - DNA, 22 bp, Homo sapiens
tgaaggtgtctttgtgaacatc

SEQ ID NO: 9460379 - DNA, 22 bp, Homo sapiens
tgaaggtgtttatacctcagat

SEQ ID NO: 9460380 - DNA, 21 bp, Homo sapiens
tgaaggtgttcatgatgcggt

SEQ ID NO: 9460381 - DNA, 22 bp, Homo sapiens
tgaaggtgtctttgtgaacatc

SEQ ID NO: 9460382 - DNA, 22 bp, Homo sapiens
tgaaggtgtctttgtgaacatc

SEQ ID NO: 9460383 - DNA, 22 bp, Homo sapiens
ccagggctctatgagggtggag

SEQ ID NO: 9460384 - DNA, 22 bp, Homo sapiens
ccagggctctatgagggtggag

SEQ ID NO: 9460385 - DNA, 22 bp, Homo sapiens
ccagggctccattgctcatcct

SEQ ID NO: 9460386 - DNA, 22 bp, Homo sapiens
ccagggctccattgctcatcct

SEQ ID NO: 9460387 - DNA, 22 bp, Homo sapiens
ccagggctccccagaagtaccc

SEQ ID NO: 9460388 - DNA, 22 bp, Homo sapiens
ccagggctccccagaagtaccc

SEQ ID NO: 9460389 - DNA, 23 bp, Homo sapiens
ccagggcccctacaccactgtcc

SEQ ID NO: 9460390 - DNA, 22 bp, Homo sapiens
tgaagtgcattctctggcactc

SEQ ID NO: 9460391 - DNA, 22 bp, Homo sapiens
tgaagttagaactatgaggata

SEQ ID NO: 9460392 - DNA, 17 bp, Homo sapiens
tgaagttaggctgcaga

SEQ ID NO: 9460393 - DNA, 22 bp, Homo sapiens
ccagggctccattgctcatcct

SEQ ID NO: 9460394 - DNA, 22 bp, Homo sapiens
ccagggctgccgcatccctggt

SEQ ID NO: 9460395 - DNA, 22 bp, Homo sapiens
ccagggctgccgcatccctggt

SEQ ID NO: 9460396 - DNA, 22 bp, Homo sapiens
ccagggctgagctgtgaccatg

SEQ ID NO: 9460397 - DNA, 22 bp, Homo sapiens
ccagggctgagctgtgaccatg

SEQ ID NO: 9460398 - DNA, 22 bp, Homo sapiens
ccagggctgagctgtgaccatg

SEQ ID NO: 9460399 - DNA, 22 bp, Homo sapiens
ccagggctgagctgtgaccatg

SEQ ID NO: 9460400 - DNA, 22 bp, Homo sapiens
ccagggctgagactgtattggg

SEQ ID NO: 9460401 - DNA, 22 bp, Homo sapiens
ccagggctctgcttctgccatg

SEQ ID NO: 9460402 - DNA, 22 bp, Homo sapiens
ccagggctctgcttctgccatg

SEQ ID NO: 9460403 - DNA, 22 bp, Homo sapiens
ccagggctctatgagggtggag

SEQ ID NO: 9460404 - DNA, 22 bp, Homo sapiens
ccagggctctatgagggtggag

SEQ ID NO: 9460405 - DNA, 22 bp, Homo sapiens
ccaggctgtggtttagatagag

SEQ ID NO: 9460406 - DNA, 22 bp, Homo sapiens
ccaggctgtggtttagatagag

SEQ ID NO: 9460407 - DNA, 22 bp, Homo sapiens
ccaggctgtggtttagatagag

SEQ ID NO: 9460408 - DNA, 22 bp, Homo sapiens
ccaggctgtggtttagatagag

SEQ ID NO: 9460409 - DNA, 22 bp, Homo sapiens
ccaggctgtggtttagatagag

SEQ ID NO: 9460410 - DNA, 22 bp, Homo sapiens
ccaggctgtggtttagatagag

SEQ ID NO: 9460411 - DNA, 22 bp, Homo sapiens
ccaggctgttttcaaacttggg

SEQ ID NO: 9460412 - DNA, 22 bp, Homo sapiens
ccaggctgttttcaaacttggg

SEQ ID NO: 9460413 - DNA, 22 bp, Homo sapiens
ccaggctgtaagagtgatgttg

SEQ ID NO: 9460414 - DNA, 22 bp, Homo sapiens
ccaggctgtaagagtgatgttg

SEQ ID NO: 9460415 - DNA, 22 bp, Homo sapiens
ccaggctgtgcttttcataaat

SEQ ID NO: 9460416 - DNA, 22 bp, Homo sapiens
ccaggctgtgcttttcataaat

SEQ ID NO: 9460417 - DNA, 22 bp, Homo sapiens
tgaaatgacagtcttaagctct

SEQ ID NO: 9460418 - DNA, 22 bp, Homo sapiens
tgaaatgaatgtgattcgatag

SEQ ID NO: 9460419 - DNA, 22 bp, Homo sapiens
tgaaatgaagggcttgttctgg

SEQ ID NO: 9460420 - DNA, 22 bp, Homo sapiens
ccaggctgttttcaaacttggg

SEQ ID NO: 9460421 - DNA, 22 bp, Homo sapiens
ccaggcttccctgagaggctgc

SEQ ID NO: 9460422 - DNA, 22 bp, Homo sapiens
tcttttgtggatgaagaaatgg

SEQ ID NO: 9460423 - DNA, 22 bp, Homo sapiens
tgaaacaaatttggaaaatcta

SEQ ID NO: 9460424 - DNA, 22 bp, Homo sapiens
tgaaacaaatttggaaaatcta

SEQ ID NO: 9460425 - DNA, 22 bp, Homo sapiens
tcttttgtgattctttagttac

SEQ ID NO: 9460426 - DNA, 22 bp, Homo sapiens
tcttttgtgattcttcagttac

SEQ ID NO: 9460427 - DNA, 22 bp, Homo sapiens
tgaaacaagatccacagacttg

SEQ ID NO: 9460428 - DNA, 22 bp, Homo sapiens
tgaaacaagatccacagacttg

SEQ ID NO: 9460429 - DNA, 22 bp, Homo sapiens
tgaaacaagatccacagacttg

SEQ ID NO: 9460430 - DNA, 22 bp, Homo sapiens
tgaaacaagggaccgtcctttc

SEQ ID NO: 9460431 - DNA, 18 bp, Homo sapiens
tgaaacaagaatggtgca

SEQ ID NO: 9460432 - DNA, 22 bp, Homo sapiens
tgaaacaagatccacagacttg

SEQ ID NO: 9460433 - DNA, 22 bp, Homo sapiens
tgaaacaaatttggaaaatcta

SEQ ID NO: 9460434 - DNA, 18 bp, Homo sapiens
tgaaacaagaatggtgca

SEQ ID NO: 9460435 - DNA, 21 bp, Homo sapiens
tgaaacaatcagacagagtct

SEQ ID NO: 9460436 - DNA, 21 bp, Homo sapiens
tgaaacaatcagacagagtct

SEQ ID NO: 9460437 - DNA, 22 bp, Homo sapiens
tgaaacaagtttaagggatcta

SEQ ID NO: 9460438 - DNA, 22 bp, Homo sapiens
tgaaacaagggccatgggaaac

SEQ ID NO: 9460439 - DNA, 22 bp, Homo sapiens
tgaaacaattagaatgtaatga

SEQ ID NO: 9460440 - DNA, 22 bp, Homo sapiens
tgaaacaattagaatgtaatga

SEQ ID NO: 9460441 - DNA, 22 bp, Homo sapiens
tgaaacaattagaatgtaatga

SEQ ID NO: 9460442 - DNA, 17 bp, Homo sapiens
tgaaacaccaagactgt

SEQ ID NO: 9460443 - DNA, 22 bp, Homo sapiens
tgaaacaattagaatgtaatga

SEQ ID NO: 9460444 - DNA, 22 bp, Homo sapiens
tgaaacaatgtgaagttgctga

SEQ ID NO: 9460445 - DNA, 21 bp, Homo sapiens
tgaaacaatcagacagagtct

SEQ ID NO: 9460446 - DNA, 22 bp, Homo sapiens
tgaaacaatgtgaagttgctga

SEQ ID NO: 9460447 - DNA, 21 bp, Homo sapiens
ccaggctggccatggtattga

SEQ ID NO: 9460448 - DNA, 23 bp, Homo sapiens
tgaaacagatgccaatgatcaag

SEQ ID NO: 9460449 - DNA, 22 bp, Homo sapiens
tgaaacactttcaattacatat

SEQ ID NO: 9460450 - DNA, 22 bp, Homo sapiens
tcttttctgccagctgagccct

SEQ ID NO: 9460451 - DNA, 22 bp, Homo sapiens
tcttttctgccacagcctgagc

SEQ ID NO: 9460452 - DNA, 22 bp, Homo sapiens
tcttttctgtaactcagtgtct

SEQ ID NO: 9460453 - DNA, 22 bp, Homo sapiens
tcttttctggactctgcatgga

SEQ ID NO: 9460454 - DNA, 22 bp, Homo sapiens
tcttttctggactctgcatgga

SEQ ID NO: 9460455 - DNA, 22 bp, Homo sapiens
tcttgccctcaacaagagcatg

SEQ ID NO: 9460456 - DNA, 22 bp, Homo sapiens
tcttttcttgcattattgcact

SEQ ID NO: 9460457 - DNA, 22 bp, Homo sapiens
tcttttcttgcattattgcact

SEQ ID NO: 9460458 - DNA, 22 bp, Homo sapiens
tcttttcttcttaatggttaat

SEQ ID NO: 9460459 - DNA, 22 bp, Homo sapiens
tcttttcttcttaatggttaat

SEQ ID NO: 9460460 - DNA, 22 bp, Homo sapiens
tcttttcttcttaatggttaat

SEQ ID NO: 9460461 - DNA, 22 bp, Homo sapiens
tcttttcttgcattattgcact

SEQ ID NO: 9460462 - DNA, 22 bp, Homo sapiens
tcttttcttgcattattgcact

SEQ ID NO: 9460463 - DNA, 21 bp, Homo sapiens
tcttttgtaactatttcagcc

SEQ ID NO: 9460464 - DNA, 22 bp, Homo sapiens
tcttttgtactcagtattgaca

SEQ ID NO: 9460465 - DNA, 22 bp, Homo sapiens
tcttttgtcatcccttgtacat

SEQ ID NO: 9460466 - DNA, 22 bp, Homo sapiens
tcttttgtgaggacaaggtacg

SEQ ID NO: 9460467 - DNA, 19 bp, Homo sapiens
ccaggcctctggggcctgt

SEQ ID NO: 9460468 - DNA, 19 bp, Homo sapiens
ccaggcctctggggcctgt

SEQ ID NO: 9460469 - DNA, 23 bp, Homo sapiens
ccaggcctctcagagggtgtgcc

SEQ ID NO: 9460470 - DNA, 23 bp, Homo sapiens
ccaggcctctcagagggtgtgcc

SEQ ID NO: 9460471 - DNA, 22 bp, Homo sapiens
ccaggcctctggctgcttagtc

SEQ ID NO: 9460472 - DNA, 22 bp, Homo sapiens
ccaggcctgattgggaatcttg

SEQ ID NO: 9460473 - DNA, 22 bp, Homo sapiens
tcttgatttattctacccagaa

SEQ ID NO: 9460474 - DNA, 22 bp, Homo sapiens
tcttgatttgaattgcagttgt

SEQ ID NO: 9460475 - DNA, 22 bp, Homo sapiens
tcttgatttgaattgcagttgt

SEQ ID NO: 9460476 - DNA, 22 bp, Homo sapiens
ccaggcctgattgggaatcttg

SEQ ID NO: 9460477 - DNA, 22 bp, Homo sapiens
tcttgcagagggcccttctgct

SEQ ID NO: 9460478 - DNA, 22 bp, Homo sapiens
tcttgcagaggcactgtgtcag

SEQ ID NO: 9460479 - DNA, 22 bp, Homo sapiens
tcttgcagacagcttccagcct

SEQ ID NO: 9460480 - DNA, 22 bp, Homo sapiens
tcttgcagcttcatctgcaatt

SEQ ID NO: 9460481 - DNA, 19 bp, Homo sapiens
tcttgcagccccagcaggc

SEQ ID NO: 9460482 - DNA, 22 bp, Homo sapiens
tcttgcacttcatgaatatgtt

SEQ ID NO: 9460483 - DNA, 22 bp, Homo sapiens
tcttgcaccacacaaaaatttg

SEQ ID NO: 9460484 - DNA, 22 bp, Homo sapiens
tcttgattttgtgaataagttg

SEQ ID NO: 9460485 - DNA, 22 bp, Homo sapiens
tcttgcacttcatgaatatgtt

SEQ ID NO: 9460486 - DNA, 22 bp, Homo sapiens
tcttgcagaaaatagtatagat

SEQ ID NO: 9460487 - DNA, 22 bp, Homo sapiens
tcttgcagaagaagctgccaag

SEQ ID NO: 9460488 - DNA, 22 bp, Homo sapiens
tcttgcagacagcttccagcct

SEQ ID NO: 9460489 - DNA, 22 bp, Homo sapiens
tgcagagagatatggcaagagg

SEQ ID NO: 9460490 - DNA, 22 bp, Homo sapiens
tgcagagagatcctcagggttt

SEQ ID NO: 9460491 - DNA, 22 bp, Homo sapiens
tgcagagagatcctcagggttt

SEQ ID NO: 9460492 - DNA, 22 bp, Homo sapiens
tgcagagagatatggcaagagg

SEQ ID NO: 9460493 - DNA, 19 bp, Homo sapiens
tgcagagagaggcaaagaa

SEQ ID NO: 9460494 - DNA, 22 bp, Homo sapiens
tgcagagagacccctgggccag

SEQ ID NO: 9460495 - DNA, 22 bp, Homo sapiens
tgcagagacttgtgtgcatttg

SEQ ID NO: 9460496 - DNA, 22 bp, Homo sapiens
tgcagagaccactgtgccttcc

SEQ ID NO: 9460497 - DNA, 22 bp, Homo sapiens
tgcagagaagaggacagttcta

SEQ ID NO: 9460498 - DNA, 22 bp, Homo sapiens
tgcagagaaaccagtggaggac

SEQ ID NO: 9460499 - DNA, 22 bp, Homo sapiens
tgcagagaaagtgtagacaggc

SEQ ID NO: 9460500 - DNA, 22 bp, Homo sapiens
tgcagagaagaggacagttcta

SEQ ID NO: 9460501 - DNA, 22 bp, Homo sapiens
tgcactgttgctttatatgatt

SEQ ID NO: 9460502 - DNA, 22 bp, Homo sapiens
tgcacttgtgttttcagaatct

SEQ ID NO: 9460503 - DNA, 22 bp, Homo sapiens
tgcacttggctgtgatctctag

SEQ ID NO: 9460504 - DNA, 22 bp, Homo sapiens
tgcacttgaggattttccacag

SEQ ID NO: 9460505 - DNA, 22 bp, Homo sapiens
tgcactccaggctgggtgacag

SEQ ID NO: 9460506 - DNA, 22 bp, Homo sapiens
tgcactccaggctgggtgacag

SEQ ID NO: 9460507 - DNA, 22 bp, Homo sapiens
tgcactccaggctgggtgacag

SEQ ID NO: 9460508 - DNA, 22 bp, Homo sapiens
tgcactgggaaagaaggaggga

SEQ ID NO: 9460509 - DNA, 22 bp, Homo sapiens
tgcactgctttgcaaagctgag

SEQ ID NO: 9460510 - DNA, 22 bp, Homo sapiens
cccagagctgattgttggagcc

SEQ ID NO: 9460511 - DNA, 22 bp, Homo sapiens
cccagagctgggtgggcagcgg

SEQ ID NO: 9460512 - DNA, 18 bp, Homo sapiens
cccagaggaatgcctgga

SEQ ID NO: 9460513 - DNA, 18 bp, Homo sapiens
cccagaggaatgcctgga

SEQ ID NO: 9460514 - DNA, 18 bp, Homo sapiens
cccagaggaatgcctgga

SEQ ID NO: 9460515 - DNA, 18 bp, Homo sapiens
cccagaggaatgcctgga

SEQ ID NO: 9460516 - DNA, 23 bp, Homo sapiens
cccagaggagcagggcgtgagat

SEQ ID NO: 9460517 - DNA, 23 bp, Homo sapiens
cccagaggagcagggcgtgagat

SEQ ID NO: 9460518 - DNA, 23 bp, Homo sapiens
cccagaggagcagggcgtgagat

SEQ ID NO: 9460519 - DNA, 23 bp, Homo sapiens
cccagaggagcagggcgtgagat

SEQ ID NO: 9460520 - DNA, 23 bp, Homo sapiens
cccagaggagcagggcgtgagat

SEQ ID NO: 9460521 - DNA, 23 bp, Homo sapiens
cccagaggagcagggcgtgagat

SEQ ID NO: 9460522 - DNA, 23 bp, Homo sapiens
cccagaggagcagggcgtgagat

SEQ ID NO: 9460523 - DNA, 23 bp, Homo sapiens
cccagaggagcagggcgtgagat

SEQ ID NO: 9460524 - DNA, 19 bp, Homo sapiens
cccagaggaatgcctggaa

SEQ ID NO: 9460525 - DNA, 19 bp, Homo sapiens
cccagaggaatgcctggaa

SEQ ID NO: 9460526 - DNA, 19 bp, Homo sapiens
cccagaggaatgcctggaa

SEQ ID NO: 9460527 - DNA, 19 bp, Homo sapiens
cccagaggaatgcctggaa

SEQ ID NO: 9460528 - DNA, 22 bp, Homo sapiens
cccagagctccggtcctgccca

SEQ ID NO: 9460529 - DNA, 22 bp, Homo sapiens
cccagagcctcattctgttggg

SEQ ID NO: 9460530 - DNA, 22 bp, Homo sapiens
cccagagcctcattctgttggg

SEQ ID NO: 9460531 - DNA, 22 bp, Homo sapiens
cccagagctcagtgtgcaaggt

SEQ ID NO: 9460532 - DNA, 22 bp, Homo sapiens
cccagagctgagtctgatatat

SEQ ID NO: 9460533 - DNA, 22 bp, Homo sapiens
cccagagctgagggggcacgtt

SEQ ID NO: 9460534 - DNA, 22 bp, Homo sapiens
cccagagctccggtcctgccca

SEQ ID NO: 9460535 - DNA, 17 bp, Homo sapiens
cccagagatgctgcctt

SEQ ID NO: 9460536 - DNA, 22 bp, Homo sapiens
cccagagcctcattctgttggg

SEQ ID NO: 9460537 - DNA, 21 bp, Homo sapiens
cccagagcctagggagggcac

SEQ ID NO: 9460538 - DNA, 16 bp, Homo sapiens
tgcagagagcatggtg

SEQ ID NO: 9460539 - DNA, 22 bp, Homo sapiens
tgcagagagccagctctctcgg

SEQ ID NO: 9460540 - DNA, 16 bp, Homo sapiens
tgcagagagcatggtg

SEQ ID NO: 9460541 - DNA, 22 bp, Homo sapiens
tgcagagagccctgccttcctc

SEQ ID NO: 9460542 - DNA, 22 bp, Homo sapiens
tgcaataatgtatgtcactccc

SEQ ID NO: 9460543 - DNA, 21 bp, Homo sapiens
tgcaatatatatttgcctgaa

SEQ ID NO: 9460544 - DNA, 22 bp, Homo sapiens
tgcaatatttggcactgagatg

SEQ ID NO: 9460545 - DNA, 22 bp, Homo sapiens
tgcaatcaggtaccatttgatt

SEQ ID NO: 9460546 - DNA, 22 bp, Homo sapiens
tgcaatatgttgcattgtatgg

SEQ ID NO: 9460547 - DNA, 22 bp, Homo sapiens
tgcaatatgttgcattgtatgg

SEQ ID NO: 9460548 - DNA, 22 bp, Homo sapiens
tgcaataaggagtaatagtaaa

SEQ ID NO: 9460549 - DNA, 22 bp, Homo sapiens
tgcaataagttgtgttatcact

SEQ ID NO: 9460550 - DNA, 22 bp, Homo sapiens
tgcaataagtattgcttacatg

SEQ ID NO: 9460551 - DNA, 22 bp, Homo sapiens
tgcaataacccatgagatagaa

SEQ ID NO: 9460552 - DNA, 22 bp, Homo sapiens
tgcaataaggagtaatagtaaa

SEQ ID NO: 9460553 - DNA, 22 bp, Homo sapiens
tgcaataaggagtaatagtaaa

SEQ ID NO: 9460554 - DNA, 22 bp, Homo sapiens
tgcaataactactttaatgttg

SEQ ID NO: 9460555 - DNA, 22 bp, Homo sapiens
tgataatattttgaatcataag

SEQ ID NO: 9460556 - DNA, 22 bp, Homo sapiens
tgataatgttcgagaatgaaga

SEQ ID NO: 9460557 - DNA, 22 bp, Homo sapiens
tgatacaatcatgagagaggac

SEQ ID NO: 9460558 - DNA, 22 bp, Homo sapiens
tgataatgttcgagaatgaaga

SEQ ID NO: 9460559 - DNA, 22 bp, Homo sapiens
tgataaatccatgtaaatggta

SEQ ID NO: 9460560 - DNA, 22 bp, Homo sapiens
tgataaatccatgtaaatggta

SEQ ID NO: 9460561 - DNA, 22 bp, Homo sapiens
tgataatattttgaatcataag

SEQ ID NO: 9460562 - DNA, 22 bp, Homo sapiens
tgcaaatattgggacagtctag

SEQ ID NO: 9460563 - DNA, 19 bp, Homo sapiens
tgcaagtgtcttggacaag

SEQ ID NO: 9460564 - DNA, 19 bp, Homo sapiens
tgcaagtgtcttggacaag

SEQ ID NO: 9460565 - DNA, 22 bp, Homo sapiens
tgcaataacccagtatctgtga

SEQ ID NO: 9460566 - DNA, 22 bp, Homo sapiens
tgcaataacccagtatctgtga

SEQ ID NO: 9460567 - DNA, 22 bp, Homo sapiens
tgcaataacccagtatctgtga

SEQ ID NO: 9460568 - DNA, 22 bp, Homo sapiens
tgcaataaagtgctataaatcc

SEQ ID NO: 9460569 - DNA, 22 bp, Homo sapiens
tgcaataaagtgctataaatcc

SEQ ID NO: 9460570 - DNA, 22 bp, Homo sapiens
cccaagggatgcttgagtagtt

SEQ ID NO: 9460571 - DNA, 22 bp, Homo sapiens
cccaaggggagattttcttgag

SEQ ID NO: 9460572 - DNA, 22 bp, Homo sapiens
cccaagggatgcttgagtagtt

SEQ ID NO: 9460573 - DNA, 22 bp, Homo sapiens
tgcacagatctggtggcaagga

SEQ ID NO: 9460574 - DNA, 22 bp, Homo sapiens
tgcacagatctggtggcaagga

SEQ ID NO: 9460575 - DNA, 22 bp, Homo sapiens
cccaaggggtgttgatggagga

SEQ ID NO: 9460576 - DNA, 22 bp, Homo sapiens
cccaaggggtgttgatggagga

SEQ ID NO: 9460577 - DNA, 22 bp, Homo sapiens
tgcactccaggctgggtgacag

SEQ ID NO: 9460578 - DNA, 22 bp, Homo sapiens
tgcactccaggctgggtgacag

SEQ ID NO: 9460579 - DNA, 22 bp, Homo sapiens
tgcactccaggctgggtgacag

SEQ ID NO: 9460580 - DNA, 22 bp, Homo sapiens
tgcactccaggctgggtgacag

SEQ ID NO: 9460581 - DNA, 22 bp, Homo sapiens
tgcactatttcgccatggttgt

SEQ ID NO: 9460582 - DNA, 18 bp, Homo sapiens
tgcactagatgctggcag

SEQ ID NO: 9460583 - DNA, 23 bp, Homo sapiens
cccaagcctgtgccctctgactc

SEQ ID NO: 9460584 - DNA, 23 bp, Homo sapiens
cccaagcctgtgccctctgactc

SEQ ID NO: 9460585 - DNA, 22 bp, Homo sapiens
tgcaatcaggtaccatttgatt

SEQ ID NO: 9460586 - DNA, 22 bp, Homo sapiens
cccaaggacacgggcagggaca

SEQ ID NO: 9460587 - DNA, 22 bp, Homo sapiens
cccaaggctgcagtgagcatga

SEQ ID NO: 9460588 - DNA, 21 bp, Homo sapiens
cccaagggaggcaggataagg

SEQ ID NO: 9460589 - DNA, 22 bp, Homo sapiens
cccaagggagtgcctggtcaac

SEQ ID NO: 9460590 - DNA, 22 bp, Homo sapiens
cccaaggctgcagtgagcatga

SEQ ID NO: 9460591 - DNA, 22 bp, Homo sapiens
cccaaggctgcagtgagcatga

SEQ ID NO: 9460592 - DNA, 22 bp, Homo sapiens
cccaaggctgcagtgagcatga

SEQ ID NO: 9460593 - DNA, 22 bp, Homo sapiens
cccaaggccttcaagccagctc

SEQ ID NO: 9460594 - DNA, 22 bp, Homo sapiens
cccaaggccttcaagccagctc

SEQ ID NO: 9460595 - DNA, 22 bp, Homo sapiens
cccaaggccttcaagccagctc

SEQ ID NO: 9460596 - DNA, 22 bp, Homo sapiens
cccaaggccttcaagccagctc

SEQ ID NO: 9460597 - DNA, 19 bp, Homo sapiens
cccaaggccctgggcaggc

SEQ ID NO: 9460598 - DNA, 19 bp, Homo sapiens
cccaaggccctgggcaggc

SEQ ID NO: 9460599 - DNA, 19 bp, Homo sapiens
cccaaggccctgggcaggc

SEQ ID NO: 9460600 - DNA, 22 bp, Homo sapiens
cccaaggcatggcatggtggca

SEQ ID NO: 9460601 - DNA, 22 bp, Homo sapiens
tgcagggccttgggatgtgtcc

SEQ ID NO: 9460602 - DNA, 22 bp, Homo sapiens
tgcagggccttgttgatgtgct

SEQ ID NO: 9460603 - DNA, 22 bp, Homo sapiens
tgcagggccgctggaggtcatg

SEQ ID NO: 9460604 - DNA, 22 bp, Homo sapiens
tgcagggatcctagctgaagag

SEQ ID NO: 9460605 - DNA, 22 bp, Homo sapiens
tgcagggatcctagctgaagag

SEQ ID NO: 9460606 - DNA, 22 bp, Homo sapiens
tgcagggatcctagctgaagag

SEQ ID NO: 9460607 - DNA, 22 bp, Homo sapiens
tgcagggccttctagaccatgg

SEQ ID NO: 9460608 - DNA, 22 bp, Homo sapiens
tgcagggatcctagctgaagag

SEQ ID NO: 9460609 - DNA, 22 bp, Homo sapiens
cccagcaggtcggtgctgcctg

SEQ ID NO: 9460610 - DNA, 22 bp, Homo sapiens
cccagcaggtcggtgctgcctg

SEQ ID NO: 9460611 - DNA, 22 bp, Homo sapiens
cccagcaggtcggtgctgcctg

SEQ ID NO: 9460612 - DNA, 22 bp, Homo sapiens
cccagcagggtctctgtgtcta

SEQ ID NO: 9460613 - DNA, 22 bp, Homo sapiens
cccagcagggtctctgtgtcta

SEQ ID NO: 9460614 - DNA, 22 bp, Homo sapiens
cccagcagggtctctgtgtcta

SEQ ID NO: 9460615 - DNA, 22 bp, Homo sapiens
cccagcagggtctctgtgtcta

SEQ ID NO: 9460616 - DNA, 22 bp, Homo sapiens
cccagcaggcatgttgggagga

SEQ ID NO: 9460617 - DNA, 22 bp, Homo sapiens
cccagcaggcatgttgggagga

SEQ ID NO: 9460618 - DNA, 22 bp, Homo sapiens
cccagcaggcatgttgggagga

SEQ ID NO: 9460619 - DNA, 22 bp, Homo sapiens
cccagcaggcatgttgggagga

SEQ ID NO: 9460620 - DNA, 22 bp, Homo sapiens
cccagcagcttgcacagtgctg

SEQ ID NO: 9460621 - DNA, 22 bp, Homo sapiens
cccagcaggaggaggttgcagt

SEQ ID NO: 9460622 - DNA, 22 bp, Homo sapiens
cccagcaggaggaggttgcagt

SEQ ID NO: 9460623 - DNA, 22 bp, Homo sapiens
tgcaggcaggggatgagcagcc

SEQ ID NO: 9460624 - DNA, 22 bp, Homo sapiens
tgcaggcaggggatgagcagcc

SEQ ID NO: 9460625 - DNA, 22 bp, Homo sapiens
tgcaggcataaccgatgttgat

SEQ ID NO: 9460626 - DNA, 22 bp, Homo sapiens
tgcaggcataaccgatgttgat

SEQ ID NO: 9460627 - DNA, 22 bp, Homo sapiens
tgcaggcattggtgagagaagc

SEQ ID NO: 9460628 - DNA, 22 bp, Homo sapiens
tgcaggcagggccagcgtgagg

SEQ ID NO: 9460629 - DNA, 22 bp, Homo sapiens
tgcaggcaggggatgagcagcc

SEQ ID NO: 9460630 - DNA, 21 bp, Homo sapiens
tgcaggcaggcagagatgctg

SEQ ID NO: 9460631 - DNA, 21 bp, Homo sapiens
tgcaggcaggcagagatgctg

SEQ ID NO: 9460632 - DNA, 22 bp, Homo sapiens
tgcaggccagggtagggactag

SEQ ID NO: 9460633 - DNA, 22 bp, Homo sapiens
tgcaggccagggtagggactag

SEQ ID NO: 9460634 - DNA, 22 bp, Homo sapiens
tgcaggccggccctaggcctca

SEQ ID NO: 9460635 - DNA, 22 bp, Homo sapiens
tgcaggcccagtgtagaggctc

SEQ ID NO: 9460636 - DNA, 22 bp, Homo sapiens
tgcaggcccagtgtagaggctc

SEQ ID NO: 9460637 - DNA, 22 bp, Homo sapiens
tgcaggcctatggtggggcccc

SEQ ID NO: 9460638 - DNA, 22 bp, Homo sapiens
tgcaggccggccctaggcctca

SEQ ID NO: 9460639 - DNA, 22 bp, Homo sapiens
tgcaggcctatggtggggcccc

SEQ ID NO: 9460640 - DNA, 22 bp, Homo sapiens
tgcaggcctcacacctggcacc

SEQ ID NO: 9460641 - DNA, 22 bp, Homo sapiens
cccagcagcttgcacagtgctg

SEQ ID NO: 9460642 - DNA, 22 bp, Homo sapiens
cccagcagcttgcacagtgctg

SEQ ID NO: 9460643 - DNA, 22 bp, Homo sapiens
cccagcagcttgcacagtgctg

SEQ ID NO: 9460644 - DNA, 22 bp, Homo sapiens
cccagcagccttgtcccttctc

SEQ ID NO: 9460645 - DNA, 22 bp, Homo sapiens
cccagcagccttgtcccttctc

SEQ ID NO: 9460646 - DNA, 22 bp, Homo sapiens
cccagcagcctggatgttcttt

SEQ ID NO: 9460647 - DNA, 22 bp, Homo sapiens
cccagcagcctggatgttcttt

SEQ ID NO: 9460648 - DNA, 22 bp, Homo sapiens
cccagaggctgagttgggagca

SEQ ID NO: 9460649 - DNA, 22 bp, Homo sapiens
cccagagggaagggaatgaggt

SEQ ID NO: 9460650 - DNA, 22 bp, Homo sapiens
cccagaggctgagttgggagca

SEQ ID NO: 9460651 - DNA, 22 bp, Homo sapiens
cccagaggctgagttgggagca

SEQ ID NO: 9460652 - DNA, 22 bp, Homo sapiens
cccagaggaggatctcggcccg

SEQ ID NO: 9460653 - DNA, 22 bp, Homo sapiens
cccagaggaggatctcggcccg

SEQ ID NO: 9460654 - DNA, 22 bp, Homo sapiens
cccagagggctgaggatatgaa

SEQ ID NO: 9460655 - DNA, 22 bp, Homo sapiens
cccagaggggtcgtctgagggg

SEQ ID NO: 9460656 - DNA, 22 bp, Homo sapiens
cccagaggggtcgtctgagggg

SEQ ID NO: 9460657 - DNA, 22 bp, Homo sapiens
cccagaggggtcgtctgagggg

SEQ ID NO: 9460658 - DNA, 22 bp, Homo sapiens
cccagagggctgaggatatgaa

SEQ ID NO: 9460659 - DNA, 22 bp, Homo sapiens
cccagagggctgaggatatgaa

SEQ ID NO: 9460660 - DNA, 22 bp, Homo sapiens
cccagagggaagggaatgaggt

SEQ ID NO: 9460661 - DNA, 22 bp, Homo sapiens
cccagagggaagggaatgaggt

SEQ ID NO: 9460662 - DNA, 22 bp, Homo sapiens
cccagagggaagggaatgaggt

SEQ ID NO: 9460663 - DNA, 22 bp, Homo sapiens
tgcagctgattaaagggcagac

SEQ ID NO: 9460664 - DNA, 22 bp, Homo sapiens
tgcagctgattaaagggcagac

SEQ ID NO: 9460665 - DNA, 22 bp, Homo sapiens
cccagagggtggaggttgcagt

SEQ ID NO: 9460666 - DNA, 22 bp, Homo sapiens
tgcagccaccacctctgctgaa

SEQ ID NO: 9460667 - DNA, 22 bp, Homo sapiens
tgcagctgattaaagggcagac

SEQ ID NO: 9460668 - DNA, 22 bp, Homo sapiens
tgcagctgcaagtccaggtcag

SEQ ID NO: 9460669 - DNA, 22 bp, Homo sapiens
tgcagctgcaagtccaggtcag

SEQ ID NO: 9460670 - DNA, 22 bp, Homo sapiens
tgcagctgattaaagggcagac

SEQ ID NO: 9460671 - DNA, 20 bp, Homo sapiens
tgcagctgcaggagggtggg

SEQ ID NO: 9460672 - DNA, 20 bp, Homo sapiens
tgcagctgcaggagggtggg

SEQ ID NO: 9460673 - DNA, 20 bp, Homo sapiens
tgcagctgcaggagggtggg

SEQ ID NO: 9460674 - DNA, 20 bp, Homo sapiens
tgcagctgcaggagggtggg

SEQ ID NO: 9460675 - DNA, 22 bp, Homo sapiens
tgcagctgcaagtccaggtcag

SEQ ID NO: 9460676 - DNA, 22 bp, Homo sapiens
tgcaggaatagctacagagctg

SEQ ID NO: 9460677 - DNA, 22 bp, Homo sapiens
tgcaggaagtttcctgaacttt

SEQ ID NO: 9460678 - DNA, 22 bp, Homo sapiens
tgcagctgctcattctctcagt

SEQ ID NO: 9460679 - DNA, 22 bp, Homo sapiens
tgcagctgctcattctctcagt

SEQ ID NO: 9460680 - DNA, 21 bp, Homo sapiens
tgcaggaagtatggtgcctat

SEQ ID NO: 9460681 - DNA, 22 bp, Homo sapiens
tgcaggaatattgatgaactta

SEQ ID NO: 9460682 - DNA, 22 bp, Homo sapiens
tgcaggaatagctacagagctg

SEQ ID NO: 9460683 - DNA, 22 bp, Homo sapiens
tgcagctgcctccttcccttgt

SEQ ID NO: 9460684 - DNA, 22 bp, Homo sapiens
tgcagctgcctagggctggctt

SEQ ID NO: 9460685 - DNA, 22 bp, Homo sapiens
tgcagctgcctagggctggctt

SEQ ID NO: 9460686 - DNA, 22 bp, Homo sapiens
tgcagctgcctagggctggctt

SEQ ID NO: 9460687 - DNA, 23 bp, Homo sapiens
tgcagctgcctctggcgggccgg

SEQ ID NO: 9460688 - DNA, 23 bp, Homo sapiens
tgcagctgcctctggcgggccgg

SEQ ID NO: 9460689 - DNA, 23 bp, Homo sapiens
tgcagctgcctctggcgggccgg

SEQ ID NO: 9460690 - DNA, 22 bp, Homo sapiens
tgcagctgcctagggctggctt

SEQ ID NO: 9460691 - DNA, 22 bp, Homo sapiens
tgcagctgcaggagggtgggag

SEQ ID NO: 9460692 - DNA, 22 bp, Homo sapiens
tgcagctgcaggagggtgggag

SEQ ID NO: 9460693 - DNA, 22 bp, Homo sapiens
tgcagctgcaggagggtgggag

SEQ ID NO: 9460694 - DNA, 22 bp, Homo sapiens
tgcaggactcaagggtagcagg

SEQ ID NO: 9460695 - DNA, 22 bp, Homo sapiens
tgcaggacttcaggactctgag

SEQ ID NO: 9460696 - DNA, 22 bp, Homo sapiens
tgcaggactggggagcggaagg

SEQ ID NO: 9460697 - DNA, 22 bp, Homo sapiens
tgcaggaccttgatcctggact

SEQ ID NO: 9460698 - DNA, 22 bp, Homo sapiens
tgcaggacattagttatgaatt

SEQ ID NO: 9460699 - DNA, 22 bp, Homo sapiens
tgcaggacagtttggaagagag

SEQ ID NO: 9460700 - DNA, 22 bp, Homo sapiens
tgcaggaatattgatgaactta

SEQ ID NO: 9460701 - DNA, 22 bp, Homo sapiens
tgcaggaatattgatgaactta

SEQ ID NO: 9460702 - DNA, 22 bp, Homo sapiens
tgcaggaatcagaggggaagcg

SEQ ID NO: 9460703 - DNA, 22 bp, Homo sapiens
tgcaggaatgaggttctcagtt

SEQ ID NO: 9460704 - DNA, 22 bp, Homo sapiens
tgcaggaattttttgcagaaag

SEQ ID NO: 9460705 - DNA, 22 bp, Homo sapiens
tgcaggaattttttgcagaaag

SEQ ID NO: 9460706 - DNA, 22 bp, Homo sapiens
tgcaggaattttttgcagaaag

SEQ ID NO: 9460707 - DNA, 20 bp, Homo sapiens
tgcaggaatttgcattcctt

SEQ ID NO: 9460708 - DNA, 22 bp, Homo sapiens
tgcaggaattttttgcagaaag

SEQ ID NO: 9460709 - DNA, 17 bp, Homo sapiens
ccaggtgggaggtgggg

SEQ ID NO: 9460710 - DNA, 17 bp, Homo sapiens
ccaggtgggaggtgggg

SEQ ID NO: 9460711 - DNA, 22 bp, Homo sapiens
ccaggtgggaggaaagcagaga

SEQ ID NO: 9460712 - DNA, 22 bp, Homo sapiens
ccaggtggaggtgtgaggtcct

SEQ ID NO: 9460713 - DNA, 22 bp, Homo sapiens
ccaggtggaggtgtgaggtcct

SEQ ID NO: 9460714 - DNA, 22 bp, Homo sapiens
ccagtcactggaaaatgggaat

SEQ ID NO: 9460715 - DNA, 22 bp, Homo sapiens
ccaggtgtgtcaccattgccca

SEQ ID NO: 9460716 - DNA, 22 bp, Homo sapiens
ccagtcagccaagctgcagcgg

SEQ ID NO: 9460717 - DNA, 22 bp, Homo sapiens
ccagtcagagaaaatgtccact

SEQ ID NO: 9460718 - DNA, 22 bp, Homo sapiens
ccagtcagggcaggagcctggt

SEQ ID NO: 9460719 - DNA, 20 bp, Homo sapiens
ccagtccacctgagacatgt

SEQ ID NO: 9460720 - DNA, 22 bp, Homo sapiens
ccagtccacgtcaagaagaggt

SEQ ID NO: 9460721 - DNA, 22 bp, Homo sapiens
ccagtccacgtcaagaagaggt

SEQ ID NO: 9460722 - DNA, 22 bp, Homo sapiens
ccagtccacgtcaagaagaggt

SEQ ID NO: 9460723 - DNA, 22 bp, Homo sapiens
ccagtccacgtcaagaagaggt

SEQ ID NO: 9460724 - DNA, 22 bp, Homo sapiens
ccagtccatatttatactgccg

SEQ ID NO: 9460725 - DNA, 22 bp, Homo sapiens
ccagtccatatttatactgccg

SEQ ID NO: 9460726 - DNA, 22 bp, Homo sapiens
ccagtccagtgccatgcatggc

SEQ ID NO: 9460727 - DNA, 22 bp, Homo sapiens
ccagtccagtgccatgcatggc

SEQ ID NO: 9460728 - DNA, 22 bp, Homo sapiens
ccagggctgctcattggctggt

SEQ ID NO: 9460729 - DNA, 22 bp, Homo sapiens
ccagggctgcctggccgtgtgt

SEQ ID NO: 9460730 - DNA, 22 bp, Homo sapiens
ccagggctgcctggccgtgtgt

SEQ ID NO: 9460731 - DNA, 22 bp, Homo sapiens
ccagggctgctcattggctggt

SEQ ID NO: 9460732 - DNA, 22 bp, Homo sapiens
ccagggctgctgggggagttga

SEQ ID NO: 9460733 - DNA, 22 bp, Homo sapiens
ccagggctgctgtgggactcca

SEQ ID NO: 9460734 - DNA, 22 bp, Homo sapiens
tgagcagagacgggggcctcca

SEQ ID NO: 9460735 - DNA, 22 bp, Homo sapiens
tgagcagggagctgggctgagc

SEQ ID NO: 9460736 - DNA, 22 bp, Homo sapiens
tgagcagggagctgggctgagc

SEQ ID NO: 9460737 - DNA, 22 bp, Homo sapiens
tgagcagtaacagctcacaggg

SEQ ID NO: 9460738 - DNA, 21 bp, Homo sapiens
tgagcaggtgcagggaagtgg

SEQ ID NO: 9460739 - DNA, 21 bp, Homo sapiens
tgagcaggtgcagggaagtgg

SEQ ID NO: 9460740 - DNA, 18 bp, Homo sapiens
tgagcaggggctgacctt

SEQ ID NO: 9460741 - DNA, 22 bp, Homo sapiens
tgagcaggtcaagactccagct

SEQ ID NO: 9460742 - DNA, 22 bp, Homo sapiens
tgagcaggtgagtctagggcag

SEQ ID NO: 9460743 - DNA, 22 bp, Homo sapiens
tgagcaggtgagtctagggcag

SEQ ID NO: 9460744 - DNA, 22 bp, Homo sapiens
tgagcaggtgagtctagggcag

SEQ ID NO: 9460745 - DNA, 22 bp, Homo sapiens
tgagcaggtcaggaagtacatt

SEQ ID NO: 9460746 - DNA, 22 bp, Homo sapiens
tgagcaggtgagtctagggcag

SEQ ID NO: 9460747 - DNA, 22 bp, Homo sapiens
ccagtcccagctctgccatgct

SEQ ID NO: 9460748 - DNA, 22 bp, Homo sapiens
ccagtcccagctctgccatgct

SEQ ID NO: 9460749 - DNA, 22 bp, Homo sapiens
ccagtcccaggcagaaatccag

SEQ ID NO: 9460750 - DNA, 22 bp, Homo sapiens
ccagtcccaggcagaaatccag

SEQ ID NO: 9460751 - DNA, 19 bp, Homo sapiens
ccagtcccatacaggagat

SEQ ID NO: 9460752 - DNA, 19 bp, Homo sapiens
ccagtcccatacaggagat

SEQ ID NO: 9460753 - DNA, 19 bp, Homo sapiens
ccagtcccatacaggagat

SEQ ID NO: 9460754 - DNA, 22 bp, Homo sapiens
tgagccatgggactccaaggga

SEQ ID NO: 9460755 - DNA, 22 bp, Homo sapiens
tgagccatgggactccaaggga

SEQ ID NO: 9460756 - DNA, 22 bp, Homo sapiens
tgagccagttcttcagatccat

SEQ ID NO: 9460757 - DNA, 22 bp, Homo sapiens
tgagccagttcttcagatccat

SEQ ID NO: 9460758 - DNA, 22 bp, Homo sapiens
tgagccagtgtggtaaagctga

SEQ ID NO: 9460759 - DNA, 22 bp, Homo sapiens
tgagccagtggaagatggcagt

SEQ ID NO: 9460760 - DNA, 22 bp, Homo sapiens
tgagccagtgtggtaaagctga

SEQ ID NO: 9460761 - DNA, 22 bp, Homo sapiens
tgagccagtggaagatggcagt

SEQ ID NO: 9460762 - DNA, 22 bp, Homo sapiens
ccagtgcaggtgagcaccaggt

SEQ ID NO: 9460763 - DNA, 22 bp, Homo sapiens
ccagtctgcagcccctggggac

SEQ ID NO: 9460764 - DNA, 22 bp, Homo sapiens
ccagtgcaggtgagcaccaggt

SEQ ID NO: 9460765 - DNA, 22 bp, Homo sapiens
ccagtgcagtccccctgaactg

SEQ ID NO: 9460766 - DNA, 22 bp, Homo sapiens
ccagtctgaggcctggtgaggg

SEQ ID NO: 9460767 - DNA, 22 bp, Homo sapiens
tgagcccagcgtcccgttctgt

SEQ ID NO: 9460768 - DNA, 22 bp, Homo sapiens
tgagcccaggagtatgaggctg

SEQ ID NO: 9460769 - DNA, 22 bp, Homo sapiens
tgagcccagaagcccactcggc

SEQ ID NO: 9460770 - DNA, 19 bp, Homo sapiens
ccagtgccggcgctgggga

SEQ ID NO: 9460771 - DNA, 22 bp, Homo sapiens
ccagtgcccagtctccctggtc

SEQ ID NO: 9460772 - DNA, 22 bp, Homo sapiens
ccagtgcccagtctccctggtc

SEQ ID NO: 9460773 - DNA, 22 bp, Homo sapiens
ccagtgcctatctcctctggga

SEQ ID NO: 9460774 - DNA, 22 bp, Homo sapiens
ccagtgcctatccttctcctgt

SEQ ID NO: 9460775 - DNA, 17 bp, Homo sapiens
ccagtgcctgtggcaac

SEQ ID NO: 9460776 - DNA, 22 bp, Homo sapiens
ccagtgcctatctcctctggga

SEQ ID NO: 9460777 - DNA, 22 bp, Homo sapiens
ccagtgcctgtgggcatggtgc

SEQ ID NO: 9460778 - DNA, 22 bp, Homo sapiens
ccagtgcctgtgggcatggtgc

SEQ ID NO: 9460779 - DNA, 22 bp, Homo sapiens
ccagtgcattgccgtgtctagg

SEQ ID NO: 9460780 - DNA, 22 bp, Homo sapiens
ccagtgcattgccgtgtctagg

SEQ ID NO: 9460781 - DNA, 22 bp, Homo sapiens
ccagtgcccagctgcccaggca

SEQ ID NO: 9460782 - DNA, 22 bp, Homo sapiens
ccagtgcagtccccctgaactg

SEQ ID NO: 9460783 - DNA, 22 bp, Homo sapiens
ccagtgcagtccccctgaactg

SEQ ID NO: 9460784 - DNA, 22 bp, Homo sapiens
ccagtgcataatcaatacagcc

SEQ ID NO: 9460785 - DNA, 22 bp, Homo sapiens
ccagtgcaggtgagcaccaggt

SEQ ID NO: 9460786 - DNA, 22 bp, Homo sapiens
ccagtgcccagctgcccaggca

SEQ ID NO: 9460787 - DNA, 22 bp, Homo sapiens
ccagtgcccagctgcccaggca

SEQ ID NO: 9460788 - DNA, 22 bp, Homo sapiens
ccagtgcccagtctccctggtc

SEQ ID NO: 9460789 - DNA, 22 bp, Homo sapiens
ccagtggaaatgtggtcaggat

SEQ ID NO: 9460790 - DNA, 22 bp, Homo sapiens
ccagtggacaatttctgaggaa

SEQ ID NO: 9460791 - DNA, 22 bp, Homo sapiens
ccagtggaattaaaaataagtg

SEQ ID NO: 9460792 - DNA, 22 bp, Homo sapiens
ccagtggacttctccctgtggt

SEQ ID NO: 9460793 - DNA, 22 bp, Homo sapiens
ccagtggccatgcacgagcagc

SEQ ID NO: 9460794 - DNA, 22 bp, Homo sapiens
ccagtggagtttttatacccag

SEQ ID NO: 9460795 - DNA, 22 bp, Homo sapiens
tgaggcagtgctgggaagcctg

SEQ ID NO: 9460796 - DNA, 22 bp, Homo sapiens
tgaggcagtgctgggaagcctg

SEQ ID NO: 9460797 - DNA, 22 bp, Homo sapiens
tgaggcagtgctgggaagcctg

SEQ ID NO: 9460798 - DNA, 22 bp, Homo sapiens
tgataaacagctgatgaagacc

SEQ ID NO: 9460799 - DNA, 22 bp, Homo sapiens
tgataaatccatgtaaatggta

SEQ ID NO: 9460800 - DNA, 22 bp, Homo sapiens
tgataaatccatgtaaatggta

SEQ ID NO: 9460801 - DNA, 22 bp, Homo sapiens
tgataaatccatgtaaatggta

SEQ ID NO: 9460802 - DNA, 22 bp, Homo sapiens
tgataaacagctgatgaagacc

SEQ ID NO: 9460803 - DNA, 22 bp, Homo sapiens
tgataaacattttaggaactaa

SEQ ID NO: 9460804 - DNA, 22 bp, Homo sapiens
tgagttgctatctagatccaga

SEQ ID NO: 9460805 - DNA, 22 bp, Homo sapiens
tgagttctgactgtgatgccag

SEQ ID NO: 9460806 - DNA, 22 bp, Homo sapiens
tgagtcctgctctgggcagggt

SEQ ID NO: 9460807 - DNA, 22 bp, Homo sapiens
tgagtcctggctttgggatgta

SEQ ID NO: 9460808 - DNA, 22 bp, Homo sapiens
tgagtccatagtggatccttca

SEQ ID NO: 9460809 - DNA, 22 bp, Homo sapiens
tgagtccatagtggatccttca

SEQ ID NO: 9460810 - DNA, 22 bp, Homo sapiens
tgagtctcggtttcccctccaa

SEQ ID NO: 9460811 - DNA, 22 bp, Homo sapiens
tgagtctcccagcgttaaacct

SEQ ID NO: 9460812 - DNA, 21 bp, Homo sapiens
tgagtctctcagcttcaggta

SEQ ID NO: 9460813 - DNA, 21 bp, Homo sapiens
tgagtctctcagcttcaggta

SEQ ID NO: 9460814 - DNA, 22 bp, Homo sapiens
tgagtctgatttttctagcatt

SEQ ID NO: 9460815 - DNA, 22 bp, Homo sapiens
tgagtctgctcctggtagcaga

SEQ ID NO: 9460816 - DNA, 22 bp, Homo sapiens
ccatccctcctccaccagctag

SEQ ID NO: 9460817 - DNA, 22 bp, Homo sapiens
ccatccctgagtcacaggaggg

SEQ ID NO: 9460818 - DNA, 22 bp, Homo sapiens
ccatcctgaatggtctcagcca

SEQ ID NO: 9460819 - DNA, 22 bp, Homo sapiens
ccatcccttctctggccagcag

SEQ ID NO: 9460820 - DNA, 22 bp, Homo sapiens
ccatcccttctctggccagcag

SEQ ID NO: 9460821 - DNA, 22 bp, Homo sapiens
ccatccatgtggcagggctggc

SEQ ID NO: 9460822 - DNA, 22 bp, Homo sapiens
ccatccaggctgtgggtgagct

SEQ ID NO: 9460823 - DNA, 22 bp, Homo sapiens
ccatccaggctgtgggtgagct

SEQ ID NO: 9460824 - DNA, 22 bp, Homo sapiens
tgagtcagtctgccctggcttc

SEQ ID NO: 9460825 - DNA, 20 bp, Homo sapiens
tgagtcagctgcatgggtgg

SEQ ID NO: 9460826 - DNA, 22 bp, Homo sapiens
tgaggtcctgcatgttgaggtc

SEQ ID NO: 9460827 - DNA, 22 bp, Homo sapiens
ccatcctgcaggacctccatat

SEQ ID NO: 9460828 - DNA, 22 bp, Homo sapiens
tgaggtcccaggggtagtgtgc

SEQ ID NO: 9460829 - DNA, 22 bp, Homo sapiens
tgagtccaggtgcttacctgga

SEQ ID NO: 9460830 - DNA, 22 bp, Homo sapiens
tgagtccagatgggccagcagg

SEQ ID NO: 9460831 - DNA, 22 bp, Homo sapiens
tgagtccagatgggccagcagg

SEQ ID NO: 9460832 - DNA, 22 bp, Homo sapiens
tgagtccagatgggccagcagg

SEQ ID NO: 9460833 - DNA, 22 bp, Homo sapiens
tgaggccaggcaaaggcgatct

SEQ ID NO: 9460834 - DNA, 22 bp, Homo sapiens
tgaggccagggattccatcatt

SEQ ID NO: 9460835 - DNA, 22 bp, Homo sapiens
tgaggccagggattccatcatt

SEQ ID NO: 9460836 - DNA, 22 bp, Homo sapiens
tgaggccagtctcatcacaggc

SEQ ID NO: 9460837 - DNA, 22 bp, Homo sapiens
tgaggccagtctcatcacaggc

SEQ ID NO: 9460838 - DNA, 22 bp, Homo sapiens
tgaggccagtgacatatattaa

SEQ ID NO: 9460839 - DNA, 22 bp, Homo sapiens
tgaggccagtctcatcacaggc

SEQ ID NO: 9460840 - DNA, 22 bp, Homo sapiens
tgaggccatgcccgtgccggcc

SEQ ID NO: 9460841 - DNA, 17 bp, Homo sapiens
tgaggccatggcaccat

SEQ ID NO: 9460842 - DNA, 17 bp, Homo sapiens
tgaggccatggcaccat

SEQ ID NO: 9460843 - DNA, 17 bp, Homo sapiens
tgaggccatggcaccat

SEQ ID NO: 9460844 - DNA, 22 bp, Homo sapiens
tgaggccatggtcttcccagtc

SEQ ID NO: 9460845 - DNA, 20 bp, Homo sapiens
tgaggcccagcagagtcggg

SEQ ID NO: 9460846 - DNA, 22 bp, Homo sapiens
tgaggccatggtcttcccagtc

SEQ ID NO: 9460847 - DNA, 22 bp, Homo sapiens
tgaggccatggaactagcttgg

SEQ ID NO: 9460848 - DNA, 22 bp, Homo sapiens
tgaggccatggaactagcttgg

SEQ ID NO: 9460849 - DNA, 22 bp, Homo sapiens
tgaggccatgcccgtgccggcc

SEQ ID NO: 9460850 - DNA, 22 bp, Homo sapiens
tgaggcccaccttggccccggc

SEQ ID NO: 9460851 - DNA, 22 bp, Homo sapiens
tgaggcccagccgccctgagag

SEQ ID NO: 9460852 - DNA, 22 bp, Homo sapiens
tgaggcccagccgccctgagag

SEQ ID NO: 9460853 - DNA, 22 bp, Homo sapiens
tgaggctgaaactggcgataga

SEQ ID NO: 9460854 - DNA, 18 bp, Homo sapiens
tgaggctgaatatggggc

SEQ ID NO: 9460855 - DNA, 22 bp, Homo sapiens
ccatcagttctcagaccacact

SEQ ID NO: 9460856 - DNA, 23 bp, Homo sapiens
ccatcaggcctccgtgtccagcc

SEQ ID NO: 9460857 - DNA, 22 bp, Homo sapiens
ccatcagctccagtatcttctg

SEQ ID NO: 9460858 - DNA, 22 bp, Homo sapiens
ccatcagctccagtatcttctg

SEQ ID NO: 9460859 - DNA, 22 bp, Homo sapiens
ccatcagcatgggagcatgggc

SEQ ID NO: 9460860 - DNA, 22 bp, Homo sapiens
ccatccagaagggtttgaaaga

SEQ ID NO: 9460861 - DNA, 22 bp, Homo sapiens
ccatccagaaacttccatcccc

SEQ ID NO: 9460862 - DNA, 21 bp, Homo sapiens
ccatccactgagtggttccct

SEQ ID NO: 9460863 - DNA, 22 bp, Homo sapiens
ccatccagaaacttccatcccc

SEQ ID NO: 9460864 - DNA, 22 bp, Homo sapiens
ccatcaatgactaataaaatag

SEQ ID NO: 9460865 - DNA, 22 bp, Homo sapiens
ccatcagacaattctttctctt

SEQ ID NO: 9460866 - DNA, 22 bp, Homo sapiens
ccatcacagtccccatcgtgat

SEQ ID NO: 9460867 - DNA, 22 bp, Homo sapiens
ccatcacagtccccatcgtgat

SEQ ID NO: 9460868 - DNA, 18 bp, Homo sapiens
tgaggctgagggtagagg

SEQ ID NO: 9460869 - DNA, 22 bp, Homo sapiens
ccagtgttttcatcctcccttg

SEQ ID NO: 9460870 - DNA, 22 bp, Homo sapiens
tgaggctgagatatcagggagg

SEQ ID NO: 9460871 - DNA, 22 bp, Homo sapiens
tgaggctgagatatcagggagg

SEQ ID NO: 9460872 - DNA, 22 bp, Homo sapiens
tgaggctgagatatcagggagg

SEQ ID NO: 9460873 - DNA, 22 bp, Homo sapiens
tgaggctgagatatcagggagg

SEQ ID NO: 9460874 - DNA, 22 bp, Homo sapiens
ccatagtgaattgtctcagacg

SEQ ID NO: 9460875 - DNA, 22 bp, Homo sapiens
ccatagtgaattgtctcagacg

SEQ ID NO: 9460876 - DNA, 19 bp, Homo sapiens
ccatataaccagcaagtgt

SEQ ID NO: 9460877 - DNA, 22 bp, Homo sapiens
ccatacacacaccaaatttgta

SEQ ID NO: 9460878 - DNA, 22 bp, Homo sapiens
ccatacacacaccaaatttgta

SEQ ID NO: 9460879 - DNA, 21 bp, Homo sapiens
ccataattttgtttcagaagt

SEQ ID NO: 9460880 - DNA, 22 bp, Homo sapiens
gaagggctgcaggtctgggccc

SEQ ID NO: 9460881 - DNA, 22 bp, Homo sapiens
gaagggggaaaatgacaacaga

SEQ ID NO: 9460882 - DNA, 22 bp, Homo sapiens
gaaggggactggcagctgcaga

SEQ ID NO: 9460883 - DNA, 22 bp, Homo sapiens
gaaggggaaagttgagcaaata

SEQ ID NO: 9460884 - DNA, 22 bp, Homo sapiens
gaaggggaaagttgagcaaata

SEQ ID NO: 9460885 - DNA, 22 bp, Homo sapiens
gaagggtgtgatttgcctgaga

SEQ ID NO: 9460886 - DNA, 22 bp, Homo sapiens
gaagggtgtgtgtgagggacac

SEQ ID NO: 9460887 - DNA, 22 bp, Homo sapiens
gaagggtgcatggagggaagtc

SEQ ID NO: 9460888 - DNA, 22 bp, Homo sapiens
gaagggtgcatggagggaagtc

SEQ ID NO: 9460889 - DNA, 22 bp, Homo sapiens
gaagggtgcatggagggaagtc

SEQ ID NO: 9460890 - DNA, 22 bp, Homo sapiens
gaagggtgcatggagggaagtc

SEQ ID NO: 9460891 - DNA, 22 bp, Homo sapiens
gaagggtgcatggagggaagtc

SEQ ID NO: 9460892 - DNA, 22 bp, Homo sapiens
gaagggtgcatggagggaagtc

SEQ ID NO: 9460893 - DNA, 22 bp, Homo sapiens
gaagggggttgcagtctagggt

SEQ ID NO: 9460894 - DNA, 22 bp, Homo sapiens
gaagggtgcatggagggaagtc

SEQ ID NO: 9460895 - DNA, 22 bp, Homo sapiens
gaagggggttgcagtctagggt

SEQ ID NO: 9460896 - DNA, 22 bp, Homo sapiens
gaaggtggcgagcggattgctg

SEQ ID NO: 9460897 - DNA, 22 bp, Homo sapiens
gaaggtgcagtggctggaggct

SEQ ID NO: 9460898 - DNA, 22 bp, Homo sapiens
gaaggtgcaggcaaggttggtt

SEQ ID NO: 9460899 - DNA, 22 bp, Homo sapiens
gaaggtggcgagcggattgctg

SEQ ID NO: 9460900 - DNA, 22 bp, Homo sapiens
gaagggtgtgtgtgagggacac

SEQ ID NO: 9460901 - DNA, 22 bp, Homo sapiens
gaagggtgtgtgtgagggacac

SEQ ID NO: 9460902 - DNA, 22 bp, Homo sapiens
gaatatttgtaattactgttga

SEQ ID NO: 9460903 - DNA, 22 bp, Homo sapiens
gaatatttgtaattactgttga

SEQ ID NO: 9460904 - DNA, 22 bp, Homo sapiens
gaatatttgtaattactgttga

SEQ ID NO: 9460905 - DNA, 22 bp, Homo sapiens
gaatatttgtaattactgttga

SEQ ID NO: 9460906 - DNA, 22 bp, Homo sapiens
gaatatttgtaattactgttga

SEQ ID NO: 9460907 - DNA, 22 bp, Homo sapiens
gaatctcagtggaagcaggaag

SEQ ID NO: 9460908 - DNA, 22 bp, Homo sapiens
gaatctcattctaactagtagg

SEQ ID NO: 9460909 - DNA, 20 bp, Homo sapiens
gaatctttccccatgcaatg

SEQ ID NO: 9460910 - DNA, 22 bp, Homo sapiens
gaatcttatttttaaatcttcc

SEQ ID NO: 9460911 - DNA, 20 bp, Homo sapiens
gaatcttactacattctctc

SEQ ID NO: 9460912 - DNA, 22 bp, Homo sapiens
gaatcttacctctctattgttg

SEQ ID NO: 9460913 - DNA, 22 bp, Homo sapiens
gaatcttaaatcggaatcttaa

SEQ ID NO: 9460914 - DNA, 22 bp, Homo sapiens
gaatctcaggaagatctctgca

SEQ ID NO: 9460915 - DNA, 22 bp, Homo sapiens
gaatctcaggggagttactgga

SEQ ID NO: 9460916 - DNA, 22 bp, Homo sapiens
gaatctatgcctcatatagacc

SEQ ID NO: 9460917 - DNA, 22 bp, Homo sapiens
gaatccttggttttaagcaata

SEQ ID NO: 9460918 - DNA, 17 bp, Homo sapiens
gaatccttctctgttct

SEQ ID NO: 9460919 - DNA, 22 bp, Homo sapiens
gaatcccttgcattatcccttt

SEQ ID NO: 9460920 - DNA, 22 bp, Homo sapiens
gaatcccaatctgttattgaca

SEQ ID NO: 9460921 - DNA, 22 bp, Homo sapiens
gaatcccttgcaagttgttgta

SEQ ID NO: 9460922 - DNA, 22 bp, Homo sapiens
gaatcccttgcaagttgttgta

SEQ ID NO: 9460923 - DNA, 22 bp, Homo sapiens
gacagacaaatgtttttaactt

SEQ ID NO: 9460924 - DNA, 22 bp, Homo sapiens
gacagacacctggggggttgct

SEQ ID NO: 9460925 - DNA, 22 bp, Homo sapiens
gacactttaggatttaaaagtc

SEQ ID NO: 9460926 - DNA, 22 bp, Homo sapiens
gacagaaggcatctagggcacg

SEQ ID NO: 9460927 - DNA, 22 bp, Homo sapiens
gacagaaggcatctagggcacg

SEQ ID NO: 9460928 - DNA, 22 bp, Homo sapiens
gacagacagagaatgggcttga

SEQ ID NO: 9460929 - DNA, 22 bp, Homo sapiens
gacagacactgtgtcctcactt

SEQ ID NO: 9460930 - DNA, 22 bp, Homo sapiens
gacagacactgtgtcctcactt

SEQ ID NO: 9460931 - DNA, 22 bp, Homo sapiens
gacagacactgtgtcctcactt

SEQ ID NO: 9460932 - DNA, 22 bp, Homo sapiens
gacagacactattggtatgcct

SEQ ID NO: 9460933 - DNA, 22 bp, Homo sapiens
gacagacactattggtatgcct

SEQ ID NO: 9460934 - DNA, 22 bp, Homo sapiens
gacagacaggagctcacaggca

SEQ ID NO: 9460935 - DNA, 22 bp, Homo sapiens
gacagacaggtgtggtaggcac

SEQ ID NO: 9460936 - DNA, 22 bp, Homo sapiens
gacagacaggtgtggtaggcac

SEQ ID NO: 9460937 - DNA, 22 bp, Homo sapiens
gacagacaggtgtggtaggcac

SEQ ID NO: 9460938 - DNA, 22 bp, Homo sapiens
gacagacaggggttctcctgga

SEQ ID NO: 9460939 - DNA, 22 bp, Homo sapiens
gacagacaggaggccacctgct

SEQ ID NO: 9460940 - DNA, 22 bp, Homo sapiens
gacactgtgctagctgggctta

SEQ ID NO: 9460941 - DNA, 22 bp, Homo sapiens
gacactgtcccacagaattcga

SEQ ID NO: 9460942 - DNA, 22 bp, Homo sapiens
gacactggaaatattgaattgg

SEQ ID NO: 9460943 - DNA, 21 bp, Homo sapiens
gacactgcttactctgaccta

SEQ ID NO: 9460944 - DNA, 22 bp, Homo sapiens
gacactgcacttggggcccaca

SEQ ID NO: 9460945 - DNA, 22 bp, Homo sapiens
gacactggatttctagaaatgt

SEQ ID NO: 9460946 - DNA, 22 bp, Homo sapiens
gacactggatttctagaaatgt

SEQ ID NO: 9460947 - DNA, 22 bp, Homo sapiens
gacactggcttgtcccgccatc

SEQ ID NO: 9460948 - DNA, 22 bp, Homo sapiens
gacactgttatggtgaggtaag

SEQ ID NO: 9460949 - DNA, 22 bp, Homo sapiens
gacactgttatggtgaggtaag

SEQ ID NO: 9460950 - DNA, 22 bp, Homo sapiens
gacactttaggatttaaaagtc

SEQ ID NO: 9460951 - DNA, 22 bp, Homo sapiens
gaatgattaactagttgataca

SEQ ID NO: 9460952 - DNA, 22 bp, Homo sapiens
gaatgatatattagcagatttt

SEQ ID NO: 9460953 - DNA, 22 bp, Homo sapiens
gaatgacattgaaaagacattg

SEQ ID NO: 9460954 - DNA, 22 bp, Homo sapiens
gaatgacattgagccataacat

SEQ ID NO: 9460955 - DNA, 22 bp, Homo sapiens
gaatgacattgagccataacat

SEQ ID NO: 9460956 - DNA, 22 bp, Homo sapiens
gaatgagactatgcgagtgtga

SEQ ID NO: 9460957 - DNA, 22 bp, Homo sapiens
gaatgagactatgcgagtgtga

SEQ ID NO: 9460958 - DNA, 22 bp, Homo sapiens
gaatgagttaatatttgcttgg

SEQ ID NO: 9460959 - DNA, 22 bp, Homo sapiens
gaatgaaagatttgcattctat

SEQ ID NO: 9460960 - DNA, 22 bp, Homo sapiens
gaatgaatctgtaagtgacaag

SEQ ID NO: 9460961 - DNA, 22 bp, Homo sapiens
gaatgaagcaggtcacacagtt

SEQ ID NO: 9460962 - DNA, 22 bp, Homo sapiens
gaatgaacaaggatgttcatcc

SEQ ID NO: 9460963 - DNA, 22 bp, Homo sapiens
gaatgaacaaatgtggtggaga

SEQ ID NO: 9460964 - DNA, 22 bp, Homo sapiens
gaatgaacaaggatgttcatcc

SEQ ID NO: 9460965 - DNA, 22 bp, Homo sapiens
gaagcagcagctggggacagtt

SEQ ID NO: 9460966 - DNA, 22 bp, Homo sapiens
gaagcagccacggggagacaga

SEQ ID NO: 9460967 - DNA, 22 bp, Homo sapiens
gaagcagctagcccactagtca

SEQ ID NO: 9460968 - DNA, 22 bp, Homo sapiens
gaagcagctcagattgactgaa

SEQ ID NO: 9460969 - DNA, 22 bp, Homo sapiens
gaaaggcaggcagggtgtccat

SEQ ID NO: 9460970 - DNA, 22 bp, Homo sapiens
gaaaggcaggcagggtgtccat

SEQ ID NO: 9460971 - DNA, 22 bp, Homo sapiens
gaagcaaagagctagtgccgct

SEQ ID NO: 9460972 - DNA, 22 bp, Homo sapiens
gaagcaaaatgtctgcacatat

SEQ ID NO: 9460973 - DNA, 22 bp, Homo sapiens
gaagcaaagagctagtgccgct

SEQ ID NO: 9460974 - DNA, 22 bp, Homo sapiens
gaagcaagtgcaaggaagaggc

SEQ ID NO: 9460975 - DNA, 22 bp, Homo sapiens
gaagcaagtgcaaggaagaggc

SEQ ID NO: 9460976 - DNA, 22 bp, Homo sapiens
gaagcaagtgcaaggaagaggc

SEQ ID NO: 9460977 - DNA, 22 bp, Homo sapiens
gaagcagcagctggggacagtt

SEQ ID NO: 9460978 - DNA, 22 bp, Homo sapiens
gaagcaagtggcctgattcaga

SEQ ID NO: 9460979 - DNA, 22 bp, Homo sapiens
gaagcaagtggcctgattcaga

SEQ ID NO: 9460980 - DNA, 22 bp, Homo sapiens
gaagcaagtggcctgattcaga

SEQ ID NO: 9460981 - DNA, 20 bp, Homo sapiens
gaagcagcttcatgtagaca

SEQ ID NO: 9460982 - DNA, 22 bp, Homo sapiens
gaagcagctggtgagatggagc

SEQ ID NO: 9460983 - DNA, 22 bp, Homo sapiens
gaagcagctttctggtgaggag

SEQ ID NO: 9460984 - DNA, 22 bp, Homo sapiens
gaagcatcagcaatggctggaa

SEQ ID NO: 9460985 - DNA, 22 bp, Homo sapiens
gaagcatactttctatactgct

SEQ ID NO: 9460986 - DNA, 22 bp, Homo sapiens
gaaaggaagaaaggtcatttta

SEQ ID NO: 9460987 - DNA, 22 bp, Homo sapiens
gaaaggaagaaaggtcatttta

SEQ ID NO: 9460988 - DNA, 22 bp, Homo sapiens
gaaaggaaattgagggacgcat

SEQ ID NO: 9460989 - DNA, 22 bp, Homo sapiens
gaaaggaaatattctaagcact

SEQ ID NO: 9460990 - DNA, 22 bp, Homo sapiens
gaaaggaaattgagggacgcat

SEQ ID NO: 9460991 - DNA, 22 bp, Homo sapiens
gaaaggaacttgtgagtgggag

SEQ ID NO: 9460992 - DNA, 22 bp, Homo sapiens
gaaagcttccattttgtacatt

SEQ ID NO: 9460993 - DNA, 22 bp, Homo sapiens
gaaagcttccattttgtacatt

SEQ ID NO: 9460994 - DNA, 22 bp, Homo sapiens
gaaaggaaatattctaagcact

SEQ ID NO: 9460995 - DNA, 22 bp, Homo sapiens
gaaaggaaatattctaagcact

SEQ ID NO: 9460996 - DNA, 22 bp, Homo sapiens
gaaagctgaaccaggaaccatg

SEQ ID NO: 9460997 - DNA, 22 bp, Homo sapiens
gaaagctgggaaataaatatta

SEQ ID NO: 9460998 - DNA, 22 bp, Homo sapiens
gaaagctgaaccaggaaccatg

SEQ ID NO: 9460999 - DNA, 22 bp, Homo sapiens
gaaagctgtgaaatagtgctct

SEQ ID NO: 9461000 - DNA, 22 bp, Homo sapiens
gaaagctgtgaaatagtgctct

SEQ ID NO: 9461001 - DNA, 22 bp, Homo sapiens
gaaaggagagggttaaggagct

SEQ ID NO: 9461002 - DNA, 22 bp, Homo sapiens
gaaaggagagggttaaggagct

SEQ ID NO: 9461003 - DNA, 22 bp, Homo sapiens
gaaaggagagggttaaggagct

SEQ ID NO: 9461004 - DNA, 22 bp, Homo sapiens
gaaaggagggaaacagagcggt

SEQ ID NO: 9461005 - DNA, 22 bp, Homo sapiens
gaaaggagggaaacagagcggt

SEQ ID NO: 9461006 - DNA, 17 bp, Homo sapiens
gaaaggaggcaacactg

SEQ ID NO: 9461007 - DNA, 22 bp, Homo sapiens
gaaaggagagggttaaggagct

SEQ ID NO: 9461008 - DNA, 22 bp, Homo sapiens
gaaaggagtgaatatttgtgac

SEQ ID NO: 9461009 - DNA, 22 bp, Homo sapiens
gaaaggagggctcacaaaagtg

SEQ ID NO: 9461010 - DNA, 22 bp, Homo sapiens
gaaaggagggctcacaaaagtg

SEQ ID NO: 9461011 - DNA, 23 bp, Homo sapiens
gaagccacacaaaggtcgccaag

SEQ ID NO: 9461012 - DNA, 22 bp, Homo sapiens
gaagccacaactttttcttagc

SEQ ID NO: 9461013 - DNA, 22 bp, Homo sapiens
gaagccacagagattgtggggg

SEQ ID NO: 9461014 - DNA, 22 bp, Homo sapiens
gaagccacagagattgtggggg

SEQ ID NO: 9461015 - DNA, 22 bp, Homo sapiens
gaagccaccctccttccagccc

SEQ ID NO: 9461016 - DNA, 22 bp, Homo sapiens
gaagccaccctccttccagccc

SEQ ID NO: 9461017 - DNA, 22 bp, Homo sapiens
gaagccaccctccttccagccc

SEQ ID NO: 9461018 - DNA, 22 bp, Homo sapiens
gaagccactatagatattctaa

SEQ ID NO: 9461019 - DNA, 22 bp, Homo sapiens
gaagccacgttaaattggctgt

SEQ ID NO: 9461020 - DNA, 22 bp, Homo sapiens
gaagccacgttaaattggctgt

SEQ ID NO: 9461021 - DNA, 22 bp, Homo sapiens
gaagccactatagatattctaa

SEQ ID NO: 9461022 - DNA, 20 bp, Homo sapiens
gaagccagaggggaaaggag

SEQ ID NO: 9461023 - DNA, 16 bp, Homo sapiens
gaaggagattcagaaa

SEQ ID NO: 9461024 - DNA, 22 bp, Homo sapiens
gaaggagccgagctcttcccca

SEQ ID NO: 9461025 - DNA, 22 bp, Homo sapiens
gaaggagctaaagggagccctg

SEQ ID NO: 9461026 - DNA, 22 bp, Homo sapiens
gaaggagctaccaagactgaat

SEQ ID NO: 9461027 - DNA, 22 bp, Homo sapiens
gaaggcacagatggcagtccac

SEQ ID NO: 9461028 - DNA, 22 bp, Homo sapiens
gaaggcaaggagggaagccacc

SEQ ID NO: 9461029 - DNA, 22 bp, Homo sapiens
gaaggcacccggcgtgcggcgg

SEQ ID NO: 9461030 - DNA, 22 bp, Homo sapiens
gaaggcacccggcgtgcggcgg

SEQ ID NO: 9461031 - DNA, 22 bp, Homo sapiens
gaaggcacagatggcagtccac

SEQ ID NO: 9461032 - DNA, 22 bp, Homo sapiens
gaaggcactgaactccttctgg

SEQ ID NO: 9461033 - DNA, 22 bp, Homo sapiens
gaaggcaccctccatcactcac

SEQ ID NO: 9461034 - DNA, 22 bp, Homo sapiens
gaaggcaccctccatcactcac

SEQ ID NO: 9461035 - DNA, 22 bp, Homo sapiens
gaaggcaccctccatcactcac

SEQ ID NO: 9461036 - DNA, 22 bp, Homo sapiens
gaaggcagggaatgtggtgcta

SEQ ID NO: 9461037 - DNA, 22 bp, Homo sapiens
gaaggcagggaatgtggtgcta

SEQ ID NO: 9461038 - DNA, 22 bp, Homo sapiens
gaaggcaggtttttcaaaactg

SEQ ID NO: 9461039 - DNA, 22 bp, Homo sapiens
gaaggcaggtttttcaaaactg

SEQ ID NO: 9461040 - DNA, 22 bp, Homo sapiens
gaaggcaggcttctgattaggt

SEQ ID NO: 9461041 - DNA, 22 bp, Homo sapiens
gaaggcactgaactccttctgg

SEQ ID NO: 9461042 - DNA, 22 bp, Homo sapiens
gaaggcagggaatgtggtgcta

SEQ ID NO: 9461043 - DNA, 22 bp, Homo sapiens
gaaggcattctattctacatat

SEQ ID NO: 9461044 - DNA, 22 bp, Homo sapiens
gaaggcatttcagagatctctg

SEQ ID NO: 9461045 - DNA, 22 bp, Homo sapiens
gaaggcattttatgccttatag

SEQ ID NO: 9461046 - DNA, 22 bp, Homo sapiens
gaaggcaggtttttcaaaactg

SEQ ID NO: 9461047 - DNA, 22 bp, Homo sapiens
gaaggcagtaaatggctgtttt

SEQ ID NO: 9461048 - DNA, 22 bp, Homo sapiens
gaaggcataaaaccaattttgt

SEQ ID NO: 9461049 - DNA, 22 bp, Homo sapiens
gaaggcatctctggacttattt

SEQ ID NO: 9461050 - DNA, 22 bp, Homo sapiens
gaaggcatcacagaggctgtgg

SEQ ID NO: 9461051 - DNA, 22 bp, Homo sapiens
gaaggcatcacagaggctgtga

SEQ ID NO: 9461052 - DNA, 22 bp, Homo sapiens
gaaggccatttttaggtagaat

SEQ ID NO: 9461053 - DNA, 22 bp, Homo sapiens
gaaggccatttttaggtagaat

SEQ ID NO: 9461054 - DNA, 22 bp, Homo sapiens
gaaggcccagcttgaatgctgc

SEQ ID NO: 9461055 - DNA, 22 bp, Homo sapiens
gaagggagaaggttgggtgacg

SEQ ID NO: 9461056 - DNA, 22 bp, Homo sapiens
gaagggaatttggagggtttca

SEQ ID NO: 9461057 - DNA, 22 bp, Homo sapiens
gaagggagaaggttgggtgacg

SEQ ID NO: 9461058 - DNA, 22 bp, Homo sapiens
gacagcagacagcctggcccct

SEQ ID NO: 9461059 - DNA, 22 bp, Homo sapiens
gacagcagagcagactaatgga

SEQ ID NO: 9461060 - DNA, 22 bp, Homo sapiens
gacagcagacagcctggcccct

SEQ ID NO: 9461061 - DNA, 22 bp, Homo sapiens
gacagcagacagaactacctgc

SEQ ID NO: 9461062 - DNA, 22 bp, Homo sapiens
gacagcagacagaactacctgc

SEQ ID NO: 9461063 - DNA, 22 bp, Homo sapiens
gacagcagacaaaccatgtttt

SEQ ID NO: 9461064 - DNA, 22 bp, Homo sapiens
gacagcagaatccattcccagt

SEQ ID NO: 9461065 - DNA, 22 bp, Homo sapiens
gacagcagacaaaccatgtttt

SEQ ID NO: 9461066 - DNA, 22 bp, Homo sapiens
gacagcaatgacggggcagctg

SEQ ID NO: 9461067 - DNA, 22 bp, Homo sapiens
gacagcaatgacggggcagctg

SEQ ID NO: 9461068 - DNA, 22 bp, Homo sapiens
gacagcagaaaacttttgtgct

SEQ ID NO: 9461069 - DNA, 22 bp, Homo sapiens
gacagaggcaagaccagaagcc

SEQ ID NO: 9461070 - DNA, 22 bp, Homo sapiens
gacagaggagaagatgctgtgg

SEQ ID NO: 9461071 - DNA, 22 bp, Homo sapiens
gacagcaagagacagagcatcc

SEQ ID NO: 9461072 - DNA, 21 bp, Homo sapiens
gacagcaactgtagtcctctt

SEQ ID NO: 9461073 - DNA, 22 bp, Homo sapiens
gacagcaagagacagagcatcc

SEQ ID NO: 9461074 - DNA, 22 bp, Homo sapiens
gacagagaggctgagcagtaca

SEQ ID NO: 9461075 - DNA, 22 bp, Homo sapiens
gacagagaggctgagcagtaca

SEQ ID NO: 9461076 - DNA, 22 bp, Homo sapiens
gacagagcagcacccagcccct

SEQ ID NO: 9461077 - DNA, 22 bp, Homo sapiens
gacagagctgctctagattctg

SEQ ID NO: 9461078 - DNA, 22 bp, Homo sapiens
gacagagctcccagagatttgc

SEQ ID NO: 9461079 - DNA, 22 bp, Homo sapiens
gacagagctcccagagatttgc

SEQ ID NO: 9461080 - DNA, 22 bp, Homo sapiens
gacagagattgaatcaggaaat

SEQ ID NO: 9461081 - DNA, 22 bp, Homo sapiens
gacagagattgaatcaggaaat

SEQ ID NO: 9461082 - DNA, 22 bp, Homo sapiens
gacatttaatagtattgtggga

SEQ ID NO: 9461083 - DNA, 22 bp, Homo sapiens
gacatttactgaatactgatta

SEQ ID NO: 9461084 - DNA, 22 bp, Homo sapiens
gacatttaatagtattgtggga

SEQ ID NO: 9461085 - DNA, 22 bp, Homo sapiens
gacatttaaggcagtcacttaa

SEQ ID NO: 9461086 - DNA, 22 bp, Homo sapiens
gacatttaaggcagtcacttaa

SEQ ID NO: 9461087 - DNA, 22 bp, Homo sapiens
gacatttactgaatactgatta

SEQ ID NO: 9461088 - DNA, 22 bp, Homo sapiens
gacatttactgaatactgatta

SEQ ID NO: 9461089 - DNA, 22 bp, Homo sapiens
gacatttactgaatactgatta

SEQ ID NO: 9461090 - DNA, 22 bp, Homo sapiens
gacatttagaagtctaatggcc

SEQ ID NO: 9461091 - DNA, 22 bp, Homo sapiens
gacatttagaagttagattcaa

SEQ ID NO: 9461092 - DNA, 22 bp, Homo sapiens
gacatttagaagtctaatggcc

SEQ ID NO: 9461093 - DNA, 22 bp, Homo sapiens
gacatttagaagtctaatggcc

SEQ ID NO: 9461094 - DNA, 22 bp, Homo sapiens
gacatttaaattgcaggcagcc

SEQ ID NO: 9461095 - DNA, 22 bp, Homo sapiens
gacattgtggttattaaatgtt

SEQ ID NO: 9461096 - DNA, 22 bp, Homo sapiens
gacatttaaggcagtcacttaa

SEQ ID NO: 9461097 - DNA, 22 bp, Homo sapiens
gacattgtggttattaaatgtt

SEQ ID NO: 9461098 - DNA, 22 bp, Homo sapiens
gacattgaagtatttttgtcga

SEQ ID NO: 9461099 - DNA, 22 bp, Homo sapiens
gacattctgtcaatgttgactc

SEQ ID NO: 9461100 - DNA, 22 bp, Homo sapiens
gacattctgtgactctgaacag

SEQ ID NO: 9461101 - DNA, 22 bp, Homo sapiens
gacattgaatttgaatgtatgt

SEQ ID NO: 9461102 - DNA, 22 bp, Homo sapiens
gacattcacaggtaaacattcc

SEQ ID NO: 9461103 - DNA, 22 bp, Homo sapiens
gacattcacagtttccgatggt

SEQ ID NO: 9461104 - DNA, 22 bp, Homo sapiens
gacattcagactcacatggagg

SEQ ID NO: 9461105 - DNA, 22 bp, Homo sapiens
gacattcaactttgatgattat

SEQ ID NO: 9461106 - DNA, 22 bp, Homo sapiens
gacattcaagtttgcagttagg

SEQ ID NO: 9461107 - DNA, 22 bp, Homo sapiens
gacattctaaaaaatatggaag

SEQ ID NO: 9461108 - DNA, 22 bp, Homo sapiens
gacattcattgatgtcttcctc

SEQ ID NO: 9461109 - DNA, 22 bp, Homo sapiens
gacattcattgatgtcttcctc

SEQ ID NO: 9461110 - DNA, 22 bp, Homo sapiens
gacattcaggtgttcaatgcca

SEQ ID NO: 9461111 - DNA, 22 bp, Homo sapiens
gacattcagccaattactttct

SEQ ID NO: 9461112 - DNA, 20 bp, Homo sapiens
gacattcatagttattacca

SEQ ID NO: 9461113 - DNA, 22 bp, Homo sapiens
gacattcattaagcctttctgt

SEQ ID NO: 9461114 - DNA, 22 bp, Homo sapiens
gacagcagatgaagcctgcaga

SEQ ID NO: 9461115 - DNA, 22 bp, Homo sapiens
gacagcagatgaagcctgcaga

SEQ ID NO: 9461116 - DNA, 22 bp, Homo sapiens
gacagcagataagacctcatca

SEQ ID NO: 9461117 - DNA, 22 bp, Homo sapiens
gacagcagagcagactaatgga

SEQ ID NO: 9461118 - DNA, 22 bp, Homo sapiens
gacagcagataagacctcatca

SEQ ID NO: 9461119 - DNA, 22 bp, Homo sapiens
gacagcagatactttcattgaa

SEQ ID NO: 9461120 - DNA, 22 bp, Homo sapiens
gacagcagcataatacatgaac

SEQ ID NO: 9461121 - DNA, 22 bp, Homo sapiens
gacagcagcataatacatgaac

SEQ ID NO: 9461122 - DNA, 22 bp, Homo sapiens
gacagcagcatgtttacaggcc

SEQ ID NO: 9461123 - DNA, 22 bp, Homo sapiens
gacagcagcatgtttacaggcc

SEQ ID NO: 9461124 - DNA, 22 bp, Homo sapiens
gacagcagatgaagcctgcaga

SEQ ID NO: 9461125 - DNA, 22 bp, Homo sapiens
gacagcagatgaagcctgcaga

SEQ ID NO: 9461126 - DNA, 22 bp, Homo sapiens
gacagcagatgaagcctgcaga

SEQ ID NO: 9461127 - DNA, 22 bp, Homo sapiens
gaccagagaaaggcactggaag

SEQ ID NO: 9461128 - DNA, 22 bp, Homo sapiens
gaccagagaaaggcactggaag

SEQ ID NO: 9461129 - DNA, 22 bp, Homo sapiens
gaccagatcgctgatgtgcact

SEQ ID NO: 9461130 - DNA, 20 bp, Homo sapiens
gaccagatcccttaccagct

SEQ ID NO: 9461131 - DNA, 22 bp, Homo sapiens
gaccagaaggaaatgtgagcag

SEQ ID NO: 9461132 - DNA, 22 bp, Homo sapiens
gaccagaatctggactctgatt

SEQ ID NO: 9461133 - DNA, 22 bp, Homo sapiens
gaccacaggtatgggcttggca

SEQ ID NO: 9461134 - DNA, 22 bp, Homo sapiens
gaccacagtccagtcatcatgg

SEQ ID NO: 9461135 - DNA, 22 bp, Homo sapiens
gaccacagtccagtcatcatgg

SEQ ID NO: 9461136 - DNA, 22 bp, Homo sapiens
gaccactggggtgagggccatc

SEQ ID NO: 9461137 - DNA, 22 bp, Homo sapiens
gacatttaggtagcttccagtt

SEQ ID NO: 9461138 - DNA, 22 bp, Homo sapiens
gacatttagctgttttgcattt

SEQ ID NO: 9461139 - DNA, 22 bp, Homo sapiens
gaccacagctacaagggcaagg

SEQ ID NO: 9461140 - DNA, 21 bp, Homo sapiens
gaccacagggaaggtcttgca

SEQ ID NO: 9461141 - DNA, 22 bp, Homo sapiens
gaccacagcagtgcaagaggag

SEQ ID NO: 9461142 - DNA, 22 bp, Homo sapiens
gaccacagcagtgcaagaggag

SEQ ID NO: 9461143 - DNA, 22 bp, Homo sapiens
gacatttagctgttttgcattt

SEQ ID NO: 9461144 - DNA, 22 bp, Homo sapiens
gacatttagaagttagattcaa

SEQ ID NO: 9461145 - DNA, 22 bp, Homo sapiens
gacatttagaagttagattcaa

SEQ ID NO: 9461146 - DNA, 22 bp, Homo sapiens
gacatttagaagttagattcaa

SEQ ID NO: 9461147 - DNA, 22 bp, Homo sapiens
gacatttagaagtctaatggcc

SEQ ID NO: 9461148 - DNA, 22 bp, Homo sapiens
gacatttagaagttagattcaa

SEQ ID NO: 9461149 - DNA, 22 bp, Homo sapiens
gaccagctggtgaaaaccaatt

SEQ ID NO: 9461150 - DNA, 22 bp, Homo sapiens
gaccagctggtcctgtcctggg

SEQ ID NO: 9461151 - DNA, 22 bp, Homo sapiens
gaccagctgataaggcatataa

SEQ ID NO: 9461152 - DNA, 22 bp, Homo sapiens
gaccagctggtcctgtcctggg

SEQ ID NO: 9461153 - DNA, 22 bp, Homo sapiens
gaccagatgcaacaacttatcc

SEQ ID NO: 9461154 - DNA, 22 bp, Homo sapiens
gaccagctacttgtacagttca

SEQ ID NO: 9461155 - DNA, 22 bp, Homo sapiens
gaccagattcaggtcactcagg

SEQ ID NO: 9461156 - DNA, 22 bp, Homo sapiens
gaccagctctctgaagaaagag

SEQ ID NO: 9461157 - DNA, 17 bp, Homo sapiens
gaccaggagaaaccagg

SEQ ID NO: 9461158 - DNA, 22 bp, Homo sapiens
gaccaggctagttcagagcttc

SEQ ID NO: 9461159 - DNA, 22 bp, Homo sapiens
gactccagcatatacttttagt

SEQ ID NO: 9461160 - DNA, 22 bp, Homo sapiens
gactccaggtgcaggaggagcc

SEQ ID NO: 9461161 - DNA, 22 bp, Homo sapiens
gactcccaagcttggaggaagg

SEQ ID NO: 9461162 - DNA, 22 bp, Homo sapiens
gactccaggtgtccaggcctcc

SEQ ID NO: 9461163 - DNA, 22 bp, Homo sapiens
gactccccacgttaaggaatgt

SEQ ID NO: 9461164 - DNA, 22 bp, Homo sapiens
gactcctcagtcaccctcagct

SEQ ID NO: 9461165 - DNA, 22 bp, Homo sapiens
gactcctcagtcaccctcagct

SEQ ID NO: 9461166 - DNA, 22 bp, Homo sapiens
gactcccctgggccccatccag

SEQ ID NO: 9461167 - DNA, 22 bp, Homo sapiens
gactgaggtattaagatggctt

SEQ ID NO: 9461168 - DNA, 22 bp, Homo sapiens
gactgagaatcatagaaggcaa

SEQ ID NO: 9461169 - DNA, 22 bp, Homo sapiens
gactctttcaaacagaaagcca

SEQ ID NO: 9461170 - DNA, 22 bp, Homo sapiens
gactctgtgggaggaggctcag

SEQ ID NO: 9461171 - DNA, 22 bp, Homo sapiens
gactctttccctgtgacagagt

SEQ ID NO: 9461172 - DNA, 22 bp, Homo sapiens
gactgagaaacagtacattacc

SEQ ID NO: 9461173 - DNA, 22 bp, Homo sapiens
gactctcaagcacaagtccacc

SEQ ID NO: 9461174 - DNA, 22 bp, Homo sapiens
gactcctcccgctcccatgccg

SEQ ID NO: 9461175 - DNA, 22 bp, Homo sapiens
gactctggcctcatccctgagg

SEQ ID NO: 9461176 - DNA, 22 bp, Homo sapiens
gactctggcctcatccctgagg

SEQ ID NO: 9461177 - DNA, 22 bp, Homo sapiens
gactctggcagcactagggggc

SEQ ID NO: 9461178 - DNA, 22 bp, Homo sapiens
gactctgggcctttggtgactc

SEQ ID NO: 9461179 - DNA, 22 bp, Homo sapiens
gactctgggctgagccagggcc

SEQ ID NO: 9461180 - DNA, 21 bp, Homo sapiens
gactctggggtcagctcaacc

SEQ ID NO: 9461181 - DNA, 21 bp, Homo sapiens
gactctggggtcagctcaacc

SEQ ID NO: 9461182 - DNA, 22 bp, Homo sapiens
gactctggtgacttgacctgta

SEQ ID NO: 9461183 - DNA, 21 bp, Homo sapiens
gactctggggtcagctcaacc

SEQ ID NO: 9461184 - DNA, 20 bp, Homo sapiens
gagactggatctggagagac

SEQ ID NO: 9461185 - DNA, 22 bp, Homo sapiens
gagactgggggcttggcctttt

SEQ ID NO: 9461186 - DNA, 22 bp, Homo sapiens
gagactgcatagatggccacaa

SEQ ID NO: 9461187 - DNA, 22 bp, Homo sapiens
gagactgcattgtccaagggtt

SEQ ID NO: 9461188 - DNA, 22 bp, Homo sapiens
gagactgctggtaaagatggga

SEQ ID NO: 9461189 - DNA, 22 bp, Homo sapiens
gagactgaggtcaccaggctgt

SEQ ID NO: 9461190 - DNA, 22 bp, Homo sapiens
gagactcttgctttaatagccc

SEQ ID NO: 9461191 - DNA, 21 bp, Homo sapiens
gagactctcatgttatttgga

SEQ ID NO: 9461192 - DNA, 21 bp, Homo sapiens
gagactctcatgttatttgga

SEQ ID NO: 9461193 - DNA, 22 bp, Homo sapiens
gagacgtggcctttgcctgagc

SEQ ID NO: 9461194 - DNA, 22 bp, Homo sapiens
gagacgtggcctttgcctgagc

SEQ ID NO: 9461195 - DNA, 22 bp, Homo sapiens
gagacctgcagctgtagtctgc

SEQ ID NO: 9461196 - DNA, 22 bp, Homo sapiens
gagaccttaagagatgtcagct

SEQ ID NO: 9461197 - DNA, 22 bp, Homo sapiens
gagaccccagctcagcctccag

SEQ ID NO: 9461198 - DNA, 17 bp, Homo sapiens
gagacccccactacacc

SEQ ID NO: 9461199 - DNA, 17 bp, Homo sapiens
gagacccccactacacc

SEQ ID NO: 9461200 - DNA, 22 bp, Homo sapiens
gagaccccctgagttatggcct

SEQ ID NO: 9461201 - DNA, 22 bp, Homo sapiens
gagactggtgtttgctgggctg

SEQ ID NO: 9461202 - DNA, 22 bp, Homo sapiens
gagactggtgtttgctgggctg

SEQ ID NO: 9461203 - DNA, 22 bp, Homo sapiens
gagactggtgtttgctgggctg

SEQ ID NO: 9461204 - DNA, 22 bp, Homo sapiens
gagagaaaacaagttctccatt

SEQ ID NO: 9461205 - DNA, 22 bp, Homo sapiens
gagagaaaacaagttctccatt

SEQ ID NO: 9461206 - DNA, 22 bp, Homo sapiens
gagagaaaaatgagcttcattg

SEQ ID NO: 9461207 - DNA, 22 bp, Homo sapiens
gagactttaaaaaacattaaga

SEQ ID NO: 9461208 - DNA, 22 bp, Homo sapiens
gagagaaagcccctgcatccct

SEQ ID NO: 9461209 - DNA, 22 bp, Homo sapiens
gagagaaagcccctgcatccct

SEQ ID NO: 9461210 - DNA, 22 bp, Homo sapiens
gagagaaaggataacagctcaa

SEQ ID NO: 9461211 - DNA, 22 bp, Homo sapiens
gagagaaaggataacagctcaa

SEQ ID NO: 9461212 - DNA, 22 bp, Homo sapiens
gagagaaatgtgcagtttgggc

SEQ ID NO: 9461213 - DNA, 22 bp, Homo sapiens
gagagaaaggcttgcaggctgt

SEQ ID NO: 9461214 - DNA, 22 bp, Homo sapiens
gagagaaaggcttgcaggctgt

SEQ ID NO: 9461215 - DNA, 22 bp, Homo sapiens
gagagaaaggcttgcaggctgt

SEQ ID NO: 9461216 - DNA, 22 bp, Homo sapiens
gagagaaatgtgcagtttgggc

SEQ ID NO: 9461217 - DNA, 22 bp, Homo sapiens
gagagaaatgtgcagtttgggc

SEQ ID NO: 9461218 - DNA, 22 bp, Homo sapiens
gagagaaattagttggtttgct

SEQ ID NO: 9461219 - DNA, 18 bp, Homo sapiens
gagagggatccctcagga

SEQ ID NO: 9461220 - DNA, 18 bp, Homo sapiens
gagagggatccctcagga

SEQ ID NO: 9461221 - DNA, 18 bp, Homo sapiens
gagagggatccctcagga

SEQ ID NO: 9461222 - DNA, 18 bp, Homo sapiens
gagagggatccctcagga

SEQ ID NO: 9461223 - DNA, 22 bp, Homo sapiens
gagagggcaaacttgtagctaa

SEQ ID NO: 9461224 - DNA, 22 bp, Homo sapiens
gagagggcaaacttgtagctaa

SEQ ID NO: 9461225 - DNA, 22 bp, Homo sapiens
gagagggcaaggtagatgctac

SEQ ID NO: 9461226 - DNA, 22 bp, Homo sapiens
gagagggcaaggtagatgctac

SEQ ID NO: 9461227 - DNA, 22 bp, Homo sapiens
gagagggcaaggtagatgctac

SEQ ID NO: 9461228 - DNA, 21 bp, Homo sapiens
gagagggcattataggaagtg

SEQ ID NO: 9461229 - DNA, 22 bp, Homo sapiens
gagagggcaaggtagatgctac

SEQ ID NO: 9461230 - DNA, 21 bp, Homo sapiens
gagagggcattataggaagtg

SEQ ID NO: 9461231 - DNA, 21 bp, Homo sapiens
gagagggcattataggaagtg

SEQ ID NO: 9461232 - DNA, 22 bp, Homo sapiens
gagagggccagggtgagaacta

SEQ ID NO: 9461233 - DNA, 21 bp, Homo sapiens
gagagggcattataggaagtg

SEQ ID NO: 9461234 - DNA, 22 bp, Homo sapiens
gagagggctgcctggtgtgagg

SEQ ID NO: 9461235 - DNA, 22 bp, Homo sapiens
gagagggctctgtgtgggtact

SEQ ID NO: 9461236 - DNA, 22 bp, Homo sapiens
gagagggccgggggccagctcc

SEQ ID NO: 9461237 - DNA, 22 bp, Homo sapiens
gagagggctctgtgtgggtact

SEQ ID NO: 9461238 - DNA, 22 bp, Homo sapiens
gagagggctctgtgtgggtact

SEQ ID NO: 9461239 - DNA, 22 bp, Homo sapiens
gagagggccgggggccagctcc

SEQ ID NO: 9461240 - DNA, 22 bp, Homo sapiens
gagagggccgggggccagctcc

SEQ ID NO: 9461241 - DNA, 22 bp, Homo sapiens
gagagggccagggtgagaacta

SEQ ID NO: 9461242 - DNA, 22 bp, Homo sapiens
gagaaagatgtaggctgggagg

SEQ ID NO: 9461243 - DNA, 22 bp, Homo sapiens
gagaaagattgtccttcagggg

SEQ ID NO: 9461244 - DNA, 22 bp, Homo sapiens
gagaaagatgtaggctgggagg

SEQ ID NO: 9461245 - DNA, 22 bp, Homo sapiens
gagaaagatgtaggctgggagg

SEQ ID NO: 9461246 - DNA, 22 bp, Homo sapiens
gagaaagatggaatcttacagg

SEQ ID NO: 9461247 - DNA, 22 bp, Homo sapiens
gagaaagatggaatcttacagg

SEQ ID NO: 9461248 - DNA, 22 bp, Homo sapiens
gagaaagcttcagaaatggcct

SEQ ID NO: 9461249 - DNA, 23 bp, Homo sapiens
gagaaagccggctatgatcctgg

SEQ ID NO: 9461250 - DNA, 22 bp, Homo sapiens
gagaaagctaataggaatccta

SEQ ID NO: 9461251 - DNA, 19 bp, Homo sapiens
gagaaagcaggcacagcac

SEQ ID NO: 9461252 - DNA, 19 bp, Homo sapiens
gagaaagcaggcacagcac

SEQ ID NO: 9461253 - DNA, 22 bp, Homo sapiens
gagaaagattgtccttcagggg

SEQ ID NO: 9461254 - DNA, 19 bp, Homo sapiens
gagaaagcaggcacagcac

SEQ ID NO: 9461255 - DNA, 22 bp, Homo sapiens
gagaccaggaagtacagcagcc

SEQ ID NO: 9461256 - DNA, 22 bp, Homo sapiens
gagacattcttaggaacaatgt

SEQ ID NO: 9461257 - DNA, 20 bp, Homo sapiens
gagacagcaaaagcctctcc

SEQ ID NO: 9461258 - DNA, 22 bp, Homo sapiens
gagaaagcttctttcccacagg

SEQ ID NO: 9461259 - DNA, 22 bp, Homo sapiens
gagaaaggcattcctatgcaaa

SEQ ID NO: 9461260 - DNA, 22 bp, Homo sapiens
gagaaaggcattcctatgcaaa

SEQ ID NO: 9461261 - DNA, 22 bp, Homo sapiens
gagaaaggcattcctatgcaaa

SEQ ID NO: 9461262 - DNA, 22 bp, Homo sapiens
gagacagatgctgctggagcat

SEQ ID NO: 9461263 - DNA, 22 bp, Homo sapiens
gagacagatgctgctggagcat

SEQ ID NO: 9461264 - DNA, 22 bp, Homo sapiens
gagaaaggcattcctatgcaaa

SEQ ID NO: 9461265 - DNA, 22 bp, Homo sapiens
gagaaagatggaatcttacagg

SEQ ID NO: 9461266 - DNA, 22 bp, Homo sapiens
gagaaagacgtaggctgggagg

SEQ ID NO: 9461267 - DNA, 22 bp, Homo sapiens
gagaaagacgtaggctgggagg

SEQ ID NO: 9461268 - DNA, 22 bp, Homo sapiens
gagaaagacgtaggctgggagg

SEQ ID NO: 9461269 - DNA, 22 bp, Homo sapiens
gagaaagaaagggaagtttgtt

SEQ ID NO: 9461270 - DNA, 22 bp, Homo sapiens
gagaaacttggagttattctgg

SEQ ID NO: 9461271 - DNA, 22 bp, Homo sapiens
gagaaactaacatctgaaggtg

SEQ ID NO: 9461272 - DNA, 22 bp, Homo sapiens
gagaaacaggaattgagtcgct

SEQ ID NO: 9461273 - DNA, 22 bp, Homo sapiens
gagaaacaggaattgagtcgct

SEQ ID NO: 9461274 - DNA, 22 bp, Homo sapiens
gagaaacactgttagtttatta

SEQ ID NO: 9461275 - DNA, 22 bp, Homo sapiens
gagaaacactgttagtttatta

SEQ ID NO: 9461276 - DNA, 22 bp, Homo sapiens
gagaaacactgttagtttatta

SEQ ID NO: 9461277 - DNA, 22 bp, Homo sapiens
gagaaacactgttagtttatta

SEQ ID NO: 9461278 - DNA, 22 bp, Homo sapiens
gagaaacactgttagtttatta

SEQ ID NO: 9461279 - DNA, 22 bp, Homo sapiens
gagaaacaggaattgagtcgct

SEQ ID NO: 9461280 - DNA, 22 bp, Homo sapiens
gactgcaagtctgggaaaggag

SEQ ID NO: 9461281 - DNA, 22 bp, Homo sapiens
gactgcagtgaaggcacatggg

SEQ ID NO: 9461282 - DNA, 22 bp, Homo sapiens
gactgcctcagtttccctgcag

SEQ ID NO: 9461283 - DNA, 22 bp, Homo sapiens
gaggcagcttggggctgtgggt

SEQ ID NO: 9461284 - DNA, 22 bp, Homo sapiens
gaggcagcttggggctgtgggt

SEQ ID NO: 9461285 - DNA, 22 bp, Homo sapiens
gaggcagcttggggctgtgggt

SEQ ID NO: 9461286 - DNA, 22 bp, Homo sapiens
gaggcaggaggattgcttgagc

SEQ ID NO: 9461287 - DNA, 22 bp, Homo sapiens
gaggcaggaggattgcttgagc

SEQ ID NO: 9461288 - DNA, 22 bp, Homo sapiens
gaggagcccccactgggctcac

SEQ ID NO: 9461289 - DNA, 22 bp, Homo sapiens
gaggcagcttagggtactgact

SEQ ID NO: 9461290 - DNA, 22 bp, Homo sapiens
gaggcaggcactgttatcagca

SEQ ID NO: 9461291 - DNA, 22 bp, Homo sapiens
gaggcaggcactgttatcagca

SEQ ID NO: 9461292 - DNA, 22 bp, Homo sapiens
gaggcaggaggattgcttgagc

SEQ ID NO: 9461293 - DNA, 22 bp, Homo sapiens
gaggcaggaggattgcttgagc

SEQ ID NO: 9461294 - DNA, 22 bp, Homo sapiens
gaggcaggaggattgcttgagc

SEQ ID NO: 9461295 - DNA, 22 bp, Homo sapiens
gaggcaggaggattgcttgagc

SEQ ID NO: 9461296 - DNA, 22 bp, Homo sapiens
gaggcaggcagattgcttgagg

SEQ ID NO: 9461297 - DNA, 22 bp, Homo sapiens
gaggcaggcagattgcttgagg

SEQ ID NO: 9461298 - DNA, 22 bp, Homo sapiens
gaggcaggcagattgcttgagg

SEQ ID NO: 9461299 - DNA, 22 bp, Homo sapiens
gaggcaggccctgaatgagtca

SEQ ID NO: 9461300 - DNA, 22 bp, Homo sapiens
gaggcaggccctgaatgagtca

SEQ ID NO: 9461301 - DNA, 22 bp, Homo sapiens
gaggcaggcagattgcttgagg

SEQ ID NO: 9461302 - DNA, 22 bp, Homo sapiens
gaggcaggcagattgcttgagg

SEQ ID NO: 9461303 - DNA, 22 bp, Homo sapiens
gaggcaggcagattgcttgagg

SEQ ID NO: 9461304 - DNA, 22 bp, Homo sapiens
gaggagcaagaaatagtgccca

SEQ ID NO: 9461305 - DNA, 22 bp, Homo sapiens
gaggagcacatgaggctgaggg

SEQ ID NO: 9461306 - DNA, 22 bp, Homo sapiens
gaggagcacatgaggctgaggg

SEQ ID NO: 9461307 - DNA, 22 bp, Homo sapiens
gaggagcacatgaggctgaggg

SEQ ID NO: 9461308 - DNA, 22 bp, Homo sapiens
gaggagcacatgaggctgaggg

SEQ ID NO: 9461309 - DNA, 22 bp, Homo sapiens
gaggagcacatgaggctgaggg

SEQ ID NO: 9461310 - DNA, 22 bp, Homo sapiens
gaggagcatgggaaggctctgg

SEQ ID NO: 9461311 - DNA, 22 bp, Homo sapiens
gaggagcatgggaaggctctgg

SEQ ID NO: 9461312 - DNA, 22 bp, Homo sapiens
gaggagcatgggaaggctctgg

SEQ ID NO: 9461313 - DNA, 22 bp, Homo sapiens
gaggagcatgggaaggctctgg

SEQ ID NO: 9461314 - DNA, 22 bp, Homo sapiens
gaggagcatgggaaggctctgg

SEQ ID NO: 9461315 - DNA, 22 bp, Homo sapiens
gaggagccaaggtatgtgtgtt

SEQ ID NO: 9461316 - DNA, 22 bp, Homo sapiens
gaggagagcctgcactttgacc

SEQ ID NO: 9461317 - DNA, 22 bp, Homo sapiens
gaggagagatggtagattgggt

SEQ ID NO: 9461318 - DNA, 22 bp, Homo sapiens
gaggagagatggtagattgggt

SEQ ID NO: 9461319 - DNA, 22 bp, Homo sapiens
gaggagagatggtagattgggt

SEQ ID NO: 9461320 - DNA, 22 bp, Homo sapiens
gaggagagggctgcgggcccac

SEQ ID NO: 9461321 - DNA, 22 bp, Homo sapiens
gaggagaggggctcccaagagc

SEQ ID NO: 9461322 - DNA, 22 bp, Homo sapiens
gaggagaggggctcccaagagc

SEQ ID NO: 9461323 - DNA, 22 bp, Homo sapiens
gaggagaggctggacgcggtga

SEQ ID NO: 9461324 - DNA, 22 bp, Homo sapiens
gaggctcagagaagtcatggta

SEQ ID NO: 9461325 - DNA, 22 bp, Homo sapiens
gaggctcagagaagtcatggta

SEQ ID NO: 9461326 - DNA, 22 bp, Homo sapiens
gaggctcactttcatcctcttc

SEQ ID NO: 9461327 - DNA, 22 bp, Homo sapiens
gaggctcacctagggagcactg

SEQ ID NO: 9461328 - DNA, 22 bp, Homo sapiens
gaggctcactaggcatcctggg

SEQ ID NO: 9461329 - DNA, 22 bp, Homo sapiens
gaggcataaatcacagtgttca

SEQ ID NO: 9461330 - DNA, 22 bp, Homo sapiens
gaggcaggccctgaatgagtca

SEQ ID NO: 9461331 - DNA, 22 bp, Homo sapiens
gaggcagggtgttgattacaga

SEQ ID NO: 9461332 - DNA, 22 bp, Homo sapiens
gaggcagggtgttgattacaga

SEQ ID NO: 9461333 - DNA, 22 bp, Homo sapiens
gaggcagtgtcggtggcaggat

SEQ ID NO: 9461334 - DNA, 22 bp, Homo sapiens
gaggctgagagtttgttctact

SEQ ID NO: 9461335 - DNA, 22 bp, Homo sapiens
gaggctgagagtttgttctact

SEQ ID NO: 9461336 - DNA, 22 bp, Homo sapiens
gaggctgacggcaccatcttct

SEQ ID NO: 9461337 - DNA, 22 bp, Homo sapiens
gaggctgacggcaccatcttct

SEQ ID NO: 9461338 - DNA, 22 bp, Homo sapiens
gaggctgacggcaccatcttct

SEQ ID NO: 9461339 - DNA, 22 bp, Homo sapiens
gaggctgaatggccagaagcca

SEQ ID NO: 9461340 - DNA, 22 bp, Homo sapiens
gaggctgagactctgaattttt

SEQ ID NO: 9461341 - DNA, 22 bp, Homo sapiens
gaggctgaatggccagaagcca

SEQ ID NO: 9461342 - DNA, 22 bp, Homo sapiens
gaggctgaatggccagaagcca

SEQ ID NO: 9461343 - DNA, 20 bp, Homo sapiens
gaggctgaagtgtttttgct

SEQ ID NO: 9461344 - DNA, 22 bp, Homo sapiens
gaggctgaagtgtacatgggtg

SEQ ID NO: 9461345 - DNA, 22 bp, Homo sapiens
gaggctgaagtgtacatgggtg

SEQ ID NO: 9461346 - DNA, 20 bp, Homo sapiens
gaggctgaagtgtttttgct

SEQ ID NO: 9461347 - DNA, 22 bp, Homo sapiens
gaggctgaagtgtacatgggtg

SEQ ID NO: 9461348 - DNA, 22 bp, Homo sapiens
gaggctgaagtgtacatgggtg

SEQ ID NO: 9461349 - DNA, 22 bp, Homo sapiens
gaggctcagagaggtccacata

SEQ ID NO: 9461350 - DNA, 22 bp, Homo sapiens
gaggctcagagaggtccacata

SEQ ID NO: 9461351 - DNA, 22 bp, Homo sapiens
gaggctgaacaggttctcatga

SEQ ID NO: 9461352 - DNA, 22 bp, Homo sapiens
gaggctgaagtgtacatgggtg

SEQ ID NO: 9461353 - DNA, 22 bp, Homo sapiens
gaggctgaacaggttctcatga

SEQ ID NO: 9461354 - DNA, 22 bp, Homo sapiens
gaggctcattgcattgtgcatt

SEQ ID NO: 9461355 - DNA, 22 bp, Homo sapiens
gaggctcattgcattgtgcatt

SEQ ID NO: 9461356 - DNA, 22 bp, Homo sapiens
gaggctcagttattttagcctg

SEQ ID NO: 9461357 - DNA, 22 bp, Homo sapiens
gagggctgtgaaggagcgggtt

SEQ ID NO: 9461358 - DNA, 22 bp, Homo sapiens
gagggctgtgaaggagcgggtt

SEQ ID NO: 9461359 - DNA, 22 bp, Homo sapiens
gagggctgtgaaggagcgggtt

SEQ ID NO: 9461360 - DNA, 22 bp, Homo sapiens
gagggctgtgaaggagcgggtt

SEQ ID NO: 9461361 - DNA, 22 bp, Homo sapiens
gagggctgtggggcatgaccag

SEQ ID NO: 9461362 - DNA, 22 bp, Homo sapiens
gagggctgtggggcatgaccag

SEQ ID NO: 9461363 - DNA, 22 bp, Homo sapiens
gagggctgtggggcatgaccag

SEQ ID NO: 9461364 - DNA, 22 bp, Homo sapiens
gagggctgtggggcatgaccag

SEQ ID NO: 9461365 - DNA, 22 bp, Homo sapiens
gaggggctgccctggtgtcagg

SEQ ID NO: 9461366 - DNA, 22 bp, Homo sapiens
gaggggaaagtgtgaggctgcg

SEQ ID NO: 9461367 - DNA, 22 bp, Homo sapiens
gaggggctctttaatagtaaca

SEQ ID NO: 9461368 - DNA, 22 bp, Homo sapiens
gaggggctggctgtggtcccat

SEQ ID NO: 9461369 - DNA, 22 bp, Homo sapiens
gaggggctggcacgatggctgc

SEQ ID NO: 9461370 - DNA, 22 bp, Homo sapiens
gaggggctggcacgatggctgc

SEQ ID NO: 9461371 - DNA, 22 bp, Homo sapiens
gaggggctggcacgatggctgc

SEQ ID NO: 9461372 - DNA, 22 bp, Homo sapiens
gaggggctggcacgatggctgc

SEQ ID NO: 9461373 - DNA, 22 bp, Homo sapiens
gaggggctggcacgatggctgc

SEQ ID NO: 9461374 - DNA, 22 bp, Homo sapiens
gagggctgccacgttgggcgag

SEQ ID NO: 9461375 - DNA, 22 bp, Homo sapiens
gagggctgctgccagatatgcc

SEQ ID NO: 9461376 - DNA, 22 bp, Homo sapiens
gagggctgctgccagatatgcc

SEQ ID NO: 9461377 - DNA, 22 bp, Homo sapiens
gagggctgctggaaaaatgcag

SEQ ID NO: 9461378 - DNA, 22 bp, Homo sapiens
gagggctgatgttgccacctca

SEQ ID NO: 9461379 - DNA, 22 bp, Homo sapiens
gagggctgatgttgccacctca

SEQ ID NO: 9461380 - DNA, 22 bp, Homo sapiens
gagggctgcaatgagacagaga

SEQ ID NO: 9461381 - DNA, 22 bp, Homo sapiens
gagggctgatgttgccacctca

SEQ ID NO: 9461382 - DNA, 22 bp, Homo sapiens
gagggctgcaatgagacagaga

SEQ ID NO: 9461383 - DNA, 22 bp, Homo sapiens
gagggctgcaatgagacagaga

SEQ ID NO: 9461384 - DNA, 22 bp, Homo sapiens
gagggagtgagacacaaaagaa

SEQ ID NO: 9461385 - DNA, 22 bp, Homo sapiens
gagggagtgccagagggccagc

SEQ ID NO: 9461386 - DNA, 18 bp, Homo sapiens
gagggagtagctgaggtt

SEQ ID NO: 9461387 - DNA, 22 bp, Homo sapiens
gagggagtctgtgcaaagaatt

SEQ ID NO: 9461388 - DNA, 22 bp, Homo sapiens
gagggctgatgttgccacctca

SEQ ID NO: 9461389 - DNA, 22 bp, Homo sapiens
gagggctgatgttgccacctca

SEQ ID NO: 9461390 - DNA, 22 bp, Homo sapiens
gagggagtgctttctgatagtt

SEQ ID NO: 9461391 - DNA, 22 bp, Homo sapiens
gagggagtgccagagggccagc

SEQ ID NO: 9461392 - DNA, 22 bp, Homo sapiens
gagggaggtgatactgaacgta

SEQ ID NO: 9461393 - DNA, 22 bp, Homo sapiens
gagggaggggagctccaccctc

SEQ ID NO: 9461394 - DNA, 22 bp, Homo sapiens
gagggaggtgatactgaacgta

SEQ ID NO: 9461395 - DNA, 22 bp, Homo sapiens
gagggagtaacgtactacagtg

SEQ ID NO: 9461396 - DNA, 22 bp, Homo sapiens
gaggctgaggttgcagtgagcc

SEQ ID NO: 9461397 - DNA, 22 bp, Homo sapiens
gaggctgaggttgcagtgagct

SEQ ID NO: 9461398 - DNA, 22 bp, Homo sapiens
gaggctgaggttgcagtgagcc

SEQ ID NO: 9461399 - DNA, 22 bp, Homo sapiens
gaggctgagggttagagagtca

SEQ ID NO: 9461400 - DNA, 22 bp, Homo sapiens
gaggctgaggttgcagtgagcc

SEQ ID NO: 9461401 - DNA, 22 bp, Homo sapiens
gaggctgaggttgcagtgagcc

SEQ ID NO: 9461402 - DNA, 22 bp, Homo sapiens
gaggctgaggttgcagtgagct

SEQ ID NO: 9461403 - DNA, 22 bp, Homo sapiens
gaggctgaggttgcagtgagct

SEQ ID NO: 9461404 - DNA, 22 bp, Homo sapiens
gaggctgagtagctttgtgctc

SEQ ID NO: 9461405 - DNA, 22 bp, Homo sapiens
gaggctgaggttgcagtgagct

SEQ ID NO: 9461406 - DNA, 22 bp, Homo sapiens
gaggctgagggttagagagtca

SEQ ID NO: 9461407 - DNA, 22 bp, Homo sapiens
gaggctgagggttagagagtca

SEQ ID NO: 9461408 - DNA, 22 bp, Homo sapiens
gaggctgaggcggatggatcac

SEQ ID NO: 9461409 - DNA, 22 bp, Homo sapiens
gaggctgagggttagagagtca

SEQ ID NO: 9461410 - DNA, 22 bp, Homo sapiens
gaggctgagggttagagagtca

SEQ ID NO: 9461411 - DNA, 22 bp, Homo sapiens
gaggctgaggcaggaggatcac

SEQ ID NO: 9461412 - DNA, 22 bp, Homo sapiens
gaggctgaggcaggaggatcac

SEQ ID NO: 9461413 - DNA, 22 bp, Homo sapiens
gaggctgaggcaggaggatcac

SEQ ID NO: 9461414 - DNA, 22 bp, Homo sapiens
gaggctgaggcaggaggatcac

SEQ ID NO: 9461415 - DNA, 22 bp, Homo sapiens
gaggctgaggcggatggatcac

SEQ ID NO: 9461416 - DNA, 22 bp, Homo sapiens
gaggctgagtagctttgtgctc

SEQ ID NO: 9461417 - DNA, 22 bp, Homo sapiens
gaggctgatgctgcctcacaga

SEQ ID NO: 9461418 - DNA, 22 bp, Homo sapiens
gaggctgattcggggaacagca

SEQ ID NO: 9461419 - DNA, 22 bp, Homo sapiens
gaggctgattcggggaacagca

SEQ ID NO: 9461420 - DNA, 22 bp, Homo sapiens
gaggctgcaggcaatgctgccc

SEQ ID NO: 9461421 - DNA, 22 bp, Homo sapiens
gaggctgcaggcaatgctgccc

SEQ ID NO: 9461422 - DNA, 22 bp, Homo sapiens
gaggctgcagctatcagacatt

SEQ ID NO: 9461423 - DNA, 22 bp, Homo sapiens
gaggctgcattcttcccactgc

SEQ ID NO: 9461424 - DNA, 22 bp, Homo sapiens
gaggctgccaatgtgtgcatgt

SEQ ID NO: 9461425 - DNA, 22 bp, Homo sapiens
gaggctgccaatgtgtgcatgt

SEQ ID NO: 9461426 - DNA, 22 bp, Homo sapiens
gaggctgcccaactggagtgga

SEQ ID NO: 9461427 - DNA, 22 bp, Homo sapiens
gagggagaattgcagccagcgt

SEQ ID NO: 9461428 - DNA, 22 bp, Homo sapiens
gagggagagtgatggaccattg

SEQ ID NO: 9461429 - DNA, 22 bp, Homo sapiens
gagggagaattgcagccagcgt

SEQ ID NO: 9461430 - DNA, 22 bp, Homo sapiens
gagggagagtgatggaccattg

SEQ ID NO: 9461431 - DNA, 22 bp, Homo sapiens
gagggagagtgatggaccattg

SEQ ID NO: 9461432 - DNA, 22 bp, Homo sapiens
gagggagagtgatggaccattg

SEQ ID NO: 9461433 - DNA, 22 bp, Homo sapiens
gagggaggcatcatgaatccag

SEQ ID NO: 9461434 - DNA, 22 bp, Homo sapiens
gagggaggcatcatgaatccag

SEQ ID NO: 9461435 - DNA, 22 bp, Homo sapiens
gagggaggcatcatgaatccag

SEQ ID NO: 9461436 - DNA, 22 bp, Homo sapiens
gagggagctggagcagacgccg

SEQ ID NO: 9461437 - DNA, 22 bp, Homo sapiens
gagggagcttgatggatgtttg

SEQ ID NO: 9461438 - DNA, 22 bp, Homo sapiens
gagggaggcatcatgaatccag

SEQ ID NO: 9461439 - DNA, 22 bp, Homo sapiens
gagggaggggagctccaccctc

SEQ ID NO: 9461440 - DNA, 22 bp, Homo sapiens
gagggaggggagctccaccctc

SEQ ID NO: 9461441 - DNA, 22 bp, Homo sapiens
gagggaggggagctccaccctc

SEQ ID NO: 9461442 - DNA, 22 bp, Homo sapiens
gagggaggggagctccaccctc

SEQ ID NO: 9461443 - DNA, 22 bp, Homo sapiens
gagggaggggagctccaccctc

SEQ ID NO: 9461444 - DNA, 22 bp, Homo sapiens
gagggagggccaggtcccaacc

SEQ ID NO: 9461445 - DNA, 22 bp, Homo sapiens
gagggagggccaggtcccaacc

SEQ ID NO: 9461446 - DNA, 22 bp, Homo sapiens
gagggagggccaggtcccaacc

SEQ ID NO: 9461447 - DNA, 22 bp, Homo sapiens
gagggagggccaggtcccaacc

SEQ ID NO: 9461448 - DNA, 22 bp, Homo sapiens
gagggagggccaggtcccaacc

SEQ ID NO: 9461449 - DNA, 22 bp, Homo sapiens
gagggagggactagcattctct

SEQ ID NO: 9461450 - DNA, 22 bp, Homo sapiens
gagggagggactagcattctct

SEQ ID NO: 9461451 - DNA, 22 bp, Homo sapiens
gagggagggactagcattctct

SEQ ID NO: 9461452 - DNA, 22 bp, Homo sapiens
gagggagggaaagtttaacact

SEQ ID NO: 9461453 - DNA, 22 bp, Homo sapiens
gagggagggaaagtttaacact

SEQ ID NO: 9461454 - DNA, 22 bp, Homo sapiens
gagggagggactagcattctct

SEQ ID NO: 9461455 - DNA, 22 bp, Homo sapiens
gagggagggaaagtttaacact

SEQ ID NO: 9461456 - DNA, 22 bp, Homo sapiens
gagctgagatttgaagcaagtt

SEQ ID NO: 9461457 - DNA, 22 bp, Homo sapiens
gagctgagcagggagcctcact

SEQ ID NO: 9461458 - DNA, 22 bp, Homo sapiens
gagctgaggatacatcagtgaa

SEQ ID NO: 9461459 - DNA, 22 bp, Homo sapiens
gagctgagcttaactccttgaa

SEQ ID NO: 9461460 - DNA, 22 bp, Homo sapiens
gagctgagggtctaggagggtt

SEQ ID NO: 9461461 - DNA, 22 bp, Homo sapiens
gagctgaggctcaggctggcgt

SEQ ID NO: 9461462 - DNA, 22 bp, Homo sapiens
gagctgaggatacatcagtgaa

SEQ ID NO: 9461463 - DNA, 22 bp, Homo sapiens
gagctgaggccagagtcttctg

SEQ ID NO: 9461464 - DNA, 22 bp, Homo sapiens
gagctgaggccagagtcttctg

SEQ ID NO: 9461465 - DNA, 22 bp, Homo sapiens
gagctgagtctgcagtcgccat

SEQ ID NO: 9461466 - DNA, 22 bp, Homo sapiens
gagctgagtctgcagtcgccat

SEQ ID NO: 9461467 - DNA, 22 bp, Homo sapiens
gagctgagtatgaaggatgtga

SEQ ID NO: 9461468 - DNA, 22 bp, Homo sapiens
gagctgcctacattgccaagag

SEQ ID NO: 9461469 - DNA, 22 bp, Homo sapiens
gagctgcctgaacaagcagcag

SEQ ID NO: 9461470 - DNA, 22 bp, Homo sapiens
gagctgcctgaacaagcagcag

SEQ ID NO: 9461471 - DNA, 22 bp, Homo sapiens
gagctgcctgaacaagcagcag

SEQ ID NO: 9461472 - DNA, 22 bp, Homo sapiens
gagctgcctacattgccaagag

SEQ ID NO: 9461473 - DNA, 22 bp, Homo sapiens
gagctgcctacattgccaagag

SEQ ID NO: 9461474 - DNA, 22 bp, Homo sapiens
gagctgagtatcccactgaagt

SEQ ID NO: 9461475 - DNA, 22 bp, Homo sapiens
gagctgagtatcccactgaagt

SEQ ID NO: 9461476 - DNA, 22 bp, Homo sapiens
gagctgagtatcccactgaagt

SEQ ID NO: 9461477 - DNA, 22 bp, Homo sapiens
gagctgagtagaggctgctccc

SEQ ID NO: 9461478 - DNA, 22 bp, Homo sapiens
gagctgaggtgatgtggtcgtt

SEQ ID NO: 9461479 - DNA, 22 bp, Homo sapiens
gagctgagggtctaggagggtt

SEQ ID NO: 9461480 - DNA, 22 bp, Homo sapiens
gagctgagggtctaggagggtt

SEQ ID NO: 9461481 - DNA, 22 bp, Homo sapiens
gagctgagggtctaggagggtt

SEQ ID NO: 9461482 - DNA, 22 bp, Homo sapiens
gagccctgcccacttgtctgag

SEQ ID NO: 9461483 - DNA, 22 bp, Homo sapiens
gagccctgcccacttgtctgag

SEQ ID NO: 9461484 - DNA, 22 bp, Homo sapiens
gagccctgcggagccccgaggc

SEQ ID NO: 9461485 - DNA, 22 bp, Homo sapiens
gagccctgatttgcagcatttg

SEQ ID NO: 9461486 - DNA, 22 bp, Homo sapiens
gagccctgatttgcagcatttg

SEQ ID NO: 9461487 - DNA, 22 bp, Homo sapiens
gagccctgcccacttgtctgag

SEQ ID NO: 9461488 - DNA, 18 bp, Homo sapiens
gagccctgagtctgcaca

SEQ ID NO: 9461489 - DNA, 18 bp, Homo sapiens
gagccctgagtctgcaca

SEQ ID NO: 9461490 - DNA, 18 bp, Homo sapiens
gagccctgagtctgcaca

SEQ ID NO: 9461491 - DNA, 18 bp, Homo sapiens
gagccctgagtctgcaca

SEQ ID NO: 9461492 - DNA, 18 bp, Homo sapiens
gagccctgagtctgcaca

SEQ ID NO: 9461493 - DNA, 22 bp, Homo sapiens
gagccctgctgggccttgtctc

SEQ ID NO: 9461494 - DNA, 22 bp, Homo sapiens
gagccctgcgtgtctgggggca

SEQ ID NO: 9461495 - DNA, 22 bp, Homo sapiens
gagccctgcgtgtctgggggca

SEQ ID NO: 9461496 - DNA, 22 bp, Homo sapiens
gagccctgcggagccccgaggc

SEQ ID NO: 9461497 - DNA, 22 bp, Homo sapiens
gagccctgcttccaagggggca

SEQ ID NO: 9461498 - DNA, 22 bp, Homo sapiens
gagccctggcagtctgggatgg

SEQ ID NO: 9461499 - DNA, 22 bp, Homo sapiens
gagccctggcagtctgggatgg

SEQ ID NO: 9461500 - DNA, 22 bp, Homo sapiens
gagccctgtaggaatctctcaa

SEQ ID NO: 9461501 - DNA, 22 bp, Homo sapiens
gagccctgtagcaagtcatgtc

SEQ ID NO: 9461502 - DNA, 22 bp, Homo sapiens
gagccctgtaggaatctctcaa

SEQ ID NO: 9461503 - DNA, 22 bp, Homo sapiens
gagccctgtgattctgttgtgt

SEQ ID NO: 9461504 - DNA, 22 bp, Homo sapiens
gagccctgtgaggaaagagggt

SEQ ID NO: 9461505 - DNA, 22 bp, Homo sapiens
gagccctgttcaggcctcctca

SEQ ID NO: 9461506 - DNA, 22 bp, Homo sapiens
gagctgagatcatgtacactag

SEQ ID NO: 9461507 - DNA, 22 bp, Homo sapiens
gagctgagatcatgtacactag

SEQ ID NO: 9461508 - DNA, 22 bp, Homo sapiens
gagctgagatttgaagcaagtt

SEQ ID NO: 9461509 - DNA, 22 bp, Homo sapiens
gagctgagatcgtgccattgca

SEQ ID NO: 9461510 - DNA, 18 bp, Homo sapiens
gagccctgggagatctct

SEQ ID NO: 9461511 - DNA, 18 bp, Homo sapiens
gagccctgggagatctct

SEQ ID NO: 9461512 - DNA, 22 bp, Homo sapiens
gagccctggcagtctgggatgg

SEQ ID NO: 9461513 - DNA, 18 bp, Homo sapiens
gagccctgggagatctct

SEQ ID NO: 9461514 - DNA, 22 bp, Homo sapiens
gagccctgtagcaagtcatgtc

SEQ ID NO: 9461515 - DNA, 22 bp, Homo sapiens
gagccctgtagcaagtcatgtc

SEQ ID NO: 9461516 - DNA, 22 bp, Homo sapiens
gagccctgtagcaagtcatgtc

SEQ ID NO: 9461517 - DNA, 22 bp, Homo sapiens
gagccctgtagcaagtcatgtc

SEQ ID NO: 9461518 - DNA, 22 bp, Homo sapiens
gagccctgtagcaagtcatgtc

SEQ ID NO: 9461519 - DNA, 22 bp, Homo sapiens
gaggaagaaagcataggtgggg

SEQ ID NO: 9461520 - DNA, 22 bp, Homo sapiens
gaggaacttatgatattctact

SEQ ID NO: 9461521 - DNA, 22 bp, Homo sapiens
gaggaacagagacgggatcgct

SEQ ID NO: 9461522 - DNA, 22 bp, Homo sapiens
gaggaacaagctgctttatctt

SEQ ID NO: 9461523 - DNA, 22 bp, Homo sapiens
gaggaaatggttgttcaggtgg

SEQ ID NO: 9461524 - DNA, 22 bp, Homo sapiens
gaggaaatggttgttcaggtgg

SEQ ID NO: 9461525 - DNA, 21 bp, Homo sapiens
gaggaaatgctctggtgttca

SEQ ID NO: 9461526 - DNA, 21 bp, Homo sapiens
gaggaaatgctctggtgttca

SEQ ID NO: 9461527 - DNA, 22 bp, Homo sapiens
gaggaacatgaggtgacctggg

SEQ ID NO: 9461528 - DNA, 22 bp, Homo sapiens
gaggaacagcagccacatgtcc

SEQ ID NO: 9461529 - DNA, 22 bp, Homo sapiens
gaggaacagagggcaaggccag

SEQ ID NO: 9461530 - DNA, 22 bp, Homo sapiens
gaggaacagcagccacatgtcc

SEQ ID NO: 9461531 - DNA, 22 bp, Homo sapiens
gaggaacagcagccacatgtcc

SEQ ID NO: 9461532 - DNA, 18 bp, Homo sapiens
gaggaacattcacctcct

SEQ ID NO: 9461533 - DNA, 18 bp, Homo sapiens
gaggaacattcacctcct

SEQ ID NO: 9461534 - DNA, 22 bp, Homo sapiens
gaggaagaagggattagaactc

SEQ ID NO: 9461535 - DNA, 22 bp, Homo sapiens
gaggaagaagggattagaactc

SEQ ID NO: 9461536 - DNA, 22 bp, Homo sapiens
gaggaagaatcagggtggtgag

SEQ ID NO: 9461537 - DNA, 22 bp, Homo sapiens
gaggaagaagggattagaactc

SEQ ID NO: 9461538 - DNA, 22 bp, Homo sapiens
gaggaagaagcaaaccagctaa

SEQ ID NO: 9461539 - DNA, 22 bp, Homo sapiens
gaggaagaagggattagaactc

SEQ ID NO: 9461540 - DNA, 22 bp, Homo sapiens
gaggaagaaagcataggtgggg

SEQ ID NO: 9461541 - DNA, 22 bp, Homo sapiens
gaggaagaagcaaaccagctaa

SEQ ID NO: 9461542 - DNA, 22 bp, Homo sapiens
gaggaagaaagcataggtgggg

SEQ ID NO: 9461543 - DNA, 22 bp, Homo sapiens
gaggaagaaagcataggtgggg

SEQ ID NO: 9461544 - DNA, 22 bp, Homo sapiens
gaggaagaagcaaaccagctaa

SEQ ID NO: 9461545 - DNA, 22 bp, Homo sapiens
gaggaagaatcagggtggtgag

SEQ ID NO: 9461546 - DNA, 22 bp, Homo sapiens
gaggaagaattggttattggag

SEQ ID NO: 9461547 - DNA, 22 bp, Homo sapiens
gaggagagagggactgtctgca

SEQ ID NO: 9461548 - DNA, 22 bp, Homo sapiens
gaggagagatggtagattgggt

SEQ ID NO: 9461549 - DNA, 22 bp, Homo sapiens
gaggagagagggactgtctgca

SEQ ID NO: 9461550 - DNA, 22 bp, Homo sapiens
gaggagagagggactgtctgca

SEQ ID NO: 9461551 - DNA, 22 bp, Homo sapiens
gagctgctggatatgtggcctg

SEQ ID NO: 9461552 - DNA, 22 bp, Homo sapiens
gagctgctggaagtggagccct

SEQ ID NO: 9461553 - DNA, 19 bp, Homo sapiens
gagctgccttttgaagacc

SEQ ID NO: 9461554 - DNA, 19 bp, Homo sapiens
gagctgccttttgaagacc

SEQ ID NO: 9461555 - DNA, 22 bp, Homo sapiens
gagctgcctgttgcatagcaac

SEQ ID NO: 9461556 - DNA, 22 bp, Homo sapiens
gagctgcctgtgtgccatgatg

SEQ ID NO: 9461557 - DNA, 22 bp, Homo sapiens
gagctgcctgtgtgccatgatg

SEQ ID NO: 9461558 - DNA, 22 bp, Homo sapiens
gagctgcctgttgcatagcaac

SEQ ID NO: 9461559 - DNA, 22 bp, Homo sapiens
gagctgcctgtgtgccatgatg

SEQ ID NO: 9461560 - DNA, 22 bp, Homo sapiens
gagctgctggatatgtggcctg

SEQ ID NO: 9461561 - DNA, 22 bp, Homo sapiens
gagctgctgtgaggggagcttc

SEQ ID NO: 9461562 - DNA, 22 bp, Homo sapiens
gaggaaaatgggacaggctgta

SEQ ID NO: 9461563 - DNA, 22 bp, Homo sapiens
gaggaaaatgggacaggctgta

SEQ ID NO: 9461564 - DNA, 22 bp, Homo sapiens
gaggaaaatgcaacaggaatgc

SEQ ID NO: 9461565 - DNA, 22 bp, Homo sapiens
gaggaaaatggagtgtaattaa

SEQ ID NO: 9461566 - DNA, 22 bp, Homo sapiens
gaggaaaatggagtgtaattaa

SEQ ID NO: 9461567 - DNA, 22 bp, Homo sapiens
gaggaaagctggtttaaagtat

SEQ ID NO: 9461568 - DNA, 22 bp, Homo sapiens
gaggaaatcattccagaaaagg

SEQ ID NO: 9461569 - DNA, 22 bp, Homo sapiens
gaggaaatcattccagaaaagg

SEQ ID NO: 9461570 - DNA, 22 bp, Homo sapiens
gaggaaatcttaggccccaacc

SEQ ID NO: 9461571 - DNA, 22 bp, Homo sapiens
gaggaaatcattccagaaaagg

SEQ ID NO: 9461572 - DNA, 22 bp, Homo sapiens
gaggaaagagtcaaatctgaag

SEQ ID NO: 9461573 - DNA, 23 bp, Homo sapiens
gaggaaagaatatagatgcaatc

SEQ ID NO: 9461574 - DNA, 18 bp, Homo sapiens
gaggaaacaaggcagagg

SEQ ID NO: 9461575 - DNA, 18 bp, Homo sapiens
gaggaaacaggctctgtg

SEQ ID NO: 9461576 - DNA, 22 bp, Homo sapiens
gaggaaacattgtagaagcagt

SEQ ID NO: 9461577 - DNA, 22 bp, Homo sapiens
gaggaaagaaccccagtcaata

SEQ ID NO: 9461578 - DNA, 22 bp, Homo sapiens
gaggaaagaaccccagtcaata

SEQ ID NO: 9461579 - DNA, 22 bp, Homo sapiens
gagcccagggtgaaatagcagc

SEQ ID NO: 9461580 - DNA, 22 bp, Homo sapiens
gagcccagggtgaaatagcagc

SEQ ID NO: 9461581 - DNA, 22 bp, Homo sapiens
gagcccagggtgaaatagcagc

SEQ ID NO: 9461582 - DNA, 22 bp, Homo sapiens
gagcccagggtgaaatagcagc

SEQ ID NO: 9461583 - DNA, 22 bp, Homo sapiens
gagcccagggcaggcaaggcag

SEQ ID NO: 9461584 - DNA, 22 bp, Homo sapiens
gagcccagggcaggcaaggcag

SEQ ID NO: 9461585 - DNA, 22 bp, Homo sapiens
gagcccagggcaggcaaggcag

SEQ ID NO: 9461586 - DNA, 22 bp, Homo sapiens
gagcccaggctggggttcagag

SEQ ID NO: 9461587 - DNA, 22 bp, Homo sapiens
gagcccaggctggggttcagag

SEQ ID NO: 9461588 - DNA, 22 bp, Homo sapiens
gagcccagggcaggcaaggcag

SEQ ID NO: 9461589 - DNA, 22 bp, Homo sapiens
gagcccaggatggtgtatggct

SEQ ID NO: 9461590 - DNA, 22 bp, Homo sapiens
gagcccaggatggtgtatggct

SEQ ID NO: 9461591 - DNA, 22 bp, Homo sapiens
gagcccaggcagaggttgcagt

SEQ ID NO: 9461592 - DNA, 22 bp, Homo sapiens
gagcccaggcagaggttgcagt

SEQ ID NO: 9461593 - DNA, 22 bp, Homo sapiens
gagcccaggctggggttcagag

SEQ ID NO: 9461594 - DNA, 21 bp, Homo sapiens
gagcccaggcatctcattaat

SEQ ID NO: 9461595 - DNA, 21 bp, Homo sapiens
gagcccaggcatctcattaat

SEQ ID NO: 9461596 - DNA, 22 bp, Homo sapiens
gagccctgacactgagggagtt

SEQ ID NO: 9461597 - DNA, 22 bp, Homo sapiens
gagccctgagagttgtgaggcc

SEQ ID NO: 9461598 - DNA, 22 bp, Homo sapiens
gagccctgacactgagggagtt

SEQ ID NO: 9461599 - DNA, 22 bp, Homo sapiens
gagccctgaacaacagcaggaa

SEQ ID NO: 9461600 - DNA, 22 bp, Homo sapiens
gagccctgaacaacagcaggaa

SEQ ID NO: 9461601 - DNA, 22 bp, Homo sapiens
gagccctgaacaacagcaggaa

SEQ ID NO: 9461602 - DNA, 22 bp, Homo sapiens
gagccctgaacaacagcaggaa

SEQ ID NO: 9461603 - DNA, 22 bp, Homo sapiens
gagccctgaacaacagcaggaa

SEQ ID NO: 9461604 - DNA, 22 bp, Homo sapiens
gagcccagtaggcaaagctgca

SEQ ID NO: 9461605 - DNA, 22 bp, Homo sapiens
gagcccagtaggcaaagctgca

SEQ ID NO: 9461606 - DNA, 22 bp, Homo sapiens
gagcccagtaggcaaagctgca

SEQ ID NO: 9461607 - DNA, 22 bp, Homo sapiens
gagcccaggttctgcttccagc

SEQ ID NO: 9461608 - DNA, 22 bp, Homo sapiens
gagcccaggttctgcttccagc

SEQ ID NO: 9461609 - DNA, 22 bp, Homo sapiens
gagccaggtttgaatctcagtc

SEQ ID NO: 9461610 - DNA, 22 bp, Homo sapiens
gagccaggtttgaatctcagtc

SEQ ID NO: 9461611 - DNA, 22 bp, Homo sapiens
gagccaggtttgaatctcagtc

SEQ ID NO: 9461612 - DNA, 22 bp, Homo sapiens
gagcatttggttatagtaattt

SEQ ID NO: 9461613 - DNA, 22 bp, Homo sapiens
gagccattgtccaagcctgttt

SEQ ID NO: 9461614 - DNA, 22 bp, Homo sapiens
gagccagtgatcagacagggag

SEQ ID NO: 9461615 - DNA, 22 bp, Homo sapiens
gagcccagattggaatttccca

SEQ ID NO: 9461616 - DNA, 22 bp, Homo sapiens
gagcccagctctacctcagact

SEQ ID NO: 9461617 - DNA, 22 bp, Homo sapiens
gagcccagctaaatttatataa

SEQ ID NO: 9461618 - DNA, 22 bp, Homo sapiens
gagcccagcccagagccatatg

SEQ ID NO: 9461619 - DNA, 22 bp, Homo sapiens
gagcccagcccagagccatatg

SEQ ID NO: 9461620 - DNA, 22 bp, Homo sapiens
gagcccagctgcggccctcagc

SEQ ID NO: 9461621 - DNA, 22 bp, Homo sapiens
gagcccagctgcggccctcagc

SEQ ID NO: 9461622 - DNA, 22 bp, Homo sapiens
gagcccagctgcggccctcagc

SEQ ID NO: 9461623 - DNA, 22 bp, Homo sapiens
gagcccagctctacctcagact

SEQ ID NO: 9461624 - DNA, 22 bp, Homo sapiens
gagcccagctctacctcagact

SEQ ID NO: 9461625 - DNA, 22 bp, Homo sapiens
gagcccaggaagtggaggctga

SEQ ID NO: 9461626 - DNA, 22 bp, Homo sapiens
gagcccagcttgcacatggagc

SEQ ID NO: 9461627 - DNA, 22 bp, Homo sapiens
gagcccagcttgcacatggagc

SEQ ID NO: 9461628 - DNA, 22 bp, Homo sapiens
gagcccagcttgcacatggagc

SEQ ID NO: 9461629 - DNA, 22 bp, Homo sapiens
gagcccagctgtccttggcaaa

SEQ ID NO: 9461630 - DNA, 22 bp, Homo sapiens
gagcccagctgtccttggcaaa

SEQ ID NO: 9461631 - DNA, 22 bp, Homo sapiens
gagcccaggagtttgatgctgc

SEQ ID NO: 9461632 - DNA, 22 bp, Homo sapiens
gagcccaggagtttgatgctgc

SEQ ID NO: 9461633 - DNA, 22 bp, Homo sapiens
gagcccaggagtttgatgctgc

SEQ ID NO: 9461634 - DNA, 22 bp, Homo sapiens
gagcccaggagtttgatgctgc

SEQ ID NO: 9461635 - DNA, 22 bp, Homo sapiens
gagcccaggaagtggaggctga

SEQ ID NO: 9461636 - DNA, 22 bp, Homo sapiens
gagcccaggaagtggaggctga

SEQ ID NO: 9461637 - DNA, 22 bp, Homo sapiens
gagcccaggaagtggaggctga

SEQ ID NO: 9461638 - DNA, 22 bp, Homo sapiens
gagcccaggaagtggaggctga

SEQ ID NO: 9461639 - DNA, 22 bp, Homo sapiens
gagcccaggaagtggaggctga

SEQ ID NO: 9461640 - DNA, 22 bp, Homo sapiens
gagcagggagacaactctggtg

SEQ ID NO: 9461641 - DNA, 20 bp, Homo sapiens
gagcagtgagccagggaaag

SEQ ID NO: 9461642 - DNA, 22 bp, Homo sapiens
gagcagtgatgggaggacgtca

SEQ ID NO: 9461643 - DNA, 22 bp, Homo sapiens
gagcagtgatgggaggacgtca

SEQ ID NO: 9461644 - DNA, 22 bp, Homo sapiens
gagagggtgcctggaagccagg

SEQ ID NO: 9461645 - DNA, 22 bp, Homo sapiens
gagaggggtttgccatcctatg

SEQ ID NO: 9461646 - DNA, 22 bp, Homo sapiens
gagcaggcttgcagagaagggg

SEQ ID NO: 9461647 - DNA, 22 bp, Homo sapiens
gagaggtaatttgaagtgcaaa

SEQ ID NO: 9461648 - DNA, 22 bp, Homo sapiens
gagcaggcttgcagagaagggg

SEQ ID NO: 9461649 - DNA, 22 bp, Homo sapiens
gagaggggcgcgcagctcgcga

SEQ ID NO: 9461650 - DNA, 22 bp, Homo sapiens
gagaggggcccaagccacatag

SEQ ID NO: 9461651 - DNA, 22 bp, Homo sapiens
gagaggggcccaagccacatag

SEQ ID NO: 9461652 - DNA, 22 bp, Homo sapiens
gagaggggcgcgcagctcgcga

SEQ ID NO: 9461653 - DNA, 22 bp, Homo sapiens
gagaggggcgcgcagctcgcga

SEQ ID NO: 9461654 - DNA, 22 bp, Homo sapiens
gagaggggcgcgcagctcgcga

SEQ ID NO: 9461655 - DNA, 22 bp, Homo sapiens
gagaggggcgcgcagctcgcga

SEQ ID NO: 9461656 - DNA, 22 bp, Homo sapiens
gagagggctggaaacttcctgg

SEQ ID NO: 9461657 - DNA, 22 bp, Homo sapiens
gagagggctgcctggtgtgagg

SEQ ID NO: 9461658 - DNA, 22 bp, Homo sapiens
gagagggctgcctggtgtgagg

SEQ ID NO: 9461659 - DNA, 22 bp, Homo sapiens
gagaggggacctgtgtgtctag

SEQ ID NO: 9461660 - DNA, 22 bp, Homo sapiens
gagaggggacctgtgtgtctag

SEQ ID NO: 9461661 - DNA, 22 bp, Homo sapiens
gagagggctggaaacttcctgg

SEQ ID NO: 9461662 - DNA, 22 bp, Homo sapiens
gagaggggcccaagccacatag

SEQ ID NO: 9461663 - DNA, 22 bp, Homo sapiens
gagcatggatagaaggtgggat

SEQ ID NO: 9461664 - DNA, 22 bp, Homo sapiens
gagcatggatagaaggtgggat

SEQ ID NO: 9461665 - DNA, 22 bp, Homo sapiens
gagcatggatcatgtgctgggt

SEQ ID NO: 9461666 - DNA, 22 bp, Homo sapiens
gagcatctggctagaggagtga

SEQ ID NO: 9461667 - DNA, 20 bp, Homo sapiens
gagcatctgtctgctgtgca

SEQ ID NO: 9461668 - DNA, 18 bp, Homo sapiens
gagcatgggcagtgggga

SEQ ID NO: 9461669 - DNA, 18 bp, Homo sapiens
gagcatgggcagtgggga

SEQ ID NO: 9461670 - DNA, 22 bp, Homo sapiens
gagcatggtgcttcagtgaagg

SEQ ID NO: 9461671 - DNA, 22 bp, Homo sapiens
gagcatggatcatgtgctgggt

SEQ ID NO: 9461672 - DNA, 22 bp, Homo sapiens
gagcatggcagctgagggcagg

SEQ ID NO: 9461673 - DNA, 22 bp, Homo sapiens
gagcatggctgcctccctgtgc

SEQ ID NO: 9461674 - DNA, 22 bp, Homo sapiens
gagcatggctgcctccctgtgc

SEQ ID NO: 9461675 - DNA, 22 bp, Homo sapiens
gagcagtggttgaacagaggca

SEQ ID NO: 9461676 - DNA, 22 bp, Homo sapiens
gagcagtggttgaacagaggca

SEQ ID NO: 9461677 - DNA, 22 bp, Homo sapiens
gagcagtgggaaggaacagggt

SEQ ID NO: 9461678 - DNA, 22 bp, Homo sapiens
gagcagtggtcacagggaggga

SEQ ID NO: 9461679 - DNA, 22 bp, Homo sapiens
gagcagtggtcacagggaggga

SEQ ID NO: 9461680 - DNA, 22 bp, Homo sapiens
gagcataggacacagaggtgtg

SEQ ID NO: 9461681 - DNA, 22 bp, Homo sapiens
gagcagttttatttcatgagac

SEQ ID NO: 9461682 - DNA, 22 bp, Homo sapiens
gagcagttctccttggtagggg

SEQ ID NO: 9461683 - DNA, 22 bp, Homo sapiens
gagcatctatgtgctgggtact

SEQ ID NO: 9461684 - DNA, 22 bp, Homo sapiens
gagcatctctatagtgactgtg

SEQ ID NO: 9461685 - DNA, 22 bp, Homo sapiens
ctgggacatagatcagcctttt

SEQ ID NO: 9461686 - DNA, 22 bp, Homo sapiens
ctgggacatattgctagtgttg

SEQ ID NO: 9461687 - DNA, 22 bp, Homo sapiens
ctgggacagttcaggtagggca

SEQ ID NO: 9461688 - DNA, 22 bp, Homo sapiens
ctgggacagctgagacaggaga

SEQ ID NO: 9461689 - DNA, 22 bp, Homo sapiens
ctgggacagctgagacaggaga

SEQ ID NO: 9461690 - DNA, 22 bp, Homo sapiens
ctgggacagctgagacaggaga

SEQ ID NO: 9461691 - DNA, 22 bp, Homo sapiens
ctgggacatggtgctgtcttta

SEQ ID NO: 9461692 - DNA, 23 bp, Homo sapiens
ctgggacatggtaggggcacaac

SEQ ID NO: 9461693 - DNA, 23 bp, Homo sapiens
ctgggacatggtaggggcacaac

SEQ ID NO: 9461694 - DNA, 22 bp, Homo sapiens
ctgggacattataagaaacatt

SEQ ID NO: 9461695 - DNA, 22 bp, Homo sapiens
ctgggacattataagaaacatt

SEQ ID NO: 9461696 - DNA, 23 bp, Homo sapiens
ctgggacatggtaggggcacaac

SEQ ID NO: 9461697 - DNA, 22 bp, Homo sapiens
ctgggacatgatagaaacagat

SEQ ID NO: 9461698 - DNA, 22 bp, Homo sapiens
ctgggacatattgctagtgttg

SEQ ID NO: 9461699 - DNA, 22 bp, Homo sapiens
ctgggacatgatagaaacagat

SEQ ID NO: 9461700 - DNA, 22 bp, Homo sapiens
ctgggacatgatagaaacagat

SEQ ID NO: 9461701 - DNA, 22 bp, Homo sapiens
ctgggacatgatagaaacagat

SEQ ID NO: 9461702 - DNA, 22 bp, Homo sapiens
ctgggactggacctctgcctgg

SEQ ID NO: 9461703 - DNA, 22 bp, Homo sapiens
ctgggactggacctctgcctgg

SEQ ID NO: 9461704 - DNA, 22 bp, Homo sapiens
ctgggactgccattcacagcca

SEQ ID NO: 9461705 - DNA, 19 bp, Homo sapiens
ctgggactcctgatacctt

SEQ ID NO: 9461706 - DNA, 22 bp, Homo sapiens
ctgggactcagaccagttctgt

SEQ ID NO: 9461707 - DNA, 22 bp, Homo sapiens
ctgggactcagaccagttctgt

SEQ ID NO: 9461708 - DNA, 22 bp, Homo sapiens
ctgggactcagaccagttctgt

SEQ ID NO: 9461709 - DNA, 18 bp, Homo sapiens
ctgggactcaatgctact

SEQ ID NO: 9461710 - DNA, 18 bp, Homo sapiens
ctgggactcaatgctact

SEQ ID NO: 9461711 - DNA, 22 bp, Homo sapiens
ctgggaccatctgtgtctactt

SEQ ID NO: 9461712 - DNA, 22 bp, Homo sapiens
ctgggaccagtgaagcaactca

SEQ ID NO: 9461713 - DNA, 22 bp, Homo sapiens
ctgggaccctgccctgtggcct

SEQ ID NO: 9461714 - DNA, 22 bp, Homo sapiens
ctgggacccccactgcgtagct

SEQ ID NO: 9461715 - DNA, 22 bp, Homo sapiens
ctgggacctcctgaggtggagc

SEQ ID NO: 9461716 - DNA, 22 bp, Homo sapiens
ctgggacctcggggtgatcaaa

SEQ ID NO: 9461717 - DNA, 22 bp, Homo sapiens
ctgggacctcctcactgttcta

SEQ ID NO: 9461718 - DNA, 22 bp, Homo sapiens
ctgggaccctgccctgtggcct

SEQ ID NO: 9461719 - DNA, 22 bp, Homo sapiens
ctgggacctcctcactgttcta

SEQ ID NO: 9461720 - DNA, 22 bp, Homo sapiens
ctgggagaggctgctccgctct

SEQ ID NO: 9461721 - DNA, 22 bp, Homo sapiens
ctgggacttgtagtctcggcgc

SEQ ID NO: 9461722 - DNA, 22 bp, Homo sapiens
ctgggacttgggctatgctctg

SEQ ID NO: 9461723 - DNA, 22 bp, Homo sapiens
ctgggacttgcagagcaggagg

SEQ ID NO: 9461724 - DNA, 22 bp, Homo sapiens
ctgggactgggtcctcaggaca

SEQ ID NO: 9461725 - DNA, 22 bp, Homo sapiens
ctgggacttgcagagcaggagg

SEQ ID NO: 9461726 - DNA, 22 bp, Homo sapiens
ctgggacttgatgaaatgactg

SEQ ID NO: 9461727 - DNA, 22 bp, Homo sapiens
ctgggactgggtcctcaggaca

SEQ ID NO: 9461728 - DNA, 22 bp, Homo sapiens
ctgggagatctcctgagggcag

SEQ ID NO: 9461729 - DNA, 22 bp, Homo sapiens
ctgggagatatgaggatctgga

SEQ ID NO: 9461730 - DNA, 22 bp, Homo sapiens
ctgggagatatgaggatctgga

SEQ ID NO: 9461731 - DNA, 22 bp, Homo sapiens
ctgggagaggtggtgggaagta

SEQ ID NO: 9461732 - DNA, 22 bp, Homo sapiens
ctgggagaggtggtgggaagta

SEQ ID NO: 9461733 - DNA, 22 bp, Homo sapiens
ctgggagattcaggtgaagttt

SEQ ID NO: 9461734 - DNA, 22 bp, Homo sapiens
ctgggagattcaggtgaagttt

SEQ ID NO: 9461735 - DNA, 22 bp, Homo sapiens
ctgggagatgactcagagcagg

SEQ ID NO: 9461736 - DNA, 22 bp, Homo sapiens
ctgggagattgaggccatggtg

SEQ ID NO: 9461737 - DNA, 22 bp, Homo sapiens
ctgggagattgctagagatgca

SEQ ID NO: 9461738 - DNA, 22 bp, Homo sapiens
ctgggagatctgttgggactgg

SEQ ID NO: 9461739 - DNA, 22 bp, Homo sapiens
ctgggagatctgttgggactgg

SEQ ID NO: 9461740 - DNA, 22 bp, Homo sapiens
ctgggagatctcctgagggcag

SEQ ID NO: 9461741 - DNA, 22 bp, Homo sapiens
ctgggagatctgttgggactgg

SEQ ID NO: 9461742 - DNA, 22 bp, Homo sapiens
ctgcttatggagatgagtaaga

SEQ ID NO: 9461743 - DNA, 22 bp, Homo sapiens
ctgcttcaaggaaatgaatcgg

SEQ ID NO: 9461744 - DNA, 22 bp, Homo sapiens
ctgcttatggagatgagtaaga

SEQ ID NO: 9461745 - DNA, 22 bp, Homo sapiens
ctgcttatggaattgtatactg

SEQ ID NO: 9461746 - DNA, 22 bp, Homo sapiens
ctgctgtttctcaaaattaagt

SEQ ID NO: 9461747 - DNA, 20 bp, Homo sapiens
ctgcttaagtaagtgacaca

SEQ ID NO: 9461748 - DNA, 22 bp, Homo sapiens
ctgcttaaaatgcagattctgt

SEQ ID NO: 9461749 - DNA, 22 bp, Homo sapiens
ctgcttaaaatgcagattctgt

SEQ ID NO: 9461750 - DNA, 20 bp, Homo sapiens
ctgcttaagtaagtgacaca

SEQ ID NO: 9461751 - DNA, 22 bp, Homo sapiens
ctgctgttctgaagcaacaagc

SEQ ID NO: 9461752 - DNA, 23 bp, Homo sapiens
ctgctgtgttggtctcgatggga

SEQ ID NO: 9461753 - DNA, 22 bp, Homo sapiens
ctgctgtgttcctcctgcatct

SEQ ID NO: 9461754 - DNA, 22 bp, Homo sapiens
ctgctgtgttcctcctgcatct

SEQ ID NO: 9461755 - DNA, 22 bp, Homo sapiens
ctgctgtgtggattcaatggct

SEQ ID NO: 9461756 - DNA, 22 bp, Homo sapiens
ctgggacacgttctattccaaa

SEQ ID NO: 9461757 - DNA, 22 bp, Homo sapiens
ctgggacacgttgtgctttaac

SEQ ID NO: 9461758 - DNA, 22 bp, Homo sapiens
ctgggacagagcagcagtgggg

SEQ ID NO: 9461759 - DNA, 22 bp, Homo sapiens
ctgggacagagcagcagtgggg

SEQ ID NO: 9461760 - DNA, 22 bp, Homo sapiens
ctgggacagagcagcagtgggg

SEQ ID NO: 9461761 - DNA, 22 bp, Homo sapiens
ctgggacagagcagcagtgggg

SEQ ID NO: 9461762 - DNA, 22 bp, Homo sapiens
ctgggacacccaaggaaagagc

SEQ ID NO: 9461763 - DNA, 22 bp, Homo sapiens
ctgggacacccaaggaaagagc

SEQ ID NO: 9461764 - DNA, 22 bp, Homo sapiens
ctgggacacccaaggaaagagc

SEQ ID NO: 9461765 - DNA, 22 bp, Homo sapiens
ctgggacacccagagctgcaga

SEQ ID NO: 9461766 - DNA, 22 bp, Homo sapiens
ctgggacacccagagctgcaga

SEQ ID NO: 9461767 - DNA, 22 bp, Homo sapiens
ctgggacacccagagctgcaga

SEQ ID NO: 9461768 - DNA, 22 bp, Homo sapiens
ctgggacacccagagctgcaga

SEQ ID NO: 9461769 - DNA, 22 bp, Homo sapiens
ctgggacacgttctattccaaa

SEQ ID NO: 9461770 - DNA, 22 bp, Homo sapiens
ctgggaagaagtgggctacatt

SEQ ID NO: 9461771 - DNA, 22 bp, Homo sapiens
ctgggaagaatccaagggccct

SEQ ID NO: 9461772 - DNA, 22 bp, Homo sapiens
ctgggaagaagtgggctacatt

SEQ ID NO: 9461773 - DNA, 22 bp, Homo sapiens
ctgggaagaagtgggctacatt

SEQ ID NO: 9461774 - DNA, 22 bp, Homo sapiens
ctgggaagaagtgggctacatt

SEQ ID NO: 9461775 - DNA, 22 bp, Homo sapiens
ctgcttccatggtctggagact

SEQ ID NO: 9461776 - DNA, 22 bp, Homo sapiens
ctgcttccatgcaatggcagtc

SEQ ID NO: 9461777 - DNA, 22 bp, Homo sapiens
ctgcttccataaataatgtgct

SEQ ID NO: 9461778 - DNA, 22 bp, Homo sapiens
ctgcttcatatttcatagtgat

SEQ ID NO: 9461779 - DNA, 22 bp, Homo sapiens
ctgggctggcgcatccgacacg

SEQ ID NO: 9461780 - DNA, 22 bp, Homo sapiens
ctgggctgttctgcccctgggt

SEQ ID NO: 9461781 - DNA, 22 bp, Homo sapiens
ctgggctggcgcatccgacacg

SEQ ID NO: 9461782 - DNA, 22 bp, Homo sapiens
ctgggctggcgcatccgacacg

SEQ ID NO: 9461783 - DNA, 22 bp, Homo sapiens
ctgggctgtttgttctggtctc

SEQ ID NO: 9461784 - DNA, 22 bp, Homo sapiens
ctgggcttaggacctggtgcgg

SEQ ID NO: 9461785 - DNA, 22 bp, Homo sapiens
ctgggcttagcagctcctggtc

SEQ ID NO: 9461786 - DNA, 22 bp, Homo sapiens
ctgggctgtttgttctggtctc

SEQ ID NO: 9461787 - DNA, 22 bp, Homo sapiens
ctgggcttagcagctcctggtc

SEQ ID NO: 9461788 - DNA, 22 bp, Homo sapiens
ctgggctggagtgcaatggcgc

SEQ ID NO: 9461789 - DNA, 22 bp, Homo sapiens
ctgggctggagtgcaatggcgc

SEQ ID NO: 9461790 - DNA, 21 bp, Homo sapiens
ctgggctggcaggcattacct

SEQ ID NO: 9461791 - DNA, 22 bp, Homo sapiens
ctgggctggataattctttgct

SEQ ID NO: 9461792 - DNA, 22 bp, Homo sapiens
ctgggctcaaatcctatctcca

SEQ ID NO: 9461793 - DNA, 22 bp, Homo sapiens
ctgggctcaaatcctatctcca

SEQ ID NO: 9461794 - DNA, 22 bp, Homo sapiens
ctgggctagaaggaccaggatg

SEQ ID NO: 9461795 - DNA, 18 bp, Homo sapiens
ctgggcctttgtattttt

SEQ ID NO: 9461796 - DNA, 22 bp, Homo sapiens
ctgggcctttgggagttcggtg

SEQ ID NO: 9461797 - DNA, 22 bp, Homo sapiens
ctgggcctttacctacggagtt

SEQ ID NO: 9461798 - DNA, 22 bp, Homo sapiens
ctgggcctttgcttattaattt

SEQ ID NO: 9461799 - DNA, 22 bp, Homo sapiens
ctgggccttggattgacactgt

SEQ ID NO: 9461800 - DNA, 22 bp, Homo sapiens
ctgggccttggattgacactgt

SEQ ID NO: 9461801 - DNA, 22 bp, Homo sapiens
ctgggccttggattgacactgt

SEQ ID NO: 9461802 - DNA, 22 bp, Homo sapiens
ctgggctaattaagcacagctg

SEQ ID NO: 9461803 - DNA, 22 bp, Homo sapiens
ctgggcgtgtcttccagctggc

SEQ ID NO: 9461804 - DNA, 22 bp, Homo sapiens
ctgggcgcgtcccctgaggcgg

SEQ ID NO: 9461805 - DNA, 22 bp, Homo sapiens
ctgggcgcgtcccctgaggcgg

SEQ ID NO: 9461806 - DNA, 22 bp, Homo sapiens
ctgggctagaaggaccaggatg

SEQ ID NO: 9461807 - DNA, 22 bp, Homo sapiens
ctgggctagaaggaccaggatg

SEQ ID NO: 9461808 - DNA, 22 bp, Homo sapiens
ctgggctagaaggaccaggatg

SEQ ID NO: 9461809 - DNA, 22 bp, Homo sapiens
ctgggctagaaggaccaggatg

SEQ ID NO: 9461810 - DNA, 22 bp, Homo sapiens
ctgggcctggtgtggcacctgc

SEQ ID NO: 9461811 - DNA, 22 bp, Homo sapiens
ctgggcctggtgtggcacctgc

SEQ ID NO: 9461812 - DNA, 22 bp, Homo sapiens
ctgggcctggtgtggcacctgc

SEQ ID NO: 9461813 - DNA, 22 bp, Homo sapiens
ctgggcctcctctgcccaagct

SEQ ID NO: 9461814 - DNA, 22 bp, Homo sapiens
ctgggcctcctctgcccaagct

SEQ ID NO: 9461815 - DNA, 22 bp, Homo sapiens
ctgggcctcctctgcccaagct

SEQ ID NO: 9461816 - DNA, 22 bp, Homo sapiens
ctgggcctccagctctgccagc

SEQ ID NO: 9461817 - DNA, 17 bp, Homo sapiens
ctgggcctcccctgtcc

SEQ ID NO: 9461818 - DNA, 17 bp, Homo sapiens
ctgggcctcccctgtcc

SEQ ID NO: 9461819 - DNA, 22 bp, Homo sapiens
ctgggcctgtgggcacacggac

SEQ ID NO: 9461820 - DNA, 22 bp, Homo sapiens
ctgggcctgtgggcacacggac

SEQ ID NO: 9461821 - DNA, 22 bp, Homo sapiens
ctgggcctgtgactcccatcct

SEQ ID NO: 9461822 - DNA, 22 bp, Homo sapiens
ctgggcctgtgactcccatcct

SEQ ID NO: 9461823 - DNA, 22 bp, Homo sapiens
ctgggcctgtcagggctttttg

SEQ ID NO: 9461824 - DNA, 22 bp, Homo sapiens
ctgggcctgtccctgattgagg

SEQ ID NO: 9461825 - DNA, 22 bp, Homo sapiens
ctgggcctgtccctgattgagg

SEQ ID NO: 9461826 - DNA, 22 bp, Homo sapiens
ctgggccttgatcacacaggtg

SEQ ID NO: 9461827 - DNA, 22 bp, Homo sapiens
ctgggccttgatcacacaggtg

SEQ ID NO: 9461828 - DNA, 22 bp, Homo sapiens
ctgggccttgatcacacaggtg

SEQ ID NO: 9461829 - DNA, 22 bp, Homo sapiens
ctgggccttgcatcccagagcc

SEQ ID NO: 9461830 - DNA, 22 bp, Homo sapiens
ctgggccttgcatcccagagcc

SEQ ID NO: 9461831 - DNA, 22 bp, Homo sapiens
ctgggccttgccaggggtgtct

SEQ ID NO: 9461832 - DNA, 22 bp, Homo sapiens
ctgggccttgccttgcccacag

SEQ ID NO: 9461833 - DNA, 22 bp, Homo sapiens
ctgggccttgccttgcccacag

SEQ ID NO: 9461834 - DNA, 22 bp, Homo sapiens
ctgggccttatgagtacctgga

SEQ ID NO: 9461835 - DNA, 22 bp, Homo sapiens
ctgggccttatgagtacctgga

SEQ ID NO: 9461836 - DNA, 22 bp, Homo sapiens
ctgggccttagggcactccctt

SEQ ID NO: 9461837 - DNA, 22 bp, Homo sapiens
ctgggccttagggcactccctt

SEQ ID NO: 9461838 - DNA, 22 bp, Homo sapiens
ctgggccttcattgctctccca

SEQ ID NO: 9461839 - DNA, 22 bp, Homo sapiens
ctgggccttcattgctctccca

SEQ ID NO: 9461840 - DNA, 22 bp, Homo sapiens
ctgggccttgagaatcatgttt

SEQ ID NO: 9461841 - DNA, 22 bp, Homo sapiens
ctgggccttcattgctctccca

SEQ ID NO: 9461842 - DNA, 22 bp, Homo sapiens
ctgggagcccgcgtcctggtgg

SEQ ID NO: 9461843 - DNA, 22 bp, Homo sapiens
ctgggagcaagaggctgcaaat

SEQ ID NO: 9461844 - DNA, 22 bp, Homo sapiens
ctgggagcaagaggctgcaaat

SEQ ID NO: 9461845 - DNA, 22 bp, Homo sapiens
ctgggagattgctagagatgca

SEQ ID NO: 9461846 - DNA, 22 bp, Homo sapiens
ctgggagattgctagagatgca

SEQ ID NO: 9461847 - DNA, 22 bp, Homo sapiens
ctgggagattgctagagatgca

SEQ ID NO: 9461848 - DNA, 22 bp, Homo sapiens
ctgggagattgctagagatgca

SEQ ID NO: 9461849 - DNA, 22 bp, Homo sapiens
ctgggagcgcagcaggcacaac

SEQ ID NO: 9461850 - DNA, 22 bp, Homo sapiens
ctgggagcgcagcaggcacaac

SEQ ID NO: 9461851 - DNA, 22 bp, Homo sapiens
ctgggagcgcagcaggcacaac

SEQ ID NO: 9461852 - DNA, 22 bp, Homo sapiens
ctgggagccctgactagcctgg

SEQ ID NO: 9461853 - DNA, 22 bp, Homo sapiens
ctgggagcctggcagttgctga

SEQ ID NO: 9461854 - DNA, 22 bp, Homo sapiens
ctgggagccctgactagcctgg

SEQ ID NO: 9461855 - DNA, 22 bp, Homo sapiens
ctgggagcctggcagttgctga

SEQ ID NO: 9461856 - DNA, 22 bp, Homo sapiens
ctgggagcctggcagttgctga

SEQ ID NO: 9461857 - DNA, 22 bp, Homo sapiens
ctgggagcggctgtcactggtt

SEQ ID NO: 9461858 - DNA, 22 bp, Homo sapiens
ctgggagcggctgtcactggtt

SEQ ID NO: 9461859 - DNA, 22 bp, Homo sapiens
ctgggcaaattgtgccagctat

SEQ ID NO: 9461860 - DNA, 17 bp, Homo sapiens
ctgggatgtggactctt

SEQ ID NO: 9461861 - DNA, 22 bp, Homo sapiens
ctgggatgtgaggagcgcctct

SEQ ID NO: 9461862 - DNA, 17 bp, Homo sapiens
ctgggatgtggactctt

SEQ ID NO: 9461863 - DNA, 22 bp, Homo sapiens
ctgggcacctttgcagcaggct

SEQ ID NO: 9461864 - DNA, 22 bp, Homo sapiens
ctgggcactgcagcaggcatca

SEQ ID NO: 9461865 - DNA, 22 bp, Homo sapiens
ctgggcactgcagcaggcatca

SEQ ID NO: 9461866 - DNA, 22 bp, Homo sapiens
ctgggcacttgctcacagctct

SEQ ID NO: 9461867 - DNA, 22 bp, Homo sapiens
ctgggcagctgtatcagggagt

SEQ ID NO: 9461868 - DNA, 22 bp, Homo sapiens
ctgggcagctgtgcaaacaata

SEQ ID NO: 9461869 - DNA, 22 bp, Homo sapiens
ctgggcagctgtatcagggagt

SEQ ID NO: 9461870 - DNA, 22 bp, Homo sapiens
ctgggcagctgtgcaaacaata

SEQ ID NO: 9461871 - DNA, 22 bp, Homo sapiens
ctgggcagctgtgcaaacaata

SEQ ID NO: 9461872 - DNA, 22 bp, Homo sapiens
ctgggcagctgtatcagggagt

SEQ ID NO: 9461873 - DNA, 22 bp, Homo sapiens
ctgggcagctgtatcagggagt

SEQ ID NO: 9461874 - DNA, 22 bp, Homo sapiens
ctgggcagctccataccaccca

SEQ ID NO: 9461875 - DNA, 22 bp, Homo sapiens
ctgggcagctaccaccactgct

SEQ ID NO: 9461876 - DNA, 22 bp, Homo sapiens
ctgggcagcctcacacaatgtt

SEQ ID NO: 9461877 - DNA, 22 bp, Homo sapiens
ctgggcagcctcacacaatgtt

SEQ ID NO: 9461878 - DNA, 22 bp, Homo sapiens
ctgggcagcctcacacaatgtt

SEQ ID NO: 9461879 - DNA, 22 bp, Homo sapiens
ctgggcagctaccaccactgct

SEQ ID NO: 9461880 - DNA, 22 bp, Homo sapiens
ctgggcagctaccaccactgct

SEQ ID NO: 9461881 - DNA, 22 bp, Homo sapiens
ctgggcagcacatcatcgtatc

SEQ ID NO: 9461882 - DNA, 22 bp, Homo sapiens
ctgggcagagtccggaagatgg

SEQ ID NO: 9461883 - DNA, 22 bp, Homo sapiens
ctgggcagagtccggaagatgg

SEQ ID NO: 9461884 - DNA, 22 bp, Homo sapiens
ctgggcagagtccggaagatgg

SEQ ID NO: 9461885 - DNA, 22 bp, Homo sapiens
ctgggcagagctaacacctgag

SEQ ID NO: 9461886 - DNA, 22 bp, Homo sapiens
ctgggcagagctaacacctgag

SEQ ID NO: 9461887 - DNA, 22 bp, Homo sapiens
ctgggcagagctaacacctgag

SEQ ID NO: 9461888 - DNA, 22 bp, Homo sapiens
ctgggcagagctaacacctgag

SEQ ID NO: 9461889 - DNA, 22 bp, Homo sapiens
ctgggcagaattttaggatggc

SEQ ID NO: 9461890 - DNA, 22 bp, Homo sapiens
ctgggcagagctaacacctgag

SEQ ID NO: 9461891 - DNA, 22 bp, Homo sapiens
ctgggcagaattttaggatggc

SEQ ID NO: 9461892 - DNA, 22 bp, Homo sapiens
ctgggcagaattttaggatggc

SEQ ID NO: 9461893 - DNA, 22 bp, Homo sapiens
ctgggcacttgctcacagctct

SEQ ID NO: 9461894 - DNA, 22 bp, Homo sapiens
ctgggcacttgctcacagctct

SEQ ID NO: 9461895 - DNA, 22 bp, Homo sapiens
ctggtgcaaggctttggaatcc

SEQ ID NO: 9461896 - DNA, 22 bp, Homo sapiens
ctggtgcaaggctttggaatcc

SEQ ID NO: 9461897 - DNA, 22 bp, Homo sapiens
ctggtgagactcagggatgctt

SEQ ID NO: 9461898 - DNA, 22 bp, Homo sapiens
ctggtgagactcagggatgctt

SEQ ID NO: 9461899 - DNA, 22 bp, Homo sapiens
ctggtgcacattcgctctcata

SEQ ID NO: 9461900 - DNA, 22 bp, Homo sapiens
ctggtgcacattcgctctcata

SEQ ID NO: 9461901 - DNA, 22 bp, Homo sapiens
ctggtgcacgtggctgcagtcg

SEQ ID NO: 9461902 - DNA, 22 bp, Homo sapiens
ctggtgcactacagcctggaac

SEQ ID NO: 9461903 - DNA, 22 bp, Homo sapiens
ctggtgcaggaaggagctggca

SEQ ID NO: 9461904 - DNA, 22 bp, Homo sapiens
ctggtgccattctgtggcctag

SEQ ID NO: 9461905 - DNA, 22 bp, Homo sapiens
ctgtaaaatgaacctagtcatc

SEQ ID NO: 9461906 - DNA, 22 bp, Homo sapiens
ctgtaaaactgcttaagtatgc

SEQ ID NO: 9461907 - DNA, 22 bp, Homo sapiens
ctgtacaaaagaaagttcctat

SEQ ID NO: 9461908 - DNA, 22 bp, Homo sapiens
ctgtacaaatggcagttgagtt

SEQ ID NO: 9461909 - DNA, 22 bp, Homo sapiens
ctgtacaaagtagctgctggga

SEQ ID NO: 9461910 - DNA, 22 bp, Homo sapiens
ctgtacaaagtagctgctggga

SEQ ID NO: 9461911 - DNA, 22 bp, Homo sapiens
ctggtgccattctgtggcctag

SEQ ID NO: 9461912 - DNA, 22 bp, Homo sapiens
ctgtaaaactgcttaagtatgc

SEQ ID NO: 9461913 - DNA, 19 bp, Homo sapiens
ctgtacaggttgcttctgg

SEQ ID NO: 9461914 - DNA, 22 bp, Homo sapiens
ctgtacaagtccttcatcaggg

SEQ ID NO: 9461915 - DNA, 22 bp, Homo sapiens
ctgtacaagtccttcatcaggg

SEQ ID NO: 9461916 - DNA, 22 bp, Homo sapiens
ctgtacaatgttacctatttat

SEQ ID NO: 9461917 - DNA, 22 bp, Homo sapiens
ctgtacaatgttacctatttat

SEQ ID NO: 9461918 - DNA, 22 bp, Homo sapiens
ctgtacaatgttacctatttat

SEQ ID NO: 9461919 - DNA, 22 bp, Homo sapiens
ctgtacaatgttacctatttat

SEQ ID NO: 9461920 - DNA, 22 bp, Homo sapiens
ctgtacatcccgagagccagta

SEQ ID NO: 9461921 - DNA, 22 bp, Homo sapiens
ctgtacatcccgagagccagta

SEQ ID NO: 9461922 - DNA, 22 bp, Homo sapiens
ctgtactaattgctttacatgt

SEQ ID NO: 9461923 - DNA, 22 bp, Homo sapiens
ctgtacctcagctttgctccca

SEQ ID NO: 9461924 - DNA, 22 bp, Homo sapiens
ctgtactaattgctttacatgt

SEQ ID NO: 9461925 - DNA, 22 bp, Homo sapiens
ctgtagagaaagcatggaagct

SEQ ID NO: 9461926 - DNA, 22 bp, Homo sapiens
ctgtagagaaagcatggaagct

SEQ ID NO: 9461927 - DNA, 22 bp, Homo sapiens
ctgtagcaagttattcaataaa

SEQ ID NO: 9461928 - DNA, 22 bp, Homo sapiens
ctgtagaggaacaagagctctt

SEQ ID NO: 9461929 - DNA, 20 bp, Homo sapiens
ctgtagagcacaagtggagg

SEQ ID NO: 9461930 - DNA, 22 bp, Homo sapiens
ctgtagccagaagcagaaggcc

SEQ ID NO: 9461931 - DNA, 22 bp, Homo sapiens
ctgtagccagtttggcctcacc

SEQ ID NO: 9461932 - DNA, 20 bp, Homo sapiens
ctggggagctgctcccacga

SEQ ID NO: 9461933 - DNA, 20 bp, Homo sapiens
ctggggagcctcgcggtggc

SEQ ID NO: 9461934 - DNA, 22 bp, Homo sapiens
ctggtcacctccttcccagcta

SEQ ID NO: 9461935 - DNA, 20 bp, Homo sapiens
ctggggagcctcgcggtggc

SEQ ID NO: 9461936 - DNA, 22 bp, Homo sapiens
ctggggagacgatcgatgttct

SEQ ID NO: 9461937 - DNA, 20 bp, Homo sapiens
ctggggagcctcgcggtggc

SEQ ID NO: 9461938 - DNA, 20 bp, Homo sapiens
ctggggagcctcgcggtggc

SEQ ID NO: 9461939 - DNA, 20 bp, Homo sapiens
ctggggagcctcgcggtggc

SEQ ID NO: 9461940 - DNA, 22 bp, Homo sapiens
ctggtcagagcaactgctcaca

SEQ ID NO: 9461941 - DNA, 22 bp, Homo sapiens
ctggtcactggtctcatccagc

SEQ ID NO: 9461942 - DNA, 23 bp, Homo sapiens
ctggtcagaggctgctggaaggg

SEQ ID NO: 9461943 - DNA, 18 bp, Homo sapiens
ctggtctcccttcgcttt

SEQ ID NO: 9461944 - DNA, 22 bp, Homo sapiens
ctggtccttgctacccagcaag

SEQ ID NO: 9461945 - DNA, 22 bp, Homo sapiens
ctggtccttgctacccagcaag

SEQ ID NO: 9461946 - DNA, 22 bp, Homo sapiens
ctggtccttgacgcgtgggagg

SEQ ID NO: 9461947 - DNA, 22 bp, Homo sapiens
ctggtccttgctacccagcaag

SEQ ID NO: 9461948 - DNA, 21 bp, Homo sapiens
ctggtctggccaataaggtcc

SEQ ID NO: 9461949 - DNA, 22 bp, Homo sapiens
ctggtctggctacccagcgaat

SEQ ID NO: 9461950 - DNA, 22 bp, Homo sapiens
ctggtctggctacccagcgaat

SEQ ID NO: 9461951 - DNA, 19 bp, Homo sapiens
ctggtctgtcatgctcccc

SEQ ID NO: 9461952 - DNA, 16 bp, Homo sapiens
ctggtcttgctgccga

SEQ ID NO: 9461953 - DNA, 22 bp, Homo sapiens
ctggtgaagcccctcatgctgg

SEQ ID NO: 9461954 - DNA, 22 bp, Homo sapiens
ctggtgaagcccctcatgctgg

SEQ ID NO: 9461955 - DNA, 22 bp, Homo sapiens
ctggtgaatattggaggcattg

SEQ ID NO: 9461956 - DNA, 22 bp, Homo sapiens
ctggtgaatggataaactgttg

SEQ ID NO: 9461957 - DNA, 22 bp, Homo sapiens
ctggtctgctagaaagatgcat

SEQ ID NO: 9461958 - DNA, 19 bp, Homo sapiens
ctggtctgctgcttccagg

SEQ ID NO: 9461959 - DNA, 19 bp, Homo sapiens
ctggtctgctgcttccagg

SEQ ID NO: 9461960 - DNA, 19 bp, Homo sapiens
ctggtctgctgcttccagg

SEQ ID NO: 9461961 - DNA, 22 bp, Homo sapiens
ctggtctgagggctcttgaggc

SEQ ID NO: 9461962 - DNA, 22 bp, Homo sapiens
ctggtctgcaaggccatataga

SEQ ID NO: 9461963 - DNA, 20 bp, Homo sapiens
ctggtctgccactcacagtt

SEQ ID NO: 9461964 - DNA, 22 bp, Homo sapiens
ctggggaacaatttgccacact

SEQ ID NO: 9461965 - DNA, 22 bp, Homo sapiens
ctggggaaggcggtgactgcgc

SEQ ID NO: 9461966 - DNA, 22 bp, Homo sapiens
ctgggcttttgagtcacaaggg

SEQ ID NO: 9461967 - DNA, 22 bp, Homo sapiens
ctgggcttttgagtcacaaggg

SEQ ID NO: 9461968 - DNA, 22 bp, Homo sapiens
ctgggcttaggacctggtgcgg

SEQ ID NO: 9461969 - DNA, 22 bp, Homo sapiens
ctgggcttctccccctggcaga

SEQ ID NO: 9461970 - DNA, 22 bp, Homo sapiens
ctgggcttgagttcctgctcgt

SEQ ID NO: 9461971 - DNA, 22 bp, Homo sapiens
ctgggcttgtgttagctgacaa

SEQ ID NO: 9461972 - DNA, 22 bp, Homo sapiens
ctggggactttggttctccatg

SEQ ID NO: 9461973 - DNA, 22 bp, Homo sapiens
ctggggagaagcgactcggctg

SEQ ID NO: 9461974 - DNA, 22 bp, Homo sapiens
ctggggagaagcgactcggctg

SEQ ID NO: 9461975 - DNA, 22 bp, Homo sapiens
ctggggagaagcgactcggctg

SEQ ID NO: 9461976 - DNA, 22 bp, Homo sapiens
ctggggagacgatcgatgttct

SEQ ID NO: 9461977 - DNA, 22 bp, Homo sapiens
ctggggagacgatcgatgttct

SEQ ID NO: 9461978 - DNA, 22 bp, Homo sapiens
ctggggaatagagctggagacc

SEQ ID NO: 9461979 - DNA, 22 bp, Homo sapiens
ctggggaaggcggtgactgcgc

SEQ ID NO: 9461980 - DNA, 20 bp, Homo sapiens
ctggggacagcaatggctgt

SEQ ID NO: 9461981 - DNA, 20 bp, Homo sapiens
ctggggacagcaatggctgt

SEQ ID NO: 9461982 - DNA, 22 bp, Homo sapiens
ctggggacgtcgggcagtgttc

SEQ ID NO: 9461983 - DNA, 22 bp, Homo sapiens
ctggggacgtcgggcagtgttc

SEQ ID NO: 9461984 - DNA, 22 bp, Homo sapiens
ctggggaccgagcaagctctgg

SEQ ID NO: 9461985 - DNA, 22 bp, Homo sapiens
ctggggaccgagcaagctctgg

SEQ ID NO: 9461986 - DNA, 18 bp, Homo sapiens
ctgtgccctgctcctact

SEQ ID NO: 9461987 - DNA, 22 bp, Homo sapiens
ctgtgccctggccaggcctctc

SEQ ID NO: 9461988 - DNA, 22 bp, Homo sapiens
ctgtctgtgcctcttctcccag

SEQ ID NO: 9461989 - DNA, 22 bp, Homo sapiens
ctgtctgtggagcttctgatgt

SEQ ID NO: 9461990 - DNA, 17 bp, Homo sapiens
ctgtgctcgagtgatgg

SEQ ID NO: 9461991 - DNA, 22 bp, Homo sapiens
ctgtgccctggccaggcctctc

SEQ ID NO: 9461992 - DNA, 22 bp, Homo sapiens
ctgtgccctgtggctggcacct

SEQ ID NO: 9461993 - DNA, 22 bp, Homo sapiens
ctgtgccctgtggctggcacct

SEQ ID NO: 9461994 - DNA, 22 bp, Homo sapiens
ctgtgctgattcagcacaggcc

SEQ ID NO: 9461995 - DNA, 22 bp, Homo sapiens
ctgtgctgattcagcacaggcc

SEQ ID NO: 9461996 - DNA, 22 bp, Homo sapiens
ctgtgctgattcagcacaggcc

SEQ ID NO: 9461997 - DNA, 17 bp, Homo sapiens
ctgtgctcgagtgatgg

SEQ ID NO: 9461998 - DNA, 22 bp, Homo sapiens
ctgtgctgaacaattctgcatt

SEQ ID NO: 9461999 - DNA, 22 bp, Homo sapiens
ctgtgctgaacaattctgcatt

SEQ ID NO: 9462000 - DNA, 22 bp, Homo sapiens
ctgtgctggtgaaacccacaga

SEQ ID NO: 9462001 - DNA, 22 bp, Homo sapiens
ctgtgctgtcttgggagcctta

SEQ ID NO: 9462002 - DNA, 22 bp, Homo sapiens
ctgtgctggtccagggagctgg

SEQ ID NO: 9462003 - DNA, 23 bp, Homo sapiens
ctgtgctgggtcccatcttgggc

SEQ ID NO: 9462004 - DNA, 22 bp, Homo sapiens
ctgtgctggcagcaatcaagga

SEQ ID NO: 9462005 - DNA, 22 bp, Homo sapiens
ctgtgctggcagacctggagtt

SEQ ID NO: 9462006 - DNA, 22 bp, Homo sapiens
ctgtgctggcagcaatcaagga

SEQ ID NO: 9462007 - DNA, 22 bp, Homo sapiens
ctgtgctggagatgggccagag

SEQ ID NO: 9462008 - DNA, 22 bp, Homo sapiens
ctgtgctggagatgggccagag

SEQ ID NO: 9462009 - DNA, 22 bp, Homo sapiens
ctgtgctggattctgaggctac

SEQ ID NO: 9462010 - DNA, 22 bp, Homo sapiens
ctgtgctggcagacctggagtt

SEQ ID NO: 9462011 - DNA, 22 bp, Homo sapiens
ctgtgctggcagacctggagtt

SEQ ID NO: 9462012 - DNA, 22 bp, Homo sapiens
ctgtgctgcagacgcagtagct

SEQ ID NO: 9462013 - DNA, 22 bp, Homo sapiens
ctgtgctgcagacgcagtagct

SEQ ID NO: 9462014 - DNA, 22 bp, Homo sapiens
ctgtgctgattcagcacaggcc

SEQ ID NO: 9462015 - DNA, 22 bp, Homo sapiens
ctgtgctgctagacctggattc

SEQ ID NO: 9462016 - DNA, 22 bp, Homo sapiens
ctgtctggaatgcagtacatag

SEQ ID NO: 9462017 - DNA, 17 bp, Homo sapiens
ctgtctgctgcttcctc

SEQ ID NO: 9462018 - DNA, 22 bp, Homo sapiens
ctgtctgctatgcttgttgtca

SEQ ID NO: 9462019 - DNA, 22 bp, Homo sapiens
ctgtctgctcataatggagggc

SEQ ID NO: 9462020 - DNA, 22 bp, Homo sapiens
ctgtctggaatgcagtacatag

SEQ ID NO: 9462021 - DNA, 22 bp, Homo sapiens
ctgtctggagttatgtaaatag

SEQ ID NO: 9462022 - DNA, 22 bp, Homo sapiens
ctgtctggatataccttggcca

SEQ ID NO: 9462023 - DNA, 19 bp, Homo sapiens
ctgtctgcggggcctgttc

SEQ ID NO: 9462024 - DNA, 19 bp, Homo sapiens
ctgtctgcggggcctgttc

SEQ ID NO: 9462025 - DNA, 17 bp, Homo sapiens
ctgtctgcgcatgaggt

SEQ ID NO: 9462026 - DNA, 17 bp, Homo sapiens
ctgtctgcgcatgaggt

SEQ ID NO: 9462027 - DNA, 22 bp, Homo sapiens
ctgtctgctatgcttgttgtca

SEQ ID NO: 9462028 - DNA, 22 bp, Homo sapiens
ctgtctgctagaacatctatac

SEQ ID NO: 9462029 - DNA, 22 bp, Homo sapiens
ctgtctgctagaacatctatac

SEQ ID NO: 9462030 - DNA, 22 bp, Homo sapiens
ctgtctgggtctacatcctctg

SEQ ID NO: 9462031 - DNA, 22 bp, Homo sapiens
ctgtctggccggcccagcttcc

SEQ ID NO: 9462032 - DNA, 22 bp, Homo sapiens
ctgtctgggtctacatcctctg

SEQ ID NO: 9462033 - DNA, 22 bp, Homo sapiens
ctgtctgggtctacatcctctg

SEQ ID NO: 9462034 - DNA, 22 bp, Homo sapiens
ctgtctgggtctacatcctctg

SEQ ID NO: 9462035 - DNA, 22 bp, Homo sapiens
ctgtctgggtctacatcctctg

SEQ ID NO: 9462036 - DNA, 22 bp, Homo sapiens
ctgtctgggtctacatcctctg

SEQ ID NO: 9462037 - DNA, 21 bp, Homo sapiens
ctgtctggccgcgggctccgc

SEQ ID NO: 9462038 - DNA, 22 bp, Homo sapiens
ctgtctggatgtgagtcaccta

SEQ ID NO: 9462039 - DNA, 22 bp, Homo sapiens
ctgtctggatataccttggcca

SEQ ID NO: 9462040 - DNA, 19 bp, Homo sapiens
ctgtctgtgcagagatgtg

SEQ ID NO: 9462041 - DNA, 22 bp, Homo sapiens
ctgtctgtgcctcttctcccag

SEQ ID NO: 9462042 - DNA, 19 bp, Homo sapiens
ctgtctgtgcagagatgtg

SEQ ID NO: 9462043 - DNA, 19 bp, Homo sapiens
ctgtctgtgcagagatgtg

SEQ ID NO: 9462044 - DNA, 22 bp, Homo sapiens
ctgtctgtgacctctgcatgtc

SEQ ID NO: 9462045 - DNA, 22 bp, Homo sapiens
ctgtctgtgacctctgcatgtc

SEQ ID NO: 9462046 - DNA, 22 bp, Homo sapiens
ctgtctgtcaagttcatctcca

SEQ ID NO: 9462047 - DNA, 22 bp, Homo sapiens
ctgtctgtcaccaaaacagact

SEQ ID NO: 9462048 - DNA, 22 bp, Homo sapiens
ctgtctgtcccgtcaccgcccc

SEQ ID NO: 9462049 - DNA, 22 bp, Homo sapiens
ctgtctgtcccgtcaccgcccc

SEQ ID NO: 9462050 - DNA, 22 bp, Homo sapiens
ctgtctgtcctgagttcaacca

SEQ ID NO: 9462051 - DNA, 22 bp, Homo sapiens
ctgtctgtactgagagttctgt

SEQ ID NO: 9462052 - DNA, 22 bp, Homo sapiens
ctgtctgtagacatttttggtt

SEQ ID NO: 9462053 - DNA, 22 bp, Homo sapiens
ctgtctgtatccctgttggtaa

SEQ ID NO: 9462054 - DNA, 22 bp, Homo sapiens
ctgtctgtatccctgttggtaa

SEQ ID NO: 9462055 - DNA, 22 bp, Homo sapiens
ctgtctgtcaagttcatctcca

SEQ ID NO: 9462056 - DNA, 19 bp, Homo sapiens
ctgtctggttcatgtgttc

SEQ ID NO: 9462057 - DNA, 22 bp, Homo sapiens
ctgtctggtgtccctgtctaca

SEQ ID NO: 9462058 - DNA, 22 bp, Homo sapiens
ctgtctggtgtccctgtctaca

SEQ ID NO: 9462059 - DNA, 22 bp, Homo sapiens
ctgtctggtgtccctgtctaca

SEQ ID NO: 9462060 - DNA, 19 bp, Homo sapiens
ctgtctggttcatgtgttc

SEQ ID NO: 9462061 - DNA, 19 bp, Homo sapiens
ctgtctggttcatgtgttc

SEQ ID NO: 9462062 - DNA, 19 bp, Homo sapiens
ctgtctggttcatgtgttc

SEQ ID NO: 9462063 - DNA, 22 bp, Homo sapiens
ctgtctgtacaaatgtggggcc

SEQ ID NO: 9462064 - DNA, 22 bp, Homo sapiens
ctgtcaacacgggtgtgcgtgc

SEQ ID NO: 9462065 - DNA, 22 bp, Homo sapiens
ctgtattttttaagtgatctgg

SEQ ID NO: 9462066 - DNA, 22 bp, Homo sapiens
ctgtattttttaagaatatctc

SEQ ID NO: 9462067 - DNA, 22 bp, Homo sapiens
ctgtattttcatgcctacgtac

SEQ ID NO: 9462068 - DNA, 22 bp, Homo sapiens
ctgtcacccacccagcctgtca

SEQ ID NO: 9462069 - DNA, 18 bp, Homo sapiens
ctgtcaccgccaccacac

SEQ ID NO: 9462070 - DNA, 22 bp, Homo sapiens
ctgtcaccatttgagccctgga

SEQ ID NO: 9462071 - DNA, 22 bp, Homo sapiens
ctgtcaccatttgagccctgga

SEQ ID NO: 9462072 - DNA, 22 bp, Homo sapiens
ctgtcacaggttcaaactcccc

SEQ ID NO: 9462073 - DNA, 22 bp, Homo sapiens
ctgtcacagcccgcgtctcctc

SEQ ID NO: 9462074 - DNA, 17 bp, Homo sapiens
ctgtcacaatacctcgc

SEQ ID NO: 9462075 - DNA, 22 bp, Homo sapiens
ctgtcaatttatgttgacatgc

SEQ ID NO: 9462076 - DNA, 22 bp, Homo sapiens
ctgtcaacattggtgtctgtca

SEQ ID NO: 9462077 - DNA, 22 bp, Homo sapiens
ctgtcacactaaaacaagaagt

SEQ ID NO: 9462078 - DNA, 17 bp, Homo sapiens
ctgtcacaatacctcgc

SEQ ID NO: 9462079 - DNA, 23 bp, Homo sapiens
ctgtatttgacttgagcggaaat

SEQ ID NO: 9462080 - DNA, 22 bp, Homo sapiens
ctgtatttgaaagaaaagattt

SEQ ID NO: 9462081 - DNA, 22 bp, Homo sapiens
ctgtatttgtcctctatttatt

SEQ ID NO: 9462082 - DNA, 22 bp, Homo sapiens
ctgtatttgtcctctatttatt

SEQ ID NO: 9462083 - DNA, 22 bp, Homo sapiens
ctgtatatcatggttttgcagt

SEQ ID NO: 9462084 - DNA, 22 bp, Homo sapiens
ctgtatataatgtatgcatggg

SEQ ID NO: 9462085 - DNA, 22 bp, Homo sapiens
ctgtatttgaaagaaaagattt

SEQ ID NO: 9462086 - DNA, 20 bp, Homo sapiens
ctgtagggtgcagcaggctc

SEQ ID NO: 9462087 - DNA, 22 bp, Homo sapiens
ctgtaggtgattgctatgttat

SEQ ID NO: 9462088 - DNA, 22 bp, Homo sapiens
ctgtaggcttagctagaagtga

SEQ ID NO: 9462089 - DNA, 22 bp, Homo sapiens
ctgtagctccagcctgtctaca

SEQ ID NO: 9462090 - DNA, 22 bp, Homo sapiens
ctgtaggagtgggaatttattg

SEQ ID NO: 9462091 - DNA, 22 bp, Homo sapiens
ctgtataacatcttttgtttcc

SEQ ID NO: 9462092 - DNA, 22 bp, Homo sapiens
ctgtcacctgttcactgcagca

SEQ ID NO: 9462093 - DNA, 22 bp, Homo sapiens
ctgtcactctggcaacccagta

SEQ ID NO: 9462094 - DNA, 22 bp, Homo sapiens
ctgtcacctgttcactgcagca

SEQ ID NO: 9462095 - DNA, 22 bp, Homo sapiens
ctgtcacctgccagcataccca

SEQ ID NO: 9462096 - DNA, 22 bp, Homo sapiens
ctgtcacctgccagcataccca

SEQ ID NO: 9462097 - DNA, 22 bp, Homo sapiens
ctgtcacttaaattcaggctga

SEQ ID NO: 9462098 - DNA, 22 bp, Homo sapiens
ctgtcagagatggggagtcaga

SEQ ID NO: 9462099 - DNA, 22 bp, Homo sapiens
ctgtcagaggctctctgttgcc

SEQ ID NO: 9462100 - DNA, 22 bp, Homo sapiens
ctgtcactgatgggctcaccag

SEQ ID NO: 9462101 - DNA, 22 bp, Homo sapiens
ctgtcagcttctcctggccaga

SEQ ID NO: 9462102 - DNA, 22 bp, Homo sapiens
ctgtcagaggctctctgttgcc

SEQ ID NO: 9462103 - DNA, 18 bp, Homo sapiens
ctgtcagcagcttcacga

SEQ ID NO: 9462104 - DNA, 22 bp, Homo sapiens
ctgtctgccaataatctatggc

SEQ ID NO: 9462105 - DNA, 22 bp, Homo sapiens
ctgtctctgttgcctgtaggtg

SEQ ID NO: 9462106 - DNA, 22 bp, Homo sapiens
ctgtctctgttgcctgtaggtg

SEQ ID NO: 9462107 - DNA, 22 bp, Homo sapiens
ctgtctgaatcctaagcttcct

SEQ ID NO: 9462108 - DNA, 22 bp, Homo sapiens
ctgtcctgtggtgacaggtaca

SEQ ID NO: 9462109 - DNA, 22 bp, Homo sapiens
ctgtcctgtggtgacaggtaca

SEQ ID NO: 9462110 - DNA, 22 bp, Homo sapiens
ctgtcctgtggacctgaggacg

SEQ ID NO: 9462111 - DNA, 22 bp, Homo sapiens
ctgtcctgtggacctgaggacg

SEQ ID NO: 9462112 - DNA, 22 bp, Homo sapiens
ctgtcctgtgtcagcctgaaat

SEQ ID NO: 9462113 - DNA, 22 bp, Homo sapiens
ctgtcctgtgtcagcctgaaat

SEQ ID NO: 9462114 - DNA, 22 bp, Homo sapiens
ctgtccttactgcttctggctt

SEQ ID NO: 9462115 - DNA, 22 bp, Homo sapiens
ctgtccttgctggccaggtatg

SEQ ID NO: 9462116 - DNA, 22 bp, Homo sapiens
cttataaagtccatctgaacaa

SEQ ID NO: 9462117 - DNA, 22 bp, Homo sapiens
cttataaagtccatctgaacaa

SEQ ID NO: 9462118 - DNA, 22 bp, Homo sapiens
cttataaagtccatctgaacaa

SEQ ID NO: 9462119 - DNA, 22 bp, Homo sapiens
cttagtttctgtttctgattaa

SEQ ID NO: 9462120 - DNA, 22 bp, Homo sapiens
cttataaagtccatctgaacaa

SEQ ID NO: 9462121 - DNA, 22 bp, Homo sapiens
cttataaagtccatctgaacaa

SEQ ID NO: 9462122 - DNA, 22 bp, Homo sapiens
cttatacaccctcttcccaggc

SEQ ID NO: 9462123 - DNA, 22 bp, Homo sapiens
cttatacacgaacacaaggtgt

SEQ ID NO: 9462124 - DNA, 22 bp, Homo sapiens
cttatacacgaacacaaggtgt

SEQ ID NO: 9462125 - DNA, 22 bp, Homo sapiens
cttagtttctctgtatgtttac

SEQ ID NO: 9462126 - DNA, 22 bp, Homo sapiens
cttagtttctctgtatgtttac

SEQ ID NO: 9462127 - DNA, 22 bp, Homo sapiens
cttagtatctatgaagtgaaaa

SEQ ID NO: 9462128 - DNA, 22 bp, Homo sapiens
cttagggaatcttagagctgga

SEQ ID NO: 9462129 - DNA, 22 bp, Homo sapiens
cttaggcaagcagagcccatcc

SEQ ID NO: 9462130 - DNA, 22 bp, Homo sapiens
cttagcagtgggtaccagggct

SEQ ID NO: 9462131 - DNA, 22 bp, Homo sapiens
cttagcagtttgcctggcacag

SEQ ID NO: 9462132 - DNA, 22 bp, Homo sapiens
cttagctgcgggccctcctcgc

SEQ ID NO: 9462133 - DNA, 20 bp, Homo sapiens
cttagcttctaaggttctgg

SEQ ID NO: 9462134 - DNA, 22 bp, Homo sapiens
cttagcttctctgcatctgtgt

SEQ ID NO: 9462135 - DNA, 22 bp, Homo sapiens
cttagcttctctgcatctgtgt

SEQ ID NO: 9462136 - DNA, 22 bp, Homo sapiens
cttagctttaaaagtgagatct

SEQ ID NO: 9462137 - DNA, 22 bp, Homo sapiens
cttaggaaagttggctgatttc

SEQ ID NO: 9462138 - DNA, 22 bp, Homo sapiens
cttaggaaagtttctgcttatg

SEQ ID NO: 9462139 - DNA, 22 bp, Homo sapiens
cttaggaaatatatactaaact

SEQ ID NO: 9462140 - DNA, 22 bp, Homo sapiens
cttaggaatatccacagcaggt

SEQ ID NO: 9462141 - DNA, 22 bp, Homo sapiens
cttcatttcaggctgaagaata

SEQ ID NO: 9462142 - DNA, 22 bp, Homo sapiens
cttcatttccatccaactggga

SEQ ID NO: 9462143 - DNA, 18 bp, Homo sapiens
cttcatttgtagagttcc

SEQ ID NO: 9462144 - DNA, 22 bp, Homo sapiens
cttccaaaatttatatgttgaa

SEQ ID NO: 9462145 - DNA, 22 bp, Homo sapiens
cttccaaagcactttatggacc

SEQ ID NO: 9462146 - DNA, 22 bp, Homo sapiens
cttccaaagcactttatggacc

SEQ ID NO: 9462147 - DNA, 22 bp, Homo sapiens
cttccaaatgtaaataagtttc

SEQ ID NO: 9462148 - DNA, 19 bp, Homo sapiens
cttccaactgtgatctaga

SEQ ID NO: 9462149 - DNA, 22 bp, Homo sapiens
cttcagttagagtttacaaagt

SEQ ID NO: 9462150 - DNA, 22 bp, Homo sapiens
cttcagttagtttcatgtgagc

SEQ ID NO: 9462151 - DNA, 22 bp, Homo sapiens
cttcagttagccaattcaggtc

SEQ ID NO: 9462152 - DNA, 22 bp, Homo sapiens
cttcagttagccaattcaggtc

SEQ ID NO: 9462153 - DNA, 22 bp, Homo sapiens
cttcattacttgctcgtagcac

SEQ ID NO: 9462154 - DNA, 19 bp, Homo sapiens
cttcattcttcagcttttg

SEQ ID NO: 9462155 - DNA, 22 bp, Homo sapiens
cttcatttcaggctgaagaata

SEQ ID NO: 9462156 - DNA, 22 bp, Homo sapiens
cttcatttcaggctgaagaata

SEQ ID NO: 9462157 - DNA, 22 bp, Homo sapiens
cttcatttcaggctgaagaata

SEQ ID NO: 9462158 - DNA, 22 bp, Homo sapiens
cttcattggcttccatagatgc

SEQ ID NO: 9462159 - DNA, 22 bp, Homo sapiens
cttcagtgttggttcattacga

SEQ ID NO: 9462160 - DNA, 22 bp, Homo sapiens
cttatatttgtcaactttacaa

SEQ ID NO: 9462161 - DNA, 22 bp, Homo sapiens
cttatagtatgatgttgagaat

SEQ ID NO: 9462162 - DNA, 22 bp, Homo sapiens
cttatagtatgatgttgagaat

SEQ ID NO: 9462163 - DNA, 19 bp, Homo sapiens
cttatacagattttctcat

SEQ ID NO: 9462164 - DNA, 22 bp, Homo sapiens
cttctcaactgcacttgccagg

SEQ ID NO: 9462165 - DNA, 22 bp, Homo sapiens
cttctattcactggtcacagtt

SEQ ID NO: 9462166 - DNA, 22 bp, Homo sapiens
cttctattcactggtcacagtt

SEQ ID NO: 9462167 - DNA, 22 bp, Homo sapiens
cttctcaaactgagactgtcta

SEQ ID NO: 9462168 - DNA, 22 bp, Homo sapiens
cttctcaaacctgaaaggacaa

SEQ ID NO: 9462169 - DNA, 23 bp, Homo sapiens
cttctcagaagtctgtgccagga

SEQ ID NO: 9462170 - DNA, 22 bp, Homo sapiens
cttctcagcatggttactgtga

SEQ ID NO: 9462171 - DNA, 22 bp, Homo sapiens
cttctcagcattttgtcagtct

SEQ ID NO: 9462172 - DNA, 22 bp, Homo sapiens
cttctcagcattttgtcagtct

SEQ ID NO: 9462173 - DNA, 22 bp, Homo sapiens
cttctcttggtagttcttgttg

SEQ ID NO: 9462174 - DNA, 23 bp, Homo sapiens
cttctagagtcagctccaagttt

SEQ ID NO: 9462175 - DNA, 22 bp, Homo sapiens
cttctagagctggagcaaatgt

SEQ ID NO: 9462176 - DNA, 22 bp, Homo sapiens
cttctagaggtgcaagggaaga

SEQ ID NO: 9462177 - DNA, 19 bp, Homo sapiens
cttctagaccttataccac

SEQ ID NO: 9462178 - DNA, 22 bp, Homo sapiens
cttctaggcttctcagggggca

SEQ ID NO: 9462179 - DNA, 22 bp, Homo sapiens
cttctagagtttctgatgcaac

SEQ ID NO: 9462180 - DNA, 22 bp, Homo sapiens
cttctacacatccctcttgctt

SEQ ID NO: 9462181 - DNA, 22 bp, Homo sapiens
cttctacacatccctcttgctt

SEQ ID NO: 9462182 - DNA, 22 bp, Homo sapiens
cttctaattcttatgtaagctt

SEQ ID NO: 9462183 - DNA, 22 bp, Homo sapiens
cttctaatataaagtctttgca

SEQ ID NO: 9462184 - DNA, 22 bp, Homo sapiens
cttctaattcttatgtaagctt

SEQ ID NO: 9462185 - DNA, 22 bp, Homo sapiens
cttccacattatttaggaatcc

SEQ ID NO: 9462186 - DNA, 20 bp, Homo sapiens
cttccacacaagaagcacag

SEQ ID NO: 9462187 - DNA, 22 bp, Homo sapiens
cttccacattatttaggaatcc

SEQ ID NO: 9462188 - DNA, 22 bp, Homo sapiens
cttccaagcccaggagccattt

SEQ ID NO: 9462189 - DNA, 22 bp, Homo sapiens
cttccagctgattacaggctat

SEQ ID NO: 9462190 - DNA, 20 bp, Homo sapiens
cttccaccagggccgctgat

SEQ ID NO: 9462191 - DNA, 22 bp, Homo sapiens
cttcctttgctgttcggaggtt

SEQ ID NO: 9462192 - DNA, 22 bp, Homo sapiens
cttcctttggttggagcgccgt

SEQ ID NO: 9462193 - DNA, 20 bp, Homo sapiens
cttccttttccttcgtcaaa

SEQ ID NO: 9462194 - DNA, 22 bp, Homo sapiens
cttctaacatcctacaatgcaa

SEQ ID NO: 9462195 - DNA, 22 bp, Homo sapiens
cttcctttgctgttcggaggtt

SEQ ID NO: 9462196 - DNA, 22 bp, Homo sapiens
cttcctttccccaatcatatcg

SEQ ID NO: 9462197 - DNA, 22 bp, Homo sapiens
cttcctggtttgaagctcgccg

SEQ ID NO: 9462198 - DNA, 22 bp, Homo sapiens
cttccttcaatataatttttac

SEQ ID NO: 9462199 - DNA, 22 bp, Homo sapiens
cttcctgttgtcacagtctgcg

SEQ ID NO: 9462200 - DNA, 22 bp, Homo sapiens
cttcctgggtctggagactgga

SEQ ID NO: 9462201 - DNA, 22 bp, Homo sapiens
cttcctgggtctggagactgga

SEQ ID NO: 9462202 - DNA, 22 bp, Homo sapiens
cttcctgggtctggagactgga

SEQ ID NO: 9462203 - DNA, 22 bp, Homo sapiens
cttccagctgattggcatccag

SEQ ID NO: 9462204 - DNA, 22 bp, Homo sapiens
cttccagcttgtggcgctttcc

SEQ ID NO: 9462205 - DNA, 22 bp, Homo sapiens
cttacaaatacacttaggagag

SEQ ID NO: 9462206 - DNA, 22 bp, Homo sapiens
cttacaaatacacttaggagag

SEQ ID NO: 9462207 - DNA, 22 bp, Homo sapiens
cttacaaatacacttaggagag

SEQ ID NO: 9462208 - DNA, 22 bp, Homo sapiens
cttacaaatacacttaggagag

SEQ ID NO: 9462209 - DNA, 22 bp, Homo sapiens
cttacaaatacacttaggagag

SEQ ID NO: 9462210 - DNA, 22 bp, Homo sapiens
cttacaaaggagaggagatagg

SEQ ID NO: 9462211 - DNA, 22 bp, Homo sapiens
cttacaaaggagaggagatagg

SEQ ID NO: 9462212 - DNA, 22 bp, Homo sapiens
cttacaaaggagaggagatagg

SEQ ID NO: 9462213 - DNA, 22 bp, Homo sapiens
cttacaaaggagaggagatagg

SEQ ID NO: 9462214 - DNA, 22 bp, Homo sapiens
cttacaaaggagaggagatagg

SEQ ID NO: 9462215 - DNA, 22 bp, Homo sapiens
cttacaaaggagaggagatagg

SEQ ID NO: 9462216 - DNA, 22 bp, Homo sapiens
cttacaaaggagaggagatagg

SEQ ID NO: 9462217 - DNA, 22 bp, Homo sapiens
cttaatgtggacctggtttcta

SEQ ID NO: 9462218 - DNA, 22 bp, Homo sapiens
cttaattactgtccaatatgca

SEQ ID NO: 9462219 - DNA, 22 bp, Homo sapiens
cttaattacccaatgtggtagg

SEQ ID NO: 9462220 - DNA, 22 bp, Homo sapiens
cttaaagttgacacagtccctg

SEQ ID NO: 9462221 - DNA, 22 bp, Homo sapiens
cttaaagtagaatacaagacct

SEQ ID NO: 9462222 - DNA, 22 bp, Homo sapiens
cttaaagtattggtttaaccaa

SEQ ID NO: 9462223 - DNA, 22 bp, Homo sapiens
cttaaagtctatcctttctaga

SEQ ID NO: 9462224 - DNA, 22 bp, Homo sapiens
cttaaatccatcatttctaatc

SEQ ID NO: 9462225 - DNA, 22 bp, Homo sapiens
cttaaaggaggttttgtttcca

SEQ ID NO: 9462226 - DNA, 22 bp, Homo sapiens
cttaaagatgtcaaggctgttt

SEQ ID NO: 9462227 - DNA, 22 bp, Homo sapiens
cttaaagtagaatacaagacct

SEQ ID NO: 9462228 - DNA, 22 bp, Homo sapiens
cttaaagtagaatacaagacct

SEQ ID NO: 9462229 - DNA, 22 bp, Homo sapiens
cttaaagagtatttaatataat

SEQ ID NO: 9462230 - DNA, 22 bp, Homo sapiens
cttagaaatcgaactcaggtta

SEQ ID NO: 9462231 - DNA, 22 bp, Homo sapiens
cttagaaatgcagattctcagg

SEQ ID NO: 9462232 - DNA, 22 bp, Homo sapiens
cttagaaatgcagattctcagg

SEQ ID NO: 9462233 - DNA, 22 bp, Homo sapiens
cttagcagagcagagtggatca

SEQ ID NO: 9462234 - DNA, 22 bp, Homo sapiens
cttagcagataaaaaccttcag

SEQ ID NO: 9462235 - DNA, 22 bp, Homo sapiens
cttagcaaggctgcctggagaa

SEQ ID NO: 9462236 - DNA, 22 bp, Homo sapiens
cttacttgaaattccaagcagg

SEQ ID NO: 9462237 - DNA, 22 bp, Homo sapiens
cttacatttaatcatgtgtcat

SEQ ID NO: 9462238 - DNA, 22 bp, Homo sapiens
cttacatttaatcatgtgtcat

SEQ ID NO: 9462239 - DNA, 22 bp, Homo sapiens
cttacattgtgtgcatgagggg

SEQ ID NO: 9462240 - DNA, 22 bp, Homo sapiens
cttacattgtcttagttttcaa

SEQ ID NO: 9462241 - DNA, 22 bp, Homo sapiens
cttagaaataatggtttcagtt

SEQ ID NO: 9462242 - DNA, 22 bp, Homo sapiens
cttagaaataatggtttcagtt

SEQ ID NO: 9462243 - DNA, 22 bp, Homo sapiens
cttacagtgatcaacacaaaga

SEQ ID NO: 9462244 - DNA, 22 bp, Homo sapiens
cttacatactgagaaaatatcc

SEQ ID NO: 9462245 - DNA, 22 bp, Homo sapiens
cttacattaagtaagagattga

SEQ ID NO: 9462246 - DNA, 22 bp, Homo sapiens
cttacattaagtaagagattga

SEQ ID NO: 9462247 - DNA, 22 bp, Homo sapiens
cttacattgtctcttgctgagc

SEQ ID NO: 9462248 - DNA, 22 bp, Homo sapiens
cttacattgtcttagttttcaa

SEQ ID NO: 9462249 - DNA, 22 bp, Homo sapiens
cttacattgtctcttgctgagc

SEQ ID NO: 9462250 - DNA, 22 bp, Homo sapiens
cttacatactgagaaaatatcc

SEQ ID NO: 9462251 - DNA, 22 bp, Homo sapiens
cttacatatgcaagacaaaggg

SEQ ID NO: 9462252 - DNA, 22 bp, Homo sapiens
cttacaagaccaaagaaaggat

SEQ ID NO: 9462253 - DNA, 22 bp, Homo sapiens
cttacaagcaaaacaactgtag

SEQ ID NO: 9462254 - DNA, 22 bp, Homo sapiens
cttacaaatacacttaggagag

SEQ ID NO: 9462255 - DNA, 22 bp, Homo sapiens
cttacaacttgtatgtgattgt

SEQ ID NO: 9462256 - DNA, 22 bp, Homo sapiens
cttacagtacttctaatatgat

SEQ ID NO: 9462257 - DNA, 22 bp, Homo sapiens
cttacagagaagaaaatgtagt

SEQ ID NO: 9462258 - DNA, 22 bp, Homo sapiens
cttacagagaagaaaatgtagt

SEQ ID NO: 9462259 - DNA, 20 bp, Homo sapiens
ctgtgctttggaacctggaa

SEQ ID NO: 9462260 - DNA, 21 bp, Homo sapiens
ctgtgctttttaagtgtgatg

SEQ ID NO: 9462261 - DNA, 21 bp, Homo sapiens
ctgtgctttttaagtgtgatg

SEQ ID NO: 9462262 - DNA, 22 bp, Homo sapiens
ctgtgctttcgagatgtgatct

SEQ ID NO: 9462263 - DNA, 22 bp, Homo sapiens
ctgtgctttcaggccgctgtgt

SEQ ID NO: 9462264 - DNA, 22 bp, Homo sapiens
ctgtgctttcaggccgctgtgt

SEQ ID NO: 9462265 - DNA, 22 bp, Homo sapiens
ctgtggaacttagtgggagaca

SEQ ID NO: 9462266 - DNA, 22 bp, Homo sapiens
ctgtgcttcgcaactccaaggt

SEQ ID NO: 9462267 - DNA, 22 bp, Homo sapiens
ctgtgcttcgcaactccaaggt

SEQ ID NO: 9462268 - DNA, 22 bp, Homo sapiens
ctgtgcttccaggatggcagct

SEQ ID NO: 9462269 - DNA, 21 bp, Homo sapiens
ctgtgcttcttcctaagccag

SEQ ID NO: 9462270 - DNA, 22 bp, Homo sapiens
ctgtgcttgacagtgggaagca

SEQ ID NO: 9462271 - DNA, 22 bp, Homo sapiens
ctgtgcttgacagtgggaagca

SEQ ID NO: 9462272 - DNA, 19 bp, Homo sapiens
ctgtgctttaaactcctat

SEQ ID NO: 9462273 - DNA, 22 bp, Homo sapiens
ctgtgcttgtgttcattgttaa

SEQ ID NO: 9462274 - DNA, 22 bp, Homo sapiens
ctgtgctttcaaaagaagggtt

SEQ ID NO: 9462275 - DNA, 22 bp, Homo sapiens
ctgtgcttgcgggtgtggagcc

SEQ ID NO: 9462276 - DNA, 22 bp, Homo sapiens
ctgtggaaggcctgtcctgaaa

SEQ ID NO: 9462277 - DNA, 22 bp, Homo sapiens
ctgtggaaggacttagcgatac

SEQ ID NO: 9462278 - DNA, 22 bp, Homo sapiens
ctgtggaaggacttagcgatac

SEQ ID NO: 9462279 - DNA, 21 bp, Homo sapiens
ctgtggaagggaactagaggg

SEQ ID NO: 9462280 - DNA, 21 bp, Homo sapiens
ctgtttcttgtgaagtgacac

SEQ ID NO: 9462281 - DNA, 22 bp, Homo sapiens
ctgtttgtgatttctacgattt

SEQ ID NO: 9462282 - DNA, 22 bp, Homo sapiens
ctgtttgttggctattgacagt

SEQ ID NO: 9462283 - DNA, 22 bp, Homo sapiens
ctgtttgttggctattgacagt

SEQ ID NO: 9462284 - DNA, 17 bp, Homo sapiens
ctgtttgttctgggagc

SEQ ID NO: 9462285 - DNA, 22 bp, Homo sapiens
ctgttttccctggagttcagca

SEQ ID NO: 9462286 - DNA, 22 bp, Homo sapiens
ctgttttccctggagttcagca

SEQ ID NO: 9462287 - DNA, 22 bp, Homo sapiens
cttaaactgaaagctacaagat

SEQ ID NO: 9462288 - DNA, 22 bp, Homo sapiens
cttaaacaggaaagagccaggt

SEQ ID NO: 9462289 - DNA, 22 bp, Homo sapiens
cttaaaatctggcagttagcta

SEQ ID NO: 9462290 - DNA, 20 bp, Homo sapiens
cttaaacacagagatagatt

SEQ ID NO: 9462291 - DNA, 22 bp, Homo sapiens
cttaaaatctggcagttagcta

SEQ ID NO: 9462292 - DNA, 22 bp, Homo sapiens
cttaaaatctggcagttagcta

SEQ ID NO: 9462293 - DNA, 22 bp, Homo sapiens
cttaaaagttgcttccctaact

SEQ ID NO: 9462294 - DNA, 22 bp, Homo sapiens
cttaaaatctggcagttagcta

SEQ ID NO: 9462295 - DNA, 22 bp, Homo sapiens
ctgttttctagggctgaggtga

SEQ ID NO: 9462296 - DNA, 22 bp, Homo sapiens
ctgtttttcagaaggtaaggga

SEQ ID NO: 9462297 - DNA, 22 bp, Homo sapiens
ctgtttttgtgctgtgtctccc

SEQ ID NO: 9462298 - DNA, 22 bp, Homo sapiens
ctgtttttcagaaggtaaggga

SEQ ID NO: 9462299 - DNA, 22 bp, Homo sapiens
cttaaaagttgcttccctaact

SEQ ID NO: 9462300 - DNA, 22 bp, Homo sapiens
cttaaaagagatgacggcaggg

SEQ ID NO: 9462301 - DNA, 23 bp, Homo sapiens
ctttaatgaaattctctgtgaag

SEQ ID NO: 9462302 - DNA, 22 bp, Homo sapiens
ctttaattaggaagtataatga

SEQ ID NO: 9462303 - DNA, 22 bp, Homo sapiens
ctttaattcagatttgaaggga

SEQ ID NO: 9462304 - DNA, 22 bp, Homo sapiens
ctttaattaggaagtataatga

SEQ ID NO: 9462305 - DNA, 22 bp, Homo sapiens
ctttaattcagatttgaaggga

SEQ ID NO: 9462306 - DNA, 22 bp, Homo sapiens
ctttaaataatacaaggtccag

SEQ ID NO: 9462307 - DNA, 22 bp, Homo sapiens
ctttaaataatacaaggtccag

SEQ ID NO: 9462308 - DNA, 22 bp, Homo sapiens
ctttaaataatacaaggtccag

SEQ ID NO: 9462309 - DNA, 22 bp, Homo sapiens
ctttaaataatacaaggtccag

SEQ ID NO: 9462310 - DNA, 22 bp, Homo sapiens
ctttaacagttccattcaattt

SEQ ID NO: 9462311 - DNA, 22 bp, Homo sapiens
ctttaagactctgctcttggtg

SEQ ID NO: 9462312 - DNA, 22 bp, Homo sapiens
ctttaacagttccattcaattt

SEQ ID NO: 9462313 - DNA, 22 bp, Homo sapiens
ctttaacagttccattcaattt

SEQ ID NO: 9462314 - DNA, 22 bp, Homo sapiens
ctttacaaagcaattttgtctc

SEQ ID NO: 9462315 - DNA, 22 bp, Homo sapiens
ctttacaaactataaagtgcgg

SEQ ID NO: 9462316 - DNA, 22 bp, Homo sapiens
ctttacaaactataaagtgcgg

SEQ ID NO: 9462317 - DNA, 22 bp, Homo sapiens
ctttaattgtagctcccataat

SEQ ID NO: 9462318 - DNA, 22 bp, Homo sapiens
ctttaattctcaggtgcacata

SEQ ID NO: 9462319 - DNA, 22 bp, Homo sapiens
ctttctcttcactgtcatgatc

SEQ ID NO: 9462320 - DNA, 22 bp, Homo sapiens
ctttacaaagcaattttgtctc

SEQ ID NO: 9462321 - DNA, 22 bp, Homo sapiens
ctttacaaatagggagggagtg

SEQ ID NO: 9462322 - DNA, 22 bp, Homo sapiens
ctttacaaatagggagggagtg

SEQ ID NO: 9462323 - DNA, 22 bp, Homo sapiens
ctttacaaattagctctcggga

SEQ ID NO: 9462324 - DNA, 22 bp, Homo sapiens
ctttgaattaacgacacaagtg

SEQ ID NO: 9462325 - DNA, 22 bp, Homo sapiens
ctttgaagatcacatgttgctc

SEQ ID NO: 9462326 - DNA, 22 bp, Homo sapiens
ctttgatataagtatacatagt

SEQ ID NO: 9462327 - DNA, 22 bp, Homo sapiens
ctttgattatcggtgtgaatgt

SEQ ID NO: 9462328 - DNA, 22 bp, Homo sapiens
ctttgactttgtcctcaggaaa

SEQ ID NO: 9462329 - DNA, 22 bp, Homo sapiens
ctttgaattccagtacaataac

SEQ ID NO: 9462330 - DNA, 22 bp, Homo sapiens
ctttgaaaacttaaataacagc

SEQ ID NO: 9462331 - DNA, 22 bp, Homo sapiens
ctttgaaaacacacgaatagac

SEQ ID NO: 9462332 - DNA, 22 bp, Homo sapiens
ctttgaaaaatggtttcctaga

SEQ ID NO: 9462333 - DNA, 22 bp, Homo sapiens
ctttctttgtccaccaacaatg

SEQ ID NO: 9462334 - DNA, 22 bp, Homo sapiens
ctttctttgcagtgagccagag

SEQ ID NO: 9462335 - DNA, 22 bp, Homo sapiens
ctttctttgtccaccaacaatg

SEQ ID NO: 9462336 - DNA, 22 bp, Homo sapiens
ctttctttgtccaccaacaatg

SEQ ID NO: 9462337 - DNA, 22 bp, Homo sapiens
ctttctttgtccaccaacaatg

SEQ ID NO: 9462338 - DNA, 22 bp, Homo sapiens
ctttctttgtccaccaacaatg

SEQ ID NO: 9462339 - DNA, 22 bp, Homo sapiens
ctttctcttcagcacccagccc

SEQ ID NO: 9462340 - DNA, 22 bp, Homo sapiens
ctttctttgcagtgagccagag

SEQ ID NO: 9462341 - DNA, 22 bp, Homo sapiens
ctttctttgcagtgagccagag

SEQ ID NO: 9462342 - DNA, 22 bp, Homo sapiens
ctttctttgcagtgagccagag

SEQ ID NO: 9462343 - DNA, 22 bp, Homo sapiens
ctttctttgcagtgagccagag

SEQ ID NO: 9462344 - DNA, 22 bp, Homo sapiens
cttgtctttatttcatattcca

SEQ ID NO: 9462345 - DNA, 22 bp, Homo sapiens
cttctgggttgcaggtcttggc

SEQ ID NO: 9462346 - DNA, 22 bp, Homo sapiens
cttctggttccagcttctgttg

SEQ ID NO: 9462347 - DNA, 22 bp, Homo sapiens
cttgtgaaatgccagataatct

SEQ ID NO: 9462348 - DNA, 22 bp, Homo sapiens
cttctgggtgtggagtgaggac

SEQ ID NO: 9462349 - DNA, 22 bp, Homo sapiens
cttctgggtgtggagtgaggac

SEQ ID NO: 9462350 - DNA, 22 bp, Homo sapiens
cttctgggttgcaggtcttggc

SEQ ID NO: 9462351 - DNA, 22 bp, Homo sapiens
cttctgggtattccagatacct

SEQ ID NO: 9462352 - DNA, 22 bp, Homo sapiens
cttctgggtgcctgtgagtgtt

SEQ ID NO: 9462353 - DNA, 22 bp, Homo sapiens
cttctgggtgcctgtgagtgtt

SEQ ID NO: 9462354 - DNA, 22 bp, Homo sapiens
cttctgggtaattcttcttcat

SEQ ID NO: 9462355 - DNA, 22 bp, Homo sapiens
cttctgggtattccagatacct

SEQ ID NO: 9462356 - DNA, 22 bp, Homo sapiens
cttgttttctaaaacatcattt

SEQ ID NO: 9462357 - DNA, 22 bp, Homo sapiens
ctttaaataatacaaggtccag

SEQ ID NO: 9462358 - DNA, 22 bp, Homo sapiens
ctttaaataatacaaggtccag

SEQ ID NO: 9462359 - DNA, 22 bp, Homo sapiens
cttgtttttaagagatgtttac

SEQ ID NO: 9462360 - DNA, 22 bp, Homo sapiens
cttgttttggctagtatgatgt

SEQ ID NO: 9462361 - DNA, 22 bp, Homo sapiens
cttgtttttaagagatgtttac

SEQ ID NO: 9462362 - DNA, 22 bp, Homo sapiens
cttgtttttaagagatgtttac

SEQ ID NO: 9462363 - DNA, 22 bp, Homo sapiens
cttgttttggctagtatgatgt

SEQ ID NO: 9462364 - DNA, 22 bp, Homo sapiens
cttctggatttattcattcctt

SEQ ID NO: 9462365 - DNA, 22 bp, Homo sapiens
cttctggatttattcattcctt

SEQ ID NO: 9462366 - DNA, 22 bp, Homo sapiens
cttctggatttattcattcctt

SEQ ID NO: 9462367 - DNA, 22 bp, Homo sapiens
cttctggcaaaacaggcagaaa

SEQ ID NO: 9462368 - DNA, 22 bp, Homo sapiens
cttctggcaaaacaggcagaaa

SEQ ID NO: 9462369 - DNA, 19 bp, Homo sapiens
cttctggatccgcagggcc

SEQ ID NO: 9462370 - DNA, 22 bp, Homo sapiens
cttctggataattgtgtgatta

SEQ ID NO: 9462371 - DNA, 19 bp, Homo sapiens
cttctggatccgcagggcc

SEQ ID NO: 9462372 - DNA, 22 bp, Homo sapiens
cttctggaggctccagggaggt

SEQ ID NO: 9462373 - DNA, 22 bp, Homo sapiens
cttctggaggctccagggaggt

SEQ ID NO: 9462374 - DNA, 22 bp, Homo sapiens
cttctggaggctccagggaggt

SEQ ID NO: 9462375 - DNA, 22 bp, Homo sapiens
cttctggaggctccagggaggt

SEQ ID NO: 9462376 - DNA, 22 bp, Homo sapiens
cttctggaggctccagggaggt

SEQ ID NO: 9462377 - DNA, 22 bp, Homo sapiens
cttctggaggacactggcccca

SEQ ID NO: 9462378 - DNA, 22 bp, Homo sapiens
cttctggaggacactggcccca

SEQ ID NO: 9462379 - DNA, 22 bp, Homo sapiens
cttctggaaacttttccaattt

SEQ ID NO: 9462380 - DNA, 22 bp, Homo sapiens
cttctggagctcaccaacttcc

SEQ ID NO: 9462381 - DNA, 22 bp, Homo sapiens
cttctgctggcatactgcccca

SEQ ID NO: 9462382 - DNA, 22 bp, Homo sapiens
cttctgctgctgttcatggttg

SEQ ID NO: 9462383 - DNA, 22 bp, Homo sapiens
cttctgaaatgtgagcaaaatc

SEQ ID NO: 9462384 - DNA, 23 bp, Homo sapiens
cttctggctctatatcagaattc

SEQ ID NO: 9462385 - DNA, 19 bp, Homo sapiens
cttctggccctgagccacc

SEQ ID NO: 9462386 - DNA, 22 bp, Homo sapiens
cttctgggcatggcagagcctg

SEQ ID NO: 9462387 - DNA, 22 bp, Homo sapiens
cttctgggcatggcagagcctg

SEQ ID NO: 9462388 - DNA, 22 bp, Homo sapiens
cttctgggcatggcagagcctg

SEQ ID NO: 9462389 - DNA, 22 bp, Homo sapiens
cttctgggcattcagctgcaca

SEQ ID NO: 9462390 - DNA, 22 bp, Homo sapiens
cttctggggatggagcccagaa

SEQ ID NO: 9462391 - DNA, 22 bp, Homo sapiens
cttctggggatggagcccagaa

SEQ ID NO: 9462392 - DNA, 22 bp, Homo sapiens
cttctgggcattcagctgcaca

SEQ ID NO: 9462393 - DNA, 22 bp, Homo sapiens
cttctgggcattcagctgcaca

SEQ ID NO: 9462394 - DNA, 22 bp, Homo sapiens
cttctgggccatggccttcctc

SEQ ID NO: 9462395 - DNA, 22 bp, Homo sapiens
ctttgattcagagagaattagc

SEQ ID NO: 9462396 - DNA, 22 bp, Homo sapiens
ctttgattcagactttgtcggc

SEQ ID NO: 9462397 - DNA, 22 bp, Homo sapiens
ctttgattcagagagaattagc

SEQ ID NO: 9462398 - DNA, 22 bp, Homo sapiens
ctttgattccaggcacatgttt

SEQ ID NO: 9462399 - DNA, 22 bp, Homo sapiens
ctttgatttctctggtccaatc

SEQ ID NO: 9462400 - DNA, 22 bp, Homo sapiens
ctttgcaaacgattaccacatg

SEQ ID NO: 9462401 - DNA, 19 bp, Homo sapiens
ctttgcaaagccctgtgta

SEQ ID NO: 9462402 - DNA, 22 bp, Homo sapiens
ctttgcaaactgtcacactttc

SEQ ID NO: 9462403 - DNA, 22 bp, Homo sapiens
ctttgcaaaagttaattgttga

SEQ ID NO: 9462404 - DNA, 22 bp, Homo sapiens
ctttgcaaaagttaattgttga

SEQ ID NO: 9462405 - DNA, 22 bp, Homo sapiens
ctttgcagaaataaacttgatg

SEQ ID NO: 9462406 - DNA, 22 bp, Homo sapiens
ctttgcaatagaggcacacatg

SEQ ID NO: 9462407 - DNA, 22 bp, Homo sapiens
ctttgcagatttgtttagtgct

SEQ ID NO: 9462408 - DNA, 22 bp, Homo sapiens
ctttgcagcaatttctgttaaa

SEQ ID NO: 9462409 - DNA, 17 bp, Homo sapiens
ctttgcagcagacatgt

SEQ ID NO: 9462410 - DNA, 22 bp, Homo sapiens
ctttgcaagggatttcatgtct

SEQ ID NO: 9462411 - DNA, 22 bp, Homo sapiens
cttttccaaagtccatctggtc

SEQ ID NO: 9462412 - DNA, 22 bp, Homo sapiens
cttttcctattgattctgttac

SEQ ID NO: 9462413 - DNA, 22 bp, Homo sapiens
cttttcctattgattctgttac

SEQ ID NO: 9462414 - DNA, 18 bp, Homo sapiens
cttttcccctttggactc

SEQ ID NO: 9462415 - DNA, 21 bp, Homo sapiens
cttttacattcagtcatgatg

SEQ ID NO: 9462416 - DNA, 22 bp, Homo sapiens
cttttcattgtttgtacatgca

SEQ ID NO: 9462417 - DNA, 22 bp, Homo sapiens
cttttcattgtttgtacatgca

SEQ ID NO: 9462418 - DNA, 22 bp, Homo sapiens
cttttcattgtttgtacatgca

SEQ ID NO: 9462419 - DNA, 22 bp, Homo sapiens
cttttacagtggacctgccatt

SEQ ID NO: 9462420 - DNA, 21 bp, Homo sapiens
cttttacattcagtcatgatg

SEQ ID NO: 9462421 - DNA, 18 bp, Homo sapiens
ctttgcagttacagggca

SEQ ID NO: 9462422 - DNA, 22 bp, Homo sapiens
ctttgcaggagtatgtgataat

SEQ ID NO: 9462423 - DNA, 20 bp, Homo sapiens
ctttgcaggagaacagagaa

SEQ ID NO: 9462424 - DNA, 22 bp, Homo sapiens
cttttgatggagttcaagaagc

SEQ ID NO: 9462425 - DNA, 22 bp, Homo sapiens
cttttgattgagcagtttcaaa

SEQ ID NO: 9462426 - DNA, 22 bp, Homo sapiens
cttttgatggagttcaagaagc

SEQ ID NO: 9462427 - DNA, 22 bp, Homo sapiens
cttttgatagttgctgagcagg

SEQ ID NO: 9462428 - DNA, 22 bp, Homo sapiens
cttttcttgtattggatgcccc

SEQ ID NO: 9462429 - DNA, 22 bp, Homo sapiens
cttttcttctcacggctgtcag

SEQ ID NO: 9462430 - DNA, 22 bp, Homo sapiens
cttttcttctcacggctgtcag

SEQ ID NO: 9462431 - DNA, 22 bp, Homo sapiens
cttttcttctcacggctgtcag

SEQ ID NO: 9462432 - DNA, 22 bp, Homo sapiens
cttttcttgtattggatgcccc

SEQ ID NO: 9462433 - DNA, 22 bp, Homo sapiens
cttttcttgtattggatgcccc

SEQ ID NO: 9462434 - DNA, 22 bp, Homo sapiens
cttttcttgtattggatgcccc

SEQ ID NO: 9462435 - DNA, 22 bp, Homo sapiens
cttttcttgtattggatgcccc

SEQ ID NO: 9462436 - DNA, 22 bp, Homo sapiens
cttttcttgtattggatgcccc

SEQ ID NO: 9462437 - DNA, 22 bp, Homo sapiens
cttttcttactcccgcaaggca

SEQ ID NO: 9462438 - DNA, 22 bp, Homo sapiens
cttttcttactcccgcaaggca

SEQ ID NO: 9462439 - DNA, 22 bp, Homo sapiens
cttttcttactcccgcaaggca

SEQ ID NO: 9462440 - DNA, 22 bp, Homo sapiens
cttttcttactcccgcaaggca

SEQ ID NO: 9462441 - DNA, 22 bp, Homo sapiens
cttttctgtgatgctgacagtc

SEQ ID NO: 9462442 - DNA, 22 bp, Homo sapiens
cttttcttactcccgcaaggca

SEQ ID NO: 9462443 - DNA, 22 bp, Homo sapiens
cttttcttatgtggacgtacct

SEQ ID NO: 9462444 - DNA, 22 bp, Homo sapiens
cttttcttatgtggacgtacct

SEQ ID NO: 9462445 - DNA, 22 bp, Homo sapiens
cttttcttatgtggacgtacct

SEQ ID NO: 9462446 - DNA, 22 bp, Homo sapiens
cttttcttctcacggctgtcag

SEQ ID NO: 9462447 - DNA, 22 bp, Homo sapiens
cttttcttatgtggacgtacct

SEQ ID NO: 9462448 - DNA, 22 bp, Homo sapiens
cttttcttatgtggacgtacct

SEQ ID NO: 9462449 - DNA, 22 bp, Homo sapiens
cttttcttactcccgcaaggca

SEQ ID NO: 9462450 - DNA, 21 bp, Homo sapiens
cttttctagtcccagccccgc

SEQ ID NO: 9462451 - DNA, 22 bp, Homo sapiens
cttttctctgcaccatgtgtga

SEQ ID NO: 9462452 - DNA, 22 bp, Homo sapiens
cttttctagagccgcagcccta

SEQ ID NO: 9462453 - DNA, 22 bp, Homo sapiens
cttttctactaatgagtagcta

SEQ ID NO: 9462454 - DNA, 22 bp, Homo sapiens
cttttcctcaggaggagacgcg

SEQ ID NO: 9462455 - DNA, 22 bp, Homo sapiens
cttttcctcaggaggagacgcg

SEQ ID NO: 9462456 - DNA, 22 bp, Homo sapiens
cttttcctcaggaggagacgcg

SEQ ID NO: 9462457 - DNA, 22 bp, Homo sapiens
cttttcctattgattctgttac

SEQ ID NO: 9462458 - DNA, 22 bp, Homo sapiens
cttttcctattgattctgttac

SEQ ID NO: 9462459 - DNA, 22 bp, Homo sapiens
cttttctctgcgggtctttcat

SEQ ID NO: 9462460 - DNA, 22 bp, Homo sapiens
cttttctcttacattccactgg

SEQ ID NO: 9462461 - DNA, 22 bp, Homo sapiens
cttttctggccaggaacttgcc

SEQ ID NO: 9462462 - DNA, 22 bp, Homo sapiens
cttttctggccaggaacttgcc

SEQ ID NO: 9462463 - DNA, 22 bp, Homo sapiens
cttttctgtatcaaaaggatta

SEQ ID NO: 9462464 - DNA, 22 bp, Homo sapiens
cttttctgtatcaaaaggatta

SEQ ID NO: 9462465 - DNA, 22 bp, Homo sapiens
cttttctgtgatgctgacagtc

SEQ ID NO: 9462466 - DNA, 22 bp, Homo sapiens
gaaaatagcagatagaccaatg

SEQ ID NO: 9462467 - DNA, 22 bp, Homo sapiens
gaaaatacttcagtgttctggc

SEQ ID NO: 9462468 - DNA, 22 bp, Homo sapiens
gaaaatacttcagtgttctggc

SEQ ID NO: 9462469 - DNA, 22 bp, Homo sapiens
gaaaatacttcagtgttctggc

SEQ ID NO: 9462470 - DNA, 22 bp, Homo sapiens
cttttgcaccttttaagtaatg

SEQ ID NO: 9462471 - DNA, 22 bp, Homo sapiens
cttttgcaccttttaagtaatg

SEQ ID NO: 9462472 - DNA, 22 bp, Homo sapiens
cttttgcacccagagttatttg

SEQ ID NO: 9462473 - DNA, 22 bp, Homo sapiens
cttttgcacccagagttatttg

SEQ ID NO: 9462474 - DNA, 22 bp, Homo sapiens
gaaaatgtttgtccggagctga

SEQ ID NO: 9462475 - DNA, 22 bp, Homo sapiens
gaaaattattgaaaatggctct

SEQ ID NO: 9462476 - DNA, 22 bp, Homo sapiens
gaaaattattgaaaatggctct

SEQ ID NO: 9462477 - DNA, 22 bp, Homo sapiens
gaaaatttctgccacatgtgtg

SEQ ID NO: 9462478 - DNA, 22 bp, Homo sapiens
gaaacaactactattgatttct

SEQ ID NO: 9462479 - DNA, 22 bp, Homo sapiens
gaaaatttctgccacatgtgtg

SEQ ID NO: 9462480 - DNA, 22 bp, Homo sapiens
gaaacaactactattgatttct

SEQ ID NO: 9462481 - DNA, 22 bp, Homo sapiens
gaaacaatcatcatgtgatttg

SEQ ID NO: 9462482 - DNA, 22 bp, Homo sapiens
gaaacaatacttgtcctcacta

SEQ ID NO: 9462483 - DNA, 19 bp, Homo sapiens
gaaacaagtcattccagag

SEQ ID NO: 9462484 - DNA, 22 bp, Homo sapiens
gaaaattattgaaaatggctct

SEQ ID NO: 9462485 - DNA, 22 bp, Homo sapiens
gaaaatttaattctcttctgtg

SEQ ID NO: 9462486 - DNA, 22 bp, Homo sapiens
gaaaatttagaactgaacttct

SEQ ID NO: 9462487 - DNA, 22 bp, Homo sapiens
gaaacactatgccaagacaggg

SEQ ID NO: 9462488 - DNA, 22 bp, Homo sapiens
gaaacactatgccaagacaggg

SEQ ID NO: 9462489 - DNA, 22 bp, Homo sapiens
gaaacagcacgtttggagagat

SEQ ID NO: 9462490 - DNA, 22 bp, Homo sapiens
gaaacagattaacagcatattt

SEQ ID NO: 9462491 - DNA, 22 bp, Homo sapiens
gaaacagattaacagcatattt

SEQ ID NO: 9462492 - DNA, 22 bp, Homo sapiens
gaaacagattaacagcatattt

SEQ ID NO: 9462493 - DNA, 22 bp, Homo sapiens
gaaacagattaacagcatattt

SEQ ID NO: 9462494 - DNA, 22 bp, Homo sapiens
gaaacacatgcagctccataga

SEQ ID NO: 9462495 - DNA, 22 bp, Homo sapiens
gaaacacatgcagctccataga

SEQ ID NO: 9462496 - DNA, 22 bp, Homo sapiens
gaaacacatgcagctccataga

SEQ ID NO: 9462497 - DNA, 22 bp, Homo sapiens
gaaacacatatgaacagttgat

SEQ ID NO: 9462498 - DNA, 22 bp, Homo sapiens
gaaacaatttttgttgtctaag

SEQ ID NO: 9462499 - DNA, 22 bp, Homo sapiens
gaaacaatttttgttgtctaag

SEQ ID NO: 9462500 - DNA, 22 bp, Homo sapiens
gaaacacatatgaacagttgat

SEQ ID NO: 9462501 - DNA, 22 bp, Homo sapiens
gaaacacatatgaacagttgat

SEQ ID NO: 9462502 - DNA, 22 bp, Homo sapiens
gaaacaatttttgttgtctaag

SEQ ID NO: 9462503 - DNA, 18 bp, Homo sapiens
gaaagccatgcagcagtg

SEQ ID NO: 9462504 - DNA, 18 bp, Homo sapiens
gaaagccatgcagcagtg

SEQ ID NO: 9462505 - DNA, 22 bp, Homo sapiens
gaaagccatagcccagctttac

SEQ ID NO: 9462506 - DNA, 22 bp, Homo sapiens
gaaagccagagagaaagggctc

SEQ ID NO: 9462507 - DNA, 22 bp, Homo sapiens
gaaagccagagagaaagggctc

SEQ ID NO: 9462508 - DNA, 22 bp, Homo sapiens
gaaagccatctggctgctggga

SEQ ID NO: 9462509 - DNA, 22 bp, Homo sapiens
gaaagccatctggctgctggga

SEQ ID NO: 9462510 - DNA, 22 bp, Homo sapiens
gaaagagaggggctgagatgca

SEQ ID NO: 9462511 - DNA, 22 bp, Homo sapiens
gaaagataatcaattactcctt

SEQ ID NO: 9462512 - DNA, 22 bp, Homo sapiens
gaaagcatccgcctggaggtgg

SEQ ID NO: 9462513 - DNA, 21 bp, Homo sapiens
ctctggagtcaagagcttcca

SEQ ID NO: 9462514 - DNA, 21 bp, Homo sapiens
ctctggagtcaagagcttcca

SEQ ID NO: 9462515 - DNA, 22 bp, Homo sapiens
ctctggagtaagagctatgaaa

SEQ ID NO: 9462516 - DNA, 22 bp, Homo sapiens
ctctggagtaagagctatgaaa

SEQ ID NO: 9462517 - DNA, 22 bp, Homo sapiens
ctctggagtcaggcagccctgg

SEQ ID NO: 9462518 - DNA, 22 bp, Homo sapiens
ctctggagtcaggcagccctgg

SEQ ID NO: 9462519 - DNA, 19 bp, Homo sapiens
ctctggagtcattgctccc

SEQ ID NO: 9462520 - DNA, 19 bp, Homo sapiens
ctctggagtcattgctccc

SEQ ID NO: 9462521 - DNA, 22 bp, Homo sapiens
ctctggagtcaggcagccctgg

SEQ ID NO: 9462522 - DNA, 19 bp, Homo sapiens
ctctggagtcattgctccc

SEQ ID NO: 9462523 - DNA, 22 bp, Homo sapiens
ctctggaggtggaggttgcagt

SEQ ID NO: 9462524 - DNA, 22 bp, Homo sapiens
ctctggaggtggaggttgcagt

SEQ ID NO: 9462525 - DNA, 22 bp, Homo sapiens
ctctggaggtggaggttgcagt

SEQ ID NO: 9462526 - DNA, 22 bp, Homo sapiens
ctctggaggtcaggtgtggtgg

SEQ ID NO: 9462527 - DNA, 22 bp, Homo sapiens
ctctggagggaggctgagctgg

SEQ ID NO: 9462528 - DNA, 22 bp, Homo sapiens
ctctggaggtcaggtgtggtgg

SEQ ID NO: 9462529 - DNA, 22 bp, Homo sapiens
ctctggaggttgagcccagcaa

SEQ ID NO: 9462530 - DNA, 22 bp, Homo sapiens
ctctggaggttgagcccagcaa

SEQ ID NO: 9462531 - DNA, 22 bp, Homo sapiens
ctctggaggttgagcccagcaa

SEQ ID NO: 9462532 - DNA, 22 bp, Homo sapiens
ctctggagtaagagctatgaaa

SEQ ID NO: 9462533 - DNA, 22 bp, Homo sapiens
ctctggaggttgagcccagcaa

SEQ ID NO: 9462534 - DNA, 22 bp, Homo sapiens
ctctggaggcagcaccagccag

SEQ ID NO: 9462535 - DNA, 21 bp, Homo sapiens
ctctggaggcaagggagagtg

SEQ ID NO: 9462536 - DNA, 22 bp, Homo sapiens
ctctggaggccgttggccctta

SEQ ID NO: 9462537 - DNA, 22 bp, Homo sapiens
ctctggaggccgttggccctta

SEQ ID NO: 9462538 - DNA, 22 bp, Homo sapiens
ctctggaggccgttggccctta

SEQ ID NO: 9462539 - DNA, 22 bp, Homo sapiens
ctctggaggccgttggccctta

SEQ ID NO: 9462540 - DNA, 22 bp, Homo sapiens
ctctggaggccgttggccctta

SEQ ID NO: 9462541 - DNA, 22 bp, Homo sapiens
ctctggaggccgttggccctta

SEQ ID NO: 9462542 - DNA, 22 bp, Homo sapiens
ctctggaggcctaaggaagtgg

SEQ ID NO: 9462543 - DNA, 22 bp, Homo sapiens
ctctggaggcctaaggaagtgg

SEQ ID NO: 9462544 - DNA, 19 bp, Homo sapiens
ctctggagggaccgccgtt

SEQ ID NO: 9462545 - DNA, 22 bp, Homo sapiens
ctctggaggcctaaggaagtgg

SEQ ID NO: 9462546 - DNA, 22 bp, Homo sapiens
ctctggaggcctaaggaagtgg

SEQ ID NO: 9462547 - DNA, 22 bp, Homo sapiens
ctctggaggccgttggccctta

SEQ ID NO: 9462548 - DNA, 22 bp, Homo sapiens
ctctggagggaggctgagctgg

SEQ ID NO: 9462549 - DNA, 22 bp, Homo sapiens
ctctggagggaggctgagctgg

SEQ ID NO: 9462550 - DNA, 22 bp, Homo sapiens
ctctggagggaggctgagctgg

SEQ ID NO: 9462551 - DNA, 22 bp, Homo sapiens
ctctggagggaggctgagctgg

SEQ ID NO: 9462552 - DNA, 22 bp, Homo sapiens
ctctggagggaggctgagctgg

SEQ ID NO: 9462553 - DNA, 22 bp, Homo sapiens
ctctggagggaggctgagctgg

SEQ ID NO: 9462554 - DNA, 22 bp, Homo sapiens
ctctggagggaggctgagctgg

SEQ ID NO: 9462555 - DNA, 22 bp, Homo sapiens
ctctggagggaggctgagctgg

SEQ ID NO: 9462556 - DNA, 22 bp, Homo sapiens
tttgaataatcactgggcatta

SEQ ID NO: 9462557 - DNA, 22 bp, Homo sapiens
tttgaataaacggttaatgttc

SEQ ID NO: 9462558 - DNA, 22 bp, Homo sapiens
tttgaataaacggttaatgttc

SEQ ID NO: 9462559 - DNA, 22 bp, Homo sapiens
ctctggaattgacctgggaggg

SEQ ID NO: 9462560 - DNA, 22 bp, Homo sapiens
tttgaataaacggttaatgttc

SEQ ID NO: 9462561 - DNA, 22 bp, Homo sapiens
ctctggagcgctgcttcccgcg

SEQ ID NO: 9462562 - DNA, 22 bp, Homo sapiens
ctctggagcatttcacctacat

SEQ ID NO: 9462563 - DNA, 22 bp, Homo sapiens
ctctggagcatttcacctacat

SEQ ID NO: 9462564 - DNA, 22 bp, Homo sapiens
ctctggagcatttcacctacat

SEQ ID NO: 9462565 - DNA, 22 bp, Homo sapiens
ctctggaattgacctgggaggg

SEQ ID NO: 9462566 - DNA, 19 bp, Homo sapiens
ctctggagcagacactgga

SEQ ID NO: 9462567 - DNA, 19 bp, Homo sapiens
ctctggagcagacactgga

SEQ ID NO: 9462568 - DNA, 19 bp, Homo sapiens
ctctggagcagacactgga

SEQ ID NO: 9462569 - DNA, 19 bp, Homo sapiens
ctctggagcagacactgga

SEQ ID NO: 9462570 - DNA, 22 bp, Homo sapiens
tttgaagtcaaagattgattcc

SEQ ID NO: 9462571 - DNA, 22 bp, Homo sapiens
tttgaagggcacgacaatagtt

SEQ ID NO: 9462572 - DNA, 22 bp, Homo sapiens
tttgaagggcacgacaatagtt

SEQ ID NO: 9462573 - DNA, 18 bp, Homo sapiens
tttgaaggatggcctgga

SEQ ID NO: 9462574 - DNA, 22 bp, Homo sapiens
ctctgcttgtgtcaggcatgct

SEQ ID NO: 9462575 - DNA, 22 bp, Homo sapiens
tttcttcttgatttaaacaggg

SEQ ID NO: 9462576 - DNA, 22 bp, Homo sapiens
tttcttcttgatttaaacaggg

SEQ ID NO: 9462577 - DNA, 22 bp, Homo sapiens
tttcttgaccactatgttgata

SEQ ID NO: 9462578 - DNA, 22 bp, Homo sapiens
tttcttctttcccagtgatggg

SEQ ID NO: 9462579 - DNA, 22 bp, Homo sapiens
tttcttcttgatttaaacaggg

SEQ ID NO: 9462580 - DNA, 22 bp, Homo sapiens
tttcttcttgagtaaccagatt

SEQ ID NO: 9462581 - DNA, 22 bp, Homo sapiens
tttcttcttgagtaaccagatt

SEQ ID NO: 9462582 - DNA, 22 bp, Homo sapiens
tttcttcttgagtaaccagatt

SEQ ID NO: 9462583 - DNA, 22 bp, Homo sapiens
tttcttctgtttgtagttacac

SEQ ID NO: 9462584 - DNA, 22 bp, Homo sapiens
tttcttcttaatactggctgct

SEQ ID NO: 9462585 - DNA, 22 bp, Homo sapiens
tttcttcttgagtaaccagatt

SEQ ID NO: 9462586 - DNA, 22 bp, Homo sapiens
tttcttcttaatactggctgct

SEQ ID NO: 9462587 - DNA, 22 bp, Homo sapiens
tttcttcttaatactggctgct

SEQ ID NO: 9462588 - DNA, 22 bp, Homo sapiens
tttcttaaatatttgcaggaca

SEQ ID NO: 9462589 - DNA, 22 bp, Homo sapiens
tttcttagggactgtaaaatag

SEQ ID NO: 9462590 - DNA, 22 bp, Homo sapiens
tttcttaggctctaaaatgact

SEQ ID NO: 9462591 - DNA, 21 bp, Homo sapiens
tttcttaggctctaaaatgac

SEQ ID NO: 9462592 - DNA, 22 bp, Homo sapiens
tttcttatactatattgtcatc

SEQ ID NO: 9462593 - DNA, 22 bp, Homo sapiens
tttcttatactatattgtcatc

SEQ ID NO: 9462594 - DNA, 22 bp, Homo sapiens
tttcttatactatattgtcatc

SEQ ID NO: 9462595 - DNA, 22 bp, Homo sapiens
tttcttatactatattgtcatc

SEQ ID NO: 9462596 - DNA, 22 bp, Homo sapiens
tttcttatattctgtcattgtt

SEQ ID NO: 9462597 - DNA, 22 bp, Homo sapiens
tttcttatattctgtcattgtt

SEQ ID NO: 9462598 - DNA, 22 bp, Homo sapiens
tttcttatactatattgtcatc

SEQ ID NO: 9462599 - DNA, 22 bp, Homo sapiens
tttcttatattctgtcattgtt

SEQ ID NO: 9462600 - DNA, 22 bp, Homo sapiens
ctctgctggtgaccactgggcc

SEQ ID NO: 9462601 - DNA, 22 bp, Homo sapiens
ctctgctggtgaccactgggcc

SEQ ID NO: 9462602 - DNA, 21 bp, Homo sapiens
ctctgctgtctaccagctgtt

SEQ ID NO: 9462603 - DNA, 22 bp, Homo sapiens
ctctgctgtgccgccagggcct

SEQ ID NO: 9462604 - DNA, 22 bp, Homo sapiens
ctctgctgtctccagggcagtc

SEQ ID NO: 9462605 - DNA, 21 bp, Homo sapiens
ctctgctgtctaccagctgtt

SEQ ID NO: 9462606 - DNA, 22 bp, Homo sapiens
ctctgctgtgccgccagggcct

SEQ ID NO: 9462607 - DNA, 22 bp, Homo sapiens
ctctgctgtgccgccagggcct

SEQ ID NO: 9462608 - DNA, 22 bp, Homo sapiens
ctctgctgttcttatgtgtcct

SEQ ID NO: 9462609 - DNA, 22 bp, Homo sapiens
ctctgctgctttgccagtggaa

SEQ ID NO: 9462610 - DNA, 19 bp, Homo sapiens
ctctgcctctggctgtggc

SEQ ID NO: 9462611 - DNA, 22 bp, Homo sapiens
tttcttgactgcttaggaatgc

SEQ ID NO: 9462612 - DNA, 22 bp, Homo sapiens
ctctgagctgaaacatgagcat

SEQ ID NO: 9462613 - DNA, 22 bp, Homo sapiens
ctctgagctgaaacatgagcat

SEQ ID NO: 9462614 - DNA, 22 bp, Homo sapiens
ctctgagctgaaacatgagcat

SEQ ID NO: 9462615 - DNA, 22 bp, Homo sapiens
ctctgagctcgtgcagtacttc

SEQ ID NO: 9462616 - DNA, 22 bp, Homo sapiens
ctctgagctcctggaagcgtgc

SEQ ID NO: 9462617 - DNA, 22 bp, Homo sapiens
ctctgacagccttcattatgca

SEQ ID NO: 9462618 - DNA, 22 bp, Homo sapiens
ctctgacaggtggcattatctc

SEQ ID NO: 9462619 - DNA, 22 bp, Homo sapiens
ctctctggcccatcctgttgcc

SEQ ID NO: 9462620 - DNA, 22 bp, Homo sapiens
ctctgacagccttcattatgca

SEQ ID NO: 9462621 - DNA, 22 bp, Homo sapiens
ctctctggcacttcattgctgt

SEQ ID NO: 9462622 - DNA, 22 bp, Homo sapiens
ctctctggcacttcattgctgt

SEQ ID NO: 9462623 - DNA, 22 bp, Homo sapiens
ctctctggcacttcattgctgt

SEQ ID NO: 9462624 - DNA, 22 bp, Homo sapiens
ctctctggcacttcattgctgt

SEQ ID NO: 9462625 - DNA, 22 bp, Homo sapiens
ctctctggcacttcattgctgt

SEQ ID NO: 9462626 - DNA, 22 bp, Homo sapiens
ctctctggatatttgtatgctg

SEQ ID NO: 9462627 - DNA, 22 bp, Homo sapiens
ctctctggatatttgtatgctg

SEQ ID NO: 9462628 - DNA, 22 bp, Homo sapiens
ctctgaggctccatgcaggctt

SEQ ID NO: 9462629 - DNA, 22 bp, Homo sapiens
ctctgaggctccatgcaggctt

SEQ ID NO: 9462630 - DNA, 22 bp, Homo sapiens
ctctgaggctgggaattcagct

SEQ ID NO: 9462631 - DNA, 22 bp, Homo sapiens
ctctgaggaagtcaagtagcca

SEQ ID NO: 9462632 - DNA, 22 bp, Homo sapiens
ctctgaggagaaagagcttggt

SEQ ID NO: 9462633 - DNA, 22 bp, Homo sapiens
ctctgaggaagtcaagtagcca

SEQ ID NO: 9462634 - DNA, 22 bp, Homo sapiens
ctctgaggctccatgcaggctt

SEQ ID NO: 9462635 - DNA, 22 bp, Homo sapiens
ctctgaggagaaagagcttggt

SEQ ID NO: 9462636 - DNA, 22 bp, Homo sapiens
ctctgagcttagtgaaatgata

SEQ ID NO: 9462637 - DNA, 22 bp, Homo sapiens
ctctgagctgtgggaaatgaga

SEQ ID NO: 9462638 - DNA, 22 bp, Homo sapiens
ctctgagctttgcagcccctgg

SEQ ID NO: 9462639 - DNA, 22 bp, Homo sapiens
ctctgagggctcgagggacgcg

SEQ ID NO: 9462640 - DNA, 22 bp, Homo sapiens
ctctgagggctcgagggacgcg

SEQ ID NO: 9462641 - DNA, 22 bp, Homo sapiens
ctctgagggctgtcaggaaagg

SEQ ID NO: 9462642 - DNA, 22 bp, Homo sapiens
ctctgagggtctaaggagtcac

SEQ ID NO: 9462643 - DNA, 22 bp, Homo sapiens
ctctgaggtcctacagtgaccc

SEQ ID NO: 9462644 - DNA, 22 bp, Homo sapiens
ctctgaggtcagggcccggcaa

SEQ ID NO: 9462645 - DNA, 22 bp, Homo sapiens
ctctgaggtcctacagtgaccc

SEQ ID NO: 9462646 - DNA, 22 bp, Homo sapiens
ctctgaggtcagggcccggcaa

SEQ ID NO: 9462647 - DNA, 22 bp, Homo sapiens
ctctgaggtcagggcccggcaa

SEQ ID NO: 9462648 - DNA, 22 bp, Homo sapiens
tttctgcatctctacagttgtt

SEQ ID NO: 9462649 - DNA, 22 bp, Homo sapiens
tttctgcatatgtatgtatgga

SEQ ID NO: 9462650 - DNA, 22 bp, Homo sapiens
tttctgcatatgtatgtatgga

SEQ ID NO: 9462651 - DNA, 22 bp, Homo sapiens
tttctgcaggtattgcataagt

SEQ ID NO: 9462652 - DNA, 22 bp, Homo sapiens
tttctgcagtctctcagaagcc

SEQ ID NO: 9462653 - DNA, 20 bp, Homo sapiens
tttctgcagatgtttacatg

SEQ ID NO: 9462654 - DNA, 19 bp, Homo sapiens
tttctgcagcccagcagca

SEQ ID NO: 9462655 - DNA, 22 bp, Homo sapiens
tttctgcagcagactcagtgtg

SEQ ID NO: 9462656 - DNA, 19 bp, Homo sapiens
tttctgcagcccagcagca

SEQ ID NO: 9462657 - DNA, 19 bp, Homo sapiens
tttctgcagctcagagaag

SEQ ID NO: 9462658 - DNA, 22 bp, Homo sapiens
tttctgcaggtattgcataagt

SEQ ID NO: 9462659 - DNA, 22 bp, Homo sapiens
tttctgtttagcataaagtggc

SEQ ID NO: 9462660 - DNA, 22 bp, Homo sapiens
tttctgtttagcataaagtggc

SEQ ID NO: 9462661 - DNA, 22 bp, Homo sapiens
tttctgtttagcataaagtggc

SEQ ID NO: 9462662 - DNA, 19 bp, Homo sapiens
tttctgtttgcttctggtt

SEQ ID NO: 9462663 - DNA, 19 bp, Homo sapiens
tttctgtttgcttctggtt

SEQ ID NO: 9462664 - DNA, 22 bp, Homo sapiens
tttctgttgtatggcttctgca

SEQ ID NO: 9462665 - DNA, 22 bp, Homo sapiens
tttctgttgtatggcttctgca

SEQ ID NO: 9462666 - DNA, 22 bp, Homo sapiens
tttctgcaaaatctaagttaga

SEQ ID NO: 9462667 - DNA, 22 bp, Homo sapiens
tttctgcaaacttccacgtctc

SEQ ID NO: 9462668 - DNA, 22 bp, Homo sapiens
tttctgattctcactttggcat

SEQ ID NO: 9462669 - DNA, 22 bp, Homo sapiens
tttctgatttgacttgaagtat

SEQ ID NO: 9462670 - DNA, 22 bp, Homo sapiens
tttctgcaacgagtctttgact

SEQ ID NO: 9462671 - DNA, 22 bp, Homo sapiens
tttctgcacatttctaaagttg

SEQ ID NO: 9462672 - DNA, 22 bp, Homo sapiens
tttctgcacatttctaaagttg

SEQ ID NO: 9462673 - DNA, 22 bp, Homo sapiens
tttctgcaagtgtagataccca

SEQ ID NO: 9462674 - DNA, 22 bp, Homo sapiens
tttctgcaagtgtagataccca

SEQ ID NO: 9462675 - DNA, 21 bp, Homo sapiens
tttctgcaatgcacgttgagg

SEQ ID NO: 9462676 - DNA, 22 bp, Homo sapiens
tttctgatatactgtagaatcc

SEQ ID NO: 9462677 - DNA, 22 bp, Homo sapiens
tttctgatattcatttagaaga

SEQ ID NO: 9462678 - DNA, 23 bp, Homo sapiens
tttctgatgagggatgtggtatg

SEQ ID NO: 9462679 - DNA, 22 bp, Homo sapiens
tttctgatattcatttagaaga

SEQ ID NO: 9462680 - DNA, 22 bp, Homo sapiens
tttctgatattcatttagaaga

SEQ ID NO: 9462681 - DNA, 22 bp, Homo sapiens
ctctgaggtctaggaccatggc

SEQ ID NO: 9462682 - DNA, 22 bp, Homo sapiens
tttctgataattttgtgaaatc

SEQ ID NO: 9462683 - DNA, 22 bp, Homo sapiens
ctctgaggtctaggaccatggc

SEQ ID NO: 9462684 - DNA, 22 bp, Homo sapiens
ctctgaggtccttcccagctct

SEQ ID NO: 9462685 - DNA, 22 bp, Homo sapiens
ctctgaggtccttcccagctct

SEQ ID NO: 9462686 - DNA, 22 bp, Homo sapiens
ctctgaggtcctacagtgaccc

SEQ ID NO: 9462687 - DNA, 22 bp, Homo sapiens
tttctctggcctcagtttaaca

SEQ ID NO: 9462688 - DNA, 22 bp, Homo sapiens
ctctctggaagggggagctgat

SEQ ID NO: 9462689 - DNA, 22 bp, Homo sapiens
ctctctggaagggggagctgat

SEQ ID NO: 9462690 - DNA, 22 bp, Homo sapiens
tttctctgccagttattttcct

SEQ ID NO: 9462691 - DNA, 22 bp, Homo sapiens
tttctctgcagagccccaagga

SEQ ID NO: 9462692 - DNA, 22 bp, Homo sapiens
ctctctggacctcaactatttt

SEQ ID NO: 9462693 - DNA, 22 bp, Homo sapiens
ctctctggacttgagtatcagc

SEQ ID NO: 9462694 - DNA, 22 bp, Homo sapiens
ctctctggacttgagtatcagc

SEQ ID NO: 9462695 - DNA, 22 bp, Homo sapiens
ctctctggaattaaagcccaat

SEQ ID NO: 9462696 - DNA, 22 bp, Homo sapiens
ctctctggaattaaagcccaat

SEQ ID NO: 9462697 - DNA, 22 bp, Homo sapiens
ctctctggaattaaagcccaat

SEQ ID NO: 9462698 - DNA, 20 bp, Homo sapiens
ctctctggaaggtgggagcc

SEQ ID NO: 9462699 - DNA, 20 bp, Homo sapiens
ctctctggaaggtgggagcc

SEQ ID NO: 9462700 - DNA, 20 bp, Homo sapiens
ctctctggaaggtgggagcc

SEQ ID NO: 9462701 - DNA, 19 bp, Homo sapiens
tttctctccctcatcccga

SEQ ID NO: 9462702 - DNA, 22 bp, Homo sapiens
tttctctctacagtactttcat

SEQ ID NO: 9462703 - DNA, 19 bp, Homo sapiens
tttctctccctcatcccga

SEQ ID NO: 9462704 - DNA, 19 bp, Homo sapiens
tttctctccctcatcccga

SEQ ID NO: 9462705 - DNA, 22 bp, Homo sapiens
tttctctctacagtactttcat

SEQ ID NO: 9462706 - DNA, 22 bp, Homo sapiens
ctctactccaaaaggctacaat

SEQ ID NO: 9462707 - DNA, 22 bp, Homo sapiens
ctctactcttaacacagctagg

SEQ ID NO: 9462708 - DNA, 22 bp, Homo sapiens
ctctactcttaacacagctagg

SEQ ID NO: 9462709 - DNA, 22 bp, Homo sapiens
ctctaggctgcccaggagctga

SEQ ID NO: 9462710 - DNA, 22 bp, Homo sapiens
ctctaggctgcccaggagctga

SEQ ID NO: 9462711 - DNA, 22 bp, Homo sapiens
ctctaggctgcccaggagctga

SEQ ID NO: 9462712 - DNA, 22 bp, Homo sapiens
ctctaggccatccagggccatt

SEQ ID NO: 9462713 - DNA, 22 bp, Homo sapiens
ctctagcttttgataccagtgt

SEQ ID NO: 9462714 - DNA, 22 bp, Homo sapiens
ctctagctgaggtcactgctat

SEQ ID NO: 9462715 - DNA, 22 bp, Homo sapiens
ctctagcttttgataccagtgt

SEQ ID NO: 9462716 - DNA, 22 bp, Homo sapiens
ctctagctgaggtcactgctat

SEQ ID NO: 9462717 - DNA, 22 bp, Homo sapiens
ctctagtgtagtgcaggaagga

SEQ ID NO: 9462718 - DNA, 22 bp, Homo sapiens
ctctatattctgaaacagttag

SEQ ID NO: 9462719 - DNA, 22 bp, Homo sapiens
ctctattagtctttgctaaata

SEQ ID NO: 9462720 - DNA, 20 bp, Homo sapiens
ctctattattaatttcttaa

SEQ ID NO: 9462721 - DNA, 22 bp, Homo sapiens
ctctatttatggcatctttatg

SEQ ID NO: 9462722 - DNA, 22 bp, Homo sapiens
tttctctattaggggctagctt

SEQ ID NO: 9462723 - DNA, 20 bp, Homo sapiens
ctctcacagctccctcagcc

SEQ ID NO: 9462724 - DNA, 20 bp, Homo sapiens
ctctcacagctccctcagcc

SEQ ID NO: 9462725 - DNA, 22 bp, Homo sapiens
ctcctgtggtactcccagggcc

SEQ ID NO: 9462726 - DNA, 22 bp, Homo sapiens
ctcctgtggtactcccagggcc

SEQ ID NO: 9462727 - DNA, 22 bp, Homo sapiens
ctcctgtgggtcaccaataggc

SEQ ID NO: 9462728 - DNA, 22 bp, Homo sapiens
ctcctgtggtactcccagggcc

SEQ ID NO: 9462729 - DNA, 22 bp, Homo sapiens
ctcctgtggtcaagggtgggac

SEQ ID NO: 9462730 - DNA, 22 bp, Homo sapiens
ctcctgtggtcaagggtgggac

SEQ ID NO: 9462731 - DNA, 22 bp, Homo sapiens
tttcaaagtaaggattttcatc

SEQ ID NO: 9462732 - DNA, 22 bp, Homo sapiens
tttcaaagtcaagaaggatact

SEQ ID NO: 9462733 - DNA, 22 bp, Homo sapiens
tttcaaagtcaagaaggatact

SEQ ID NO: 9462734 - DNA, 22 bp, Homo sapiens
tttcaaagtcaagaaggatact

SEQ ID NO: 9462735 - DNA, 22 bp, Homo sapiens
tttcaaagtcaatatcattacc

SEQ ID NO: 9462736 - DNA, 22 bp, Homo sapiens
ctcctgtgaggcttaagcccag

SEQ ID NO: 9462737 - DNA, 22 bp, Homo sapiens
ctcctgtgggtcaccaataggc

SEQ ID NO: 9462738 - DNA, 22 bp, Homo sapiens
ctcctgtggctttctgatttca

SEQ ID NO: 9462739 - DNA, 20 bp, Homo sapiens
ctcctgtgcctctctgggcc

SEQ ID NO: 9462740 - DNA, 22 bp, Homo sapiens
ctcctgtggctttctgatttca

SEQ ID NO: 9462741 - DNA, 22 bp, Homo sapiens
ctcctgtgcatgcatctcccta

SEQ ID NO: 9462742 - DNA, 22 bp, Homo sapiens
ctcctgtgcacctccagcggca

SEQ ID NO: 9462743 - DNA, 20 bp, Homo sapiens
ctcctgtgcctctctgggcc

SEQ ID NO: 9462744 - DNA, 20 bp, Homo sapiens
ctcctgtgcctctctgggcc

SEQ ID NO: 9462745 - DNA, 22 bp, Homo sapiens
ctcctgtcaataggctcctggc

SEQ ID NO: 9462746 - DNA, 22 bp, Homo sapiens
ctcctgtcaataggctcctggc

SEQ ID NO: 9462747 - DNA, 22 bp, Homo sapiens
ctcctgtcaataggctcctggc

SEQ ID NO: 9462748 - DNA, 22 bp, Homo sapiens
ctcctgtcaataggctcctggc

SEQ ID NO: 9462749 - DNA, 22 bp, Homo sapiens
ctcctgtcaataggctcctggc

SEQ ID NO: 9462750 - DNA, 22 bp, Homo sapiens
ctcctgtcaataggctcctggc

SEQ ID NO: 9462751 - DNA, 22 bp, Homo sapiens
ctcctgtcagaagcatcctgag

SEQ ID NO: 9462752 - DNA, 22 bp, Homo sapiens
ctcctgtcagaagcatcctgag

SEQ ID NO: 9462753 - DNA, 22 bp, Homo sapiens
ctcctgtcagaagcatcctgag

SEQ ID NO: 9462754 - DNA, 22 bp, Homo sapiens
ctcctgtcagaagcatcctgag

SEQ ID NO: 9462755 - DNA, 22 bp, Homo sapiens
ctcctgtcagaagcatcctgag

SEQ ID NO: 9462756 - DNA, 22 bp, Homo sapiens
ctcctgtcagaagcatcctgag

SEQ ID NO: 9462757 - DNA, 22 bp, Homo sapiens
ctcctgtcaataggctcctggc

SEQ ID NO: 9462758 - DNA, 22 bp, Homo sapiens
tttatattacctggaatagctt

SEQ ID NO: 9462759 - DNA, 22 bp, Homo sapiens
tttatatgtttgtacaattaag

SEQ ID NO: 9462760 - DNA, 22 bp, Homo sapiens
tttatatgtttgtacaattaag

SEQ ID NO: 9462761 - DNA, 22 bp, Homo sapiens
ctcctgggctgtcggcgctctg

SEQ ID NO: 9462762 - DNA, 22 bp, Homo sapiens
tttatattacctggaatagctt

SEQ ID NO: 9462763 - DNA, 22 bp, Homo sapiens
ctcctgggcttcgaaggctccc

SEQ ID NO: 9462764 - DNA, 22 bp, Homo sapiens
ctcctgggcttcgaaggctccc

SEQ ID NO: 9462765 - DNA, 22 bp, Homo sapiens
tttcaaataccataaacctaat

SEQ ID NO: 9462766 - DNA, 22 bp, Homo sapiens
tttcaaataccataaacctaat

SEQ ID NO: 9462767 - DNA, 22 bp, Homo sapiens
tttcaaataccataaacctaat

SEQ ID NO: 9462768 - DNA, 22 bp, Homo sapiens
tttcaaagttgggaattgtaat

SEQ ID NO: 9462769 - DNA, 22 bp, Homo sapiens
tttcaaagttgggaattgtaat

SEQ ID NO: 9462770 - DNA, 22 bp, Homo sapiens
tttcaaagtcaatatcattacc

SEQ ID NO: 9462771 - DNA, 22 bp, Homo sapiens
tttcaaagtcaatatcattacc

SEQ ID NO: 9462772 - DNA, 22 bp, Homo sapiens
tttcaaagtggagaattagaca

SEQ ID NO: 9462773 - DNA, 22 bp, Homo sapiens
tttcaaataccataaacctaat

SEQ ID NO: 9462774 - DNA, 22 bp, Homo sapiens
tttcaaataccataaacctaat

SEQ ID NO: 9462775 - DNA, 22 bp, Homo sapiens
tttcaaataccataaacctaat

SEQ ID NO: 9462776 - DNA, 22 bp, Homo sapiens
tttcaaataccataaacctaat

SEQ ID NO: 9462777 - DNA, 22 bp, Homo sapiens
tttcaaatagaatctttccaaa

SEQ ID NO: 9462778 - DNA, 22 bp, Homo sapiens
tttcaaatggagtcgtgaaatg

SEQ ID NO: 9462779 - DNA, 22 bp, Homo sapiens
ctctaaatccaaataagtgtcc

SEQ ID NO: 9462780 - DNA, 22 bp, Homo sapiens
ctctaaatccaaataagtgtcc

SEQ ID NO: 9462781 - DNA, 22 bp, Homo sapiens
ctctaaaggcttgttattgcat

SEQ ID NO: 9462782 - DNA, 22 bp, Homo sapiens
ctctaaatccacggtatagttg

SEQ ID NO: 9462783 - DNA, 22 bp, Homo sapiens
ctctaaatccacggtatagttg

SEQ ID NO: 9462784 - DNA, 22 bp, Homo sapiens
ctctaaggaactcccccaaact

SEQ ID NO: 9462785 - DNA, 21 bp, Homo sapiens
ctctacattcccagcaactct

SEQ ID NO: 9462786 - DNA, 22 bp, Homo sapiens
ctcgtgccaggacgcgcagttt

SEQ ID NO: 9462787 - DNA, 22 bp, Homo sapiens
ctccttcctggttagcacctta

SEQ ID NO: 9462788 - DNA, 22 bp, Homo sapiens
ctccttcctggttagcacctta

SEQ ID NO: 9462789 - DNA, 22 bp, Homo sapiens
ctccttcctggttagcacctta

SEQ ID NO: 9462790 - DNA, 22 bp, Homo sapiens
ctcctggaggctccaagggaga

SEQ ID NO: 9462791 - DNA, 22 bp, Homo sapiens
ctcctggaggctccaagggaga

SEQ ID NO: 9462792 - DNA, 22 bp, Homo sapiens
ctcctggaggatagtgactggg

SEQ ID NO: 9462793 - DNA, 22 bp, Homo sapiens
ctcctggaggatagtgactggg

SEQ ID NO: 9462794 - DNA, 22 bp, Homo sapiens
ctcctggaggatagtgactggg

SEQ ID NO: 9462795 - DNA, 22 bp, Homo sapiens
ctcctggaggctccaagggaga

SEQ ID NO: 9462796 - DNA, 22 bp, Homo sapiens
ctcctggagggccaaagaaata

SEQ ID NO: 9462797 - DNA, 22 bp, Homo sapiens
ctcctggatcttagccagattc

SEQ ID NO: 9462798 - DNA, 22 bp, Homo sapiens
ctcctggagtcctttcctattc

SEQ ID NO: 9462799 - DNA, 23 bp, Homo sapiens
ctcctggagggtccggccctgcc

SEQ ID NO: 9462800 - DNA, 22 bp, Homo sapiens
ctcctggagggccaaagaaata

SEQ ID NO: 9462801 - DNA, 22 bp, Homo sapiens
ctcctggagtcctttcctattc

SEQ ID NO: 9462802 - DNA, 23 bp, Homo sapiens
ctcctggagggtccggccctgcc

SEQ ID NO: 9462803 - DNA, 22 bp, Homo sapiens
ctcctggaccaccttgtggcca

SEQ ID NO: 9462804 - DNA, 22 bp, Homo sapiens
ctcctggaccagggctattggg

SEQ ID NO: 9462805 - DNA, 22 bp, Homo sapiens
ctcctggaccaccttgtggcca

SEQ ID NO: 9462806 - DNA, 22 bp, Homo sapiens
ctcctggagcagcaggcgcagg

SEQ ID NO: 9462807 - DNA, 22 bp, Homo sapiens
ctcctggaccagggctattggg

SEQ ID NO: 9462808 - DNA, 22 bp, Homo sapiens
ctcctggagcagcaggcgcagg

SEQ ID NO: 9462809 - DNA, 22 bp, Homo sapiens
ctcctggacatggagcggagga

SEQ ID NO: 9462810 - DNA, 22 bp, Homo sapiens
ctcctggacatggagcggagga

SEQ ID NO: 9462811 - DNA, 22 bp, Homo sapiens
ctcctggaccaccttgtggcca

SEQ ID NO: 9462812 - DNA, 22 bp, Homo sapiens
ctcctggaagcccgccctgctg

SEQ ID NO: 9462813 - DNA, 22 bp, Homo sapiens
ctcctggaagcccgccctgctg

SEQ ID NO: 9462814 - DNA, 22 bp, Homo sapiens
tttatatgtttgtacaattaag

SEQ ID NO: 9462815 - DNA, 22 bp, Homo sapiens
tttatatgtttgtacaattaag

SEQ ID NO: 9462816 - DNA, 22 bp, Homo sapiens
tttatatgtttgtacaattaag

SEQ ID NO: 9462817 - DNA, 22 bp, Homo sapiens
tttatatgtttgtacaattaag

SEQ ID NO: 9462818 - DNA, 22 bp, Homo sapiens
tttatatgtttgtacaattaag

SEQ ID NO: 9462819 - DNA, 22 bp, Homo sapiens
tttatatccatctttgaagtaa

SEQ ID NO: 9462820 - DNA, 22 bp, Homo sapiens
ctcctggatcttagccagattc

SEQ ID NO: 9462821 - DNA, 22 bp, Homo sapiens
tttatatctggagttgctagga

SEQ ID NO: 9462822 - DNA, 23 bp, Homo sapiens
ctcctggagggtccggccctgcc

SEQ ID NO: 9462823 - DNA, 22 bp, Homo sapiens
tttatatcttatgtcatttcaa

SEQ ID NO: 9462824 - DNA, 18 bp, Homo sapiens
tttatatggatagagacc

SEQ ID NO: 9462825 - DNA, 22 bp, Homo sapiens
tttatatgaaagtgaccagtgg

SEQ ID NO: 9462826 - DNA, 18 bp, Homo sapiens
tttatatggatagagacc

SEQ ID NO: 9462827 - DNA, 18 bp, Homo sapiens
tttatatggatagagacc

SEQ ID NO: 9462828 - DNA, 22 bp, Homo sapiens
tttacacaaaatgttagtagat

SEQ ID NO: 9462829 - DNA, 22 bp, Homo sapiens
tttacacaaaagatagcacacc

SEQ ID NO: 9462830 - DNA, 22 bp, Homo sapiens
tttacacaaaagatagcacacc

SEQ ID NO: 9462831 - DNA, 22 bp, Homo sapiens
tttacacaaaagatagcacacc

SEQ ID NO: 9462832 - DNA, 22 bp, Homo sapiens
tttacacaaaatgttagtagat

SEQ ID NO: 9462833 - DNA, 22 bp, Homo sapiens
tttacacagaggacactgggct

SEQ ID NO: 9462834 - DNA, 22 bp, Homo sapiens
tttacacagaggacactgggct

SEQ ID NO: 9462835 - DNA, 22 bp, Homo sapiens
tttacacataaatgtgtagaca

SEQ ID NO: 9462836 - DNA, 22 bp, Homo sapiens
ctcctgagctctgaggaagctt

SEQ ID NO: 9462837 - DNA, 22 bp, Homo sapiens
tttacacatacctctttaaagt

SEQ ID NO: 9462838 - DNA, 22 bp, Homo sapiens
ctcctgagctgcagccttgtgt

SEQ ID NO: 9462839 - DNA, 22 bp, Homo sapiens
ctcctgagctctgaggaagctt

SEQ ID NO: 9462840 - DNA, 22 bp, Homo sapiens
ctcctgctgaatggccaggagc

SEQ ID NO: 9462841 - DNA, 22 bp, Homo sapiens
ctcctgcttcacgggcaccgcc

SEQ ID NO: 9462842 - DNA, 22 bp, Homo sapiens
ctcctgctgaatggccaggagc

SEQ ID NO: 9462843 - DNA, 22 bp, Homo sapiens
ctcctgcggtactactgtgctt

SEQ ID NO: 9462844 - DNA, 22 bp, Homo sapiens
tttacaattggttttctctaat

SEQ ID NO: 9462845 - DNA, 22 bp, Homo sapiens
tttacaattggttttctctaat

SEQ ID NO: 9462846 - DNA, 22 bp, Homo sapiens
tttacacaaaagatagcacacc

SEQ ID NO: 9462847 - DNA, 22 bp, Homo sapiens
tttacacaaaagatagcacacc

SEQ ID NO: 9462848 - DNA, 22 bp, Homo sapiens
tttacaattctggtgccagcta

SEQ ID NO: 9462849 - DNA, 22 bp, Homo sapiens
tttacaattggttttctctaat

SEQ ID NO: 9462850 - DNA, 20 bp, Homo sapiens
ctcctcagttccatgggagg

SEQ ID NO: 9462851 - DNA, 20 bp, Homo sapiens
ctcctcagttccatgggagg

SEQ ID NO: 9462852 - DNA, 22 bp, Homo sapiens
ctcctcagttgtcccatggaga

SEQ ID NO: 9462853 - DNA, 22 bp, Homo sapiens
ctcctcagttgtcccatggaga

SEQ ID NO: 9462854 - DNA, 22 bp, Homo sapiens
ctcctcagttgtcccatggaga

SEQ ID NO: 9462855 - DNA, 23 bp, Homo sapiens
ctccctggcccttgggagacctg

SEQ ID NO: 9462856 - DNA, 22 bp, Homo sapiens
ctccctggctttgtcctgaggc

SEQ ID NO: 9462857 - DNA, 22 bp, Homo sapiens
ctccctggctttgtcctgaggc

SEQ ID NO: 9462858 - DNA, 22 bp, Homo sapiens
ctccctgggcagatgtggctct

SEQ ID NO: 9462859 - DNA, 22 bp, Homo sapiens
ctccctgggcctcagtttctct

SEQ ID NO: 9462860 - DNA, 22 bp, Homo sapiens
ctccctgggcagatgtggctct

SEQ ID NO: 9462861 - DNA, 23 bp, Homo sapiens
ctccctggagtttctggaagatg

SEQ ID NO: 9462862 - DNA, 23 bp, Homo sapiens
ctccctggagtttctggaagatg

SEQ ID NO: 9462863 - DNA, 22 bp, Homo sapiens
ctccctggaggtgagctggcac

SEQ ID NO: 9462864 - DNA, 22 bp, Homo sapiens
ctccctggcagccgcactcctg

SEQ ID NO: 9462865 - DNA, 22 bp, Homo sapiens
ctccctggcacagcgagaggtt

SEQ ID NO: 9462866 - DNA, 22 bp, Homo sapiens
ctccctggcagccgcactcctg

SEQ ID NO: 9462867 - DNA, 22 bp, Homo sapiens
ctccctggcagccgcactcctg

SEQ ID NO: 9462868 - DNA, 22 bp, Homo sapiens
ctccctgaaattcagatgcctc

SEQ ID NO: 9462869 - DNA, 22 bp, Homo sapiens
ctccctgacctggattccaggc

SEQ ID NO: 9462870 - DNA, 22 bp, Homo sapiens
ctccctgaggacaggccctgtc

SEQ ID NO: 9462871 - DNA, 22 bp, Homo sapiens
ctccctcacacccttgcccaga

SEQ ID NO: 9462872 - DNA, 22 bp, Homo sapiens
ctccctctgtcttgtccagaaa

SEQ ID NO: 9462873 - DNA, 22 bp, Homo sapiens
ctccctggaggcccagacctgg

SEQ ID NO: 9462874 - DNA, 22 bp, Homo sapiens
ctccctggaggcccagacctgg

SEQ ID NO: 9462875 - DNA, 22 bp, Homo sapiens
ctccctgcttgtttcccttcag

SEQ ID NO: 9462876 - DNA, 22 bp, Homo sapiens
ctccctggaggtgagctggcac

SEQ ID NO: 9462877 - DNA, 22 bp, Homo sapiens
ctccctggaggtgagctggcac

SEQ ID NO: 9462878 - DNA, 22 bp, Homo sapiens
ctccctggaggtgagctggcac

SEQ ID NO: 9462879 - DNA, 22 bp, Homo sapiens
ctcctcagggctggttacatgg

SEQ ID NO: 9462880 - DNA, 21 bp, Homo sapiens
ctcctcaggaccagccacagg

SEQ ID NO: 9462881 - DNA, 21 bp, Homo sapiens
ctcctcaggaccagccacagg

SEQ ID NO: 9462882 - DNA, 21 bp, Homo sapiens
ctcctcaggaccagccacagg

SEQ ID NO: 9462883 - DNA, 22 bp, Homo sapiens
ctcctcaggaagtagcatgtgt

SEQ ID NO: 9462884 - DNA, 19 bp, Homo sapiens
ctcctcagtcccagaggtc

SEQ ID NO: 9462885 - DNA, 19 bp, Homo sapiens
ctcctcagtcccagaggtc

SEQ ID NO: 9462886 - DNA, 20 bp, Homo sapiens
ctcctcagttccatgggagg

SEQ ID NO: 9462887 - DNA, 20 bp, Homo sapiens
ctcctcagttccatgggagg

SEQ ID NO: 9462888 - DNA, 20 bp, Homo sapiens
ctcctcagttccatgggagg

SEQ ID NO: 9462889 - DNA, 19 bp, Homo sapiens
ctcctcagtcccagaggtc

SEQ ID NO: 9462890 - DNA, 19 bp, Homo sapiens
ctcctcagtcccagaggtc

SEQ ID NO: 9462891 - DNA, 19 bp, Homo sapiens
ctcctcagtcccagaggtc

SEQ ID NO: 9462892 - DNA, 22 bp, Homo sapiens
ctcctcagtcaggtctagggtc

SEQ ID NO: 9462893 - DNA, 22 bp, Homo sapiens
ctccgagactcgagtgtcctca

SEQ ID NO: 9462894 - DNA, 22 bp, Homo sapiens
ctcccttgcttctggcattttg

SEQ ID NO: 9462895 - DNA, 22 bp, Homo sapiens
ctcctcagctgggaggagtccc

SEQ ID NO: 9462896 - DNA, 22 bp, Homo sapiens
ctcctcagctgggaggagtccc

SEQ ID NO: 9462897 - DNA, 22 bp, Homo sapiens
ctcccttccaatgactatgctt

SEQ ID NO: 9462898 - DNA, 22 bp, Homo sapiens
ctcccttcaggagaggctcaca

SEQ ID NO: 9462899 - DNA, 22 bp, Homo sapiens
ctccctggtctttcccatcatt

SEQ ID NO: 9462900 - DNA, 22 bp, Homo sapiens
ctccctgtgctcagagccctgc

SEQ ID NO: 9462901 - DNA, 22 bp, Homo sapiens
ctccctgtgctcagagccctgc

SEQ ID NO: 9462902 - DNA, 22 bp, Homo sapiens
ctccctgtgctcagagccctgc

SEQ ID NO: 9462903 - DNA, 22 bp, Homo sapiens
ctccctgtgctcagagccctgc

SEQ ID NO: 9462904 - DNA, 22 bp, Homo sapiens
ttgtttaatgcctcatacatct

SEQ ID NO: 9462905 - DNA, 22 bp, Homo sapiens
ctccccaggttcaggaggtggg

SEQ ID NO: 9462906 - DNA, 22 bp, Homo sapiens
ctccccaggttcaggaggtggg

SEQ ID NO: 9462907 - DNA, 18 bp, Homo sapiens
ctccccagctgcccccag

SEQ ID NO: 9462908 - DNA, 18 bp, Homo sapiens
ctccccagctgcccccag

SEQ ID NO: 9462909 - DNA, 22 bp, Homo sapiens
ctccccagctcgcgggtgacgg

SEQ ID NO: 9462910 - DNA, 22 bp, Homo sapiens
ctccccagcattctgacttcct

SEQ ID NO: 9462911 - DNA, 22 bp, Homo sapiens
ctccccagcattctgacttcct

SEQ ID NO: 9462912 - DNA, 22 bp, Homo sapiens
ttgtttacaagttactcagtct

SEQ ID NO: 9462913 - DNA, 22 bp, Homo sapiens
ttgtttatcgcttgctcacata

SEQ ID NO: 9462914 - DNA, 22 bp, Homo sapiens
ttgtttatgtaattggcacact

SEQ ID NO: 9462915 - DNA, 22 bp, Homo sapiens
ttgtttatgtgttgtctatggc

SEQ ID NO: 9462916 - DNA, 22 bp, Homo sapiens
ttgtttatggattgtagaaact

SEQ ID NO: 9462917 - DNA, 20 bp, Homo sapiens
ttgtttattatgttctgatc

SEQ ID NO: 9462918 - DNA, 22 bp, Homo sapiens
ttgtttattagcaattatcctg

SEQ ID NO: 9462919 - DNA, 22 bp, Homo sapiens
ctccctcacaaagcattctctt

SEQ ID NO: 9462920 - DNA, 22 bp, Homo sapiens
ctccctcacaaagcattctctt

SEQ ID NO: 9462921 - DNA, 22 bp, Homo sapiens
ttgtttcagcccagatctttac

SEQ ID NO: 9462922 - DNA, 22 bp, Homo sapiens
ttgtttcagcccagatctttac

SEQ ID NO: 9462923 - DNA, 22 bp, Homo sapiens
ttgtttcaaatatttcagaata

SEQ ID NO: 9462924 - DNA, 22 bp, Homo sapiens
ttgtttcaaatatttcagaata

SEQ ID NO: 9462925 - DNA, 22 bp, Homo sapiens
ctcaggctctgtactccctttg

SEQ ID NO: 9462926 - DNA, 22 bp, Homo sapiens
ctcaggctctggccatccaagg

SEQ ID NO: 9462927 - DNA, 22 bp, Homo sapiens
ctcaggctctggccatccaagg

SEQ ID NO: 9462928 - DNA, 21 bp, Homo sapiens
ctcaggctggcagcaggctag

SEQ ID NO: 9462929 - DNA, 22 bp, Homo sapiens
ctcaggctgccctgacagcccc

SEQ ID NO: 9462930 - DNA, 22 bp, Homo sapiens
ctcaggcttgggaggaggccca

SEQ ID NO: 9462931 - DNA, 22 bp, Homo sapiens
ctcaggctgtgccacctgtgtg

SEQ ID NO: 9462932 - DNA, 22 bp, Homo sapiens
ctccccacatttctccctgtct

SEQ ID NO: 9462933 - DNA, 22 bp, Homo sapiens
ctccccacatttctccctgtct

SEQ ID NO: 9462934 - DNA, 22 bp, Homo sapiens
ctccccaccttcgcggtccctg

SEQ ID NO: 9462935 - DNA, 22 bp, Homo sapiens
ctccccaccttcgcggtccctg

SEQ ID NO: 9462936 - DNA, 22 bp, Homo sapiens
ctccccaagtcatggagccagg

SEQ ID NO: 9462937 - DNA, 22 bp, Homo sapiens
ctccccaagtcatggagccagg

SEQ ID NO: 9462938 - DNA, 22 bp, Homo sapiens
ctccccaagccttggcttctcc

SEQ ID NO: 9462939 - DNA, 22 bp, Homo sapiens
ctcccatgctctctctgagaag

SEQ ID NO: 9462940 - DNA, 22 bp, Homo sapiens
ctcccagtgttgttttctgatg

SEQ ID NO: 9462941 - DNA, 22 bp, Homo sapiens
ctcccagggccatcgagtcact

SEQ ID NO: 9462942 - DNA, 22 bp, Homo sapiens
ctcccagggccatcgagtcact

SEQ ID NO: 9462943 - DNA, 22 bp, Homo sapiens
ctgaaaaacgggatttggctgg

SEQ ID NO: 9462944 - DNA, 22 bp, Homo sapiens
ctgaaaaatatgttttggagaa

SEQ ID NO: 9462945 - DNA, 19 bp, Homo sapiens
ctgaaacacagagagggct

SEQ ID NO: 9462946 - DNA, 22 bp, Homo sapiens
ctgaaactccatgagaaattgc

SEQ ID NO: 9462947 - DNA, 22 bp, Homo sapiens
ctgaaactccatgagaaattgc

SEQ ID NO: 9462948 - DNA, 22 bp, Homo sapiens
ctgaaactggtcaattaatctg

SEQ ID NO: 9462949 - DNA, 22 bp, Homo sapiens
ctgaaactttagttctgcaaca

SEQ ID NO: 9462950 - DNA, 22 bp, Homo sapiens
ctgaaactttagttctgcaaca

SEQ ID NO: 9462951 - DNA, 22 bp, Homo sapiens
ctgaaactggtcaattaatctg

SEQ ID NO: 9462952 - DNA, 22 bp, Homo sapiens
tttttcttaaatgtgggttggc

SEQ ID NO: 9462953 - DNA, 22 bp, Homo sapiens
tttttcttaaatgtgggttggc

SEQ ID NO: 9462954 - DNA, 22 bp, Homo sapiens
tttttcttaaatgtgggttggc

SEQ ID NO: 9462955 - DNA, 22 bp, Homo sapiens
tttttcttgtgctggatctaat

SEQ ID NO: 9462956 - DNA, 22 bp, Homo sapiens
tttttcttgtgctggatctaat

SEQ ID NO: 9462957 - DNA, 22 bp, Homo sapiens
tttttcttgtgctggatctaat

SEQ ID NO: 9462958 - DNA, 22 bp, Homo sapiens
tttttcttgtgctggatctaat

SEQ ID NO: 9462959 - DNA, 22 bp, Homo sapiens
tttttcttgtgctggatctaat

SEQ ID NO: 9462960 - DNA, 22 bp, Homo sapiens
tttttctgtctcttacattgca

SEQ ID NO: 9462961 - DNA, 22 bp, Homo sapiens
tttttcttaaatgtgggttggc

SEQ ID NO: 9462962 - DNA, 22 bp, Homo sapiens
tttttcttaaatgtgggttggc

SEQ ID NO: 9462963 - DNA, 22 bp, Homo sapiens
tttttcttaaatgtgggttggc

SEQ ID NO: 9462964 - DNA, 20 bp, Homo sapiens
tttttctgggcttccatagc

SEQ ID NO: 9462965 - DNA, 22 bp, Homo sapiens
ctgaagttagttatgcctaaaa

SEQ ID NO: 9462966 - DNA, 22 bp, Homo sapiens
ctgaagttcatacaatggccat

SEQ ID NO: 9462967 - DNA, 22 bp, Homo sapiens
ctgaagttattgtacaaatttg

SEQ ID NO: 9462968 - DNA, 22 bp, Homo sapiens
ctgaagtgccaaatcataatca

SEQ ID NO: 9462969 - DNA, 22 bp, Homo sapiens
ctgaagtccagagtaagggact

SEQ ID NO: 9462970 - DNA, 22 bp, Homo sapiens
ctgaaggatttagttctttgct

SEQ ID NO: 9462971 - DNA, 18 bp, Homo sapiens
ctgaaggcaccagggcag

SEQ ID NO: 9462972 - DNA, 22 bp, Homo sapiens
ctgaaggcaccaggggtgccag

SEQ ID NO: 9462973 - DNA, 22 bp, Homo sapiens
ctgaaggctaaaatggactgaa

SEQ ID NO: 9462974 - DNA, 22 bp, Homo sapiens
ctgaagggggtttcactgagct

SEQ ID NO: 9462975 - DNA, 22 bp, Homo sapiens
ctgaagggatgtgatttctaca

SEQ ID NO: 9462976 - DNA, 22 bp, Homo sapiens
ctgaaggctaaaatggactgaa

SEQ ID NO: 9462977 - DNA, 22 bp, Homo sapiens
ctgaagatgtctgagatgctca

SEQ ID NO: 9462978 - DNA, 20 bp, Homo sapiens
ctgaaagacgtaacagtgca

SEQ ID NO: 9462979 - DNA, 22 bp, Homo sapiens
ctgaagattcgcctttgtttat

SEQ ID NO: 9462980 - DNA, 22 bp, Homo sapiens
ctgaaggaagcaggtggcctgt

SEQ ID NO: 9462981 - DNA, 22 bp, Homo sapiens
ctgaagatttttggtaatcatg

SEQ ID NO: 9462982 - DNA, 22 bp, Homo sapiens
ctgaaggacttggtgatagttg

SEQ ID NO: 9462983 - DNA, 22 bp, Homo sapiens
ctgaaggagcatagtcagtttt

SEQ ID NO: 9462984 - DNA, 22 bp, Homo sapiens
ctgaaggagcatagtcagtttt

SEQ ID NO: 9462985 - DNA, 22 bp, Homo sapiens
ctgaaggatgtgtggtgggagt

SEQ ID NO: 9462986 - DNA, 22 bp, Homo sapiens
ctgaaggattagagagcactta

SEQ ID NO: 9462987 - DNA, 18 bp, Homo sapiens
ctgaaggatccaggtgta

SEQ ID NO: 9462988 - DNA, 19 bp, Homo sapiens
ttttcctgcctcattgttt

SEQ ID NO: 9462989 - DNA, 22 bp, Homo sapiens
ttttcctgcctgtctctagagg

SEQ ID NO: 9462990 - DNA, 22 bp, Homo sapiens
ttttcctctgtatttgaaatgc

SEQ ID NO: 9462991 - DNA, 22 bp, Homo sapiens
ttttcctctgtatttgaaatgc

SEQ ID NO: 9462992 - DNA, 22 bp, Homo sapiens
ttttcctctgttattagtgtga

SEQ ID NO: 9462993 - DNA, 22 bp, Homo sapiens
ctctggagtcctgtatcactcc

SEQ ID NO: 9462994 - DNA, 22 bp, Homo sapiens
ctctggagtgcagcctggtggc

SEQ ID NO: 9462995 - DNA, 22 bp, Homo sapiens
ctctggagtgcagcctggtggc

SEQ ID NO: 9462996 - DNA, 23 bp, Homo sapiens
ttttcctgtggagacatgactgg

SEQ ID NO: 9462997 - DNA, 23 bp, Homo sapiens
ttttcctgtggagacatgactgg

SEQ ID NO: 9462998 - DNA, 22 bp, Homo sapiens
ttttcctgtccaggcaattatt

SEQ ID NO: 9462999 - DNA, 23 bp, Homo sapiens
ttttcctgtggagacatgactgg

SEQ ID NO: 9463000 - DNA, 22 bp, Homo sapiens
ttttcctggggcttctggactc

SEQ ID NO: 9463001 - DNA, 23 bp, Homo sapiens
ttttcctgtggagacatgactgg

SEQ ID NO: 9463002 - DNA, 20 bp, Homo sapiens
ttttcctgtggtttgatatg

SEQ ID NO: 9463003 - DNA, 22 bp, Homo sapiens
ttttctcaggtgcttatctaag

SEQ ID NO: 9463004 - DNA, 22 bp, Homo sapiens
ttttctcaggtgcttatctaag

SEQ ID NO: 9463005 - DNA, 22 bp, Homo sapiens
ttttccttaacagagggagaaa

SEQ ID NO: 9463006 - DNA, 22 bp, Homo sapiens
tttttctgagaatatgagagga

SEQ ID NO: 9463007 - DNA, 22 bp, Homo sapiens
tttttctcttctgtaaagtggt

SEQ ID NO: 9463008 - DNA, 22 bp, Homo sapiens
tttttctgagcggtaatcatca

SEQ ID NO: 9463009 - DNA, 22 bp, Homo sapiens
tttttctgccattcaaagagga

SEQ ID NO: 9463010 - DNA, 22 bp, Homo sapiens
tttttctagaccttaaaggcca

SEQ ID NO: 9463011 - DNA, 22 bp, Homo sapiens
tttttctagctcaaagattcta

SEQ ID NO: 9463012 - DNA, 22 bp, Homo sapiens
tttttctagaccttaaaggcca

SEQ ID NO: 9463013 - DNA, 17 bp, Homo sapiens
ttttctcctgcccattc

SEQ ID NO: 9463014 - DNA, 22 bp, Homo sapiens
ttttctcccgctggctgctctt

SEQ ID NO: 9463015 - DNA, 22 bp, Homo sapiens
ttttctcccgctggctgctctt

SEQ ID NO: 9463016 - DNA, 22 bp, Homo sapiens
ttttctctatattgtctgtgaa

SEQ ID NO: 9463017 - DNA, 22 bp, Homo sapiens
ttttctctacaaaataaccagc

SEQ ID NO: 9463018 - DNA, 22 bp, Homo sapiens
ttttctctatattgtctgtgaa

SEQ ID NO: 9463019 - DNA, 22 bp, Homo sapiens
ttttctctatattgtctgtgaa

SEQ ID NO: 9463020 - DNA, 22 bp, Homo sapiens
ttttctctacaaaataaccagc

SEQ ID NO: 9463021 - DNA, 22 bp, Homo sapiens
ttttctctacaaaataaccagc

SEQ ID NO: 9463022 - DNA, 22 bp, Homo sapiens
ctgagagtctgcatttctaaca

SEQ ID NO: 9463023 - DNA, 22 bp, Homo sapiens
ctgagagtctgcatttctaaca

SEQ ID NO: 9463024 - DNA, 20 bp, Homo sapiens
ctgagagtctgtgcttagtc

SEQ ID NO: 9463025 - DNA, 22 bp, Homo sapiens
ctgagagtcagtggagtggtgt

SEQ ID NO: 9463026 - DNA, 22 bp, Homo sapiens
ctgagagtctacatttttagca

SEQ ID NO: 9463027 - DNA, 22 bp, Homo sapiens
ctgagagtgctctttgatgtca

SEQ ID NO: 9463028 - DNA, 22 bp, Homo sapiens
ctgagagtgtggcttccaggcc

SEQ ID NO: 9463029 - DNA, 22 bp, Homo sapiens
ctgagagtgcttgaaaggccag

SEQ ID NO: 9463030 - DNA, 20 bp, Homo sapiens
ctgagagtctgtgcttagtc

SEQ ID NO: 9463031 - DNA, 22 bp, Homo sapiens
ctgagagtgtggcttccaggcc

SEQ ID NO: 9463032 - DNA, 22 bp, Homo sapiens
ctgagagtgcttgaaaggccag

SEQ ID NO: 9463033 - DNA, 22 bp, Homo sapiens
ctgagagttcgttccaccctcc

SEQ ID NO: 9463034 - DNA, 22 bp, Homo sapiens
ctgagagttaagagatggggct

SEQ ID NO: 9463035 - DNA, 22 bp, Homo sapiens
ctgagataaatgcctccagtca

SEQ ID NO: 9463036 - DNA, 22 bp, Homo sapiens
ctgagatactgtggcgaatgca

SEQ ID NO: 9463037 - DNA, 22 bp, Homo sapiens
ctgagatctttatacgaggcac

SEQ ID NO: 9463038 - DNA, 22 bp, Homo sapiens
ctgagatctttatacgaggcac

SEQ ID NO: 9463039 - DNA, 22 bp, Homo sapiens
ctgagctgggcaactcttagat

SEQ ID NO: 9463040 - DNA, 22 bp, Homo sapiens
ctgagctgggcaactcttagat

SEQ ID NO: 9463041 - DNA, 22 bp, Homo sapiens
ctgagctgggagtggatagtgg

SEQ ID NO: 9463042 - DNA, 22 bp, Homo sapiens
ctgagctgggagcctggcacca

SEQ ID NO: 9463043 - DNA, 22 bp, Homo sapiens
ctgagcgcgggacctgaggctg

SEQ ID NO: 9463044 - DNA, 22 bp, Homo sapiens
ctgagctgggagtagagactct

SEQ ID NO: 9463045 - DNA, 22 bp, Homo sapiens
ctgagctgggagtagagactct

SEQ ID NO: 9463046 - DNA, 22 bp, Homo sapiens
ctgagccttattcaccagccct

SEQ ID NO: 9463047 - DNA, 22 bp, Homo sapiens
ctgagcgaggagttggagcttt

SEQ ID NO: 9463048 - DNA, 22 bp, Homo sapiens
ctgagcgacaagtagcttttga

SEQ ID NO: 9463049 - DNA, 22 bp, Homo sapiens
ctgagcgcatggttgctgggga

SEQ ID NO: 9463050 - DNA, 23 bp, Homo sapiens
ctgagcacagctctgtgggcctc

SEQ ID NO: 9463051 - DNA, 22 bp, Homo sapiens
ctgagcacctgctgtgtgccag

SEQ ID NO: 9463052 - DNA, 22 bp, Homo sapiens
ctgagcacagaaataagatatt

SEQ ID NO: 9463053 - DNA, 22 bp, Homo sapiens
ctgagcacctgttataggttag

SEQ ID NO: 9463054 - DNA, 22 bp, Homo sapiens
ctgagcaatttcagctctcact

SEQ ID NO: 9463055 - DNA, 22 bp, Homo sapiens
ctgagagatcaagccacaggat

SEQ ID NO: 9463056 - DNA, 22 bp, Homo sapiens
ctgagagatcaagccacaggat

SEQ ID NO: 9463057 - DNA, 22 bp, Homo sapiens
ctgaatagtgttatatgggtga

SEQ ID NO: 9463058 - DNA, 22 bp, Homo sapiens
ctgaataattttctgttgtatg

SEQ ID NO: 9463059 - DNA, 22 bp, Homo sapiens
ctgaataattttatagttgctg

SEQ ID NO: 9463060 - DNA, 22 bp, Homo sapiens
ctgaataatgttctcttgtatg

SEQ ID NO: 9463061 - DNA, 22 bp, Homo sapiens
ctgaataattttatagttgctg

SEQ ID NO: 9463062 - DNA, 19 bp, Homo sapiens
ctgagagatgcttcacaca

SEQ ID NO: 9463063 - DNA, 22 bp, Homo sapiens
ctgaataatgttctcttgtatg

SEQ ID NO: 9463064 - DNA, 22 bp, Homo sapiens
ctgaataatattccattatgag

SEQ ID NO: 9463065 - DNA, 22 bp, Homo sapiens
ctgaataatattccattatgag

SEQ ID NO: 9463066 - DNA, 22 bp, Homo sapiens
ctgaataaagccctcgcgcgct

SEQ ID NO: 9463067 - DNA, 22 bp, Homo sapiens
ctgaataatacagactagcttc

SEQ ID NO: 9463068 - DNA, 22 bp, Homo sapiens
ctgagaggtaagcagcgcagtg

SEQ ID NO: 9463069 - DNA, 22 bp, Homo sapiens
ctgagaggtaagcagcgcagtg

SEQ ID NO: 9463070 - DNA, 22 bp, Homo sapiens
ctgagaggggaccagggtgttt

SEQ ID NO: 9463071 - DNA, 22 bp, Homo sapiens
ctgagaggggaccagggtgttt

SEQ ID NO: 9463072 - DNA, 22 bp, Homo sapiens
ctgagaggtaagcagcgcagtg

SEQ ID NO: 9463073 - DNA, 22 bp, Homo sapiens
ctgagaggtgacagcgtgctgg

SEQ ID NO: 9463074 - DNA, 22 bp, Homo sapiens
ctgagaggtgctggtggctgca

SEQ ID NO: 9463075 - DNA, 22 bp, Homo sapiens
ctgagagtaattttctacttga

SEQ ID NO: 9463076 - DNA, 22 bp, Homo sapiens
ctgagaggtgacagcgtgctgg

SEQ ID NO: 9463077 - DNA, 22 bp, Homo sapiens
ctgagaggtgacagcgtgctgg

SEQ ID NO: 9463078 - DNA, 22 bp, Homo sapiens
ctgagaggtgctggtggctgca

SEQ ID NO: 9463079 - DNA, 22 bp, Homo sapiens
ctgagagtcagcttctcctcct

SEQ ID NO: 9463080 - DNA, 22 bp, Homo sapiens
ctgagagtattggcaggcttgg

SEQ ID NO: 9463081 - DNA, 22 bp, Homo sapiens
ctgagagtattggcaggcttgg

SEQ ID NO: 9463082 - DNA, 22 bp, Homo sapiens
ctgagagtagctggagaacatt

SEQ ID NO: 9463083 - DNA, 22 bp, Homo sapiens
ctgagagtagctggagaacatt

SEQ ID NO: 9463084 - DNA, 22 bp, Homo sapiens
ctgagggagttcctgagcccac

SEQ ID NO: 9463085 - DNA, 22 bp, Homo sapiens
ctgagggagttcctgagcccac

SEQ ID NO: 9463086 - DNA, 22 bp, Homo sapiens
ctgagggatgggctgggccgcc

SEQ ID NO: 9463087 - DNA, 22 bp, Homo sapiens
ctgagggatgggctgggccgcc

SEQ ID NO: 9463088 - DNA, 22 bp, Homo sapiens
ctgagggcaccgacagagtgga

SEQ ID NO: 9463089 - DNA, 22 bp, Homo sapiens
ctgagggcaccgacagagtgga

SEQ ID NO: 9463090 - DNA, 18 bp, Homo sapiens
ctgagggcaacagaggct

SEQ ID NO: 9463091 - DNA, 18 bp, Homo sapiens
ctgagggcaacagaggct

SEQ ID NO: 9463092 - DNA, 18 bp, Homo sapiens
ctgagggcaacagaggct

SEQ ID NO: 9463093 - DNA, 18 bp, Homo sapiens
ctgagggcagcccctggg

SEQ ID NO: 9463094 - DNA, 18 bp, Homo sapiens
ctgagggcagcccctggg

SEQ ID NO: 9463095 - DNA, 18 bp, Homo sapiens
ctgagggcagcccctggg

SEQ ID NO: 9463096 - DNA, 22 bp, Homo sapiens
ctgagggcagtgatgaaggtga

SEQ ID NO: 9463097 - DNA, 22 bp, Homo sapiens
ctgagggcagtgatgaaggtga

SEQ ID NO: 9463098 - DNA, 22 bp, Homo sapiens
ctgagggccctgaagcttggca

SEQ ID NO: 9463099 - DNA, 22 bp, Homo sapiens
ctgagggccctgaagcttggca

SEQ ID NO: 9463100 - DNA, 21 bp, Homo sapiens
ctgagggccgcagctgggctc

SEQ ID NO: 9463101 - DNA, 21 bp, Homo sapiens
ctgagggccgcagctgggctc

SEQ ID NO: 9463102 - DNA, 22 bp, Homo sapiens
ctgagggagaagtcacgggcag

SEQ ID NO: 9463103 - DNA, 22 bp, Homo sapiens
ctgagggagaagtgatctctac

SEQ ID NO: 9463104 - DNA, 22 bp, Homo sapiens
ctgagggaccctgtgagtacct

SEQ ID NO: 9463105 - DNA, 22 bp, Homo sapiens
ctgagggagagaatggggcaaa

SEQ ID NO: 9463106 - DNA, 22 bp, Homo sapiens
ctgagggagctgctggccttgg

SEQ ID NO: 9463107 - DNA, 22 bp, Homo sapiens
ctgagggagctgctggccttgg

SEQ ID NO: 9463108 - DNA, 22 bp, Homo sapiens
ctgagggagacagtgcggacta

SEQ ID NO: 9463109 - DNA, 22 bp, Homo sapiens
ctgagggagagaatggggcaaa

SEQ ID NO: 9463110 - DNA, 22 bp, Homo sapiens
ctgaggctgggcatggggtcca

SEQ ID NO: 9463111 - DNA, 18 bp, Homo sapiens
ctgaggctggcaggagcc

SEQ ID NO: 9463112 - DNA, 22 bp, Homo sapiens
ctgagggaacttgggcaagtct

SEQ ID NO: 9463113 - DNA, 22 bp, Homo sapiens
ctgagggaaggggtacatggct

SEQ ID NO: 9463114 - DNA, 22 bp, Homo sapiens
ctgagggaacttgggcaagtct

SEQ ID NO: 9463115 - DNA, 22 bp, Homo sapiens
ctgaggctgggcatggggtcca

SEQ ID NO: 9463116 - DNA, 22 bp, Homo sapiens
ctgagctgtgctaagtgaaatg

SEQ ID NO: 9463117 - DNA, 22 bp, Homo sapiens
ctgagctgtcaggaatggaaag

SEQ ID NO: 9463118 - DNA, 22 bp, Homo sapiens
ctgagctgttactctgtcctcg

SEQ ID NO: 9463119 - DNA, 22 bp, Homo sapiens
ctgagctgtgtggtcctgggca

SEQ ID NO: 9463120 - DNA, 22 bp, Homo sapiens
ctgagctgtggccaccaattta

SEQ ID NO: 9463121 - DNA, 22 bp, Homo sapiens
ctgagctgtggaataaacactg

SEQ ID NO: 9463122 - DNA, 21 bp, Homo sapiens
ctgagctggggtgaaggttgc

SEQ ID NO: 9463123 - DNA, 22 bp, Homo sapiens
ctgagctgggctctcttgaggg

SEQ ID NO: 9463124 - DNA, 22 bp, Homo sapiens
ctgagctgggctctcttgaggg

SEQ ID NO: 9463125 - DNA, 21 bp, Homo sapiens
ctgagctggggtgaaggttgc

SEQ ID NO: 9463126 - DNA, 22 bp, Homo sapiens
ctgagctggtggaagcatgcag

SEQ ID NO: 9463127 - DNA, 22 bp, Homo sapiens
ctgagctggtgtttcagggtca

SEQ ID NO: 9463128 - DNA, 22 bp, Homo sapiens
ctgagctggtgtttcagggtca

SEQ ID NO: 9463129 - DNA, 22 bp, Homo sapiens
ctgagctggtggaagcatgcag

SEQ ID NO: 9463130 - DNA, 22 bp, Homo sapiens
ctgagctgtttaatcccagata

SEQ ID NO: 9463131 - DNA, 22 bp, Homo sapiens
ctgagctgtttaatcccagata

SEQ ID NO: 9463132 - DNA, 22 bp, Homo sapiens
ctgagctgtttaatcccagata

SEQ ID NO: 9463133 - DNA, 22 bp, Homo sapiens
ctgagcttcagtgcactgggag

SEQ ID NO: 9463134 - DNA, 22 bp, Homo sapiens
ctgagcttccagttcctccagg

SEQ ID NO: 9463135 - DNA, 22 bp, Homo sapiens
ctgaggaaagctgcagcggtac

SEQ ID NO: 9463136 - DNA, 22 bp, Homo sapiens
ctgaggaagacagcagctgtgt

SEQ ID NO: 9463137 - DNA, 22 bp, Homo sapiens
ctgaggaaagtattgcctggtg

SEQ ID NO: 9463138 - DNA, 22 bp, Homo sapiens
ctgaggaagacagcagctgtgt

SEQ ID NO: 9463139 - DNA, 22 bp, Homo sapiens
ctgaggacattgatgaggcaat

SEQ ID NO: 9463140 - DNA, 22 bp, Homo sapiens
ctgagggccttggctcctgccc

SEQ ID NO: 9463141 - DNA, 22 bp, Homo sapiens
ctgagggccttggctcctgccc

SEQ ID NO: 9463142 - DNA, 22 bp, Homo sapiens
ctgagggccttctatgctgagc

SEQ ID NO: 9463143 - DNA, 22 bp, Homo sapiens
ctgagggcctgaggacctagat

SEQ ID NO: 9463144 - DNA, 22 bp, Homo sapiens
ctgagggccttctatgctgagc

SEQ ID NO: 9463145 - DNA, 21 bp, Homo sapiens
ctgagggccgcagctgggctc

SEQ ID NO: 9463146 - DNA, 22 bp, Homo sapiens
ctgagggccgggacccagtttc

SEQ ID NO: 9463147 - DNA, 21 bp, Homo sapiens
ctgagggccgcagctgggctc

SEQ ID NO: 9463148 - DNA, 22 bp, Homo sapiens
ctgagggctggagctgaggcct

SEQ ID NO: 9463149 - DNA, 22 bp, Homo sapiens
ctgagggctggagctgaggcct

SEQ ID NO: 9463150 - DNA, 22 bp, Homo sapiens
ctgagggctggagctgaggcct

SEQ ID NO: 9463151 - DNA, 22 bp, Homo sapiens
ctgagggctggagctgaggcct

SEQ ID NO: 9463152 - DNA, 23 bp, Homo sapiens
ctgagggctggtctgaagtctgc

SEQ ID NO: 9463153 - DNA, 22 bp, Homo sapiens
ctgagggcttccttgtcccggg

SEQ ID NO: 9463154 - DNA, 23 bp, Homo sapiens
ctgagggctggtctgaagtctgc

SEQ ID NO: 9463155 - DNA, 22 bp, Homo sapiens
ctgagggctggagctgaggcct

SEQ ID NO: 9463156 - DNA, 22 bp, Homo sapiens
ctgcaggggcctcgagcacagg

SEQ ID NO: 9463157 - DNA, 23 bp, Homo sapiens
ctgaggggaaaagggcttcaggc

SEQ ID NO: 9463158 - DNA, 22 bp, Homo sapiens
ctgagggcttccttgtcccggg

SEQ ID NO: 9463159 - DNA, 21 bp, Homo sapiens
ctgagggctttgaatccagac

SEQ ID NO: 9463160 - DNA, 22 bp, Homo sapiens
ctgcaggggctggagttggctt

SEQ ID NO: 9463161 - DNA, 22 bp, Homo sapiens
ctgcaggggctggagttggctt

SEQ ID NO: 9463162 - DNA, 22 bp, Homo sapiens
ctgcaggggcctcgagcacagg

SEQ ID NO: 9463163 - DNA, 22 bp, Homo sapiens
ctgcaggttaggagcactcctt

SEQ ID NO: 9463164 - DNA, 22 bp, Homo sapiens
ctgcagggtttttcaaggacaa

SEQ ID NO: 9463165 - DNA, 22 bp, Homo sapiens
ctgcagggtttttcaaggacaa

SEQ ID NO: 9463166 - DNA, 22 bp, Homo sapiens
ctgcagtaaccactgtaggtgt

SEQ ID NO: 9463167 - DNA, 22 bp, Homo sapiens
ctgcagttctcaatttctattg

SEQ ID NO: 9463168 - DNA, 22 bp, Homo sapiens
ctgcagttctcaatttctattg

SEQ ID NO: 9463169 - DNA, 22 bp, Homo sapiens
ctgcagttcttctcctcaaggc

SEQ ID NO: 9463170 - DNA, 22 bp, Homo sapiens
ctgcagttgactccctgtttgc

SEQ ID NO: 9463171 - DNA, 22 bp, Homo sapiens
ctgcagttctttggcttttaga

SEQ ID NO: 9463172 - DNA, 22 bp, Homo sapiens
ctgcagttggtgggtcctcggt

SEQ ID NO: 9463173 - DNA, 22 bp, Homo sapiens
ctgcagttggtgggtcctcggt

SEQ ID NO: 9463174 - DNA, 22 bp, Homo sapiens
ctgcagttggataaagatactt

SEQ ID NO: 9463175 - DNA, 22 bp, Homo sapiens
ctgcagttgggtgacccaatat

SEQ ID NO: 9463176 - DNA, 22 bp, Homo sapiens
ctgcagttggctgagacccccc

SEQ ID NO: 9463177 - DNA, 22 bp, Homo sapiens
ctgcagtttgaccttgttttct

SEQ ID NO: 9463178 - DNA, 22 bp, Homo sapiens
ctgcagtttcagcctttctggc

SEQ ID NO: 9463179 - DNA, 22 bp, Homo sapiens
ctgcagtttgctaagagacaaa

SEQ ID NO: 9463180 - DNA, 22 bp, Homo sapiens
ctgcagtttgtaaacattttaa

SEQ ID NO: 9463181 - DNA, 22 bp, Homo sapiens
ctgcatatcaaattactcctgg

SEQ ID NO: 9463182 - DNA, 22 bp, Homo sapiens
ctgcatatcaaattactcctgg

SEQ ID NO: 9463183 - DNA, 22 bp, Homo sapiens
ctgcatatgagaataggagaaa

SEQ ID NO: 9463184 - DNA, 22 bp, Homo sapiens
ctgcatatgatagatgccttgc

SEQ ID NO: 9463185 - DNA, 23 bp, Homo sapiens
ctgcatatggaggttagcaactc

SEQ ID NO: 9463186 - DNA, 22 bp, Homo sapiens
ctgcatatgatagatgccttgc

SEQ ID NO: 9463187 - DNA, 22 bp, Homo sapiens
ctgcatcactcttactggcttt

SEQ ID NO: 9463188 - DNA, 22 bp, Homo sapiens
ctgcccctgctcatggctgtcc

SEQ ID NO: 9463189 - DNA, 22 bp, Homo sapiens
ctgcagtctacctggattttta

SEQ ID NO: 9463190 - DNA, 23 bp, Homo sapiens
ctgcagtcgccggcctgggtgcc

SEQ ID NO: 9463191 - DNA, 22 bp, Homo sapiens
ctgcagtcagtgctaatgggta

SEQ ID NO: 9463192 - DNA, 22 bp, Homo sapiens
ctgcagtatgagctacccaggt

SEQ ID NO: 9463193 - DNA, 22 bp, Homo sapiens
ctgcagtagcagagctgagtag

SEQ ID NO: 9463194 - DNA, 22 bp, Homo sapiens
ctgcagtgcctgccactgagcc

SEQ ID NO: 9463195 - DNA, 22 bp, Homo sapiens
ctgcagtgttctggaatgcatt

SEQ ID NO: 9463196 - DNA, 22 bp, Homo sapiens
ctgcagtgcctgccactgagcc

SEQ ID NO: 9463197 - DNA, 22 bp, Homo sapiens
ctgcagtgcaagcccagatgga

SEQ ID NO: 9463198 - DNA, 22 bp, Homo sapiens
ctgcagtgcaagcccagatgga

SEQ ID NO: 9463199 - DNA, 22 bp, Homo sapiens
ctgccctgcccaggccttgggc

SEQ ID NO: 9463200 - DNA, 22 bp, Homo sapiens
ctgccctgcccaggccttgggc

SEQ ID NO: 9463201 - DNA, 22 bp, Homo sapiens
ctgccctgcccaggccttgggc

SEQ ID NO: 9463202 - DNA, 22 bp, Homo sapiens
ctgccctgcccaggccttgggc

SEQ ID NO: 9463203 - DNA, 22 bp, Homo sapiens
ctgccctgcagctccacggact

SEQ ID NO: 9463204 - DNA, 22 bp, Homo sapiens
ctgccctgcccaggccttgggc

SEQ ID NO: 9463205 - DNA, 22 bp, Homo sapiens
ctgccctgcccaggccttgggc

SEQ ID NO: 9463206 - DNA, 22 bp, Homo sapiens
ctgccctgcccaggccttgggc

SEQ ID NO: 9463207 - DNA, 20 bp, Homo sapiens
ctgccctgccctgggtcctg

SEQ ID NO: 9463208 - DNA, 20 bp, Homo sapiens
ctgccctgccctgggtcctg

SEQ ID NO: 9463209 - DNA, 22 bp, Homo sapiens
ctgccctgcctggccagtgtgg

SEQ ID NO: 9463210 - DNA, 22 bp, Homo sapiens
ctgccctgcctggccagtgtgg

SEQ ID NO: 9463211 - DNA, 22 bp, Homo sapiens
ctgccctgctctccgggatctt

SEQ ID NO: 9463212 - DNA, 22 bp, Homo sapiens
ctgccctgctaatgagttccaa

SEQ ID NO: 9463213 - DNA, 22 bp, Homo sapiens
ctgccctgctctccgggatctt

SEQ ID NO: 9463214 - DNA, 22 bp, Homo sapiens
ctgccctgcctggccagtgtgg

SEQ ID NO: 9463215 - DNA, 22 bp, Homo sapiens
ctgccctgctaatgagttccaa

SEQ ID NO: 9463216 - DNA, 22 bp, Homo sapiens
ctgccctgcctggccagtgtgg

SEQ ID NO: 9463217 - DNA, 22 bp, Homo sapiens
ctgccctgcctggccagtgtgg

SEQ ID NO: 9463218 - DNA, 22 bp, Homo sapiens
ctgccctgctggagatcacagt

SEQ ID NO: 9463219 - DNA, 22 bp, Homo sapiens
ctgccctgcttctgagggaagc

SEQ ID NO: 9463220 - DNA, 23 bp, Homo sapiens
ctgccctgatcttgatctattgt

SEQ ID NO: 9463221 - DNA, 23 bp, Homo sapiens
ctgccctgatcttgatctattgt

SEQ ID NO: 9463222 - DNA, 22 bp, Homo sapiens
ctgccctgatatgatttagaac

SEQ ID NO: 9463223 - DNA, 22 bp, Homo sapiens
ctgccctgcagctccacggact

SEQ ID NO: 9463224 - DNA, 22 bp, Homo sapiens
ctgccctgagggcctgtgtgtt

SEQ ID NO: 9463225 - DNA, 22 bp, Homo sapiens
ctgccctgagggcctgtgtgtt

SEQ ID NO: 9463226 - DNA, 22 bp, Homo sapiens
ctgccctgagtcatgccagatg

SEQ ID NO: 9463227 - DNA, 22 bp, Homo sapiens
ctgccctgagtcatgccagatg

SEQ ID NO: 9463228 - DNA, 22 bp, Homo sapiens
ctgccctgatatgatttagaac

SEQ ID NO: 9463229 - DNA, 22 bp, Homo sapiens
ctgccctgactgaccttttgaa

SEQ ID NO: 9463230 - DNA, 22 bp, Homo sapiens
ctgccctgagggcctgtgtgtt

SEQ ID NO: 9463231 - DNA, 22 bp, Homo sapiens
ctgccctgagggcctgtgtgtt

SEQ ID NO: 9463232 - DNA, 22 bp, Homo sapiens
ctgccctgactgaccttttgaa

SEQ ID NO: 9463233 - DNA, 22 bp, Homo sapiens
ctgccctgagggcctgtgtgtt

SEQ ID NO: 9463234 - DNA, 22 bp, Homo sapiens
ctgccctgagggcctgtgtgtt

SEQ ID NO: 9463235 - DNA, 22 bp, Homo sapiens
ctgcctctataggagtccacca

SEQ ID NO: 9463236 - DNA, 22 bp, Homo sapiens
ctgcctctattcactgaggcag

SEQ ID NO: 9463237 - DNA, 22 bp, Homo sapiens
ctgcctctattcactgaggcag

SEQ ID NO: 9463238 - DNA, 22 bp, Homo sapiens
ctgcctctattcactgaggcag

SEQ ID NO: 9463239 - DNA, 22 bp, Homo sapiens
ctgcctctattcactgaggcag

SEQ ID NO: 9463240 - DNA, 22 bp, Homo sapiens
ctgcctctattcactgaggcag

SEQ ID NO: 9463241 - DNA, 22 bp, Homo sapiens
ctgccctgggccaggaagcggc

SEQ ID NO: 9463242 - DNA, 22 bp, Homo sapiens
ctgccctgggatggtctgtgcg

SEQ ID NO: 9463243 - DNA, 22 bp, Homo sapiens
ctgccctgggatggtctgtgcg

SEQ ID NO: 9463244 - DNA, 22 bp, Homo sapiens
ctgccctgggccaggaagcggc

SEQ ID NO: 9463245 - DNA, 22 bp, Homo sapiens
ctgccctgggccaggaagcggc

SEQ ID NO: 9463246 - DNA, 22 bp, Homo sapiens
ctgcctctggttttggtccctg

SEQ ID NO: 9463247 - DNA, 22 bp, Homo sapiens
ctgcctctggttttggtccctg

SEQ ID NO: 9463248 - DNA, 22 bp, Homo sapiens
ctgcctctgttgggcatggtct

SEQ ID NO: 9463249 - DNA, 22 bp, Homo sapiens
ctgcctctggttttggtccctg

SEQ ID NO: 9463250 - DNA, 22 bp, Homo sapiens
ctgcctctggttttggtccctg

SEQ ID NO: 9463251 - DNA, 22 bp, Homo sapiens
ctgcctctggcctcaggcccag

SEQ ID NO: 9463252 - DNA, 22 bp, Homo sapiens
ctgcctctggcctcaggcccag

SEQ ID NO: 9463253 - DNA, 22 bp, Homo sapiens
ctgcctctggcctcaggcccag

SEQ ID NO: 9463254 - DNA, 22 bp, Homo sapiens
ctgccctgcttgatgacagcga

SEQ ID NO: 9463255 - DNA, 22 bp, Homo sapiens
ctgccctgcttgatgacagcga

SEQ ID NO: 9463256 - DNA, 22 bp, Homo sapiens
ctgccctgcttgatgacagcga

SEQ ID NO: 9463257 - DNA, 22 bp, Homo sapiens
ctgccctgcttgatgacagcga

SEQ ID NO: 9463258 - DNA, 22 bp, Homo sapiens
ctgccctggaaaacgtatctta

SEQ ID NO: 9463259 - DNA, 22 bp, Homo sapiens
ctgccctgcttgtttccagtgg

SEQ ID NO: 9463260 - DNA, 22 bp, Homo sapiens
ctgccctgcttgtttccagtgg

SEQ ID NO: 9463261 - DNA, 22 bp, Homo sapiens
ctgccctggcagcctaccatgg

SEQ ID NO: 9463262 - DNA, 22 bp, Homo sapiens
ctgccctggaaaacgtatctta

SEQ ID NO: 9463263 - DNA, 22 bp, Homo sapiens
ctgccctggcagcctaccatgg

SEQ ID NO: 9463264 - DNA, 22 bp, Homo sapiens
ctgccctgggagtacctgtcct

SEQ ID NO: 9463265 - DNA, 22 bp, Homo sapiens
ctgccctgggagtacctgtcct

SEQ ID NO: 9463266 - DNA, 22 bp, Homo sapiens
ctgccctgggagtacctgtcct

SEQ ID NO: 9463267 - DNA, 22 bp, Homo sapiens
ctgccctgggagtacctgtcct

SEQ ID NO: 9463268 - DNA, 22 bp, Homo sapiens
ctgccctgggagtacctgtcct

SEQ ID NO: 9463269 - DNA, 22 bp, Homo sapiens
ctgccctgggatggtctgtgcg

SEQ ID NO: 9463270 - DNA, 22 bp, Homo sapiens
ctgccctgggatggtctgtgcg

SEQ ID NO: 9463271 - DNA, 22 bp, Homo sapiens
ctgccctgggatggtctgtgcg

SEQ ID NO: 9463272 - DNA, 22 bp, Homo sapiens
ctgccctggccactgtgcccag

SEQ ID NO: 9463273 - DNA, 22 bp, Homo sapiens
ctgccctggcagcctaccatgg

SEQ ID NO: 9463274 - DNA, 22 bp, Homo sapiens
ctgccctggcagcctaccatgg

SEQ ID NO: 9463275 - DNA, 22 bp, Homo sapiens
ctgccctggccactgtgcccag

SEQ ID NO: 9463276 - DNA, 22 bp, Homo sapiens
ctgccctggccactgtgcccag

SEQ ID NO: 9463277 - DNA, 22 bp, Homo sapiens
ctgccctggccactgtgcccag

SEQ ID NO: 9463278 - DNA, 20 bp, Homo sapiens
ctgctgccctgtcagcctct

SEQ ID NO: 9463279 - DNA, 19 bp, Homo sapiens
ctgctgccggagactcgtc

SEQ ID NO: 9463280 - DNA, 19 bp, Homo sapiens
ctgctgccggagactcgtc

SEQ ID NO: 9463281 - DNA, 22 bp, Homo sapiens
ctgctgccggcgagcctccctt

SEQ ID NO: 9463282 - DNA, 22 bp, Homo sapiens
ctgctgcctagtccaagacgtg

SEQ ID NO: 9463283 - DNA, 22 bp, Homo sapiens
ctgctgccggcgagcctccctt

SEQ ID NO: 9463284 - DNA, 22 bp, Homo sapiens
ctgctgcccctgagctcagcct

SEQ ID NO: 9463285 - DNA, 22 bp, Homo sapiens
ctgctgccctagacccagtcct

SEQ ID NO: 9463286 - DNA, 22 bp, Homo sapiens
ctgctgcccctgagctcagcct

SEQ ID NO: 9463287 - DNA, 22 bp, Homo sapiens
ctgctgagccctggcacaggtg

SEQ ID NO: 9463288 - DNA, 22 bp, Homo sapiens
ctgctgagccgcacccaggagc

SEQ ID NO: 9463289 - DNA, 22 bp, Homo sapiens
ctgctgagcctggtgcgggatg

SEQ ID NO: 9463290 - DNA, 22 bp, Homo sapiens
ctgctgagcatttgcagggaca

SEQ ID NO: 9463291 - DNA, 22 bp, Homo sapiens
ctgctctgaagccaggattctg

SEQ ID NO: 9463292 - DNA, 22 bp, Homo sapiens
ctgctctgaagccaggattctg

SEQ ID NO: 9463293 - DNA, 22 bp, Homo sapiens
ctgctgagcatcagggctgccc

SEQ ID NO: 9463294 - DNA, 22 bp, Homo sapiens
ctgctctgaagccaggattctg

SEQ ID NO: 9463295 - DNA, 22 bp, Homo sapiens
ctgctctaactgcattagtttt

SEQ ID NO: 9463296 - DNA, 22 bp, Homo sapiens
ctgctctccccaggccagtctg

SEQ ID NO: 9463297 - DNA, 22 bp, Homo sapiens
ctgctctccccaggccagtctg

SEQ ID NO: 9463298 - DNA, 22 bp, Homo sapiens
ctgctctaatatcagatagact

SEQ ID NO: 9463299 - DNA, 22 bp, Homo sapiens
ctgctctagagagcattagtca

SEQ ID NO: 9463300 - DNA, 22 bp, Homo sapiens
ctgctgtgagtttggaggtcta

SEQ ID NO: 9463301 - DNA, 22 bp, Homo sapiens
ctgctggaagtttgctgtggat

SEQ ID NO: 9463302 - DNA, 22 bp, Homo sapiens
ctgctggaaggtacacatcttg

SEQ ID NO: 9463303 - DNA, 22 bp, Homo sapiens
ctgctggaagtttgctgtggat

SEQ ID NO: 9463304 - DNA, 22 bp, Homo sapiens
ctgctggactacaggaagagtt

SEQ ID NO: 9463305 - DNA, 22 bp, Homo sapiens
ctgctggagggagctgatagtg

SEQ ID NO: 9463306 - DNA, 22 bp, Homo sapiens
ctgctggaggttggagcatgca

SEQ ID NO: 9463307 - DNA, 22 bp, Homo sapiens
ctgctggaggttggagcatgca

SEQ ID NO: 9463308 - DNA, 22 bp, Homo sapiens
ctgctggaggttggagcatgca

SEQ ID NO: 9463309 - DNA, 21 bp, Homo sapiens
ctgctgctggggtctgggcag

SEQ ID NO: 9463310 - DNA, 22 bp, Homo sapiens
ctgctgctcttgtgcattagtg

SEQ ID NO: 9463311 - DNA, 22 bp, Homo sapiens
ctgctgcctgattgcagacctc

SEQ ID NO: 9463312 - DNA, 22 bp, Homo sapiens
ctgctgcctgattgcagacctc

SEQ ID NO: 9463313 - DNA, 22 bp, Homo sapiens
ctgctgccttccaaaggccagg

SEQ ID NO: 9463314 - DNA, 22 bp, Homo sapiens
ctgcctcttgacagatcgtggc

SEQ ID NO: 9463315 - DNA, 22 bp, Homo sapiens
ctgcctcttgacagatcgtggc

SEQ ID NO: 9463316 - DNA, 22 bp, Homo sapiens
ctgcctcttaagtggatggagt

SEQ ID NO: 9463317 - DNA, 22 bp, Homo sapiens
ctgcctctgttgggcatggtct

SEQ ID NO: 9463318 - DNA, 22 bp, Homo sapiens
ctgcctctgttgggcatggtct

SEQ ID NO: 9463319 - DNA, 22 bp, Homo sapiens
ctgcctgcactgcctggctcca

SEQ ID NO: 9463320 - DNA, 22 bp, Homo sapiens
ctgcctgcactgcctggctcca

SEQ ID NO: 9463321 - DNA, 22 bp, Homo sapiens
ctgcctgcaggacacctcgcta

SEQ ID NO: 9463322 - DNA, 22 bp, Homo sapiens
ctgcctgcactgcctggctcca

SEQ ID NO: 9463323 - DNA, 22 bp, Homo sapiens
ctgcctgcactgcctggctcca

SEQ ID NO: 9463324 - DNA, 22 bp, Homo sapiens
ctgcctgagtggaggtcgaggg

SEQ ID NO: 9463325 - DNA, 22 bp, Homo sapiens
ctgcgtgcatgtctgcgtgcat

SEQ ID NO: 9463326 - DNA, 22 bp, Homo sapiens
ctgcgtgtctctgtctcatggc

SEQ ID NO: 9463327 - DNA, 22 bp, Homo sapiens
ctgcgtgcattaatatttcctt

SEQ ID NO: 9463328 - DNA, 22 bp, Homo sapiens
ctgcgtgtctccttggggcaga

SEQ ID NO: 9463329 - DNA, 22 bp, Homo sapiens
ctgcctgccttggcctccagga

SEQ ID NO: 9463330 - DNA, 22 bp, Homo sapiens
ctgcctgccttggcctccagga

SEQ ID NO: 9463331 - DNA, 22 bp, Homo sapiens
ctgcctgccttggcctccagga

SEQ ID NO: 9463332 - DNA, 22 bp, Homo sapiens
ctgcctgcctggagacagatgg

SEQ ID NO: 9463333 - DNA, 22 bp, Homo sapiens
ctgcctgcatcccacagtgggg

SEQ ID NO: 9463334 - DNA, 22 bp, Homo sapiens
ctgctcctgtccagcagggcca

SEQ ID NO: 9463335 - DNA, 22 bp, Homo sapiens
ctgctcctctgaggtagccaca

SEQ ID NO: 9463336 - DNA, 18 bp, Homo sapiens
ctgctccagtctggccag

SEQ ID NO: 9463337 - DNA, 22 bp, Homo sapiens
ctgctccccagcctgcgccttt

SEQ ID NO: 9463338 - DNA, 22 bp, Homo sapiens
ctgctccccagcctgcgccttt

SEQ ID NO: 9463339 - DNA, 22 bp, Homo sapiens
ctgctccccagcctgcgccttt

SEQ ID NO: 9463340 - DNA, 19 bp, Homo sapiens
ctgctccctccttctggca

SEQ ID NO: 9463341 - DNA, 19 bp, Homo sapiens
ctgctccctccttctggca

SEQ ID NO: 9463342 - DNA, 22 bp, Homo sapiens
ctgctccagacacctgcagggg

SEQ ID NO: 9463343 - DNA, 22 bp, Homo sapiens
ctgctccagacacctgcagggg

SEQ ID NO: 9463344 - DNA, 22 bp, Homo sapiens
ctgctccaggaacagagctgct

SEQ ID NO: 9463345 - DNA, 22 bp, Homo sapiens
ctgctccaggaacagagctgct

SEQ ID NO: 9463346 - DNA, 23 bp, Homo sapiens
ctgctccaggacagcatggaggt

SEQ ID NO: 9463347 - DNA, 23 bp, Homo sapiens
ctgctccaggacagcatggaggt

SEQ ID NO: 9463348 - DNA, 20 bp, Homo sapiens
ctgctccacccggctctcag

SEQ ID NO: 9463349 - DNA, 22 bp, Homo sapiens
ctgctccacctccgggtcaggc

SEQ ID NO: 9463350 - DNA, 22 bp, Homo sapiens
ctgctccacctccgggtcaggc

SEQ ID NO: 9463351 - DNA, 22 bp, Homo sapiens
ctgctccaagccagccctgcag

SEQ ID NO: 9463352 - DNA, 22 bp, Homo sapiens
ctgcgtgtttgcaccctgtctg

SEQ ID NO: 9463353 - DNA, 22 bp, Homo sapiens
ctgcgtgttcctgaagcgcgct

SEQ ID NO: 9463354 - DNA, 22 bp, Homo sapiens
ttgaagttggtgtggaaagtag

SEQ ID NO: 9463355 - DNA, 22 bp, Homo sapiens
ttgaagtttaatggtagattcc

SEQ ID NO: 9463356 - DNA, 22 bp, Homo sapiens
ttgaataatatgcttcgttctc

SEQ ID NO: 9463357 - DNA, 22 bp, Homo sapiens
ttgaataatgtgtatgttgtta

SEQ ID NO: 9463358 - DNA, 19 bp, Homo sapiens
ttgaatatgcaaactgaag

SEQ ID NO: 9463359 - DNA, 22 bp, Homo sapiens
ttgaatcattacaatagataag

SEQ ID NO: 9463360 - DNA, 22 bp, Homo sapiens
ctcactgccctgaagttgggtt

SEQ ID NO: 9463361 - DNA, 22 bp, Homo sapiens
ctcactgcaagctctgcctccc

SEQ ID NO: 9463362 - DNA, 22 bp, Homo sapiens
ctcactgcaagctctgcctccc

SEQ ID NO: 9463363 - DNA, 22 bp, Homo sapiens
ctcactgcaagctccgcctccc

SEQ ID NO: 9463364 - DNA, 22 bp, Homo sapiens
ctcactgcaagctctgcctcca

SEQ ID NO: 9463365 - DNA, 22 bp, Homo sapiens
ctcactgcaagctctgcctcca

SEQ ID NO: 9463366 - DNA, 22 bp, Homo sapiens
ctcactgcaagctctgcctccc

SEQ ID NO: 9463367 - DNA, 22 bp, Homo sapiens
ctcactgcaagctctgcctcca

SEQ ID NO: 9463368 - DNA, 22 bp, Homo sapiens
ctcacttagcaggttaatatca

SEQ ID NO: 9463369 - DNA, 20 bp, Homo sapiens
ctcacttacctttttctata

SEQ ID NO: 9463370 - DNA, 22 bp, Homo sapiens
ctcactggcaagactacaggtg

SEQ ID NO: 9463371 - DNA, 22 bp, Homo sapiens
ctcactggcaagactacaggtg

SEQ ID NO: 9463372 - DNA, 23 bp, Homo sapiens
ttcttcattttcagagttgagca

SEQ ID NO: 9463373 - DNA, 23 bp, Homo sapiens
ttcttcattttcagagttgagca

SEQ ID NO: 9463374 - DNA, 21 bp, Homo sapiens
ttcttcatgatgattaatggc

SEQ ID NO: 9463375 - DNA, 21 bp, Homo sapiens
ttcttcatgatgattaatggc

SEQ ID NO: 9463376 - DNA, 22 bp, Homo sapiens
ttcttcatgctgttgctgcttg

SEQ ID NO: 9463377 - DNA, 22 bp, Homo sapiens
ttcttcattcccttacttccga

SEQ ID NO: 9463378 - DNA, 22 bp, Homo sapiens
ttcttcagtgacaaaggcaaaa

SEQ ID NO: 9463379 - DNA, 22 bp, Homo sapiens
ttcttcagtttggtaaatgtaa

SEQ ID NO: 9463380 - DNA, 22 bp, Homo sapiens
ttcttcatctgtaagataagca

SEQ ID NO: 9463381 - DNA, 21 bp, Homo sapiens
ttcttcatgatgattaatggc

SEQ ID NO: 9463382 - DNA, 22 bp, Homo sapiens
ttgaagttctaagccccagtac

SEQ ID NO: 9463383 - DNA, 22 bp, Homo sapiens
ttgaagttctgcatttctaata

SEQ ID NO: 9463384 - DNA, 22 bp, Homo sapiens
ttgaagttgcacattataattt

SEQ ID NO: 9463385 - DNA, 22 bp, Homo sapiens
ttgaagttgcacattataattt

SEQ ID NO: 9463386 - DNA, 22 bp, Homo sapiens
ttgaaatatcaagttattagtg

SEQ ID NO: 9463387 - DNA, 22 bp, Homo sapiens
ttgaaatatcaagttattagtg

SEQ ID NO: 9463388 - DNA, 22 bp, Homo sapiens
ttgaaatatcaagttattagtg

SEQ ID NO: 9463389 - DNA, 22 bp, Homo sapiens
ttgaaggaggcgaaaattggtc

SEQ ID NO: 9463390 - DNA, 22 bp, Homo sapiens
ttgaaggtttaactgagaggca

SEQ ID NO: 9463391 - DNA, 22 bp, Homo sapiens
ttgaaggtgacatatctggagc

SEQ ID NO: 9463392 - DNA, 22 bp, Homo sapiens
ttgaaggtaaattatattgatc

SEQ ID NO: 9463393 - DNA, 22 bp, Homo sapiens
ttgaaggtcaccccgtagccat

SEQ ID NO: 9463394 - DNA, 22 bp, Homo sapiens
ttgaaggtcctgtttctatcca

SEQ ID NO: 9463395 - DNA, 19 bp, Homo sapiens
ttgaaggttcggagatagg

SEQ ID NO: 9463396 - DNA, 19 bp, Homo sapiens
ttgaaggttcggagatagg

SEQ ID NO: 9463397 - DNA, 20 bp, Homo sapiens
ttcttaaagacctcactttg

SEQ ID NO: 9463398 - DNA, 22 bp, Homo sapiens
ttcttaaaattcaagctaggtt

SEQ ID NO: 9463399 - DNA, 22 bp, Homo sapiens
ttctgaaattcgactatccaat

SEQ ID NO: 9463400 - DNA, 22 bp, Homo sapiens
ttctgaaagtctttttaagtta

SEQ ID NO: 9463401 - DNA, 22 bp, Homo sapiens
ctataaatctacccagcattgg

SEQ ID NO: 9463402 - DNA, 22 bp, Homo sapiens
ctataaatctacccagcattgg

SEQ ID NO: 9463403 - DNA, 22 bp, Homo sapiens
ttctcttttgtgatgtgagatg

SEQ ID NO: 9463404 - DNA, 22 bp, Homo sapiens
ttctctttttgcatctcaacct

SEQ ID NO: 9463405 - DNA, 22 bp, Homo sapiens
ttctgaaaattgggtcatactt

SEQ ID NO: 9463406 - DNA, 22 bp, Homo sapiens
ttctgaaaccttcagtatgaag

SEQ ID NO: 9463407 - DNA, 20 bp, Homo sapiens
ttctgaaagcagcagaggga

SEQ ID NO: 9463408 - DNA, 22 bp, Homo sapiens
ttctgaaagccaattcattgaa

SEQ ID NO: 9463409 - DNA, 21 bp, Homo sapiens
ttcttcaggccaatgctcatt

SEQ ID NO: 9463410 - DNA, 22 bp, Homo sapiens
ttcttcagggaagcttgttaat

SEQ ID NO: 9463411 - DNA, 22 bp, Homo sapiens
ttcttacaagtattccaggtcc

SEQ ID NO: 9463412 - DNA, 22 bp, Homo sapiens
ttcttacaaacaagatcattga

SEQ ID NO: 9463413 - DNA, 22 bp, Homo sapiens
ttcttacaaacaagatcattga

SEQ ID NO: 9463414 - DNA, 22 bp, Homo sapiens
ttcttacaagtatgacgtagca

SEQ ID NO: 9463415 - DNA, 23 bp, Homo sapiens
ttcttacaaggctggcccacttg

SEQ ID NO: 9463416 - DNA, 19 bp, Homo sapiens
ttcttacaacaccctggga

SEQ ID NO: 9463417 - DNA, 19 bp, Homo sapiens
ttcttacaacaccctggga

SEQ ID NO: 9463418 - DNA, 22 bp, Homo sapiens
ttcttaagtttagcaacttgtg

SEQ ID NO: 9463419 - DNA, 22 bp, Homo sapiens
ttcttaagtgagaaagcaggag

SEQ ID NO: 9463420 - DNA, 22 bp, Homo sapiens
ttcttaatcccacaaatcttca

SEQ ID NO: 9463421 - DNA, 22 bp, Homo sapiens
ttcttaatctgtgtgggttcga

SEQ ID NO: 9463422 - DNA, 22 bp, Homo sapiens
ttcttaatcccacaaatcttca

SEQ ID NO: 9463423 - DNA, 22 bp, Homo sapiens
ttcttaatacctattttctacc

SEQ ID NO: 9463424 - DNA, 22 bp, Homo sapiens
ttcttaaagaggcaaaacacag

SEQ ID NO: 9463425 - DNA, 22 bp, Homo sapiens
ttcttaaagaggcaaaacacag

SEQ ID NO: 9463426 - DNA, 22 bp, Homo sapiens
ttcttaactcaaatatatatcc

SEQ ID NO: 9463427 - DNA, 22 bp, Homo sapiens
ttcttaaagaggcaaaacacag

SEQ ID NO: 9463428 - DNA, 20 bp, Homo sapiens
ttcttaaagacctcactttg

SEQ ID NO: 9463429 - DNA, 22 bp, Homo sapiens
ttcttaaaattcaagctaggtt

SEQ ID NO: 9463430 - DNA, 20 bp, Homo sapiens
ttcttaaagacctcactttg

SEQ ID NO: 9463431 - DNA, 22 bp, Homo sapiens
ttcttaactggaaaatgtcaga

SEQ ID NO: 9463432 - DNA, 22 bp, Homo sapiens
ttcttaagaaaccatcacattc

SEQ ID NO: 9463433 - DNA, 22 bp, Homo sapiens
ttcttaagtatgatcttaacgg

SEQ ID NO: 9463434 - DNA, 22 bp, Homo sapiens
ctcagcccagcccaggaccagg

SEQ ID NO: 9463435 - DNA, 22 bp, Homo sapiens
ctcagccccaattctccccatt

SEQ ID NO: 9463436 - DNA, 22 bp, Homo sapiens
ctcagccaggagagtgttcaca

SEQ ID NO: 9463437 - DNA, 22 bp, Homo sapiens
ctcagccagacatgacccagtc

SEQ ID NO: 9463438 - DNA, 22 bp, Homo sapiens
ctcagcattcaatgtccagtcc

SEQ ID NO: 9463439 - DNA, 22 bp, Homo sapiens
ctcagcatcatggtatctgggg

SEQ ID NO: 9463440 - DNA, 22 bp, Homo sapiens
ctcagcatggagggagaacaag

SEQ ID NO: 9463441 - DNA, 22 bp, Homo sapiens
ctcagccagtgatctttccttt

SEQ ID NO: 9463442 - DNA, 22 bp, Homo sapiens
ctcagccagtgatctttccttt

SEQ ID NO: 9463443 - DNA, 22 bp, Homo sapiens
ctcagccatgcaacatgctggg

SEQ ID NO: 9463444 - DNA, 22 bp, Homo sapiens
ctcaggccattcttccagctgc

SEQ ID NO: 9463445 - DNA, 22 bp, Homo sapiens
ctcaggccattcttccagctgc

SEQ ID NO: 9463446 - DNA, 22 bp, Homo sapiens
ctcaggccattcttccagctgc

SEQ ID NO: 9463447 - DNA, 22 bp, Homo sapiens
ctcaggccattcttccagctgc

SEQ ID NO: 9463448 - DNA, 22 bp, Homo sapiens
ctcaggccattcttccagctgc

SEQ ID NO: 9463449 - DNA, 22 bp, Homo sapiens
ctcaggccattcttccagctgc

SEQ ID NO: 9463450 - DNA, 22 bp, Homo sapiens
ctcaggcctgagtggcagtccc

SEQ ID NO: 9463451 - DNA, 22 bp, Homo sapiens
ctcaggcctgagtggcagtccc

SEQ ID NO: 9463452 - DNA, 22 bp, Homo sapiens
ctcaggcccacagcagacccac

SEQ ID NO: 9463453 - DNA, 22 bp, Homo sapiens
ctcaggcccacagcagacccac

SEQ ID NO: 9463454 - DNA, 22 bp, Homo sapiens
ctcaggcccacagcagacccac

SEQ ID NO: 9463455 - DNA, 22 bp, Homo sapiens
ctcaggccattcctaccaaggg

SEQ ID NO: 9463456 - DNA, 22 bp, Homo sapiens
ctcaggccattcctaccaaggg

SEQ ID NO: 9463457 - DNA, 22 bp, Homo sapiens
ctcaggccaggtttctcccaca

SEQ ID NO: 9463458 - DNA, 22 bp, Homo sapiens
ctcaggccaggtttctcccaca

SEQ ID NO: 9463459 - DNA, 22 bp, Homo sapiens
ctcaggccaataagctccagcc

SEQ ID NO: 9463460 - DNA, 22 bp, Homo sapiens
ctcaggccaggtttctcccaca

SEQ ID NO: 9463461 - DNA, 22 bp, Homo sapiens
ctcaggccaataagctccagcc

SEQ ID NO: 9463462 - DNA, 22 bp, Homo sapiens
ttgcaaaaccatcctaagtaaa

SEQ ID NO: 9463463 - DNA, 22 bp, Homo sapiens
ttgcaaaaactgcaattacttt

SEQ ID NO: 9463464 - DNA, 22 bp, Homo sapiens
ttgcaaaaactgcaattacttt

SEQ ID NO: 9463465 - DNA, 22 bp, Homo sapiens
ttgcaaaaccatcctaagtaaa

SEQ ID NO: 9463466 - DNA, 22 bp, Homo sapiens
ttgcaaaaccatcctaagtaaa

SEQ ID NO: 9463467 - DNA, 22 bp, Homo sapiens
ttgcaaaagcaattgcagtttt

SEQ ID NO: 9463468 - DNA, 22 bp, Homo sapiens
ttgcaaaagccgaggcactcca

SEQ ID NO: 9463469 - DNA, 22 bp, Homo sapiens
ttgcaaaagccgaggcactcca

SEQ ID NO: 9463470 - DNA, 22 bp, Homo sapiens
ttgcaaaatcatttctcaggat

SEQ ID NO: 9463471 - DNA, 22 bp, Homo sapiens
ttgcaaaagccgaggcactcca

SEQ ID NO: 9463472 - DNA, 22 bp, Homo sapiens
ttgcaaaagcaattgcagtttt

SEQ ID NO: 9463473 - DNA, 22 bp, Homo sapiens
ttgcaaaagcaattgcagtttt

SEQ ID NO: 9463474 - DNA, 22 bp, Homo sapiens
ttgcaaaagcaattgcagtttt

SEQ ID NO: 9463475 - DNA, 23 bp, Homo sapiens
ttgcaaaatgagtcttgagtgaa

SEQ ID NO: 9463476 - DNA, 23 bp, Homo sapiens
ttgcaaaatgcaattgagttaga

SEQ ID NO: 9463477 - DNA, 23 bp, Homo sapiens
ttgcaaaatgcaattgagttaga

SEQ ID NO: 9463478 - DNA, 23 bp, Homo sapiens
ttgcaaaatgagtcttgagtgaa

SEQ ID NO: 9463479 - DNA, 22 bp, Homo sapiens
ttgcaaaatcatttctcaggat

SEQ ID NO: 9463480 - DNA, 23 bp, Homo sapiens
ttgcaaaatgagtcttgagtgaa

SEQ ID NO: 9463481 - DNA, 22 bp, Homo sapiens
ttgcaaaatcatttctcaggat

SEQ ID NO: 9463482 - DNA, 23 bp, Homo sapiens
ttgcaaaatgcaattgagttaga

SEQ ID NO: 9463483 - DNA, 23 bp, Homo sapiens
ttgcaaaatgagtcttgagtgaa

SEQ ID NO: 9463484 - DNA, 22 bp, Homo sapiens
ttgatcaaatcagctactgagg

SEQ ID NO: 9463485 - DNA, 22 bp, Homo sapiens
ctcagaaacggagctgccattt

SEQ ID NO: 9463486 - DNA, 22 bp, Homo sapiens
ttgatttttttctactatgcgc

SEQ ID NO: 9463487 - DNA, 22 bp, Homo sapiens
ttgcaaaaaccacaattacttt

SEQ ID NO: 9463488 - DNA, 22 bp, Homo sapiens
ttgcaaaaaccacaattacttt

SEQ ID NO: 9463489 - DNA, 22 bp, Homo sapiens
ttgcaaaaaccacaattacttt

SEQ ID NO: 9463490 - DNA, 22 bp, Homo sapiens
ttgcaaaaaccacaattacttt

SEQ ID NO: 9463491 - DNA, 22 bp, Homo sapiens
ttgcaaaaactgcaattacttt

SEQ ID NO: 9463492 - DNA, 22 bp, Homo sapiens
ttgcaaaaactgcaattacttt

SEQ ID NO: 9463493 - DNA, 22 bp, Homo sapiens
ttgccctgtggggcctccagcc

SEQ ID NO: 9463494 - DNA, 23 bp, Homo sapiens
ttgctgagataaagaatgcaggg

SEQ ID NO: 9463495 - DNA, 18 bp, Homo sapiens
ctcaggcctttccctgtg

SEQ ID NO: 9463496 - DNA, 18 bp, Homo sapiens
ctcaggcctttccctgtg

SEQ ID NO: 9463497 - DNA, 22 bp, Homo sapiens
ctcaggccttgaagtcttttct

SEQ ID NO: 9463498 - DNA, 22 bp, Homo sapiens
ctcaggccttgaagtcttttct

SEQ ID NO: 9463499 - DNA, 22 bp, Homo sapiens
ctcaggccttgaagtcttttct

SEQ ID NO: 9463500 - DNA, 20 bp, Homo sapiens
ttgcacagaggtttcaagtg

SEQ ID NO: 9463501 - DNA, 20 bp, Homo sapiens
ttgcacagaggtttcaagtg

SEQ ID NO: 9463502 - DNA, 20 bp, Homo sapiens
ttgcacagaggtttcaagtg

SEQ ID NO: 9463503 - DNA, 22 bp, Homo sapiens
ttgcacagagtggatattcagt

SEQ ID NO: 9463504 - DNA, 22 bp, Homo sapiens
ttgcacagagtggatattcagt

SEQ ID NO: 9463505 - DNA, 18 bp, Homo sapiens
ctcaggcctttccctgtg

SEQ ID NO: 9463506 - DNA, 23 bp, Homo sapiens
ttgcacagtttcggaaactgagg

SEQ ID NO: 9463507 - DNA, 22 bp, Homo sapiens
ttgcacagatgagggtgatgct

SEQ ID NO: 9463508 - DNA, 22 bp, Homo sapiens
ttgcacagcaacgtgaatgtac

SEQ ID NO: 9463509 - DNA, 22 bp, Homo sapiens
ttgcacagtggtttagagcctg

SEQ ID NO: 9463510 - DNA, 22 bp, Homo sapiens
ctcaggctaagaaggccaagtg

SEQ ID NO: 9463511 - DNA, 22 bp, Homo sapiens
ttgctgtaagtatctttctacc

SEQ ID NO: 9463512 - DNA, 22 bp, Homo sapiens
ttgctgtagtgttctgatgtca

SEQ ID NO: 9463513 - DNA, 22 bp, Homo sapiens
ttgctgtaggctgattgctgaa

SEQ ID NO: 9463514 - DNA, 22 bp, Homo sapiens
ttgctgtagctcatttcactct

SEQ ID NO: 9463515 - DNA, 22 bp, Homo sapiens
ttgctgtagctcatttcactct

SEQ ID NO: 9463516 - DNA, 22 bp, Homo sapiens
ttgctggaggtgttccagatct

SEQ ID NO: 9463517 - DNA, 22 bp, Homo sapiens
ttgctggagcacaggactaagg

SEQ ID NO: 9463518 - DNA, 19 bp, Homo sapiens
ttgctggagaaaaaggaga

SEQ ID NO: 9463519 - DNA, 22 bp, Homo sapiens
ttgctggacatgaatcagatat

SEQ ID NO: 9463520 - DNA, 22 bp, Homo sapiens
ttgctggacagcttcacggaga

SEQ ID NO: 9463521 - DNA, 22 bp, Homo sapiens
ttgctggcaatttagagatttc

SEQ ID NO: 9463522 - DNA, 19 bp, Homo sapiens
ttgctggcatttgatctct

SEQ ID NO: 9463523 - DNA, 22 bp, Homo sapiens
ttgctggcttgaagatagagga

SEQ ID NO: 9463524 - DNA, 22 bp, Homo sapiens
ttgctgggtcagaagccaggag

SEQ ID NO: 9463525 - DNA, 22 bp, Homo sapiens
ttgctggggtgtgaaatctgat

SEQ ID NO: 9463526 - DNA, 22 bp, Homo sapiens
ttgctgcctttgtactctgatg

SEQ ID NO: 9463527 - DNA, 22 bp, Homo sapiens
ttgctgctcccaagaggcagct

SEQ ID NO: 9463528 - DNA, 22 bp, Homo sapiens
ttgctgatttgtttctattcca

SEQ ID NO: 9463529 - DNA, 22 bp, Homo sapiens
ttgctgattctgtatttaaggt

SEQ ID NO: 9463530 - DNA, 22 bp, Homo sapiens
ttgctgatttccccttgagtgt

SEQ ID NO: 9463531 - DNA, 22 bp, Homo sapiens
ttgctgataccatgaatgttaa

SEQ ID NO: 9463532 - DNA, 22 bp, Homo sapiens
ttgctgatggtattatgctagt

SEQ ID NO: 9463533 - DNA, 22 bp, Homo sapiens
ttgctgattcatgatttgagaa

SEQ ID NO: 9463534 - DNA, 22 bp, Homo sapiens
ttgctgatctgaaacgttactg

SEQ ID NO: 9463535 - DNA, 22 bp, Homo sapiens
ttgctgatctgtgaatcagcca

SEQ ID NO: 9463536 - DNA, 22 bp, Homo sapiens
ctagttgtttaatattgattga

SEQ ID NO: 9463537 - DNA, 22 bp, Homo sapiens
ctagttctcctgaaatgtttgg

SEQ ID NO: 9463538 - DNA, 22 bp, Homo sapiens
ctagttgtttaatattgattga

SEQ ID NO: 9463539 - DNA, 22 bp, Homo sapiens
ctagttcttaactgttatgatt

SEQ ID NO: 9463540 - DNA, 22 bp, Homo sapiens
ctagttctgccattcagtgtca

SEQ ID NO: 9463541 - DNA, 22 bp, Homo sapiens
ctagtgtttattaatcatgagg

SEQ ID NO: 9463542 - DNA, 22 bp, Homo sapiens
ctagttctagatccctgaggaa

SEQ ID NO: 9463543 - DNA, 22 bp, Homo sapiens
ctagttctaaatctgttgtcca

SEQ ID NO: 9463544 - DNA, 22 bp, Homo sapiens
ctagtggaaactaactggaatt

SEQ ID NO: 9463545 - DNA, 22 bp, Homo sapiens
ctagtgcctgtccctacccaaa

SEQ ID NO: 9463546 - DNA, 22 bp, Homo sapiens
ctagtgtacaagtggtggagat

SEQ ID NO: 9463547 - DNA, 22 bp, Homo sapiens
ctagtgaacgtggtactatgga

SEQ ID NO: 9463548 - DNA, 22 bp, Homo sapiens
ctagtgctctaggggctgaagg

SEQ ID NO: 9463549 - DNA, 21 bp, Homo sapiens
ttctcctgttttgcaccacag

SEQ ID NO: 9463550 - DNA, 22 bp, Homo sapiens
ttctccttattcatagttgtct

SEQ ID NO: 9463551 - DNA, 22 bp, Homo sapiens
ttctccttggtttatgggacat

SEQ ID NO: 9463552 - DNA, 18 bp, Homo sapiens
ctagggctgtggctctca

SEQ ID NO: 9463553 - DNA, 22 bp, Homo sapiens
ttctcctttgtaattctcatcc

SEQ ID NO: 9463554 - DNA, 22 bp, Homo sapiens
ctagggctcgcaagggctggag

SEQ ID NO: 9463555 - DNA, 22 bp, Homo sapiens
ttctcaggtgaggctgaggctg

SEQ ID NO: 9463556 - DNA, 22 bp, Homo sapiens
ttctcaaaactcagggtatctg

SEQ ID NO: 9463557 - DNA, 22 bp, Homo sapiens
ttctcaggtgaggctgaggctg

SEQ ID NO: 9463558 - DNA, 22 bp, Homo sapiens
ttctcaggtcaccagggtgcca

SEQ ID NO: 9463559 - DNA, 22 bp, Homo sapiens
ctacatttacacagttaggctt

SEQ ID NO: 9463560 - DNA, 22 bp, Homo sapiens
ctacattctgggaaatcagatg

SEQ ID NO: 9463561 - DNA, 18 bp, Homo sapiens
ctacattcataggaaagg

SEQ ID NO: 9463562 - DNA, 22 bp, Homo sapiens
ttctatttttgtggaactgtag

SEQ ID NO: 9463563 - DNA, 22 bp, Homo sapiens
ctacatttacacagttaggctt

SEQ ID NO: 9463564 - DNA, 22 bp, Homo sapiens
ttctcaggtgaggctgaggctg

SEQ ID NO: 9463565 - DNA, 22 bp, Homo sapiens
ttctcatagagacatgattata

SEQ ID NO: 9463566 - DNA, 22 bp, Homo sapiens
ttctcatgaaactcgcttcctc

SEQ ID NO: 9463567 - DNA, 22 bp, Homo sapiens
ttctcatgaaactcgcttcctc

SEQ ID NO: 9463568 - DNA, 22 bp, Homo sapiens
ttctcatgaaactcgcttcctc

SEQ ID NO: 9463569 - DNA, 22 bp, Homo sapiens
ttctcatgatgcaattcatccc

SEQ ID NO: 9463570 - DNA, 19 bp, Homo sapiens
ttctcattcctttccactt

SEQ ID NO: 9463571 - DNA, 22 bp, Homo sapiens
ttctcatgtaaatgccatcatc

SEQ ID NO: 9463572 - DNA, 22 bp, Homo sapiens
ttctcatgtaaatgccatcatc

SEQ ID NO: 9463573 - DNA, 22 bp, Homo sapiens
ttctcctgcccttggacttcca

SEQ ID NO: 9463574 - DNA, 22 bp, Homo sapiens
ttctcctgcgcaggcccaggga

SEQ ID NO: 9463575 - DNA, 22 bp, Homo sapiens
ttctcctgcgcaggcccaggga

SEQ ID NO: 9463576 - DNA, 22 bp, Homo sapiens
ttctcctggagtgcttgttggg

SEQ ID NO: 9463577 - DNA, 22 bp, Homo sapiens
ttctacatggttgctcagaggg

SEQ ID NO: 9463578 - DNA, 22 bp, Homo sapiens
ttctacattgtgaagttcttta

SEQ ID NO: 9463579 - DNA, 22 bp, Homo sapiens
ttctacatcacttaacatgcta

SEQ ID NO: 9463580 - DNA, 22 bp, Homo sapiens
ttctacatgagaaaatgtattt

SEQ ID NO: 9463581 - DNA, 22 bp, Homo sapiens
ttctacatttaaaaggaaaatc

SEQ ID NO: 9463582 - DNA, 22 bp, Homo sapiens
ttctacatttaaaaggaaaatc

SEQ ID NO: 9463583 - DNA, 22 bp, Homo sapiens
ttctacatttgaggagagtcag

SEQ ID NO: 9463584 - DNA, 22 bp, Homo sapiens
ctacagtgaagactagctatag

SEQ ID NO: 9463585 - DNA, 22 bp, Homo sapiens
ctacataaatttatcacagact

SEQ ID NO: 9463586 - DNA, 22 bp, Homo sapiens
ctacataaatatttatgtgtct

SEQ ID NO: 9463587 - DNA, 22 bp, Homo sapiens
ctacataatctggatttgtctg

SEQ ID NO: 9463588 - DNA, 22 bp, Homo sapiens
ctacatcacttaattcttagaa

SEQ ID NO: 9463589 - DNA, 22 bp, Homo sapiens
ctacatcagaacatttacccta

SEQ ID NO: 9463590 - DNA, 22 bp, Homo sapiens
ctacattaaattggcttactta

SEQ ID NO: 9463591 - DNA, 22 bp, Homo sapiens
ctacattcaacagcagagtttt

SEQ ID NO: 9463592 - DNA, 22 bp, Homo sapiens
ctacattcaacagcagagtttt

SEQ ID NO: 9463593 - DNA, 22 bp, Homo sapiens
ctacatgtaggtttccttaatt

SEQ ID NO: 9463594 - DNA, 22 bp, Homo sapiens
ctacatctcaccttccaggaca

SEQ ID NO: 9463595 - DNA, 22 bp, Homo sapiens
ctaactttagcttagattatca

SEQ ID NO: 9463596 - DNA, 22 bp, Homo sapiens
ctaactttgtcatcttcccttt

SEQ ID NO: 9463597 - DNA, 22 bp, Homo sapiens
ctaactttatttgctaagtaga

SEQ ID NO: 9463598 - DNA, 22 bp, Homo sapiens
ttcctttttacataatcacatt

SEQ ID NO: 9463599 - DNA, 22 bp, Homo sapiens
ttcctttttacataatcacatt

SEQ ID NO: 9463600 - DNA, 22 bp, Homo sapiens
ttcctttttacataatcacatt

SEQ ID NO: 9463601 - DNA, 22 bp, Homo sapiens
ttctacactgagttttttccct

SEQ ID NO: 9463602 - DNA, 22 bp, Homo sapiens
ttctacacttttcattagctag

SEQ ID NO: 9463603 - DNA, 22 bp, Homo sapiens
ttctacactcacccagctgtaa

SEQ ID NO: 9463604 - DNA, 22 bp, Homo sapiens
ttcctttttacataatcacatt

SEQ ID NO: 9463605 - DNA, 22 bp, Homo sapiens
ttctacacttttcattagctag

SEQ ID NO: 9463606 - DNA, 22 bp, Homo sapiens
ttctacaggtactgaagtacat

SEQ ID NO: 9463607 - DNA, 22 bp, Homo sapiens
ttctacagtgactgcagccata

SEQ ID NO: 9463608 - DNA, 22 bp, Homo sapiens
ctaaattatttgcacattagag

SEQ ID NO: 9463609 - DNA, 18 bp, Homo sapiens
ctaacagggaaaatagaa

SEQ ID NO: 9463610 - DNA, 22 bp, Homo sapiens
ctaaattatcatgagaattatg

SEQ ID NO: 9463611 - DNA, 22 bp, Homo sapiens
ctaacgaatatgtatgcatgtt

SEQ ID NO: 9463612 - DNA, 22 bp, Homo sapiens
ctaacgaaatacctcagacttt

SEQ ID NO: 9463613 - DNA, 22 bp, Homo sapiens
ctaacatttggaaggcttatga

SEQ ID NO: 9463614 - DNA, 22 bp, Homo sapiens
ctaacatttattgagcacttag

SEQ ID NO: 9463615 - DNA, 22 bp, Homo sapiens
ctaaatgtgctaatagcatgaa

SEQ ID NO: 9463616 - DNA, 22 bp, Homo sapiens
ctaaatgttcacatgcaatttt

SEQ ID NO: 9463617 - DNA, 22 bp, Homo sapiens
ctaaatgttttatcttcctggc

SEQ ID NO: 9463618 - DNA, 22 bp, Homo sapiens
ctaaatgttcacatgcaatttt

SEQ ID NO: 9463619 - DNA, 22 bp, Homo sapiens
ctaaattatcatgagaattatg

SEQ ID NO: 9463620 - DNA, 22 bp, Homo sapiens
ctaaatgtcagagtagcttgca

SEQ ID NO: 9463621 - DNA, 22 bp, Homo sapiens
ctaaatgtcagagtagcttgca

SEQ ID NO: 9463622 - DNA, 22 bp, Homo sapiens
ctaaatgcctttcctacctaac

SEQ ID NO: 9463623 - DNA, 22 bp, Homo sapiens
ctaaatgtgactcaccatctca

SEQ ID NO: 9463624 - DNA, 22 bp, Homo sapiens
ctaaatgtctcagagggagaca

SEQ ID NO: 9463625 - DNA, 22 bp, Homo sapiens
cgcagctgaccttttacaaaac

SEQ ID NO: 9463626 - DNA, 21 bp, Homo sapiens
cgcagctgagaaatatacaga

SEQ ID NO: 9463627 - DNA, 22 bp, Homo sapiens
cgcagctgcaaaggaaacattt

SEQ ID NO: 9463628 - DNA, 22 bp, Homo sapiens
ttcagtttcaaatcctgtgaag

SEQ ID NO: 9463629 - DNA, 22 bp, Homo sapiens
ttcagtttcagtcttgcaaaaa

SEQ ID NO: 9463630 - DNA, 22 bp, Homo sapiens
ttcagtttcaagtccctctggg

SEQ ID NO: 9463631 - DNA, 22 bp, Homo sapiens
ttcagtttccacttacatttaa

SEQ ID NO: 9463632 - DNA, 22 bp, Homo sapiens
ttcagtttccacttacatttaa

SEQ ID NO: 9463633 - DNA, 22 bp, Homo sapiens
ttcagtttcgttatctatgaga

SEQ ID NO: 9463634 - DNA, 19 bp, Homo sapiens
ttcagtttcctcatctgga

SEQ ID NO: 9463635 - DNA, 19 bp, Homo sapiens
ttcagtttcctcatctgga

SEQ ID NO: 9463636 - DNA, 19 bp, Homo sapiens
ttcagtttcctcatctgga

SEQ ID NO: 9463637 - DNA, 22 bp, Homo sapiens
ttcagtttccctaaagccaatt

SEQ ID NO: 9463638 - DNA, 22 bp, Homo sapiens
ttcagtttcgttatctatgaga

SEQ ID NO: 9463639 - DNA, 22 bp, Homo sapiens
ttcagtttctaaagatgttcct

SEQ ID NO: 9463640 - DNA, 22 bp, Homo sapiens
ttcagtttctaaatgctcctct

SEQ ID NO: 9463641 - DNA, 18 bp, Homo sapiens
ttcagtttctagttcctt

SEQ ID NO: 9463642 - DNA, 22 bp, Homo sapiens
ttcagtttctaaatgctcctct

SEQ ID NO: 9463643 - DNA, 18 bp, Homo sapiens
ttcagtttctagttcctt

SEQ ID NO: 9463644 - DNA, 18 bp, Homo sapiens
ttcagtttctagttcctt

SEQ ID NO: 9463645 - DNA, 22 bp, Homo sapiens
ttcagtttcttccctgtgaaat

SEQ ID NO: 9463646 - DNA, 22 bp, Homo sapiens
ttcagtttgaattctgtagaac

SEQ ID NO: 9463647 - DNA, 22 bp, Homo sapiens
ttcagtttgaattctgtagaac

SEQ ID NO: 9463648 - DNA, 21 bp, Homo sapiens
ttcagtttcttcctcatctat

SEQ ID NO: 9463649 - DNA, 21 bp, Homo sapiens
ttcagtttcttcctcatctat

SEQ ID NO: 9463650 - DNA, 21 bp, Homo sapiens
ttcagtttcttcctcatctat

SEQ ID NO: 9463651 - DNA, 22 bp, Homo sapiens
ttccaccattcatgctaatatt

SEQ ID NO: 9463652 - DNA, 22 bp, Homo sapiens
ttccaccattcatgctaatatt

SEQ ID NO: 9463653 - DNA, 22 bp, Homo sapiens
ttccactctactctggccagtc

SEQ ID NO: 9463654 - DNA, 22 bp, Homo sapiens
ttccactctactctggccagtc

SEQ ID NO: 9463655 - DNA, 22 bp, Homo sapiens
ttccaaattaaaatgtacaatg

SEQ ID NO: 9463656 - DNA, 22 bp, Homo sapiens
ttccaaattaaaatgtacaatg

SEQ ID NO: 9463657 - DNA, 22 bp, Homo sapiens
ttccaaattaaaatgtacaatg

SEQ ID NO: 9463658 - DNA, 22 bp, Homo sapiens
ttccaccaattctcctccaagg

SEQ ID NO: 9463659 - DNA, 22 bp, Homo sapiens
ttccaccaggagatatttcaaa

SEQ ID NO: 9463660 - DNA, 22 bp, Homo sapiens
ttccaccaggagatatttcaaa

SEQ ID NO: 9463661 - DNA, 19 bp, Homo sapiens
ttccaccatcactctgttt

SEQ ID NO: 9463662 - DNA, 22 bp, Homo sapiens
cgggagcctctgggtcacactg

SEQ ID NO: 9463663 - DNA, 22 bp, Homo sapiens
cgggaaggtggaggttgcagtg

SEQ ID NO: 9463664 - DNA, 21 bp, Homo sapiens
cgggaaggaggttctgaccct

SEQ ID NO: 9463665 - DNA, 21 bp, Homo sapiens
cgggaaggaggttctgaccct

SEQ ID NO: 9463666 - DNA, 22 bp, Homo sapiens
cgggaaagttccacagatggat

SEQ ID NO: 9463667 - DNA, 22 bp, Homo sapiens
cgggaaagttccacagatggat

SEQ ID NO: 9463668 - DNA, 22 bp, Homo sapiens
cggcttcttcatcaggtcagca

SEQ ID NO: 9463669 - DNA, 22 bp, Homo sapiens
cggctggtgtcgggcacagcaa

SEQ ID NO: 9463670 - DNA, 22 bp, Homo sapiens
cggctggtgtcgggcacagcaa

SEQ ID NO: 9463671 - DNA, 22 bp, Homo sapiens
cggctggtgtcgggcacagcaa

SEQ ID NO: 9463672 - DNA, 22 bp, Homo sapiens
cggctggtgtcgggcacagcaa

SEQ ID NO: 9463673 - DNA, 22 bp, Homo sapiens
cggcttccaacaagctttgctg

SEQ ID NO: 9463674 - DNA, 22 bp, Homo sapiens
cggcttctcgggtcggattccg

SEQ ID NO: 9463675 - DNA, 21 bp, Homo sapiens
cggcttctgcattccagagct

SEQ ID NO: 9463676 - DNA, 22 bp, Homo sapiens
cggctggtgtcgggcacagcaa

SEQ ID NO: 9463677 - DNA, 22 bp, Homo sapiens
cggctgggttcggctgcaggcc

SEQ ID NO: 9463678 - DNA, 22 bp, Homo sapiens
cggctgggttcggctgcaggcc

SEQ ID NO: 9463679 - DNA, 22 bp, Homo sapiens
cggctgggttcggctgcaggcc

SEQ ID NO: 9463680 - DNA, 22 bp, Homo sapiens
cggctgggtagaggtgccgggt

SEQ ID NO: 9463681 - DNA, 22 bp, Homo sapiens
cggctgggtagaggtgccgggt

SEQ ID NO: 9463682 - DNA, 22 bp, Homo sapiens
cggctgggtagaggtgccgggt

SEQ ID NO: 9463683 - DNA, 22 bp, Homo sapiens
cggctgggttcggctgcaggcc

SEQ ID NO: 9463684 - DNA, 22 bp, Homo sapiens
ttcctccttgtcctagttactg

SEQ ID NO: 9463685 - DNA, 22 bp, Homo sapiens
ttcctctcaacatgcctgccgg

SEQ ID NO: 9463686 - DNA, 22 bp, Homo sapiens
ttcctctcctcacatgagtcac

SEQ ID NO: 9463687 - DNA, 22 bp, Homo sapiens
ttcctctcctcccaccaggtga

SEQ ID NO: 9463688 - DNA, 22 bp, Homo sapiens
ctaaatgatggatttaaacttt

SEQ ID NO: 9463689 - DNA, 21 bp, Homo sapiens
ttcctctgcaactgatgctca

SEQ ID NO: 9463690 - DNA, 21 bp, Homo sapiens
ttcctctgcaactgatgctca

SEQ ID NO: 9463691 - DNA, 22 bp, Homo sapiens
ttcctctgaaatggcttggaaa

SEQ ID NO: 9463692 - DNA, 22 bp, Homo sapiens
ttcctctcctcccaccaggtga

SEQ ID NO: 9463693 - DNA, 22 bp, Homo sapiens
ttcctctcgctctccggggccc

SEQ ID NO: 9463694 - DNA, 17 bp, Homo sapiens
ttcctcctcaccatgtt

SEQ ID NO: 9463695 - DNA, 22 bp, Homo sapiens
cgtctggcttctccacggtaaa

SEQ ID NO: 9463696 - DNA, 22 bp, Homo sapiens
cgtcttggagatattctgggct

SEQ ID NO: 9463697 - DNA, 22 bp, Homo sapiens
ttcctccagcctggagcacttc

SEQ ID NO: 9463698 - DNA, 22 bp, Homo sapiens
cgtctctggcccggcccctggg

SEQ ID NO: 9463699 - DNA, 19 bp, Homo sapiens
cgtctgagtcacgggggtg

SEQ ID NO: 9463700 - DNA, 22 bp, Homo sapiens
cgtcctttgaattgaggtcttt

SEQ ID NO: 9463701 - DNA, 22 bp, Homo sapiens
cgtccttgcaagatctgtacaa

SEQ ID NO: 9463702 - DNA, 22 bp, Homo sapiens
cgtctcctgtgttcgagccatt

SEQ ID NO: 9463703 - DNA, 22 bp, Homo sapiens
cgtcctgggtctgggaaggcat

SEQ ID NO: 9463704 - DNA, 22 bp, Homo sapiens
cgtcctgggtctgggaaggcat

SEQ ID NO: 9463705 - DNA, 22 bp, Homo sapiens
cgtcccgggttcacgccattct

SEQ ID NO: 9463706 - DNA, 22 bp, Homo sapiens
cgtcccgggttcacgccattct

SEQ ID NO: 9463707 - DNA, 22 bp, Homo sapiens
cgtcccagcagataaatgagga

SEQ ID NO: 9463708 - DNA, 22 bp, Homo sapiens
cgtccagggcgggctcccctca

SEQ ID NO: 9463709 - DNA, 22 bp, Homo sapiens
cgtcatcacggcaagcatctcc

SEQ ID NO: 9463710 - DNA, 19 bp, Homo sapiens
ttccacttgggttagaatt

SEQ ID NO: 9463711 - DNA, 22 bp, Homo sapiens
ttccactctgtcccctgtggga

SEQ ID NO: 9463712 - DNA, 22 bp, Homo sapiens
ttccactctatgatagaagggt

SEQ ID NO: 9463713 - DNA, 22 bp, Homo sapiens
ttccactctccagtcaatttca

SEQ ID NO: 9463714 - DNA, 22 bp, Homo sapiens
ttccactgattttggttgacct

SEQ ID NO: 9463715 - DNA, 22 bp, Homo sapiens
ttccacttttctctctcatgcc

SEQ ID NO: 9463716 - DNA, 22 bp, Homo sapiens
ttccagaaaaaaatgtatatct

SEQ ID NO: 9463717 - DNA, 22 bp, Homo sapiens
ttccagaaaacgctttatttag

SEQ ID NO: 9463718 - DNA, 22 bp, Homo sapiens
ttaatagatttgattttaaagg

SEQ ID NO: 9463719 - DNA, 22 bp, Homo sapiens
ttaatagatttgattttaaagg

SEQ ID NO: 9463720 - DNA, 22 bp, Homo sapiens
ttaatagatatgcctctagagt

SEQ ID NO: 9463721 - DNA, 22 bp, Homo sapiens
ttaatactataatttgaagtac

SEQ ID NO: 9463722 - DNA, 22 bp, Homo sapiens
ttaatatgctgcttcttgaaaa

SEQ ID NO: 9463723 - DNA, 22 bp, Homo sapiens
cctgtcacatatttgctgttca

SEQ ID NO: 9463724 - DNA, 23 bp, Homo sapiens
cctgtcaacaaggccccactgta

SEQ ID NO: 9463725 - DNA, 22 bp, Homo sapiens
cctgtatttgcttccttctgca

SEQ ID NO: 9463726 - DNA, 22 bp, Homo sapiens
cctgtcacctaggtactgagca

SEQ ID NO: 9463727 - DNA, 22 bp, Homo sapiens
cctgtcacgatgactgcactct

SEQ ID NO: 9463728 - DNA, 18 bp, Homo sapiens
cctgtcacgtccaggcct

SEQ ID NO: 9463729 - DNA, 18 bp, Homo sapiens
cctgtcacgtccaggcct

SEQ ID NO: 9463730 - DNA, 17 bp, Homo sapiens
ttaagcatgtaatctgc

SEQ ID NO: 9463731 - DNA, 22 bp, Homo sapiens
cctgtcacgatgactgcactct

SEQ ID NO: 9463732 - DNA, 22 bp, Homo sapiens
ttaagctatacattgttagagt

SEQ ID NO: 9463733 - DNA, 22 bp, Homo sapiens
cctgtattgtgcccagaatctc

SEQ ID NO: 9463734 - DNA, 22 bp, Homo sapiens
cctgtaccgcgatctgctgcgc

SEQ ID NO: 9463735 - DNA, 22 bp, Homo sapiens
cctgtagaatctgtagacccat

SEQ ID NO: 9463736 - DNA, 22 bp, Homo sapiens
tgttttctagaaacaatgccta

SEQ ID NO: 9463737 - DNA, 22 bp, Homo sapiens
tgttttctattacctgagattg

SEQ ID NO: 9463738 - DNA, 22 bp, Homo sapiens
ttaaaagagcagcccagcatat

SEQ ID NO: 9463739 - DNA, 22 bp, Homo sapiens
ttaaaagagcagcccagcatat

SEQ ID NO: 9463740 - DNA, 22 bp, Homo sapiens
ttaaaagagcagcccagcatat

SEQ ID NO: 9463741 - DNA, 22 bp, Homo sapiens
ttaaaagagcagcccagcatat

SEQ ID NO: 9463742 - DNA, 22 bp, Homo sapiens
ttaaaatagccagtgcccctct

SEQ ID NO: 9463743 - DNA, 23 bp, Homo sapiens
ttaaaagtggagagagaagctgg

SEQ ID NO: 9463744 - DNA, 22 bp, Homo sapiens
ttaaaagtctgatgatttacat

SEQ ID NO: 9463745 - DNA, 22 bp, Homo sapiens
ttaaaagggatgttatctgtaa

SEQ ID NO: 9463746 - DNA, 22 bp, Homo sapiens
ttaaaagggtaagcagcaactt

SEQ ID NO: 9463747 - DNA, 22 bp, Homo sapiens
ttaaaagggatgttatctgtaa

SEQ ID NO: 9463748 - DNA, 22 bp, Homo sapiens
ttaaaatgaatattgattagca

SEQ ID NO: 9463749 - DNA, 22 bp, Homo sapiens
ttaaaatgcagattatgactca

SEQ ID NO: 9463750 - DNA, 22 bp, Homo sapiens
ttaaaatagccagtgcccctct

SEQ ID NO: 9463751 - DNA, 22 bp, Homo sapiens
ttaaaatagccagtgcccctct

SEQ ID NO: 9463752 - DNA, 22 bp, Homo sapiens
ttaaaatagccagtgcccctct

SEQ ID NO: 9463753 - DNA, 22 bp, Homo sapiens
ttaaaatagccagtgcccctct

SEQ ID NO: 9463754 - DNA, 22 bp, Homo sapiens
ttaaaatcacagtcacccagta

SEQ ID NO: 9463755 - DNA, 22 bp, Homo sapiens
ttaaaatcgctgttgcttctgt

SEQ ID NO: 9463756 - DNA, 22 bp, Homo sapiens
ttaaaatgaatattgattagca

SEQ ID NO: 9463757 - DNA, 22 bp, Homo sapiens
ttaaaatctaaagcagttgtct

SEQ ID NO: 9463758 - DNA, 22 bp, Homo sapiens
ttaaaatcgctgttgcttctgt

SEQ ID NO: 9463759 - DNA, 22 bp, Homo sapiens
cctgtggctgccccgctgttgg

SEQ ID NO: 9463760 - DNA, 22 bp, Homo sapiens
cctgtggctgccacttgggtga

SEQ ID NO: 9463761 - DNA, 22 bp, Homo sapiens
ttacaaagcgttgagacaagta

SEQ ID NO: 9463762 - DNA, 22 bp, Homo sapiens
ttacaaagcgttgagacaagta

SEQ ID NO: 9463763 - DNA, 22 bp, Homo sapiens
cctgtggctggtcaggccagca

SEQ ID NO: 9463764 - DNA, 22 bp, Homo sapiens
ttacaagtatttaagatgctgt

SEQ ID NO: 9463765 - DNA, 18 bp, Homo sapiens
cctgtggctcagcccaca

SEQ ID NO: 9463766 - DNA, 22 bp, Homo sapiens
cctgtggcgggggccagtgcct

SEQ ID NO: 9463767 - DNA, 22 bp, Homo sapiens
cctgtggcgggggccagtgcct

SEQ ID NO: 9463768 - DNA, 22 bp, Homo sapiens
cctgtggcgggggccagtgcct

SEQ ID NO: 9463769 - DNA, 22 bp, Homo sapiens
ttacaatagttccttcttttgt

SEQ ID NO: 9463770 - DNA, 22 bp, Homo sapiens
ttacaatagttccttcttttgt

SEQ ID NO: 9463771 - DNA, 22 bp, Homo sapiens
ttacaatagttccttcttttgt

SEQ ID NO: 9463772 - DNA, 22 bp, Homo sapiens
ttacaatagttccttcttttgt

SEQ ID NO: 9463773 - DNA, 22 bp, Homo sapiens
ttacaatcatctaggataaaga

SEQ ID NO: 9463774 - DNA, 22 bp, Homo sapiens
ttacaatcatctaggataaaga

SEQ ID NO: 9463775 - DNA, 22 bp, Homo sapiens
ttacaatagttccttcttttgt

SEQ ID NO: 9463776 - DNA, 23 bp, Homo sapiens
ttacaagttctgaaatttccttc

SEQ ID NO: 9463777 - DNA, 20 bp, Homo sapiens
ttacaagtttctaataacca

SEQ ID NO: 9463778 - DNA, 22 bp, Homo sapiens
ttaatccaataacaaggttcaa

SEQ ID NO: 9463779 - DNA, 22 bp, Homo sapiens
ttaatccaatatcctggctatt

SEQ ID NO: 9463780 - DNA, 22 bp, Homo sapiens
ttaatccatggcagttattaaa

SEQ ID NO: 9463781 - DNA, 22 bp, Homo sapiens
ttaatctcttagcaaattaatg

SEQ ID NO: 9463782 - DNA, 22 bp, Homo sapiens
ttaatcttcagggactcttgct

SEQ ID NO: 9463783 - DNA, 22 bp, Homo sapiens
cctgtggaccaggaggcagccc

SEQ ID NO: 9463784 - DNA, 22 bp, Homo sapiens
cctgtggacattctgtgtggaa

SEQ ID NO: 9463785 - DNA, 22 bp, Homo sapiens
cctgtggaatagaatcttccct

SEQ ID NO: 9463786 - DNA, 22 bp, Homo sapiens
cctgtggaatagaatcttccct

SEQ ID NO: 9463787 - DNA, 22 bp, Homo sapiens
cctgtgcttcagctggaggagg

SEQ ID NO: 9463788 - DNA, 22 bp, Homo sapiens
cctgtgcttcagctggaggagg

SEQ ID NO: 9463789 - DNA, 22 bp, Homo sapiens
cctgtgcttggccagagaggtt

SEQ ID NO: 9463790 - DNA, 22 bp, Homo sapiens
cctgtgcttggccagagaggtt

SEQ ID NO: 9463791 - DNA, 22 bp, Homo sapiens
cctgtgcttcagctggaggagg

SEQ ID NO: 9463792 - DNA, 22 bp, Homo sapiens
ttaatgccaacaaagtgatttt

SEQ ID NO: 9463793 - DNA, 22 bp, Homo sapiens
ttaatgcagctctaccacacag

SEQ ID NO: 9463794 - DNA, 22 bp, Homo sapiens
cctgtggaggctgctcagctgg

SEQ ID NO: 9463795 - DNA, 20 bp, Homo sapiens
cctgtggagctgcctcctcc

SEQ ID NO: 9463796 - DNA, 22 bp, Homo sapiens
cctgtggccgcgtcgggcggcg

SEQ ID NO: 9463797 - DNA, 22 bp, Homo sapiens
cctgtggcacatgcagggattc

SEQ ID NO: 9463798 - DNA, 23 bp, Homo sapiens
cctgtggcaagtagatgagatga

SEQ ID NO: 9463799 - DNA, 17 bp, Homo sapiens
cctgtggatgacacctg

SEQ ID NO: 9463800 - DNA, 22 bp, Homo sapiens
tggttcctcaagcgctggcggc

SEQ ID NO: 9463801 - DNA, 22 bp, Homo sapiens
tggttcctcaagcgctggcggc

SEQ ID NO: 9463802 - DNA, 22 bp, Homo sapiens
tggttccagttttcaatagagc

SEQ ID NO: 9463803 - DNA, 22 bp, Homo sapiens
tggttccactaacctgagagcc

SEQ ID NO: 9463804 - DNA, 22 bp, Homo sapiens
tggttccaatcgcactggctca

SEQ ID NO: 9463805 - DNA, 17 bp, Homo sapiens
tggttccaaccatacgc

SEQ ID NO: 9463806 - DNA, 22 bp, Homo sapiens
tggttccaagatggctgccaca

SEQ ID NO: 9463807 - DNA, 22 bp, Homo sapiens
tggttcatagcctcacaggata

SEQ ID NO: 9463808 - DNA, 22 bp, Homo sapiens
tggttcataatttgcactactg

SEQ ID NO: 9463809 - DNA, 22 bp, Homo sapiens
tggttcaggcagggtgttgctg

SEQ ID NO: 9463810 - DNA, 22 bp, Homo sapiens
tggttatgggagtcatgttgcc

SEQ ID NO: 9463811 - DNA, 22 bp, Homo sapiens
tggttataaaagtcctctcatt

SEQ ID NO: 9463812 - DNA, 22 bp, Homo sapiens
tggttataaattgctatgcaga

SEQ ID NO: 9463813 - DNA, 22 bp, Homo sapiens
tggttagactcaccttatagtt

SEQ ID NO: 9463814 - DNA, 22 bp, Homo sapiens
tggttagaggcttcttgcttgg

SEQ ID NO: 9463815 - DNA, 22 bp, Homo sapiens
tggttagatgaggctggtttca

SEQ ID NO: 9463816 - DNA, 22 bp, Homo sapiens
cctgcgcgtctgggtctgtctc

SEQ ID NO: 9463817 - DNA, 22 bp, Homo sapiens
cctgctcacctgatgtggcaac

SEQ ID NO: 9463818 - DNA, 22 bp, Homo sapiens
cctgcgggctgtgctgaagcct

SEQ ID NO: 9463819 - DNA, 22 bp, Homo sapiens
cctgctcagccccagctcaccc

SEQ ID NO: 9463820 - DNA, 22 bp, Homo sapiens
cctgctcagagcgtcttgtgtg

SEQ ID NO: 9463821 - DNA, 22 bp, Homo sapiens
cctgctcagctgtcctcacgct

SEQ ID NO: 9463822 - DNA, 23 bp, Homo sapiens
cctgctcaggcgtgtgccctgct

SEQ ID NO: 9463823 - DNA, 22 bp, Homo sapiens
cctgctcatgggtccctggcag

SEQ ID NO: 9463824 - DNA, 22 bp, Homo sapiens
cctgctcatgggtccctggcag

SEQ ID NO: 9463825 - DNA, 23 bp, Homo sapiens
cctgctcaggcgtgtgccctgct

SEQ ID NO: 9463826 - DNA, 22 bp, Homo sapiens
tgttgctactctccctgggagg

SEQ ID NO: 9463827 - DNA, 22 bp, Homo sapiens
tgttgcctaactgccctctgaa

SEQ ID NO: 9463828 - DNA, 22 bp, Homo sapiens
tgttgcccaggttctctcctgc

SEQ ID NO: 9463829 - DNA, 19 bp, Homo sapiens
tgttggaggtgctgaatta

SEQ ID NO: 9463830 - DNA, 22 bp, Homo sapiens
tgttggaaaggccaggctgtgg

SEQ ID NO: 9463831 - DNA, 20 bp, Homo sapiens
tgttgattggtgtcatctca

SEQ ID NO: 9463832 - DNA, 22 bp, Homo sapiens
tgttgattagtgtttagactta

SEQ ID NO: 9463833 - DNA, 22 bp, Homo sapiens
tgttgattagtgtttagactta

SEQ ID NO: 9463834 - DNA, 22 bp, Homo sapiens
tgttgattagtgtttagactta

SEQ ID NO: 9463835 - DNA, 22 bp, Homo sapiens
tgttgcagagctggggagggtg

SEQ ID NO: 9463836 - DNA, 22 bp, Homo sapiens
tgttgcaggcccctggggtatg

SEQ ID NO: 9463837 - DNA, 22 bp, Homo sapiens
tgttgcagtaaaaatggagagg

SEQ ID NO: 9463838 - DNA, 20 bp, Homo sapiens
tgttgattggtgtcatctca

SEQ ID NO: 9463839 - DNA, 22 bp, Homo sapiens
tgttccatgtctttgtaggact

SEQ ID NO: 9463840 - DNA, 22 bp, Homo sapiens
tgttgattagtgtttagactta

SEQ ID NO: 9463841 - DNA, 22 bp, Homo sapiens
tgttcccacaccagcctcagcc

SEQ ID NO: 9463842 - DNA, 22 bp, Homo sapiens
cctgctcctatctgggctcatt

SEQ ID NO: 9463843 - DNA, 22 bp, Homo sapiens
cctgctcctatctgggctcatt

SEQ ID NO: 9463844 - DNA, 22 bp, Homo sapiens
cctgctcctgctattcttctgg

SEQ ID NO: 9463845 - DNA, 23 bp, Homo sapiens
cctggggcacttgagtcctcatc

SEQ ID NO: 9463846 - DNA, 22 bp, Homo sapiens
cctggggctcaagatggcgccg

SEQ ID NO: 9463847 - DNA, 22 bp, Homo sapiens
tgtttataatatgcagtgagca

SEQ ID NO: 9463848 - DNA, 22 bp, Homo sapiens
tgtttataatatgcagtgagca

SEQ ID NO: 9463849 - DNA, 22 bp, Homo sapiens
tgtttctaggtcaataattttt

SEQ ID NO: 9463850 - DNA, 22 bp, Homo sapiens
tgtttctagagaaaatatttac

SEQ ID NO: 9463851 - DNA, 22 bp, Homo sapiens
tgtttctagagaaaatatttac

SEQ ID NO: 9463852 - DNA, 22 bp, Homo sapiens
tgtttctatctggatcaataga

SEQ ID NO: 9463853 - DNA, 22 bp, Homo sapiens
tgtttctaggtcaataattttt

SEQ ID NO: 9463854 - DNA, 22 bp, Homo sapiens
tgtttctaggtcaataattttt

SEQ ID NO: 9463855 - DNA, 22 bp, Homo sapiens
tgtttctatctggatcaataga

SEQ ID NO: 9463856 - DNA, 22 bp, Homo sapiens
tgtttctataacctctgaagca

SEQ ID NO: 9463857 - DNA, 22 bp, Homo sapiens
tgtttctaggtcaataattttt

SEQ ID NO: 9463858 - DNA, 22 bp, Homo sapiens
tgtttctaggtcaataattttt

SEQ ID NO: 9463859 - DNA, 22 bp, Homo sapiens
tgtttataccttggtataacca

SEQ ID NO: 9463860 - DNA, 22 bp, Homo sapiens
tgtttctagagaaaatatttac

SEQ ID NO: 9463861 - DNA, 22 bp, Homo sapiens
tgtttctagagaaaatatttac

SEQ ID NO: 9463862 - DNA, 23 bp, Homo sapiens
cctggggcacttgagtcctcatc

SEQ ID NO: 9463863 - DNA, 23 bp, Homo sapiens
cctggggcacttgagtcctcatc

SEQ ID NO: 9463864 - DNA, 22 bp, Homo sapiens
cctggggattctgacacggagt

SEQ ID NO: 9463865 - DNA, 22 bp, Homo sapiens
cctggggattctgacacggagt

SEQ ID NO: 9463866 - DNA, 22 bp, Homo sapiens
cctggggattctgacacggagt

SEQ ID NO: 9463867 - DNA, 22 bp, Homo sapiens
cctggggagccgcctgagcccc

SEQ ID NO: 9463868 - DNA, 23 bp, Homo sapiens
cctggggagctgtatccagagtg

SEQ ID NO: 9463869 - DNA, 23 bp, Homo sapiens
cctggggagctgtatccagagtg

SEQ ID NO: 9463870 - DNA, 22 bp, Homo sapiens
cctggggattctgacacggagt

SEQ ID NO: 9463871 - DNA, 22 bp, Homo sapiens
cctggggagagaaagcccagcc

SEQ ID NO: 9463872 - DNA, 22 bp, Homo sapiens
cctggggagagaaagcccagcc

SEQ ID NO: 9463873 - DNA, 22 bp, Homo sapiens
cctggggagaagagcttccccc

SEQ ID NO: 9463874 - DNA, 22 bp, Homo sapiens
cctggggagaagagcttccccc

SEQ ID NO: 9463875 - DNA, 22 bp, Homo sapiens
cctggggagccgcctgagcccc

SEQ ID NO: 9463876 - DNA, 22 bp, Homo sapiens
cctggggagagaaagcccagcc

SEQ ID NO: 9463877 - DNA, 22 bp, Homo sapiens
cctggggagccgcctgagcccc

SEQ ID NO: 9463878 - DNA, 22 bp, Homo sapiens
cctggggagccgcctgagcccc

SEQ ID NO: 9463879 - DNA, 22 bp, Homo sapiens
tgtttctgtctgttttctacat

SEQ ID NO: 9463880 - DNA, 22 bp, Homo sapiens
tgtttctgtatgatcaatattg

SEQ ID NO: 9463881 - DNA, 22 bp, Homo sapiens
tgtttctgtatgatcaatattg

SEQ ID NO: 9463882 - DNA, 22 bp, Homo sapiens
tgtttctgggtgtgtctcacct

SEQ ID NO: 9463883 - DNA, 22 bp, Homo sapiens
tgtttctgggtgtgtctcacct

SEQ ID NO: 9463884 - DNA, 20 bp, Homo sapiens
tgtttctgacggtaggagag

SEQ ID NO: 9463885 - DNA, 22 bp, Homo sapiens
tgtttctatctggatcaataga

SEQ ID NO: 9463886 - DNA, 22 bp, Homo sapiens
tgtttctgtctgttttctacat

SEQ ID NO: 9463887 - DNA, 22 bp, Homo sapiens
tgtttcttacgtttttagaggc

SEQ ID NO: 9463888 - DNA, 19 bp, Homo sapiens
tgtttcttcctccatctga

SEQ ID NO: 9463889 - DNA, 19 bp, Homo sapiens
tgtttcttcctccatctga

SEQ ID NO: 9463890 - DNA, 22 bp, Homo sapiens
tgtttcttctcacacaaactca

SEQ ID NO: 9463891 - DNA, 17 bp, Homo sapiens
tgttttcattcattgct

SEQ ID NO: 9463892 - DNA, 17 bp, Homo sapiens
tgttttcattcattgct

SEQ ID NO: 9463893 - DNA, 22 bp, Homo sapiens
tgttttcagtcatatagcaggt

SEQ ID NO: 9463894 - DNA, 22 bp, Homo sapiens
tgttttcatcacagaatgtaac

SEQ ID NO: 9463895 - DNA, 22 bp, Homo sapiens
tgttttcatggttatgtgtcta

SEQ ID NO: 9463896 - DNA, 22 bp, Homo sapiens
tgttttcatttgatgtaacaaa

SEQ ID NO: 9463897 - DNA, 17 bp, Homo sapiens
tgttttcattcattgct

SEQ ID NO: 9463898 - DNA, 22 bp, Homo sapiens
tgttttccggcctcagcacgcc

SEQ ID NO: 9463899 - DNA, 22 bp, Homo sapiens
ttattattgtgacctgagaatg

SEQ ID NO: 9463900 - DNA, 22 bp, Homo sapiens
cgcaccactgaattccagcctg

SEQ ID NO: 9463901 - DNA, 22 bp, Homo sapiens
cgcaccactgaattccagcctg

SEQ ID NO: 9463902 - DNA, 22 bp, Homo sapiens
ttattattgtgacctgagaatg

SEQ ID NO: 9463903 - DNA, 22 bp, Homo sapiens
ttattattgtggttgcattatc

SEQ ID NO: 9463904 - DNA, 22 bp, Homo sapiens
ttattattgtggttgcattatc

SEQ ID NO: 9463905 - DNA, 22 bp, Homo sapiens
ttattattttgtgtacagcaaa

SEQ ID NO: 9463906 - DNA, 22 bp, Homo sapiens
ttattattttgtgtacagcaaa

SEQ ID NO: 9463907 - DNA, 22 bp, Homo sapiens
ttattattttgtgtacagcaaa

SEQ ID NO: 9463908 - DNA, 22 bp, Homo sapiens
ttattcaccagtgtaaaacact

SEQ ID NO: 9463909 - DNA, 23 bp, Homo sapiens
ttattttgtcagaagggactttt

SEQ ID NO: 9463910 - DNA, 22 bp, Homo sapiens
ttatttcattgatttctaagac

SEQ ID NO: 9463911 - DNA, 22 bp, Homo sapiens
ttatttttaaaagttcacacag

SEQ ID NO: 9463912 - DNA, 22 bp, Homo sapiens
ttattcactcattaaagcagga

SEQ ID NO: 9463913 - DNA, 22 bp, Homo sapiens
ttattcacctctattagactca

SEQ ID NO: 9463914 - DNA, 22 bp, Homo sapiens
ttattcacctctattagactca

SEQ ID NO: 9463915 - DNA, 22 bp, Homo sapiens
ttattcaccagtgtaaaacact

SEQ ID NO: 9463916 - DNA, 22 bp, Homo sapiens
ttattcaccatttattatgtga

SEQ ID NO: 9463917 - DNA, 22 bp, Homo sapiens
ttattcaccgcaggtgcttccc

SEQ ID NO: 9463918 - DNA, 22 bp, Homo sapiens
ttattcactcatttaacattat

SEQ ID NO: 9463919 - DNA, 22 bp, Homo sapiens
ttattcactcatttaacattat

SEQ ID NO: 9463920 - DNA, 22 bp, Homo sapiens
ttatttcatgtaaaatttatgt

SEQ ID NO: 9463921 - DNA, 17 bp, Homo sapiens
ttattttttgggctgag

SEQ ID NO: 9463922 - DNA, 22 bp, Homo sapiens
ttcaaaaaggtatgttcaagtc

SEQ ID NO: 9463923 - DNA, 22 bp, Homo sapiens
ttcaaaaaggtatgttcaagtc

SEQ ID NO: 9463924 - DNA, 22 bp, Homo sapiens
ttatttttaaaagttcacacag

SEQ ID NO: 9463925 - DNA, 22 bp, Homo sapiens
ttatttttaaaagttcacacag

SEQ ID NO: 9463926 - DNA, 22 bp, Homo sapiens
ttatttttaaaagttcacacag

SEQ ID NO: 9463927 - DNA, 22 bp, Homo sapiens
ttatttttaaaagttcacacag

SEQ ID NO: 9463928 - DNA, 22 bp, Homo sapiens
ttatttttaaaagttcacacag

SEQ ID NO: 9463929 - DNA, 22 bp, Homo sapiens
ttatttttaaaagttcacacag

SEQ ID NO: 9463930 - DNA, 22 bp, Homo sapiens
cgcactggagctggaacgagtc

SEQ ID NO: 9463931 - DNA, 22 bp, Homo sapiens
ttcaaaacagctagatattgga

SEQ ID NO: 9463932 - DNA, 22 bp, Homo sapiens
cgcaccactgaattccagcctg

SEQ ID NO: 9463933 - DNA, 22 bp, Homo sapiens
ttcaaaacaatctgtttgcatt

SEQ ID NO: 9463934 - DNA, 21 bp, Homo sapiens
cgcagagcgaacttgcggcgc

SEQ ID NO: 9463935 - DNA, 22 bp, Homo sapiens
cgcagagggcaggcagtgctgg

SEQ ID NO: 9463936 - DNA, 22 bp, Homo sapiens
cgcagagggagccgcgggctgc

SEQ ID NO: 9463937 - DNA, 22 bp, Homo sapiens
cgcagcagccccgtggtaggtg

SEQ ID NO: 9463938 - DNA, 22 bp, Homo sapiens
cgaggtgactttggtttagaca

SEQ ID NO: 9463939 - DNA, 17 bp, Homo sapiens
cgagggcttgctggctc

SEQ ID NO: 9463940 - DNA, 17 bp, Homo sapiens
cgagggcttgctggctc

SEQ ID NO: 9463941 - DNA, 22 bp, Homo sapiens
cgagggctgtgttgctctcctt

SEQ ID NO: 9463942 - DNA, 22 bp, Homo sapiens
cgagggctgtgttgctctcctt

SEQ ID NO: 9463943 - DNA, 22 bp, Homo sapiens
cgagcagagcagagacgtctgg

SEQ ID NO: 9463944 - DNA, 22 bp, Homo sapiens
cgagcagaagcctggtggtctg

SEQ ID NO: 9463945 - DNA, 22 bp, Homo sapiens
cctttgggtgaattcctctctt

SEQ ID NO: 9463946 - DNA, 22 bp, Homo sapiens
cgagcagaatggagggtgccga

SEQ ID NO: 9463947 - DNA, 22 bp, Homo sapiens
cctttggctgcatagggaaggg

SEQ ID NO: 9463948 - DNA, 22 bp, Homo sapiens
cctttggccgctttatggagga

SEQ ID NO: 9463949 - DNA, 22 bp, Homo sapiens
cctttggcattttgaggatgcg

SEQ ID NO: 9463950 - DNA, 22 bp, Homo sapiens
cctttggccctgagagatgatt

SEQ ID NO: 9463951 - DNA, 22 bp, Homo sapiens
cgcaactcagcaacttaactgc

SEQ ID NO: 9463952 - DNA, 22 bp, Homo sapiens
cgcaaagagctctaaatcagac

SEQ ID NO: 9463953 - DNA, 22 bp, Homo sapiens
cgcaccactgaattccagcctg

SEQ ID NO: 9463954 - DNA, 22 bp, Homo sapiens
cgcaccactgaattccagcctg

SEQ ID NO: 9463955 - DNA, 22 bp, Homo sapiens
cgatgctggaatgacagctgct

SEQ ID NO: 9463956 - DNA, 22 bp, Homo sapiens
cgatgggggcagtgttacattg

SEQ ID NO: 9463957 - DNA, 20 bp, Homo sapiens
cgattcagtggagtttgaaa

SEQ ID NO: 9463958 - DNA, 22 bp, Homo sapiens
cgatggaattggaaagaggaat

SEQ ID NO: 9463959 - DNA, 18 bp, Homo sapiens
cgatgtgtatgtgatttg

SEQ ID NO: 9463960 - DNA, 21 bp, Homo sapiens
cgaggtgagctcttggctcag

SEQ ID NO: 9463961 - DNA, 22 bp, Homo sapiens
cgaggtgatggcatttagactc

SEQ ID NO: 9463962 - DNA, 22 bp, Homo sapiens
cgatgaatatttaacgctgtga

SEQ ID NO: 9463963 - DNA, 22 bp, Homo sapiens
cgagtgtctgctatgggctgag

SEQ ID NO: 9463964 - DNA, 22 bp, Homo sapiens
cgagtgtccctaccatttccta

SEQ ID NO: 9463965 - DNA, 22 bp, Homo sapiens
cgagtgtccctaccatttccta

SEQ ID NO: 9463966 - DNA, 22 bp, Homo sapiens
cgagtgtccctaccatttccta

SEQ ID NO: 9463967 - DNA, 22 bp, Homo sapiens
ttatgtactctgcaatgtttga

SEQ ID NO: 9463968 - DNA, 22 bp, Homo sapiens
ttatgtaggataatgaattgcc

SEQ ID NO: 9463969 - DNA, 22 bp, Homo sapiens
ttatgtagtcactgtggtcttg

SEQ ID NO: 9463970 - DNA, 22 bp, Homo sapiens
ttatgtacccactcatattccc

SEQ ID NO: 9463971 - DNA, 22 bp, Homo sapiens
ttatgtacccactcatattccc

SEQ ID NO: 9463972 - DNA, 22 bp, Homo sapiens
ttatgtacctgaattagtaaag

SEQ ID NO: 9463973 - DNA, 22 bp, Homo sapiens
ttatgtacctctttctgcttca

SEQ ID NO: 9463974 - DNA, 22 bp, Homo sapiens
ttatgggagcaattggggaggt

SEQ ID NO: 9463975 - DNA, 22 bp, Homo sapiens
ttatgggcagagggtaactgat

SEQ ID NO: 9463976 - DNA, 22 bp, Homo sapiens
ttatgggcgatgcaaacctgat

SEQ ID NO: 9463977 - DNA, 22 bp, Homo sapiens
ttatgggctgtcacgtgaatat

SEQ ID NO: 9463978 - DNA, 22 bp, Homo sapiens
ttatgtaagtggagtcatatag

SEQ ID NO: 9463979 - DNA, 22 bp, Homo sapiens
ttatgtaagtggagtcatatag

SEQ ID NO: 9463980 - DNA, 22 bp, Homo sapiens
ttatggtaattaaaacatgtat

SEQ ID NO: 9463981 - DNA, 22 bp, Homo sapiens
ttatggtaggagctgtcagttt

SEQ ID NO: 9463982 - DNA, 22 bp, Homo sapiens
ttatgtaatttgtttgctcttc

SEQ ID NO: 9463983 - DNA, 22 bp, Homo sapiens
ttatgtaatttgtttgctcttc

SEQ ID NO: 9463984 - DNA, 22 bp, Homo sapiens
ttatgtacaatgttaatgtaaa

SEQ ID NO: 9463985 - DNA, 22 bp, Homo sapiens
cctttcttttatccaccagcca

SEQ ID NO: 9463986 - DNA, 22 bp, Homo sapiens
cctttgcattctagatgtttag

SEQ ID NO: 9463987 - DNA, 22 bp, Homo sapiens
cctttgccatgacatggcacaa

SEQ ID NO: 9463988 - DNA, 22 bp, Homo sapiens
cctttgccatgacatggcacaa

SEQ ID NO: 9463989 - DNA, 22 bp, Homo sapiens
cctttctgacagtgatgggggg

SEQ ID NO: 9463990 - DNA, 22 bp, Homo sapiens
ttatgtatgaatatagtagaag

SEQ ID NO: 9463991 - DNA, 22 bp, Homo sapiens
ttatgtatgaatatagtagaag

SEQ ID NO: 9463992 - DNA, 22 bp, Homo sapiens
ttatgtatgaatatagtagaag

SEQ ID NO: 9463993 - DNA, 22 bp, Homo sapiens
cctttctgtgttgccctatttg

SEQ ID NO: 9463994 - DNA, 22 bp, Homo sapiens
cctttctggtatttaaccaaag

SEQ ID NO: 9463995 - DNA, 17 bp, Homo sapiens
cctttcttcccagaggg

SEQ ID NO: 9463996 - DNA, 22 bp, Homo sapiens
cctttctgatggcctcccagcc

SEQ ID NO: 9463997 - DNA, 22 bp, Homo sapiens
cctttctgatggcctcccagcc

SEQ ID NO: 9463998 - DNA, 20 bp, Homo sapiens
cctttctggagtgctgttca

SEQ ID NO: 9463999 - DNA, 22 bp, Homo sapiens
ttacctaaaatagctcaattta

SEQ ID NO: 9464000 - DNA, 22 bp, Homo sapiens
ttacctaaaatagctcaattta

SEQ ID NO: 9464001 - DNA, 22 bp, Homo sapiens
ttaccaatgtgcttttgctaca

SEQ ID NO: 9464002 - DNA, 22 bp, Homo sapiens
ttaccaattcagacatctcttc

SEQ ID NO: 9464003 - DNA, 22 bp, Homo sapiens
ttaccaagctctgcatgttaag

SEQ ID NO: 9464004 - DNA, 22 bp, Homo sapiens
ttaccaaatgaaatagagattt

SEQ ID NO: 9464005 - DNA, 22 bp, Homo sapiens
ttaccatagaaacttccttttt

SEQ ID NO: 9464006 - DNA, 22 bp, Homo sapiens
ttaccacagtgcctgtctaatg

SEQ ID NO: 9464007 - DNA, 22 bp, Homo sapiens
ccttctgatactgacatcattt

SEQ ID NO: 9464008 - DNA, 22 bp, Homo sapiens
ccttctgataactgtgaaattg

SEQ ID NO: 9464009 - DNA, 22 bp, Homo sapiens
ccttctggagggtgtacgagag

SEQ ID NO: 9464010 - DNA, 22 bp, Homo sapiens
ccttctgctggtcatcccagtg

SEQ ID NO: 9464011 - DNA, 22 bp, Homo sapiens
ccttctgctccctggccagggc

SEQ ID NO: 9464012 - DNA, 22 bp, Homo sapiens
ccttctgctccctggccagggc

SEQ ID NO: 9464013 - DNA, 22 bp, Homo sapiens
ccttctggatgtgctaaggaag

SEQ ID NO: 9464014 - DNA, 22 bp, Homo sapiens
ccttctgtctccctcatattga

SEQ ID NO: 9464015 - DNA, 22 bp, Homo sapiens
ccttctgggccaacttccagga

SEQ ID NO: 9464016 - DNA, 22 bp, Homo sapiens
ccttctgtgtgcccacgtttat

SEQ ID NO: 9464017 - DNA, 23 bp, Homo sapiens
ccttctgttaaccatctgggggg

SEQ ID NO: 9464018 - DNA, 22 bp, Homo sapiens
ccttcttgaggtagcacattct

SEQ ID NO: 9464019 - DNA, 22 bp, Homo sapiens
ccttcttgaggtagcacattct

SEQ ID NO: 9464020 - DNA, 21 bp, Homo sapiens
ccttctccacagggtctccgg

SEQ ID NO: 9464021 - DNA, 21 bp, Homo sapiens
ccttctccacagggtctccgg

SEQ ID NO: 9464022 - DNA, 22 bp, Homo sapiens
ttacagaagtattgagagatcc

SEQ ID NO: 9464023 - DNA, 21 bp, Homo sapiens
ccttctcttgcttcagcttca

SEQ ID NO: 9464024 - DNA, 21 bp, Homo sapiens
ccttctcttgcttcagcttca

SEQ ID NO: 9464025 - DNA, 20 bp, Homo sapiens
ccttctctggaattgcctcc

SEQ ID NO: 9464026 - DNA, 22 bp, Homo sapiens
ttacagaagagaaagaattcag

SEQ ID NO: 9464027 - DNA, 22 bp, Homo sapiens
ttacagaagagaaagaattcag

SEQ ID NO: 9464028 - DNA, 22 bp, Homo sapiens
ttacagaagagaaagaattcag

SEQ ID NO: 9464029 - DNA, 22 bp, Homo sapiens
ttacagaagagaaagaattcag

SEQ ID NO: 9464030 - DNA, 22 bp, Homo sapiens
ttacagaactgtcttgaaattt

SEQ ID NO: 9464031 - DNA, 22 bp, Homo sapiens
ttacagaactgtcttgaaattt

SEQ ID NO: 9464032 - DNA, 22 bp, Homo sapiens
ttacagaagagaaagaattcag

SEQ ID NO: 9464033 - DNA, 22 bp, Homo sapiens
ttacagaaggaacactactcag

SEQ ID NO: 9464034 - DNA, 22 bp, Homo sapiens
ttacagaaggaacactactcag

SEQ ID NO: 9464035 - DNA, 22 bp, Homo sapiens
ttacagaaggaacactactcag

SEQ ID NO: 9464036 - DNA, 22 bp, Homo sapiens
ttacagaaggaacactactcag

SEQ ID NO: 9464037 - DNA, 22 bp, Homo sapiens
ttacagaagagtaacttggcaa

SEQ ID NO: 9464038 - DNA, 22 bp, Homo sapiens
ttacagaaggaacactactcag

SEQ ID NO: 9464039 - DNA, 22 bp, Homo sapiens
ttacagaaggaacactactcag

SEQ ID NO: 9464040 - DNA, 22 bp, Homo sapiens
ttacagaaaatgtgttttaact

SEQ ID NO: 9464041 - DNA, 22 bp, Homo sapiens
ttacagaaaggaaggactgact

SEQ ID NO: 9464042 - DNA, 23 bp, Homo sapiens
ttacagaaagtatgcttttgttt

SEQ ID NO: 9464043 - DNA, 20 bp, Homo sapiens
ttacagaaatgatgttattt

SEQ ID NO: 9464044 - DNA, 22 bp, Homo sapiens
ttacagaactgccctagttggc

SEQ ID NO: 9464045 - DNA, 20 bp, Homo sapiens
ttacagaaatgatgttattt

SEQ ID NO: 9464046 - DNA, 22 bp, Homo sapiens
ttacagaactgtcttgaaattt

SEQ ID NO: 9464047 - DNA, 22 bp, Homo sapiens
ttacagaactgtcttgaaattt

SEQ ID NO: 9464048 - DNA, 22 bp, Homo sapiens
ttacagaactgtcttgaaattt

SEQ ID NO: 9464049 - DNA, 22 bp, Homo sapiens
ttacagaactgtcttgaaattt

SEQ ID NO: 9464050 - DNA, 22 bp, Homo sapiens
ccttggggaactggacgtgctg

SEQ ID NO: 9464051 - DNA, 22 bp, Homo sapiens
ccttggggaactggacgtgctg

SEQ ID NO: 9464052 - DNA, 22 bp, Homo sapiens
ccttgggatttctcatgccaat

SEQ ID NO: 9464053 - DNA, 22 bp, Homo sapiens
ccttgggatgcataagagccca

SEQ ID NO: 9464054 - DNA, 22 bp, Homo sapiens
ccttgggagaaattgcagagtc

SEQ ID NO: 9464055 - DNA, 22 bp, Homo sapiens
ccttgggaccctgctggaggtt

SEQ ID NO: 9464056 - DNA, 22 bp, Homo sapiens
ccttggcttgcacacggccacc

SEQ ID NO: 9464057 - DNA, 22 bp, Homo sapiens
ccttggcttgcacacggccacc

SEQ ID NO: 9464058 - DNA, 22 bp, Homo sapiens
ccttggcttccttccctctaga

SEQ ID NO: 9464059 - DNA, 22 bp, Homo sapiens
ccttggcttccttccctctaga

SEQ ID NO: 9464060 - DNA, 22 bp, Homo sapiens
ccttggcttaccttctgtgtgg

SEQ ID NO: 9464061 - DNA, 22 bp, Homo sapiens
ccttggcttgtgggctgcagcc

SEQ ID NO: 9464062 - DNA, 22 bp, Homo sapiens
ccttggcttgtgggctgcagcc

SEQ ID NO: 9464063 - DNA, 19 bp, Homo sapiens
ccttggctttaactatgaa

SEQ ID NO: 9464064 - DNA, 22 bp, Homo sapiens
ccttgggacagccagcttcaga

SEQ ID NO: 9464065 - DNA, 22 bp, Homo sapiens
ccttgggacagccagcttcaga

SEQ ID NO: 9464066 - DNA, 22 bp, Homo sapiens
ccttggctgcttatatgtctgt

SEQ ID NO: 9464067 - DNA, 19 bp, Homo sapiens
ccttgcctgtccctgcagc

SEQ ID NO: 9464068 - DNA, 19 bp, Homo sapiens
ccttgcctgtccctgcagc

SEQ ID NO: 9464069 - DNA, 22 bp, Homo sapiens
ccttggctggaattactctggg

SEQ ID NO: 9464070 - DNA, 22 bp, Homo sapiens
ccttggctggaattactctggg

SEQ ID NO: 9464071 - DNA, 22 bp, Homo sapiens
ccttggctgtgttgcctgccct

SEQ ID NO: 9464072 - DNA, 22 bp, Homo sapiens
ccttggctgtgttgcctgccct

SEQ ID NO: 9464073 - DNA, 20 bp, Homo sapiens
ccttggcttaataataggga

SEQ ID NO: 9464074 - DNA, 22 bp, Homo sapiens
ccttggctgtgctgccctttgc

SEQ ID NO: 9464075 - DNA, 22 bp, Homo sapiens
ccttggctgtgctgccctttgc

SEQ ID NO: 9464076 - DNA, 21 bp, Homo sapiens
ccttggctggcatctagcacc

SEQ ID NO: 9464077 - DNA, 21 bp, Homo sapiens
ccttggctggcatctagcacc

SEQ ID NO: 9464078 - DNA, 22 bp, Homo sapiens
ttacctggtgtttatggtccat

SEQ ID NO: 9464079 - DNA, 22 bp, Homo sapiens
ttacctgtaaaactgcgatata

SEQ ID NO: 9464080 - DNA, 22 bp, Homo sapiens
ttacctgttttacatgcacaac

SEQ ID NO: 9464081 - DNA, 22 bp, Homo sapiens
ttacgaatgttagattgcatct

SEQ ID NO: 9464082 - DNA, 22 bp, Homo sapiens
ccttgcctcattgtgcttctcc

SEQ ID NO: 9464083 - DNA, 22 bp, Homo sapiens
cctttacagtatggttgtatca

SEQ ID NO: 9464084 - DNA, 22 bp, Homo sapiens
ttatcgtacgcttcagaaattt

SEQ ID NO: 9464085 - DNA, 21 bp, Homo sapiens
cctttacaattttgcattcct

SEQ ID NO: 9464086 - DNA, 22 bp, Homo sapiens
cctttacaaagttcttcatggg

SEQ ID NO: 9464087 - DNA, 22 bp, Homo sapiens
cctttaatttacaatgttaatt

SEQ ID NO: 9464088 - DNA, 22 bp, Homo sapiens
cctttaaatggatgttcaactg

SEQ ID NO: 9464089 - DNA, 22 bp, Homo sapiens
cctttaaatggatgttcaactg

SEQ ID NO: 9464090 - DNA, 22 bp, Homo sapiens
ttatctacgtatttaaactctt

SEQ ID NO: 9464091 - DNA, 22 bp, Homo sapiens
ttatcgtatctcttggtcttca

SEQ ID NO: 9464092 - DNA, 22 bp, Homo sapiens
ttatctctcacttttaaggaca

SEQ ID NO: 9464093 - DNA, 18 bp, Homo sapiens
ttatggctgtgaaagagt

SEQ ID NO: 9464094 - DNA, 22 bp, Homo sapiens
ttatggcttctgtgaagaattt

SEQ ID NO: 9464095 - DNA, 22 bp, Homo sapiens
ccttggtccctccccagaccaa

SEQ ID NO: 9464096 - DNA, 22 bp, Homo sapiens
ccttgggttccaagtcactgaa

SEQ ID NO: 9464097 - DNA, 22 bp, Homo sapiens
ccttggtgctctgctgggatgg

SEQ ID NO: 9464098 - DNA, 22 bp, Homo sapiens
ccttggttctgcctggcctgga

SEQ ID NO: 9464099 - DNA, 22 bp, Homo sapiens
ccttggttttaccaggtgttca

SEQ ID NO: 9464100 - DNA, 22 bp, Homo sapiens
ccttggtttccaggatgaggct

SEQ ID NO: 9464101 - DNA, 22 bp, Homo sapiens
ccttggtttccaggatgaggct

SEQ ID NO: 9464102 - DNA, 22 bp, Homo sapiens
ccttggggaatatccattcttc

SEQ ID NO: 9464103 - DNA, 22 bp, Homo sapiens
ccttggggtgttggaggcagcc

SEQ ID NO: 9464104 - DNA, 22 bp, Homo sapiens
ccttggggtgttggaggcagcc

SEQ ID NO: 9464105 - DNA, 22 bp, Homo sapiens
cctttaaatggatgttcaactg

SEQ ID NO: 9464106 - DNA, 22 bp, Homo sapiens
cctttaaagactgcataacttc

SEQ ID NO: 9464107 - DNA, 22 bp, Homo sapiens
cctttaaagactgcataacttc

SEQ ID NO: 9464108 - DNA, 22 bp, Homo sapiens
cctttaaagactgcataacttc

SEQ ID NO: 9464109 - DNA, 22 bp, Homo sapiens
cctttaaagactgcataacttc

SEQ ID NO: 9464110 - DNA, 22 bp, Homo sapiens
ccttgtcttgcacagatgcagc

SEQ ID NO: 9464111 - DNA, 23 bp, Homo sapiens
tagccaggcccagcatggacacc

SEQ ID NO: 9464112 - DNA, 22 bp, Homo sapiens
tagccaggctgcagctgatccg

SEQ ID NO: 9464113 - DNA, 22 bp, Homo sapiens
tagccaggcctttgatcccggc

SEQ ID NO: 9464114 - DNA, 22 bp, Homo sapiens
tagccaggcgaggtcagtgtcg

SEQ ID NO: 9464115 - DNA, 22 bp, Homo sapiens
tagccagctggataatgtgggg

SEQ ID NO: 9464116 - DNA, 22 bp, Homo sapiens
tagccagctgaatgcactacag

SEQ ID NO: 9464117 - DNA, 22 bp, Homo sapiens
tagccaggcaattatgggtgat

SEQ ID NO: 9464118 - DNA, 22 bp, Homo sapiens
tagccaggcaattatgggtgat

SEQ ID NO: 9464119 - DNA, 22 bp, Homo sapiens
tagccagggagacactgtggag

SEQ ID NO: 9464120 - DNA, 22 bp, Homo sapiens
tagccaggctgcagctgatccg

SEQ ID NO: 9464121 - DNA, 22 bp, Homo sapiens
tagcatttcccaaatgcatttg

SEQ ID NO: 9464122 - DNA, 22 bp, Homo sapiens
tagcatttggacattgtcacct

SEQ ID NO: 9464123 - DNA, 22 bp, Homo sapiens
tagcatttggcaccagttattt

SEQ ID NO: 9464124 - DNA, 21 bp, Homo sapiens
tagcatttttgtattgctgaa

SEQ ID NO: 9464125 - DNA, 22 bp, Homo sapiens
tagccaaagtagctgttatagc

SEQ ID NO: 9464126 - DNA, 22 bp, Homo sapiens
tagcatttcccaaatgcatttg

SEQ ID NO: 9464127 - DNA, 22 bp, Homo sapiens
tagcatttcactgatcttcact

SEQ ID NO: 9464128 - DNA, 22 bp, Homo sapiens
tagcatttcccaaatgcatttg

SEQ ID NO: 9464129 - DNA, 22 bp, Homo sapiens
tagcatttattccagatttgga

SEQ ID NO: 9464130 - DNA, 22 bp, Homo sapiens
tagcatttattccagatttgga

SEQ ID NO: 9464131 - DNA, 22 bp, Homo sapiens
tagcattccttgtggcttctga

SEQ ID NO: 9464132 - DNA, 22 bp, Homo sapiens
tagcattccttgtggcttctga

SEQ ID NO: 9464133 - DNA, 22 bp, Homo sapiens
tagcatttattccagatttgga

SEQ ID NO: 9464134 - DNA, 22 bp, Homo sapiens
tagcatttatggtcatgtgtcc

SEQ ID NO: 9464135 - DNA, 22 bp, Homo sapiens
tagcagggttttgaagagggtt

SEQ ID NO: 9464136 - DNA, 22 bp, Homo sapiens
tagcaggtgctcatttaactcc

SEQ ID NO: 9464137 - DNA, 21 bp, Homo sapiens
tagcagaaacagttcaggcca

SEQ ID NO: 9464138 - DNA, 22 bp, Homo sapiens
tagcacataacttagaatagtt

SEQ ID NO: 9464139 - DNA, 22 bp, Homo sapiens
tagcacagttcctgactctttg

SEQ ID NO: 9464140 - DNA, 22 bp, Homo sapiens
tagcacagttcctgactctttg

SEQ ID NO: 9464141 - DNA, 22 bp, Homo sapiens
tagcacagttcactatgataca

SEQ ID NO: 9464142 - DNA, 22 bp, Homo sapiens
tagcacatctggcgcttatagg

SEQ ID NO: 9464143 - DNA, 22 bp, Homo sapiens
tagcaccatacccggcagctcg

SEQ ID NO: 9464144 - DNA, 22 bp, Homo sapiens
tagatgtgttgcctggagttgt

SEQ ID NO: 9464145 - DNA, 22 bp, Homo sapiens
tagatgttaagcttctagaagg

SEQ ID NO: 9464146 - DNA, 22 bp, Homo sapiens
tagatgtgagcccaggctgctt

SEQ ID NO: 9464147 - DNA, 22 bp, Homo sapiens
tagatgtgttcagttggtgcag

SEQ ID NO: 9464148 - DNA, 22 bp, Homo sapiens
tagatgtaagcagaagaacagc

SEQ ID NO: 9464149 - DNA, 23 bp, Homo sapiens
tagatgtattaagtgcattttca

SEQ ID NO: 9464150 - DNA, 22 bp, Homo sapiens
tagatgtatcttctcttatcgt

SEQ ID NO: 9464151 - DNA, 20 bp, Homo sapiens
tagatgtttcctgtcataaa

SEQ ID NO: 9464152 - DNA, 22 bp, Homo sapiens
tagatgttttgatatttgctga

SEQ ID NO: 9464153 - DNA, 18 bp, Homo sapiens
tagattaaaattgaattc

SEQ ID NO: 9464154 - DNA, 22 bp, Homo sapiens
tagatttgtttccttctctcca

SEQ ID NO: 9464155 - DNA, 22 bp, Homo sapiens
tagatttgtttccttctctcca

SEQ ID NO: 9464156 - DNA, 22 bp, Homo sapiens
tagatttgtttccttctctcca

SEQ ID NO: 9464157 - DNA, 22 bp, Homo sapiens
tagatttgtttccttctctcca

SEQ ID NO: 9464158 - DNA, 22 bp, Homo sapiens
tagatttgtttccttctctcca

SEQ ID NO: 9464159 - DNA, 22 bp, Homo sapiens
tagattttacttctgtcattac

SEQ ID NO: 9464160 - DNA, 22 bp, Homo sapiens
tagattttaggagattttactg

SEQ ID NO: 9464161 - DNA, 22 bp, Homo sapiens
tagattttgcatttctaacaag

SEQ ID NO: 9464162 - DNA, 22 bp, Homo sapiens
tagattttgcatttctaacaag

SEQ ID NO: 9464163 - DNA, 22 bp, Homo sapiens
tagattttgcatttctaacaag

SEQ ID NO: 9464164 - DNA, 22 bp, Homo sapiens
tagattttgcatttctaacaag

SEQ ID NO: 9464165 - DNA, 22 bp, Homo sapiens
tagattttgcatttctaacaag

SEQ ID NO: 9464166 - DNA, 22 bp, Homo sapiens
tagcacaaagtcttgccctttt

SEQ ID NO: 9464167 - DNA, 22 bp, Homo sapiens
tagcacaagaagtacacataga

SEQ ID NO: 9464168 - DNA, 22 bp, Homo sapiens
tagcacaatatcatgtctgtga

SEQ ID NO: 9464169 - DNA, 22 bp, Homo sapiens
tagcacaatatcatgtctgtga

SEQ ID NO: 9464170 - DNA, 22 bp, Homo sapiens
tagcacaagtatctgcttttcc

SEQ ID NO: 9464171 - DNA, 22 bp, Homo sapiens
tagcacaagtatctgcttttcc

SEQ ID NO: 9464172 - DNA, 22 bp, Homo sapiens
tagcacaagcaactactgaagt

SEQ ID NO: 9464173 - DNA, 22 bp, Homo sapiens
tagcacaaagtcttgccctttt

SEQ ID NO: 9464174 - DNA, 22 bp, Homo sapiens
tagcaagaggtgaaggtttcat

SEQ ID NO: 9464175 - DNA, 22 bp, Homo sapiens
tagcaaaaactgcagttacttt

SEQ ID NO: 9464176 - DNA, 22 bp, Homo sapiens
tagcaaaaactgcagttacttt

SEQ ID NO: 9464177 - DNA, 22 bp, Homo sapiens
tagcaaaagccacgattacttt

SEQ ID NO: 9464178 - DNA, 22 bp, Homo sapiens
tagcaagacaacttttctcagt

SEQ ID NO: 9464179 - DNA, 22 bp, Homo sapiens
tagcacaggtcttgttgccatt

SEQ ID NO: 9464180 - DNA, 22 bp, Homo sapiens
tagcacagtatttctcaactgg

SEQ ID NO: 9464181 - DNA, 22 bp, Homo sapiens
tagcacaggtcttgttgccatt

SEQ ID NO: 9464182 - DNA, 17 bp, Homo sapiens
tagcacagtgcctggta

SEQ ID NO: 9464183 - DNA, 22 bp, Homo sapiens
tagcacagagcttttaaacttc

SEQ ID NO: 9464184 - DNA, 18 bp, Homo sapiens
tagcacagagcaggatgt

SEQ ID NO: 9464185 - DNA, 22 bp, Homo sapiens
tagcacagcttcttgatgtcac

SEQ ID NO: 9464186 - DNA, 18 bp, Homo sapiens
tagcacagagcaggatgt

SEQ ID NO: 9464187 - DNA, 22 bp, Homo sapiens
tagcacagacagaatggtcata

SEQ ID NO: 9464188 - DNA, 22 bp, Homo sapiens
tagaaggcaagcttggtacagg

SEQ ID NO: 9464189 - DNA, 22 bp, Homo sapiens
tagaagtggcaacactcagaaa

SEQ ID NO: 9464190 - DNA, 22 bp, Homo sapiens
tagaaggctttgagagatactt

SEQ ID NO: 9464191 - DNA, 22 bp, Homo sapiens
tagaagttcatgcgaattattt

SEQ ID NO: 9464192 - DNA, 22 bp, Homo sapiens
tagaagttcatgcgaattattt

SEQ ID NO: 9464193 - DNA, 22 bp, Homo sapiens
tagaagttgaactaaaaatatt

SEQ ID NO: 9464194 - DNA, 22 bp, Homo sapiens
tagaagttaggaaataggaata

SEQ ID NO: 9464195 - DNA, 18 bp, Homo sapiens
tagaagtgtgctatacaa

SEQ ID NO: 9464196 - DNA, 22 bp, Homo sapiens
tagaatcagaagatttgactgt

SEQ ID NO: 9464197 - DNA, 22 bp, Homo sapiens
tagaataagttgatgatatatg

SEQ ID NO: 9464198 - DNA, 21 bp, Homo sapiens
tagaatcactaataagatgta

SEQ ID NO: 9464199 - DNA, 22 bp, Homo sapiens
tagaataagttgatgatatatg

SEQ ID NO: 9464200 - DNA, 22 bp, Homo sapiens
tagaataagttgatgatatatg

SEQ ID NO: 9464201 - DNA, 22 bp, Homo sapiens
tagaagttgctcaataaatgtt

SEQ ID NO: 9464202 - DNA, 22 bp, Homo sapiens
tagaagtttcaaaagacttcat

SEQ ID NO: 9464203 - DNA, 22 bp, Homo sapiens
tagaagttgctcaataaatgtt

SEQ ID NO: 9464204 - DNA, 22 bp, Homo sapiens
tagaataagttgatgatatatg

SEQ ID NO: 9464205 - DNA, 22 bp, Homo sapiens
tagaatctagttcattcatttg

SEQ ID NO: 9464206 - DNA, 22 bp, Homo sapiens
tagaatcatacctctaggaaca

SEQ ID NO: 9464207 - DNA, 22 bp, Homo sapiens
tagaatcagaagatttgactgt

SEQ ID NO: 9464208 - DNA, 22 bp, Homo sapiens
tagaatcatacctctaggaaca

SEQ ID NO: 9464209 - DNA, 22 bp, Homo sapiens
tagaatcattgagaataacagg

SEQ ID NO: 9464210 - DNA, 22 bp, Homo sapiens
tactttattgtaaatgctgatg

SEQ ID NO: 9464211 - DNA, 22 bp, Homo sapiens
tactttattgtaaatgctgatg

SEQ ID NO: 9464212 - DNA, 22 bp, Homo sapiens
tactttattgtaaatgctgatg

SEQ ID NO: 9464213 - DNA, 22 bp, Homo sapiens
tacttgctgggtgtaattttct

SEQ ID NO: 9464214 - DNA, 22 bp, Homo sapiens
tacttgctgttagtattttaca

SEQ ID NO: 9464215 - DNA, 22 bp, Homo sapiens
tacttgcttggatttcaccaga

SEQ ID NO: 9464216 - DNA, 22 bp, Homo sapiens
tactttctaagacatacaactt

SEQ ID NO: 9464217 - DNA, 22 bp, Homo sapiens
tagaagcagtaatagaaatagg

SEQ ID NO: 9464218 - DNA, 22 bp, Homo sapiens
tactttcttgttcctttcataa

SEQ ID NO: 9464219 - DNA, 22 bp, Homo sapiens
tactttcttgttcctttcataa

SEQ ID NO: 9464220 - DNA, 22 bp, Homo sapiens
tactttctttcccaagaggtgg

SEQ ID NO: 9464221 - DNA, 22 bp, Homo sapiens
tactttctttcccaagaggtgg

SEQ ID NO: 9464222 - DNA, 19 bp, Homo sapiens
tagaagcactaggcaaact

SEQ ID NO: 9464223 - DNA, 22 bp, Homo sapiens
tagaagcaccactcatcacgtg

SEQ ID NO: 9464224 - DNA, 23 bp, Homo sapiens
tagagcagccccgaggtgctgtc

SEQ ID NO: 9464225 - DNA, 22 bp, Homo sapiens
tagagcagccttcagagcagtt

SEQ ID NO: 9464226 - DNA, 22 bp, Homo sapiens
tagagatgtgatatagcagagt

SEQ ID NO: 9464227 - DNA, 22 bp, Homo sapiens
tagagatggggtcttgctatga

SEQ ID NO: 9464228 - DNA, 22 bp, Homo sapiens
tagagcaatgctctactccttg

SEQ ID NO: 9464229 - DNA, 21 bp, Homo sapiens
tagagatgtttgctaagtagc

SEQ ID NO: 9464230 - DNA, 22 bp, Homo sapiens
tagagcagaacttgttaacacc

SEQ ID NO: 9464231 - DNA, 22 bp, Homo sapiens
tagagcaatgctctactccttg

SEQ ID NO: 9464232 - DNA, 22 bp, Homo sapiens
tagagatgccctagctgaagta

SEQ ID NO: 9464233 - DNA, 22 bp, Homo sapiens
tagagatgccctagctgaagta

SEQ ID NO: 9464234 - DNA, 21 bp, Homo sapiens
tagagatgacgagctctagca

SEQ ID NO: 9464235 - DNA, 22 bp, Homo sapiens
tagagatgaattctgcagtctt

SEQ ID NO: 9464236 - DNA, 22 bp, Homo sapiens
tagaatctggaaggggctattc

SEQ ID NO: 9464237 - DNA, 22 bp, Homo sapiens
tagaatctgaatattcttattt

SEQ ID NO: 9464238 - DNA, 23 bp, Homo sapiens
tagaatctgtatttctgcagttc

SEQ ID NO: 9464239 - DNA, 22 bp, Homo sapiens
tagagctagcttcaaaatgcga

SEQ ID NO: 9464240 - DNA, 22 bp, Homo sapiens
tagagctatacactgagtaaaa

SEQ ID NO: 9464241 - DNA, 22 bp, Homo sapiens
tagagctagcttcaaaatgcga

SEQ ID NO: 9464242 - DNA, 22 bp, Homo sapiens
tagagcatttagaggggcagga

SEQ ID NO: 9464243 - DNA, 22 bp, Homo sapiens
tagagctgataatgaggccaag

SEQ ID NO: 9464244 - DNA, 22 bp, Homo sapiens
tagagctgataatgaggccaag

SEQ ID NO: 9464245 - DNA, 22 bp, Homo sapiens
tagagctatttagagcatttta

SEQ ID NO: 9464246 - DNA, 22 bp, Homo sapiens
tagagctatttatcagccagaa

SEQ ID NO: 9464247 - DNA, 22 bp, Homo sapiens
tagagcagttggcagctgtatt

SEQ ID NO: 9464248 - DNA, 22 bp, Homo sapiens
tagaggagggctgttcttcagt

SEQ ID NO: 9464249 - DNA, 22 bp, Homo sapiens
tagaggagggctgttcttcagt

SEQ ID NO: 9464250 - DNA, 22 bp, Homo sapiens
tagaggaggtgattcttgagct

SEQ ID NO: 9464251 - DNA, 22 bp, Homo sapiens
tagaggcaaccagtgttgagaa

SEQ ID NO: 9464252 - DNA, 22 bp, Homo sapiens
tagaggcacagtctatgtagag

SEQ ID NO: 9464253 - DNA, 22 bp, Homo sapiens
tagaggcaccctggaggagact

SEQ ID NO: 9464254 - DNA, 22 bp, Homo sapiens
tagaggatgcaggattgtttgt

SEQ ID NO: 9464255 - DNA, 22 bp, Homo sapiens
tagaggcaaccagtgttgagaa

SEQ ID NO: 9464256 - DNA, 22 bp, Homo sapiens
tagaggcaaccagtgttgagaa

SEQ ID NO: 9464257 - DNA, 22 bp, Homo sapiens
tagaggagagttgctggatgga

SEQ ID NO: 9464258 - DNA, 22 bp, Homo sapiens
tagaggagcggcgagctgagct

SEQ ID NO: 9464259 - DNA, 22 bp, Homo sapiens
tagatgatggaaaaaagcaata

SEQ ID NO: 9464260 - DNA, 22 bp, Homo sapiens
tagaggcaccctggaggagact

SEQ ID NO: 9464261 - DNA, 22 bp, Homo sapiens
tagatgattttcagtcaaagca

SEQ ID NO: 9464262 - DNA, 22 bp, Homo sapiens
tagatgattttcagtcaaagca

SEQ ID NO: 9464263 - DNA, 22 bp, Homo sapiens
tagatgatggaaaaaagcaata

SEQ ID NO: 9464264 - DNA, 22 bp, Homo sapiens
tagatgatggtaaaaagaagtt

SEQ ID NO: 9464265 - DNA, 22 bp, Homo sapiens
tagatgctgtagaaatacttat

SEQ ID NO: 9464266 - DNA, 22 bp, Homo sapiens
tagatgctgaaacatggaggcg

SEQ ID NO: 9464267 - DNA, 22 bp, Homo sapiens
tagatgcttcagaaggcctgca

SEQ ID NO: 9464268 - DNA, 22 bp, Homo sapiens
tagtcccggaactccttcaggt

SEQ ID NO: 9464269 - DNA, 22 bp, Homo sapiens
tagtccattttcacactgctga

SEQ ID NO: 9464270 - DNA, 22 bp, Homo sapiens
tagtccttgctgggcacagagt

SEQ ID NO: 9464271 - DNA, 22 bp, Homo sapiens
tagtcctgaccagctggatgtt

SEQ ID NO: 9464272 - DNA, 22 bp, Homo sapiens
tagtcctgaccttgccaccagc

SEQ ID NO: 9464273 - DNA, 22 bp, Homo sapiens
tagtccaggttaatccctgcct

SEQ ID NO: 9464274 - DNA, 22 bp, Homo sapiens
tagtccaggtttccatctccac

SEQ ID NO: 9464275 - DNA, 22 bp, Homo sapiens
tagtccagtaaaacagctaacg

SEQ ID NO: 9464276 - DNA, 22 bp, Homo sapiens
tagtccaggtttccatctccac

SEQ ID NO: 9464277 - DNA, 22 bp, Homo sapiens
tagtggcattgttgtgaggatt

SEQ ID NO: 9464278 - DNA, 17 bp, Homo sapiens
tagtggcaggaaatgaa

SEQ ID NO: 9464279 - DNA, 22 bp, Homo sapiens
tagtggggaaggaggacaagaa

SEQ ID NO: 9464280 - DNA, 22 bp, Homo sapiens
tagtggggaaggaggacaagaa

SEQ ID NO: 9464281 - DNA, 22 bp, Homo sapiens
tagtggatgggtaaagtatttt

SEQ ID NO: 9464282 - DNA, 19 bp, Homo sapiens
tagtggagtgacaagttct

SEQ ID NO: 9464283 - DNA, 22 bp, Homo sapiens
tagtggggaaggaggacaagaa

SEQ ID NO: 9464284 - DNA, 22 bp, Homo sapiens
tagtggggcctgggagggttcc

SEQ ID NO: 9464285 - DNA, 22 bp, Homo sapiens
tagtgggtgatttgatgaggaa

SEQ ID NO: 9464286 - DNA, 23 bp, Homo sapiens
tagtgtatatcaacatttgtccc

SEQ ID NO: 9464287 - DNA, 22 bp, Homo sapiens
tagtggggcctgggagggttcc

SEQ ID NO: 9464288 - DNA, 21 bp, Homo sapiens
tagtgtagctgcagcagcaga

SEQ ID NO: 9464289 - DNA, 22 bp, Homo sapiens
tagtgtaaacttatgctgagcc

SEQ ID NO: 9464290 - DNA, 22 bp, Homo sapiens
tagtcattctccttacaaagcc

SEQ ID NO: 9464291 - DNA, 22 bp, Homo sapiens
tagtccagaaactgagcttata

SEQ ID NO: 9464292 - DNA, 22 bp, Homo sapiens
tagtccagccttgggtgtagcc

SEQ ID NO: 9464293 - DNA, 22 bp, Homo sapiens
tagtcaggagtaggagttttgg

SEQ ID NO: 9464294 - DNA, 22 bp, Homo sapiens
tagtcagggatgcaattatgtg

SEQ ID NO: 9464295 - DNA, 22 bp, Homo sapiens
tagtcacatgatcacaggatcg

SEQ ID NO: 9464296 - DNA, 22 bp, Homo sapiens
tagtcacagtacaggataaaga

SEQ ID NO: 9464297 - DNA, 22 bp, Homo sapiens
tagtcacaggaagtttcaatgt

SEQ ID NO: 9464298 - DNA, 22 bp, Homo sapiens
tagtcacacaattgtgtacatt

SEQ ID NO: 9464299 - DNA, 22 bp, Homo sapiens
tagtcacacaattgtgtacatt

SEQ ID NO: 9464300 - DNA, 22 bp, Homo sapiens
tagtatttcctgtaagctatag

SEQ ID NO: 9464301 - DNA, 22 bp, Homo sapiens
tagtatttcctgtaagctatag

SEQ ID NO: 9464302 - DNA, 22 bp, Homo sapiens
tagtatttcctgtaagctatag

SEQ ID NO: 9464303 - DNA, 22 bp, Homo sapiens
tagtatttcctgtaagctatag

SEQ ID NO: 9464304 - DNA, 22 bp, Homo sapiens
tagtatttataatcatgcttaa

SEQ ID NO: 9464305 - DNA, 22 bp, Homo sapiens
tagtatctttctatatttccca

SEQ ID NO: 9464306 - DNA, 22 bp, Homo sapiens
tagtatttaatcacttttgtct

SEQ ID NO: 9464307 - DNA, 22 bp, Homo sapiens
tagtatttaatcacttttgtct

SEQ ID NO: 9464308 - DNA, 22 bp, Homo sapiens
tagtatttaatcacttttgtct

SEQ ID NO: 9464309 - DNA, 22 bp, Homo sapiens
tagtatttaatcacttttgtct

SEQ ID NO: 9464310 - DNA, 22 bp, Homo sapiens
tagtattttagaaaaccatgaa

SEQ ID NO: 9464311 - DNA, 20 bp, Homo sapiens
tagtatttgcataaggatag

SEQ ID NO: 9464312 - DNA, 20 bp, Homo sapiens
tagtatttgcataaggatag

SEQ ID NO: 9464313 - DNA, 22 bp, Homo sapiens
tagtatttgcagatttgtgtca

SEQ ID NO: 9464314 - DNA, 22 bp, Homo sapiens
tagtatttgcagatttgtgtca

SEQ ID NO: 9464315 - DNA, 22 bp, Homo sapiens
tagtcacaaccttcaagttgtc

SEQ ID NO: 9464316 - DNA, 22 bp, Homo sapiens
tagtcaagattggaataatgta

SEQ ID NO: 9464317 - DNA, 22 bp, Homo sapiens
tagtataattgttctggaatca

SEQ ID NO: 9464318 - DNA, 22 bp, Homo sapiens
tagtatagattgaagcagatca

SEQ ID NO: 9464319 - DNA, 22 bp, Homo sapiens
tagtatagattgaagcagatca

SEQ ID NO: 9464320 - DNA, 22 bp, Homo sapiens
tagtatagattgaagcagatca

SEQ ID NO: 9464321 - DNA, 22 bp, Homo sapiens
tagtatatctttagtacatagt

SEQ ID NO: 9464322 - DNA, 22 bp, Homo sapiens
tagtagcagggggtacctctca

SEQ ID NO: 9464323 - DNA, 22 bp, Homo sapiens
tagtagcaaaactcatctcttt

SEQ ID NO: 9464324 - DNA, 22 bp, Homo sapiens
tagtagtaattgttatcttatt

SEQ ID NO: 9464325 - DNA, 22 bp, Homo sapiens
tagtacttatctctgtcattgt

SEQ ID NO: 9464326 - DNA, 22 bp, Homo sapiens
tagtactacgttttctactatc

SEQ ID NO: 9464327 - DNA, 22 bp, Homo sapiens
tagtacagttttggcacatgga

SEQ ID NO: 9464328 - DNA, 22 bp, Homo sapiens
tagtactacgttttctactatc

SEQ ID NO: 9464329 - DNA, 22 bp, Homo sapiens
tagtaaaagtttagttgaaagt

SEQ ID NO: 9464330 - DNA, 22 bp, Homo sapiens
tagtaaaagtttagttgaaagt

SEQ ID NO: 9464331 - DNA, 22 bp, Homo sapiens
tagtaaaagtttagttgaaagt

SEQ ID NO: 9464332 - DNA, 22 bp, Homo sapiens
tagtaaacaggcaagggaccac

SEQ ID NO: 9464333 - DNA, 22 bp, Homo sapiens
tagtacagtttaaatattaata

SEQ ID NO: 9464334 - DNA, 22 bp, Homo sapiens
tagtaaaaagcaatggtgagta

SEQ ID NO: 9464335 - DNA, 22 bp, Homo sapiens
taggtttaggagtgaaggtgaa

SEQ ID NO: 9464336 - DNA, 22 bp, Homo sapiens
taggtttactgaattagtggaa

SEQ ID NO: 9464337 - DNA, 22 bp, Homo sapiens
taggtttaggagtgaaggtgaa

SEQ ID NO: 9464338 - DNA, 22 bp, Homo sapiens
taggtttaggagtgaaggtgaa

SEQ ID NO: 9464339 - DNA, 22 bp, Homo sapiens
taggtttaggagtgaaggtgaa

SEQ ID NO: 9464340 - DNA, 22 bp, Homo sapiens
taggtttactgaattagtggaa

SEQ ID NO: 9464341 - DNA, 22 bp, Homo sapiens
taggttctctattgcccccaaa

SEQ ID NO: 9464342 - DNA, 22 bp, Homo sapiens
taggttccatttaaacaaagaa

SEQ ID NO: 9464343 - DNA, 22 bp, Homo sapiens
taggttccatgagggaggcaaa

SEQ ID NO: 9464344 - DNA, 22 bp, Homo sapiens
taggtgtgattcgaagagcaaa

SEQ ID NO: 9464345 - DNA, 22 bp, Homo sapiens
taggtgtgggctcaggaatgtg

SEQ ID NO: 9464346 - DNA, 22 bp, Homo sapiens
taggtgtgattcgaagagcaaa

SEQ ID NO: 9464347 - DNA, 22 bp, Homo sapiens
taggttcaagttcaggctctat

SEQ ID NO: 9464348 - DNA, 22 bp, Homo sapiens
taggctgggagcctgaggctag

SEQ ID NO: 9464349 - DNA, 22 bp, Homo sapiens
taggctgggaagaaagattctc

SEQ ID NO: 9464350 - DNA, 22 bp, Homo sapiens
taggctgagctaagagagctta

SEQ ID NO: 9464351 - DNA, 22 bp, Homo sapiens
taggctgacttgtttcataaag

SEQ ID NO: 9464352 - DNA, 22 bp, Homo sapiens
taggctgagcttgtagatcgta

SEQ ID NO: 9464353 - DNA, 22 bp, Homo sapiens
taggctgaggttgatgccaggg

SEQ ID NO: 9464354 - DNA, 22 bp, Homo sapiens
taggctgctcaccaggctcaga

SEQ ID NO: 9464355 - DNA, 22 bp, Homo sapiens
taggctggaacttaggcagagg

SEQ ID NO: 9464356 - DNA, 22 bp, Homo sapiens
taggctggaacttaggcagagg

SEQ ID NO: 9464357 - DNA, 22 bp, Homo sapiens
taggctggaggaagcagtgcct

SEQ ID NO: 9464358 - DNA, 18 bp, Homo sapiens
taggaagcttaatgtttt

SEQ ID NO: 9464359 - DNA, 22 bp, Homo sapiens
taggaagctctttgttttgtga

SEQ ID NO: 9464360 - DNA, 22 bp, Homo sapiens
taggaagcctaaattaagtggt

SEQ ID NO: 9464361 - DNA, 22 bp, Homo sapiens
taggaagataaacatttgtatg

SEQ ID NO: 9464362 - DNA, 22 bp, Homo sapiens
taggaagagctataggtcccca

SEQ ID NO: 9464363 - DNA, 22 bp, Homo sapiens
taggaagataaacatttgtatg

SEQ ID NO: 9464364 - DNA, 23 bp, Homo sapiens
taggaagacagcaaaagaatgga

SEQ ID NO: 9464365 - DNA, 22 bp, Homo sapiens
taggaagagctataggtcccca

SEQ ID NO: 9464366 - DNA, 22 bp, Homo sapiens
taggaagatgagtatcaacttg

SEQ ID NO: 9464367 - DNA, 22 bp, Homo sapiens
taggaagatgagtatcaacttg

SEQ ID NO: 9464368 - DNA, 22 bp, Homo sapiens
taggaagatgagtatcaacttg

SEQ ID NO: 9464369 - DNA, 22 bp, Homo sapiens
taggaagatcaagtttatctca

SEQ ID NO: 9464370 - DNA, 22 bp, Homo sapiens
taggaagatcaagtttatctca

SEQ ID NO: 9464371 - DNA, 22 bp, Homo sapiens
taggaagatcaagtttatctca

SEQ ID NO: 9464372 - DNA, 22 bp, Homo sapiens
taggaaatgctccattgcataa

SEQ ID NO: 9464373 - DNA, 22 bp, Homo sapiens
taggaaatgctccattgcataa

SEQ ID NO: 9464374 - DNA, 22 bp, Homo sapiens
taggaaatgctgtcttattgta

SEQ ID NO: 9464375 - DNA, 22 bp, Homo sapiens
taggaaatggctcagttactgc

SEQ ID NO: 9464376 - DNA, 22 bp, Homo sapiens
taggaaatgctgtcttattgta

SEQ ID NO: 9464377 - DNA, 22 bp, Homo sapiens
taggaaatgctgtcttattgta

SEQ ID NO: 9464378 - DNA, 22 bp, Homo sapiens
taggaaatgctgtcttattgta

SEQ ID NO: 9464379 - DNA, 22 bp, Homo sapiens
taggaaatgctccattgcataa

SEQ ID NO: 9464380 - DNA, 22 bp, Homo sapiens
taggaaatgctccattgcataa

SEQ ID NO: 9464381 - DNA, 22 bp, Homo sapiens
taggaaatgccagccttcctcc

SEQ ID NO: 9464382 - DNA, 22 bp, Homo sapiens
taggaaatgaggccaacatgtg

SEQ ID NO: 9464383 - DNA, 22 bp, Homo sapiens
taggaaatgaatgcaggctccc

SEQ ID NO: 9464384 - DNA, 23 bp, Homo sapiens
taggaagacagcaaaagaatgga

SEQ ID NO: 9464385 - DNA, 23 bp, Homo sapiens
taggaagacagcaaaagaatgga

SEQ ID NO: 9464386 - DNA, 22 bp, Homo sapiens
taggaagaagcagccttgctta

SEQ ID NO: 9464387 - DNA, 22 bp, Homo sapiens
taggaagaaactttccctgcag

SEQ ID NO: 9464388 - DNA, 22 bp, Homo sapiens
taggaagaaactttccctgcag

SEQ ID NO: 9464389 - DNA, 22 bp, Homo sapiens
taggaagaaactttccctgcag

SEQ ID NO: 9464390 - DNA, 22 bp, Homo sapiens
taggaaatggctcagttactgc

SEQ ID NO: 9464391 - DNA, 22 bp, Homo sapiens
taggaaatggctcagttactgc

SEQ ID NO: 9464392 - DNA, 22 bp, Homo sapiens
taggaaatggctcagttactgc

SEQ ID NO: 9464393 - DNA, 22 bp, Homo sapiens
taggaaagcagtagagccagga

SEQ ID NO: 9464394 - DNA, 22 bp, Homo sapiens
taggaaataattcactctggct

SEQ ID NO: 9464395 - DNA, 22 bp, Homo sapiens
taggaaataattcactctggct

SEQ ID NO: 9464396 - DNA, 22 bp, Homo sapiens
taggaaataaatacttatggtt

SEQ ID NO: 9464397 - DNA, 22 bp, Homo sapiens
taggaaataaatacttatggtt

SEQ ID NO: 9464398 - DNA, 20 bp, Homo sapiens
taggaaatatgtttttaccc

SEQ ID NO: 9464399 - DNA, 18 bp, Homo sapiens
taggaaatagggctgtga

SEQ ID NO: 9464400 - DNA, 20 bp, Homo sapiens
taggaaatatgtttttaccc

SEQ ID NO: 9464401 - DNA, 20 bp, Homo sapiens
taggaaatatgtttttaccc

SEQ ID NO: 9464402 - DNA, 20 bp, Homo sapiens
taggaaatatgtttttaccc

SEQ ID NO: 9464403 - DNA, 18 bp, Homo sapiens
taggaaatagggctgtga

SEQ ID NO: 9464404 - DNA, 22 bp, Homo sapiens
taggaaatactgtaagtttggg

SEQ ID NO: 9464405 - DNA, 22 bp, Homo sapiens
taggaaatactgtaagtttggg

SEQ ID NO: 9464406 - DNA, 22 bp, Homo sapiens
taggaaataattcactctggct

SEQ ID NO: 9464407 - DNA, 22 bp, Homo sapiens
taggaaatattgatttcagtca

SEQ ID NO: 9464408 - DNA, 22 bp, Homo sapiens
taggaaatattgatttcagtca

SEQ ID NO: 9464409 - DNA, 22 bp, Homo sapiens
taggaaatatttgaacatagga

SEQ ID NO: 9464410 - DNA, 22 bp, Homo sapiens
taggaaatatttgaacatagga

SEQ ID NO: 9464411 - DNA, 22 bp, Homo sapiens
taggaaatatttgaacatagga

SEQ ID NO: 9464412 - DNA, 22 bp, Homo sapiens
taggaaatcagagaaagaggtg

SEQ ID NO: 9464413 - DNA, 22 bp, Homo sapiens
taggaaatcagagaaagaggtg

SEQ ID NO: 9464414 - DNA, 22 bp, Homo sapiens
taggaaatatttgaacatagga

SEQ ID NO: 9464415 - DNA, 22 bp, Homo sapiens
taggaaatcagagaaagaggtg

SEQ ID NO: 9464416 - DNA, 20 bp, Homo sapiens
taggaaatcgaggcagggtg

SEQ ID NO: 9464417 - DNA, 20 bp, Homo sapiens
taggaaatcgaggcagggtg

SEQ ID NO: 9464418 - DNA, 20 bp, Homo sapiens
taggaaatcgaggcagggtg

SEQ ID NO: 9464419 - DNA, 22 bp, Homo sapiens
taggaaatgaatgcaggctccc

SEQ ID NO: 9464420 - DNA, 22 bp, Homo sapiens
taggaaatgaatgcaggctccc

SEQ ID NO: 9464421 - DNA, 22 bp, Homo sapiens
tagcccagatgattgaaccatg

SEQ ID NO: 9464422 - DNA, 22 bp, Homo sapiens
tagcccagatgattgaaccatg

SEQ ID NO: 9464423 - DNA, 16 bp, Homo sapiens
taggaaactgcatgtg

SEQ ID NO: 9464424 - DNA, 22 bp, Homo sapiens
taggaaactctcagctggtcat

SEQ ID NO: 9464425 - DNA, 22 bp, Homo sapiens
taggaaagaaatgagtagtgat

SEQ ID NO: 9464426 - DNA, 22 bp, Homo sapiens
tagcccagaagagggaagcaac

SEQ ID NO: 9464427 - DNA, 19 bp, Homo sapiens
tagcccagagcctggctac

SEQ ID NO: 9464428 - DNA, 19 bp, Homo sapiens
tagcccagagcctggctac

SEQ ID NO: 9464429 - DNA, 19 bp, Homo sapiens
tagcccagagcctggctac

SEQ ID NO: 9464430 - DNA, 19 bp, Homo sapiens
tagcccagagcctggctac

SEQ ID NO: 9464431 - DNA, 22 bp, Homo sapiens
taggctcacatagcactaagtg

SEQ ID NO: 9464432 - DNA, 22 bp, Homo sapiens
taggctgaaaggagaggtgaag

SEQ ID NO: 9464433 - DNA, 22 bp, Homo sapiens
taggctcctgagtccacagcac

SEQ ID NO: 9464434 - DNA, 23 bp, Homo sapiens
taggctctgtaggtagagatggg

SEQ ID NO: 9464435 - DNA, 22 bp, Homo sapiens
taggctcctgaggactccatgc

SEQ ID NO: 9464436 - DNA, 22 bp, Homo sapiens
taggctcccagatcgtttgctg

SEQ ID NO: 9464437 - DNA, 22 bp, Homo sapiens
taggctcctctcacattctatt

SEQ ID NO: 9464438 - DNA, 22 bp, Homo sapiens
taggctccaagagcgaactcag

SEQ ID NO: 9464439 - DNA, 22 bp, Homo sapiens
taggctccagtgtgtggcgagt

SEQ ID NO: 9464440 - DNA, 22 bp, Homo sapiens
taggctcagtgagtagggagtt

SEQ ID NO: 9464441 - DNA, 19 bp, Homo sapiens
taggccctagctctgcagt

SEQ ID NO: 9464442 - DNA, 19 bp, Homo sapiens
taggccctagctctgcagt

SEQ ID NO: 9464443 - DNA, 22 bp, Homo sapiens
taggcctcaggaccccagggct

SEQ ID NO: 9464444 - DNA, 23 bp, Homo sapiens
taggcctccctggagcacccagc

SEQ ID NO: 9464445 - DNA, 22 bp, Homo sapiens
taggcctggatctctgggagca

SEQ ID NO: 9464446 - DNA, 20 bp, Homo sapiens
taggacagggcctggcttct

SEQ ID NO: 9464447 - DNA, 20 bp, Homo sapiens
taggacagggcctggcttct

SEQ ID NO: 9464448 - DNA, 22 bp, Homo sapiens
taggacagggacatctttttga

SEQ ID NO: 9464449 - DNA, 20 bp, Homo sapiens
taggacagggcctggcttct

SEQ ID NO: 9464450 - DNA, 22 bp, Homo sapiens
taggacagggacatctttttga

SEQ ID NO: 9464451 - DNA, 22 bp, Homo sapiens
taggcccagttccgcctcccgg

SEQ ID NO: 9464452 - DNA, 22 bp, Homo sapiens
taggacaggctaaaagggataa

SEQ ID NO: 9464453 - DNA, 20 bp, Homo sapiens
taggacaggcagccgagggg

SEQ ID NO: 9464454 - DNA, 22 bp, Homo sapiens
taggacaggctaaaagggataa

SEQ ID NO: 9464455 - DNA, 23 bp, Homo sapiens
taggacagaatgcagaaaaatac

SEQ ID NO: 9464456 - DNA, 22 bp, Homo sapiens
taggacaggatcatgatgctgg

SEQ ID NO: 9464457 - DNA, 22 bp, Homo sapiens
taggacagagttccctgatggc

SEQ ID NO: 9464458 - DNA, 21 bp, Homo sapiens
taggacagcccccctgccctc

SEQ ID NO: 9464459 - DNA, 22 bp, Homo sapiens
taggacaggatcatgatgctgg

SEQ ID NO: 9464460 - DNA, 22 bp, Homo sapiens
taggaatgggcaagacaaagaa

SEQ ID NO: 9464461 - DNA, 22 bp, Homo sapiens
taggaatgcagatgcataataa

SEQ ID NO: 9464462 - DNA, 22 bp, Homo sapiens
taggaatgtctatgcagtgagg

SEQ ID NO: 9464463 - DNA, 19 bp, Homo sapiens
taggaatgtagaatcctag

SEQ ID NO: 9464464 - DNA, 22 bp, Homo sapiens
taggacagagctggttacaatg

SEQ ID NO: 9464465 - DNA, 22 bp, Homo sapiens
taggacagagatttgttttatg

SEQ ID NO: 9464466 - DNA, 23 bp, Homo sapiens
taggacagaatgcagaaaaatac

SEQ ID NO: 9464467 - DNA, 22 bp, Homo sapiens
taggacagagatttgttttatg

SEQ ID NO: 9464468 - DNA, 22 bp, Homo sapiens
taggaatttttgtaatggtact

SEQ ID NO: 9464469 - DNA, 22 bp, Homo sapiens
taggaattatgatgctatcaag

SEQ ID NO: 9464470 - DNA, 22 bp, Homo sapiens
taggaatgtttttatcaactta

SEQ ID NO: 9464471 - DNA, 22 bp, Homo sapiens
taggaatgaagaagtatgatat

SEQ ID NO: 9464472 - DNA, 22 bp, Homo sapiens
taggaaggtccatgtcttatct

SEQ ID NO: 9464473 - DNA, 22 bp, Homo sapiens
taggaatgagaaagaattagat

SEQ ID NO: 9464474 - DNA, 22 bp, Homo sapiens
taggaatgattggaattccagg

SEQ ID NO: 9464475 - DNA, 22 bp, Homo sapiens
taggaaggaggccatcttggcg

SEQ ID NO: 9464476 - DNA, 22 bp, Homo sapiens
taggaaggtgtttttaaggagc

SEQ ID NO: 9464477 - DNA, 22 bp, Homo sapiens
tatgttatattttgtcaattgt

SEQ ID NO: 9464478 - DNA, 22 bp, Homo sapiens
tatgttaacatgttaggaactg

SEQ ID NO: 9464479 - DNA, 22 bp, Homo sapiens
tatgttaagtgggataatcaaa

SEQ ID NO: 9464480 - DNA, 22 bp, Homo sapiens
tatgttaagtgggataatcaaa

SEQ ID NO: 9464481 - DNA, 22 bp, Homo sapiens
tatgttacaaagtttttctaaa

SEQ ID NO: 9464482 - DNA, 22 bp, Homo sapiens
tatgttactcacatgttcttgc

SEQ ID NO: 9464483 - DNA, 22 bp, Homo sapiens
tatgttaagtgggataatcaaa

SEQ ID NO: 9464484 - DNA, 22 bp, Homo sapiens
tatgttaagtgggataatcaaa

SEQ ID NO: 9464485 - DNA, 22 bp, Homo sapiens
tatgttaagtgggataatcaaa

SEQ ID NO: 9464486 - DNA, 22 bp, Homo sapiens
tatgttaagtgggataatcaaa

SEQ ID NO: 9464487 - DNA, 22 bp, Homo sapiens
tatgttcatagaaatcatgacc

SEQ ID NO: 9464488 - DNA, 22 bp, Homo sapiens
tatgttattttcatacaacaga

SEQ ID NO: 9464489 - DNA, 22 bp, Homo sapiens
tatgttattttcatacaacaga

SEQ ID NO: 9464490 - DNA, 22 bp, Homo sapiens
tatgttattttcatacaacaga

SEQ ID NO: 9464491 - DNA, 22 bp, Homo sapiens
tatgttcatctggtgcatcagt

SEQ ID NO: 9464492 - DNA, 22 bp, Homo sapiens
tatgttgcaccaacctaataat

SEQ ID NO: 9464493 - DNA, 22 bp, Homo sapiens
tatgttgagtgaaagaagctag

SEQ ID NO: 9464494 - DNA, 22 bp, Homo sapiens
tatgttctctgctctaggatgt

SEQ ID NO: 9464495 - DNA, 22 bp, Homo sapiens
tatgttctgactctacatggga

SEQ ID NO: 9464496 - DNA, 22 bp, Homo sapiens
tatgtttacgctggtagaatta

SEQ ID NO: 9464497 - DNA, 22 bp, Homo sapiens
tatgtttagtatccattttcag

SEQ ID NO: 9464498 - DNA, 22 bp, Homo sapiens
tatgtttacgctggtagaatta

SEQ ID NO: 9464499 - DNA, 22 bp, Homo sapiens
tatgtttacgctggtagaatta

SEQ ID NO: 9464500 - DNA, 22 bp, Homo sapiens
tatgtttaaatgtatgtgtatg

SEQ ID NO: 9464501 - DNA, 22 bp, Homo sapiens
tatgtttaaatgtatgtgtatg

SEQ ID NO: 9464502 - DNA, 22 bp, Homo sapiens
tatgctgagtatataaaacaga

SEQ ID NO: 9464503 - DNA, 22 bp, Homo sapiens
tatgctaagtgagaaaagacag

SEQ ID NO: 9464504 - DNA, 22 bp, Homo sapiens
tatgctaactgggggaaaagag

SEQ ID NO: 9464505 - DNA, 22 bp, Homo sapiens
tatgctaaatatgttcacattg

SEQ ID NO: 9464506 - DNA, 22 bp, Homo sapiens
tatgcgtgcctctgtctgtctg

SEQ ID NO: 9464507 - DNA, 22 bp, Homo sapiens
tatgccactgctctccatccta

SEQ ID NO: 9464508 - DNA, 22 bp, Homo sapiens
tatgccagcacttagatgagat

SEQ ID NO: 9464509 - DNA, 22 bp, Homo sapiens
tatgccgcagccggatttcccc

SEQ ID NO: 9464510 - DNA, 22 bp, Homo sapiens
tatgcctggggtgctcaggcca

SEQ ID NO: 9464511 - DNA, 22 bp, Homo sapiens
tatgcctggaacctttctcttt

SEQ ID NO: 9464512 - DNA, 22 bp, Homo sapiens
tatgtgtttgacaccctgcaag

SEQ ID NO: 9464513 - DNA, 17 bp, Homo sapiens
tatgtgtgtttgcagca

SEQ ID NO: 9464514 - DNA, 22 bp, Homo sapiens
tatgtgtttgacaccctgcaag

SEQ ID NO: 9464515 - DNA, 22 bp, Homo sapiens
tatgctttaacattaaacaaca

SEQ ID NO: 9464516 - DNA, 22 bp, Homo sapiens
tatgctttaacattaaacaaca

SEQ ID NO: 9464517 - DNA, 16 bp, Homo sapiens
tatgtgtgtgggagtg

SEQ ID NO: 9464518 - DNA, 17 bp, Homo sapiens
tatgtgtgtgtttatac

SEQ ID NO: 9464519 - DNA, 17 bp, Homo sapiens
tatgtgtgtgtttatac

SEQ ID NO: 9464520 - DNA, 22 bp, Homo sapiens
tatgtttatactttgatgtact

SEQ ID NO: 9464521 - DNA, 22 bp, Homo sapiens
tattcaaagtaccttcattgcc

SEQ ID NO: 9464522 - DNA, 22 bp, Homo sapiens
tattcaaagtaccttcattgcc

SEQ ID NO: 9464523 - DNA, 22 bp, Homo sapiens
tattcaagattgaactggcaga

SEQ ID NO: 9464524 - DNA, 20 bp, Homo sapiens
tattcaactttaaaaactta

SEQ ID NO: 9464525 - DNA, 20 bp, Homo sapiens
tattcaactttaaaaactta

SEQ ID NO: 9464526 - DNA, 22 bp, Homo sapiens
tattcaaagtgcgaggtcaggg

SEQ ID NO: 9464527 - DNA, 22 bp, Homo sapiens
tattcaaagtgcgaggtcaggg

SEQ ID NO: 9464528 - DNA, 22 bp, Homo sapiens
tattcacaggcacgaaatattg

SEQ ID NO: 9464529 - DNA, 22 bp, Homo sapiens
tattcacaggcacgaaatattg

SEQ ID NO: 9464530 - DNA, 22 bp, Homo sapiens
tattcacaggcacgaaatattg

SEQ ID NO: 9464531 - DNA, 22 bp, Homo sapiens
tattcacaggcacgaaatattg

SEQ ID NO: 9464532 - DNA, 22 bp, Homo sapiens
tattcacaggcacgaaatattg

SEQ ID NO: 9464533 - DNA, 22 bp, Homo sapiens
tattcacaggcacgaaatattg

SEQ ID NO: 9464534 - DNA, 22 bp, Homo sapiens
tattcacagctgccgcactcag

SEQ ID NO: 9464535 - DNA, 22 bp, Homo sapiens
tattcacagctgccgcactcag

SEQ ID NO: 9464536 - DNA, 22 bp, Homo sapiens
tattcacagctgccgcactcag

SEQ ID NO: 9464537 - DNA, 22 bp, Homo sapiens
tattcacaaaatgaggtcctca

SEQ ID NO: 9464538 - DNA, 22 bp, Homo sapiens
tattcacaaaatgaggtcctca

SEQ ID NO: 9464539 - DNA, 22 bp, Homo sapiens
tattcacaaaatgaggtcctca

SEQ ID NO: 9464540 - DNA, 22 bp, Homo sapiens
tattcacaaaatgaggtcctca

SEQ ID NO: 9464541 - DNA, 22 bp, Homo sapiens
tattcacaggctggagtgatgt

SEQ ID NO: 9464542 - DNA, 22 bp, Homo sapiens
tattcacaggctggagtgatgt

SEQ ID NO: 9464543 - DNA, 22 bp, Homo sapiens
tattcacaggctggagtgatgt

SEQ ID NO: 9464544 - DNA, 22 bp, Homo sapiens
tattcacaggttccggagatta

SEQ ID NO: 9464545 - DNA, 22 bp, Homo sapiens
tattcacaggttccggagatta

SEQ ID NO: 9464546 - DNA, 22 bp, Homo sapiens
tattcacaggttctggggatca

SEQ ID NO: 9464547 - DNA, 22 bp, Homo sapiens
tattcacaggctggagtgatgt

SEQ ID NO: 9464548 - DNA, 22 bp, Homo sapiens
tattcacaggttccggagatta

SEQ ID NO: 9464549 - DNA, 22 bp, Homo sapiens
tattcacagttgatttacagtt

SEQ ID NO: 9464550 - DNA, 22 bp, Homo sapiens
tattcacagttgatttacagtt

SEQ ID NO: 9464551 - DNA, 22 bp, Homo sapiens
tattcacatgaaaacaaatttt

SEQ ID NO: 9464552 - DNA, 22 bp, Homo sapiens
tattcacaggttctggggatca

SEQ ID NO: 9464553 - DNA, 22 bp, Homo sapiens
tattcacaggttctggggatca

SEQ ID NO: 9464554 - DNA, 22 bp, Homo sapiens
tattcacagttgatttacagtt

SEQ ID NO: 9464555 - DNA, 22 bp, Homo sapiens
tattcacagttgatttacagtt

SEQ ID NO: 9464556 - DNA, 22 bp, Homo sapiens
tattcacatgaaaacaaatttt

SEQ ID NO: 9464557 - DNA, 22 bp, Homo sapiens
tattcacatgaaaacaaatttt

SEQ ID NO: 9464558 - DNA, 22 bp, Homo sapiens
tattcacatgtacatatgctca

SEQ ID NO: 9464559 - DNA, 22 bp, Homo sapiens
tattcacatgaaaacaaatttt

SEQ ID NO: 9464560 - DNA, 22 bp, Homo sapiens
tattcacatgaaaacaaatttt

SEQ ID NO: 9464561 - DNA, 22 bp, Homo sapiens
tattcacatgaaaacaaatttt

SEQ ID NO: 9464562 - DNA, 22 bp, Homo sapiens
tattcacatgtacatatgctca

SEQ ID NO: 9464563 - DNA, 22 bp, Homo sapiens
tattcacatgtacatatgctca

SEQ ID NO: 9464564 - DNA, 22 bp, Homo sapiens
tattcacattaataagtcttca

SEQ ID NO: 9464565 - DNA, 22 bp, Homo sapiens
tattcacattaataagtcttca

SEQ ID NO: 9464566 - DNA, 22 bp, Homo sapiens
tattcacatgtacatatgctca

SEQ ID NO: 9464567 - DNA, 22 bp, Homo sapiens
tattcacatgtacatatgctca

SEQ ID NO: 9464568 - DNA, 22 bp, Homo sapiens
tattcacattaataagtcttca

SEQ ID NO: 9464569 - DNA, 22 bp, Homo sapiens
tattcagaggtgaagtagggag

SEQ ID NO: 9464570 - DNA, 22 bp, Homo sapiens
tattcagagtattccatgaggt

SEQ ID NO: 9464571 - DNA, 22 bp, Homo sapiens
tattcagattacttgtgcctgc

SEQ ID NO: 9464572 - DNA, 22 bp, Homo sapiens
tattcagtgacagggtattatg

SEQ ID NO: 9464573 - DNA, 22 bp, Homo sapiens
tattcagtgcgggaactcagcc

SEQ ID NO: 9464574 - DNA, 22 bp, Homo sapiens
tattcagaaaactgagcgatga

SEQ ID NO: 9464575 - DNA, 22 bp, Homo sapiens
tattcagaaaataaattggatt

SEQ ID NO: 9464576 - DNA, 22 bp, Homo sapiens
tattcagaaaataaattggatt

SEQ ID NO: 9464577 - DNA, 22 bp, Homo sapiens
tattcacattctcaggcctggt

SEQ ID NO: 9464578 - DNA, 22 bp, Homo sapiens
tattcacattaataagtcttca

SEQ ID NO: 9464579 - DNA, 22 bp, Homo sapiens
tattcacattctcaggcctggt

SEQ ID NO: 9464580 - DNA, 22 bp, Homo sapiens
tattcacattctcaggcctggt

SEQ ID NO: 9464581 - DNA, 22 bp, Homo sapiens
tattcacattctcaggcctggt

SEQ ID NO: 9464582 - DNA, 22 bp, Homo sapiens
tattcacattctcaggcctggt

SEQ ID NO: 9464583 - DNA, 22 bp, Homo sapiens
tattgagacttccagtatatga

SEQ ID NO: 9464584 - DNA, 22 bp, Homo sapiens
tattgactaaattggaaagaat

SEQ ID NO: 9464585 - DNA, 17 bp, Homo sapiens
tattgacctttgtatgt

SEQ ID NO: 9464586 - DNA, 22 bp, Homo sapiens
tattgaccagactgacacacat

SEQ ID NO: 9464587 - DNA, 22 bp, Homo sapiens
tattgacatttttatagcttga

SEQ ID NO: 9464588 - DNA, 22 bp, Homo sapiens
tattcatattgtaaaagaagtg

SEQ ID NO: 9464589 - DNA, 22 bp, Homo sapiens
tattgaggtgcttagctggggg

SEQ ID NO: 9464590 - DNA, 22 bp, Homo sapiens
tattgaggatctcctgctaatt

SEQ ID NO: 9464591 - DNA, 20 bp, Homo sapiens
tattgagtacctactgtata

SEQ ID NO: 9464592 - DNA, 22 bp, Homo sapiens
tattgatctggatatttagaca

SEQ ID NO: 9464593 - DNA, 22 bp, Homo sapiens
tattgaggaaacagagcaggca

SEQ ID NO: 9464594 - DNA, 22 bp, Homo sapiens
tattgatatgcagaactgactt

SEQ ID NO: 9464595 - DNA, 22 bp, Homo sapiens
tatttgtatgtgtgtacatata

SEQ ID NO: 9464596 - DNA, 22 bp, Homo sapiens
tatttgtatgtgtgtacatata

SEQ ID NO: 9464597 - DNA, 22 bp, Homo sapiens
tatttgtatgtgtgtacatata

SEQ ID NO: 9464598 - DNA, 22 bp, Homo sapiens
tatttgtatgtgtgtacatata

SEQ ID NO: 9464599 - DNA, 22 bp, Homo sapiens
tatttgtagcttcccaaagctt

SEQ ID NO: 9464600 - DNA, 22 bp, Homo sapiens
tatttgtagaatggattaaggg

SEQ ID NO: 9464601 - DNA, 22 bp, Homo sapiens
tatttgtagaatggattaaggg

SEQ ID NO: 9464602 - DNA, 22 bp, Homo sapiens
tatttgtagaatggattaaggg

SEQ ID NO: 9464603 - DNA, 22 bp, Homo sapiens
tatttgtatgtgtgtacatata

SEQ ID NO: 9464604 - DNA, 22 bp, Homo sapiens
tatttgtatgtgtgtacatata

SEQ ID NO: 9464605 - DNA, 22 bp, Homo sapiens
tatttgtagaatggattaaggg

SEQ ID NO: 9464606 - DNA, 22 bp, Homo sapiens
tatttctaagctgtaagtctga

SEQ ID NO: 9464607 - DNA, 22 bp, Homo sapiens
tatttggaggccactgttgagt

SEQ ID NO: 9464608 - DNA, 22 bp, Homo sapiens
tatttctaagagatatctgtac

SEQ ID NO: 9464609 - DNA, 22 bp, Homo sapiens
tatttctaagagatatctgtac

SEQ ID NO: 9464610 - DNA, 22 bp, Homo sapiens
tatttcctgtggatacttttag

SEQ ID NO: 9464611 - DNA, 22 bp, Homo sapiens
tatttccatgttagaactaagt

SEQ ID NO: 9464612 - DNA, 22 bp, Homo sapiens
tatttccaggccccactctaga

SEQ ID NO: 9464613 - DNA, 22 bp, Homo sapiens
tattttcaccatgtatccctgt

SEQ ID NO: 9464614 - DNA, 22 bp, Homo sapiens
tattttcaccttctctggatat

SEQ ID NO: 9464615 - DNA, 22 bp, Homo sapiens
tcaaaaatggtctttgagctgc

SEQ ID NO: 9464616 - DNA, 22 bp, Homo sapiens
tattttcattctgtgtgactgt

SEQ ID NO: 9464617 - DNA, 22 bp, Homo sapiens
tattttcatcttgtccttggat

SEQ ID NO: 9464618 - DNA, 22 bp, Homo sapiens
tattttcatcttgtccttggat

SEQ ID NO: 9464619 - DNA, 22 bp, Homo sapiens
tatttgtatttcatgcagtaaa

SEQ ID NO: 9464620 - DNA, 22 bp, Homo sapiens
tatttgtatttcatgcagtaaa

SEQ ID NO: 9464621 - DNA, 22 bp, Homo sapiens
tatttgtatttcatgcagtaaa

SEQ ID NO: 9464622 - DNA, 22 bp, Homo sapiens
tatttgtatttcatgcagtaaa

SEQ ID NO: 9464623 - DNA, 22 bp, Homo sapiens
tatttgtatttcatgcagtaaa

SEQ ID NO: 9464624 - DNA, 20 bp, Homo sapiens
tatttgtatttgggaaagtt

SEQ ID NO: 9464625 - DNA, 20 bp, Homo sapiens
tatttgtatttgggaaagtt

SEQ ID NO: 9464626 - DNA, 22 bp, Homo sapiens
tatttgtccaggtaaatttcag

SEQ ID NO: 9464627 - DNA, 22 bp, Homo sapiens
tatttgtcactgcacttgaaat

SEQ ID NO: 9464628 - DNA, 22 bp, Homo sapiens
tatttgttccagagataaaaat

SEQ ID NO: 9464629 - DNA, 22 bp, Homo sapiens
tatttgttgagttgttatgtct

SEQ ID NO: 9464630 - DNA, 22 bp, Homo sapiens
tatttgttgagttgttatgtct

SEQ ID NO: 9464631 - DNA, 22 bp, Homo sapiens
tattgcatccccattgtgcccc

SEQ ID NO: 9464632 - DNA, 22 bp, Homo sapiens
tattgcagacaaaatgagctac

SEQ ID NO: 9464633 - DNA, 23 bp, Homo sapiens
tattgcacacatagaaacataga

SEQ ID NO: 9464634 - DNA, 22 bp, Homo sapiens
tattggtttattgtgtatgaga

SEQ ID NO: 9464635 - DNA, 22 bp, Homo sapiens
tattgtacatggttatgcagga

SEQ ID NO: 9464636 - DNA, 22 bp, Homo sapiens
tattgtacatggttatgcagga

SEQ ID NO: 9464637 - DNA, 22 bp, Homo sapiens
tattgtacatttcaaagtagct

SEQ ID NO: 9464638 - DNA, 22 bp, Homo sapiens
tattgtacatttcaaagtagct

SEQ ID NO: 9464639 - DNA, 22 bp, Homo sapiens
tattggtcttctgttccctatt

SEQ ID NO: 9464640 - DNA, 22 bp, Homo sapiens
tattgggtaaagatccagtttt

SEQ ID NO: 9464641 - DNA, 22 bp, Homo sapiens
tattgggtaaagatccagtttt

SEQ ID NO: 9464642 - DNA, 22 bp, Homo sapiens
tatttcaggctatatttcttgt

SEQ ID NO: 9464643 - DNA, 22 bp, Homo sapiens
tatttcagccctactacttggc

SEQ ID NO: 9464644 - DNA, 22 bp, Homo sapiens
tatttcagcaagaagaatgtgg

SEQ ID NO: 9464645 - DNA, 22 bp, Homo sapiens
tatttcagagttgttttctgtc

SEQ ID NO: 9464646 - DNA, 20 bp, Homo sapiens
tatttcactctccagatggc

SEQ ID NO: 9464647 - DNA, 20 bp, Homo sapiens
tatttcactctccagatggc

SEQ ID NO: 9464648 - DNA, 22 bp, Homo sapiens
tatttcaacgtatgaaaagctg

SEQ ID NO: 9464649 - DNA, 22 bp, Homo sapiens
tatttcaacgtatgaaaagctg

SEQ ID NO: 9464650 - DNA, 22 bp, Homo sapiens
tattgtatcttaccacatgtat

SEQ ID NO: 9464651 - DNA, 22 bp, Homo sapiens
tattgtatcttaccacatgtat

SEQ ID NO: 9464652 - DNA, 22 bp, Homo sapiens
tatttcaacgtatgaaaagctg

SEQ ID NO: 9464653 - DNA, 22 bp, Homo sapiens
tatttcaacgtatgaaaagctg

SEQ ID NO: 9464654 - DNA, 22 bp, Homo sapiens
tatttcaccaccgctgatgaag

SEQ ID NO: 9464655 - DNA, 22 bp, Homo sapiens
tatttcaccagtaggaggctgt

SEQ ID NO: 9464656 - DNA, 22 bp, Homo sapiens
tatttcacagcagctcatttaa

SEQ ID NO: 9464657 - DNA, 22 bp, Homo sapiens
tatttcacataccacagagtgt

SEQ ID NO: 9464658 - DNA, 22 bp, Homo sapiens
tatttcacataccacagagtgt

SEQ ID NO: 9464659 - DNA, 22 bp, Homo sapiens
tatcaatacatgttatcagtgt

SEQ ID NO: 9464660 - DNA, 22 bp, Homo sapiens
tatcaatacatgttatcagtgt

SEQ ID NO: 9464661 - DNA, 22 bp, Homo sapiens
tatcaatatctcagtgtgcttc

SEQ ID NO: 9464662 - DNA, 22 bp, Homo sapiens
tatcaattgggccaaatggtac

SEQ ID NO: 9464663 - DNA, 22 bp, Homo sapiens
tatctagatatttggataaatg

SEQ ID NO: 9464664 - DNA, 22 bp, Homo sapiens
tatcacaattcctatagtttgt

SEQ ID NO: 9464665 - DNA, 22 bp, Homo sapiens
tatcacaattcctatagtttgt

SEQ ID NO: 9464666 - DNA, 22 bp, Homo sapiens
tatcaatacatgttatcagtgt

SEQ ID NO: 9464667 - DNA, 21 bp, Homo sapiens
tatcaagatgttatggttgaa

SEQ ID NO: 9464668 - DNA, 22 bp, Homo sapiens
tatcaatacatgttatcagtgt

SEQ ID NO: 9464669 - DNA, 22 bp, Homo sapiens
tatcaatacatgttatcagtgt

SEQ ID NO: 9464670 - DNA, 17 bp, Homo sapiens
tatcaagaagtctggcc

SEQ ID NO: 9464671 - DNA, 22 bp, Homo sapiens
tatcaacaaaggccttgtgttt

SEQ ID NO: 9464672 - DNA, 22 bp, Homo sapiens
tatctgttggctcctagttgta

SEQ ID NO: 9464673 - DNA, 22 bp, Homo sapiens
tatctgttcttagctatagatg

SEQ ID NO: 9464674 - DNA, 22 bp, Homo sapiens
tatctgttcatgtttatatgtc

SEQ ID NO: 9464675 - DNA, 22 bp, Homo sapiens
tatctgttatgggctgaattgc

SEQ ID NO: 9464676 - DNA, 22 bp, Homo sapiens
tatctgttatgggctgaattgc

SEQ ID NO: 9464677 - DNA, 22 bp, Homo sapiens
tatctgttagctaatgaatgag

SEQ ID NO: 9464678 - DNA, 22 bp, Homo sapiens
tatctgttcatgtttatatgtc

SEQ ID NO: 9464679 - DNA, 22 bp, Homo sapiens
tatctgttcaatggaagatgac

SEQ ID NO: 9464680 - DNA, 22 bp, Homo sapiens
tatctgttatgggctgaattgc

SEQ ID NO: 9464681 - DNA, 22 bp, Homo sapiens
tatctagatggattttagtgaa

SEQ ID NO: 9464682 - DNA, 22 bp, Homo sapiens
tatctataagtactaacatggt

SEQ ID NO: 9464683 - DNA, 22 bp, Homo sapiens
tatctgtcacctgtagggtagg

SEQ ID NO: 9464684 - DNA, 23 bp, Homo sapiens
tatctgtatttgttcactgctgt

SEQ ID NO: 9464685 - DNA, 22 bp, Homo sapiens
tatctgtgaaatgtgtttgtat

SEQ ID NO: 9464686 - DNA, 22 bp, Homo sapiens
tatctgtctttatcaggattta

SEQ ID NO: 9464687 - DNA, 22 bp, Homo sapiens
tatattttagacaccctcacgc

SEQ ID NO: 9464688 - DNA, 22 bp, Homo sapiens
tatattttagacaccctcacgc

SEQ ID NO: 9464689 - DNA, 20 bp, Homo sapiens
tatattttctctttggcctt

SEQ ID NO: 9464690 - DNA, 19 bp, Homo sapiens
tatatttgttgaataaaaa

SEQ ID NO: 9464691 - DNA, 22 bp, Homo sapiens
tatattttagacaccctcacgc

SEQ ID NO: 9464692 - DNA, 19 bp, Homo sapiens
tatatttgttgaataaaaa

SEQ ID NO: 9464693 - DNA, 19 bp, Homo sapiens
tatatttgttgaataaaaa

SEQ ID NO: 9464694 - DNA, 20 bp, Homo sapiens
tatattttctctttggcctt

SEQ ID NO: 9464695 - DNA, 22 bp, Homo sapiens
tatcaaaaggagttgaaagggg

SEQ ID NO: 9464696 - DNA, 22 bp, Homo sapiens
tatcaaaaggagttgaaagggg

SEQ ID NO: 9464697 - DNA, 22 bp, Homo sapiens
tatcaaagttgtcctgtgaagt

SEQ ID NO: 9464698 - DNA, 22 bp, Homo sapiens
tatcaaaggctatgtgattttt

SEQ ID NO: 9464699 - DNA, 22 bp, Homo sapiens
tatcaaagttgtcctgtgaagt

SEQ ID NO: 9464700 - DNA, 22 bp, Homo sapiens
tatatttaaatccaggttgaaa

SEQ ID NO: 9464701 - DNA, 22 bp, Homo sapiens
tatattcaacaggctaatgtca

SEQ ID NO: 9464702 - DNA, 22 bp, Homo sapiens
tatattcaacaggctaatgtca

SEQ ID NO: 9464703 - DNA, 22 bp, Homo sapiens
tatattcaacaggctaatgtca

SEQ ID NO: 9464704 - DNA, 22 bp, Homo sapiens
tatatttaatcctagagccatt

SEQ ID NO: 9464705 - DNA, 22 bp, Homo sapiens
tatatttaatcctagagccatt

SEQ ID NO: 9464706 - DNA, 22 bp, Homo sapiens
tatatttaattagttgctggat

SEQ ID NO: 9464707 - DNA, 19 bp, Homo sapiens
tatatttgagtgtgcatgc

SEQ ID NO: 9464708 - DNA, 22 bp, Homo sapiens
tatatttgctaaatgtgtgcaa

SEQ ID NO: 9464709 - DNA, 22 bp, Homo sapiens
tatatttgctaaatgtgtgcaa

SEQ ID NO: 9464710 - DNA, 22 bp, Homo sapiens
tatatttgtgtgtgatttatga

SEQ ID NO: 9464711 - DNA, 18 bp, Homo sapiens
tatatttcacacatattc

SEQ ID NO: 9464712 - DNA, 22 bp, Homo sapiens
tatatttaattagttgctggat

SEQ ID NO: 9464713 - DNA, 18 bp, Homo sapiens
tatatttcacacatattc

SEQ ID NO: 9464714 - DNA, 23 bp, Homo sapiens
tatgccaaaatggaaagtgtata

SEQ ID NO: 9464715 - DNA, 22 bp, Homo sapiens
tatgccactgctctccatccta

SEQ ID NO: 9464716 - DNA, 22 bp, Homo sapiens
tatgccaaggatcaatatgtat

SEQ ID NO: 9464717 - DNA, 22 bp, Homo sapiens
tatgccactgctctccatccta

SEQ ID NO: 9464718 - DNA, 22 bp, Homo sapiens
tatgcatatgtgttcattggag

SEQ ID NO: 9464719 - DNA, 21 bp, Homo sapiens
tatgcagtttacttaggtatt

SEQ ID NO: 9464720 - DNA, 22 bp, Homo sapiens
tatgcagtgtatgcactgagat

SEQ ID NO: 9464721 - DNA, 22 bp, Homo sapiens
tatgcatagtgatttagaacag

SEQ ID NO: 9464722 - DNA, 22 bp, Homo sapiens
tatgcacattatctaatccatt

SEQ ID NO: 9464723 - DNA, 20 bp, Homo sapiens
tatgcagtatgtgtgtataa

SEQ ID NO: 9464724 - DNA, 22 bp, Homo sapiens
tatgcactggtactattcgtgt

SEQ ID NO: 9464725 - DNA, 22 bp, Homo sapiens
tatgagttcagttatcttaagt

SEQ ID NO: 9464726 - DNA, 22 bp, Homo sapiens
tatctttgcaaatatctctaag

SEQ ID NO: 9464727 - DNA, 22 bp, Homo sapiens
tatctttgatgccagatgttac

SEQ ID NO: 9464728 - DNA, 20 bp, Homo sapiens
tatgataattacaaaatagt

SEQ ID NO: 9464729 - DNA, 20 bp, Homo sapiens
tatgataattacaaaatagt

SEQ ID NO: 9464730 - DNA, 20 bp, Homo sapiens
tatgataattacaaaatagt

SEQ ID NO: 9464731 - DNA, 20 bp, Homo sapiens
tatgataattacaaaatagt

SEQ ID NO: 9464732 - DNA, 22 bp, Homo sapiens
tatgagtttaaggctaaaatag

SEQ ID NO: 9464733 - DNA, 22 bp, Homo sapiens
tatgataacctgttgtagtttg

SEQ ID NO: 9464734 - DNA, 22 bp, Homo sapiens
tatgataacctgttgtagtttg

SEQ ID NO: 9464735 - DNA, 20 bp, Homo sapiens
tatgataattacaaaatagt

SEQ ID NO: 9464736 - DNA, 22 bp, Homo sapiens
tatcttggcttgaaagatgctt

SEQ ID NO: 9464737 - DNA, 22 bp, Homo sapiens
tatcttggactctttgcagtgc

SEQ ID NO: 9464738 - DNA, 21 bp, Homo sapiens
tatcttgggctctgtgcttga

SEQ ID NO: 9464739 - DNA, 22 bp, Homo sapiens
tatcttggtgggcttaatataa

SEQ ID NO: 9464740 - DNA, 22 bp, Homo sapiens
tatcttgagagacaacacagca

SEQ ID NO: 9464741 - DNA, 22 bp, Homo sapiens
tatcttgatcaagtagaagagg

SEQ ID NO: 9464742 - DNA, 22 bp, Homo sapiens
tatctttaacttgcagtattta

SEQ ID NO: 9464743 - DNA, 22 bp, Homo sapiens
tatctttaacttgcagtattta

SEQ ID NO: 9464744 - DNA, 22 bp, Homo sapiens
tatctttagaggaagagaatct

SEQ ID NO: 9464745 - DNA, 22 bp, Homo sapiens
tatctttagaggaagagaatct

SEQ ID NO: 9464746 - DNA, 22 bp, Homo sapiens
tatctttagaggaagagaatct

SEQ ID NO: 9464747 - DNA, 22 bp, Homo sapiens
tatctttagaggaagagaatct

SEQ ID NO: 9464748 - DNA, 22 bp, Homo sapiens
tatctttgatgccagatgttac

SEQ ID NO: 9464749 - DNA, 22 bp, Homo sapiens
tatctttctgtcctagattctg

SEQ ID NO: 9464750 - DNA, 22 bp, Homo sapiens
tatctttctgtcctagattctg

SEQ ID NO: 9464751 - DNA, 22 bp, Homo sapiens
tatctttattatgtctatctgc

SEQ ID NO: 9464752 - DNA, 22 bp, Homo sapiens
tatctttattatgtctatctgc

SEQ ID NO: 9464753 - DNA, 22 bp, Homo sapiens
tatcttaaatgcatgatagaca

SEQ ID NO: 9464754 - DNA, 22 bp, Homo sapiens
tatctgtttcctatgcatgtga

SEQ ID NO: 9464755 - DNA, 19 bp, Homo sapiens
tatctgtttcctgcttgtc

SEQ ID NO: 9464756 - DNA, 22 bp, Homo sapiens
tatctgtttctgaggatacatg

SEQ ID NO: 9464757 - DNA, 22 bp, Homo sapiens
tatctgttgtccatgcagaaag

SEQ ID NO: 9464758 - DNA, 22 bp, Homo sapiens
tatctgttggctttggaaataa

SEQ ID NO: 9464759 - DNA, 22 bp, Homo sapiens
tatctgttgtcttttacatgta

SEQ ID NO: 9464760 - DNA, 22 bp, Homo sapiens
tatctgtttcctatgcatgtga

SEQ ID NO: 9464761 - DNA, 22 bp, Homo sapiens
tatctgtttattgttactgtca

SEQ ID NO: 9464762 - DNA, 23 bp, Homo sapiens
tatcttacctcccttctttcctg

SEQ ID NO: 9464763 - DNA, 22 bp, Homo sapiens
tatcttacagactgaatgttgg

SEQ ID NO: 9464764 - DNA, 22 bp, Homo sapiens
tatcttagggaattaactaaaa

SEQ ID NO: 9464765 - DNA, 22 bp, Homo sapiens
tatcttcaatttattcaaggag

SEQ ID NO: 9464766 - DNA, 22 bp, Homo sapiens
tatcttcaatttattcaaggag

SEQ ID NO: 9464767 - DNA, 22 bp, Homo sapiens
tatcttcacttatatctttctt

SEQ ID NO: 9464768 - DNA, 22 bp, Homo sapiens
tatcttcaactaggattcattt

SEQ ID NO: 9464769 - DNA, 22 bp, Homo sapiens
tatcttcagctgaagcagagtc

SEQ ID NO: 9464770 - DNA, 22 bp, Homo sapiens
tatcttcagcacagatcctgtg

SEQ ID NO: 9464771 - DNA, 22 bp, Homo sapiens
tatcttcagcacagatcctgtg

SEQ ID NO: 9464772 - DNA, 22 bp, Homo sapiens
tatcttcatagatttttacacc

SEQ ID NO: 9464773 - DNA, 22 bp, Homo sapiens
tatatgtagattgtaccaatgt

SEQ ID NO: 9464774 - DNA, 22 bp, Homo sapiens
tatatgtagattgtaccaatgt

SEQ ID NO: 9464775 - DNA, 22 bp, Homo sapiens
tatatgtaagctatgtaagagt

SEQ ID NO: 9464776 - DNA, 22 bp, Homo sapiens
tatatgtagtcagtcagagtaa

SEQ ID NO: 9464777 - DNA, 22 bp, Homo sapiens
tatatgtagtcagtcagagtaa

SEQ ID NO: 9464778 - DNA, 17 bp, Homo sapiens
tatatgtatgcctctcc

SEQ ID NO: 9464779 - DNA, 23 bp, Homo sapiens
tatatgtctgtatcttaggttgc

SEQ ID NO: 9464780 - DNA, 22 bp, Homo sapiens
tatatgtctgctactgtataaa

SEQ ID NO: 9464781 - DNA, 22 bp, Homo sapiens
tatatgcatgcccatgtataca

SEQ ID NO: 9464782 - DNA, 22 bp, Homo sapiens
tatatgcttgggaaatggtaga

SEQ ID NO: 9464783 - DNA, 22 bp, Homo sapiens
tatatgtaagctatgtaagagt

SEQ ID NO: 9464784 - DNA, 22 bp, Homo sapiens
tatatgtaaataagtctaatgt

SEQ ID NO: 9464785 - DNA, 22 bp, Homo sapiens
tatagcaaggacataatatgct

SEQ ID NO: 9464786 - DNA, 22 bp, Homo sapiens
tatatgcaattttttagtgcaa

SEQ ID NO: 9464787 - DNA, 22 bp, Homo sapiens
tatagatagactgacgatacag

SEQ ID NO: 9464788 - DNA, 22 bp, Homo sapiens
tatagaggtggaaactgaggtt

SEQ ID NO: 9464789 - DNA, 22 bp, Homo sapiens
tatagaggccaccaacatgaaa

SEQ ID NO: 9464790 - DNA, 22 bp, Homo sapiens
tatagacaagcgtaacaagaag

SEQ ID NO: 9464791 - DNA, 22 bp, Homo sapiens
tatagacttgatggtattaagt

SEQ ID NO: 9464792 - DNA, 22 bp, Homo sapiens
tatagaggatgaacatctatta

SEQ ID NO: 9464793 - DNA, 22 bp, Homo sapiens
tatattaaagtgctttgcagtg

SEQ ID NO: 9464794 - DNA, 22 bp, Homo sapiens
tatattaaatgaccagttttaa

SEQ ID NO: 9464795 - DNA, 22 bp, Homo sapiens
tatattaaatgaccagttttaa

SEQ ID NO: 9464796 - DNA, 22 bp, Homo sapiens
tatattaaatgaccagttttaa

SEQ ID NO: 9464797 - DNA, 22 bp, Homo sapiens
tatattaaatgaccagttttaa

SEQ ID NO: 9464798 - DNA, 22 bp, Homo sapiens
tatattaaaccctctctgtagg

SEQ ID NO: 9464799 - DNA, 22 bp, Homo sapiens
tatattaaaccctctctgtagg

SEQ ID NO: 9464800 - DNA, 22 bp, Homo sapiens
tatattaaaccctctctgtagg

SEQ ID NO: 9464801 - DNA, 22 bp, Homo sapiens
tatattaaagtgctttgcagtg

SEQ ID NO: 9464802 - DNA, 22 bp, Homo sapiens
tatatgtttcttacaaaatatt

SEQ ID NO: 9464803 - DNA, 22 bp, Homo sapiens
tatatgtttttctaattaggga

SEQ ID NO: 9464804 - DNA, 22 bp, Homo sapiens
tatatgtttcttacaaaatatt

SEQ ID NO: 9464805 - DNA, 22 bp, Homo sapiens
tatatgttgatactaattctgg

SEQ ID NO: 9464806 - DNA, 20 bp, Homo sapiens
tatatgtgtacatacacaca

SEQ ID NO: 9464807 - DNA, 22 bp, Homo sapiens
tatatgttgatactaattctgg

SEQ ID NO: 9464808 - DNA, 22 bp, Homo sapiens
tatattaacacccacttgcctc

SEQ ID NO: 9464809 - DNA, 22 bp, Homo sapiens
tatattaacacccacttgcctc

SEQ ID NO: 9464810 - DNA, 22 bp, Homo sapiens
tatattaacacccacttgcctc

SEQ ID NO: 9464811 - DNA, 22 bp, Homo sapiens
tatattaaccatagggttctag

SEQ ID NO: 9464812 - DNA, 22 bp, Homo sapiens
tatattaaccatagggttctag

SEQ ID NO: 9464813 - DNA, 22 bp, Homo sapiens
tatattaacttgtgatcctgga

SEQ ID NO: 9464814 - DNA, 22 bp, Homo sapiens
tatattaacttgtgatcctgga

SEQ ID NO: 9464815 - DNA, 22 bp, Homo sapiens
tatattatcataaaaccattca

SEQ ID NO: 9464816 - DNA, 22 bp, Homo sapiens
tatattatcataaaaccattca

SEQ ID NO: 9464817 - DNA, 22 bp, Homo sapiens
tatattataagccctttcagaa

SEQ ID NO: 9464818 - DNA, 22 bp, Homo sapiens
tagttaaagccctaaattgata

SEQ ID NO: 9464819 - DNA, 22 bp, Homo sapiens
tagttaaagccctaaattgata

SEQ ID NO: 9464820 - DNA, 22 bp, Homo sapiens
tagttaaagccctaaattgata

SEQ ID NO: 9464821 - DNA, 22 bp, Homo sapiens
tagttaaaataatggagatgtt

SEQ ID NO: 9464822 - DNA, 22 bp, Homo sapiens
tagttaaagattctgttaagag

SEQ ID NO: 9464823 - DNA, 21 bp, Homo sapiens
tatacagaggggaacaggaga

SEQ ID NO: 9464824 - DNA, 22 bp, Homo sapiens
tagttaattctttaagaacaag

SEQ ID NO: 9464825 - DNA, 22 bp, Homo sapiens
tatacagaacattaagaactgt

SEQ ID NO: 9464826 - DNA, 22 bp, Homo sapiens
tagttaattctttaagaacaag

SEQ ID NO: 9464827 - DNA, 22 bp, Homo sapiens
tagttaactcttggtaataggt

SEQ ID NO: 9464828 - DNA, 22 bp, Homo sapiens
tagttaatgctaattaacaaat

SEQ ID NO: 9464829 - DNA, 22 bp, Homo sapiens
tagttaatgctaattaacaaat

SEQ ID NO: 9464830 - DNA, 22 bp, Homo sapiens
tagttaatgctaattaacaaat

SEQ ID NO: 9464831 - DNA, 22 bp, Homo sapiens
tagtgtcaaatagcctgagctt

SEQ ID NO: 9464832 - DNA, 23 bp, Homo sapiens
tagtgtcaagagggagtgtaatt

SEQ ID NO: 9464833 - DNA, 22 bp, Homo sapiens
tagtgtcaaacagggattagaa

SEQ ID NO: 9464834 - DNA, 22 bp, Homo sapiens
tagtgtcaaatagcctgagctt

SEQ ID NO: 9464835 - DNA, 22 bp, Homo sapiens
tagtgtcagagaatcttggttt

SEQ ID NO: 9464836 - DNA, 22 bp, Homo sapiens
tagtgtcagcatctcattgagc

SEQ ID NO: 9464837 - DNA, 19 bp, Homo sapiens
tagtgtcaaggaggagggt

SEQ ID NO: 9464838 - DNA, 22 bp, Homo sapiens
tagtgtcagagaatcttggttt

SEQ ID NO: 9464839 - DNA, 23 bp, Homo sapiens
tagtgtcatcctcagcttctgtt

SEQ ID NO: 9464840 - DNA, 22 bp, Homo sapiens
tagtgtcatcgttgcagctgag

SEQ ID NO: 9464841 - DNA, 22 bp, Homo sapiens
tagtgtcaggagggaaatgcaa

SEQ ID NO: 9464842 - DNA, 22 bp, Homo sapiens
tagtgtcagggagtgataaatg

SEQ ID NO: 9464843 - DNA, 22 bp, Homo sapiens
tagttaaaataatggagatgtt

SEQ ID NO: 9464844 - DNA, 22 bp, Homo sapiens
tagtgtcatttcagtggagttt

SEQ ID NO: 9464845 - DNA, 22 bp, Homo sapiens
tagtgtttagtacatatgcata

SEQ ID NO: 9464846 - DNA, 22 bp, Homo sapiens
tagtgtcatgaaaagtacacta

SEQ ID NO: 9464847 - DNA, 22 bp, Homo sapiens
tatacttatgctaaaaaatgtt

SEQ ID NO: 9464848 - DNA, 22 bp, Homo sapiens
tatactgtgttttcaccactgt

SEQ ID NO: 9464849 - DNA, 22 bp, Homo sapiens
tatactctgagaaacgtgtcac

SEQ ID NO: 9464850 - DNA, 22 bp, Homo sapiens
tatagaagtaagcattgtgatg

SEQ ID NO: 9464851 - DNA, 22 bp, Homo sapiens
tatagaagtaagcattgtgatg

SEQ ID NO: 9464852 - DNA, 22 bp, Homo sapiens
tatagaagtaagcattgtgatg

SEQ ID NO: 9464853 - DNA, 22 bp, Homo sapiens
tatagaagagacatgtgcatag

SEQ ID NO: 9464854 - DNA, 22 bp, Homo sapiens
tatagaagagacatgtgcatag

SEQ ID NO: 9464855 - DNA, 22 bp, Homo sapiens
tatactttcctgcaactttgat

SEQ ID NO: 9464856 - DNA, 22 bp, Homo sapiens
tatactttcctgcaactttgat

SEQ ID NO: 9464857 - DNA, 22 bp, Homo sapiens
tatacttatgctaaaaaatgtt

SEQ ID NO: 9464858 - DNA, 22 bp, Homo sapiens
tataccaaaatatcagaaaggg

SEQ ID NO: 9464859 - DNA, 22 bp, Homo sapiens
tatacatgttttacataagtga

SEQ ID NO: 9464860 - DNA, 22 bp, Homo sapiens
tatacatgttttacataagtga

SEQ ID NO: 9464861 - DNA, 22 bp, Homo sapiens
tatacatgttttacataagtga

SEQ ID NO: 9464862 - DNA, 22 bp, Homo sapiens
tataccaaaaaaattcttgtct

SEQ ID NO: 9464863 - DNA, 22 bp, Homo sapiens
tatacatgttttacataagtga

SEQ ID NO: 9464864 - DNA, 22 bp, Homo sapiens
tatacagaactgcacgtgcacg

SEQ ID NO: 9464865 - DNA, 20 bp, Homo sapiens
tatactaacatatatctgtt

SEQ ID NO: 9464866 - DNA, 20 bp, Homo sapiens
tatactaacatatatctgtt

SEQ ID NO: 9464867 - DNA, 22 bp, Homo sapiens
tataccatgtgtgcacactccc

SEQ ID NO: 9464868 - DNA, 22 bp, Homo sapiens
tacaatgttcgcattctctctg

SEQ ID NO: 9464869 - DNA, 22 bp, Homo sapiens
tacaattctttgtaaggtggtc

SEQ ID NO: 9464870 - DNA, 22 bp, Homo sapiens
tacaatgtgtgcttcttgtcac

SEQ ID NO: 9464871 - DNA, 22 bp, Homo sapiens
tacaatgtgtgcttcttgtcac

SEQ ID NO: 9464872 - DNA, 22 bp, Homo sapiens
tacacaaaggcactctgttgtt

SEQ ID NO: 9464873 - DNA, 22 bp, Homo sapiens
tacacaaaggcactctgttgtt

SEQ ID NO: 9464874 - DNA, 21 bp, Homo sapiens
tacacaaagcgtggtccagag

SEQ ID NO: 9464875 - DNA, 22 bp, Homo sapiens
tacacaaaggcactctgttgtt

SEQ ID NO: 9464876 - DNA, 19 bp, Homo sapiens
tacaattggctttccattg

SEQ ID NO: 9464877 - DNA, 21 bp, Homo sapiens
tacacaaagcgtggtccagag

SEQ ID NO: 9464878 - DNA, 21 bp, Homo sapiens
tacacaaagcgtggtccagag

SEQ ID NO: 9464879 - DNA, 21 bp, Homo sapiens
tacacaaagcgtggtccagag

SEQ ID NO: 9464880 - DNA, 22 bp, Homo sapiens
tacacatctctgtcagtagtga

SEQ ID NO: 9464881 - DNA, 22 bp, Homo sapiens
tacacatccttctgaacaacct

SEQ ID NO: 9464882 - DNA, 22 bp, Homo sapiens
tacacatatgtgtgtatatgtg

SEQ ID NO: 9464883 - DNA, 22 bp, Homo sapiens
tacacaaaggcactctgttgtt

SEQ ID NO: 9464884 - DNA, 22 bp, Homo sapiens
tacacatatgtccattaatcag

SEQ ID NO: 9464885 - DNA, 22 bp, Homo sapiens
tacacgatatttttacagatac

SEQ ID NO: 9464886 - DNA, 22 bp, Homo sapiens
tacacctgctgagcctgtcctc

SEQ ID NO: 9464887 - DNA, 22 bp, Homo sapiens
tacacccttctcctgagtgtgt

SEQ ID NO: 9464888 - DNA, 22 bp, Homo sapiens
tacacctgctgagcctgtcctc

SEQ ID NO: 9464889 - DNA, 22 bp, Homo sapiens
tacacccaggtaccgtgatttc

SEQ ID NO: 9464890 - DNA, 22 bp, Homo sapiens
tacacccacattgagcatggga

SEQ ID NO: 9464891 - DNA, 22 bp, Homo sapiens
tacactaaatcttcatctttta

SEQ ID NO: 9464892 - DNA, 22 bp, Homo sapiens
tacactaaatcttcatctttta

SEQ ID NO: 9464893 - DNA, 22 bp, Homo sapiens
tacactaatgtttttgcaaagc

SEQ ID NO: 9464894 - DNA, 22 bp, Homo sapiens
tacactaatgtttttgcaaagc

SEQ ID NO: 9464895 - DNA, 22 bp, Homo sapiens
tacactaatagccacactaatg

SEQ ID NO: 9464896 - DNA, 22 bp, Homo sapiens
tacaccattcccaggtggattt

SEQ ID NO: 9464897 - DNA, 22 bp, Homo sapiens
tacaccattttctgcagtgttt

SEQ ID NO: 9464898 - DNA, 22 bp, Homo sapiens
tacacccacatgcctaggaggg

SEQ ID NO: 9464899 - DNA, 22 bp, Homo sapiens
tacacccacatgcctaggaggg

SEQ ID NO: 9464900 - DNA, 22 bp, Homo sapiens
tacacatgtttggcaagtatgt

SEQ ID NO: 9464901 - DNA, 22 bp, Homo sapiens
tacacatgcatgtactccagga

SEQ ID NO: 9464902 - DNA, 22 bp, Homo sapiens
tacacatgctcagattcctgtg

SEQ ID NO: 9464903 - DNA, 22 bp, Homo sapiens
tacacatgtttggcaagtatgt

SEQ ID NO: 9464904 - DNA, 22 bp, Homo sapiens
tacacattacataatactatct

SEQ ID NO: 9464905 - DNA, 22 bp, Homo sapiens
tacacattacataatactatct

SEQ ID NO: 9464906 - DNA, 22 bp, Homo sapiens
tacacattacataatactatct

SEQ ID NO: 9464907 - DNA, 22 bp, Homo sapiens
tacaagctcacaaatttttaag

SEQ ID NO: 9464908 - DNA, 22 bp, Homo sapiens
tacaagctgaccctgaagatga

SEQ ID NO: 9464909 - DNA, 22 bp, Homo sapiens
taatttttccacgtacactggg

SEQ ID NO: 9464910 - DNA, 22 bp, Homo sapiens
taatttttccacgtacactggg

SEQ ID NO: 9464911 - DNA, 22 bp, Homo sapiens
taatttttccacgtacactggg

SEQ ID NO: 9464912 - DNA, 20 bp, Homo sapiens
tacaatattcccactttgct

SEQ ID NO: 9464913 - DNA, 20 bp, Homo sapiens
tacaatattcccactttgct

SEQ ID NO: 9464914 - DNA, 22 bp, Homo sapiens
tacaatatgtggccttttgtga

SEQ ID NO: 9464915 - DNA, 22 bp, Homo sapiens
tacaatatgtggccttttgtga

SEQ ID NO: 9464916 - DNA, 22 bp, Homo sapiens
tacaatgtaattctgattatgt

SEQ ID NO: 9464917 - DNA, 22 bp, Homo sapiens
tacaatgctgtttgtttctact

SEQ ID NO: 9464918 - DNA, 22 bp, Homo sapiens
tacaatgctgtgcatgtaatgg

SEQ ID NO: 9464919 - DNA, 22 bp, Homo sapiens
tacaatgctgtgcatgtaatgg

SEQ ID NO: 9464920 - DNA, 22 bp, Homo sapiens
tacaatgcattcatttttgagg

SEQ ID NO: 9464921 - DNA, 22 bp, Homo sapiens
tacaatgcattcgttgtctcgg

SEQ ID NO: 9464922 - DNA, 22 bp, Homo sapiens
tacaatgcaaaatactgtctgc

SEQ ID NO: 9464923 - DNA, 22 bp, Homo sapiens
tacaatgcagtgacctccttta

SEQ ID NO: 9464924 - DNA, 21 bp, Homo sapiens
tacaatgcacaggagagcctc

SEQ ID NO: 9464925 - DNA, 23 bp, Homo sapiens
tacaatgcaaacttggcccatgg

SEQ ID NO: 9464926 - DNA, 22 bp, Homo sapiens
tacaatgagctgtacatctcca

SEQ ID NO: 9464927 - DNA, 22 bp, Homo sapiens
tacaatcaggataataatagtg

SEQ ID NO: 9464928 - DNA, 22 bp, Homo sapiens
tacaatctttatgttgagtggt

SEQ ID NO: 9464929 - DNA, 22 bp, Homo sapiens
taattttacttcctgagcacct

SEQ ID NO: 9464930 - DNA, 22 bp, Homo sapiens
taattttacttcctgagcacct

SEQ ID NO: 9464931 - DNA, 22 bp, Homo sapiens
taattttaactgtgctgtttgg

SEQ ID NO: 9464932 - DNA, 22 bp, Homo sapiens
taattttaactgtgctgtttgg

SEQ ID NO: 9464933 - DNA, 20 bp, Homo sapiens
taatttgatatctataagtt

SEQ ID NO: 9464934 - DNA, 22 bp, Homo sapiens
taattttaactgtgctgtttgg

SEQ ID NO: 9464935 - DNA, 22 bp, Homo sapiens
taattttaactgtgctgtttgg

SEQ ID NO: 9464936 - DNA, 18 bp, Homo sapiens
taatttgcacagttgcaa

SEQ ID NO: 9464937 - DNA, 22 bp, Homo sapiens
taattttccactctgtttatct

SEQ ID NO: 9464938 - DNA, 22 bp, Homo sapiens
taattttccactctgtttatct

SEQ ID NO: 9464939 - DNA, 22 bp, Homo sapiens
taattttccactctgtttatct

SEQ ID NO: 9464940 - DNA, 22 bp, Homo sapiens
taattttatgacagtgtatttt

SEQ ID NO: 9464941 - DNA, 22 bp, Homo sapiens
taattttatgacagtgtatttt

SEQ ID NO: 9464942 - DNA, 22 bp, Homo sapiens
taattttatgacagtgtatttt

SEQ ID NO: 9464943 - DNA, 22 bp, Homo sapiens
taattttgtattgccattgtag

SEQ ID NO: 9464944 - DNA, 22 bp, Homo sapiens
taattttgctgtgaccattgaa

SEQ ID NO: 9464945 - DNA, 22 bp, Homo sapiens
taattttgctgtgaccattgaa

SEQ ID NO: 9464946 - DNA, 22 bp, Homo sapiens
taattttgtcacagtgacatgc

SEQ ID NO: 9464947 - DNA, 22 bp, Homo sapiens
taattttgtattgccattgtag

SEQ ID NO: 9464948 - DNA, 22 bp, Homo sapiens
taattttgtattgccattgtag

SEQ ID NO: 9464949 - DNA, 22 bp, Homo sapiens
taattttgtcacagtgacatgc

SEQ ID NO: 9464950 - DNA, 22 bp, Homo sapiens
taattttgtcacagtgacatgc

SEQ ID NO: 9464951 - DNA, 22 bp, Homo sapiens
taattttgtcacagtgacatgc

SEQ ID NO: 9464952 - DNA, 22 bp, Homo sapiens
taattttgtccccctgcacata

SEQ ID NO: 9464953 - DNA, 22 bp, Homo sapiens
taattttgtccccctgcacata

SEQ ID NO: 9464954 - DNA, 22 bp, Homo sapiens
taattttgtccccctgcacata

SEQ ID NO: 9464955 - DNA, 22 bp, Homo sapiens
taagttatcggagtgtgtttca

SEQ ID NO: 9464956 - DNA, 22 bp, Homo sapiens
taagttcaaatcatcccaactt

SEQ ID NO: 9464957 - DNA, 17 bp, Homo sapiens
taagttatagcagaaga

SEQ ID NO: 9464958 - DNA, 17 bp, Homo sapiens
taagttatagcagaaga

SEQ ID NO: 9464959 - DNA, 22 bp, Homo sapiens
taagttcaaatcatcccaactt

SEQ ID NO: 9464960 - DNA, 22 bp, Homo sapiens
taagttcaagtcttggatataa

SEQ ID NO: 9464961 - DNA, 22 bp, Homo sapiens
taagttcaccagttgtaataag

SEQ ID NO: 9464962 - DNA, 22 bp, Homo sapiens
taagttcattagactacagata

SEQ ID NO: 9464963 - DNA, 22 bp, Homo sapiens
taagttcattagactacagata

SEQ ID NO: 9464964 - DNA, 22 bp, Homo sapiens
taagttcagttggtcgaagtag

SEQ ID NO: 9464965 - DNA, 22 bp, Homo sapiens
taagttacacttaacttactag

SEQ ID NO: 9464966 - DNA, 22 bp, Homo sapiens
taagtgttggtaattacaatga

SEQ ID NO: 9464967 - DNA, 22 bp, Homo sapiens
taagcaatctaaaagccttacc

SEQ ID NO: 9464968 - DNA, 22 bp, Homo sapiens
taagcaagtggtagaaggacaa

SEQ ID NO: 9464969 - DNA, 18 bp, Homo sapiens
taagcaatgacattgcaa

SEQ ID NO: 9464970 - DNA, 22 bp, Homo sapiens
taagcagtttttcttgtattaa

SEQ ID NO: 9464971 - DNA, 22 bp, Homo sapiens
taagcagtttttcttgtattaa

SEQ ID NO: 9464972 - DNA, 22 bp, Homo sapiens
taagcataactaaaaatgattt

SEQ ID NO: 9464973 - DNA, 22 bp, Homo sapiens
taagcataactaaaaatgattt

SEQ ID NO: 9464974 - DNA, 20 bp, Homo sapiens
taagcacatgaacagtcctc

SEQ ID NO: 9464975 - DNA, 22 bp, Homo sapiens
taataacaattgtaggacatga

SEQ ID NO: 9464976 - DNA, 22 bp, Homo sapiens
taataacaattgtaggacatga

SEQ ID NO: 9464977 - DNA, 22 bp, Homo sapiens
taataacaattgtaggacatga

SEQ ID NO: 9464978 - DNA, 22 bp, Homo sapiens
taataaatgaaagtgctggcat

SEQ ID NO: 9464979 - DNA, 22 bp, Homo sapiens
taataaatgaaagtgctggcat

SEQ ID NO: 9464980 - DNA, 22 bp, Homo sapiens
taataaatgaaagtgctggcat

SEQ ID NO: 9464981 - DNA, 22 bp, Homo sapiens
taataaatgaaagtgctggcat

SEQ ID NO: 9464982 - DNA, 22 bp, Homo sapiens
taataaatgaaagtgctggcat

SEQ ID NO: 9464983 - DNA, 22 bp, Homo sapiens
taataaatgaaagtgctggcat

SEQ ID NO: 9464984 - DNA, 22 bp, Homo sapiens
taataaatgaaagtgctggcat

SEQ ID NO: 9464985 - DNA, 22 bp, Homo sapiens
taataaatgaaagtgctggcat

SEQ ID NO: 9464986 - DNA, 22 bp, Homo sapiens
taataaatgaaagtgctggcat

SEQ ID NO: 9464987 - DNA, 22 bp, Homo sapiens
taagttttctggaataacttgg

SEQ ID NO: 9464988 - DNA, 22 bp, Homo sapiens
taataaactgctacgcttagtt

SEQ ID NO: 9464989 - DNA, 22 bp, Homo sapiens
taataaactgctacgcttagtt

SEQ ID NO: 9464990 - DNA, 22 bp, Homo sapiens
taagttctgagtaaatactgtt

SEQ ID NO: 9464991 - DNA, 22 bp, Homo sapiens
taagtttaaatgtacatgaagc

SEQ ID NO: 9464992 - DNA, 22 bp, Homo sapiens
taagtttaccactttcagaatt

SEQ ID NO: 9464993 - DNA, 22 bp, Homo sapiens
taagtttagagagaatggggac

SEQ ID NO: 9464994 - DNA, 22 bp, Homo sapiens
taagtttgtgtctctgttactt

SEQ ID NO: 9464995 - DNA, 22 bp, Homo sapiens
taagtttggggaaaatgttaag

SEQ ID NO: 9464996 - DNA, 22 bp, Homo sapiens
taagtttccagattgtaagtcc

SEQ ID NO: 9464997 - DNA, 22 bp, Homo sapiens
taagtttatagataaatgccta

SEQ ID NO: 9464998 - DNA, 22 bp, Homo sapiens
taatgaatgagaatataacaga

SEQ ID NO: 9464999 - DNA, 22 bp, Homo sapiens
taatgaatgagaatataacaga

SEQ ID NO: 9465000 - DNA, 22 bp, Homo sapiens
taatgacattgtatccacagag

SEQ ID NO: 9465001 - DNA, 22 bp, Homo sapiens
taataacaattgtaggacatga

SEQ ID NO: 9465002 - DNA, 22 bp, Homo sapiens
taataacaattgtaggacatga

SEQ ID NO: 9465003 - DNA, 22 bp, Homo sapiens
taataacaattgtaggacatga

SEQ ID NO: 9465004 - DNA, 22 bp, Homo sapiens
taatgaacatcttaatctgaaa

SEQ ID NO: 9465005 - DNA, 22 bp, Homo sapiens
taatgaacatgcatcgtgtgta

SEQ ID NO: 9465006 - DNA, 22 bp, Homo sapiens
taatgaactctttactttggga

SEQ ID NO: 9465007 - DNA, 23 bp, Homo sapiens
taatgccagccctgcagttaagc

SEQ ID NO: 9465008 - DNA, 22 bp, Homo sapiens
taatgccacggcagggaacagc

SEQ ID NO: 9465009 - DNA, 22 bp, Homo sapiens
taatgcatgtaatgggctgata

SEQ ID NO: 9465010 - DNA, 22 bp, Homo sapiens
taatgccaatttaatgatccat

SEQ ID NO: 9465011 - DNA, 22 bp, Homo sapiens
taatgcaattttctcagtccat

SEQ ID NO: 9465012 - DNA, 22 bp, Homo sapiens
taatgcaatttagcaaagtttt

SEQ ID NO: 9465013 - DNA, 22 bp, Homo sapiens
taatgcaaggaattccaagtag

SEQ ID NO: 9465014 - DNA, 22 bp, Homo sapiens
taatgcaatttagcaaagtttt

SEQ ID NO: 9465015 - DNA, 22 bp, Homo sapiens
taatgcacatagaagtacttag

SEQ ID NO: 9465016 - DNA, 19 bp, Homo sapiens
taatgcacttaacacatgg

SEQ ID NO: 9465017 - DNA, 22 bp, Homo sapiens
taatgatatttcccatttctct

SEQ ID NO: 9465018 - DNA, 22 bp, Homo sapiens
taatgatgctagatttatctgg

SEQ ID NO: 9465019 - DNA, 22 bp, Homo sapiens
taatgagtcattcctgaatgct

SEQ ID NO: 9465020 - DNA, 22 bp, Homo sapiens
taatgcaaggaattccaagtag

SEQ ID NO: 9465021 - DNA, 21 bp, Homo sapiens
taatgcaaggaactaatgtca

SEQ ID NO: 9465022 - DNA, 22 bp, Homo sapiens
taatgcaaggaattccaagtag

SEQ ID NO: 9465023 - DNA, 22 bp, Homo sapiens
taatgcaacgtgagataattaa

SEQ ID NO: 9465024 - DNA, 21 bp, Homo sapiens
taatgcaaggaactaatgtca

SEQ ID NO: 9465025 - DNA, 22 bp, Homo sapiens
taatgatgtgtgcaaactgaat

SEQ ID NO: 9465026 - DNA, 22 bp, Homo sapiens
taatgatgtttcctatcttcca

SEQ ID NO: 9465027 - DNA, 22 bp, Homo sapiens
taatgcaacagctgctagtgat

SEQ ID NO: 9465028 - DNA, 22 bp, Homo sapiens
taatgcaacgtgagataattaa

SEQ ID NO: 9465029 - DNA, 22 bp, Homo sapiens
taatgcaacgtgagataattaa

SEQ ID NO: 9465030 - DNA, 22 bp, Homo sapiens
taatgcttttccttcaaataag

SEQ ID NO: 9465031 - DNA, 22 bp, Homo sapiens
taatgcttttccttcaaataag

SEQ ID NO: 9465032 - DNA, 22 bp, Homo sapiens
taatgcttttccttcaaataag

SEQ ID NO: 9465033 - DNA, 22 bp, Homo sapiens
taatgctttgttttgatctaac

SEQ ID NO: 9465034 - DNA, 22 bp, Homo sapiens
taatgctttgtcagcctaaggg

SEQ ID NO: 9465035 - DNA, 22 bp, Homo sapiens
taatgcttgcaaattatgggac

SEQ ID NO: 9465036 - DNA, 22 bp, Homo sapiens
taatgctttgttttgatctaac

SEQ ID NO: 9465037 - DNA, 22 bp, Homo sapiens
taatgctttgttttgatctaac

SEQ ID NO: 9465038 - DNA, 22 bp, Homo sapiens
taatgcttctgttaggatcttc

SEQ ID NO: 9465039 - DNA, 22 bp, Homo sapiens
taatgcttcctatatagcactc

SEQ ID NO: 9465040 - DNA, 22 bp, Homo sapiens
taatgcttcaatttccttgatt

SEQ ID NO: 9465041 - DNA, 22 bp, Homo sapiens
taatgcttatgttatgcaattt

SEQ ID NO: 9465042 - DNA, 22 bp, Homo sapiens
taatgcttatgttatgcaattt

SEQ ID NO: 9465043 - DNA, 20 bp, Homo sapiens
taatgcttaacacatcccct

SEQ ID NO: 9465044 - DNA, 22 bp, Homo sapiens
taatgcttaattttcacaagcc

SEQ ID NO: 9465045 - DNA, 22 bp, Homo sapiens
taatgcttaattttcacaagcc

SEQ ID NO: 9465046 - DNA, 22 bp, Homo sapiens
taatgctcaccctgcatcaggc

SEQ ID NO: 9465047 - DNA, 22 bp, Homo sapiens
taatttcaccgttgctagaaat

SEQ ID NO: 9465048 - DNA, 22 bp, Homo sapiens
taatttcactgatatgaagtca

SEQ ID NO: 9465049 - DNA, 22 bp, Homo sapiens
taatttctaattcattttcagt

SEQ ID NO: 9465050 - DNA, 22 bp, Homo sapiens
taatttcacagttcaacgcaca

SEQ ID NO: 9465051 - DNA, 22 bp, Homo sapiens
taatttcacagttcaacgcaca

SEQ ID NO: 9465052 - DNA, 22 bp, Homo sapiens
taatggaagttaaatatggtat

SEQ ID NO: 9465053 - DNA, 22 bp, Homo sapiens
tacttcccactggggtctacca

SEQ ID NO: 9465054 - DNA, 22 bp, Homo sapiens
tacttcctgtttccatgtctgt

SEQ ID NO: 9465055 - DNA, 22 bp, Homo sapiens
tacttcatgagttaatatgcag

SEQ ID NO: 9465056 - DNA, 22 bp, Homo sapiens
tacttcattcctttgtaaaatg

SEQ ID NO: 9465057 - DNA, 22 bp, Homo sapiens
tacttctgccttagagaacact

SEQ ID NO: 9465058 - DNA, 20 bp, Homo sapiens
tacttctgaggcactctgaa

SEQ ID NO: 9465059 - DNA, 23 bp, Homo sapiens
tacttgaaatcaggcttacttcc

SEQ ID NO: 9465060 - DNA, 22 bp, Homo sapiens
tacttagtctttctgatgaaat

SEQ ID NO: 9465061 - DNA, 22 bp, Homo sapiens
tacttcaaacaatggtacaaac

SEQ ID NO: 9465062 - DNA, 22 bp, Homo sapiens
tacttcaaccttctctattaga

SEQ ID NO: 9465063 - DNA, 22 bp, Homo sapiens
tacttcaatttgtatatgtgaa

SEQ ID NO: 9465064 - DNA, 22 bp, Homo sapiens
tacttacatttctgtaatcggc

SEQ ID NO: 9465065 - DNA, 22 bp, Homo sapiens
tacttagagcgataatttatac

SEQ ID NO: 9465066 - DNA, 22 bp, Homo sapiens
tactgtaatcagggcttaggta

SEQ ID NO: 9465067 - DNA, 22 bp, Homo sapiens
tacttacattagcaaacaaggt

SEQ ID NO: 9465068 - DNA, 22 bp, Homo sapiens
tactgtaatgagattagcttcc

SEQ ID NO: 9465069 - DNA, 20 bp, Homo sapiens
tactgggtctgggtcctgga

SEQ ID NO: 9465070 - DNA, 22 bp, Homo sapiens
tactgtaaactgtaacttcctt

SEQ ID NO: 9465071 - DNA, 22 bp, Homo sapiens
tactgcactccagcctgggtga

SEQ ID NO: 9465072 - DNA, 20 bp, Homo sapiens
tactgcaggaatcagctagc

SEQ ID NO: 9465073 - DNA, 22 bp, Homo sapiens
tactgcatcgaaatgcttttat

SEQ ID NO: 9465074 - DNA, 22 bp, Homo sapiens
tactgcataactggcatgtggg

SEQ ID NO: 9465075 - DNA, 22 bp, Homo sapiens
tactgcatagacactgggatat

SEQ ID NO: 9465076 - DNA, 22 bp, Homo sapiens
tactgagctggtccactgaggt

SEQ ID NO: 9465077 - DNA, 20 bp, Homo sapiens
tactggaaatttctccacct

SEQ ID NO: 9465078 - DNA, 22 bp, Homo sapiens
tactgctagatgaaaatgtagg

SEQ ID NO: 9465079 - DNA, 22 bp, Homo sapiens
tactgctgattagagctgaggt

SEQ ID NO: 9465080 - DNA, 22 bp, Homo sapiens
tactgctgagctgggtagaagg

SEQ ID NO: 9465081 - DNA, 22 bp, Homo sapiens
tactgcctattcaattggaatt

SEQ ID NO: 9465082 - DNA, 22 bp, Homo sapiens
tactgcatgggtgcatgctgct

SEQ ID NO: 9465083 - DNA, 22 bp, Homo sapiens
tactgcatgtgtttgatgatgg

SEQ ID NO: 9465084 - DNA, 22 bp, Homo sapiens
tactgcattaaatttaggttat

SEQ ID NO: 9465085 - DNA, 22 bp, Homo sapiens
tactgaaagtggtcaacagtgg

SEQ ID NO: 9465086 - DNA, 22 bp, Homo sapiens
tactaagtagcagaactaagaa

SEQ ID NO: 9465087 - DNA, 22 bp, Homo sapiens
tactaacaatgagaacaagcca

SEQ ID NO: 9465088 - DNA, 22 bp, Homo sapiens
tactgaaagactgaatatttag

SEQ ID NO: 9465089 - DNA, 22 bp, Homo sapiens
tactgaaatggcagatatataa

SEQ ID NO: 9465090 - DNA, 22 bp, Homo sapiens
tactgaaatggcagatatataa

SEQ ID NO: 9465091 - DNA, 22 bp, Homo sapiens
tactgaatggggcagtaagaaa

SEQ ID NO: 9465092 - DNA, 22 bp, Homo sapiens
tactgaagcaccattaaagaca

SEQ ID NO: 9465093 - DNA, 22 bp, Homo sapiens
tactgaaatagcactctgatgc

SEQ ID NO: 9465094 - DNA, 22 bp, Homo sapiens
tactgaaatactaagaagttaa

SEQ ID NO: 9465095 - DNA, 22 bp, Homo sapiens
tactgaaatactaagaagttaa

SEQ ID NO: 9465096 - DNA, 22 bp, Homo sapiens
tacctttgatctggaattttaa

SEQ ID NO: 9465097 - DNA, 22 bp, Homo sapiens
taccttttgcttattatgacac

SEQ ID NO: 9465098 - DNA, 22 bp, Homo sapiens
tacgaatcctgtggatgaatgt

SEQ ID NO: 9465099 - DNA, 22 bp, Homo sapiens
tacctttaaggagatttgacaa

SEQ ID NO: 9465100 - DNA, 22 bp, Homo sapiens
taccttgtgagctttctaacat

SEQ ID NO: 9465101 - DNA, 22 bp, Homo sapiens
taccttgtgagatgtcagtgag

SEQ ID NO: 9465102 - DNA, 22 bp, Homo sapiens
tacgcctgtaatcccagcactt

SEQ ID NO: 9465103 - DNA, 22 bp, Homo sapiens
tacgcctgtaatcccagcactt

SEQ ID NO: 9465104 - DNA, 22 bp, Homo sapiens
tacgagcgctcttgctggccaa

SEQ ID NO: 9465105 - DNA, 21 bp, Homo sapiens
tacgtgtgtgcatgtttatat

SEQ ID NO: 9465106 - DNA, 22 bp, Homo sapiens
tacgtttggaagatagaaacaa

SEQ ID NO: 9465107 - DNA, 22 bp, Homo sapiens
tactaaatagtttaattcctca

SEQ ID NO: 9465108 - DNA, 22 bp, Homo sapiens
tactaaatgattaagcaggaat

SEQ ID NO: 9465109 - DNA, 22 bp, Homo sapiens
tactaaatagtttaattcctca

SEQ ID NO: 9465110 - DNA, 22 bp, Homo sapiens
taccattttgaggatggagaga

SEQ ID NO: 9465111 - DNA, 22 bp, Homo sapiens
taccattttgaaacatttcatc

SEQ ID NO: 9465112 - DNA, 22 bp, Homo sapiens
tacctgaagtaacaatgaatat

SEQ ID NO: 9465113 - DNA, 23 bp, Homo sapiens
tacctgaagtaagcattcatcca

SEQ ID NO: 9465114 - DNA, 22 bp, Homo sapiens
tacctgaattaccaaaagcttt

SEQ ID NO: 9465115 - DNA, 22 bp, Homo sapiens
tacctgagaagaaacccgtgtt

SEQ ID NO: 9465116 - DNA, 22 bp, Homo sapiens
tacccagcccatgcctacctca

SEQ ID NO: 9465117 - DNA, 22 bp, Homo sapiens
tacctgagttatattaataatt

SEQ ID NO: 9465118 - DNA, 22 bp, Homo sapiens
tacctgaggtaaggatgatgag

SEQ ID NO: 9465119 - DNA, 22 bp, Homo sapiens
tacctgagttatattaataatt

SEQ ID NO: 9465120 - DNA, 22 bp, Homo sapiens
taccttctctagatctttattc

SEQ ID NO: 9465121 - DNA, 22 bp, Homo sapiens
taccttctctagatctttattc

SEQ ID NO: 9465122 - DNA, 22 bp, Homo sapiens
taccttggggttttgttgctct

SEQ ID NO: 9465123 - DNA, 22 bp, Homo sapiens
taccttgggttgagttcattct

SEQ ID NO: 9465124 - DNA, 22 bp, Homo sapiens
taccttgggctattatctttga

SEQ ID NO: 9465125 - DNA, 22 bp, Homo sapiens
taccttggaggccaagcagttt

SEQ ID NO: 9465126 - DNA, 22 bp, Homo sapiens
taccttggaaatgctagagtaa

SEQ ID NO: 9465127 - DNA, 22 bp, Homo sapiens
taccttgggagacgccaggccc

SEQ ID NO: 9465128 - DNA, 22 bp, Homo sapiens
tacctggatatcattcattctc

SEQ ID NO: 9465129 - DNA, 22 bp, Homo sapiens
tacctggagcaggaggcagaat

SEQ ID NO: 9465130 - DNA, 22 bp, Homo sapiens
tacctggaatagagtctctcca

SEQ ID NO: 9465131 - DNA, 22 bp, Homo sapiens
tacctggaatcacagaggctga

SEQ ID NO: 9465132 - DNA, 22 bp, Homo sapiens
tacctggaatttatatagctat

SEQ ID NO: 9465133 - DNA, 22 bp, Homo sapiens
tacctgtcaaaagacatggaga

SEQ ID NO: 9465134 - DNA, 22 bp, Homo sapiens
tacctggggctgggctttgatt

SEQ ID NO: 9465135 - DNA, 18 bp, Homo sapiens
tacaggaaggggttctcg

SEQ ID NO: 9465136 - DNA, 22 bp, Homo sapiens
tacaggaaggctctggaggtgc

SEQ ID NO: 9465137 - DNA, 22 bp, Homo sapiens
tacaggaagcactcaagaaatg

SEQ ID NO: 9465138 - DNA, 22 bp, Homo sapiens
tacaggaaggagcacatcggga

SEQ ID NO: 9465139 - DNA, 22 bp, Homo sapiens
tacaggaagtaagtaatgaaat

SEQ ID NO: 9465140 - DNA, 22 bp, Homo sapiens
tacaggaagtaagtaatgaaat

SEQ ID NO: 9465141 - DNA, 22 bp, Homo sapiens
tacaggaagtaagtaatgaaat

SEQ ID NO: 9465142 - DNA, 22 bp, Homo sapiens
tacaggaagtctcagtacagta

SEQ ID NO: 9465143 - DNA, 22 bp, Homo sapiens
tacaggaagtctcagtacagta

SEQ ID NO: 9465144 - DNA, 22 bp, Homo sapiens
tacaggaactgggcaggacatt

SEQ ID NO: 9465145 - DNA, 22 bp, Homo sapiens
tacaggaactgggcaggacatt

SEQ ID NO: 9465146 - DNA, 22 bp, Homo sapiens
tacaggaaccagattgttcagc

SEQ ID NO: 9465147 - DNA, 22 bp, Homo sapiens
tacaggaaccagattgttcagc

SEQ ID NO: 9465148 - DNA, 22 bp, Homo sapiens
tacaggaactgggcaggacatt

SEQ ID NO: 9465149 - DNA, 22 bp, Homo sapiens
tacaggaagcactcaagaaatg

SEQ ID NO: 9465150 - DNA, 22 bp, Homo sapiens
tacaggaaagaaatttgaactc

SEQ ID NO: 9465151 - DNA, 18 bp, Homo sapiens
tacaggaaaagtgttaca

SEQ ID NO: 9465152 - DNA, 22 bp, Homo sapiens
tacagcttttcatatttgtgtt

SEQ ID NO: 9465153 - DNA, 22 bp, Homo sapiens
tacagcttttgcagctgttttg

SEQ ID NO: 9465154 - DNA, 22 bp, Homo sapiens
tacagcttttgcagctgttttg

SEQ ID NO: 9465155 - DNA, 22 bp, Homo sapiens
tacagcttgacccataatgtct

SEQ ID NO: 9465156 - DNA, 22 bp, Homo sapiens
tacagcttcagtgtgccccagt

SEQ ID NO: 9465157 - DNA, 22 bp, Homo sapiens
tacagcttaaaagatgcattta

SEQ ID NO: 9465158 - DNA, 18 bp, Homo sapiens
tacagcttgagttgactg

SEQ ID NO: 9465159 - DNA, 22 bp, Homo sapiens
tacagcttgacccataatgtct

SEQ ID NO: 9465160 - DNA, 22 bp, Homo sapiens
tacagcttgatgagagcgcgag

SEQ ID NO: 9465161 - DNA, 22 bp, Homo sapiens
tacagctttgggaaggccccat

SEQ ID NO: 9465162 - DNA, 22 bp, Homo sapiens
tacagcttttcatatttgtgtt

SEQ ID NO: 9465163 - DNA, 22 bp, Homo sapiens
tacagctttatacccatcaaaa

SEQ ID NO: 9465164 - DNA, 22 bp, Homo sapiens
tacagcttgatgtttgtgtgtt

SEQ ID NO: 9465165 - DNA, 22 bp, Homo sapiens
tacagctttagcaaattaccta

SEQ ID NO: 9465166 - DNA, 22 bp, Homo sapiens
tacagcactctggggagcatga

SEQ ID NO: 9465167 - DNA, 22 bp, Homo sapiens
tacagcactgtgcatagtggtt

SEQ ID NO: 9465168 - DNA, 20 bp, Homo sapiens
tacagcagaaatgttttgct

SEQ ID NO: 9465169 - DNA, 22 bp, Homo sapiens
tacagcagactgaaggttgtgt

SEQ ID NO: 9465170 - DNA, 22 bp, Homo sapiens
tacagcagagtgggatgcatct

SEQ ID NO: 9465171 - DNA, 22 bp, Homo sapiens
tacagcagagtgggatgcatct

SEQ ID NO: 9465172 - DNA, 22 bp, Homo sapiens
tacagcagcatcgcagtgacct

SEQ ID NO: 9465173 - DNA, 22 bp, Homo sapiens
tacagcagcccaccttcttctg

SEQ ID NO: 9465174 - DNA, 22 bp, Homo sapiens
tacagcttaaaagatgcattta

SEQ ID NO: 9465175 - DNA, 22 bp, Homo sapiens
tacagcttatccagcttgatag

SEQ ID NO: 9465176 - DNA, 22 bp, Homo sapiens
tacaggagagatttagtaatca

SEQ ID NO: 9465177 - DNA, 17 bp, Homo sapiens
tacaggagagcaggaac

SEQ ID NO: 9465178 - DNA, 22 bp, Homo sapiens
tacagttaccctggaaagaaat

SEQ ID NO: 9465179 - DNA, 22 bp, Homo sapiens
tacagttaccctggaaagaaat

SEQ ID NO: 9465180 - DNA, 22 bp, Homo sapiens
tacaggaagttacagactatga

SEQ ID NO: 9465181 - DNA, 20 bp, Homo sapiens
tacaggaatcaagactgcat

SEQ ID NO: 9465182 - DNA, 20 bp, Homo sapiens
tacaggaatcaagactgcat

SEQ ID NO: 9465183 - DNA, 20 bp, Homo sapiens
tacaggaatcaagactgcat

SEQ ID NO: 9465184 - DNA, 22 bp, Homo sapiens
tacagttactgcatttctaata

SEQ ID NO: 9465185 - DNA, 22 bp, Homo sapiens
tacagtttgttacattgttagt

SEQ ID NO: 9465186 - DNA, 22 bp, Homo sapiens
tacagtttttcactgaagatgt

SEQ ID NO: 9465187 - DNA, 22 bp, Homo sapiens
tacataatgagctagttaagtt

SEQ ID NO: 9465188 - DNA, 22 bp, Homo sapiens
tacataataaggggcatggtgt

SEQ ID NO: 9465189 - DNA, 22 bp, Homo sapiens
tacataattaatctttaagttc

SEQ ID NO: 9465190 - DNA, 22 bp, Homo sapiens
tacataattaatctttaagttc

SEQ ID NO: 9465191 - DNA, 22 bp, Homo sapiens
tacatacaagatgtgtttaaaa

SEQ ID NO: 9465192 - DNA, 22 bp, Homo sapiens
tacataattaatctttaagttc

SEQ ID NO: 9465193 - DNA, 22 bp, Homo sapiens
tacataattaatctttaagttc

SEQ ID NO: 9465194 - DNA, 22 bp, Homo sapiens
tacataattgtctttgtcctca

SEQ ID NO: 9465195 - DNA, 22 bp, Homo sapiens
tacattcacttgttgaaggtgg

SEQ ID NO: 9465196 - DNA, 22 bp, Homo sapiens
tacattcacagttgttcatctc

SEQ ID NO: 9465197 - DNA, 22 bp, Homo sapiens
tacattcagagaaagtttccat

SEQ ID NO: 9465198 - DNA, 22 bp, Homo sapiens
tacattcagaattgggaggcaa

SEQ ID NO: 9465199 - DNA, 22 bp, Homo sapiens
tacattcagaagaatggacacg

SEQ ID NO: 9465200 - DNA, 22 bp, Homo sapiens
tacattcagaagaatggacacg

SEQ ID NO: 9465201 - DNA, 22 bp, Homo sapiens
tacattcagagaaagtttccat

SEQ ID NO: 9465202 - DNA, 22 bp, Homo sapiens
tacattcagcaaaagaatggtt

SEQ ID NO: 9465203 - DNA, 15 bp, Homo sapiens
tacattcatttccac

SEQ ID NO: 9465204 - DNA, 15 bp, Homo sapiens
tacattcatttccac

SEQ ID NO: 9465205 - DNA, 23 bp, Homo sapiens
tacattcatttgcacagccagta

SEQ ID NO: 9465206 - DNA, 22 bp, Homo sapiens
tacattcatggtgacttgtatg

SEQ ID NO: 9465207 - DNA, 22 bp, Homo sapiens
tacattcatggtgacttgtatg

SEQ ID NO: 9465208 - DNA, 22 bp, Homo sapiens
tacattcatggtgacttgtatg

SEQ ID NO: 9465209 - DNA, 22 bp, Homo sapiens
tacattcagcaaaagaatggtt

SEQ ID NO: 9465210 - DNA, 22 bp, Homo sapiens
tacattcatatgtgtgcataca

SEQ ID NO: 9465211 - DNA, 22 bp, Homo sapiens
tacattatcttgttatctttca

SEQ ID NO: 9465212 - DNA, 22 bp, Homo sapiens
tacattatcttgttatctttca

SEQ ID NO: 9465213 - DNA, 22 bp, Homo sapiens
tacattatttcatcagtcatct

SEQ ID NO: 9465214 - DNA, 22 bp, Homo sapiens
tacattatttcatcagtcatct

SEQ ID NO: 9465215 - DNA, 20 bp, Homo sapiens
tacattcaaaacaaactctg

SEQ ID NO: 9465216 - DNA, 22 bp, Homo sapiens
tacattcaacatgtcactatgt

SEQ ID NO: 9465217 - DNA, 22 bp, Homo sapiens
tacattcaaacgatttattgat

SEQ ID NO: 9465218 - DNA, 22 bp, Homo sapiens
tacattcaacatgtcactatgt

SEQ ID NO: 9465219 - DNA, 22 bp, Homo sapiens
tacattcaacatgtcactatgt

SEQ ID NO: 9465220 - DNA, 22 bp, Homo sapiens
tacattcaacatgtcactatgt

SEQ ID NO: 9465221 - DNA, 22 bp, Homo sapiens
tacattcacagttgttcatctc

SEQ ID NO: 9465222 - DNA, 22 bp, Homo sapiens
tacattcaacatgtcactatgt

SEQ ID NO: 9465223 - DNA, 22 bp, Homo sapiens
tacatacagtggatgctttagg

SEQ ID NO: 9465224 - DNA, 22 bp, Homo sapiens
tacatacagtggatgctttagg

SEQ ID NO: 9465225 - DNA, 22 bp, Homo sapiens
tacatacatattcatacaggtg

SEQ ID NO: 9465226 - DNA, 22 bp, Homo sapiens
tacattaacttacgtccacatg

SEQ ID NO: 9465227 - DNA, 22 bp, Homo sapiens
tacattaacttacgtccacatg

SEQ ID NO: 9465228 - DNA, 22 bp, Homo sapiens
tacatgtctgggttttgtttcc

SEQ ID NO: 9465229 - DNA, 22 bp, Homo sapiens
tacatgtattgatttctcttct

SEQ ID NO: 9465230 - DNA, 22 bp, Homo sapiens
tacatgtctacagccatgtctg

SEQ ID NO: 9465231 - DNA, 22 bp, Homo sapiens
tacatgtattgatttctcttct

SEQ ID NO: 9465232 - DNA, 22 bp, Homo sapiens
tacatgtctacagccatgtctg

SEQ ID NO: 9465233 - DNA, 22 bp, Homo sapiens
tacatgtctacatgcatttttg

SEQ ID NO: 9465234 - DNA, 22 bp, Homo sapiens
tacatgtatgtttatcttgaga

SEQ ID NO: 9465235 - DNA, 22 bp, Homo sapiens
tacatacacaaatatactgttt

SEQ ID NO: 9465236 - DNA, 22 bp, Homo sapiens
tacatacacaaatatactgttt

SEQ ID NO: 9465237 - DNA, 22 bp, Homo sapiens
tacatacaagcattcaatttta

SEQ ID NO: 9465238 - DNA, 22 bp, Homo sapiens
tacatacaagcattcaatttta

SEQ ID NO: 9465239 - DNA, 22 bp, Homo sapiens
tacatacaagcattcaatttta

SEQ ID NO: 9465240 - DNA, 22 bp, Homo sapiens
tacatacagagatgctagttaa

SEQ ID NO: 9465241 - DNA, 22 bp, Homo sapiens
tacatacacaaatgctgaatgg

SEQ ID NO: 9465242 - DNA, 22 bp, Homo sapiens
tacatacacaaatatactgttt

SEQ ID NO: 9465243 - DNA, 22 bp, Homo sapiens
tacatacacaaatatactgttt

SEQ ID NO: 9465244 - DNA, 22 bp, Homo sapiens
gttcatttttagaatgctagta

SEQ ID NO: 9465245 - DNA, 23 bp, Homo sapiens
gttcattttattgtctgattgct

SEQ ID NO: 9465246 - DNA, 19 bp, Homo sapiens
gttccaaaggccagacctt

SEQ ID NO: 9465247 - DNA, 22 bp, Homo sapiens
gttccaaatttggatctttagg

SEQ ID NO: 9465248 - DNA, 22 bp, Homo sapiens
gttccacaaaaggtctagttta

SEQ ID NO: 9465249 - DNA, 22 bp, Homo sapiens
gttagtgtatattgccttcaaa

SEQ ID NO: 9465250 - DNA, 22 bp, Homo sapiens
gttagtgtatattgccttcaaa

SEQ ID NO: 9465251 - DNA, 22 bp, Homo sapiens
gttagtgtgactgaggaatgca

SEQ ID NO: 9465252 - DNA, 22 bp, Homo sapiens
gttagtgtgactgaggaatgca

SEQ ID NO: 9465253 - DNA, 22 bp, Homo sapiens
gttagttgtaagtattctagag

SEQ ID NO: 9465254 - DNA, 22 bp, Homo sapiens
gttagtgcttattaaatagtat

SEQ ID NO: 9465255 - DNA, 22 bp, Homo sapiens
gttataaaatgcacagttgttt

SEQ ID NO: 9465256 - DNA, 22 bp, Homo sapiens
gttataaaggtgataatggtca

SEQ ID NO: 9465257 - DNA, 22 bp, Homo sapiens
gttataaaatgcacagttgttt

SEQ ID NO: 9465258 - DNA, 22 bp, Homo sapiens
gttataaaatgcacagttgttt

SEQ ID NO: 9465259 - DNA, 22 bp, Homo sapiens
gttataaaatgcacagttgttt

SEQ ID NO: 9465260 - DNA, 22 bp, Homo sapiens
gttataaatacctaataggatt

SEQ ID NO: 9465261 - DNA, 22 bp, Homo sapiens
gttataaatacctaataggatt

SEQ ID NO: 9465262 - DNA, 22 bp, Homo sapiens
gttataaatacctaataggatt

SEQ ID NO: 9465263 - DNA, 22 bp, Homo sapiens
gttataaatacctaataggatt

SEQ ID NO: 9465264 - DNA, 22 bp, Homo sapiens
gttataaatacctaataggatt

SEQ ID NO: 9465265 - DNA, 22 bp, Homo sapiens
gttataaaggtgataatggtca

SEQ ID NO: 9465266 - DNA, 22 bp, Homo sapiens
gttataaaggtgataatggtca

SEQ ID NO: 9465267 - DNA, 22 bp, Homo sapiens
gttataaaggtgataatggtca

SEQ ID NO: 9465268 - DNA, 22 bp, Homo sapiens
gttataaaggtgataatggtca

SEQ ID NO: 9465269 - DNA, 20 bp, Homo sapiens
gttaggaggttggacatgga

SEQ ID NO: 9465270 - DNA, 22 bp, Homo sapiens
gttagagggctgccttttgttt

SEQ ID NO: 9465271 - DNA, 22 bp, Homo sapiens
gttagagacatctctggtttct

SEQ ID NO: 9465272 - DNA, 22 bp, Homo sapiens
gttagagggaaaaatcatttgc

SEQ ID NO: 9465273 - DNA, 22 bp, Homo sapiens
gtgttacttaattagaatctgc

SEQ ID NO: 9465274 - DNA, 22 bp, Homo sapiens
gtgttacttacctgggacagca

SEQ ID NO: 9465275 - DNA, 22 bp, Homo sapiens
gtgttacttgccatacagaaaa

SEQ ID NO: 9465276 - DNA, 22 bp, Homo sapiens
gttacaaaggtcataaaagtgt

SEQ ID NO: 9465277 - DNA, 22 bp, Homo sapiens
gttacaaaggtcataaaagtgt

SEQ ID NO: 9465278 - DNA, 22 bp, Homo sapiens
gttacaaaggtcataaaagtgt

SEQ ID NO: 9465279 - DNA, 22 bp, Homo sapiens
gttacaaatgccaaagctgaga

SEQ ID NO: 9465280 - DNA, 22 bp, Homo sapiens
gttacaaaggtcataaaagtgt

SEQ ID NO: 9465281 - DNA, 22 bp, Homo sapiens
gttacaaaggtcataaaagtgt

SEQ ID NO: 9465282 - DNA, 22 bp, Homo sapiens
gttacaaaggtcataaaagtgt

SEQ ID NO: 9465283 - DNA, 22 bp, Homo sapiens
gttacaaaggtcataaaagtgt

SEQ ID NO: 9465284 - DNA, 22 bp, Homo sapiens
gttacaaaggtcataaaagtgt

SEQ ID NO: 9465285 - DNA, 22 bp, Homo sapiens
gttagacatgagtgtgcttaca

SEQ ID NO: 9465286 - DNA, 22 bp, Homo sapiens
gttactcttgagaggctgaggt

SEQ ID NO: 9465287 - DNA, 22 bp, Homo sapiens
gttagaaacacattcttattga

SEQ ID NO: 9465288 - DNA, 22 bp, Homo sapiens
gttagaaacacattcttattga

SEQ ID NO: 9465289 - DNA, 22 bp, Homo sapiens
gtgttaaatgcaatcacatgca

SEQ ID NO: 9465290 - DNA, 22 bp, Homo sapiens
gtgttaaatttctaatttgtga

SEQ ID NO: 9465291 - DNA, 22 bp, Homo sapiens
gtgttaatgaaaaacaactcat

SEQ ID NO: 9465292 - DNA, 22 bp, Homo sapiens
gtgttaatggtagaatctgagt

SEQ ID NO: 9465293 - DNA, 22 bp, Homo sapiens
gtgttaatggctatgaactgat

SEQ ID NO: 9465294 - DNA, 22 bp, Homo sapiens
gtgttaatggtagaatctgagt

SEQ ID NO: 9465295 - DNA, 22 bp, Homo sapiens
gtgttactgggaggacggaggt

SEQ ID NO: 9465296 - DNA, 22 bp, Homo sapiens
gtgttactgcttttatctacca

SEQ ID NO: 9465297 - DNA, 23 bp, Homo sapiens
gtgttactctgataggtgctttt

SEQ ID NO: 9465298 - DNA, 22 bp, Homo sapiens
gtgttactgacacatttttgtc

SEQ ID NO: 9465299 - DNA, 22 bp, Homo sapiens
gtgttactaaaatttgattctt

SEQ ID NO: 9465300 - DNA, 23 bp, Homo sapiens
gtgttactaaagatgaacattta

SEQ ID NO: 9465301 - DNA, 23 bp, Homo sapiens
gtgttactaaagatgaacattta

SEQ ID NO: 9465302 - DNA, 22 bp, Homo sapiens
gtgttactcaagagatagcttt

SEQ ID NO: 9465303 - DNA, 22 bp, Homo sapiens
gtgtgtttagcattagcagggg

SEQ ID NO: 9465304 - DNA, 22 bp, Homo sapiens
gtgtgttccatggggacaacag

SEQ ID NO: 9465305 - DNA, 22 bp, Homo sapiens
gtgtgttcagcaagaggtaagg

SEQ ID NO: 9465306 - DNA, 22 bp, Homo sapiens
gtgtgtgttcaataaatttaag

SEQ ID NO: 9465307 - DNA, 22 bp, Homo sapiens
gtgtgtgttcaataaatttaag

SEQ ID NO: 9465308 - DNA, 22 bp, Homo sapiens
gtgtgtgttcaataaatttaag

SEQ ID NO: 9465309 - DNA, 22 bp, Homo sapiens
gtgtgtgtgtaaaaatccagag

SEQ ID NO: 9465310 - DNA, 22 bp, Homo sapiens
gtgtgtgtgcctgcacacacac

SEQ ID NO: 9465311 - DNA, 22 bp, Homo sapiens
gtgtgtgtgtaaaaatccagag

SEQ ID NO: 9465312 - DNA, 22 bp, Homo sapiens
gtgtgtgtgtaaaaatccagag

SEQ ID NO: 9465313 - DNA, 22 bp, Homo sapiens
gtgtgtgtgtaaaaatccagag

SEQ ID NO: 9465314 - DNA, 22 bp, Homo sapiens
gtgtgtgttcaataaatttaag

SEQ ID NO: 9465315 - DNA, 22 bp, Homo sapiens
gtgtgtgtgcctgcacacacac

SEQ ID NO: 9465316 - DNA, 22 bp, Homo sapiens
gtgtgtgtgcatctcttttatt

SEQ ID NO: 9465317 - DNA, 22 bp, Homo sapiens
gtgtgtgtgcatctcttttatt

SEQ ID NO: 9465318 - DNA, 22 bp, Homo sapiens
gtgtgtgtgcctgcacacacac

SEQ ID NO: 9465319 - DNA, 22 bp, Homo sapiens
gtgtgtgtgcctgcacacacac

SEQ ID NO: 9465320 - DNA, 23 bp, Homo sapiens
gtgctttatgatctgctgtccct

SEQ ID NO: 9465321 - DNA, 22 bp, Homo sapiens
gtgctttagttcttgcaactgg

SEQ ID NO: 9465322 - DNA, 22 bp, Homo sapiens
gtgctttctgctgcattcctct

SEQ ID NO: 9465323 - DNA, 22 bp, Homo sapiens
gtgctttctgctgcattcctct

SEQ ID NO: 9465324 - DNA, 22 bp, Homo sapiens
gtgcttttaaaggcaattagta

SEQ ID NO: 9465325 - DNA, 22 bp, Homo sapiens
gtgcttttaattctggtgagta

SEQ ID NO: 9465326 - DNA, 22 bp, Homo sapiens
gtgcttttaacttttgaaagga

SEQ ID NO: 9465327 - DNA, 22 bp, Homo sapiens
gtgctttagctgagttggtcaa

SEQ ID NO: 9465328 - DNA, 22 bp, Homo sapiens
gtgctttaaaccactgtgctgt

SEQ ID NO: 9465329 - DNA, 22 bp, Homo sapiens
gtgtgtgtctccgcggccgtag

SEQ ID NO: 9465330 - DNA, 22 bp, Homo sapiens
gtgtgtgtctccgcggccgtag

SEQ ID NO: 9465331 - DNA, 22 bp, Homo sapiens
gtgtgtgtctccgcggccgtag

SEQ ID NO: 9465332 - DNA, 22 bp, Homo sapiens
gtgtgtgtctccgcggccgtag

SEQ ID NO: 9465333 - DNA, 22 bp, Homo sapiens
gtgtgtgtgcatataacatata

SEQ ID NO: 9465334 - DNA, 22 bp, Homo sapiens
gtgtgtgtgcatctcttttatt

SEQ ID NO: 9465335 - DNA, 22 bp, Homo sapiens
gtgtgtgtgcatctcttttatt

SEQ ID NO: 9465336 - DNA, 22 bp, Homo sapiens
gtgtgtgtgcatataacatata

SEQ ID NO: 9465337 - DNA, 22 bp, Homo sapiens
gtgtgtgtgcatataacatata

SEQ ID NO: 9465338 - DNA, 22 bp, Homo sapiens
gtgtgtgtgcatataacatata

SEQ ID NO: 9465339 - DNA, 22 bp, Homo sapiens
gtgtgtgtatctgcctatcaca

SEQ ID NO: 9465340 - DNA, 21 bp, Homo sapiens
gtgtgtctaatgtagtggaaa

SEQ ID NO: 9465341 - DNA, 22 bp, Homo sapiens
gtgtgtgtatctgcctatcaca

SEQ ID NO: 9465342 - DNA, 22 bp, Homo sapiens
gtgtgtgtatctgcctatcaca

SEQ ID NO: 9465343 - DNA, 22 bp, Homo sapiens
gtgtgtgtatctgcctatcaca

SEQ ID NO: 9465344 - DNA, 22 bp, Homo sapiens
gtgcttttctgcagggtcctat

SEQ ID NO: 9465345 - DNA, 22 bp, Homo sapiens
gtgcttttccttatttggtgct

SEQ ID NO: 9465346 - DNA, 21 bp, Homo sapiens
gtgcttttccttaatgttctt

SEQ ID NO: 9465347 - DNA, 19 bp, Homo sapiens
gtgctttttaagagctcag

SEQ ID NO: 9465348 - DNA, 19 bp, Homo sapiens
gtgctttttaagagctcag

SEQ ID NO: 9465349 - DNA, 19 bp, Homo sapiens
gtgctttttaagagctcag

SEQ ID NO: 9465350 - DNA, 22 bp, Homo sapiens
gtttctcagcatgtcagtacaa

SEQ ID NO: 9465351 - DNA, 22 bp, Homo sapiens
gtttctcacttccagtagccaa

SEQ ID NO: 9465352 - DNA, 22 bp, Homo sapiens
gtttctcacaaggctgcaatcc

SEQ ID NO: 9465353 - DNA, 22 bp, Homo sapiens
gtttctcaagcttgaatgcaca

SEQ ID NO: 9465354 - DNA, 22 bp, Homo sapiens
gtttctcaaattatttcagctt

SEQ ID NO: 9465355 - DNA, 22 bp, Homo sapiens
gtttctcaacatgctttctaac

SEQ ID NO: 9465356 - DNA, 22 bp, Homo sapiens
gtttctcaacatgctttctaac

SEQ ID NO: 9465357 - DNA, 22 bp, Homo sapiens
gtttctcaacatgctttctaac

SEQ ID NO: 9465358 - DNA, 22 bp, Homo sapiens
gtttctcaacatgctttctaac

SEQ ID NO: 9465359 - DNA, 22 bp, Homo sapiens
gtttctaattggaactttgagg

SEQ ID NO: 9465360 - DNA, 22 bp, Homo sapiens
gtttctaattggaactttgagg

SEQ ID NO: 9465361 - DNA, 22 bp, Homo sapiens
gtttctaagcacatgtgagtgt

SEQ ID NO: 9465362 - DNA, 22 bp, Homo sapiens
gtttctaagggagagctgccag

SEQ ID NO: 9465363 - DNA, 22 bp, Homo sapiens
gtttctaaatgttctgagtttt

SEQ ID NO: 9465364 - DNA, 22 bp, Homo sapiens
gtttctaaatgttctgagtttt

SEQ ID NO: 9465365 - DNA, 22 bp, Homo sapiens
gtttctaagcacatgtgagtgt

SEQ ID NO: 9465366 - DNA, 22 bp, Homo sapiens
gtttctaagcacatgtgagtgt

SEQ ID NO: 9465367 - DNA, 22 bp, Homo sapiens
gtttctaaatgttctgagtttt

SEQ ID NO: 9465368 - DNA, 22 bp, Homo sapiens
gtttcctttttctgccctcaat

SEQ ID NO: 9465369 - DNA, 22 bp, Homo sapiens
gtttcctttttctgccctcaat

SEQ ID NO: 9465370 - DNA, 22 bp, Homo sapiens
gtttccgccctgggcctgtggg

SEQ ID NO: 9465371 - DNA, 22 bp, Homo sapiens
gtttcctacactgtagtattat

SEQ ID NO: 9465372 - DNA, 22 bp, Homo sapiens
gtttcctttgccagtaaatggg

SEQ ID NO: 9465373 - DNA, 22 bp, Homo sapiens
gtttccttttggaattagagct

SEQ ID NO: 9465374 - DNA, 22 bp, Homo sapiens
gtttccttttggaattagagct

SEQ ID NO: 9465375 - DNA, 22 bp, Homo sapiens
gtttccttttggaattagagct

SEQ ID NO: 9465376 - DNA, 22 bp, Homo sapiens
gtttatacagtgcatggtgtta

SEQ ID NO: 9465377 - DNA, 22 bp, Homo sapiens
gtttataaggcccaatatttct

SEQ ID NO: 9465378 - DNA, 22 bp, Homo sapiens
gtttataatccaactctgctcc

SEQ ID NO: 9465379 - DNA, 22 bp, Homo sapiens
gttttacacacctatgaaagac

SEQ ID NO: 9465380 - DNA, 22 bp, Homo sapiens
gttttagtgggtggccactgat

SEQ ID NO: 9465381 - DNA, 22 bp, Homo sapiens
gttttagtgggtggccactgat

SEQ ID NO: 9465382 - DNA, 22 bp, Homo sapiens
gtttctgttgctcagataatgc

SEQ ID NO: 9465383 - DNA, 22 bp, Homo sapiens
gtttcttaaatgtagcaggacc

SEQ ID NO: 9465384 - DNA, 22 bp, Homo sapiens
gtttcttaagttacaaaatctt

SEQ ID NO: 9465385 - DNA, 22 bp, Homo sapiens
gtttcttaagttacaaaatctt

SEQ ID NO: 9465386 - DNA, 22 bp, Homo sapiens
gtttcttaagttacaaaatctt

SEQ ID NO: 9465387 - DNA, 22 bp, Homo sapiens
gtttctcctctgtgtcttgttt

SEQ ID NO: 9465388 - DNA, 22 bp, Homo sapiens
gtttctcatcagtttctgatat

SEQ ID NO: 9465389 - DNA, 22 bp, Homo sapiens
gtttctcatcagtttctgatat

SEQ ID NO: 9465390 - DNA, 22 bp, Homo sapiens
gtttctcagtttggtctgcaga

SEQ ID NO: 9465391 - DNA, 22 bp, Homo sapiens
gtttctctgtacctctgtccca

SEQ ID NO: 9465392 - DNA, 22 bp, Homo sapiens
gtttctctgtctgttacattgg

SEQ ID NO: 9465393 - DNA, 22 bp, Homo sapiens
gtttctctgtctgttacattgg

SEQ ID NO: 9465394 - DNA, 22 bp, Homo sapiens
gtttctcttaacacataaagta

SEQ ID NO: 9465395 - DNA, 22 bp, Homo sapiens
gtttctgagagccacacacagc

SEQ ID NO: 9465396 - DNA, 22 bp, Homo sapiens
gtttctgagcacttttattgca

SEQ ID NO: 9465397 - DNA, 22 bp, Homo sapiens
gtttctgaagggattacttggt

SEQ ID NO: 9465398 - DNA, 22 bp, Homo sapiens
gtttctgtaagactgaattgac

SEQ ID NO: 9465399 - DNA, 22 bp, Homo sapiens
gtttctggcgccggggcaggcc

SEQ ID NO: 9465400 - DNA, 22 bp, Homo sapiens
gtttctggagtgactataactg

SEQ ID NO: 9465401 - DNA, 22 bp, Homo sapiens
gtttctgctccagtgatgcaag

SEQ ID NO: 9465402 - DNA, 22 bp, Homo sapiens
gtttctgctgcgtgctccagga

SEQ ID NO: 9465403 - DNA, 22 bp, Homo sapiens
gtttctgattctagaggcaggc

SEQ ID NO: 9465404 - DNA, 22 bp, Homo sapiens
gttcctggtggtcatggcagct

SEQ ID NO: 9465405 - DNA, 22 bp, Homo sapiens
gttcctgggaggcatgggctgg

SEQ ID NO: 9465406 - DNA, 22 bp, Homo sapiens
gttcctgggaggcatgggctgg

SEQ ID NO: 9465407 - DNA, 22 bp, Homo sapiens
gttcctgggcctgcattcacca

SEQ ID NO: 9465408 - DNA, 22 bp, Homo sapiens
gttcctggtggtcatggcagct

SEQ ID NO: 9465409 - DNA, 23 bp, Homo sapiens
gttccttcatgtggtcattggtt

SEQ ID NO: 9465410 - DNA, 22 bp, Homo sapiens
gttccttgggaacaacgctgaa

SEQ ID NO: 9465411 - DNA, 22 bp, Homo sapiens
gttccttggaagaacttgaggt

SEQ ID NO: 9465412 - DNA, 22 bp, Homo sapiens
gtttacaaatattttaaatggt

SEQ ID NO: 9465413 - DNA, 22 bp, Homo sapiens
gtttaattttaggttgtcaagc

SEQ ID NO: 9465414 - DNA, 22 bp, Homo sapiens
gtttacaaatattttaaatggt

SEQ ID NO: 9465415 - DNA, 22 bp, Homo sapiens
gttccttgggaacaacgctgaa

SEQ ID NO: 9465416 - DNA, 22 bp, Homo sapiens
gttccttgggaacaacgctgaa

SEQ ID NO: 9465417 - DNA, 22 bp, Homo sapiens
gttccttgtaatttgttaagga

SEQ ID NO: 9465418 - DNA, 22 bp, Homo sapiens
gttccttgtatttcagacatga

SEQ ID NO: 9465419 - DNA, 22 bp, Homo sapiens
gttccttgtatttcagacatga

SEQ ID NO: 9465420 - DNA, 22 bp, Homo sapiens
gttccttgtatttcagacatga

SEQ ID NO: 9465421 - DNA, 22 bp, Homo sapiens
gttcctttcctatttggataag

SEQ ID NO: 9465422 - DNA, 22 bp, Homo sapiens
gttccaggtggtcacagagctc

SEQ ID NO: 9465423 - DNA, 22 bp, Homo sapiens
gttccaggtggtcacagagctc

SEQ ID NO: 9465424 - DNA, 22 bp, Homo sapiens
gttccagggaagggaaggcaga

SEQ ID NO: 9465425 - DNA, 22 bp, Homo sapiens
gttccaggcagtggcaacagct

SEQ ID NO: 9465426 - DNA, 22 bp, Homo sapiens
gttccaggcaagtgggatagga

SEQ ID NO: 9465427 - DNA, 18 bp, Homo sapiens
gttcccagatggtgctga

SEQ ID NO: 9465428 - DNA, 22 bp, Homo sapiens
gttcctgggaggcatgggctgg

SEQ ID NO: 9465429 - DNA, 22 bp, Homo sapiens
gttccaggaccctggcctctga

SEQ ID NO: 9465430 - DNA, 22 bp, Homo sapiens
gttccacaaaatgtacccagtt

SEQ ID NO: 9465431 - DNA, 22 bp, Homo sapiens
gttccacataacacatctacaa

SEQ ID NO: 9465432 - DNA, 20 bp, Homo sapiens
gtttagctccaaatatgatc

SEQ ID NO: 9465433 - DNA, 22 bp, Homo sapiens
gtttataaggcccaatatttct

SEQ ID NO: 9465434 - DNA, 22 bp, Homo sapiens
gtttataaattctgcttttgtt

SEQ ID NO: 9465435 - DNA, 22 bp, Homo sapiens
gtttagtgtttcaagactcttt

SEQ ID NO: 9465436 - DNA, 22 bp, Homo sapiens
gtttagtgtttcaagactcttt

SEQ ID NO: 9465437 - DNA, 22 bp, Homo sapiens
gtttagaatggcaaaattaagt

SEQ ID NO: 9465438 - DNA, 22 bp, Homo sapiens
gtttagaatgaaacttttgagc

SEQ ID NO: 9465439 - DNA, 22 bp, Homo sapiens
gtttagaatggcaaaattaagt

SEQ ID NO: 9465440 - DNA, 22 bp, Homo sapiens
gtttagatgaaagtttgtttca

SEQ ID NO: 9465441 - DNA, 22 bp, Homo sapiens
gtttagaattctaactttaagg

SEQ ID NO: 9465442 - DNA, 22 bp, Homo sapiens
gtttagaattctaactttaagg

SEQ ID NO: 9465443 - DNA, 22 bp, Homo sapiens
gtttagaattctaactttaagg

SEQ ID NO: 9465444 - DNA, 22 bp, Homo sapiens
gtttagaagccaagatttgggt

SEQ ID NO: 9465445 - DNA, 22 bp, Homo sapiens
gtttagaagccaagatttgggt

SEQ ID NO: 9465446 - DNA, 21 bp, Homo sapiens
gtttagaagtagtctggctca

SEQ ID NO: 9465447 - DNA, 22 bp, Homo sapiens
gtttacttgtgccttggcttaa

SEQ ID NO: 9465448 - DNA, 22 bp, Homo sapiens
gtttagaacacggaaatactga

SEQ ID NO: 9465449 - DNA, 22 bp, Homo sapiens
gtttagaaaatagtgaagcaag

SEQ ID NO: 9465450 - DNA, 22 bp, Homo sapiens
gtttacttagatgctcatgcag

SEQ ID NO: 9465451 - DNA, 22 bp, Homo sapiens
gtttactgttttctgataagtg

SEQ ID NO: 9465452 - DNA, 22 bp, Homo sapiens
gtttactgttttctgataagtg

SEQ ID NO: 9465453 - DNA, 22 bp, Homo sapiens
gtttactgctctaggttgcaca

SEQ ID NO: 9465454 - DNA, 22 bp, Homo sapiens
gtttactggagaagatgacctg

SEQ ID NO: 9465455 - DNA, 22 bp, Homo sapiens
gtttactgttaaccaacgaatg

SEQ ID NO: 9465456 - DNA, 22 bp, Homo sapiens
gtttacaaatattttaaatggt

SEQ ID NO: 9465457 - DNA, 22 bp, Homo sapiens
gtttacattgctgtttgtgtct

SEQ ID NO: 9465458 - DNA, 22 bp, Homo sapiens
gttttattggaacacagccatg

SEQ ID NO: 9465459 - DNA, 22 bp, Homo sapiens
gttttattggaacacagccatg

SEQ ID NO: 9465460 - DNA, 22 bp, Homo sapiens
gttttattggaacacagccatg

SEQ ID NO: 9465461 - DNA, 22 bp, Homo sapiens
gttttattggaacacagccatg

SEQ ID NO: 9465462 - DNA, 22 bp, Homo sapiens
gttttattggaacacagccatg

SEQ ID NO: 9465463 - DNA, 22 bp, Homo sapiens
gttttattggaacacagccatg

SEQ ID NO: 9465464 - DNA, 22 bp, Homo sapiens
gttttattggaacacagccatg

SEQ ID NO: 9465465 - DNA, 22 bp, Homo sapiens
gttttatttccatgagagaccg

SEQ ID NO: 9465466 - DNA, 22 bp, Homo sapiens
gttttatttccatgagagaccg

SEQ ID NO: 9465467 - DNA, 22 bp, Homo sapiens
gttttatttccatgagagaccg

SEQ ID NO: 9465468 - DNA, 22 bp, Homo sapiens
gttttatttccatgagagaccg

SEQ ID NO: 9465469 - DNA, 22 bp, Homo sapiens
gttttagtgtaacggagtgtga

SEQ ID NO: 9465470 - DNA, 22 bp, Homo sapiens
gttttagtgtaacggagtgtga

SEQ ID NO: 9465471 - DNA, 22 bp, Homo sapiens
gttttataattgcttcataaga

SEQ ID NO: 9465472 - DNA, 22 bp, Homo sapiens
gttttataggctgttgctatat

SEQ ID NO: 9465473 - DNA, 20 bp, Homo sapiens
gttttatgccagttctgtgt

SEQ ID NO: 9465474 - DNA, 22 bp, Homo sapiens
gttttatgagacctcaggaata

SEQ ID NO: 9465475 - DNA, 22 bp, Homo sapiens
gttttataggtgaaatattact

SEQ ID NO: 9465476 - DNA, 22 bp, Homo sapiens
gttttataggtgaaatattact

SEQ ID NO: 9465477 - DNA, 22 bp, Homo sapiens
taaacagagatgcctgggtctg

SEQ ID NO: 9465478 - DNA, 22 bp, Homo sapiens
taaacagagatgcctgggtctg

SEQ ID NO: 9465479 - DNA, 22 bp, Homo sapiens
taaacagagagtgcagttatag

SEQ ID NO: 9465480 - DNA, 22 bp, Homo sapiens
taaacagagagtgcagttatag

SEQ ID NO: 9465481 - DNA, 22 bp, Homo sapiens
taaacagagaagactttgagca

SEQ ID NO: 9465482 - DNA, 22 bp, Homo sapiens
taaacagagagtgcagttatag

SEQ ID NO: 9465483 - DNA, 22 bp, Homo sapiens
taaacagcctaaaactttcttt

SEQ ID NO: 9465484 - DNA, 22 bp, Homo sapiens
taaacagcctaaaactttcttt

SEQ ID NO: 9465485 - DNA, 22 bp, Homo sapiens
taaacagcctcccctttcactc

SEQ ID NO: 9465486 - DNA, 22 bp, Homo sapiens
taaacagcctcccctttcactc

SEQ ID NO: 9465487 - DNA, 16 bp, Homo sapiens
taaacagcagacagtt

SEQ ID NO: 9465488 - DNA, 22 bp, Homo sapiens
taaacagagtgctagttcacgg

SEQ ID NO: 9465489 - DNA, 22 bp, Homo sapiens
taaacagagtgctagttcacgg

SEQ ID NO: 9465490 - DNA, 23 bp, Homo sapiens
gttttcaacacaataaatgtaac

SEQ ID NO: 9465491 - DNA, 23 bp, Homo sapiens
gttttcaacacaataaatgtaac

SEQ ID NO: 9465492 - DNA, 22 bp, Homo sapiens
taaacagaattcaggcaagata

SEQ ID NO: 9465493 - DNA, 22 bp, Homo sapiens
taaacagagaagactttgagca

SEQ ID NO: 9465494 - DNA, 21 bp, Homo sapiens
gttttcatgatagagtctgta

SEQ ID NO: 9465495 - DNA, 22 bp, Homo sapiens
taaacatgcccagtgacaggga

SEQ ID NO: 9465496 - DNA, 22 bp, Homo sapiens
taaacatggattctgatcacag

SEQ ID NO: 9465497 - DNA, 22 bp, Homo sapiens
taaacatctgtagccttcagtc

SEQ ID NO: 9465498 - DNA, 22 bp, Homo sapiens
taaacatggctgtttcagttat

SEQ ID NO: 9465499 - DNA, 22 bp, Homo sapiens
taaacatggctgtttcagttat

SEQ ID NO: 9465500 - DNA, 22 bp, Homo sapiens
taaacatctgaatcctgcttcc

SEQ ID NO: 9465501 - DNA, 22 bp, Homo sapiens
taaacagctactgtgtcaaagg

SEQ ID NO: 9465502 - DNA, 22 bp, Homo sapiens
taaacaggagttgaagcagtaa

SEQ ID NO: 9465503 - DNA, 22 bp, Homo sapiens
taaagtttatttgaacatctct

SEQ ID NO: 9465504 - DNA, 22 bp, Homo sapiens
taaagtttggcagacaataaca

SEQ ID NO: 9465505 - DNA, 22 bp, Homo sapiens
taaagtttattggcaccaccat

SEQ ID NO: 9465506 - DNA, 22 bp, Homo sapiens
taaagttcttagaacaaggcct

SEQ ID NO: 9465507 - DNA, 22 bp, Homo sapiens
taaagtttgtagcaattgatat

SEQ ID NO: 9465508 - DNA, 22 bp, Homo sapiens
taaagtttggcagacaataaca

SEQ ID NO: 9465509 - DNA, 22 bp, Homo sapiens
taaagtttggcagacaataaca

SEQ ID NO: 9465510 - DNA, 22 bp, Homo sapiens
taaagtttggcagacaataaca

SEQ ID NO: 9465511 - DNA, 22 bp, Homo sapiens
taaagtttgtagcaattgatat

SEQ ID NO: 9465512 - DNA, 22 bp, Homo sapiens
taaataagtcactgaccattta

SEQ ID NO: 9465513 - DNA, 22 bp, Homo sapiens
taaagtttgtagcaattgatat

SEQ ID NO: 9465514 - DNA, 21 bp, Homo sapiens
taaataataagttgctgagat

SEQ ID NO: 9465515 - DNA, 21 bp, Homo sapiens
taaataataagttgctgagat

SEQ ID NO: 9465516 - DNA, 21 bp, Homo sapiens
taaataataagttgctgagat

SEQ ID NO: 9465517 - DNA, 21 bp, Homo sapiens
taaataataagttgctgagat

SEQ ID NO: 9465518 - DNA, 21 bp, Homo sapiens
taaataataagttgctgagat

SEQ ID NO: 9465519 - DNA, 22 bp, Homo sapiens
taaataagttcttcattgtttg

SEQ ID NO: 9465520 - DNA, 22 bp, Homo sapiens
taaataagttcttcattgtttg

SEQ ID NO: 9465521 - DNA, 22 bp, Homo sapiens
taaataagttcttcattgtttg

SEQ ID NO: 9465522 - DNA, 21 bp, Homo sapiens
taaataataagttgctgagat

SEQ ID NO: 9465523 - DNA, 22 bp, Homo sapiens
taaacatgttgacatcttacct

SEQ ID NO: 9465524 - DNA, 22 bp, Homo sapiens
taaactgtagctctcgtaattc

SEQ ID NO: 9465525 - DNA, 22 bp, Homo sapiens
taaactgtggaatgttctcttt

SEQ ID NO: 9465526 - DNA, 22 bp, Homo sapiens
taaactgtgaaaggcttaacat

SEQ ID NO: 9465527 - DNA, 22 bp, Homo sapiens
taaagaacacagggaatagcac

SEQ ID NO: 9465528 - DNA, 21 bp, Homo sapiens
taaagaagatgaatgtgatca

SEQ ID NO: 9465529 - DNA, 21 bp, Homo sapiens
taaagaagatgaatgtgatca

SEQ ID NO: 9465530 - DNA, 21 bp, Homo sapiens
taaagaagatgaatgtgatca

SEQ ID NO: 9465531 - DNA, 22 bp, Homo sapiens
taaagacaaacccactagggtt

SEQ ID NO: 9465532 - DNA, 22 bp, Homo sapiens
taaagacaaacccactagggtt

SEQ ID NO: 9465533 - DNA, 22 bp, Homo sapiens
taaagacaataggaaagttgtt

SEQ ID NO: 9465534 - DNA, 22 bp, Homo sapiens
taaagacaaatgacattacggc

SEQ ID NO: 9465535 - DNA, 22 bp, Homo sapiens
taaagaataatacccatggagc

SEQ ID NO: 9465536 - DNA, 21 bp, Homo sapiens
taaagaagatgaatgtgatca

SEQ ID NO: 9465537 - DNA, 21 bp, Homo sapiens
taaagaagatgaatgtgatca

SEQ ID NO: 9465538 - DNA, 22 bp, Homo sapiens
taaagacaatttcgagctgtag

SEQ ID NO: 9465539 - DNA, 22 bp, Homo sapiens
taaagacaatttcgagctgtag

SEQ ID NO: 9465540 - DNA, 22 bp, Homo sapiens
taaagacaataggaaagttgtt

SEQ ID NO: 9465541 - DNA, 22 bp, Homo sapiens
taaagacaataggaaagttgtt

SEQ ID NO: 9465542 - DNA, 22 bp, Homo sapiens
taaagacacccagggagggact

SEQ ID NO: 9465543 - DNA, 22 bp, Homo sapiens
taaagtgtgcatggtcaaatat

SEQ ID NO: 9465544 - DNA, 22 bp, Homo sapiens
taaagacactggttttaatcat

SEQ ID NO: 9465545 - DNA, 22 bp, Homo sapiens
taaagtgtgcatggtcaaatat

SEQ ID NO: 9465546 - DNA, 22 bp, Homo sapiens
taaagtgtgtatatacatatgg

SEQ ID NO: 9465547 - DNA, 22 bp, Homo sapiens
taaagtgtgtatatacatatgg

SEQ ID NO: 9465548 - DNA, 22 bp, Homo sapiens
taaagttataaattacctgtca

SEQ ID NO: 9465549 - DNA, 22 bp, Homo sapiens
taaagtgttgtacaaatgtatg

SEQ ID NO: 9465550 - DNA, 22 bp, Homo sapiens
taaagtgttgtacaaatgtatg

SEQ ID NO: 9465551 - DNA, 22 bp, Homo sapiens
taagataaggaacattctgtga

SEQ ID NO: 9465552 - DNA, 22 bp, Homo sapiens
taagagttgaaggagattttca

SEQ ID NO: 9465553 - DNA, 22 bp, Homo sapiens
taagagttactggtttagaacc

SEQ ID NO: 9465554 - DNA, 22 bp, Homo sapiens
taagagtaagtgattaagaaga

SEQ ID NO: 9465555 - DNA, 22 bp, Homo sapiens
taagagtaagtgattaagaaga

SEQ ID NO: 9465556 - DNA, 22 bp, Homo sapiens
taagataataagtatgtctatg

SEQ ID NO: 9465557 - DNA, 22 bp, Homo sapiens
taagataataagtatgtctatg

SEQ ID NO: 9465558 - DNA, 22 bp, Homo sapiens
taagataataccatgggccagg

SEQ ID NO: 9465559 - DNA, 22 bp, Homo sapiens
taagataagtgggttgagatgg

SEQ ID NO: 9465560 - DNA, 22 bp, Homo sapiens
taagataagtgggttgagatgg

SEQ ID NO: 9465561 - DNA, 22 bp, Homo sapiens
taagataaggaacattctgtga

SEQ ID NO: 9465562 - DNA, 22 bp, Homo sapiens
taagataaggaacattctgtga

SEQ ID NO: 9465563 - DNA, 22 bp, Homo sapiens
taagataaggaacattctgtga

SEQ ID NO: 9465564 - DNA, 22 bp, Homo sapiens
taagatggttgtagatggactg

SEQ ID NO: 9465565 - DNA, 21 bp, Homo sapiens
taagcaaggaaagggcagccc

SEQ ID NO: 9465566 - DNA, 22 bp, Homo sapiens
taagcaagatttattgaatttt

SEQ ID NO: 9465567 - DNA, 22 bp, Homo sapiens
taagcaagggtctctgtatcag

SEQ ID NO: 9465568 - DNA, 22 bp, Homo sapiens
taagcaagtggtagaaggacaa

SEQ ID NO: 9465569 - DNA, 22 bp, Homo sapiens
taagatgggggaaagaaatagt

SEQ ID NO: 9465570 - DNA, 22 bp, Homo sapiens
taagatgaggtaggtaagactt

SEQ ID NO: 9465571 - DNA, 22 bp, Homo sapiens
taagatgaaggctcacctagaa

SEQ ID NO: 9465572 - DNA, 22 bp, Homo sapiens
taagataatccattataatgtt

SEQ ID NO: 9465573 - DNA, 22 bp, Homo sapiens
taagatagaactctgaggctac

SEQ ID NO: 9465574 - DNA, 22 bp, Homo sapiens
taagatatggtaggaagtttgg

SEQ ID NO: 9465575 - DNA, 22 bp, Homo sapiens
taagatatggtaggaagtttgg

SEQ ID NO: 9465576 - DNA, 22 bp, Homo sapiens
taagaaacccaggaatttctta

SEQ ID NO: 9465577 - DNA, 22 bp, Homo sapiens
taagaaactaatgcaataagag

SEQ ID NO: 9465578 - DNA, 22 bp, Homo sapiens
taagaaactaatgcaataagag

SEQ ID NO: 9465579 - DNA, 22 bp, Homo sapiens
taagaaactatggagaagaact

SEQ ID NO: 9465580 - DNA, 22 bp, Homo sapiens
taagaaactatggagaagaact

SEQ ID NO: 9465581 - DNA, 22 bp, Homo sapiens
taagaaactaatgcaataagag

SEQ ID NO: 9465582 - DNA, 22 bp, Homo sapiens
taagaaacccaggaatttctta

SEQ ID NO: 9465583 - DNA, 22 bp, Homo sapiens
taagaaactaatgcaataagag

SEQ ID NO: 9465584 - DNA, 22 bp, Homo sapiens
taagaaatttagttatagaatg

SEQ ID NO: 9465585 - DNA, 22 bp, Homo sapiens
taagaaatttagttatagaatg

SEQ ID NO: 9465586 - DNA, 22 bp, Homo sapiens
taagaaacttaactgggaacta

SEQ ID NO: 9465587 - DNA, 22 bp, Homo sapiens
taagaaatttagttatagaatg

SEQ ID NO: 9465588 - DNA, 22 bp, Homo sapiens
taagaaactattgtctctgaac

SEQ ID NO: 9465589 - DNA, 22 bp, Homo sapiens
taagaaactattgtctctgaac

SEQ ID NO: 9465590 - DNA, 22 bp, Homo sapiens
taagaaactgtcacagtactat

SEQ ID NO: 9465591 - DNA, 22 bp, Homo sapiens
taagaaactgtcacagtactat

SEQ ID NO: 9465592 - DNA, 22 bp, Homo sapiens
taagaaacttaactgggaacta

SEQ ID NO: 9465593 - DNA, 22 bp, Homo sapiens
taagaaactgtcacagtactat

SEQ ID NO: 9465594 - DNA, 22 bp, Homo sapiens
taagaaacttaactgggaacta

SEQ ID NO: 9465595 - DNA, 22 bp, Homo sapiens
taactgtagttataaagctatc

SEQ ID NO: 9465596 - DNA, 22 bp, Homo sapiens
taactgtatagcttggactaaa

SEQ ID NO: 9465597 - DNA, 22 bp, Homo sapiens
taactgtacctagataacgaac

SEQ ID NO: 9465598 - DNA, 22 bp, Homo sapiens
taactgtaatataaatatgagt

SEQ ID NO: 9465599 - DNA, 22 bp, Homo sapiens
taactgtagaacaaaatgggct

SEQ ID NO: 9465600 - DNA, 22 bp, Homo sapiens
taacttctctgctatcatagga

SEQ ID NO: 9465601 - DNA, 22 bp, Homo sapiens
taacttcagcgagttctcttaa

SEQ ID NO: 9465602 - DNA, 22 bp, Homo sapiens
taacttcaagtctgtggatcag

SEQ ID NO: 9465603 - DNA, 22 bp, Homo sapiens
taacttcactggactcagcagc

SEQ ID NO: 9465604 - DNA, 22 bp, Homo sapiens
taacttctctgctatcatagga

SEQ ID NO: 9465605 - DNA, 22 bp, Homo sapiens
taacttctgaatagcaatagta

SEQ ID NO: 9465606 - DNA, 22 bp, Homo sapiens
taacttcaaaattgccacatgt

SEQ ID NO: 9465607 - DNA, 23 bp, Homo sapiens
taacttacatcattctgcacaag

SEQ ID NO: 9465608 - DNA, 22 bp, Homo sapiens
taactgtgtgaacgtgatcatt

SEQ ID NO: 9465609 - DNA, 22 bp, Homo sapiens
taacaatgggaaggactgatga

SEQ ID NO: 9465610 - DNA, 23 bp, Homo sapiens
taacaatggactcctcttagcta

SEQ ID NO: 9465611 - DNA, 22 bp, Homo sapiens
taacaatggagttttgagaaag

SEQ ID NO: 9465612 - DNA, 22 bp, Homo sapiens
taacaatggttttgctgataat

SEQ ID NO: 9465613 - DNA, 22 bp, Homo sapiens
taacaatgggaaggactgatga

SEQ ID NO: 9465614 - DNA, 22 bp, Homo sapiens
taacaatggagttttgagaaag

SEQ ID NO: 9465615 - DNA, 22 bp, Homo sapiens
taacaattctcaaaagagggga

SEQ ID NO: 9465616 - DNA, 22 bp, Homo sapiens
taacaatggttttgctgataat

SEQ ID NO: 9465617 - DNA, 22 bp, Homo sapiens
taacaattctcaaaagagggga

SEQ ID NO: 9465618 - DNA, 22 bp, Homo sapiens
taacaatgattagtgactacag

SEQ ID NO: 9465619 - DNA, 22 bp, Homo sapiens
taacaatgcaaaatgaatttag

SEQ ID NO: 9465620 - DNA, 22 bp, Homo sapiens
taacaatgcaaaatgaatttag

SEQ ID NO: 9465621 - DNA, 22 bp, Homo sapiens
taacaatagtgtttgctagtca

SEQ ID NO: 9465622 - DNA, 22 bp, Homo sapiens
taacacagacagccactagtaa

SEQ ID NO: 9465623 - DNA, 22 bp, Homo sapiens
taacacaaaagaatatgtgtgt

SEQ ID NO: 9465624 - DNA, 22 bp, Homo sapiens
taacaatttgcttcatttgttt

SEQ ID NO: 9465625 - DNA, 22 bp, Homo sapiens
taacaatttgcttcatttgttt

SEQ ID NO: 9465626 - DNA, 22 bp, Homo sapiens
taacaatagtgtttgctagtca

SEQ ID NO: 9465627 - DNA, 21 bp, Homo sapiens
taacaaagacttctggtcagg

SEQ ID NO: 9465628 - DNA, 21 bp, Homo sapiens
taacaaagacttctggtcagg

SEQ ID NO: 9465629 - DNA, 22 bp, Homo sapiens
taaatactgagttggagttggc

SEQ ID NO: 9465630 - DNA, 22 bp, Homo sapiens
taaatacagtcatttgagccat

SEQ ID NO: 9465631 - DNA, 22 bp, Homo sapiens
taaatttttgttaacagcctct

SEQ ID NO: 9465632 - DNA, 22 bp, Homo sapiens
taaatacttagttttgtgtcta

SEQ ID NO: 9465633 - DNA, 22 bp, Homo sapiens
taaatacttagttttgtgtcta

SEQ ID NO: 9465634 - DNA, 22 bp, Homo sapiens
taaatacttagttttgtgtcta

SEQ ID NO: 9465635 - DNA, 22 bp, Homo sapiens
taaatacttagttttgtgtcta

SEQ ID NO: 9465636 - DNA, 22 bp, Homo sapiens
taacacagtgtctaccattatt

SEQ ID NO: 9465637 - DNA, 22 bp, Homo sapiens
taacacagtgtcctcagaaaca

SEQ ID NO: 9465638 - DNA, 22 bp, Homo sapiens
taacacagttctctgttgcaca

SEQ ID NO: 9465639 - DNA, 22 bp, Homo sapiens
taacacataagctgagaccatg

SEQ ID NO: 9465640 - DNA, 22 bp, Homo sapiens
taacacatagatattttaactt

SEQ ID NO: 9465641 - DNA, 22 bp, Homo sapiens
taacacatatttcaagagtagt

SEQ ID NO: 9465642 - DNA, 22 bp, Homo sapiens
taacacatatctacaacatgtg

SEQ ID NO: 9465643 - DNA, 22 bp, Homo sapiens
taacacatggttagtacacaat

SEQ ID NO: 9465644 - DNA, 22 bp, Homo sapiens
taacacatgaaagcaccttctt

SEQ ID NO: 9465645 - DNA, 22 bp, Homo sapiens
taacacatatttgcagtaagca

SEQ ID NO: 9465646 - DNA, 22 bp, Homo sapiens
taacacattttcctcatacgga

SEQ ID NO: 9465647 - DNA, 22 bp, Homo sapiens
taacacattttaagccatttta

SEQ ID NO: 9465648 - DNA, 21 bp, Homo sapiens
taacacattttggtactttgg

SEQ ID NO: 9465649 - DNA, 21 bp, Homo sapiens
taacacattttggtactttgg

SEQ ID NO: 9465650 - DNA, 22 bp, Homo sapiens
taacacattttcctcatacgga

SEQ ID NO: 9465651 - DNA, 22 bp, Homo sapiens
taacacatggttctgtcaggaa

SEQ ID NO: 9465652 - DNA, 22 bp, Homo sapiens
taacacatggttctgtcaggaa

SEQ ID NO: 9465653 - DNA, 22 bp, Homo sapiens
taacacatggttagtacacaat

SEQ ID NO: 9465654 - DNA, 22 bp, Homo sapiens
taacacatgtctgggatgtgaa

SEQ ID NO: 9465655 - DNA, 22 bp, Homo sapiens
taacacattagttctcctagat

SEQ ID NO: 9465656 - DNA, 22 bp, Homo sapiens
tcccttggtaattctgttcctt

SEQ ID NO: 9465657 - DNA, 22 bp, Homo sapiens
tcccttgggagtggtgaccaca

SEQ ID NO: 9465658 - DNA, 22 bp, Homo sapiens
tcccttggttaaatatgtagga

SEQ ID NO: 9465659 - DNA, 22 bp, Homo sapiens
tcccttctggcagcagtgtgag

SEQ ID NO: 9465660 - DNA, 18 bp, Homo sapiens
tcccttctcccttgcctc

SEQ ID NO: 9465661 - DNA, 18 bp, Homo sapiens
tcccttctcccttgcctc

SEQ ID NO: 9465662 - DNA, 18 bp, Homo sapiens
tcccttctcccttgcctc

SEQ ID NO: 9465663 - DNA, 19 bp, Homo sapiens
tcccttctatagtaataaa

SEQ ID NO: 9465664 - DNA, 18 bp, Homo sapiens
tcccttctcccttgcctc

SEQ ID NO: 9465665 - DNA, 22 bp, Homo sapiens
tccctgtggctaagacatgaca

SEQ ID NO: 9465666 - DNA, 22 bp, Homo sapiens
tccctgtgggatgaggactctg

SEQ ID NO: 9465667 - DNA, 22 bp, Homo sapiens
tccctgtgggatgaggactctg

SEQ ID NO: 9465668 - DNA, 22 bp, Homo sapiens
tccctgtgggatgaggactctg

SEQ ID NO: 9465669 - DNA, 22 bp, Homo sapiens
tccctgtgggcagaggctgcct

SEQ ID NO: 9465670 - DNA, 22 bp, Homo sapiens
tccctgtgggcagaggctgcct

SEQ ID NO: 9465671 - DNA, 23 bp, Homo sapiens
tccctgtgtacagcctgcatgag

SEQ ID NO: 9465672 - DNA, 23 bp, Homo sapiens
tccctgtgtacagcctgcatgag

SEQ ID NO: 9465673 - DNA, 23 bp, Homo sapiens
tccctgtgtacagcctgcatgag

SEQ ID NO: 9465674 - DNA, 22 bp, Homo sapiens
tccctgtgtccatgccaggagg

SEQ ID NO: 9465675 - DNA, 22 bp, Homo sapiens
tccctgtgtccatgccaggagg

SEQ ID NO: 9465676 - DNA, 22 bp, Homo sapiens
tccctgtgtccatgccaggagg

SEQ ID NO: 9465677 - DNA, 22 bp, Homo sapiens
tcccttcatcagtgagcaagcc

SEQ ID NO: 9465678 - DNA, 22 bp, Homo sapiens
tcccttcacagatgcgatgttt

SEQ ID NO: 9465679 - DNA, 22 bp, Homo sapiens
tcccttcaataattcaacatta

SEQ ID NO: 9465680 - DNA, 22 bp, Homo sapiens
tcccttagggctgggtgggtgt

SEQ ID NO: 9465681 - DNA, 22 bp, Homo sapiens
tcccttcaagatttggggaaat

SEQ ID NO: 9465682 - DNA, 22 bp, Homo sapiens
tccctgtgtcttcctcttgccc

SEQ ID NO: 9465683 - DNA, 22 bp, Homo sapiens
tccctgtgtcttcctcttgccc

SEQ ID NO: 9465684 - DNA, 22 bp, Homo sapiens
tccctgtgtcctgggggcacct

SEQ ID NO: 9465685 - DNA, 22 bp, Homo sapiens
tccctgtgtcttcctcttgccc

SEQ ID NO: 9465686 - DNA, 22 bp, Homo sapiens
tccctgtgtgtatataaacggt

SEQ ID NO: 9465687 - DNA, 22 bp, Homo sapiens
tccctgtgtgtatataaacggt

SEQ ID NO: 9465688 - DNA, 22 bp, Homo sapiens
tccctgtgtcttcctcttgccc

SEQ ID NO: 9465689 - DNA, 20 bp, Homo sapiens
tccctggggccctacttcct

SEQ ID NO: 9465690 - DNA, 22 bp, Homo sapiens
tccctgtaaggttctgagattt

SEQ ID NO: 9465691 - DNA, 22 bp, Homo sapiens
tccctgtaaggttctgagattt

SEQ ID NO: 9465692 - DNA, 22 bp, Homo sapiens
tccctgtacactaacttgagac

SEQ ID NO: 9465693 - DNA, 22 bp, Homo sapiens
tccctgtacttacacagcgtcc

SEQ ID NO: 9465694 - DNA, 22 bp, Homo sapiens
tccctgtatagagaatcccttt

SEQ ID NO: 9465695 - DNA, 22 bp, Homo sapiens
tccctgtattcgaaagtgatcg

SEQ ID NO: 9465696 - DNA, 22 bp, Homo sapiens
tccctgtccaaagtcttcctat

SEQ ID NO: 9465697 - DNA, 22 bp, Homo sapiens
tccctgtctcccttgagactag

SEQ ID NO: 9465698 - DNA, 22 bp, Homo sapiens
tccctgtgaatcagaagcaggt

SEQ ID NO: 9465699 - DNA, 22 bp, Homo sapiens
tccctgtctcccttgagactag

SEQ ID NO: 9465700 - DNA, 21 bp, Homo sapiens
tccctgtgagcagctcttcct

SEQ ID NO: 9465701 - DNA, 21 bp, Homo sapiens
tccctgtgagcagctcttcct

SEQ ID NO: 9465702 - DNA, 22 bp, Homo sapiens
tccctgtgcctatatgtgctga

SEQ ID NO: 9465703 - DNA, 22 bp, Homo sapiens
tccctgtgagtcaactaaacaa

SEQ ID NO: 9465704 - DNA, 22 bp, Homo sapiens
tccctgtgagtcaactaaacaa

SEQ ID NO: 9465705 - DNA, 22 bp, Homo sapiens
tccctgtgagaaatgaagcagg

SEQ ID NO: 9465706 - DNA, 22 bp, Homo sapiens
tccctgtgacaagtctgagttc

SEQ ID NO: 9465707 - DNA, 22 bp, Homo sapiens
tccctgtgagaaatgaagcagg

SEQ ID NO: 9465708 - DNA, 21 bp, Homo sapiens
tccctgtgagcagctcttcct

SEQ ID NO: 9465709 - DNA, 22 bp, Homo sapiens
tccctgtgagaaatgaagcagg

SEQ ID NO: 9465710 - DNA, 22 bp, Homo sapiens
tccctgtgaatcagaagcaggt

SEQ ID NO: 9465711 - DNA, 22 bp, Homo sapiens
tccctgtgacaagtctgagttc

SEQ ID NO: 9465712 - DNA, 22 bp, Homo sapiens
tccctgtggaagactgccagag

SEQ ID NO: 9465713 - DNA, 22 bp, Homo sapiens
tccctgtggaagactgccagag

SEQ ID NO: 9465714 - DNA, 22 bp, Homo sapiens
tccctgtgcctatatgtgctga

SEQ ID NO: 9465715 - DNA, 22 bp, Homo sapiens
tccctgtgcctatatgtgctga

SEQ ID NO: 9465716 - DNA, 22 bp, Homo sapiens
tccctgtggatatctgcagctg

SEQ ID NO: 9465717 - DNA, 22 bp, Homo sapiens
tccctgtggatatctgcagctg

SEQ ID NO: 9465718 - DNA, 22 bp, Homo sapiens
tccctgtggatatctgcagctg

SEQ ID NO: 9465719 - DNA, 22 bp, Homo sapiens
tccctgtggcacacccaagccc

SEQ ID NO: 9465720 - DNA, 22 bp, Homo sapiens
tccctgtggcacacccaagccc

SEQ ID NO: 9465721 - DNA, 22 bp, Homo sapiens
tccctgtggctaagacatgaca

SEQ ID NO: 9465722 - DNA, 22 bp, Homo sapiens
tccctggggaagggcaagcaag

SEQ ID NO: 9465723 - DNA, 22 bp, Homo sapiens
tccctggggatgttggcctgcc

SEQ ID NO: 9465724 - DNA, 22 bp, Homo sapiens
tccctggggaagggcaagcaag

SEQ ID NO: 9465725 - DNA, 22 bp, Homo sapiens
tccctggggatgttggcctgcc

SEQ ID NO: 9465726 - DNA, 22 bp, Homo sapiens
tccctggggatgttggcctgcc

SEQ ID NO: 9465727 - DNA, 22 bp, Homo sapiens
tccctggggatgttggcctgcc

SEQ ID NO: 9465728 - DNA, 22 bp, Homo sapiens
tccctggggcagtggctcggag

SEQ ID NO: 9465729 - DNA, 22 bp, Homo sapiens
tccctggggatgttggcctgcc

SEQ ID NO: 9465730 - DNA, 22 bp, Homo sapiens
tccctggggcagtggctcggag

SEQ ID NO: 9465731 - DNA, 22 bp, Homo sapiens
tccctgggcctatcttagctcc

SEQ ID NO: 9465732 - DNA, 22 bp, Homo sapiens
tccctgggcctatcttagctcc

SEQ ID NO: 9465733 - DNA, 22 bp, Homo sapiens
tccctgggcggacattctccca

SEQ ID NO: 9465734 - DNA, 22 bp, Homo sapiens
tccctgggcttctccagacttg

SEQ ID NO: 9465735 - DNA, 22 bp, Homo sapiens
tccctgggcttctccagacttg

SEQ ID NO: 9465736 - DNA, 22 bp, Homo sapiens
tcccaggcaaaggcagctcatt

SEQ ID NO: 9465737 - DNA, 22 bp, Homo sapiens
tcccaggcaaaggcagctcatt

SEQ ID NO: 9465738 - DNA, 22 bp, Homo sapiens
tcccaggcaaaggcagctcatt

SEQ ID NO: 9465739 - DNA, 22 bp, Homo sapiens
tcccaggatgtttatggctggt

SEQ ID NO: 9465740 - DNA, 22 bp, Homo sapiens
tcccaggatgttggcggcaggt

SEQ ID NO: 9465741 - DNA, 22 bp, Homo sapiens
tcccaggatgttggcggcaggt

SEQ ID NO: 9465742 - DNA, 19 bp, Homo sapiens
tcccaggcaaaggcttctc

SEQ ID NO: 9465743 - DNA, 22 bp, Homo sapiens
tccctgagagcactggggagcc

SEQ ID NO: 9465744 - DNA, 23 bp, Homo sapiens
tccctgagatgctgctctgtccc

SEQ ID NO: 9465745 - DNA, 23 bp, Homo sapiens
tccctgagatgctgctctgtccc

SEQ ID NO: 9465746 - DNA, 23 bp, Homo sapiens
tccctgagatgctgctctgtccc

SEQ ID NO: 9465747 - DNA, 21 bp, Homo sapiens
tccctgagcccaaggggctcc

SEQ ID NO: 9465748 - DNA, 21 bp, Homo sapiens
tccctgagcccaaggggctcc

SEQ ID NO: 9465749 - DNA, 21 bp, Homo sapiens
tccctgagcccaaggggctcc

SEQ ID NO: 9465750 - DNA, 21 bp, Homo sapiens
tccctgagcccaaggggctcc

SEQ ID NO: 9465751 - DNA, 21 bp, Homo sapiens
tccctgagcccaaggggctcc

SEQ ID NO: 9465752 - DNA, 22 bp, Homo sapiens
tccctgagctcacatggcagga

SEQ ID NO: 9465753 - DNA, 22 bp, Homo sapiens
tccctgagcttcatcaggcttt

SEQ ID NO: 9465754 - DNA, 22 bp, Homo sapiens
tccctgagcttcatcaggcttt

SEQ ID NO: 9465755 - DNA, 22 bp, Homo sapiens
tccctgagcttcatcaggcttt

SEQ ID NO: 9465756 - DNA, 22 bp, Homo sapiens
tccctgaggaaggggtgtggtg

SEQ ID NO: 9465757 - DNA, 22 bp, Homo sapiens
tccctgaggaaggggtgtggtg

SEQ ID NO: 9465758 - DNA, 22 bp, Homo sapiens
tccctgagcttctctgaaatgg

SEQ ID NO: 9465759 - DNA, 22 bp, Homo sapiens
tccctgagctgagctcaacagc

SEQ ID NO: 9465760 - DNA, 23 bp, Homo sapiens
tccctgagctggagagactgcac

SEQ ID NO: 9465761 - DNA, 23 bp, Homo sapiens
tccctgagctggagagactgcac

SEQ ID NO: 9465762 - DNA, 22 bp, Homo sapiens
tccctgagctcacatggcagga

SEQ ID NO: 9465763 - DNA, 22 bp, Homo sapiens
tccctgagctgagctcaacagc

SEQ ID NO: 9465764 - DNA, 22 bp, Homo sapiens
tccctgagctgagctcaacagc

SEQ ID NO: 9465765 - DNA, 22 bp, Homo sapiens
tccctgagtgtatgtggtgaac

SEQ ID NO: 9465766 - DNA, 19 bp, Homo sapiens
tccctgagttccagcccag

SEQ ID NO: 9465767 - DNA, 22 bp, Homo sapiens
tccctgagtgggctggtagtat

SEQ ID NO: 9465768 - DNA, 22 bp, Homo sapiens
tccctgagtgggctggtagtat

SEQ ID NO: 9465769 - DNA, 22 bp, Homo sapiens
tccctgagtgtatgtggtgaac

SEQ ID NO: 9465770 - DNA, 16 bp, Homo sapiens
tccctgaggttttgga

SEQ ID NO: 9465771 - DNA, 22 bp, Homo sapiens
tccctgaggatgaggctgatca

SEQ ID NO: 9465772 - DNA, 22 bp, Homo sapiens
tccctgaggatgaggctgatca

SEQ ID NO: 9465773 - DNA, 22 bp, Homo sapiens
tccctgaggatgaggctgatca

SEQ ID NO: 9465774 - DNA, 22 bp, Homo sapiens
tccctgaggatggttgtattta

SEQ ID NO: 9465775 - DNA, 22 bp, Homo sapiens
tccctgagggcagctcaagtcc

SEQ ID NO: 9465776 - DNA, 22 bp, Homo sapiens
tccctgagggcagctcaagtcc

SEQ ID NO: 9465777 - DNA, 22 bp, Homo sapiens
tccctgcacagccgagccatgc

SEQ ID NO: 9465778 - DNA, 22 bp, Homo sapiens
tccctgatgtgggctgcgtgac

SEQ ID NO: 9465779 - DNA, 21 bp, Homo sapiens
tccctgagttctctgagcatc

SEQ ID NO: 9465780 - DNA, 21 bp, Homo sapiens
tccctgagttctctgagcatc

SEQ ID NO: 9465781 - DNA, 21 bp, Homo sapiens
tccctgagttctctgagcatc

SEQ ID NO: 9465782 - DNA, 22 bp, Homo sapiens
tccctgagttttctttctgact

SEQ ID NO: 9465783 - DNA, 22 bp, Homo sapiens
tccctgagttttctttctgact

SEQ ID NO: 9465784 - DNA, 22 bp, Homo sapiens
tccctgcagcccctgagccttc

SEQ ID NO: 9465785 - DNA, 22 bp, Homo sapiens
tccctgccagtcctggtctgaa

SEQ ID NO: 9465786 - DNA, 22 bp, Homo sapiens
tccctgggcaagtttactcttc

SEQ ID NO: 9465787 - DNA, 22 bp, Homo sapiens
tccctgccctcagtgcacccgg

SEQ ID NO: 9465788 - DNA, 22 bp, Homo sapiens
tccctgggccacagctgtgagc

SEQ ID NO: 9465789 - DNA, 22 bp, Homo sapiens
tccctgggcacaatctgctggc

SEQ ID NO: 9465790 - DNA, 22 bp, Homo sapiens
tccctgggcacaatctgctggc

SEQ ID NO: 9465791 - DNA, 22 bp, Homo sapiens
tcctcatctcggaacctgccac

SEQ ID NO: 9465792 - DNA, 22 bp, Homo sapiens
tcctcagtcgtttgagccaaaa

SEQ ID NO: 9465793 - DNA, 22 bp, Homo sapiens
tcctcagtgctagccaactgcc

SEQ ID NO: 9465794 - DNA, 22 bp, Homo sapiens
tccggtccgggtactcctctct

SEQ ID NO: 9465795 - DNA, 22 bp, Homo sapiens
tccgggtgactggctacccccc

SEQ ID NO: 9465796 - DNA, 22 bp, Homo sapiens
tccgggttttacactcacatca

SEQ ID NO: 9465797 - DNA, 22 bp, Homo sapiens
tccgggtgtttcaacttcccga

SEQ ID NO: 9465798 - DNA, 22 bp, Homo sapiens
tccgggttttacactcacatca

SEQ ID NO: 9465799 - DNA, 22 bp, Homo sapiens
tccggggcttccccgcagtgcc

SEQ ID NO: 9465800 - DNA, 22 bp, Homo sapiens
tcctcagtctctaaggcctcag

SEQ ID NO: 9465801 - DNA, 22 bp, Homo sapiens
tcctcagtcagctccgttcttg

SEQ ID NO: 9465802 - DNA, 22 bp, Homo sapiens
tcctcagtctctaaggcctcag

SEQ ID NO: 9465803 - DNA, 22 bp, Homo sapiens
tcctcagtctctcaaatgaggc

SEQ ID NO: 9465804 - DNA, 22 bp, Homo sapiens
tcctcagtcgtttgagccaaaa

SEQ ID NO: 9465805 - DNA, 22 bp, Homo sapiens
tcctcagtcacggtagcacatt

SEQ ID NO: 9465806 - DNA, 22 bp, Homo sapiens
tccgaggccaaagctgtgaata

SEQ ID NO: 9465807 - DNA, 22 bp, Homo sapiens
tccctttcactactgtgttggt

SEQ ID NO: 9465808 - DNA, 22 bp, Homo sapiens
tccgaggcgcaccggcgctcct

SEQ ID NO: 9465809 - DNA, 22 bp, Homo sapiens
tccgataagcaattcttgtgct

SEQ ID NO: 9465810 - DNA, 22 bp, Homo sapiens
tccgccaggactgagggcccat

SEQ ID NO: 9465811 - DNA, 22 bp, Homo sapiens
tccgccaggactgagggcccat

SEQ ID NO: 9465812 - DNA, 23 bp, Homo sapiens
tccggcaacttcactcctcccgc

SEQ ID NO: 9465813 - DNA, 22 bp, Homo sapiens
tccgggcaactgaagggaggtt

SEQ ID NO: 9465814 - DNA, 22 bp, Homo sapiens
tccgggaggcagaggttgcagt

SEQ ID NO: 9465815 - DNA, 22 bp, Homo sapiens
tccgggaggcagaggttgcagt

SEQ ID NO: 9465816 - DNA, 22 bp, Homo sapiens
tccgggagctgaacgtcttgcg

SEQ ID NO: 9465817 - DNA, 22 bp, Homo sapiens
tccgggagctgaacgtcttgcg

SEQ ID NO: 9465818 - DNA, 23 bp, Homo sapiens
tcctccagaggccctccttggcc

SEQ ID NO: 9465819 - DNA, 22 bp, Homo sapiens
tcctccagcaggactgaggccc

SEQ ID NO: 9465820 - DNA, 22 bp, Homo sapiens
tcctccagcaggactgaggccc

SEQ ID NO: 9465821 - DNA, 22 bp, Homo sapiens
tcctccagccctctaggaaaat

SEQ ID NO: 9465822 - DNA, 22 bp, Homo sapiens
tcctccagctactaggcaaata

SEQ ID NO: 9465823 - DNA, 22 bp, Homo sapiens
tcctccaggcacctcactggct

SEQ ID NO: 9465824 - DNA, 22 bp, Homo sapiens
tcctccagggggatcttcagcc

SEQ ID NO: 9465825 - DNA, 22 bp, Homo sapiens
tcctccagctgtatcctgcctg

SEQ ID NO: 9465826 - DNA, 22 bp, Homo sapiens
tcctccagaaactgaggcagaa

SEQ ID NO: 9465827 - DNA, 22 bp, Homo sapiens
tcctccagaaactgaggcagaa

SEQ ID NO: 9465828 - DNA, 22 bp, Homo sapiens
tcctccactttgtctagcaaca

SEQ ID NO: 9465829 - DNA, 22 bp, Homo sapiens
tcctccagaaactgaggcagaa

SEQ ID NO: 9465830 - DNA, 22 bp, Homo sapiens
tcctccagaaactgaggcagaa

SEQ ID NO: 9465831 - DNA, 20 bp, Homo sapiens
tcctccagaagggcagggtg

SEQ ID NO: 9465832 - DNA, 20 bp, Homo sapiens
tcctccagaagggcagggtg

SEQ ID NO: 9465833 - DNA, 22 bp, Homo sapiens
tcctccaagcctttgtgaagtg

SEQ ID NO: 9465834 - DNA, 22 bp, Homo sapiens
tcctccaaggcagggggagaga

SEQ ID NO: 9465835 - DNA, 20 bp, Homo sapiens
tcctccaaccagctgctaat

SEQ ID NO: 9465836 - DNA, 23 bp, Homo sapiens
tcctccaaccagcagctgcataa

SEQ ID NO: 9465837 - DNA, 22 bp, Homo sapiens
tcctcattgtcactggcccgca

SEQ ID NO: 9465838 - DNA, 22 bp, Homo sapiens
tcctccctgcactcagtgaagt

SEQ ID NO: 9465839 - DNA, 22 bp, Homo sapiens
tcctccctgcactcagtgaagt

SEQ ID NO: 9465840 - DNA, 22 bp, Homo sapiens
tcctccctgggagcttctgagt

SEQ ID NO: 9465841 - DNA, 22 bp, Homo sapiens
tcctccctgggagcttctgagt

SEQ ID NO: 9465842 - DNA, 22 bp, Homo sapiens
tcctccctgtaccattcctctg

SEQ ID NO: 9465843 - DNA, 22 bp, Homo sapiens
tcctccctgtaccattcctctg

SEQ ID NO: 9465844 - DNA, 22 bp, Homo sapiens
tcctcccttgactcctgctttt

SEQ ID NO: 9465845 - DNA, 22 bp, Homo sapiens
tcctcccttctcactgggaagg

SEQ ID NO: 9465846 - DNA, 22 bp, Homo sapiens
tcctcccttctcactgggaagg

SEQ ID NO: 9465847 - DNA, 22 bp, Homo sapiens
tcctccctgtaccattcctctg

SEQ ID NO: 9465848 - DNA, 22 bp, Homo sapiens
tcctccctgagtggggacagct

SEQ ID NO: 9465849 - DNA, 23 bp, Homo sapiens
tcctccctgacttctacagcaca

SEQ ID NO: 9465850 - DNA, 22 bp, Homo sapiens
tcctccctgagtggggacagct

SEQ ID NO: 9465851 - DNA, 22 bp, Homo sapiens
tcctccctgagtggggacagct

SEQ ID NO: 9465852 - DNA, 23 bp, Homo sapiens
tcctccctgacttctacagcaca

SEQ ID NO: 9465853 - DNA, 23 bp, Homo sapiens
tcctccctgacttctacagcaca

SEQ ID NO: 9465854 - DNA, 22 bp, Homo sapiens
tcctcccctgcccatgaggagg

SEQ ID NO: 9465855 - DNA, 22 bp, Homo sapiens
tcctccctaaatcctagactgt

SEQ ID NO: 9465856 - DNA, 22 bp, Homo sapiens
tcctccagtggtactggccaat

SEQ ID NO: 9465857 - DNA, 22 bp, Homo sapiens
tcctccagtggtactggccaat

SEQ ID NO: 9465858 - DNA, 22 bp, Homo sapiens
tcctccagtggtactggccaat

SEQ ID NO: 9465859 - DNA, 22 bp, Homo sapiens
tcctccagtgtctggggccttg

SEQ ID NO: 9465860 - DNA, 22 bp, Homo sapiens
tcctccaggtctagggtggctt

SEQ ID NO: 9465861 - DNA, 22 bp, Homo sapiens
tcctccaggtctagggtggctt

SEQ ID NO: 9465862 - DNA, 22 bp, Homo sapiens
tcctccagtcttggtgaggttg

SEQ ID NO: 9465863 - DNA, 22 bp, Homo sapiens
tcctccagtcttggtgaggttg

SEQ ID NO: 9465864 - DNA, 22 bp, Homo sapiens
tcctccagtggcccagtccttc

SEQ ID NO: 9465865 - DNA, 22 bp, Homo sapiens
tcctccagtggcccagtccttc

SEQ ID NO: 9465866 - DNA, 22 bp, Homo sapiens
tcctccagtggcccagtccttc

SEQ ID NO: 9465867 - DNA, 23 bp, Homo sapiens
tcctcctgacacagcctgagtga

SEQ ID NO: 9465868 - DNA, 23 bp, Homo sapiens
tcctcctgacacagcctgagtga

SEQ ID NO: 9465869 - DNA, 23 bp, Homo sapiens
tcctcctgacacagcctgagtga

SEQ ID NO: 9465870 - DNA, 23 bp, Homo sapiens
tcctcctgacacagcctgagtga

SEQ ID NO: 9465871 - DNA, 23 bp, Homo sapiens
tcctcctgacacagcctgagtga

SEQ ID NO: 9465872 - DNA, 22 bp, Homo sapiens
tcctcctctatcagacagtgcc

SEQ ID NO: 9465873 - DNA, 22 bp, Homo sapiens
tcctcctctatcagacagtgcc

SEQ ID NO: 9465874 - DNA, 22 bp, Homo sapiens
tcctcctcctcacagtcacctg

SEQ ID NO: 9465875 - DNA, 22 bp, Homo sapiens
tcctcctcacgctgttgcttgt

SEQ ID NO: 9465876 - DNA, 21 bp, Homo sapiens
tcctcctccactaggctagcc

SEQ ID NO: 9465877 - DNA, 22 bp, Homo sapiens
tcctcccttggggtttcgttat

SEQ ID NO: 9465878 - DNA, 22 bp, Homo sapiens
tcctcccttgactcctgctttt

SEQ ID NO: 9465879 - DNA, 22 bp, Homo sapiens
tcctcccttgactcctgctttt

SEQ ID NO: 9465880 - DNA, 19 bp, Homo sapiens
tcctccctttggtgtcctg

SEQ ID NO: 9465881 - DNA, 22 bp, Homo sapiens
tcctcccttggggtttcgttat

SEQ ID NO: 9465882 - DNA, 22 bp, Homo sapiens
tcctcctgctgttagtcttgaa

SEQ ID NO: 9465883 - DNA, 22 bp, Homo sapiens
tcctcctgctgttagtcttgaa

SEQ ID NO: 9465884 - DNA, 22 bp, Homo sapiens
tcctcctgctgttagtcttgaa

SEQ ID NO: 9465885 - DNA, 21 bp, Homo sapiens
tcctcctggccaggcggcccc

SEQ ID NO: 9465886 - DNA, 21 bp, Homo sapiens
tcctcctggccaggcggcccc

SEQ ID NO: 9465887 - DNA, 23 bp, Homo sapiens
tcctcctggatacaaagggaaca

SEQ ID NO: 9465888 - DNA, 23 bp, Homo sapiens
tcctcctggatacaaagggaaca

SEQ ID NO: 9465889 - DNA, 23 bp, Homo sapiens
tcctcctgagtgagagtgccagc

SEQ ID NO: 9465890 - DNA, 22 bp, Homo sapiens
tcctcctgcctttgcttcttgt

SEQ ID NO: 9465891 - DNA, 23 bp, Homo sapiens
tcctcctgagtgagagtgccagc

SEQ ID NO: 9465892 - DNA, 23 bp, Homo sapiens
tcctcctgagtgagagtgccagc

SEQ ID NO: 9465893 - DNA, 22 bp, Homo sapiens
tcccagcagtcagagctatgtg

SEQ ID NO: 9465894 - DNA, 22 bp, Homo sapiens
tcccagcagtcagagctatgtg

SEQ ID NO: 9465895 - DNA, 22 bp, Homo sapiens
tcccagcagtcagagctatgtg

SEQ ID NO: 9465896 - DNA, 22 bp, Homo sapiens
tcccagcagtcagagctatgtg

SEQ ID NO: 9465897 - DNA, 22 bp, Homo sapiens
tcccagcctttcttttctgctg

SEQ ID NO: 9465898 - DNA, 22 bp, Homo sapiens
tcccagcctttcttttctgctg

SEQ ID NO: 9465899 - DNA, 22 bp, Homo sapiens
tcccagcctttcttttctgctg

SEQ ID NO: 9465900 - DNA, 22 bp, Homo sapiens
tcccagcctttcttttctgctg

SEQ ID NO: 9465901 - DNA, 22 bp, Homo sapiens
tcccagcagcatagctcagaat

SEQ ID NO: 9465902 - DNA, 22 bp, Homo sapiens
tcccagcagatgagctgaccta

SEQ ID NO: 9465903 - DNA, 22 bp, Homo sapiens
tcccagcaggagtccagttccc

SEQ ID NO: 9465904 - DNA, 22 bp, Homo sapiens
tcccagcaggagtccagttccc

SEQ ID NO: 9465905 - DNA, 22 bp, Homo sapiens
tcccagattcctgctcttatat

SEQ ID NO: 9465906 - DNA, 22 bp, Homo sapiens
tcccagagtttcctgtgtccca

SEQ ID NO: 9465907 - DNA, 22 bp, Homo sapiens
tcccagagttcaatgggaaggt

SEQ ID NO: 9465908 - DNA, 22 bp, Homo sapiens
tcccagagttcaatgggaaggt

SEQ ID NO: 9465909 - DNA, 22 bp, Homo sapiens
tcccagattcctgctcttatat

SEQ ID NO: 9465910 - DNA, 22 bp, Homo sapiens
tcccagattcctgctcttatat

SEQ ID NO: 9465911 - DNA, 22 bp, Homo sapiens
tcccagattcctgctcttatat

SEQ ID NO: 9465912 - DNA, 22 bp, Homo sapiens
tcccagattcctgctcttatat

SEQ ID NO: 9465913 - DNA, 22 bp, Homo sapiens
tcccagcacagggcagatgtga

SEQ ID NO: 9465914 - DNA, 22 bp, Homo sapiens
tcccagcaagaaagggggtggc

SEQ ID NO: 9465915 - DNA, 22 bp, Homo sapiens
tcccagcactgtaattctttgg

SEQ ID NO: 9465916 - DNA, 22 bp, Homo sapiens
tcccagcagatgagctgaccta

SEQ ID NO: 9465917 - DNA, 22 bp, Homo sapiens
tcccagcagagccagcaagccg

SEQ ID NO: 9465918 - DNA, 22 bp, Homo sapiens
tcccaggaagatcccagggacc

SEQ ID NO: 9465919 - DNA, 17 bp, Homo sapiens
tcccaggaacagggaat

SEQ ID NO: 9465920 - DNA, 21 bp, Homo sapiens
tcccagctgggtcagtgctgc

SEQ ID NO: 9465921 - DNA, 22 bp, Homo sapiens
tcccagctactctagaggctga

SEQ ID NO: 9465922 - DNA, 22 bp, Homo sapiens
tcccagctactctagaggctga

SEQ ID NO: 9465923 - DNA, 22 bp, Homo sapiens
tcccagctactctagaggctga

SEQ ID NO: 9465924 - DNA, 22 bp, Homo sapiens
tcccaggaaaacactcgaggac

SEQ ID NO: 9465925 - DNA, 22 bp, Homo sapiens
tcccagcttagatttgctcatt

SEQ ID NO: 9465926 - DNA, 22 bp, Homo sapiens
tcccagcttagatttgctcatt

SEQ ID NO: 9465927 - DNA, 21 bp, Homo sapiens
tcccagctgggtcagtgctgc

SEQ ID NO: 9465928 - DNA, 22 bp, Homo sapiens
tcccagcttagatttgctcatt

SEQ ID NO: 9465929 - DNA, 22 bp, Homo sapiens
tcccagctgtgtggaggagatg

SEQ ID NO: 9465930 - DNA, 22 bp, Homo sapiens
tcccagaatctttggaagagca

SEQ ID NO: 9465931 - DNA, 22 bp, Homo sapiens
tcccagaatctttggaagagca

SEQ ID NO: 9465932 - DNA, 22 bp, Homo sapiens
tcccagagaaagtcaaggtctt

SEQ ID NO: 9465933 - DNA, 22 bp, Homo sapiens
tcccagaatggcccagctgccc

SEQ ID NO: 9465934 - DNA, 22 bp, Homo sapiens
tcccagaatcctcactctatca

SEQ ID NO: 9465935 - DNA, 22 bp, Homo sapiens
tcccagaaccttttagcttcac

SEQ ID NO: 9465936 - DNA, 22 bp, Homo sapiens
tcccagagtgtgggcatcaagg

SEQ ID NO: 9465937 - DNA, 22 bp, Homo sapiens
tcccagagtgtgggcatcaagg

SEQ ID NO: 9465938 - DNA, 22 bp, Homo sapiens
tcccagagtgtgggcatcaagg

SEQ ID NO: 9465939 - DNA, 22 bp, Homo sapiens
tcccagagttcaatgggaaggt

SEQ ID NO: 9465940 - DNA, 22 bp, Homo sapiens
tcccagagttcaatgggaaggt

SEQ ID NO: 9465941 - DNA, 22 bp, Homo sapiens
tcccagagtgagccaggggcag

SEQ ID NO: 9465942 - DNA, 22 bp, Homo sapiens
tcccagagtgagccaggggcag

SEQ ID NO: 9465943 - DNA, 21 bp, Homo sapiens
tcccagagtgcttgggactgc

SEQ ID NO: 9465944 - DNA, 21 bp, Homo sapiens
tcccagagtgcttgggactgc

SEQ ID NO: 9465945 - DNA, 22 bp, Homo sapiens
tcccagagtgtgggcatcaagg

SEQ ID NO: 9465946 - DNA, 21 bp, Homo sapiens
tcccagagtgcttgggactgc

SEQ ID NO: 9465947 - DNA, 22 bp, Homo sapiens
tcccagagtcttctcctgtaat

SEQ ID NO: 9465948 - DNA, 22 bp, Homo sapiens
tcccagagtcttctcctgtaat

SEQ ID NO: 9465949 - DNA, 19 bp, Homo sapiens
tcccagagtctagaggttg

SEQ ID NO: 9465950 - DNA, 19 bp, Homo sapiens
tcccagagtctagaggttg

SEQ ID NO: 9465951 - DNA, 19 bp, Homo sapiens
tcccagagtctagaggttg

SEQ ID NO: 9465952 - DNA, 19 bp, Homo sapiens
tcccagagtctagaggttg

SEQ ID NO: 9465953 - DNA, 22 bp, Homo sapiens
tcccagagtcagaggtggggcc

SEQ ID NO: 9465954 - DNA, 22 bp, Homo sapiens
tcccagagtattagcaattgct

SEQ ID NO: 9465955 - DNA, 22 bp, Homo sapiens
tcccagagaaagtcaaggtctt

SEQ ID NO: 9465956 - DNA, 22 bp, Homo sapiens
tcccactgtgcctgttgtaatc

SEQ ID NO: 9465957 - DNA, 22 bp, Homo sapiens
tcccactgtgaatccaaggcct

SEQ ID NO: 9465958 - DNA, 22 bp, Homo sapiens
tcccactgtctgtcttgctgca

SEQ ID NO: 9465959 - DNA, 22 bp, Homo sapiens
tcccactgtcttctcgtgctcg

SEQ ID NO: 9465960 - DNA, 22 bp, Homo sapiens
tcccagaaaaaggaggctatga

SEQ ID NO: 9465961 - DNA, 22 bp, Homo sapiens
tcccagaaccctgccaggtcct

SEQ ID NO: 9465962 - DNA, 22 bp, Homo sapiens
tcccacttaactgtgacttctc

SEQ ID NO: 9465963 - DNA, 22 bp, Homo sapiens
tcccactggacgtctgtgctgg

SEQ ID NO: 9465964 - DNA, 22 bp, Homo sapiens
tcccactgctttgctctgctca

SEQ ID NO: 9465965 - DNA, 22 bp, Homo sapiens
tcccactgctttgctctgctca

SEQ ID NO: 9465966 - DNA, 22 bp, Homo sapiens
tcccactgtctgtcttgctgca

SEQ ID NO: 9465967 - DNA, 22 bp, Homo sapiens
tcccactggacgtctgtgctgg

SEQ ID NO: 9465968 - DNA, 22 bp, Homo sapiens
tcccactggacgtctgtgctgg

SEQ ID NO: 9465969 - DNA, 21 bp, Homo sapiens
tcccactggcccagggctcca

SEQ ID NO: 9465970 - DNA, 23 bp, Homo sapiens
tccagtgtgtgcagattaagtgc

SEQ ID NO: 9465971 - DNA, 22 bp, Homo sapiens
tccagtgtggtcaaaggggaat

SEQ ID NO: 9465972 - DNA, 22 bp, Homo sapiens
tcccactgagcccctgctggtg

SEQ ID NO: 9465973 - DNA, 22 bp, Homo sapiens
tcccactgagcccctgctggtg

SEQ ID NO: 9465974 - DNA, 22 bp, Homo sapiens
tcccactgagcccctgctggtg

SEQ ID NO: 9465975 - DNA, 22 bp, Homo sapiens
tcccacatgtgaatcctcaggt

SEQ ID NO: 9465976 - DNA, 22 bp, Homo sapiens
tcccacagtggtacagccctga

SEQ ID NO: 9465977 - DNA, 22 bp, Homo sapiens
tcccacagtggtacagccctga

SEQ ID NO: 9465978 - DNA, 22 bp, Homo sapiens
tcccacagtggtacagccctga

SEQ ID NO: 9465979 - DNA, 22 bp, Homo sapiens
tcccacagtggtacagccctga

SEQ ID NO: 9465980 - DNA, 22 bp, Homo sapiens
tcccacagtgaagttcatgata

SEQ ID NO: 9465981 - DNA, 22 bp, Homo sapiens
tccagttagtgggcaaaattta

SEQ ID NO: 9465982 - DNA, 20 bp, Homo sapiens
tccagtggcctgaatctgga

SEQ ID NO: 9465983 - DNA, 22 bp, Homo sapiens
tccagtgctggaccagagcacc

SEQ ID NO: 9465984 - DNA, 22 bp, Homo sapiens
tccagtggtagtaaagaggtct

SEQ ID NO: 9465985 - DNA, 22 bp, Homo sapiens
tccagtggctttgctgctttaa

SEQ ID NO: 9465986 - DNA, 22 bp, Homo sapiens
tccagtgcattcagacacttgg

SEQ ID NO: 9465987 - DNA, 22 bp, Homo sapiens
tccagtgcattcagacacttgg

SEQ ID NO: 9465988 - DNA, 22 bp, Homo sapiens
tccagtgatctagggagctgga

SEQ ID NO: 9465989 - DNA, 22 bp, Homo sapiens
tccagtgatctagggagctgga

SEQ ID NO: 9465990 - DNA, 22 bp, Homo sapiens
tccagtgagcactacatgaact

SEQ ID NO: 9465991 - DNA, 22 bp, Homo sapiens
tccagtctgtagtgcacagtga

SEQ ID NO: 9465992 - DNA, 22 bp, Homo sapiens
tccagtctggagccttctggtt

SEQ ID NO: 9465993 - DNA, 22 bp, Homo sapiens
tccagtctggagccttctggtt

SEQ ID NO: 9465994 - DNA, 22 bp, Homo sapiens
tccagtcctagaaactggagag

SEQ ID NO: 9465995 - DNA, 22 bp, Homo sapiens
tccagtcctagaaactggagag

SEQ ID NO: 9465996 - DNA, 22 bp, Homo sapiens
tccagtcccttgcctccacagc

SEQ ID NO: 9465997 - DNA, 22 bp, Homo sapiens
tccagtcccttgcctccacagc

SEQ ID NO: 9465998 - DNA, 22 bp, Homo sapiens
tccagtcctagaaactggagag

SEQ ID NO: 9465999 - DNA, 23 bp, Homo sapiens
tccagtcccctaaatctcactgt

SEQ ID NO: 9466000 - DNA, 23 bp, Homo sapiens
tccagtcccctaaatctcactgt

SEQ ID NO: 9466001 - DNA, 20 bp, Homo sapiens
tccagtccccacttgctcct

SEQ ID NO: 9466002 - DNA, 20 bp, Homo sapiens
tccagtccccacttgctcct

SEQ ID NO: 9466003 - DNA, 18 bp, Homo sapiens
tccagtcccagctctgcc

SEQ ID NO: 9466004 - DNA, 22 bp, Homo sapiens
tccagtcccattacccacattt

SEQ ID NO: 9466005 - DNA, 22 bp, Homo sapiens
tccagtcccattacccacattt

SEQ ID NO: 9466006 - DNA, 22 bp, Homo sapiens
tccagtctaatgagtcagagtg

SEQ ID NO: 9466007 - DNA, 22 bp, Homo sapiens
tccagtcctgggagcctttctg

SEQ ID NO: 9466008 - DNA, 22 bp, Homo sapiens
tccagtcctatctgcccttgga

SEQ ID NO: 9466009 - DNA, 22 bp, Homo sapiens
tccagtccttgcctctgtcagg

SEQ ID NO: 9466010 - DNA, 22 bp, Homo sapiens
tccagtccttgaaaatccaaca

SEQ ID NO: 9466011 - DNA, 22 bp, Homo sapiens
tccagggagtcaaatgaactac

SEQ ID NO: 9466012 - DNA, 22 bp, Homo sapiens
tccagggagtcaaatgaactac

SEQ ID NO: 9466013 - DNA, 22 bp, Homo sapiens
tccagggagcaagtcaggccgg

SEQ ID NO: 9466014 - DNA, 22 bp, Homo sapiens
tccagggagcaagtcaggccgg

SEQ ID NO: 9466015 - DNA, 22 bp, Homo sapiens
tccagggatctttagagtcttt

SEQ ID NO: 9466016 - DNA, 22 bp, Homo sapiens
tccagggatgccagccatgttg

SEQ ID NO: 9466017 - DNA, 22 bp, Homo sapiens
tccagggatctttagagtcttt

SEQ ID NO: 9466018 - DNA, 22 bp, Homo sapiens
tccagggatgtcctgtagcact

SEQ ID NO: 9466019 - DNA, 23 bp, Homo sapiens
tccagggattaatgaagtcagtc

SEQ ID NO: 9466020 - DNA, 22 bp, Homo sapiens
tccagggcaccagcgtccccct

SEQ ID NO: 9466021 - DNA, 22 bp, Homo sapiens
tccagggcaccagcgtccccct

SEQ ID NO: 9466022 - DNA, 18 bp, Homo sapiens
tccagtcccaaggccagc

SEQ ID NO: 9466023 - DNA, 22 bp, Homo sapiens
tccagtccatggcctcagtctt

SEQ ID NO: 9466024 - DNA, 22 bp, Homo sapiens
tccagtccatggcctcagtctt

SEQ ID NO: 9466025 - DNA, 22 bp, Homo sapiens
tccagtccactgccttgctctt

SEQ ID NO: 9466026 - DNA, 22 bp, Homo sapiens
tccagtcatttccattgttccc

SEQ ID NO: 9466027 - DNA, 22 bp, Homo sapiens
tccagtccagggaatggctgat

SEQ ID NO: 9466028 - DNA, 22 bp, Homo sapiens
tccagtccactgccttgctctt

SEQ ID NO: 9466029 - DNA, 20 bp, Homo sapiens
tccagggcaaactcatcacc

SEQ ID NO: 9466030 - DNA, 20 bp, Homo sapiens
tccagggcaaactcatcacc

SEQ ID NO: 9466031 - DNA, 20 bp, Homo sapiens
tccagggcaaactcatcacc

SEQ ID NO: 9466032 - DNA, 20 bp, Homo sapiens
tccagggcaaactcatcacc

SEQ ID NO: 9466033 - DNA, 20 bp, Homo sapiens
tccagggcaaactcatcacc

SEQ ID NO: 9466034 - DNA, 20 bp, Homo sapiens
tccagggcaaactcatcacc

SEQ ID NO: 9466035 - DNA, 20 bp, Homo sapiens
tccagggcaaactcatcacc

SEQ ID NO: 9466036 - DNA, 20 bp, Homo sapiens
tccagggcaactagagtgtg

SEQ ID NO: 9466037 - DNA, 22 bp, Homo sapiens
tccagggcaccagcgtccccct

SEQ ID NO: 9466038 - DNA, 20 bp, Homo sapiens
tccagggcaactagagtgtg

SEQ ID NO: 9466039 - DNA, 20 bp, Homo sapiens
tccagggcaactagagtgtg

SEQ ID NO: 9466040 - DNA, 20 bp, Homo sapiens
tccagggcaactagagtgtg

SEQ ID NO: 9466041 - DNA, 22 bp, Homo sapiens
tccagggagatactggctgcca

SEQ ID NO: 9466042 - DNA, 22 bp, Homo sapiens
tccagggagatggcagaggctg

SEQ ID NO: 9466043 - DNA, 22 bp, Homo sapiens
tccagggagatactggctgcca

SEQ ID NO: 9466044 - DNA, 22 bp, Homo sapiens
tccagggagatactggctgcca

SEQ ID NO: 9466045 - DNA, 22 bp, Homo sapiens
tccagggagagccgctgctcca

SEQ ID NO: 9466046 - DNA, 22 bp, Homo sapiens
tccagggagatactggctgcca

SEQ ID NO: 9466047 - DNA, 22 bp, Homo sapiens
tccagggacctccctgagagct

SEQ ID NO: 9466048 - DNA, 22 bp, Homo sapiens
tccagggacctccctgagagct

SEQ ID NO: 9466049 - DNA, 22 bp, Homo sapiens
tccagggagagccgctgctcca

SEQ ID NO: 9466050 - DNA, 21 bp, Homo sapiens
tccaggcctcaggaagggatg

SEQ ID NO: 9466051 - DNA, 21 bp, Homo sapiens
tccaggcctcaggaagggatg

SEQ ID NO: 9466052 - DNA, 22 bp, Homo sapiens
tccagggacagcgctggagcta

SEQ ID NO: 9466053 - DNA, 22 bp, Homo sapiens
tccagggacagtatagaggatc

SEQ ID NO: 9466054 - DNA, 22 bp, Homo sapiens
tccaggcccgagatgggctgga

SEQ ID NO: 9466055 - DNA, 22 bp, Homo sapiens
tccaggcccgagatgggctgga

SEQ ID NO: 9466056 - DNA, 22 bp, Homo sapiens
tccaggcccatagacacttctc

SEQ ID NO: 9466057 - DNA, 22 bp, Homo sapiens
tccaggccgcaggggcagcccc

SEQ ID NO: 9466058 - DNA, 22 bp, Homo sapiens
tccaggccgcaggggcagcccc

SEQ ID NO: 9466059 - DNA, 22 bp, Homo sapiens
tccaggccctgggatgggagca

SEQ ID NO: 9466060 - DNA, 22 bp, Homo sapiens
tccaggccctgggatgggagca

SEQ ID NO: 9466061 - DNA, 22 bp, Homo sapiens
tccaggccgcaggggcagcccc

SEQ ID NO: 9466062 - DNA, 22 bp, Homo sapiens
tccaggccgcaggggcagcccc

SEQ ID NO: 9466063 - DNA, 22 bp, Homo sapiens
tccaggccgcaggggcagcccc

SEQ ID NO: 9466064 - DNA, 22 bp, Homo sapiens
tccaggccgcatagttactctg

SEQ ID NO: 9466065 - DNA, 22 bp, Homo sapiens
tccaggcctaggccaagtgatt

SEQ ID NO: 9466066 - DNA, 21 bp, Homo sapiens
tccaggcctcaggaagggatg

SEQ ID NO: 9466067 - DNA, 22 bp, Homo sapiens
tccaggccattgactgcatcct

SEQ ID NO: 9466068 - DNA, 22 bp, Homo sapiens
tccaggccattgactgcatcct

SEQ ID NO: 9466069 - DNA, 22 bp, Homo sapiens
tccaggccattgactgcatcct

SEQ ID NO: 9466070 - DNA, 20 bp, Homo sapiens
tccaggcccactcagctgaa

SEQ ID NO: 9466071 - DNA, 22 bp, Homo sapiens
tccaggcccagacggggtgagg

SEQ ID NO: 9466072 - DNA, 22 bp, Homo sapiens
tccaggcccagacggggtgagg

SEQ ID NO: 9466073 - DNA, 22 bp, Homo sapiens
tccaggcccactcggtggggct

SEQ ID NO: 9466074 - DNA, 22 bp, Homo sapiens
tccaggcccactcagctgaaat

SEQ ID NO: 9466075 - DNA, 22 bp, Homo sapiens
tccaggcccactcagctgaaat

SEQ ID NO: 9466076 - DNA, 21 bp, Homo sapiens
tccaggccatggtggggaggc

SEQ ID NO: 9466077 - DNA, 22 bp, Homo sapiens
tccaggccagggtaagaggaga

SEQ ID NO: 9466078 - DNA, 22 bp, Homo sapiens
tccaggccagggtaagaggaga

SEQ ID NO: 9466079 - DNA, 19 bp, Homo sapiens
tccaggccattcccagagc

SEQ ID NO: 9466080 - DNA, 21 bp, Homo sapiens
tccaggccatggtggggaggc

SEQ ID NO: 9466081 - DNA, 22 bp, Homo sapiens
tccaggccactgcagaggctct

SEQ ID NO: 9466082 - DNA, 22 bp, Homo sapiens
tccaggccactgcagaggctct

SEQ ID NO: 9466083 - DNA, 22 bp, Homo sapiens
tccaggaggcagggctgtgccc

SEQ ID NO: 9466084 - DNA, 22 bp, Homo sapiens
tccaggaggcacctttggacca

SEQ ID NO: 9466085 - DNA, 22 bp, Homo sapiens
tccagccttctcaaggctggct

SEQ ID NO: 9466086 - DNA, 22 bp, Homo sapiens
tccagccttctcaaggctggct

SEQ ID NO: 9466087 - DNA, 22 bp, Homo sapiens
tccagccttctcaaggctggct

SEQ ID NO: 9466088 - DNA, 22 bp, Homo sapiens
tccagcctggttgcgggcatcc

SEQ ID NO: 9466089 - DNA, 22 bp, Homo sapiens
tccagcctggttgcgggcatcc

SEQ ID NO: 9466090 - DNA, 19 bp, Homo sapiens
tccagcctgctgtttctct

SEQ ID NO: 9466091 - DNA, 19 bp, Homo sapiens
tccagcctgctgtttctct

SEQ ID NO: 9466092 - DNA, 23 bp, Homo sapiens
tccagcctcttgctctcacatgc

SEQ ID NO: 9466093 - DNA, 23 bp, Homo sapiens
tccagcctcttgctctcacatgc

SEQ ID NO: 9466094 - DNA, 23 bp, Homo sapiens
tccagcctcttgctctcacatgc

SEQ ID NO: 9466095 - DNA, 20 bp, Homo sapiens
tccagccctgcttctctctt

SEQ ID NO: 9466096 - DNA, 22 bp, Homo sapiens
tccagccctgtggcttccaccc

SEQ ID NO: 9466097 - DNA, 22 bp, Homo sapiens
tccagccctgcttcctgcctca

SEQ ID NO: 9466098 - DNA, 20 bp, Homo sapiens
tccagccctgcttctctctt

SEQ ID NO: 9466099 - DNA, 20 bp, Homo sapiens
tccagccctgcttctctctt

SEQ ID NO: 9466100 - DNA, 20 bp, Homo sapiens
tccagccctgcttctctctt

SEQ ID NO: 9466101 - DNA, 20 bp, Homo sapiens
tccagccctgcttctctctt

SEQ ID NO: 9466102 - DNA, 22 bp, Homo sapiens
tccaggaaatcataaattgctt

SEQ ID NO: 9466103 - DNA, 21 bp, Homo sapiens
tccagcctttccctcacttcc

SEQ ID NO: 9466104 - DNA, 21 bp, Homo sapiens
tccagcctttccctcacttcc

SEQ ID NO: 9466105 - DNA, 22 bp, Homo sapiens
tccagccttctcaaggctggct

SEQ ID NO: 9466106 - DNA, 22 bp, Homo sapiens
tccagccttgccacttttctgt

SEQ ID NO: 9466107 - DNA, 22 bp, Homo sapiens
tccaggaatttcccctttcctg

SEQ ID NO: 9466108 - DNA, 20 bp, Homo sapiens
tccaggaatggtagaggact

SEQ ID NO: 9466109 - DNA, 22 bp, Homo sapiens
tccaggacagagtagaagcagc

SEQ ID NO: 9466110 - DNA, 18 bp, Homo sapiens
tccaggactctgcgtggc

SEQ ID NO: 9466111 - DNA, 23 bp, Homo sapiens
tccaggagcatgctggctggcga

SEQ ID NO: 9466112 - DNA, 22 bp, Homo sapiens
tccaggagctcatccacgtcaa

SEQ ID NO: 9466113 - DNA, 20 bp, Homo sapiens
tccaggagaactgggagccg

SEQ ID NO: 9466114 - DNA, 23 bp, Homo sapiens
tccaggagcatgctggctggcga

SEQ ID NO: 9466115 - DNA, 23 bp, Homo sapiens
tccaggagcatgctggctggcga

SEQ ID NO: 9466116 - DNA, 22 bp, Homo sapiens
tccaggagaaaactgacggtgg

SEQ ID NO: 9466117 - DNA, 23 bp, Homo sapiens
tccaggagaacccctgtctgtcc

SEQ ID NO: 9466118 - DNA, 22 bp, Homo sapiens
tccagccctcagccaagtggaa

SEQ ID NO: 9466119 - DNA, 22 bp, Homo sapiens
tccagccctcagccaagtggaa

SEQ ID NO: 9466120 - DNA, 22 bp, Homo sapiens
tccagccctcagccaagtggaa

SEQ ID NO: 9466121 - DNA, 20 bp, Homo sapiens
tccagccctcatgtcgctca

SEQ ID NO: 9466122 - DNA, 20 bp, Homo sapiens
tccagccctcatgtcgctca

SEQ ID NO: 9466123 - DNA, 22 bp, Homo sapiens
tccagcccgggggcaggtgacc

SEQ ID NO: 9466124 - DNA, 22 bp, Homo sapiens
tccagcccgggggcaggtgacc

SEQ ID NO: 9466125 - DNA, 22 bp, Homo sapiens
tccagcccgactgggcctgccg

SEQ ID NO: 9466126 - DNA, 22 bp, Homo sapiens
tccagcccgagggcgctgatga

SEQ ID NO: 9466127 - DNA, 22 bp, Homo sapiens
tccagcccgagggcgctgatga

SEQ ID NO: 9466128 - DNA, 22 bp, Homo sapiens
tccagcccgggggcaggtgacc

SEQ ID NO: 9466129 - DNA, 22 bp, Homo sapiens
tccagcccgggggcaggtgacc

SEQ ID NO: 9466130 - DNA, 22 bp, Homo sapiens
tccagcccgggggcaggtgacc

SEQ ID NO: 9466131 - DNA, 19 bp, Homo sapiens
tccagcccctctgtgtgtg

SEQ ID NO: 9466132 - DNA, 19 bp, Homo sapiens
tccagcccctctgtgtgtg

SEQ ID NO: 9466133 - DNA, 19 bp, Homo sapiens
tccagcccctctgtgtgtg

SEQ ID NO: 9466134 - DNA, 20 bp, Homo sapiens
tccagcccctgcatgttgct

SEQ ID NO: 9466135 - DNA, 20 bp, Homo sapiens
tccagcccctgcatgttgct

SEQ ID NO: 9466136 - DNA, 22 bp, Homo sapiens
tccagccccttttactcattca

SEQ ID NO: 9466137 - DNA, 22 bp, Homo sapiens
tccagccccttttactcattca

SEQ ID NO: 9466138 - DNA, 22 bp, Homo sapiens
tccagcccgactgggcctgccg

SEQ ID NO: 9466139 - DNA, 22 bp, Homo sapiens
tccagccccttttactcattca

SEQ ID NO: 9466140 - DNA, 22 bp, Homo sapiens
tccagcccgactgggcctgccg

SEQ ID NO: 9466141 - DNA, 22 bp, Homo sapiens
tccagcccgactgggcctgccg

SEQ ID NO: 9466142 - DNA, 17 bp, Homo sapiens
tccagccctgcccgacg

SEQ ID NO: 9466143 - DNA, 22 bp, Homo sapiens
tccagccctgcccattctctcg

SEQ ID NO: 9466144 - DNA, 17 bp, Homo sapiens
tccagccctgcccgacg

SEQ ID NO: 9466145 - DNA, 22 bp, Homo sapiens
tccagccctgcccattctctcg

SEQ ID NO: 9466146 - DNA, 22 bp, Homo sapiens
tccagccctgcccattctctcg

SEQ ID NO: 9466147 - DNA, 22 bp, Homo sapiens
tccagccctgcttcctgcctca

SEQ ID NO: 9466148 - DNA, 22 bp, Homo sapiens
tccagccctgcttcctgcctca

SEQ ID NO: 9466149 - DNA, 17 bp, Homo sapiens
tccagccctgcccgacg

SEQ ID NO: 9466150 - DNA, 22 bp, Homo sapiens
tccagccctgcttcctgcctca

SEQ ID NO: 9466151 - DNA, 17 bp, Homo sapiens
tccagccctgcccgacg

SEQ ID NO: 9466152 - DNA, 22 bp, Homo sapiens
tccagccctctggcccgcggtg

SEQ ID NO: 9466153 - DNA, 22 bp, Homo sapiens
tccagccctctggcccgcggtg

SEQ ID NO: 9466154 - DNA, 22 bp, Homo sapiens
tccagccctctggcccgcggtg

SEQ ID NO: 9466155 - DNA, 22 bp, Homo sapiens
tccagccctgcactgattagat

SEQ ID NO: 9466156 - DNA, 22 bp, Homo sapiens
tccagccctgcactgattagat

SEQ ID NO: 9466157 - DNA, 22 bp, Homo sapiens
tccagccctgcactgattagat

SEQ ID NO: 9466158 - DNA, 22 bp, Homo sapiens
tccagccctgcccattctctcg

SEQ ID NO: 9466159 - DNA, 22 bp, Homo sapiens
tccagccctgcccattctctcg

SEQ ID NO: 9466160 - DNA, 20 bp, Homo sapiens
tccagccctcatgtcgctca

SEQ ID NO: 9466161 - DNA, 20 bp, Homo sapiens
tccagccctcatgtcgctca

SEQ ID NO: 9466162 - DNA, 22 bp, Homo sapiens
tccagccctcctgggatcacag

SEQ ID NO: 9466163 - DNA, 22 bp, Homo sapiens
tccagccctcctgggatcacag

SEQ ID NO: 9466164 - DNA, 22 bp, Homo sapiens
tccagccctcctgggatcacag

SEQ ID NO: 9466165 - DNA, 22 bp, Homo sapiens
tccagcccatccctagcctggg

SEQ ID NO: 9466166 - DNA, 22 bp, Homo sapiens
tccagcccatccctagcctggg

SEQ ID NO: 9466167 - DNA, 22 bp, Homo sapiens
tccagccccgaggccggcgacg

SEQ ID NO: 9466168 - DNA, 22 bp, Homo sapiens
tccagcccatccctagcctggg

SEQ ID NO: 9466169 - DNA, 22 bp, Homo sapiens
tccagccccgaggccggcgacg

SEQ ID NO: 9466170 - DNA, 22 bp, Homo sapiens
tccagccccgaggccggcgacg

SEQ ID NO: 9466171 - DNA, 22 bp, Homo sapiens
tccagccccggcttccttacag

SEQ ID NO: 9466172 - DNA, 22 bp, Homo sapiens
tccagccccgaggccggcgacg

SEQ ID NO: 9466173 - DNA, 22 bp, Homo sapiens
tccagcccagtttggtgaattg

SEQ ID NO: 9466174 - DNA, 20 bp, Homo sapiens
tccagcccaggtcctgcctg

SEQ ID NO: 9466175 - DNA, 20 bp, Homo sapiens
tccagcccaggtcctgcctg

SEQ ID NO: 9466176 - DNA, 22 bp, Homo sapiens
tccagcccagtttggtgaattg

SEQ ID NO: 9466177 - DNA, 22 bp, Homo sapiens
tccagcccatccctagcctggg

SEQ ID NO: 9466178 - DNA, 22 bp, Homo sapiens
tccagcccatccctagcctggg

SEQ ID NO: 9466179 - DNA, 22 bp, Homo sapiens
tccagccccgggatgttcttca

SEQ ID NO: 9466180 - DNA, 22 bp, Homo sapiens
tccagccccgggatgttcttca

SEQ ID NO: 9466181 - DNA, 22 bp, Homo sapiens
tccagccccgggatgttcttca

SEQ ID NO: 9466182 - DNA, 22 bp, Homo sapiens
tccagccccgggatgttcttca

SEQ ID NO: 9466183 - DNA, 22 bp, Homo sapiens
tccagccccggcttccttacag

SEQ ID NO: 9466184 - DNA, 22 bp, Homo sapiens
tccagccccggcttccttacag

SEQ ID NO: 9466185 - DNA, 22 bp, Homo sapiens
tccagccccggcttccttacag

SEQ ID NO: 9466186 - DNA, 22 bp, Homo sapiens
tccagccccggcttccttacag

SEQ ID NO: 9466187 - DNA, 22 bp, Homo sapiens
tccagcccctcctgagccaagc

SEQ ID NO: 9466188 - DNA, 22 bp, Homo sapiens
tccagcccctcctgagccaagc

SEQ ID NO: 9466189 - DNA, 22 bp, Homo sapiens
tccagcccctcctgagccaagc

SEQ ID NO: 9466190 - DNA, 22 bp, Homo sapiens
tccagcccctcctgagccaagc

SEQ ID NO: 9466191 - DNA, 19 bp, Homo sapiens
tccagcccctctgtgtgtg

SEQ ID NO: 9466192 - DNA, 22 bp, Homo sapiens
tccagccactcagcagggattg

SEQ ID NO: 9466193 - DNA, 22 bp, Homo sapiens
tccagccactcagcagggattg

SEQ ID NO: 9466194 - DNA, 20 bp, Homo sapiens
tccagccacttccgctggtc

SEQ ID NO: 9466195 - DNA, 22 bp, Homo sapiens
tccagcccaggctggagtgtag

SEQ ID NO: 9466196 - DNA, 20 bp, Homo sapiens
tccagccacttccgctggtc

SEQ ID NO: 9466197 - DNA, 20 bp, Homo sapiens
tccagcccaggtcctgcctg

SEQ ID NO: 9466198 - DNA, 20 bp, Homo sapiens
tccagcccaggtcctgcctg

SEQ ID NO: 9466199 - DNA, 20 bp, Homo sapiens
tccagcccaggtcctgcctg

SEQ ID NO: 9466200 - DNA, 22 bp, Homo sapiens
tccagcccaggctggagtgtag

SEQ ID NO: 9466201 - DNA, 22 bp, Homo sapiens
tccagcccaggctggagtgtag

SEQ ID NO: 9466202 - DNA, 22 bp, Homo sapiens
tccagcccaggctggagtgtag

SEQ ID NO: 9466203 - DNA, 22 bp, Homo sapiens
tccagaaatgcaagccaggtgt

SEQ ID NO: 9466204 - DNA, 22 bp, Homo sapiens
tccagccactcagcagggattg

SEQ ID NO: 9466205 - DNA, 22 bp, Homo sapiens
tccagaaacttcatttgcaagc

SEQ ID NO: 9466206 - DNA, 22 bp, Homo sapiens
tccagaaactgctgagataaga

SEQ ID NO: 9466207 - DNA, 22 bp, Homo sapiens
tcatggcttcaaggaagcaggc

SEQ ID NO: 9466208 - DNA, 18 bp, Homo sapiens
tcatggcttgcagatggt

SEQ ID NO: 9466209 - DNA, 18 bp, Homo sapiens
tcatggcttgcagatggt

SEQ ID NO: 9466210 - DNA, 20 bp, Homo sapiens
tcatggctgctgagaggttc

SEQ ID NO: 9466211 - DNA, 22 bp, Homo sapiens
tcatggctggaagctcagttag

SEQ ID NO: 9466212 - DNA, 22 bp, Homo sapiens
tcatggcttcaaggaagcaggc

SEQ ID NO: 9466213 - DNA, 22 bp, Homo sapiens
tcatggctttttcactgttcgc

SEQ ID NO: 9466214 - DNA, 22 bp, Homo sapiens
tcatgttattgactcataatat

SEQ ID NO: 9466215 - DNA, 22 bp, Homo sapiens
tcatgtttgttggaaatgtggc

SEQ ID NO: 9466216 - DNA, 22 bp, Homo sapiens
tcatgtttggagtttgctcact

SEQ ID NO: 9466217 - DNA, 22 bp, Homo sapiens
tcatgtttgccctaagaaaaag

SEQ ID NO: 9466218 - DNA, 22 bp, Homo sapiens
tcatgtttgagactaatttttc

SEQ ID NO: 9466219 - DNA, 22 bp, Homo sapiens
tcatgttattgactcataatat

SEQ ID NO: 9466220 - DNA, 22 bp, Homo sapiens
tcatgttttagctgcaaaatga

SEQ ID NO: 9466221 - DNA, 22 bp, Homo sapiens
tcatgttttagctgcaaaatga

SEQ ID NO: 9466222 - DNA, 22 bp, Homo sapiens
tcatgttttagctgcaaaatga

SEQ ID NO: 9466223 - DNA, 22 bp, Homo sapiens
tcatgttttagctgcaaaatga

SEQ ID NO: 9466224 - DNA, 22 bp, Homo sapiens
tcatgtttgttggaaatgtggc

SEQ ID NO: 9466225 - DNA, 22 bp, Homo sapiens
tcatgttttaatgcctttttct

SEQ ID NO: 9466226 - DNA, 22 bp, Homo sapiens
tcatgtttttgccatatgactc

SEQ ID NO: 9466227 - DNA, 22 bp, Homo sapiens
tcatgttttagtaaagtgaagg

SEQ ID NO: 9466228 - DNA, 22 bp, Homo sapiens
tccacacttgctgtctgctgag

SEQ ID NO: 9466229 - DNA, 22 bp, Homo sapiens
tccacagaccagtatctgcagc

SEQ ID NO: 9466230 - DNA, 22 bp, Homo sapiens
tccacagaatgtaagatccaca

SEQ ID NO: 9466231 - DNA, 22 bp, Homo sapiens
tccacagactattaagtgatct

SEQ ID NO: 9466232 - DNA, 22 bp, Homo sapiens
tccacagacgtgttattagttg

SEQ ID NO: 9466233 - DNA, 22 bp, Homo sapiens
tcattaatttgcttagacttat

SEQ ID NO: 9466234 - DNA, 22 bp, Homo sapiens
tcattaataagtctaactctcc

SEQ ID NO: 9466235 - DNA, 22 bp, Homo sapiens
tcattaataagtctaactctcc

SEQ ID NO: 9466236 - DNA, 22 bp, Homo sapiens
tcattaataagtctaactctcc

SEQ ID NO: 9466237 - DNA, 22 bp, Homo sapiens
tccacagatgacagaggggatg

SEQ ID NO: 9466238 - DNA, 22 bp, Homo sapiens
tccacagcacaaagccagtgtg

SEQ ID NO: 9466239 - DNA, 22 bp, Homo sapiens
tccacagcacaaagccagtgtg

SEQ ID NO: 9466240 - DNA, 22 bp, Homo sapiens
tccacagcacaaagccagtgtg

SEQ ID NO: 9466241 - DNA, 22 bp, Homo sapiens
tccacaggaaagcacctcccat

SEQ ID NO: 9466242 - DNA, 22 bp, Homo sapiens
tccacagctgtcctgtaacagg

SEQ ID NO: 9466243 - DNA, 22 bp, Homo sapiens
tccacaggctgaggcccttctg

SEQ ID NO: 9466244 - DNA, 22 bp, Homo sapiens
tccacaggaaagcacctcccat

SEQ ID NO: 9466245 - DNA, 22 bp, Homo sapiens
tccacaggcaagtctcttggca

SEQ ID NO: 9466246 - DNA, 22 bp, Homo sapiens
tccacaggcaagtctcttggca

SEQ ID NO: 9466247 - DNA, 22 bp, Homo sapiens
tccacagggatgcctgcggctt

SEQ ID NO: 9466248 - DNA, 22 bp, Homo sapiens
tccacagggatgttgagttctt

SEQ ID NO: 9466249 - DNA, 22 bp, Homo sapiens
tccacagggatgttgagttctt

SEQ ID NO: 9466250 - DNA, 22 bp, Homo sapiens
tccacagggatgcctgcggctt

SEQ ID NO: 9466251 - DNA, 22 bp, Homo sapiens
tccacagggatgcctgcggctt

SEQ ID NO: 9466252 - DNA, 22 bp, Homo sapiens
tccaccatgtaacaagctctgt

SEQ ID NO: 9466253 - DNA, 22 bp, Homo sapiens
tccaccatgtaacaagctctgt

SEQ ID NO: 9466254 - DNA, 22 bp, Homo sapiens
tccaccatgtaacaagctctgt

SEQ ID NO: 9466255 - DNA, 22 bp, Homo sapiens
tccaccatgtaacaagctctgt

SEQ ID NO: 9466256 - DNA, 22 bp, Homo sapiens
tccacccagcacactgtggtag

SEQ ID NO: 9466257 - DNA, 22 bp, Homo sapiens
tccaccatgatttagcactggc

SEQ ID NO: 9466258 - DNA, 18 bp, Homo sapiens
tccaccagtcaatctgtc

SEQ ID NO: 9466259 - DNA, 23 bp, Homo sapiens
tccaccccagctgaggcttagcc

SEQ ID NO: 9466260 - DNA, 23 bp, Homo sapiens
tccaccccagctgaggcttagcc

SEQ ID NO: 9466261 - DNA, 22 bp, Homo sapiens
tccacccccagacagctggtga

SEQ ID NO: 9466262 - DNA, 19 bp, Homo sapiens
tccaccccagccagctctg

SEQ ID NO: 9466263 - DNA, 22 bp, Homo sapiens
tccacccagtgtttctacaggt

SEQ ID NO: 9466264 - DNA, 19 bp, Homo sapiens
tccaccccagccagctctg

SEQ ID NO: 9466265 - DNA, 22 bp, Homo sapiens
tccaccagcagcctgtcagcct

SEQ ID NO: 9466266 - DNA, 22 bp, Homo sapiens
tccaccagagccttcccatgct

SEQ ID NO: 9466267 - DNA, 22 bp, Homo sapiens
tccaccagagccctctttgcgg

SEQ ID NO: 9466268 - DNA, 22 bp, Homo sapiens
tccacattgcacagccagaaca

SEQ ID NO: 9466269 - DNA, 22 bp, Homo sapiens
tccacattgcacagccagaaca

SEQ ID NO: 9466270 - DNA, 22 bp, Homo sapiens
tccacattctctgttacagata

SEQ ID NO: 9466271 - DNA, 22 bp, Homo sapiens
tccacattctctgttacagata

SEQ ID NO: 9466272 - DNA, 22 bp, Homo sapiens
tccacagggcctttctggtgtg

SEQ ID NO: 9466273 - DNA, 22 bp, Homo sapiens
tccacagggattcacccaaaag

SEQ ID NO: 9466274 - DNA, 22 bp, Homo sapiens
tccacagggattcacccaaaag

SEQ ID NO: 9466275 - DNA, 20 bp, Homo sapiens
tccaccaggaagggtaggga

SEQ ID NO: 9466276 - DNA, 22 bp, Homo sapiens
tccaccagcttcttcaccagct

SEQ ID NO: 9466277 - DNA, 22 bp, Homo sapiens
tccaccaggctccatgttcagt

SEQ ID NO: 9466278 - DNA, 22 bp, Homo sapiens
tccaccagcagcctgtcagcct

SEQ ID NO: 9466279 - DNA, 21 bp, Homo sapiens
tccaccagctcttcctcttca

SEQ ID NO: 9466280 - DNA, 22 bp, Homo sapiens
tccactggcctctgtctttcag

SEQ ID NO: 9466281 - DNA, 22 bp, Homo sapiens
tccactggtaatacctagatcc

SEQ ID NO: 9466282 - DNA, 22 bp, Homo sapiens
tccactggcccacctcctcagt

SEQ ID NO: 9466283 - DNA, 22 bp, Homo sapiens
tccactggaacaactctgaggc

SEQ ID NO: 9466284 - DNA, 22 bp, Homo sapiens
tccactttagcaatgattgaat

SEQ ID NO: 9466285 - DNA, 22 bp, Homo sapiens
tccagaaaattcagaaattgtt

SEQ ID NO: 9466286 - DNA, 22 bp, Homo sapiens
tccagaaaaagtaatttatttg

SEQ ID NO: 9466287 - DNA, 22 bp, Homo sapiens
tccacctgggcaacagtgcctc

SEQ ID NO: 9466288 - DNA, 22 bp, Homo sapiens
tccaccctgctttcttatctcc

SEQ ID NO: 9466289 - DNA, 22 bp, Homo sapiens
tccaccctgctttcttatctcc

SEQ ID NO: 9466290 - DNA, 21 bp, Homo sapiens
tccaccctctctgctcccagt

SEQ ID NO: 9466291 - DNA, 21 bp, Homo sapiens
tccaccctctctgctcccagt

SEQ ID NO: 9466292 - DNA, 21 bp, Homo sapiens
tccaccctctctgctcccagt

SEQ ID NO: 9466293 - DNA, 22 bp, Homo sapiens
tccactctaattactaccttct

SEQ ID NO: 9466294 - DNA, 22 bp, Homo sapiens
tccactcaaggccattgcacat

SEQ ID NO: 9466295 - DNA, 22 bp, Homo sapiens
tccacgtgagcttcgtgtgcag

SEQ ID NO: 9466296 - DNA, 22 bp, Homo sapiens
tccacgtgagcttcgtgtgcag

SEQ ID NO: 9466297 - DNA, 22 bp, Homo sapiens
tcagtgcatcacagaactttgt

SEQ ID NO: 9466298 - DNA, 22 bp, Homo sapiens
tcagtgcatggacagatttaga

SEQ ID NO: 9466299 - DNA, 22 bp, Homo sapiens
tcagtgcatggacagatttaga

SEQ ID NO: 9466300 - DNA, 22 bp, Homo sapiens
tcagtgcattaataatatcagt

SEQ ID NO: 9466301 - DNA, 22 bp, Homo sapiens
tcagtgcattcatgggtggctg

SEQ ID NO: 9466302 - DNA, 22 bp, Homo sapiens
tcagtgcattaataatatcagt

SEQ ID NO: 9466303 - DNA, 22 bp, Homo sapiens
tcagtgcagtagaactttagtt

SEQ ID NO: 9466304 - DNA, 22 bp, Homo sapiens
tcagtgcagtgaaaggtttact

SEQ ID NO: 9466305 - DNA, 20 bp, Homo sapiens
tcaggtgacacacgtggcac

SEQ ID NO: 9466306 - DNA, 22 bp, Homo sapiens
tcaggtgacctgagccactatg

SEQ ID NO: 9466307 - DNA, 22 bp, Homo sapiens
tcaggtcttgagccatcaggat

SEQ ID NO: 9466308 - DNA, 22 bp, Homo sapiens
tcaggtcttttgtctcctagaa

SEQ ID NO: 9466309 - DNA, 22 bp, Homo sapiens
tcaggtctgtactattgtcttg

SEQ ID NO: 9466310 - DNA, 22 bp, Homo sapiens
tcaggtctgatgcctcatccat

SEQ ID NO: 9466311 - DNA, 22 bp, Homo sapiens
tcaggtctgggcacatggtaca

SEQ ID NO: 9466312 - DNA, 22 bp, Homo sapiens
tcaggtctatagaagaggaggg

SEQ ID NO: 9466313 - DNA, 22 bp, Homo sapiens
tcaggtccttactgtgctccct

SEQ ID NO: 9466314 - DNA, 22 bp, Homo sapiens
tcaggtctatactatgagaggc

SEQ ID NO: 9466315 - DNA, 22 bp, Homo sapiens
tcaggtccagctcctgtgcctc

SEQ ID NO: 9466316 - DNA, 22 bp, Homo sapiens
tcaggtcctctgggtcccagcc

SEQ ID NO: 9466317 - DNA, 22 bp, Homo sapiens
tcaggtaagtgtaatatataga

SEQ ID NO: 9466318 - DNA, 20 bp, Homo sapiens
tcagggtttcccattcttgg

SEQ ID NO: 9466319 - DNA, 22 bp, Homo sapiens
tcaggtccaagatggccatcca

SEQ ID NO: 9466320 - DNA, 22 bp, Homo sapiens
tcaggtccaagatggccatcca

SEQ ID NO: 9466321 - DNA, 22 bp, Homo sapiens
tcaggtcatctgtctctgggct

SEQ ID NO: 9466322 - DNA, 22 bp, Homo sapiens
tcagggtcagattccagagcct

SEQ ID NO: 9466323 - DNA, 22 bp, Homo sapiens
tcagggtatgttctagatctga

SEQ ID NO: 9466324 - DNA, 22 bp, Homo sapiens
tcagggtgaaccaggcaggaat

SEQ ID NO: 9466325 - DNA, 22 bp, Homo sapiens
tcagggtcaggacccagctgtt

SEQ ID NO: 9466326 - DNA, 22 bp, Homo sapiens
tcagggcagcctaaggcacctc

SEQ ID NO: 9466327 - DNA, 22 bp, Homo sapiens
tcagggcagcctaaggcacctc

SEQ ID NO: 9466328 - DNA, 22 bp, Homo sapiens
tcagggcagcctaaggcacctc

SEQ ID NO: 9466329 - DNA, 22 bp, Homo sapiens
tcagggcagaatccaaagaatt

SEQ ID NO: 9466330 - DNA, 22 bp, Homo sapiens
tcagggcagaatccaaagaatt

SEQ ID NO: 9466331 - DNA, 22 bp, Homo sapiens
tcagggcaccaaaaaagatgcc

SEQ ID NO: 9466332 - DNA, 22 bp, Homo sapiens
tcaggggctgtgcatttcccag

SEQ ID NO: 9466333 - DNA, 21 bp, Homo sapiens
tcaggggctgtgttttccatc

SEQ ID NO: 9466334 - DNA, 22 bp, Homo sapiens
tcaggggcttgaggtgcatgtc

SEQ ID NO: 9466335 - DNA, 22 bp, Homo sapiens
tcaggggcttgaggtgcatgtc

SEQ ID NO: 9466336 - DNA, 22 bp, Homo sapiens
tcaggggaaatctctcagcgaa

SEQ ID NO: 9466337 - DNA, 22 bp, Homo sapiens
tcaggggacttaggagagaagt

SEQ ID NO: 9466338 - DNA, 22 bp, Homo sapiens
tcaggggcagctgtgctttgtg

SEQ ID NO: 9466339 - DNA, 22 bp, Homo sapiens
tcaggggcagccggggaagcca

SEQ ID NO: 9466340 - DNA, 22 bp, Homo sapiens
tcaggggcagccggggaagcca

SEQ ID NO: 9466341 - DNA, 22 bp, Homo sapiens
tcagggcacattctgcagtggc

SEQ ID NO: 9466342 - DNA, 22 bp, Homo sapiens
tcagggcacattctgcagtggc

SEQ ID NO: 9466343 - DNA, 22 bp, Homo sapiens
tcagggcaatgtccctcagaag

SEQ ID NO: 9466344 - DNA, 22 bp, Homo sapiens
tcagggcacaggcctgtgggtt

SEQ ID NO: 9466345 - DNA, 22 bp, Homo sapiens
tcagggcaaagggcagagtttg

SEQ ID NO: 9466346 - DNA, 22 bp, Homo sapiens
tcagggcaagtctcagaaggtt

SEQ ID NO: 9466347 - DNA, 22 bp, Homo sapiens
tcagggcaagtctcagaaggtt

SEQ ID NO: 9466348 - DNA, 22 bp, Homo sapiens
tcagggcaagtctcagaaggtt

SEQ ID NO: 9466349 - DNA, 22 bp, Homo sapiens
tcagggcaaaagggaaaccatt

SEQ ID NO: 9466350 - DNA, 22 bp, Homo sapiens
tcagggagagcctgtctgacgt

SEQ ID NO: 9466351 - DNA, 22 bp, Homo sapiens
tcagggcaaaagggaaaccatt

SEQ ID NO: 9466352 - DNA, 22 bp, Homo sapiens
tcagggagaggtgagagcctgt

SEQ ID NO: 9466353 - DNA, 22 bp, Homo sapiens
tcagggactgcagagggaagct

SEQ ID NO: 9466354 - DNA, 22 bp, Homo sapiens
tcaggctgaggtcatctgcatc

SEQ ID NO: 9466355 - DNA, 22 bp, Homo sapiens
tcaggctcaggaatgtgtttat

SEQ ID NO: 9466356 - DNA, 22 bp, Homo sapiens
tcaggcgaggcttaatccaagg

SEQ ID NO: 9466357 - DNA, 22 bp, Homo sapiens
tcaggcctttgaacttggagtg

SEQ ID NO: 9466358 - DNA, 22 bp, Homo sapiens
tcaggcctttgaacttggagtg

SEQ ID NO: 9466359 - DNA, 22 bp, Homo sapiens
tcaggcctttgaacttggagtg

SEQ ID NO: 9466360 - DNA, 22 bp, Homo sapiens
tcaggcctttcttcagagcttc

SEQ ID NO: 9466361 - DNA, 22 bp, Homo sapiens
tcaggcctttcttcagagcttc

SEQ ID NO: 9466362 - DNA, 22 bp, Homo sapiens
tcaggcctttcttcagagcttc

SEQ ID NO: 9466363 - DNA, 22 bp, Homo sapiens
tcaggctccctgctgggctctg

SEQ ID NO: 9466364 - DNA, 22 bp, Homo sapiens
tcaggctccctgctgggctctg

SEQ ID NO: 9466365 - DNA, 20 bp, Homo sapiens
tcaggctccgcattaactta

SEQ ID NO: 9466366 - DNA, 22 bp, Homo sapiens
tcaggctcaggttaggggccaa

SEQ ID NO: 9466367 - DNA, 22 bp, Homo sapiens
tcaggctccctgctgggctctg

SEQ ID NO: 9466368 - DNA, 22 bp, Homo sapiens
tcaggctctacacttgacacac

SEQ ID NO: 9466369 - DNA, 18 bp, Homo sapiens
tcaggctctctggctaga

SEQ ID NO: 9466370 - DNA, 22 bp, Homo sapiens
tcaggctctcagaccaacagca

SEQ ID NO: 9466371 - DNA, 22 bp, Homo sapiens
tcaggctctcagaccaacagca

SEQ ID NO: 9466372 - DNA, 22 bp, Homo sapiens
tcaggctgaaaggactccagtt

SEQ ID NO: 9466373 - DNA, 22 bp, Homo sapiens
tcaggctctgggtacacctgac

SEQ ID NO: 9466374 - DNA, 22 bp, Homo sapiens
tcaggctctgccacctagatta

SEQ ID NO: 9466375 - DNA, 22 bp, Homo sapiens
tcaggctctgagctgatgctaa

SEQ ID NO: 9466376 - DNA, 22 bp, Homo sapiens
tcaggctctgagctgatgctaa

SEQ ID NO: 9466377 - DNA, 22 bp, Homo sapiens
tcatctaagagtcttacattta

SEQ ID NO: 9466378 - DNA, 22 bp, Homo sapiens
tcatctaagagtcttacattta

SEQ ID NO: 9466379 - DNA, 22 bp, Homo sapiens
tcatctaagagtcttacattta

SEQ ID NO: 9466380 - DNA, 22 bp, Homo sapiens
tcatctaagagtcttacattta

SEQ ID NO: 9466381 - DNA, 22 bp, Homo sapiens
tcatcctgtatcctcagaccat

SEQ ID NO: 9466382 - DNA, 22 bp, Homo sapiens
tcatcctgcactggctcctcct

SEQ ID NO: 9466383 - DNA, 22 bp, Homo sapiens
tcatcctgcactggctcctcct

SEQ ID NO: 9466384 - DNA, 22 bp, Homo sapiens
tcatcctgtctcactttttgct

SEQ ID NO: 9466385 - DNA, 22 bp, Homo sapiens
tcatcctgtctcactttttgct

SEQ ID NO: 9466386 - DNA, 22 bp, Homo sapiens
tcatccttttgcatgggaaggc

SEQ ID NO: 9466387 - DNA, 18 bp, Homo sapiens
tcatctactggtccaggt

SEQ ID NO: 9466388 - DNA, 22 bp, Homo sapiens
tcatctcagggcgacatcatgt

SEQ ID NO: 9466389 - DNA, 22 bp, Homo sapiens
tcatctccatacggtctcgcag

SEQ ID NO: 9466390 - DNA, 22 bp, Homo sapiens
tcatccagtatgactggtgtct

SEQ ID NO: 9466391 - DNA, 20 bp, Homo sapiens
tcatccagttggtttatggt

SEQ ID NO: 9466392 - DNA, 22 bp, Homo sapiens
tcatccatactattgagaggca

SEQ ID NO: 9466393 - DNA, 22 bp, Homo sapiens
tcatccctaaggacagctctgc

SEQ ID NO: 9466394 - DNA, 22 bp, Homo sapiens
tcatccctctgccaggcccagg

SEQ ID NO: 9466395 - DNA, 22 bp, Homo sapiens
tcatcctgaagaacctgcttcc

SEQ ID NO: 9466396 - DNA, 22 bp, Homo sapiens
tcataaaatgctcctgatattg

SEQ ID NO: 9466397 - DNA, 22 bp, Homo sapiens
tcataaaatgctcctgatattg

SEQ ID NO: 9466398 - DNA, 22 bp, Homo sapiens
tcataaaagtactcatgttcat

SEQ ID NO: 9466399 - DNA, 22 bp, Homo sapiens
tcataaaagtactcatgttcat

SEQ ID NO: 9466400 - DNA, 22 bp, Homo sapiens
tcataaagatactaagtgagtt

SEQ ID NO: 9466401 - DNA, 20 bp, Homo sapiens
tcataaagaggaaataaata

SEQ ID NO: 9466402 - DNA, 20 bp, Homo sapiens
tcataaagaggaaataaata

SEQ ID NO: 9466403 - DNA, 22 bp, Homo sapiens
tcatcatgtttgatttccacag

SEQ ID NO: 9466404 - DNA, 22 bp, Homo sapiens
tcatcaaagcgcttggagtagg

SEQ ID NO: 9466405 - DNA, 22 bp, Homo sapiens
tcatcaaaggattgcatgattt

SEQ ID NO: 9466406 - DNA, 22 bp, Homo sapiens
tcatcaaaggattgcatgattt

SEQ ID NO: 9466407 - DNA, 20 bp, Homo sapiens
tcatatttttgccctgggcc

SEQ ID NO: 9466408 - DNA, 22 bp, Homo sapiens
tcatccagagcttcataagtaa

SEQ ID NO: 9466409 - DNA, 22 bp, Homo sapiens
tcagtggtatgcgtgggagctg

SEQ ID NO: 9466410 - DNA, 22 bp, Homo sapiens
tcagtggggtcgatgtgaggga

SEQ ID NO: 9466411 - DNA, 22 bp, Homo sapiens
tcagtggatatttctgtggctg

SEQ ID NO: 9466412 - DNA, 22 bp, Homo sapiens
tcagtggagtatggatgaagtc

SEQ ID NO: 9466413 - DNA, 22 bp, Homo sapiens
tcagtggattgacatgaaaaag

SEQ ID NO: 9466414 - DNA, 19 bp, Homo sapiens
tcagtggatgaacatgttt

SEQ ID NO: 9466415 - DNA, 22 bp, Homo sapiens
tcagtggagctaagcatgagat

SEQ ID NO: 9466416 - DNA, 22 bp, Homo sapiens
tcagtggagtatggatgaagtc

SEQ ID NO: 9466417 - DNA, 22 bp, Homo sapiens
tcagtggagctaagcatgagat

SEQ ID NO: 9466418 - DNA, 22 bp, Homo sapiens
tcagtggattggatgagatctg

SEQ ID NO: 9466419 - DNA, 22 bp, Homo sapiens
tcagtggattgtagaaggctta

SEQ ID NO: 9466420 - DNA, 20 bp, Homo sapiens
tcagtgggaaagtgagagtg

SEQ ID NO: 9466421 - DNA, 22 bp, Homo sapiens
tcagtgctgtgtaaatgtatta

SEQ ID NO: 9466422 - DNA, 22 bp, Homo sapiens
tcagtgcttcctggaggaagcc

SEQ ID NO: 9466423 - DNA, 22 bp, Homo sapiens
tcagtgcttcctggaggaagcc

SEQ ID NO: 9466424 - DNA, 22 bp, Homo sapiens
tcagtgcttcggcgagcaccta

SEQ ID NO: 9466425 - DNA, 22 bp, Homo sapiens
tcagtgcttgcctctggaggag

SEQ ID NO: 9466426 - DNA, 22 bp, Homo sapiens
tcagtgcttcggcgagcaccta

SEQ ID NO: 9466427 - DNA, 22 bp, Homo sapiens
tcagtgcttttgagaagctcct

SEQ ID NO: 9466428 - DNA, 22 bp, Homo sapiens
tcagtgcttgcctctggaggag

SEQ ID NO: 9466429 - DNA, 19 bp, Homo sapiens
tcagtggagaaaggggaag

SEQ ID NO: 9466430 - DNA, 22 bp, Homo sapiens
tcagtgcttttgtcacatggtc

SEQ ID NO: 9466431 - DNA, 19 bp, Homo sapiens
tcagtggagaaaggggaag

SEQ ID NO: 9466432 - DNA, 22 bp, Homo sapiens
tcagtggagagcttccaggatt

SEQ ID NO: 9466433 - DNA, 22 bp, Homo sapiens
tcagtggaactgtctgggtgag

SEQ ID NO: 9466434 - DNA, 22 bp, Homo sapiens
tcagtggaactgtctgggtgag

SEQ ID NO: 9466435 - DNA, 22 bp, Homo sapiens
tcagtgcttttgtcacatggtc

SEQ ID NO: 9466436 - DNA, 22 bp, Homo sapiens
tcagtttctttactcatagaat

SEQ ID NO: 9466437 - DNA, 22 bp, Homo sapiens
tcagtttcttctttagataaaa

SEQ ID NO: 9466438 - DNA, 22 bp, Homo sapiens
tcagtttcttcatctccctaac

SEQ ID NO: 9466439 - DNA, 22 bp, Homo sapiens
tcagtttcttcatctccctaac

SEQ ID NO: 9466440 - DNA, 22 bp, Homo sapiens
tcagtttctccatcgctccagt

SEQ ID NO: 9466441 - DNA, 22 bp, Homo sapiens
tcagtttctccatcgctccagt

SEQ ID NO: 9466442 - DNA, 22 bp, Homo sapiens
tcagttctaacagtttagaaca

SEQ ID NO: 9466443 - DNA, 22 bp, Homo sapiens
tcagttcagtatacactattct

SEQ ID NO: 9466444 - DNA, 22 bp, Homo sapiens
tcagtttctaaatcttaccaat

SEQ ID NO: 9466445 - DNA, 22 bp, Homo sapiens
tcagtttctaaatcttaccaat

SEQ ID NO: 9466446 - DNA, 22 bp, Homo sapiens
tcagttttaaggtttgagaatt

SEQ ID NO: 9466447 - DNA, 22 bp, Homo sapiens
tcagttttaaggtttgagaatt

SEQ ID NO: 9466448 - DNA, 19 bp, Homo sapiens
tcagttttagtcatcagtt

SEQ ID NO: 9466449 - DNA, 19 bp, Homo sapiens
tcagttttagtcatcagtt

SEQ ID NO: 9466450 - DNA, 22 bp, Homo sapiens
tcagttttcaatttcatcagag

SEQ ID NO: 9466451 - DNA, 22 bp, Homo sapiens
tcagttttcatttcatgagcag

SEQ ID NO: 9466452 - DNA, 22 bp, Homo sapiens
tcagttttcaatttcatcagag

SEQ ID NO: 9466453 - DNA, 22 bp, Homo sapiens
tcagtttttgtttgccagatag

SEQ ID NO: 9466454 - DNA, 22 bp, Homo sapiens
tcataaaaatagactctaaagt

SEQ ID NO: 9466455 - DNA, 22 bp, Homo sapiens
tcataaaacacaccaggtagtt

SEQ ID NO: 9466456 - DNA, 19 bp, Homo sapiens
tcataaaaatggtaaccca

SEQ ID NO: 9466457 - DNA, 22 bp, Homo sapiens
tcagtttttacggtcacaggga

SEQ ID NO: 9466458 - DNA, 22 bp, Homo sapiens
tcagttttgtatgttgtaagtc

SEQ ID NO: 9466459 - DNA, 22 bp, Homo sapiens
tcagccagggcagagcaggtga

SEQ ID NO: 9466460 - DNA, 22 bp, Homo sapiens
tcagccaggccaggcattcaca

SEQ ID NO: 9466461 - DNA, 22 bp, Homo sapiens
tcagccaggccaggcattcaca

SEQ ID NO: 9466462 - DNA, 22 bp, Homo sapiens
tcagccaggccctaagagattg

SEQ ID NO: 9466463 - DNA, 22 bp, Homo sapiens
tcagccagtgccttgatcttgc

SEQ ID NO: 9466464 - DNA, 22 bp, Homo sapiens
tcagccagtgccttgatcttgc

SEQ ID NO: 9466465 - DNA, 22 bp, Homo sapiens
tcagccaggtaatgtggagatg

SEQ ID NO: 9466466 - DNA, 22 bp, Homo sapiens
tcagccagtatttgagtgctca

SEQ ID NO: 9466467 - DNA, 22 bp, Homo sapiens
tcagccagtatttgagtgctca

SEQ ID NO: 9466468 - DNA, 22 bp, Homo sapiens
tcagccagtatttgagtgctca

SEQ ID NO: 9466469 - DNA, 22 bp, Homo sapiens
tcagccagggggagagaatgga

SEQ ID NO: 9466470 - DNA, 22 bp, Homo sapiens
tcagccagggctctggcctcag

SEQ ID NO: 9466471 - DNA, 22 bp, Homo sapiens
tcagagtccatggtacttaatt

SEQ ID NO: 9466472 - DNA, 22 bp, Homo sapiens
tcagagtgaggcgtcaacatga

SEQ ID NO: 9466473 - DNA, 22 bp, Homo sapiens
tcagagtgaccttacatggtct

SEQ ID NO: 9466474 - DNA, 22 bp, Homo sapiens
tcagagtcttaactattcagag

SEQ ID NO: 9466475 - DNA, 22 bp, Homo sapiens
tcagagtcttggcaataggtta

SEQ ID NO: 9466476 - DNA, 22 bp, Homo sapiens
tcagaggttcttctcagtggcc

SEQ ID NO: 9466477 - DNA, 22 bp, Homo sapiens
tcagagtatttcattcttaggt

SEQ ID NO: 9466478 - DNA, 23 bp, Homo sapiens
tcagagtagcaatttttctctcc

SEQ ID NO: 9466479 - DNA, 22 bp, Homo sapiens
tcagagtcaggaatgcttgatt

SEQ ID NO: 9466480 - DNA, 22 bp, Homo sapiens
tcagagtcattgcaagtagaag

SEQ ID NO: 9466481 - DNA, 22 bp, Homo sapiens
tcagagggcttatgatatattg

SEQ ID NO: 9466482 - DNA, 21 bp, Homo sapiens
tcagagggccctggaggctca

SEQ ID NO: 9466483 - DNA, 21 bp, Homo sapiens
tcagagggccctggaggctca

SEQ ID NO: 9466484 - DNA, 21 bp, Homo sapiens
tcagagggccctggaggctca

SEQ ID NO: 9466485 - DNA, 17 bp, Homo sapiens
tcagagggatgagcagg

SEQ ID NO: 9466486 - DNA, 22 bp, Homo sapiens
tcagaggcttgaagcccaagcc

SEQ ID NO: 9466487 - DNA, 22 bp, Homo sapiens
tcagaggcttgaagcccaagcc

SEQ ID NO: 9466488 - DNA, 20 bp, Homo sapiens
tcagaggctgccagctgggg

SEQ ID NO: 9466489 - DNA, 21 bp, Homo sapiens
tcagaggctgggggaatgccc

SEQ ID NO: 9466490 - DNA, 22 bp, Homo sapiens
tcagaggcttctgctcacctca

SEQ ID NO: 9466491 - DNA, 22 bp, Homo sapiens
tcagaggcttctggccagtctg

SEQ ID NO: 9466492 - DNA, 22 bp, Homo sapiens
tcagaggcttctggccagtctg

SEQ ID NO: 9466493 - DNA, 22 bp, Homo sapiens
tcagaggcttctggccagtctg

SEQ ID NO: 9466494 - DNA, 22 bp, Homo sapiens
tcagaggcttccttcctcggag

SEQ ID NO: 9466495 - DNA, 22 bp, Homo sapiens
tcagaggtggcaggggtgtcca

SEQ ID NO: 9466496 - DNA, 22 bp, Homo sapiens
tcagaggtgagcatgtgaccaa

SEQ ID NO: 9466497 - DNA, 22 bp, Homo sapiens
tcagaggtcacacagcaagttt

SEQ ID NO: 9466498 - DNA, 22 bp, Homo sapiens
tcagagggtggctgggagcatc

SEQ ID NO: 9466499 - DNA, 22 bp, Homo sapiens
tcagaggtaagggctgagagga

SEQ ID NO: 9466500 - DNA, 22 bp, Homo sapiens
tcagcttgggggtggcttctca

SEQ ID NO: 9466501 - DNA, 22 bp, Homo sapiens
tcagcttggacagcttggttga

SEQ ID NO: 9466502 - DNA, 22 bp, Homo sapiens
tcagcttggacagcttggttga

SEQ ID NO: 9466503 - DNA, 22 bp, Homo sapiens
tcagctttcctgcagctaaggg

SEQ ID NO: 9466504 - DNA, 22 bp, Homo sapiens
tcagctttccttgctttagatt

SEQ ID NO: 9466505 - DNA, 22 bp, Homo sapiens
tcagctttctatgttgctaaac

SEQ ID NO: 9466506 - DNA, 22 bp, Homo sapiens
tcagcttccctatctgaccata

SEQ ID NO: 9466507 - DNA, 22 bp, Homo sapiens
tcagcttgcgttctgggattta

SEQ ID NO: 9466508 - DNA, 22 bp, Homo sapiens
tcagcttgatccatccaactat

SEQ ID NO: 9466509 - DNA, 23 bp, Homo sapiens
tcagcctcttaggacttctcacc

SEQ ID NO: 9466510 - DNA, 23 bp, Homo sapiens
tcagcctcttaggacttctcacc

SEQ ID NO: 9466511 - DNA, 22 bp, Homo sapiens
tcagctgtaggtatggatgtcc

SEQ ID NO: 9466512 - DNA, 22 bp, Homo sapiens
tcagctgtaggtatggatgtcc

SEQ ID NO: 9466513 - DNA, 22 bp, Homo sapiens
tcagctgtaggtatggatgtcc

SEQ ID NO: 9466514 - DNA, 22 bp, Homo sapiens
tcagctgtccgcagcccacttc

SEQ ID NO: 9466515 - DNA, 22 bp, Homo sapiens
tcagctgtgatccatctatcta

SEQ ID NO: 9466516 - DNA, 22 bp, Homo sapiens
tcagctgtatcttgctgcactt

SEQ ID NO: 9466517 - DNA, 22 bp, Homo sapiens
tcagctgtatcagaaatacaat

SEQ ID NO: 9466518 - DNA, 22 bp, Homo sapiens
tcagctgtatcagaaatacaat

SEQ ID NO: 9466519 - DNA, 23 bp, Homo sapiens
tcagctgttcttttccctgggac

SEQ ID NO: 9466520 - DNA, 22 bp, Homo sapiens
tcagctgttttgagtttaattg

SEQ ID NO: 9466521 - DNA, 22 bp, Homo sapiens
tcagcttatatttttagtgtaa

SEQ ID NO: 9466522 - DNA, 22 bp, Homo sapiens
tcagctgttatcactgtctgtc

SEQ ID NO: 9466523 - DNA, 22 bp, Homo sapiens
tcagctgtgtatcccagggcct

SEQ ID NO: 9466524 - DNA, 22 bp, Homo sapiens
tcagctgtgtatcccagggcct

SEQ ID NO: 9466525 - DNA, 22 bp, Homo sapiens
tcagcctcctaatttcctgtga

SEQ ID NO: 9466526 - DNA, 22 bp, Homo sapiens
tcagcctccgaaagtgctggga

SEQ ID NO: 9466527 - DNA, 22 bp, Homo sapiens
tcagcctcattttctgctctgt

SEQ ID NO: 9466528 - DNA, 22 bp, Homo sapiens
tcagcctccgaaagtgctggga

SEQ ID NO: 9466529 - DNA, 22 bp, Homo sapiens
tcagcccagcccagcaagtgca

SEQ ID NO: 9466530 - DNA, 22 bp, Homo sapiens
tcagcccagaccacctcattgc

SEQ ID NO: 9466531 - DNA, 18 bp, Homo sapiens
tcagcccagagcccagtt

SEQ ID NO: 9466532 - DNA, 22 bp, Homo sapiens
tcagcccttcctggagctttta

SEQ ID NO: 9466533 - DNA, 22 bp, Homo sapiens
tcagcccttgatgtttgggggt

SEQ ID NO: 9466534 - DNA, 22 bp, Homo sapiens
tcagcccttcctggagctttta

SEQ ID NO: 9466535 - DNA, 22 bp, Homo sapiens
tcagcctcattttctgctctgt

SEQ ID NO: 9466536 - DNA, 22 bp, Homo sapiens
tcagcctcattttctgctctgt

SEQ ID NO: 9466537 - DNA, 22 bp, Homo sapiens
tcagccagtttgtttattccgg

SEQ ID NO: 9466538 - DNA, 22 bp, Homo sapiens
tcagccagtgtgcacctggagt

SEQ ID NO: 9466539 - DNA, 22 bp, Homo sapiens
tcagccagttaaggcttagaca

SEQ ID NO: 9466540 - DNA, 20 bp, Homo sapiens
tcagccattccttacctttc

SEQ ID NO: 9466541 - DNA, 20 bp, Homo sapiens
tcagccattccttacctttc

SEQ ID NO: 9466542 - DNA, 20 bp, Homo sapiens
tcagccattccttacctttc

SEQ ID NO: 9466543 - DNA, 22 bp, Homo sapiens
tcagcccaccttcaggggagtt

SEQ ID NO: 9466544 - DNA, 22 bp, Homo sapiens
tcagcccagaccacctcattgc

SEQ ID NO: 9466545 - DNA, 22 bp, Homo sapiens
tcagcccaaccctgcacaagga

SEQ ID NO: 9466546 - DNA, 22 bp, Homo sapiens
tcagcccacctggtgtggggct

SEQ ID NO: 9466547 - DNA, 22 bp, Homo sapiens
tcaggcaggaagggaggacttg

SEQ ID NO: 9466548 - DNA, 22 bp, Homo sapiens
tcaggcaggaagggaggacttg

SEQ ID NO: 9466549 - DNA, 22 bp, Homo sapiens
tcaggcaggaagggaggacttg

SEQ ID NO: 9466550 - DNA, 22 bp, Homo sapiens
tcaggcaggacaattatttagg

SEQ ID NO: 9466551 - DNA, 22 bp, Homo sapiens
tcaggcaggatcccagggaagg

SEQ ID NO: 9466552 - DNA, 22 bp, Homo sapiens
tcaggcaggcagagggcaaatg

SEQ ID NO: 9466553 - DNA, 21 bp, Homo sapiens
tcaggcaggcgcagagggaag

SEQ ID NO: 9466554 - DNA, 21 bp, Homo sapiens
tcaggcaggcgcagagggaag

SEQ ID NO: 9466555 - DNA, 21 bp, Homo sapiens
tcaggcaggcgcagagggaag

SEQ ID NO: 9466556 - DNA, 22 bp, Homo sapiens
tcaggcaggttggctgcaggtc

SEQ ID NO: 9466557 - DNA, 22 bp, Homo sapiens
tcaggcaggttggctgcaggtc

SEQ ID NO: 9466558 - DNA, 22 bp, Homo sapiens
tcaggcaggtggctggctatgg

SEQ ID NO: 9466559 - DNA, 22 bp, Homo sapiens
tcaggccttgtcctgacctcct

SEQ ID NO: 9466560 - DNA, 22 bp, Homo sapiens
tcaggcagtagaattgcttgaa

SEQ ID NO: 9466561 - DNA, 22 bp, Homo sapiens
tcaggcctttcttcagagcttc

SEQ ID NO: 9466562 - DNA, 22 bp, Homo sapiens
tcaggcaggctcagaggaaaac

SEQ ID NO: 9466563 - DNA, 22 bp, Homo sapiens
tcaggcaggctcagaggaaaac

SEQ ID NO: 9466564 - DNA, 22 bp, Homo sapiens
tcaggcaggctcagaggaaaac

SEQ ID NO: 9466565 - DNA, 22 bp, Homo sapiens
tcaggcaatctgacagctggag

SEQ ID NO: 9466566 - DNA, 19 bp, Homo sapiens
tcaggaggtcgacctggca

SEQ ID NO: 9466567 - DNA, 22 bp, Homo sapiens
tcaggaggtccgcccgggaggg

SEQ ID NO: 9466568 - DNA, 22 bp, Homo sapiens
tcaggaggtccgcccgggaggg

SEQ ID NO: 9466569 - DNA, 22 bp, Homo sapiens
tcaggcagagttaatttgctcc

SEQ ID NO: 9466570 - DNA, 22 bp, Homo sapiens
tcaggcagatgcagggatggat

SEQ ID NO: 9466571 - DNA, 22 bp, Homo sapiens
tcaggcactgctttctgatatg

SEQ ID NO: 9466572 - DNA, 22 bp, Homo sapiens
tcaggcagctccaggaatggta

SEQ ID NO: 9466573 - DNA, 22 bp, Homo sapiens
tcaggcaggaagcccctgcaca

SEQ ID NO: 9466574 - DNA, 22 bp, Homo sapiens
tcaggcagctccaggaatggta

SEQ ID NO: 9466575 - DNA, 22 bp, Homo sapiens
tcaggagatgtaaccttagctg

SEQ ID NO: 9466576 - DNA, 22 bp, Homo sapiens
tcaggagatgtaaccttagctg

SEQ ID NO: 9466577 - DNA, 22 bp, Homo sapiens
tcaggagatggtctttataggc

SEQ ID NO: 9466578 - DNA, 22 bp, Homo sapiens
tcaggagagtgttcagtggagg

SEQ ID NO: 9466579 - DNA, 22 bp, Homo sapiens
tcaggagatggtctttataggc

SEQ ID NO: 9466580 - DNA, 22 bp, Homo sapiens
tcaggagcagcatgggtgagag

SEQ ID NO: 9466581 - DNA, 22 bp, Homo sapiens
tcaggagagtgttcagtggagg

SEQ ID NO: 9466582 - DNA, 22 bp, Homo sapiens
tcaggaaatggtgatttggttg

SEQ ID NO: 9466583 - DNA, 22 bp, Homo sapiens
tcaggaaattaaacacttgaaa

SEQ ID NO: 9466584 - DNA, 22 bp, Homo sapiens
tcaggaaatgtcccaggttgtg

SEQ ID NO: 9466585 - DNA, 22 bp, Homo sapiens
tcaggaaatggacatctttgct

SEQ ID NO: 9466586 - DNA, 22 bp, Homo sapiens
tcaggaaatggcttcatggttt

SEQ ID NO: 9466587 - DNA, 22 bp, Homo sapiens
tcaggaaatggtgatttggttg

SEQ ID NO: 9466588 - DNA, 22 bp, Homo sapiens
tcaggaaatggaattcttgtgt

SEQ ID NO: 9466589 - DNA, 22 bp, Homo sapiens
tcaggaaatggacatctttgct

SEQ ID NO: 9466590 - DNA, 22 bp, Homo sapiens
tcaggaaatggacatctttgct

SEQ ID NO: 9466591 - DNA, 22 bp, Homo sapiens
tcaggaaatggacatctttgct

SEQ ID NO: 9466592 - DNA, 22 bp, Homo sapiens
tcaggaaagcctagaagagaac

SEQ ID NO: 9466593 - DNA, 22 bp, Homo sapiens
tcaggaaagcctagaagagaac

SEQ ID NO: 9466594 - DNA, 22 bp, Homo sapiens
tcaggaaaggcagagtgtctgt

SEQ ID NO: 9466595 - DNA, 22 bp, Homo sapiens
tcaggaaaggtttgttgaatgg

SEQ ID NO: 9466596 - DNA, 22 bp, Homo sapiens
tcaggaaaggcagagtgtctgt

SEQ ID NO: 9466597 - DNA, 22 bp, Homo sapiens
tcaggaaaggcagagtgtctgt

SEQ ID NO: 9466598 - DNA, 22 bp, Homo sapiens
tcaggaaagtgttctcagagga

SEQ ID NO: 9466599 - DNA, 22 bp, Homo sapiens
tcaggaaagtgttctcagagga

SEQ ID NO: 9466600 - DNA, 22 bp, Homo sapiens
tcaggaaaggtttgttgaatgg

SEQ ID NO: 9466601 - DNA, 22 bp, Homo sapiens
tcaggaaatggaattcttgtgt

SEQ ID NO: 9466602 - DNA, 22 bp, Homo sapiens
tcaggaaatggaattcttgtgt

SEQ ID NO: 9466603 - DNA, 22 bp, Homo sapiens
tcaggaaatacaagtgacatca

SEQ ID NO: 9466604 - DNA, 22 bp, Homo sapiens
tcaggaaagagtaatgtataca

SEQ ID NO: 9466605 - DNA, 22 bp, Homo sapiens
tcaggaaagagttagatgatta

SEQ ID NO: 9466606 - DNA, 22 bp, Homo sapiens
tcaggaaagagtgtatccatca

SEQ ID NO: 9466607 - DNA, 22 bp, Homo sapiens
tcaggaaagagttagatgatta

SEQ ID NO: 9466608 - DNA, 22 bp, Homo sapiens
tcaggaaagagttagatgatta

SEQ ID NO: 9466609 - DNA, 22 bp, Homo sapiens
tcaggaaagagttagatgatta

SEQ ID NO: 9466610 - DNA, 22 bp, Homo sapiens
tcaggagcttggtagtgtgatt

SEQ ID NO: 9466611 - DNA, 22 bp, Homo sapiens
tcaggagcttggtagtgtgatt

SEQ ID NO: 9466612 - DNA, 22 bp, Homo sapiens
tcaggagcttggtagtgtgatt

SEQ ID NO: 9466613 - DNA, 22 bp, Homo sapiens
tcaggaggatgtcggcaaattt

SEQ ID NO: 9466614 - DNA, 22 bp, Homo sapiens
tcaggagggagtgtggatagag

SEQ ID NO: 9466615 - DNA, 22 bp, Homo sapiens
tcaggagggagtgtggatagag

SEQ ID NO: 9466616 - DNA, 22 bp, Homo sapiens
tcaggagggtgacaggccctgg

SEQ ID NO: 9466617 - DNA, 22 bp, Homo sapiens
tcaggagggtgacaggccctgg

SEQ ID NO: 9466618 - DNA, 22 bp, Homo sapiens
tcaggagcctgaaagaggtcta

SEQ ID NO: 9466619 - DNA, 22 bp, Homo sapiens
tcaggagcctgaaagaggtcta

SEQ ID NO: 9466620 - DNA, 20 bp, Homo sapiens
tcaggagcctaggacatgat

SEQ ID NO: 9466621 - DNA, 20 bp, Homo sapiens
tcaggagcctaggacatgat

SEQ ID NO: 9466622 - DNA, 22 bp, Homo sapiens
tcaggagcaggttgtttggttt

SEQ ID NO: 9466623 - DNA, 22 bp, Homo sapiens
tcaggagcagggtctgttacca

SEQ ID NO: 9466624 - DNA, 22 bp, Homo sapiens
tcaggagcttagatgctttgac

SEQ ID NO: 9466625 - DNA, 22 bp, Homo sapiens
tcaggagctgtgaatacaaagg

SEQ ID NO: 9466626 - DNA, 22 bp, Homo sapiens
tcaggagctcttccctggtgtg

SEQ ID NO: 9466627 - DNA, 22 bp, Homo sapiens
tcaggagctcttccctggtgtg

SEQ ID NO: 9466628 - DNA, 22 bp, Homo sapiens
tcaggagctcaggctgatggaa

SEQ ID NO: 9466629 - DNA, 22 bp, Homo sapiens
tcagaggattgcctcagcgagc

SEQ ID NO: 9466630 - DNA, 18 bp, Homo sapiens
tcagaggagatacctaaa

SEQ ID NO: 9466631 - DNA, 22 bp, Homo sapiens
tcagaggactaccttctccagt

SEQ ID NO: 9466632 - DNA, 22 bp, Homo sapiens
tcagaggactaccttctccagt

SEQ ID NO: 9466633 - DNA, 22 bp, Homo sapiens
tcagaggagaccaaggggaata

SEQ ID NO: 9466634 - DNA, 22 bp, Homo sapiens
tcagaggagaagttgggaaaat

SEQ ID NO: 9466635 - DNA, 22 bp, Homo sapiens
tcagaggagaagttgggaaaat

SEQ ID NO: 9466636 - DNA, 22 bp, Homo sapiens
tcagaggcctgaaagaatttgg

SEQ ID NO: 9466637 - DNA, 22 bp, Homo sapiens
tcagaggctacagtctgggagt

SEQ ID NO: 9466638 - DNA, 22 bp, Homo sapiens
tcagaggctacagtctgggagt

SEQ ID NO: 9466639 - DNA, 22 bp, Homo sapiens
tcagaggccaaactgagcaggg

SEQ ID NO: 9466640 - DNA, 22 bp, Homo sapiens
tcagaggccaaactgagcaggg

SEQ ID NO: 9466641 - DNA, 22 bp, Homo sapiens
tcagaggcatcattcatagtta

SEQ ID NO: 9466642 - DNA, 21 bp, Homo sapiens
tcagaggcactgagagcaatg

SEQ ID NO: 9466643 - DNA, 21 bp, Homo sapiens
tcagaggcactgagagcaatg

SEQ ID NO: 9466644 - DNA, 21 bp, Homo sapiens
tcagaggcactgagagcaatg

SEQ ID NO: 9466645 - DNA, 18 bp, Homo sapiens
tcagagagaatagtaatt

SEQ ID NO: 9466646 - DNA, 22 bp, Homo sapiens
tcagagacatcaggttgtagca

SEQ ID NO: 9466647 - DNA, 20 bp, Homo sapiens
tcagagagagggtgccactt

SEQ ID NO: 9466648 - DNA, 22 bp, Homo sapiens
tcagagagcctcaggcactgcc

SEQ ID NO: 9466649 - DNA, 22 bp, Homo sapiens
tcagagagcctcaggcactgcc

SEQ ID NO: 9466650 - DNA, 22 bp, Homo sapiens
tcagagagctggtgggcagagg

SEQ ID NO: 9466651 - DNA, 22 bp, Homo sapiens
tcagagagcctcaggcactgcc

SEQ ID NO: 9466652 - DNA, 23 bp, Homo sapiens
tcagagagctgttgagagctgcc

SEQ ID NO: 9466653 - DNA, 22 bp, Homo sapiens
tcagagaggattttaataagtg

SEQ ID NO: 9466654 - DNA, 22 bp, Homo sapiens
tcagaggaccttactgagaacc

SEQ ID NO: 9466655 - DNA, 22 bp, Homo sapiens
tcagaggaccttactgagaacc

SEQ ID NO: 9466656 - DNA, 22 bp, Homo sapiens
tcagaggacaagctccctggtg

SEQ ID NO: 9466657 - DNA, 22 bp, Homo sapiens
tcagaggaatctgtacttgaaa

SEQ ID NO: 9466658 - DNA, 22 bp, Homo sapiens
tcagaggacagcagctaaataa

SEQ ID NO: 9466659 - DNA, 22 bp, Homo sapiens
tcagaagcagaaaataggtggg

SEQ ID NO: 9466660 - DNA, 22 bp, Homo sapiens
tcagaagcagaaaataggtggg

SEQ ID NO: 9466661 - DNA, 22 bp, Homo sapiens
tcagaagcaagcttctacttct

SEQ ID NO: 9466662 - DNA, 22 bp, Homo sapiens
tcagaagcaagcttctacttct

SEQ ID NO: 9466663 - DNA, 22 bp, Homo sapiens
tcagaagcaaacatcactctag

SEQ ID NO: 9466664 - DNA, 22 bp, Homo sapiens
tcagaagcaaacatcactctag

SEQ ID NO: 9466665 - DNA, 22 bp, Homo sapiens
tcagaagagtaatagggtgaga

SEQ ID NO: 9466666 - DNA, 21 bp, Homo sapiens
tcagaagagctgcctcttggt

SEQ ID NO: 9466667 - DNA, 22 bp, Homo sapiens
tcagaactgctgctcctgcaaa

SEQ ID NO: 9466668 - DNA, 19 bp, Homo sapiens
tcagaactcagaatgtgta

SEQ ID NO: 9466669 - DNA, 22 bp, Homo sapiens
tcagaagaaagatgttattact

SEQ ID NO: 9466670 - DNA, 22 bp, Homo sapiens
tcagaagactactaggacacat

SEQ ID NO: 9466671 - DNA, 22 bp, Homo sapiens
tcagaacatcctggtttaaaat

SEQ ID NO: 9466672 - DNA, 22 bp, Homo sapiens
tcagaacatgaaggttaatttg

SEQ ID NO: 9466673 - DNA, 22 bp, Homo sapiens
tcagaacatgtttgagtaagac

SEQ ID NO: 9466674 - DNA, 22 bp, Homo sapiens
tcagaacatggcatgttccatc

SEQ ID NO: 9466675 - DNA, 22 bp, Homo sapiens
tcagaacattctcattgactgc

SEQ ID NO: 9466676 - DNA, 22 bp, Homo sapiens
tcagaacattacattttgagct

SEQ ID NO: 9466677 - DNA, 22 bp, Homo sapiens
tcagaacattaaggatttgaag

SEQ ID NO: 9466678 - DNA, 22 bp, Homo sapiens
tcagaacattaaggatttgaag

SEQ ID NO: 9466679 - DNA, 22 bp, Homo sapiens
tcagaacattgacattcttatt

SEQ ID NO: 9466680 - DNA, 22 bp, Homo sapiens
tcagaacattctcattgactgc

SEQ ID NO: 9466681 - DNA, 22 bp, Homo sapiens
tcagaacattgacattcttatt

SEQ ID NO: 9466682 - DNA, 22 bp, Homo sapiens
tcagaacattgacattcttatt

SEQ ID NO: 9466683 - DNA, 22 bp, Homo sapiens
tcagaacatttgggactttggg

SEQ ID NO: 9466684 - DNA, 22 bp, Homo sapiens
tcagaacatttgggactttggg

SEQ ID NO: 9466685 - DNA, 22 bp, Homo sapiens
tcagagaagtaggctaatggtg

SEQ ID NO: 9466686 - DNA, 23 bp, Homo sapiens
tcagagaagttgtaggctgggga

SEQ ID NO: 9466687 - DNA, 23 bp, Homo sapiens
tcagagaagttgtaggctgggga

SEQ ID NO: 9466688 - DNA, 22 bp, Homo sapiens
tcagagaaggtaagtgacctgc

SEQ ID NO: 9466689 - DNA, 22 bp, Homo sapiens
tcagagaaggtaagtgacctgc

SEQ ID NO: 9466690 - DNA, 22 bp, Homo sapiens
tcagagaaggtaagtgacctgc

SEQ ID NO: 9466691 - DNA, 22 bp, Homo sapiens
tcagagaagtaaggtggggtgc

SEQ ID NO: 9466692 - DNA, 22 bp, Homo sapiens
tcagaagcatccatttcaccac

SEQ ID NO: 9466693 - DNA, 22 bp, Homo sapiens
tcagaagcaggagtgtgcacaa

SEQ ID NO: 9466694 - DNA, 22 bp, Homo sapiens
tcagaagcagatatttcaaaat

SEQ ID NO: 9466695 - DNA, 22 bp, Homo sapiens
tcagaagcagatatttcaaaat

SEQ ID NO: 9466696 - DNA, 20 bp, Homo sapiens
tcagagaagggactgagatt

SEQ ID NO: 9466697 - DNA, 20 bp, Homo sapiens
tcagagaagggactgagatt

SEQ ID NO: 9466698 - DNA, 22 bp, Homo sapiens
tcagagaatctctccttagttt

SEQ ID NO: 9466699 - DNA, 22 bp, Homo sapiens
tcagagaatctctccttagttt

SEQ ID NO: 9466700 - DNA, 22 bp, Homo sapiens
tcagagaatccgtaagtcacaa

SEQ ID NO: 9466701 - DNA, 22 bp, Homo sapiens
tcagagaatccgtaagtcacaa

SEQ ID NO: 9466702 - DNA, 23 bp, Homo sapiens
tcagagaatggtatgcttttcct

SEQ ID NO: 9466703 - DNA, 21 bp, Homo sapiens
tcagagaatggcctactctca

SEQ ID NO: 9466704 - DNA, 22 bp, Homo sapiens
tcagagaatgtccttcttcatt

SEQ ID NO: 9466705 - DNA, 23 bp, Homo sapiens
tcagagaatggtatgcttttcct

SEQ ID NO: 9466706 - DNA, 22 bp, Homo sapiens
tcagagaatgtgaatattaaac

SEQ ID NO: 9466707 - DNA, 22 bp, Homo sapiens
tcagagaattctcagatgactc

SEQ ID NO: 9466708 - DNA, 22 bp, Homo sapiens
tcagagaattcgattaaatgca

SEQ ID NO: 9466709 - DNA, 22 bp, Homo sapiens
tcagagaattctcagatgactc

SEQ ID NO: 9466710 - DNA, 22 bp, Homo sapiens
tcagagaattgtttaatggaat

SEQ ID NO: 9466711 - DNA, 22 bp, Homo sapiens
tcacatctgcctccatagcacc

SEQ ID NO: 9466712 - DNA, 22 bp, Homo sapiens
tcacatctgtgtgattgtcatt

SEQ ID NO: 9466713 - DNA, 22 bp, Homo sapiens
tcacatcttagtttgggactct

SEQ ID NO: 9466714 - DNA, 22 bp, Homo sapiens
tcacatgaagatccctcaattt

SEQ ID NO: 9466715 - DNA, 18 bp, Homo sapiens
tcacatgacagctgttgc

SEQ ID NO: 9466716 - DNA, 22 bp, Homo sapiens
tcacatgaggttatgacaaagc

SEQ ID NO: 9466717 - DNA, 22 bp, Homo sapiens
tcacatgccctacctaatctta

SEQ ID NO: 9466718 - DNA, 22 bp, Homo sapiens
tcacatgccctacctaatctta

SEQ ID NO: 9466719 - DNA, 22 bp, Homo sapiens
tcacatgcacatacttcctgtg

SEQ ID NO: 9466720 - DNA, 22 bp, Homo sapiens
tcacccagggactgtgatggaa

SEQ ID NO: 9466721 - DNA, 22 bp, Homo sapiens
tcacccagggactgtgatggaa

SEQ ID NO: 9466722 - DNA, 22 bp, Homo sapiens
tcacccaggctggtgcgcagtg

SEQ ID NO: 9466723 - DNA, 22 bp, Homo sapiens
tcacatgccttttactctgcac

SEQ ID NO: 9466724 - DNA, 22 bp, Homo sapiens
tcacccaggtaatagcagtttg

SEQ ID NO: 9466725 - DNA, 22 bp, Homo sapiens
tcacccaggtccaggctctggc

SEQ ID NO: 9466726 - DNA, 22 bp, Homo sapiens
tcacccaggtccaggctctggc

SEQ ID NO: 9466727 - DNA, 22 bp, Homo sapiens
tcacccagggtgtttggtgtct

SEQ ID NO: 9466728 - DNA, 22 bp, Homo sapiens
tcacccagggtgtttggtgtct

SEQ ID NO: 9466729 - DNA, 22 bp, Homo sapiens
tcacccaggtaatagcagtttg

SEQ ID NO: 9466730 - DNA, 22 bp, Homo sapiens
tcacccttagtgtactatcatg

SEQ ID NO: 9466731 - DNA, 22 bp, Homo sapiens
tcacccttgataatgttcttct

SEQ ID NO: 9466732 - DNA, 22 bp, Homo sapiens
tcaccgaggctggagtgcagtg

SEQ ID NO: 9466733 - DNA, 17 bp, Homo sapiens
tcaccgtttggctttcc

SEQ ID NO: 9466734 - DNA, 22 bp, Homo sapiens
tcaccccaaagttgagtttgat

SEQ ID NO: 9466735 - DNA, 22 bp, Homo sapiens
tcacccaggtccaggctctggc

SEQ ID NO: 9466736 - DNA, 22 bp, Homo sapiens
tcacccctacatttcccttgct

SEQ ID NO: 9466737 - DNA, 22 bp, Homo sapiens
tcacccctacatttcccttgct

SEQ ID NO: 9466738 - DNA, 22 bp, Homo sapiens
tcaccccctgtattagtagcta

SEQ ID NO: 9466739 - DNA, 22 bp, Homo sapiens
tcacccctacatttcccttgct

SEQ ID NO: 9466740 - DNA, 22 bp, Homo sapiens
tcacccctaccaaggagcactg

SEQ ID NO: 9466741 - DNA, 22 bp, Homo sapiens
tcacccctaccaaggagcactg

SEQ ID NO: 9466742 - DNA, 22 bp, Homo sapiens
tcacccctaccaaggagcactg

SEQ ID NO: 9466743 - DNA, 22 bp, Homo sapiens
tcacccctccattctctcatgt

SEQ ID NO: 9466744 - DNA, 22 bp, Homo sapiens
tcaccccttgtgaatgctgctc

SEQ ID NO: 9466745 - DNA, 22 bp, Homo sapiens
tcacccctggcccagtcttgga

SEQ ID NO: 9466746 - DNA, 21 bp, Homo sapiens
tcacgtggtcacatgagcttt

SEQ ID NO: 9466747 - DNA, 22 bp, Homo sapiens
tcacgtgagggacctgtgtctg

SEQ ID NO: 9466748 - DNA, 22 bp, Homo sapiens
tcaccttgtgatctccctgcct

SEQ ID NO: 9466749 - DNA, 22 bp, Homo sapiens
tcacctgttggatgtatactgt

SEQ ID NO: 9466750 - DNA, 22 bp, Homo sapiens
tcacctgttcaacagcaataat

SEQ ID NO: 9466751 - DNA, 22 bp, Homo sapiens
tcacctgggagggctgtggtag

SEQ ID NO: 9466752 - DNA, 22 bp, Homo sapiens
tcacctgggagggctgtggtag

SEQ ID NO: 9466753 - DNA, 22 bp, Homo sapiens
tcacctaattgaagtcaggagt

SEQ ID NO: 9466754 - DNA, 22 bp, Homo sapiens
tcacctctctggccgtctacct

SEQ ID NO: 9466755 - DNA, 21 bp, Homo sapiens
tcacctggcttctgacctggc

SEQ ID NO: 9466756 - DNA, 22 bp, Homo sapiens
tcactgtgattctgtatggatt

SEQ ID NO: 9466757 - DNA, 22 bp, Homo sapiens
tcactgtgaatgttatcatctt

SEQ ID NO: 9466758 - DNA, 22 bp, Homo sapiens
tcactgtgaatgttatcatctt

SEQ ID NO: 9466759 - DNA, 22 bp, Homo sapiens
tcactgtatttgctgatgcata

SEQ ID NO: 9466760 - DNA, 22 bp, Homo sapiens
tcactgtatttggaagggatgg

SEQ ID NO: 9466761 - DNA, 22 bp, Homo sapiens
tcactgtccctgtcctcttatc

SEQ ID NO: 9466762 - DNA, 22 bp, Homo sapiens
tcagaacagttcttaatattgc

SEQ ID NO: 9466763 - DNA, 23 bp, Homo sapiens
tcagaacagttcttggtgcatag

SEQ ID NO: 9466764 - DNA, 22 bp, Homo sapiens
tcagaacagtgcctggcactaa

SEQ ID NO: 9466765 - DNA, 22 bp, Homo sapiens
tcagaacagttcttaatattgc

SEQ ID NO: 9466766 - DNA, 22 bp, Homo sapiens
tcagaacatcctggtttaaaat

SEQ ID NO: 9466767 - DNA, 22 bp, Homo sapiens
tcagaacatcccagatagtaga

SEQ ID NO: 9466768 - DNA, 22 bp, Homo sapiens
tcagaacatatattttgtgatg

SEQ ID NO: 9466769 - DNA, 22 bp, Homo sapiens
tcactgggtaggacatgctgat

SEQ ID NO: 9466770 - DNA, 22 bp, Homo sapiens
tcactgggtaggacatgctgat

SEQ ID NO: 9466771 - DNA, 22 bp, Homo sapiens
tcactgggtaggacatgctgat

SEQ ID NO: 9466772 - DNA, 22 bp, Homo sapiens
tcactgggtaggacatgctgat

SEQ ID NO: 9466773 - DNA, 18 bp, Homo sapiens
tcactgggtgtatgtggc

SEQ ID NO: 9466774 - DNA, 22 bp, Homo sapiens
tcactggggcctttggtcagga

SEQ ID NO: 9466775 - DNA, 22 bp, Homo sapiens
tcactggggcctttggtcagga

SEQ ID NO: 9466776 - DNA, 22 bp, Homo sapiens
tcactggggcctttggtcagga

SEQ ID NO: 9466777 - DNA, 22 bp, Homo sapiens
tcactggggcccacatcaacat

SEQ ID NO: 9466778 - DNA, 22 bp, Homo sapiens
tcactggggcccacatcaacat

SEQ ID NO: 9466779 - DNA, 22 bp, Homo sapiens
tcactgtagagtctgtttccac

SEQ ID NO: 9466780 - DNA, 22 bp, Homo sapiens
tcactgtagcctcaacctttca

SEQ ID NO: 9466781 - DNA, 22 bp, Homo sapiens
tcactgtaccttccatttcatt

SEQ ID NO: 9466782 - DNA, 22 bp, Homo sapiens
tcactgtagcctcaactcttgg

SEQ ID NO: 9466783 - DNA, 22 bp, Homo sapiens
tcactgtagtgagcagaatata

SEQ ID NO: 9466784 - DNA, 22 bp, Homo sapiens
tcactgtaaactaggtcagtcc

SEQ ID NO: 9466785 - DNA, 20 bp, Homo sapiens
tcactgtaacatttgggggg

SEQ ID NO: 9466786 - DNA, 18 bp, Homo sapiens
tcactgggagaagatatt

SEQ ID NO: 9466787 - DNA, 18 bp, Homo sapiens
tcactgggagaagatatt

SEQ ID NO: 9466788 - DNA, 22 bp, Homo sapiens
tcactgggagagctgacaagga

SEQ ID NO: 9466789 - DNA, 22 bp, Homo sapiens
tcactgggagagctgacaagga

SEQ ID NO: 9466790 - DNA, 22 bp, Homo sapiens
tcactgggagagctgacaagga

SEQ ID NO: 9466791 - DNA, 22 bp, Homo sapiens
tcactgggagagctgacaagga

SEQ ID NO: 9466792 - DNA, 22 bp, Homo sapiens
tcactgggagagctgacaagga

SEQ ID NO: 9466793 - DNA, 22 bp, Homo sapiens
tcactgggagatgtgggaaggg

SEQ ID NO: 9466794 - DNA, 22 bp, Homo sapiens
tcactggcaacttgtgctccct

SEQ ID NO: 9466795 - DNA, 17 bp, Homo sapiens
tcactgggcctgctccc

SEQ ID NO: 9466796 - DNA, 22 bp, Homo sapiens
tcactggggagcactgacatgt

SEQ ID NO: 9466797 - DNA, 22 bp, Homo sapiens
tcactggggagcactgacatgt

SEQ ID NO: 9466798 - DNA, 22 bp, Homo sapiens
tcactggggccatgtgagggac

SEQ ID NO: 9466799 - DNA, 22 bp, Homo sapiens
tcactggggccatgtgagggac

SEQ ID NO: 9466800 - DNA, 22 bp, Homo sapiens
tcactgggcatcggagctgaaa

SEQ ID NO: 9466801 - DNA, 22 bp, Homo sapiens
tcactgggcatcggagctgaaa

SEQ ID NO: 9466802 - DNA, 22 bp, Homo sapiens
tcactgggagatgtgggaaggg

SEQ ID NO: 9466803 - DNA, 22 bp, Homo sapiens
tcactgggccctgaggtgggac

SEQ ID NO: 9466804 - DNA, 22 bp, Homo sapiens
tcactgggccctgaggtgggac

SEQ ID NO: 9466805 - DNA, 22 bp, Homo sapiens
tcactgctttcaaaaattattg

SEQ ID NO: 9466806 - DNA, 22 bp, Homo sapiens
tcactgcttcttggagaatgtc

SEQ ID NO: 9466807 - DNA, 22 bp, Homo sapiens
tcactgcttcttggagaatgtc

SEQ ID NO: 9466808 - DNA, 22 bp, Homo sapiens
tcactggaaatgcacagctgta

SEQ ID NO: 9466809 - DNA, 22 bp, Homo sapiens
tcactgctttgtttacaactat

SEQ ID NO: 9466810 - DNA, 22 bp, Homo sapiens
tcactgctttgagccactgagc

SEQ ID NO: 9466811 - DNA, 22 bp, Homo sapiens
tcactgctttgagccactgagc

SEQ ID NO: 9466812 - DNA, 22 bp, Homo sapiens
tcactgctttgtttacaactat

SEQ ID NO: 9466813 - DNA, 21 bp, Homo sapiens
tcacgtggtcacatgagcttt

SEQ ID NO: 9466814 - DNA, 22 bp, Homo sapiens
tcacgttttactgagtgagata

SEQ ID NO: 9466815 - DNA, 22 bp, Homo sapiens
tcacgttttactgagtgagata

SEQ ID NO: 9466816 - DNA, 22 bp, Homo sapiens
tcactaagtgccgagtttagtt

SEQ ID NO: 9466817 - DNA, 22 bp, Homo sapiens
tcactaatgattttgaaagaag

SEQ ID NO: 9466818 - DNA, 22 bp, Homo sapiens
tcactacaacctccgcctcctg

SEQ ID NO: 9466819 - DNA, 22 bp, Homo sapiens
tcactaatgagctaaggaaaag

SEQ ID NO: 9466820 - DNA, 22 bp, Homo sapiens
tcactaagttacatttagtatt

SEQ ID NO: 9466821 - DNA, 22 bp, Homo sapiens
tcaattattttggctatgctaa

SEQ ID NO: 9466822 - DNA, 22 bp, Homo sapiens
tcaattattttggctatgctaa

SEQ ID NO: 9466823 - DNA, 22 bp, Homo sapiens
tcaattatttgatatgaaaggg

SEQ ID NO: 9466824 - DNA, 22 bp, Homo sapiens
tcaattcaattgaacagttact

SEQ ID NO: 9466825 - DNA, 22 bp, Homo sapiens
tcaattcaattgcatttctgtg

SEQ ID NO: 9466826 - DNA, 22 bp, Homo sapiens
tcaattcagtccaacagtaatt

SEQ ID NO: 9466827 - DNA, 22 bp, Homo sapiens
tcaattctagtggagagagttt

SEQ ID NO: 9466828 - DNA, 22 bp, Homo sapiens
tcaattctgcatacatttcact

SEQ ID NO: 9466829 - DNA, 22 bp, Homo sapiens
tcaattctgcatacatttcact

SEQ ID NO: 9466830 - DNA, 22 bp, Homo sapiens
tcaattatgccattgcaatatt

SEQ ID NO: 9466831 - DNA, 22 bp, Homo sapiens
tcaattagggtctatttctagt

SEQ ID NO: 9466832 - DNA, 22 bp, Homo sapiens
tcaattatgccattgcaatatt

SEQ ID NO: 9466833 - DNA, 22 bp, Homo sapiens
tcaattacagcaatgactgtac

SEQ ID NO: 9466834 - DNA, 22 bp, Homo sapiens
tcaatgtccgggccccattcca

SEQ ID NO: 9466835 - DNA, 22 bp, Homo sapiens
tcaatgtcagctggtaggaaat

SEQ ID NO: 9466836 - DNA, 22 bp, Homo sapiens
tcaatgtctgtctatctattta

SEQ ID NO: 9466837 - DNA, 22 bp, Homo sapiens
tcaatgtctgcggctagctgga

SEQ ID NO: 9466838 - DNA, 22 bp, Homo sapiens
tcaatgtccgggccccattcca

SEQ ID NO: 9466839 - DNA, 22 bp, Homo sapiens
tcaatgtaataaaatactctat

SEQ ID NO: 9466840 - DNA, 19 bp, Homo sapiens
tcaatgcatgaaatcagcc

SEQ ID NO: 9466841 - DNA, 22 bp, Homo sapiens
tcaatgcatgtgacaaagagta

SEQ ID NO: 9466842 - DNA, 22 bp, Homo sapiens
tcaatgttcaagtatgacaatg

SEQ ID NO: 9466843 - DNA, 22 bp, Homo sapiens
tcaatgtctgtctatctattta

SEQ ID NO: 9466844 - DNA, 22 bp, Homo sapiens
tcaatgtttgttcatgaaaata

SEQ ID NO: 9466845 - DNA, 22 bp, Homo sapiens
tcaatgtttgttcatgaaaata

SEQ ID NO: 9466846 - DNA, 22 bp, Homo sapiens
tcacacagctcctttccttagt

SEQ ID NO: 9466847 - DNA, 22 bp, Homo sapiens
tcacacagattggtagagctga

SEQ ID NO: 9466848 - DNA, 23 bp, Homo sapiens
tcacacagctggtcaggtacaga

SEQ ID NO: 9466849 - DNA, 22 bp, Homo sapiens
tcacacagggtcggaaagagtg

SEQ ID NO: 9466850 - DNA, 22 bp, Homo sapiens
tcacacacatttgctgtctgat

SEQ ID NO: 9466851 - DNA, 22 bp, Homo sapiens
tcacacacatttgctgtctgat

SEQ ID NO: 9466852 - DNA, 22 bp, Homo sapiens
tcacacacatggatagtatttt

SEQ ID NO: 9466853 - DNA, 21 bp, Homo sapiens
tcacacacgtttccaagggca

SEQ ID NO: 9466854 - DNA, 21 bp, Homo sapiens
tcacacacgtttccaagggca

SEQ ID NO: 9466855 - DNA, 21 bp, Homo sapiens
tcacacacgtttccaagggca

SEQ ID NO: 9466856 - DNA, 22 bp, Homo sapiens
tcacacacataatctaagatta

SEQ ID NO: 9466857 - DNA, 22 bp, Homo sapiens
tcacacacatggatagtatttt

SEQ ID NO: 9466858 - DNA, 22 bp, Homo sapiens
tcacacacatggatagtatttt

SEQ ID NO: 9466859 - DNA, 22 bp, Homo sapiens
tcacacacataatctaagatta

SEQ ID NO: 9466860 - DNA, 22 bp, Homo sapiens
tcacacacataatctaagatta

SEQ ID NO: 9466861 - DNA, 22 bp, Homo sapiens
tcacaattgagatcctcccacc

SEQ ID NO: 9466862 - DNA, 22 bp, Homo sapiens
tcaaaattctagggagaatggt

SEQ ID NO: 9466863 - DNA, 22 bp, Homo sapiens
tcaaaatttcagcactagccct

SEQ ID NO: 9466864 - DNA, 22 bp, Homo sapiens
tcaaaattttatttctcaagga

SEQ ID NO: 9466865 - DNA, 22 bp, Homo sapiens
tcaaacagaaattgttcatgct

SEQ ID NO: 9466866 - DNA, 22 bp, Homo sapiens
tcaaacagaggaacaattgttt

SEQ ID NO: 9466867 - DNA, 22 bp, Homo sapiens
tcaaaattttatttctcaagga

SEQ ID NO: 9466868 - DNA, 22 bp, Homo sapiens
tcaaacaccatctgaccttatg

SEQ ID NO: 9466869 - DNA, 22 bp, Homo sapiens
tcaaaattttatttctcaagga

SEQ ID NO: 9466870 - DNA, 18 bp, Homo sapiens
tcaaaatatttctgtgga

SEQ ID NO: 9466871 - DNA, 18 bp, Homo sapiens
tcaaaatatttctgtgga

SEQ ID NO: 9466872 - DNA, 18 bp, Homo sapiens
tcaaaatatttctgtgga

SEQ ID NO: 9466873 - DNA, 20 bp, Homo sapiens
tcaaaataggtgtgggcgga

SEQ ID NO: 9466874 - DNA, 20 bp, Homo sapiens
tcaaaataggtgtgggcgga

SEQ ID NO: 9466875 - DNA, 18 bp, Homo sapiens
tcaaaatatttctgtgga

SEQ ID NO: 9466876 - DNA, 18 bp, Homo sapiens
tcaaaatatttctgtgga

SEQ ID NO: 9466877 - DNA, 22 bp, Homo sapiens
tcaaaaatggtctttgagctgc

SEQ ID NO: 9466878 - DNA, 22 bp, Homo sapiens
tcaaaaatggtctttgagctgc

SEQ ID NO: 9466879 - DNA, 22 bp, Homo sapiens
tcaaaaatgttttatattggta

SEQ ID NO: 9466880 - DNA, 22 bp, Homo sapiens
tcaaaagacacaggaggctagt

SEQ ID NO: 9466881 - DNA, 22 bp, Homo sapiens
tcaaaagaaacaccatgttcct

SEQ ID NO: 9466882 - DNA, 22 bp, Homo sapiens
tcaaaagacacaggaggctagt

SEQ ID NO: 9466883 - DNA, 20 bp, Homo sapiens
tcaaaataggtgtgggcgga

SEQ ID NO: 9466884 - DNA, 22 bp, Homo sapiens
tcaaaagtttcacatagagata

SEQ ID NO: 9466885 - DNA, 22 bp, Homo sapiens
tcaaaagtggcctgtaaaatct

SEQ ID NO: 9466886 - DNA, 22 bp, Homo sapiens
tcaaaagtttcacatagagata

SEQ ID NO: 9466887 - DNA, 22 bp, Homo sapiens
tcaaaagtctgcattcttcaca

SEQ ID NO: 9466888 - DNA, 22 bp, Homo sapiens
tcaaaagtctgcattcttcaca

SEQ ID NO: 9466889 - DNA, 22 bp, Homo sapiens
tcaatactcacaaagagatttt

SEQ ID NO: 9466890 - DNA, 22 bp, Homo sapiens
tcaatactcacaaagagatttt

SEQ ID NO: 9466891 - DNA, 22 bp, Homo sapiens
tcaatacatacaatgtatagtg

SEQ ID NO: 9466892 - DNA, 22 bp, Homo sapiens
tcaaacctgctgtcttgttcat

SEQ ID NO: 9466893 - DNA, 22 bp, Homo sapiens
tcaatgcataggaggtggcaga

SEQ ID NO: 9466894 - DNA, 19 bp, Homo sapiens
tcaatgcatgaaatcagcc

SEQ ID NO: 9466895 - DNA, 22 bp, Homo sapiens
tcaatgcatgtgacaaagagta

SEQ ID NO: 9466896 - DNA, 22 bp, Homo sapiens
tcaatgcaacttccacctccca

SEQ ID NO: 9466897 - DNA, 22 bp, Homo sapiens
tcaatgcacacaggacttggtg

SEQ ID NO: 9466898 - DNA, 22 bp, Homo sapiens
tcaatgcaatcattggacaagt

SEQ ID NO: 9466899 - DNA, 22 bp, Homo sapiens
tcaatgcaatcattggacaagt

SEQ ID NO: 9466900 - DNA, 22 bp, Homo sapiens
tcaatgcaacctccacctcccg

SEQ ID NO: 9466901 - DNA, 22 bp, Homo sapiens
tcaatgatgctgaaggtagcgt

SEQ ID NO: 9466902 - DNA, 22 bp, Homo sapiens
tcaatgatatcagcaggatgtg

SEQ ID NO: 9466903 - DNA, 22 bp, Homo sapiens
tcaatgatagtacaatcagcct

SEQ ID NO: 9466904 - DNA, 22 bp, Homo sapiens
tcaatagaaatgcagagtctca

SEQ ID NO: 9466905 - DNA, 23 bp, Homo sapiens
tcaaacatattgtgagacacagg

SEQ ID NO: 9466906 - DNA, 22 bp, Homo sapiens
tcaaacatatctgattttccat

SEQ ID NO: 9466907 - DNA, 22 bp, Homo sapiens
tcaaacatgaaagcttgatttt

SEQ ID NO: 9466908 - DNA, 22 bp, Homo sapiens
tcaaacatgaaagcttgatttt

SEQ ID NO: 9466909 - DNA, 22 bp, Homo sapiens
tcaaacaggactacattctcat

SEQ ID NO: 9466910 - DNA, 22 bp, Homo sapiens
tcaaacagcaggtctttcatag

SEQ ID NO: 9466911 - DNA, 22 bp, Homo sapiens
tcaaacagaggaacaattgttt

SEQ ID NO: 9466912 - DNA, 22 bp, Homo sapiens
tcaaacagcaggtctttcatag

SEQ ID NO: 9466913 - DNA, 23 bp, Homo sapiens
tcaaacaggtttcagagcatctt

SEQ ID NO: 9466914 - DNA, 22 bp, Homo sapiens
tcaaacataaaactaaatcgag

SEQ ID NO: 9466915 - DNA, 22 bp, Homo sapiens
tcaaacataaaactaaatcgag

SEQ ID NO: 9466916 - DNA, 22 bp, Homo sapiens
tcaaacataggcacacattcag

SEQ ID NO: 9466917 - DNA, 22 bp, Homo sapiens
tcaaacatatctgattttccat

SEQ ID NO: 9466918 - DNA, 22 bp, Homo sapiens
tcacatcactagctggtaatga

SEQ ID NO: 9466919 - DNA, 22 bp, Homo sapiens
tcacatcacatgagtgcaagga

SEQ ID NO: 9466920 - DNA, 22 bp, Homo sapiens
tcacatcacatgacagtaggcc

SEQ ID NO: 9466921 - DNA, 17 bp, Homo sapiens
tcacatcacacaagcaa

SEQ ID NO: 9466922 - DNA, 17 bp, Homo sapiens
tcacatcacacaagcaa

SEQ ID NO: 9466923 - DNA, 17 bp, Homo sapiens
tcacatcacacaagcaa

SEQ ID NO: 9466924 - DNA, 22 bp, Homo sapiens
tcacatatttaagaaagttaaa

SEQ ID NO: 9466925 - DNA, 22 bp, Homo sapiens
tcacagcctggtcactctgccc

SEQ ID NO: 9466926 - DNA, 22 bp, Homo sapiens
tcacatatttaagaaagttaaa

SEQ ID NO: 9466927 - DNA, 22 bp, Homo sapiens
tcacatatttaagaaagttaaa

SEQ ID NO: 9466928 - DNA, 22 bp, Homo sapiens
tcacatcaacattatagcatga

SEQ ID NO: 9466929 - DNA, 22 bp, Homo sapiens
tcacatatttaagaaagttaaa

SEQ ID NO: 9466930 - DNA, 22 bp, Homo sapiens
tcacagcatttttagaaagatt

SEQ ID NO: 9466931 - DNA, 22 bp, Homo sapiens
tcacagcatttttagaaagatt

SEQ ID NO: 9466932 - DNA, 22 bp, Homo sapiens
tcacagcctggtcactctgccc

SEQ ID NO: 9466933 - DNA, 23 bp, Homo sapiens
tcacatatgtagaagtggaattc

SEQ ID NO: 9466934 - DNA, 23 bp, Homo sapiens
tcacatatcaagaaagtggtaga

SEQ ID NO: 9466935 - DNA, 22 bp, Homo sapiens
tcacagctattctcatgtattt

SEQ ID NO: 9466936 - DNA, 22 bp, Homo sapiens
tcacagctaagcttggtcactg

SEQ ID NO: 9466937 - DNA, 22 bp, Homo sapiens
tcacatctaattcggttaggtt

SEQ ID NO: 9466938 - DNA, 22 bp, Homo sapiens
tcacatctatacccaataattt

SEQ ID NO: 9466939 - DNA, 22 bp, Homo sapiens
tcacatctaattccatttctgc

SEQ ID NO: 9466940 - DNA, 22 bp, Homo sapiens
tcacatctctcattgcctctgc

SEQ ID NO: 9466941 - DNA, 22 bp, Homo sapiens
tcacatctctgttttctaaatc

SEQ ID NO: 9466942 - DNA, 22 bp, Homo sapiens
tcacatctgcaaaatccctttt

SEQ ID NO: 9466943 - DNA, 23 bp, Homo sapiens
tcacatctgccgtagtgtattct

SEQ ID NO: 9466944 - DNA, 22 bp, Homo sapiens
tcacagcaccaggatctctcca

SEQ ID NO: 9466945 - DNA, 22 bp, Homo sapiens
tcacagcacatggaccgagtcc

SEQ ID NO: 9466946 - DNA, 22 bp, Homo sapiens
tcacagcaaccctgaggcgagt

SEQ ID NO: 9466947 - DNA, 22 bp, Homo sapiens
tcacagcaaccctgaggcgagt

SEQ ID NO: 9466948 - DNA, 22 bp, Homo sapiens
tcacagcaacactggggcagac

SEQ ID NO: 9466949 - DNA, 22 bp, Homo sapiens
tcacagcaacactggggcagac

SEQ ID NO: 9466950 - DNA, 22 bp, Homo sapiens
tcacagcaccaggatctctcca

SEQ ID NO: 9466951 - DNA, 22 bp, Homo sapiens
tcacagcaccctgaggtgctgg

SEQ ID NO: 9466952 - DNA, 22 bp, Homo sapiens
tcacagcaggcagatattgttg

SEQ ID NO: 9466953 - DNA, 22 bp, Homo sapiens
tcacagcaggcagatattgttg

SEQ ID NO: 9466954 - DNA, 22 bp, Homo sapiens
tcacagcattcgcaatggacag

SEQ ID NO: 9466955 - DNA, 22 bp, Homo sapiens
tcacagcattcgcaatggacag

SEQ ID NO: 9466956 - DNA, 22 bp, Homo sapiens
tcacagcattgagtgtactaga

SEQ ID NO: 9466957 - DNA, 22 bp, Homo sapiens
tcacagcattgagtgtactaga

SEQ ID NO: 9466958 - DNA, 22 bp, Homo sapiens
tcacagcattgtcacaaggctg

SEQ ID NO: 9466959 - DNA, 22 bp, Homo sapiens
tcacagcattgtcacaaggctg

SEQ ID NO: 9466960 - DNA, 22 bp, Homo sapiens
tcacagcattgtcacaaggctg

SEQ ID NO: 9466961 - DNA, 22 bp, Homo sapiens
tcacagcagggtaacaggaaga

SEQ ID NO: 9466962 - DNA, 22 bp, Homo sapiens
tcacagcagggtaacaggaaga

SEQ ID NO: 9466963 - DNA, 22 bp, Homo sapiens
tcacagcagggtaacaggaaga

SEQ ID NO: 9466964 - DNA, 22 bp, Homo sapiens
tcacagcagggtaacaggaaga

SEQ ID NO: 9466965 - DNA, 22 bp, Homo sapiens
tcacagcagggtaacaggaaga

SEQ ID NO: 9466966 - DNA, 22 bp, Homo sapiens
tcacagcagtaaagaaaacact

SEQ ID NO: 9466967 - DNA, 19 bp, Homo sapiens
tcacagcatctgtctgaac

SEQ ID NO: 9466968 - DNA, 19 bp, Homo sapiens
tcacagcatctgtctgaac

SEQ ID NO: 9466969 - DNA, 20 bp, Homo sapiens
tcacagagtagccttgtctg

SEQ ID NO: 9466970 - DNA, 22 bp, Homo sapiens
tcacagagctcacagtttagca

SEQ ID NO: 9466971 - DNA, 22 bp, Homo sapiens
tcacagagctcacagtttagca

SEQ ID NO: 9466972 - DNA, 22 bp, Homo sapiens
tcacagagctcacagtttagca

SEQ ID NO: 9466973 - DNA, 21 bp, Homo sapiens
tcacagagccacagaattggt

SEQ ID NO: 9466974 - DNA, 22 bp, Homo sapiens
tcacagagttaaaagtttcttt

SEQ ID NO: 9466975 - DNA, 22 bp, Homo sapiens
tcacagagttaaaagtttcttt

SEQ ID NO: 9466976 - DNA, 20 bp, Homo sapiens
tcacagagtagccttgtctg

SEQ ID NO: 9466977 - DNA, 21 bp, Homo sapiens
tcacagagccacagaattggt

SEQ ID NO: 9466978 - DNA, 21 bp, Homo sapiens
tcacagagccacagaattggt

SEQ ID NO: 9466979 - DNA, 23 bp, Homo sapiens
tcacagagcatactgcattttgc

SEQ ID NO: 9466980 - DNA, 22 bp, Homo sapiens
tcacagagcacgtatcatgcct

SEQ ID NO: 9466981 - DNA, 22 bp, Homo sapiens
tcacagagcacacaagaattgc

SEQ ID NO: 9466982 - DNA, 22 bp, Homo sapiens
tcacagagcacgtatcatgcct

SEQ ID NO: 9466983 - DNA, 22 bp, Homo sapiens
tcacagagcacgtatcatgcct

SEQ ID NO: 9466984 - DNA, 22 bp, Homo sapiens
tcacagcaaatgctgcttctca

SEQ ID NO: 9466985 - DNA, 19 bp, Homo sapiens
tcacagagttcttacggga

SEQ ID NO: 9466986 - DNA, 22 bp, Homo sapiens
tcacagagttaaaagtttcttt

SEQ ID NO: 9466987 - DNA, 20 bp, Homo sapiens
tcacagatgaaagttcaaga

SEQ ID NO: 9466988 - DNA, 22 bp, Homo sapiens
tcacagacactgggttattgca

SEQ ID NO: 9466989 - DNA, 22 bp, Homo sapiens
tcacagagatgaacttttgata

SEQ ID NO: 9466990 - DNA, 22 bp, Homo sapiens
tcacagagagtgacttgttgct

SEQ ID NO: 9466991 - DNA, 22 bp, Homo sapiens
tcacagagatgaacttttgata

SEQ ID NO: 9466992 - DNA, 22 bp, Homo sapiens
tcacagagcacacaagaattgc

SEQ ID NO: 9466993 - DNA, 22 bp, Homo sapiens
tcacagagaggttaagcagttg

SEQ ID NO: 9466994 - DNA, 22 bp, Homo sapiens
tcacagagagtgacttgttgct

SEQ ID NO: 9466995 - DNA, 22 bp, Homo sapiens
tcacagagaggttaagcagttg

SEQ ID NO: 9466996 - DNA, 22 bp, Homo sapiens
tcacagagagaatattgtgttt

SEQ ID NO: 9466997 - DNA, 22 bp, Homo sapiens
tcacagagagaatattgtgttt

SEQ ID NO: 9466998 - DNA, 22 bp, Homo sapiens
tcacagagaactataatccatc

SEQ ID NO: 9466999 - DNA, 22 bp, Homo sapiens
tcacagaatagcactgtaagcg

SEQ ID NO: 9467000 - DNA, 22 bp, Homo sapiens
tcacagaataaattgagaagac

SEQ ID NO: 9467001 - DNA, 22 bp, Homo sapiens
tcacagaataaattgagaagac

SEQ ID NO: 9467002 - DNA, 22 bp, Homo sapiens
tcacagaatagcactgtaagcg

SEQ ID NO: 9467003 - DNA, 20 bp, Homo sapiens
tcacagaatgcctgaagaag

SEQ ID NO: 9467004 - DNA, 20 bp, Homo sapiens
tcacagaatgcctgaagaag

SEQ ID NO: 9467005 - DNA, 22 bp, Homo sapiens
tcacagaatctctgataagtct

SEQ ID NO: 9467006 - DNA, 18 bp, Homo sapiens
tcacagaatattgagtgg

SEQ ID NO: 9467007 - DNA, 22 bp, Homo sapiens
tcacagaatctctgataagtct

SEQ ID NO: 9467008 - DNA, 22 bp, Homo sapiens
tcacagaatgtcagagttgggg

SEQ ID NO: 9467009 - DNA, 22 bp, Homo sapiens
tcacagaatgtctagcataatt

SEQ ID NO: 9467010 - DNA, 22 bp, Homo sapiens
tcacagaatttttgcttccagt

SEQ ID NO: 9467011 - DNA, 22 bp, Homo sapiens
tcacagaatttttgcttccagt

SEQ ID NO: 9467012 - DNA, 22 bp, Homo sapiens
tcacagaattgacatgggaatc

SEQ ID NO: 9467013 - DNA, 22 bp, Homo sapiens
tcacagaattgacatgggaatc

SEQ ID NO: 9467014 - DNA, 22 bp, Homo sapiens
tcacacagggttctggtctcat

SEQ ID NO: 9467015 - DNA, 22 bp, Homo sapiens
tcacacagggttctggtctcat

SEQ ID NO: 9467016 - DNA, 22 bp, Homo sapiens
tcacacagtgagcggggctcag

SEQ ID NO: 9467017 - DNA, 22 bp, Homo sapiens
tcacacagtggtaaaaccctga

SEQ ID NO: 9467018 - DNA, 22 bp, Homo sapiens
tcacacagtgagaaagtgcgga

SEQ ID NO: 9467019 - DNA, 22 bp, Homo sapiens
tcacacataaaaagaagactag

SEQ ID NO: 9467020 - DNA, 22 bp, Homo sapiens
ggctgagggccagggctagtct

SEQ ID NO: 9467021 - DNA, 22 bp, Homo sapiens
ggctgagggccagggctagtct

SEQ ID NO: 9467022 - DNA, 22 bp, Homo sapiens
ggctgaggggcccagaggaaca

SEQ ID NO: 9467023 - DNA, 22 bp, Homo sapiens
ggctgaggggcccagaggaaca

SEQ ID NO: 9467024 - DNA, 22 bp, Homo sapiens
ggctgaggggcccagaggaaca

SEQ ID NO: 9467025 - DNA, 22 bp, Homo sapiens
ggctgagggtatagctgtccca

SEQ ID NO: 9467026 - DNA, 22 bp, Homo sapiens
ggctgaggggcccagaggaaca

SEQ ID NO: 9467027 - DNA, 22 bp, Homo sapiens
ggctgagggtatagctgtccca

SEQ ID NO: 9467028 - DNA, 22 bp, Homo sapiens
ggctgagggtatagctgtccca

SEQ ID NO: 9467029 - DNA, 18 bp, Homo sapiens
ggctgaggttgactagaa

SEQ ID NO: 9467030 - DNA, 22 bp, Homo sapiens
ggctgagggttaagatcagaca

SEQ ID NO: 9467031 - DNA, 22 bp, Homo sapiens
ggctgagggttaagatcagaca

SEQ ID NO: 9467032 - DNA, 22 bp, Homo sapiens
ggctgaggtgtggggaactata

SEQ ID NO: 9467033 - DNA, 22 bp, Homo sapiens
ggctgaggtgtggggaactata

SEQ ID NO: 9467034 - DNA, 22 bp, Homo sapiens
ggctgaggtgtggggaactata

SEQ ID NO: 9467035 - DNA, 22 bp, Homo sapiens
ggctgagggttaagatcagaca

SEQ ID NO: 9467036 - DNA, 22 bp, Homo sapiens
ggctgctggggacgtgggagag

SEQ ID NO: 9467037 - DNA, 22 bp, Homo sapiens
ggctgctggggacgtgggagag

SEQ ID NO: 9467038 - DNA, 22 bp, Homo sapiens
ggctgctggggacgtgggagag

SEQ ID NO: 9467039 - DNA, 22 bp, Homo sapiens
ggctgagttgagaggattactt

SEQ ID NO: 9467040 - DNA, 22 bp, Homo sapiens
ggctgctggggacgtgggagag

SEQ ID NO: 9467041 - DNA, 20 bp, Homo sapiens
ggctgctgtgggcagagagg

SEQ ID NO: 9467042 - DNA, 22 bp, Homo sapiens
ggctgctgtttcagagactgtt

SEQ ID NO: 9467043 - DNA, 22 bp, Homo sapiens
ggctgctgtttcagagactgtt

SEQ ID NO: 9467044 - DNA, 20 bp, Homo sapiens
ggctgctgtgggcagagagg

SEQ ID NO: 9467045 - DNA, 22 bp, Homo sapiens
ggctgctgtttcagagactgtt

SEQ ID NO: 9467046 - DNA, 22 bp, Homo sapiens
ggctggaaggtagaagatgagg

SEQ ID NO: 9467047 - DNA, 22 bp, Homo sapiens
ggctgctttgtagcttttgcca

SEQ ID NO: 9467048 - DNA, 22 bp, Homo sapiens
ggctggaatgcaactgtgtgtt

SEQ ID NO: 9467049 - DNA, 22 bp, Homo sapiens
ggctggacatagacatagccat

SEQ ID NO: 9467050 - DNA, 22 bp, Homo sapiens
ggctggaatgtgtggatgtgat

SEQ ID NO: 9467051 - DNA, 19 bp, Homo sapiens
ggctggagaaaggaatcag

SEQ ID NO: 9467052 - DNA, 19 bp, Homo sapiens
ggctggagaaaggaatcag

SEQ ID NO: 9467053 - DNA, 19 bp, Homo sapiens
ggctggagaaaggaatcag

SEQ ID NO: 9467054 - DNA, 19 bp, Homo sapiens
ggctggagaaaggaatcag

SEQ ID NO: 9467055 - DNA, 19 bp, Homo sapiens
ggctggagaaaggaatcag

SEQ ID NO: 9467056 - DNA, 19 bp, Homo sapiens
ggctggagaaaggaatcag

SEQ ID NO: 9467057 - DNA, 19 bp, Homo sapiens
ggctggagaaaggaatcag

SEQ ID NO: 9467058 - DNA, 19 bp, Homo sapiens
ggctggagaaaggaatcag

SEQ ID NO: 9467059 - DNA, 19 bp, Homo sapiens
ggctggagaaaggaatcag

SEQ ID NO: 9467060 - DNA, 22 bp, Homo sapiens
ggctggactttctgctgggctc

SEQ ID NO: 9467061 - DNA, 22 bp, Homo sapiens
ggctggactttctgctgggctc

SEQ ID NO: 9467062 - DNA, 22 bp, Homo sapiens
ggctggaccatgctgccccttc

SEQ ID NO: 9467063 - DNA, 22 bp, Homo sapiens
ggctggactgcctcccagagtc

SEQ ID NO: 9467064 - DNA, 22 bp, Homo sapiens
ggctggactctgggcctctcca

SEQ ID NO: 9467065 - DNA, 22 bp, Homo sapiens
ggctgggtacagggcagtgtgc

SEQ ID NO: 9467066 - DNA, 22 bp, Homo sapiens
ggctgggtaccctgtttcccct

SEQ ID NO: 9467067 - DNA, 21 bp, Homo sapiens
ggctgggtcatgcagctggcc

SEQ ID NO: 9467068 - DNA, 21 bp, Homo sapiens
ggctgggtcatgcagctggcc

SEQ ID NO: 9467069 - DNA, 22 bp, Homo sapiens
ggctgggtacagggcagtgtgc

SEQ ID NO: 9467070 - DNA, 22 bp, Homo sapiens
ggctggagaagggtggttgaca

SEQ ID NO: 9467071 - DNA, 22 bp, Homo sapiens
ggctgggctgctgggtcagagc

SEQ ID NO: 9467072 - DNA, 19 bp, Homo sapiens
ggctgggtctggcaggttc

SEQ ID NO: 9467073 - DNA, 22 bp, Homo sapiens
ggctgggtcccagctgggagga

SEQ ID NO: 9467074 - DNA, 19 bp, Homo sapiens
ggctgggtctggcaggttc

SEQ ID NO: 9467075 - DNA, 22 bp, Homo sapiens
ggctgggttatttatggccaag

SEQ ID NO: 9467076 - DNA, 21 bp, Homo sapiens
ggctgggtcatgcagctggcc

SEQ ID NO: 9467077 - DNA, 22 bp, Homo sapiens
ggctgggtcccagctgggagga

SEQ ID NO: 9467078 - DNA, 23 bp, Homo sapiens
ggctggtgcccttggccagtcgg

SEQ ID NO: 9467079 - DNA, 23 bp, Homo sapiens
ggctggtgcccttggccagtcgg

SEQ ID NO: 9467080 - DNA, 23 bp, Homo sapiens
ggctggtgcccttggccagtcgg

SEQ ID NO: 9467081 - DNA, 22 bp, Homo sapiens
ggctggtgagttcagagaaccc

SEQ ID NO: 9467082 - DNA, 22 bp, Homo sapiens
ggctgggttctgagaaagagta

SEQ ID NO: 9467083 - DNA, 22 bp, Homo sapiens
ggctgggtttgactcctggctt

SEQ ID NO: 9467084 - DNA, 22 bp, Homo sapiens
ggctggtcccgggtcctccggc

SEQ ID NO: 9467085 - DNA, 17 bp, Homo sapiens
ggctgtgccaggtgaga

SEQ ID NO: 9467086 - DNA, 22 bp, Homo sapiens
ggctgtgccctcacatggggca

SEQ ID NO: 9467087 - DNA, 22 bp, Homo sapiens
ggctgtgccctcacatggggca

SEQ ID NO: 9467088 - DNA, 22 bp, Homo sapiens
ggctgtgcagggcagagtctca

SEQ ID NO: 9467089 - DNA, 22 bp, Homo sapiens
ggctgtgacccccacaggggtg

SEQ ID NO: 9467090 - DNA, 22 bp, Homo sapiens
ggctgtgagcaggcagaatgct

SEQ ID NO: 9467091 - DNA, 22 bp, Homo sapiens
ggctgtgattggtggatgtgaa

SEQ ID NO: 9467092 - DNA, 22 bp, Homo sapiens
ggctgtgagcaggcagaatgct

SEQ ID NO: 9467093 - DNA, 22 bp, Homo sapiens
ggctggtggggaaagaggacca

SEQ ID NO: 9467094 - DNA, 22 bp, Homo sapiens
ggctggtggggaaagaggacca

SEQ ID NO: 9467095 - DNA, 22 bp, Homo sapiens
ggctctggttgaccatgatggc

SEQ ID NO: 9467096 - DNA, 22 bp, Homo sapiens
ggctctggtgtgaagcagcctc

SEQ ID NO: 9467097 - DNA, 22 bp, Homo sapiens
ggctctggtgtgaagcagcctc

SEQ ID NO: 9467098 - DNA, 22 bp, Homo sapiens
ggctctgggtgtgaccttgggt

SEQ ID NO: 9467099 - DNA, 22 bp, Homo sapiens
ggctctgggttctgcaatgcgt

SEQ ID NO: 9467100 - DNA, 22 bp, Homo sapiens
ggctctggtgtgaagcagcctc

SEQ ID NO: 9467101 - DNA, 22 bp, Homo sapiens
ggctctggtgtgaagcagcctc

SEQ ID NO: 9467102 - DNA, 22 bp, Homo sapiens
ggctctgggtgtgaccttgggt

SEQ ID NO: 9467103 - DNA, 22 bp, Homo sapiens
ggctctgggtgtgaccttgggt

SEQ ID NO: 9467104 - DNA, 22 bp, Homo sapiens
ggctctgggtgtgaccttgggt

SEQ ID NO: 9467105 - DNA, 17 bp, Homo sapiens
ggctctgggtgtcacat

SEQ ID NO: 9467106 - DNA, 17 bp, Homo sapiens
ggctctgggtgtcacat

SEQ ID NO: 9467107 - DNA, 17 bp, Homo sapiens
ggctctgggtgtcacat

SEQ ID NO: 9467108 - DNA, 17 bp, Homo sapiens
ggctctgggtgtcacat

SEQ ID NO: 9467109 - DNA, 17 bp, Homo sapiens
ggctctgggtgtcacat

SEQ ID NO: 9467110 - DNA, 22 bp, Homo sapiens
ggctctgggtctgtggggagcg

SEQ ID NO: 9467111 - DNA, 22 bp, Homo sapiens
ggctctgggtctgtggggagcg

SEQ ID NO: 9467112 - DNA, 22 bp, Homo sapiens
ggctctgggtctgtggggagcg

SEQ ID NO: 9467113 - DNA, 22 bp, Homo sapiens
ggctctggttgaccatgatggc

SEQ ID NO: 9467114 - DNA, 22 bp, Homo sapiens
ggctctggttgaccatgatggc

SEQ ID NO: 9467115 - DNA, 22 bp, Homo sapiens
ggctctggttgaccatgatggc

SEQ ID NO: 9467116 - DNA, 23 bp, Homo sapiens
ggctctgtgctaattgctgaaaa

SEQ ID NO: 9467117 - DNA, 23 bp, Homo sapiens
ggctctgtgctgggcctgcagga

SEQ ID NO: 9467118 - DNA, 22 bp, Homo sapiens
ggctctgtggctggccatgatg

SEQ ID NO: 9467119 - DNA, 22 bp, Homo sapiens
ggctgagccatgggcactgcag

SEQ ID NO: 9467120 - DNA, 22 bp, Homo sapiens
ggctgagccatgggcactgcag

SEQ ID NO: 9467121 - DNA, 22 bp, Homo sapiens
ggctgaggctcatgccatcttg

SEQ ID NO: 9467122 - DNA, 22 bp, Homo sapiens
ggctcttctacttcagatgggg

SEQ ID NO: 9467123 - DNA, 22 bp, Homo sapiens
ggctgagcactttaggcaggag

SEQ ID NO: 9467124 - DNA, 22 bp, Homo sapiens
ggctgagcactttaggcaggag

SEQ ID NO: 9467125 - DNA, 22 bp, Homo sapiens
ggctgagcactttaggcaggag

SEQ ID NO: 9467126 - DNA, 22 bp, Homo sapiens
ggctcttccgccaccagccaca

SEQ ID NO: 9467127 - DNA, 22 bp, Homo sapiens
ggctcttccgccaccagccaca

SEQ ID NO: 9467128 - DNA, 22 bp, Homo sapiens
ggctcctgataggagaatgcgg

SEQ ID NO: 9467129 - DNA, 22 bp, Homo sapiens
ggctcctgataggagaatgcgg

SEQ ID NO: 9467130 - DNA, 22 bp, Homo sapiens
ggctcctgaggaccaggcacag

SEQ ID NO: 9467131 - DNA, 22 bp, Homo sapiens
ggctcctgaggaccaggcacag

SEQ ID NO: 9467132 - DNA, 22 bp, Homo sapiens
ggctcctgaggaccaggcacag

SEQ ID NO: 9467133 - DNA, 22 bp, Homo sapiens
ggctcctgaggaccaggcacag

SEQ ID NO: 9467134 - DNA, 22 bp, Homo sapiens
ggctcctgaggaccaggcacag

SEQ ID NO: 9467135 - DNA, 22 bp, Homo sapiens
ggctcctgagaatgggccatca

SEQ ID NO: 9467136 - DNA, 22 bp, Homo sapiens
ggctcctgagaatgggccatca

SEQ ID NO: 9467137 - DNA, 22 bp, Homo sapiens
ggctccctgggtgctcctgctc

SEQ ID NO: 9467138 - DNA, 22 bp, Homo sapiens
ggctccctgggtgctcctgctc

SEQ ID NO: 9467139 - DNA, 22 bp, Homo sapiens
ggctccctgggtgctcctgctc

SEQ ID NO: 9467140 - DNA, 22 bp, Homo sapiens
ggctccctgttctattccctgg

SEQ ID NO: 9467141 - DNA, 22 bp, Homo sapiens
ggctccctgttctattccctgg

SEQ ID NO: 9467142 - DNA, 22 bp, Homo sapiens
ggctccctgggtgctcctgctc

SEQ ID NO: 9467143 - DNA, 22 bp, Homo sapiens
ggctcctctctggccgctcccg

SEQ ID NO: 9467144 - DNA, 22 bp, Homo sapiens
ggctctgggcctccaaggtctg

SEQ ID NO: 9467145 - DNA, 22 bp, Homo sapiens
ggctctgggccagagttggctt

SEQ ID NO: 9467146 - DNA, 22 bp, Homo sapiens
ggctctgggcctccaaggtctg

SEQ ID NO: 9467147 - DNA, 22 bp, Homo sapiens
ggctctggggaagctctcttca

SEQ ID NO: 9467148 - DNA, 22 bp, Homo sapiens
ggctctgggcctccaaggtctg

SEQ ID NO: 9467149 - DNA, 22 bp, Homo sapiens
ggctctggggcctcctcccttg

SEQ ID NO: 9467150 - DNA, 22 bp, Homo sapiens
ggctctggggcctcctcccttg

SEQ ID NO: 9467151 - DNA, 22 bp, Homo sapiens
ggctctggggcctcctcccttg

SEQ ID NO: 9467152 - DNA, 22 bp, Homo sapiens
ggctctggggaagctctcttca

SEQ ID NO: 9467153 - DNA, 22 bp, Homo sapiens
ggctctggggaagctctcttca

SEQ ID NO: 9467154 - DNA, 22 bp, Homo sapiens
ggctctgggtaaggcgtttgac

SEQ ID NO: 9467155 - DNA, 22 bp, Homo sapiens
ggctctgggtaaggcgtttgac

SEQ ID NO: 9467156 - DNA, 22 bp, Homo sapiens
ggctctgggtaaggcgtttgac

SEQ ID NO: 9467157 - DNA, 22 bp, Homo sapiens
ggctctggggttggcccatctc

SEQ ID NO: 9467158 - DNA, 22 bp, Homo sapiens
ggctctgggtctgtggggagcg

SEQ ID NO: 9467159 - DNA, 22 bp, Homo sapiens
ggctctgggtctgtggggagcg

SEQ ID NO: 9467160 - DNA, 22 bp, Homo sapiens
ggctctgggtctgtggggagcg

SEQ ID NO: 9467161 - DNA, 22 bp, Homo sapiens
ggctctggggttggcccatctc

SEQ ID NO: 9467162 - DNA, 22 bp, Homo sapiens
ggctctggggttggcccatctc

SEQ ID NO: 9467163 - DNA, 22 bp, Homo sapiens
ggctctggggggaagtctgttg

SEQ ID NO: 9467164 - DNA, 22 bp, Homo sapiens
ggctctggggggaagtctgttg

SEQ ID NO: 9467165 - DNA, 22 bp, Homo sapiens
ggctctggggggaagtctgttg

SEQ ID NO: 9467166 - DNA, 22 bp, Homo sapiens
ggctctggggggaagtctgttg

SEQ ID NO: 9467167 - DNA, 22 bp, Homo sapiens
ggcgtttcaccatgttgaccag

SEQ ID NO: 9467168 - DNA, 22 bp, Homo sapiens
ggctacagactgcataagggca

SEQ ID NO: 9467169 - DNA, 19 bp, Homo sapiens
ggctaatgtctttgaaata

SEQ ID NO: 9467170 - DNA, 22 bp, Homo sapiens
ggctacagcggggtggagacgg

SEQ ID NO: 9467171 - DNA, 22 bp, Homo sapiens
ggcgtctgtttgaaggcaacgt

SEQ ID NO: 9467172 - DNA, 22 bp, Homo sapiens
ggcgtgggcgaggtgctctatc

SEQ ID NO: 9467173 - DNA, 22 bp, Homo sapiens
ggcggtggttgagaggacggcg

SEQ ID NO: 9467174 - DNA, 22 bp, Homo sapiens
ggctagcttagagtcatgctag

SEQ ID NO: 9467175 - DNA, 22 bp, Homo sapiens
ggctagcaaggtagcagaatgc

SEQ ID NO: 9467176 - DNA, 22 bp, Homo sapiens
ggctaggcaggctcagagccta

SEQ ID NO: 9467177 - DNA, 22 bp, Homo sapiens
ggctaggcctcaggcctgcctg

SEQ ID NO: 9467178 - DNA, 22 bp, Homo sapiens
ggctagagtggaactggagcgg

SEQ ID NO: 9467179 - DNA, 22 bp, Homo sapiens
ggctactaggtaccatttagaa

SEQ ID NO: 9467180 - DNA, 22 bp, Homo sapiens
ggctactagactttgatactag

SEQ ID NO: 9467181 - DNA, 22 bp, Homo sapiens
ggctccctgggtgctcctgctc

SEQ ID NO: 9467182 - DNA, 22 bp, Homo sapiens
ggctccctggccctggggacac

SEQ ID NO: 9467183 - DNA, 21 bp, Homo sapiens
ggctccctggcaggggtctgg

SEQ ID NO: 9467184 - DNA, 22 bp, Homo sapiens
ggctccctggccctggggacac

SEQ ID NO: 9467185 - DNA, 22 bp, Homo sapiens
ggctccctggccctggggacac

SEQ ID NO: 9467186 - DNA, 22 bp, Homo sapiens
ggctccctggaaatcccgaggc

SEQ ID NO: 9467187 - DNA, 21 bp, Homo sapiens
ggctccctggcaggggtctgg

SEQ ID NO: 9467188 - DNA, 22 bp, Homo sapiens
ggctccctgcctgtcctcagtc

SEQ ID NO: 9467189 - DNA, 22 bp, Homo sapiens
ggctccctgcctgtcctcagtc

SEQ ID NO: 9467190 - DNA, 22 bp, Homo sapiens
ggctccctgcctgtcctcagtc

SEQ ID NO: 9467191 - DNA, 22 bp, Homo sapiens
ggctccctgcaacctccgcctc

SEQ ID NO: 9467192 - DNA, 22 bp, Homo sapiens
ggctccctgcctgtcctcagtc

SEQ ID NO: 9467193 - DNA, 22 bp, Homo sapiens
ggctccctgcctgtcctcagtc

SEQ ID NO: 9467194 - DNA, 22 bp, Homo sapiens
ggctccctggaaatcccgaggc

SEQ ID NO: 9467195 - DNA, 22 bp, Homo sapiens
ggctccctggaaatcccgaggc

SEQ ID NO: 9467196 - DNA, 22 bp, Homo sapiens
ggctccctggaaatcccgaggc

SEQ ID NO: 9467197 - DNA, 22 bp, Homo sapiens
ggctccctcaccaccatcacat

SEQ ID NO: 9467198 - DNA, 23 bp, Homo sapiens
ggctccctcctagctttcccaat

SEQ ID NO: 9467199 - DNA, 22 bp, Homo sapiens
ggctccctgcaacctccgcctc

SEQ ID NO: 9467200 - DNA, 22 bp, Homo sapiens
ggctccctgcaacctccgcctc

SEQ ID NO: 9467201 - DNA, 22 bp, Homo sapiens
ggctccctagggagagtgggag

SEQ ID NO: 9467202 - DNA, 22 bp, Homo sapiens
ggctccctagggagagtgggag

SEQ ID NO: 9467203 - DNA, 22 bp, Homo sapiens
ggctccctcaccaccatcacat

SEQ ID NO: 9467204 - DNA, 22 bp, Homo sapiens
ggctccctcaccaccatcacat

SEQ ID NO: 9467205 - DNA, 22 bp, Homo sapiens
ggctaggcgggcacatggtgga

SEQ ID NO: 9467206 - DNA, 22 bp, Homo sapiens
ggctaggcgggcacatggtgga

SEQ ID NO: 9467207 - DNA, 22 bp, Homo sapiens
ggctaggcctcaggcctgcctg

SEQ ID NO: 9467208 - DNA, 22 bp, Homo sapiens
ggctccagggagtggagagaag

SEQ ID NO: 9467209 - DNA, 22 bp, Homo sapiens
ggctccagggagtggagagaag

SEQ ID NO: 9467210 - DNA, 22 bp, Homo sapiens
ggctccagggagtggagagaag

SEQ ID NO: 9467211 - DNA, 22 bp, Homo sapiens
ggctcccacccatagggcgagt

SEQ ID NO: 9467212 - DNA, 22 bp, Homo sapiens
ggctcccacccatagggcgagt

SEQ ID NO: 9467213 - DNA, 22 bp, Homo sapiens
ggctcccaggagggcctggagg

SEQ ID NO: 9467214 - DNA, 22 bp, Homo sapiens
ggctccagggagtggagagaag

SEQ ID NO: 9467215 - DNA, 22 bp, Homo sapiens
ggctccagtttgtgccttcagc

SEQ ID NO: 9467216 - DNA, 22 bp, Homo sapiens
ggctccagtttgtgccttcagc

SEQ ID NO: 9467217 - DNA, 22 bp, Homo sapiens
ggctccagtttgtgccttcagc

SEQ ID NO: 9467218 - DNA, 22 bp, Homo sapiens
ggctccagtttgtgccttcagc

SEQ ID NO: 9467219 - DNA, 22 bp, Homo sapiens
gggaaggctgcctgagggatgg

SEQ ID NO: 9467220 - DNA, 22 bp, Homo sapiens
gggaaggctgcctgagggatgg

SEQ ID NO: 9467221 - DNA, 22 bp, Homo sapiens
gggaaggctgcctgagggatgg

SEQ ID NO: 9467222 - DNA, 22 bp, Homo sapiens
gggaaggctgcctgagggatgg

SEQ ID NO: 9467223 - DNA, 22 bp, Homo sapiens
gggaagggacttgtttaaggtc

SEQ ID NO: 9467224 - DNA, 22 bp, Homo sapiens
gggaagggagggacctcagtct

SEQ ID NO: 9467225 - DNA, 22 bp, Homo sapiens
ggctttgacatgctgaattaaa

SEQ ID NO: 9467226 - DNA, 22 bp, Homo sapiens
ggctttgacatgctgaattaaa

SEQ ID NO: 9467227 - DNA, 22 bp, Homo sapiens
ggctttctagatctagctctgt

SEQ ID NO: 9467228 - DNA, 22 bp, Homo sapiens
ggctttctatgaactcaaaggc

SEQ ID NO: 9467229 - DNA, 22 bp, Homo sapiens
ggctttctccttgccttagtct

SEQ ID NO: 9467230 - DNA, 22 bp, Homo sapiens
ggctttctgtctgcgtctgtgt

SEQ ID NO: 9467231 - DNA, 22 bp, Homo sapiens
ggctttattatgtggccatgtg

SEQ ID NO: 9467232 - DNA, 22 bp, Homo sapiens
ggctgtgcctcaaggctactca

SEQ ID NO: 9467233 - DNA, 22 bp, Homo sapiens
ggctgtgcctcaaggctactca

SEQ ID NO: 9467234 - DNA, 22 bp, Homo sapiens
ggctgtgcctcaaggctactca

SEQ ID NO: 9467235 - DNA, 22 bp, Homo sapiens
gggagctgagctctgagccacg

SEQ ID NO: 9467236 - DNA, 22 bp, Homo sapiens
gggagctgagaaacaacattct

SEQ ID NO: 9467237 - DNA, 22 bp, Homo sapiens
gggagctgagaaacaacattct

SEQ ID NO: 9467238 - DNA, 22 bp, Homo sapiens
gggagctgacctgcaggttccc

SEQ ID NO: 9467239 - DNA, 21 bp, Homo sapiens
gggagctgacagcagcacggc

SEQ ID NO: 9467240 - DNA, 21 bp, Homo sapiens
gggagctgacagcagcacggc

SEQ ID NO: 9467241 - DNA, 21 bp, Homo sapiens
gggagctgacagcagcacggc

SEQ ID NO: 9467242 - DNA, 22 bp, Homo sapiens
gggagctgagctggaagagaat

SEQ ID NO: 9467243 - DNA, 22 bp, Homo sapiens
gggagctgagctggaagagaat

SEQ ID NO: 9467244 - DNA, 22 bp, Homo sapiens
gggagctgagctctgagccacg

SEQ ID NO: 9467245 - DNA, 22 bp, Homo sapiens
gggagctgagctctgagccacg

SEQ ID NO: 9467246 - DNA, 22 bp, Homo sapiens
gggagctgagctctgagccacg

SEQ ID NO: 9467247 - DNA, 22 bp, Homo sapiens
gggagctgagctggaagagaat

SEQ ID NO: 9467248 - DNA, 22 bp, Homo sapiens
gggagctgagctctgagccacg

SEQ ID NO: 9467249 - DNA, 22 bp, Homo sapiens
gggagctggagctggaagactc

SEQ ID NO: 9467250 - DNA, 22 bp, Homo sapiens
gggagctggagctggaagactc

SEQ ID NO: 9467251 - DNA, 19 bp, Homo sapiens
gggagctgaggtctttggt

SEQ ID NO: 9467252 - DNA, 19 bp, Homo sapiens
gggagctgaggtctttggt

SEQ ID NO: 9467253 - DNA, 22 bp, Homo sapiens
gggagctgagctggaagagaat

SEQ ID NO: 9467254 - DNA, 22 bp, Homo sapiens
gggagctgagctggaagagaat

SEQ ID NO: 9467255 - DNA, 22 bp, Homo sapiens
gggagctgagctggaagagaat

SEQ ID NO: 9467256 - DNA, 22 bp, Homo sapiens
gggagctgagctggaagagaat

SEQ ID NO: 9467257 - DNA, 22 bp, Homo sapiens
gggagctgagctggaagagaat

SEQ ID NO: 9467258 - DNA, 22 bp, Homo sapiens
gggagctgaggagccccgtcgg

SEQ ID NO: 9467259 - DNA, 22 bp, Homo sapiens
gggagctgagggacctctgtgg

SEQ ID NO: 9467260 - DNA, 22 bp, Homo sapiens
gggagctgagggacctctgtgg

SEQ ID NO: 9467261 - DNA, 22 bp, Homo sapiens
gggagctgagggacctctgtgg

SEQ ID NO: 9467262 - DNA, 23 bp, Homo sapiens
gggaagtggggatttgaagtcat

SEQ ID NO: 9467263 - DNA, 22 bp, Homo sapiens
gggaagtgtgcagagttctctt

SEQ ID NO: 9467264 - DNA, 22 bp, Homo sapiens
gggaagtgtgcagagttctctt

SEQ ID NO: 9467265 - DNA, 22 bp, Homo sapiens
gggaagtgtggtttctttacag

SEQ ID NO: 9467266 - DNA, 22 bp, Homo sapiens
gggaagtgtggtttctttacag

SEQ ID NO: 9467267 - DNA, 17 bp, Homo sapiens
gggaagtggagaaagct

SEQ ID NO: 9467268 - DNA, 17 bp, Homo sapiens
gggaagtggagaaagct

SEQ ID NO: 9467269 - DNA, 22 bp, Homo sapiens
gggaagtgatggagccaggatt

SEQ ID NO: 9467270 - DNA, 22 bp, Homo sapiens
gggaatgagagtcagcccagga

SEQ ID NO: 9467271 - DNA, 21 bp, Homo sapiens
gggaatgagattcttggagat

SEQ ID NO: 9467272 - DNA, 22 bp, Homo sapiens
gggaatgaccttaataagtagg

SEQ ID NO: 9467273 - DNA, 22 bp, Homo sapiens
gggaatgaggcagatagataaa

SEQ ID NO: 9467274 - DNA, 19 bp, Homo sapiens
gggaatgatggaagacttc

SEQ ID NO: 9467275 - DNA, 22 bp, Homo sapiens
gggaatgaggcagatagataaa

SEQ ID NO: 9467276 - DNA, 21 bp, Homo sapiens
gggaatgagattcttggagat

SEQ ID NO: 9467277 - DNA, 21 bp, Homo sapiens
gggagctgacagcagcacggc

SEQ ID NO: 9467278 - DNA, 22 bp, Homo sapiens
gggaagggagggcctccagtca

SEQ ID NO: 9467279 - DNA, 22 bp, Homo sapiens
gggaaggtatttagctgctgaa

SEQ ID NO: 9467280 - DNA, 22 bp, Homo sapiens
gggaagtgatggagccaggatt

SEQ ID NO: 9467281 - DNA, 22 bp, Homo sapiens
gggaagtgaggagcccctctgc

SEQ ID NO: 9467282 - DNA, 22 bp, Homo sapiens
gggaagtgagctggaatcaagg

SEQ ID NO: 9467283 - DNA, 22 bp, Homo sapiens
gggaagtgagctggaatcaagg

SEQ ID NO: 9467284 - DNA, 22 bp, Homo sapiens
gggaagtgaagtgtagctgtct

SEQ ID NO: 9467285 - DNA, 22 bp, Homo sapiens
gggagggaggtgatgcttggct

SEQ ID NO: 9467286 - DNA, 22 bp, Homo sapiens
gggagggagaggacagttctat

SEQ ID NO: 9467287 - DNA, 22 bp, Homo sapiens
gggagggaggtgctggttcacg

SEQ ID NO: 9467288 - DNA, 22 bp, Homo sapiens
gggagggaggtgatgcttggct

SEQ ID NO: 9467289 - DNA, 22 bp, Homo sapiens
gggagggatctgctaggcaatg

SEQ ID NO: 9467290 - DNA, 22 bp, Homo sapiens
gggagggatctgctaggcaatg

SEQ ID NO: 9467291 - DNA, 22 bp, Homo sapiens
gggagggatctgctaggcaatg

SEQ ID NO: 9467292 - DNA, 22 bp, Homo sapiens
gggagggatctgctaggcaatg

SEQ ID NO: 9467293 - DNA, 16 bp, Homo sapiens
gggagggagttggtgg

SEQ ID NO: 9467294 - DNA, 22 bp, Homo sapiens
gggagggaggtgctggttcacg

SEQ ID NO: 9467295 - DNA, 22 bp, Homo sapiens
gggagctggatcgcgcgcccgg

SEQ ID NO: 9467296 - DNA, 22 bp, Homo sapiens
gggagctggatcgcgcgcccgg

SEQ ID NO: 9467297 - DNA, 22 bp, Homo sapiens
gggagctggagttgtgttgcct

SEQ ID NO: 9467298 - DNA, 22 bp, Homo sapiens
gggagctggagctggaagactc

SEQ ID NO: 9467299 - DNA, 22 bp, Homo sapiens
gggagctggagctggaagactc

SEQ ID NO: 9467300 - DNA, 22 bp, Homo sapiens
gggagctggagctggaagactc

SEQ ID NO: 9467301 - DNA, 22 bp, Homo sapiens
gggagctggagctggaagactc

SEQ ID NO: 9467302 - DNA, 22 bp, Homo sapiens
gggagctggatgattgaggcaa

SEQ ID NO: 9467303 - DNA, 22 bp, Homo sapiens
gggagctggatgattgaggcaa

SEQ ID NO: 9467304 - DNA, 22 bp, Homo sapiens
gggagctggatgattgaggcaa

SEQ ID NO: 9467305 - DNA, 22 bp, Homo sapiens
gggagctggcctactattagat

SEQ ID NO: 9467306 - DNA, 22 bp, Homo sapiens
gggagggacacaaagagttccc

SEQ ID NO: 9467307 - DNA, 22 bp, Homo sapiens
gggagggagaggacagttctat

SEQ ID NO: 9467308 - DNA, 22 bp, Homo sapiens
gggaggttctgttcgcacttga

SEQ ID NO: 9467309 - DNA, 22 bp, Homo sapiens
gggcacaggagaaggatctggc

SEQ ID NO: 9467310 - DNA, 22 bp, Homo sapiens
gggcacaggagaaggatctggc

SEQ ID NO: 9467311 - DNA, 22 bp, Homo sapiens
gggcacaggagaaggatctggc

SEQ ID NO: 9467312 - DNA, 22 bp, Homo sapiens
gggaggtgttccagtgttggta

SEQ ID NO: 9467313 - DNA, 22 bp, Homo sapiens
gggaggtgattaggaccatgta

SEQ ID NO: 9467314 - DNA, 22 bp, Homo sapiens
gggaggtgttccagtgttggta

SEQ ID NO: 9467315 - DNA, 22 bp, Homo sapiens
gggaggtgttccagtgttggta

SEQ ID NO: 9467316 - DNA, 22 bp, Homo sapiens
gggaggtgttctgccaacgcgg

SEQ ID NO: 9467317 - DNA, 22 bp, Homo sapiens
gggagggattagttctgcctgg

SEQ ID NO: 9467318 - DNA, 22 bp, Homo sapiens
gggagggattagttctgcctgg

SEQ ID NO: 9467319 - DNA, 22 bp, Homo sapiens
gggagggattagttctgcctgg

SEQ ID NO: 9467320 - DNA, 21 bp, Homo sapiens
gggagggatggaaatgatgtt

SEQ ID NO: 9467321 - DNA, 21 bp, Homo sapiens
gggagggatggaaatgatgtt

SEQ ID NO: 9467322 - DNA, 21 bp, Homo sapiens
gggagggatggaaatgatgtt

SEQ ID NO: 9467323 - DNA, 19 bp, Homo sapiens
gggcagtggcactagggag

SEQ ID NO: 9467324 - DNA, 19 bp, Homo sapiens
gggcagtggcactagggag

SEQ ID NO: 9467325 - DNA, 22 bp, Homo sapiens
gggcagtgacaaaggggatgaa

SEQ ID NO: 9467326 - DNA, 22 bp, Homo sapiens
gggcagtgacaaaggggatgaa

SEQ ID NO: 9467327 - DNA, 22 bp, Homo sapiens
gggcagtgacaaaggggatgaa

SEQ ID NO: 9467328 - DNA, 22 bp, Homo sapiens
gggcagtgaatattggtgggaa

SEQ ID NO: 9467329 - DNA, 22 bp, Homo sapiens
gggcagtgaatattggtgggaa

SEQ ID NO: 9467330 - DNA, 21 bp, Homo sapiens
gggcagtctggtggctatggc

SEQ ID NO: 9467331 - DNA, 22 bp, Homo sapiens
gggcagtagcttcgtaggcatc

SEQ ID NO: 9467332 - DNA, 22 bp, Homo sapiens
gggcagtcacagtgctggagca

SEQ ID NO: 9467333 - DNA, 22 bp, Homo sapiens
gggcagtcacagtgctggagca

SEQ ID NO: 9467334 - DNA, 22 bp, Homo sapiens
gggcagtgaatattggtgggaa

SEQ ID NO: 9467335 - DNA, 18 bp, Homo sapiens
gggcactggggactggag

SEQ ID NO: 9467336 - DNA, 22 bp, Homo sapiens
gggcactggcagtcggggacgc

SEQ ID NO: 9467337 - DNA, 22 bp, Homo sapiens
gggcaggttattggagtaggga

SEQ ID NO: 9467338 - DNA, 22 bp, Homo sapiens
gggcaggttggcatcccgggca

SEQ ID NO: 9467339 - DNA, 22 bp, Homo sapiens
gggcaggttattggagtaggga

SEQ ID NO: 9467340 - DNA, 22 bp, Homo sapiens
gggcaggttattggagtaggga

SEQ ID NO: 9467341 - DNA, 22 bp, Homo sapiens
gggcaggttattggagtaggga

SEQ ID NO: 9467342 - DNA, 22 bp, Homo sapiens
gggcaggttattggagtaggga

SEQ ID NO: 9467343 - DNA, 23 bp, Homo sapiens
gggcaggtttttataggcttcag

SEQ ID NO: 9467344 - DNA, 23 bp, Homo sapiens
gggcaggtttttataggcttcag

SEQ ID NO: 9467345 - DNA, 22 bp, Homo sapiens
gggcactgagggcccacaggat

SEQ ID NO: 9467346 - DNA, 22 bp, Homo sapiens
gggcactgaatgccaagctagg

SEQ ID NO: 9467347 - DNA, 22 bp, Homo sapiens
gggcactgagtggatgatgcag

SEQ ID NO: 9467348 - DNA, 22 bp, Homo sapiens
gggcactgctggaggctccctg

SEQ ID NO: 9467349 - DNA, 22 bp, Homo sapiens
gggcactggaggccaaggagct

SEQ ID NO: 9467350 - DNA, 22 bp, Homo sapiens
gggcactggaggccaaggagct

SEQ ID NO: 9467351 - DNA, 22 bp, Homo sapiens
gggcactggaggccaaggagct

SEQ ID NO: 9467352 - DNA, 22 bp, Homo sapiens
gggcactggaaggctctcaggc

SEQ ID NO: 9467353 - DNA, 22 bp, Homo sapiens
gggcacatgtaaagctggagaa

SEQ ID NO: 9467354 - DNA, 22 bp, Homo sapiens
gggcaccagcggccgcactgcc

SEQ ID NO: 9467355 - DNA, 23 bp, Homo sapiens
gggcaccaggagcaccggacagg

SEQ ID NO: 9467356 - DNA, 22 bp, Homo sapiens
gggcacagtactccaatcaact

SEQ ID NO: 9467357 - DNA, 22 bp, Homo sapiens
gggcacctggctagtgacagtg

SEQ ID NO: 9467358 - DNA, 22 bp, Homo sapiens
gggcaccttgggtctcaggcaa

SEQ ID NO: 9467359 - DNA, 22 bp, Homo sapiens
ggcagcagtaggagctaatctt

SEQ ID NO: 9467360 - DNA, 22 bp, Homo sapiens
ggcagcagggtctagattgatg

SEQ ID NO: 9467361 - DNA, 22 bp, Homo sapiens
ggcagcagggtagccatttctc

SEQ ID NO: 9467362 - DNA, 22 bp, Homo sapiens
ggcagcagggtctagattgatg

SEQ ID NO: 9467363 - DNA, 22 bp, Homo sapiens
ggcagcagggtctagattgatg

SEQ ID NO: 9467364 - DNA, 22 bp, Homo sapiens
ggcagcagggctgtctccctac

SEQ ID NO: 9467365 - DNA, 22 bp, Homo sapiens
ggcagcaggcgacttccctatt

SEQ ID NO: 9467366 - DNA, 22 bp, Homo sapiens
ggcagcagggctgtctccctac

SEQ ID NO: 9467367 - DNA, 22 bp, Homo sapiens
ggcagccatgcacgctgcctgg

SEQ ID NO: 9467368 - DNA, 22 bp, Homo sapiens
ggcagccatactcagacctggg

SEQ ID NO: 9467369 - DNA, 22 bp, Homo sapiens
ggcagccatggacactggctag

SEQ ID NO: 9467370 - DNA, 22 bp, Homo sapiens
ggcagccatgctccaggtgcag

SEQ ID NO: 9467371 - DNA, 22 bp, Homo sapiens
ggcagccagcaatgagaagttt

SEQ ID NO: 9467372 - DNA, 22 bp, Homo sapiens
ggcagccagagggcagctggat

SEQ ID NO: 9467373 - DNA, 22 bp, Homo sapiens
ggcagcagtccatggcccaagg

SEQ ID NO: 9467374 - DNA, 22 bp, Homo sapiens
ggcagcagtccatggcccaagg

SEQ ID NO: 9467375 - DNA, 21 bp, Homo sapiens
ggcagctgtggttaattgaac

SEQ ID NO: 9467376 - DNA, 17 bp, Homo sapiens
ggcagctgtgtgcatgc

SEQ ID NO: 9467377 - DNA, 17 bp, Homo sapiens
ggcagctgtgtgcatgc

SEQ ID NO: 9467378 - DNA, 17 bp, Homo sapiens
ggcagctgtgtgcatgc

SEQ ID NO: 9467379 - DNA, 22 bp, Homo sapiens
ggcagctgtgaagtgcctcaca

SEQ ID NO: 9467380 - DNA, 22 bp, Homo sapiens
ggcagctgtgaagtgcctcaca

SEQ ID NO: 9467381 - DNA, 21 bp, Homo sapiens
ggcagctgtggttaattgaac

SEQ ID NO: 9467382 - DNA, 22 bp, Homo sapiens
ggcagctgtggacgtcgtcatt

SEQ ID NO: 9467383 - DNA, 22 bp, Homo sapiens
ggcagctgtggacgtcgtcatt

SEQ ID NO: 9467384 - DNA, 22 bp, Homo sapiens
ggcagctgtggacgtcgtcatt

SEQ ID NO: 9467385 - DNA, 22 bp, Homo sapiens
ggcagctgttggctctctagga

SEQ ID NO: 9467386 - DNA, 22 bp, Homo sapiens
ggcagctgtttgtcctcctgtt

SEQ ID NO: 9467387 - DNA, 22 bp, Homo sapiens
ggcagctgttggctctctagga

SEQ ID NO: 9467388 - DNA, 17 bp, Homo sapiens
ggcagctgtgtgcatgc

SEQ ID NO: 9467389 - DNA, 22 bp, Homo sapiens
ggcagctgttggctctctagga

SEQ ID NO: 9467390 - DNA, 22 bp, Homo sapiens
ggcagctgttggctctctagga

SEQ ID NO: 9467391 - DNA, 22 bp, Homo sapiens
ggcagctgttggctctctagga

SEQ ID NO: 9467392 - DNA, 19 bp, Homo sapiens
ggcagcttgggaaggtagc

SEQ ID NO: 9467393 - DNA, 22 bp, Homo sapiens
ggcagcttgtcctggaggatgg

SEQ ID NO: 9467394 - DNA, 23 bp, Homo sapiens
ggcagcttgttcctttgcttcca

SEQ ID NO: 9467395 - DNA, 22 bp, Homo sapiens
ggcagcttgtccttcaggagag

SEQ ID NO: 9467396 - DNA, 22 bp, Homo sapiens
ggcagcttgtccttcaggagag

SEQ ID NO: 9467397 - DNA, 22 bp, Homo sapiens
ggcagctttcaatagggttatg

SEQ ID NO: 9467398 - DNA, 22 bp, Homo sapiens
ggcagctttctcacccatgacc

SEQ ID NO: 9467399 - DNA, 22 bp, Homo sapiens
ggcagctttgagtcttagagta

SEQ ID NO: 9467400 - DNA, 22 bp, Homo sapiens
ggcagctttgccctcactgtcc

SEQ ID NO: 9467401 - DNA, 22 bp, Homo sapiens
ggcaggagaaaggtctcttctt

SEQ ID NO: 9467402 - DNA, 22 bp, Homo sapiens
ggcagcttgccctggtctcaac

SEQ ID NO: 9467403 - DNA, 22 bp, Homo sapiens
ggcagcttcggacggcttataa

SEQ ID NO: 9467404 - DNA, 22 bp, Homo sapiens
ggcagcttctcccaggctgttt

SEQ ID NO: 9467405 - DNA, 22 bp, Homo sapiens
ggcagctgtttgtcctcctgtt

SEQ ID NO: 9467406 - DNA, 22 bp, Homo sapiens
ggcagcttcctaggagagggca

SEQ ID NO: 9467407 - DNA, 23 bp, Homo sapiens
ggcagcttatactttcatagaca

SEQ ID NO: 9467408 - DNA, 23 bp, Homo sapiens
ggcagcttatactttcatagaca

SEQ ID NO: 9467409 - DNA, 22 bp, Homo sapiens
ggcactgattccattcatgaag

SEQ ID NO: 9467410 - DNA, 19 bp, Homo sapiens
ggcactggggccaggacca

SEQ ID NO: 9467411 - DNA, 22 bp, Homo sapiens
ggcactgggcaccggctgaggg

SEQ ID NO: 9467412 - DNA, 22 bp, Homo sapiens
ggcactgggcaccggctgaggg

SEQ ID NO: 9467413 - DNA, 22 bp, Homo sapiens
ggcactgggcaccggctgaggg

SEQ ID NO: 9467414 - DNA, 22 bp, Homo sapiens
ggatttacacacctgcctgtca

SEQ ID NO: 9467415 - DNA, 22 bp, Homo sapiens
ggatttacaagtttaactctca

SEQ ID NO: 9467416 - DNA, 22 bp, Homo sapiens
ggatttacccaatggatagatg

SEQ ID NO: 9467417 - DNA, 20 bp, Homo sapiens
ggatttacaggggaaaagtg

SEQ ID NO: 9467418 - DNA, 22 bp, Homo sapiens
ggattgcaacaagctagtttag

SEQ ID NO: 9467419 - DNA, 22 bp, Homo sapiens
ggatttactatcttgaaatata

SEQ ID NO: 9467420 - DNA, 22 bp, Homo sapiens
ggatttgggcttgcagcagagc

SEQ ID NO: 9467421 - DNA, 22 bp, Homo sapiens
ggcactttgattttgagatgca

SEQ ID NO: 9467422 - DNA, 22 bp, Homo sapiens
ggcactttgattttgagatgca

SEQ ID NO: 9467423 - DNA, 20 bp, Homo sapiens
ggcacttgatcccctggttc

SEQ ID NO: 9467424 - DNA, 22 bp, Homo sapiens
ggcacttgcttgctgcctttat

SEQ ID NO: 9467425 - DNA, 22 bp, Homo sapiens
ggcacttgcttgctgcctttat

SEQ ID NO: 9467426 - DNA, 18 bp, Homo sapiens
ggcactggtgatgcagag

SEQ ID NO: 9467427 - DNA, 22 bp, Homo sapiens
ggcactgtgtacacacagagac

SEQ ID NO: 9467428 - DNA, 18 bp, Homo sapiens
ggcactggtgatgcagag

SEQ ID NO: 9467429 - DNA, 22 bp, Homo sapiens
ggcactgggtgagggtcactgg

SEQ ID NO: 9467430 - DNA, 22 bp, Homo sapiens
ggcactgggtgagggtcactgg

SEQ ID NO: 9467431 - DNA, 19 bp, Homo sapiens
ggcactggggccaggacca

SEQ ID NO: 9467432 - DNA, 18 bp, Homo sapiens
ggcactggtgatgcagag

SEQ ID NO: 9467433 - DNA, 18 bp, Homo sapiens
ggcactggtgatgcagag

SEQ ID NO: 9467434 - DNA, 22 bp, Homo sapiens
ggcagaaggcctcccagctcct

SEQ ID NO: 9467435 - DNA, 22 bp, Homo sapiens
ggcagaaggcctcccagctcct

SEQ ID NO: 9467436 - DNA, 22 bp, Homo sapiens
ggcagaaggcaattagagactg

SEQ ID NO: 9467437 - DNA, 22 bp, Homo sapiens
ggcagaaggcaattagagactg

SEQ ID NO: 9467438 - DNA, 22 bp, Homo sapiens
ggcagaagataggacagggaat

SEQ ID NO: 9467439 - DNA, 22 bp, Homo sapiens
ggcagaagataggacagggaat

SEQ ID NO: 9467440 - DNA, 22 bp, Homo sapiens
ggcagaagaaaggctaagtctc

SEQ ID NO: 9467441 - DNA, 22 bp, Homo sapiens
ggcagaagaaaggctaagtctc

SEQ ID NO: 9467442 - DNA, 22 bp, Homo sapiens
ggcagaagaaaggctaagtctc

SEQ ID NO: 9467443 - DNA, 22 bp, Homo sapiens
ggcagcagacccctaagtctac

SEQ ID NO: 9467444 - DNA, 22 bp, Homo sapiens
ggcagaaggttgaagtaatttg

SEQ ID NO: 9467445 - DNA, 21 bp, Homo sapiens
ggcagaagtagcatggacggg

SEQ ID NO: 9467446 - DNA, 21 bp, Homo sapiens
ggcagaagtagcatggacggg

SEQ ID NO: 9467447 - DNA, 22 bp, Homo sapiens
ggcagcagcaaggttggagctg

SEQ ID NO: 9467448 - DNA, 20 bp, Homo sapiens
ggcagcaggagtttcctctt

SEQ ID NO: 9467449 - DNA, 22 bp, Homo sapiens
ggcagcaggagccatctggtag

SEQ ID NO: 9467450 - DNA, 22 bp, Homo sapiens
ggcagcaggagccatctggtag

SEQ ID NO: 9467451 - DNA, 22 bp, Homo sapiens
ggagatggctctgcaaggtcta

SEQ ID NO: 9467452 - DNA, 22 bp, Homo sapiens
ggagatggctctgcaaggtcta

SEQ ID NO: 9467453 - DNA, 22 bp, Homo sapiens
ggagatggccacgtcactcagt

SEQ ID NO: 9467454 - DNA, 22 bp, Homo sapiens
ggagatggccacgtcactcagt

SEQ ID NO: 9467455 - DNA, 22 bp, Homo sapiens
ggagatggctggcaggtagatg

SEQ ID NO: 9467456 - DNA, 22 bp, Homo sapiens
ggagatggctggcaggtagatg

SEQ ID NO: 9467457 - DNA, 22 bp, Homo sapiens
ggagatggctctgcaaggtcta

SEQ ID NO: 9467458 - DNA, 22 bp, Homo sapiens
ggagatggcaagaagttattag

SEQ ID NO: 9467459 - DNA, 22 bp, Homo sapiens
ggagatggccaaaaacacaaat

SEQ ID NO: 9467460 - DNA, 22 bp, Homo sapiens
ggagatggagtggattcagcag

SEQ ID NO: 9467461 - DNA, 21 bp, Homo sapiens
ggagatgggtatcgcctgggc

SEQ ID NO: 9467462 - DNA, 21 bp, Homo sapiens
ggagatgggtatcgcctgggc

SEQ ID NO: 9467463 - DNA, 22 bp, Homo sapiens
ggagatggtctgttctcatatt

SEQ ID NO: 9467464 - DNA, 22 bp, Homo sapiens
ggagatgggggattttacagcg

SEQ ID NO: 9467465 - DNA, 22 bp, Homo sapiens
ggagatggctggcaggtagatg

SEQ ID NO: 9467466 - DNA, 22 bp, Homo sapiens
ggagatggctggcaggtagatg

SEQ ID NO: 9467467 - DNA, 22 bp, Homo sapiens
ggagcaccctgctcagccaagc

SEQ ID NO: 9467468 - DNA, 22 bp, Homo sapiens
ggagcacctactttgataacta

SEQ ID NO: 9467469 - DNA, 22 bp, Homo sapiens
ggagcaagtcccaggcactagt

SEQ ID NO: 9467470 - DNA, 22 bp, Homo sapiens
ggagcacagccttgccagtacc

SEQ ID NO: 9467471 - DNA, 22 bp, Homo sapiens
ggagcaaatgccaagtgggagg

SEQ ID NO: 9467472 - DNA, 22 bp, Homo sapiens
ggagcaagaggtggtgaaaaat

SEQ ID NO: 9467473 - DNA, 22 bp, Homo sapiens
ggagatggtggaagctggtgca

SEQ ID NO: 9467474 - DNA, 22 bp, Homo sapiens
ggagatggtggaagctggtgca

SEQ ID NO: 9467475 - DNA, 22 bp, Homo sapiens
ggagatggtggaagctggtgca

SEQ ID NO: 9467476 - DNA, 21 bp, Homo sapiens
ggagatgggtatcgcctgggc

SEQ ID NO: 9467477 - DNA, 22 bp, Homo sapiens
ggatgaggaaaccacagtgtcc

SEQ ID NO: 9467478 - DNA, 22 bp, Homo sapiens
ggatgacagcaagggggtgaag

SEQ ID NO: 9467479 - DNA, 19 bp, Homo sapiens
ggatgagggtcaggcatag

SEQ ID NO: 9467480 - DNA, 19 bp, Homo sapiens
ggatgagggtcaggcatag

SEQ ID NO: 9467481 - DNA, 22 bp, Homo sapiens
ggatctggggctctgctgctca

SEQ ID NO: 9467482 - DNA, 22 bp, Homo sapiens
ggatctggggtagagcagtggg

SEQ ID NO: 9467483 - DNA, 22 bp, Homo sapiens
ggatctggggtagagcagtggg

SEQ ID NO: 9467484 - DNA, 22 bp, Homo sapiens
ggatctgttttgcctctgaggg

SEQ ID NO: 9467485 - DNA, 22 bp, Homo sapiens
ggagttggaggctccagggaac

SEQ ID NO: 9467486 - DNA, 22 bp, Homo sapiens
ggagcagagctgggcttggctg

SEQ ID NO: 9467487 - DNA, 22 bp, Homo sapiens
ggagcagagctgggcttggctg

SEQ ID NO: 9467488 - DNA, 22 bp, Homo sapiens
ggagcagagctgggcttggctg

SEQ ID NO: 9467489 - DNA, 17 bp, Homo sapiens
ggagcagatccaccatt

SEQ ID NO: 9467490 - DNA, 17 bp, Homo sapiens
ggagcagatccaccatt

SEQ ID NO: 9467491 - DNA, 17 bp, Homo sapiens
ggagcagatccaccatt

SEQ ID NO: 9467492 - DNA, 17 bp, Homo sapiens
ggagcagatccaccatt

SEQ ID NO: 9467493 - DNA, 22 bp, Homo sapiens
ggagcagagcatttcacagcct

SEQ ID NO: 9467494 - DNA, 22 bp, Homo sapiens
ggagcagacataaccttacaga

SEQ ID NO: 9467495 - DNA, 22 bp, Homo sapiens
ggagcagagcatttcacagcct

SEQ ID NO: 9467496 - DNA, 22 bp, Homo sapiens
ggagcagagcatttcacagcct

SEQ ID NO: 9467497 - DNA, 22 bp, Homo sapiens
ggagcagagctcttcatctgca

SEQ ID NO: 9467498 - DNA, 22 bp, Homo sapiens
ggagcagagctgggcttggctg

SEQ ID NO: 9467499 - DNA, 22 bp, Homo sapiens
ggagcagagctcttcatctgca

SEQ ID NO: 9467500 - DNA, 22 bp, Homo sapiens
ggagcagagcatttcacagcct

SEQ ID NO: 9467501 - DNA, 22 bp, Homo sapiens
ggagcagagctcttcatctgca

SEQ ID NO: 9467502 - DNA, 22 bp, Homo sapiens
ggatgcacgaaggcgcctcgga

SEQ ID NO: 9467503 - DNA, 22 bp, Homo sapiens
ggatgcaggaacacagcgacct

SEQ ID NO: 9467504 - DNA, 22 bp, Homo sapiens
ggatgaggtagatgaacaaggg

SEQ ID NO: 9467505 - DNA, 22 bp, Homo sapiens
ggatgaggtagatgaacaaggg

SEQ ID NO: 9467506 - DNA, 22 bp, Homo sapiens
ggatgaggtagatgaacaaggg

SEQ ID NO: 9467507 - DNA, 22 bp, Homo sapiens
ggatgaggtagatgaacaaggg

SEQ ID NO: 9467508 - DNA, 21 bp, Homo sapiens
ggatgccacgaagcaccagga

SEQ ID NO: 9467509 - DNA, 22 bp, Homo sapiens
ggatgccatcagagtgtctgtg

SEQ ID NO: 9467510 - DNA, 22 bp, Homo sapiens
ggatgccatttgggtctggctt

SEQ ID NO: 9467511 - DNA, 22 bp, Homo sapiens
ggatgcaggggcagcagagcct

SEQ ID NO: 9467512 - DNA, 22 bp, Homo sapiens
ggatgcaggagttgaagaagga

SEQ ID NO: 9467513 - DNA, 22 bp, Homo sapiens
ggatgcaggacggcatggatgt

SEQ ID NO: 9467514 - DNA, 22 bp, Homo sapiens
ggatgcaggagttgaagaagga

SEQ ID NO: 9467515 - DNA, 23 bp, Homo sapiens
ggatggacgtgatgccttagcca

SEQ ID NO: 9467516 - DNA, 22 bp, Homo sapiens
ggatgctgtctaagctgaggac

SEQ ID NO: 9467517 - DNA, 22 bp, Homo sapiens
ggatgctgtctaagctgaggac

SEQ ID NO: 9467518 - DNA, 22 bp, Homo sapiens
ggatgctgggagacagcaggca

SEQ ID NO: 9467519 - DNA, 22 bp, Homo sapiens
ggatgctgggagacagcaggca

SEQ ID NO: 9467520 - DNA, 22 bp, Homo sapiens
ggatgctgggagacagcaggca

SEQ ID NO: 9467521 - DNA, 22 bp, Homo sapiens
ggatgctgctatcaggcttcga

SEQ ID NO: 9467522 - DNA, 22 bp, Homo sapiens
ggatgctgctatcaggcttcga

SEQ ID NO: 9467523 - DNA, 22 bp, Homo sapiens
ggatgctgatatagagcattct

SEQ ID NO: 9467524 - DNA, 22 bp, Homo sapiens
ggatgctgatatagagcattct

SEQ ID NO: 9467525 - DNA, 23 bp, Homo sapiens
ggatggacgtgatgccttagcca

SEQ ID NO: 9467526 - DNA, 22 bp, Homo sapiens
ggatggagatgaccatggtgac

SEQ ID NO: 9467527 - DNA, 23 bp, Homo sapiens
ggatggagccactttgaaaccac

SEQ ID NO: 9467528 - DNA, 22 bp, Homo sapiens
ggatggagatgaccatggtgac

SEQ ID NO: 9467529 - DNA, 22 bp, Homo sapiens
ggatggagatgaccatggtgac

SEQ ID NO: 9467530 - DNA, 23 bp, Homo sapiens
ggatggagccactttgaaaccac

SEQ ID NO: 9467531 - DNA, 22 bp, Homo sapiens
ggatggaggttctcagatgctc

SEQ ID NO: 9467532 - DNA, 22 bp, Homo sapiens
ggatggaggttctcagatgctc

SEQ ID NO: 9467533 - DNA, 22 bp, Homo sapiens
ggatggaggttctcagatgctc

SEQ ID NO: 9467534 - DNA, 22 bp, Homo sapiens
ggatggcatgttgggctctgtt

SEQ ID NO: 9467535 - DNA, 22 bp, Homo sapiens
ggatggcagtctgcatgagaaa

SEQ ID NO: 9467536 - DNA, 21 bp, Homo sapiens
ggatggatagggaagagattt

SEQ ID NO: 9467537 - DNA, 20 bp, Homo sapiens
ggatggccggaccagagcct

SEQ ID NO: 9467538 - DNA, 22 bp, Homo sapiens
ggatggccttcttgctcaggaa

SEQ ID NO: 9467539 - DNA, 22 bp, Homo sapiens
ggatggctccagaaagcagggt

SEQ ID NO: 9467540 - DNA, 22 bp, Homo sapiens
ggatggctgtaaaaggtgggaa

SEQ ID NO: 9467541 - DNA, 22 bp, Homo sapiens
ggatggctgtaaaaggtgggaa

SEQ ID NO: 9467542 - DNA, 22 bp, Homo sapiens
ggatggcttgcatttgaggact

SEQ ID NO: 9467543 - DNA, 22 bp, Homo sapiens
ggatgggaacttggtagggcat

SEQ ID NO: 9467544 - DNA, 22 bp, Homo sapiens
ggattccatggtcaggaaatag

SEQ ID NO: 9467545 - DNA, 22 bp, Homo sapiens
ggattcagggtaaagtttcagt

SEQ ID NO: 9467546 - DNA, 22 bp, Homo sapiens
ggattctactgatcagcaccac

SEQ ID NO: 9467547 - DNA, 19 bp, Homo sapiens
ggattctgcagttttcaca

SEQ ID NO: 9467548 - DNA, 22 bp, Homo sapiens
ggattctgccttgttgcttcaa

SEQ ID NO: 9467549 - DNA, 22 bp, Homo sapiens
ggattaatgagggggttccggt

SEQ ID NO: 9467550 - DNA, 22 bp, Homo sapiens
ggattcagcgaggcagcctgga

SEQ ID NO: 9467551 - DNA, 22 bp, Homo sapiens
ggattcagcgaggcagcctgga

SEQ ID NO: 9467552 - DNA, 22 bp, Homo sapiens
ggattaagacctgtcagtacac

SEQ ID NO: 9467553 - DNA, 22 bp, Homo sapiens
ggatgttgattgaatggccatt

SEQ ID NO: 9467554 - DNA, 22 bp, Homo sapiens
ggcctggaagaggacagagaaa

SEQ ID NO: 9467555 - DNA, 22 bp, Homo sapiens
ggcctgctgggccccacagtcc

SEQ ID NO: 9467556 - DNA, 22 bp, Homo sapiens
ggcctgctggggcctcagacac

SEQ ID NO: 9467557 - DNA, 22 bp, Homo sapiens
ggcctgctggggcctcagacac

SEQ ID NO: 9467558 - DNA, 22 bp, Homo sapiens
ggcctgcttctcagtgagcttg

SEQ ID NO: 9467559 - DNA, 22 bp, Homo sapiens
ggcctgctgtagcttttgttct

SEQ ID NO: 9467560 - DNA, 22 bp, Homo sapiens
ggcctgctgtgtactgatgtca

SEQ ID NO: 9467561 - DNA, 19 bp, Homo sapiens
ggcctgcccaatgtctgct

SEQ ID NO: 9467562 - DNA, 22 bp, Homo sapiens
ggcctgcctcacagtcagcacc

SEQ ID NO: 9467563 - DNA, 22 bp, Homo sapiens
ggcctgctcagtcctctttctt

SEQ ID NO: 9467564 - DNA, 22 bp, Homo sapiens
ggcctgctattggtgggcagac

SEQ ID NO: 9467565 - DNA, 22 bp, Homo sapiens
ggcctgctctggctgtggtcag

SEQ ID NO: 9467566 - DNA, 22 bp, Homo sapiens
ggcctgctctggctgtggtcag

SEQ ID NO: 9467567 - DNA, 22 bp, Homo sapiens
ggcctgctctgcagcctctaca

SEQ ID NO: 9467568 - DNA, 22 bp, Homo sapiens
ggcctgctctgcagcctctaca

SEQ ID NO: 9467569 - DNA, 22 bp, Homo sapiens
ggcctgctccgggggctgagct

SEQ ID NO: 9467570 - DNA, 22 bp, Homo sapiens
ggcctgctgctggttagatggg

SEQ ID NO: 9467571 - DNA, 22 bp, Homo sapiens
ggcctgctgcagtgtgacagtt

SEQ ID NO: 9467572 - DNA, 22 bp, Homo sapiens
ggcctgctgcagtgtgacagtt

SEQ ID NO: 9467573 - DNA, 22 bp, Homo sapiens
ggcctgctgcagtgtgacagtt

SEQ ID NO: 9467574 - DNA, 22 bp, Homo sapiens
ggcctggagaaggcccagggag

SEQ ID NO: 9467575 - DNA, 22 bp, Homo sapiens
ggcctggagcagagactaggga

SEQ ID NO: 9467576 - DNA, 22 bp, Homo sapiens
ggcctggagcagagactaggga

SEQ ID NO: 9467577 - DNA, 22 bp, Homo sapiens
ggcctggagtcagggaaagcaa

SEQ ID NO: 9467578 - DNA, 22 bp, Homo sapiens
ggcctggagtttggggaataga

SEQ ID NO: 9467579 - DNA, 23 bp, Homo sapiens
ggcctggcccagggccctgatga

SEQ ID NO: 9467580 - DNA, 23 bp, Homo sapiens
ggcctggcccagggccctgatga

SEQ ID NO: 9467581 - DNA, 22 bp, Homo sapiens
ggcctggccctcccgggttcaa

SEQ ID NO: 9467582 - DNA, 22 bp, Homo sapiens
ggcctggctcttgcccagcctg

SEQ ID NO: 9467583 - DNA, 22 bp, Homo sapiens
ggcctggcctcccttcctagcg

SEQ ID NO: 9467584 - DNA, 19 bp, Homo sapiens
ggcctggctatccctgctg

SEQ ID NO: 9467585 - DNA, 19 bp, Homo sapiens
ggcctggctatccctgctg

SEQ ID NO: 9467586 - DNA, 22 bp, Homo sapiens
ggcgggtgtaagtaggacagcg

SEQ ID NO: 9467587 - DNA, 22 bp, Homo sapiens
ggcggtctcagcaccctcttgg

SEQ ID NO: 9467588 - DNA, 22 bp, Homo sapiens
ggcggtggcgtgaaggtggctg

SEQ ID NO: 9467589 - DNA, 22 bp, Homo sapiens
ggcctagggcttggtcatggca

SEQ ID NO: 9467590 - DNA, 22 bp, Homo sapiens
ggcctagggcttggtcatggca

SEQ ID NO: 9467591 - DNA, 21 bp, Homo sapiens
ggcctaggggcagatggtgct

SEQ ID NO: 9467592 - DNA, 22 bp, Homo sapiens
ggcctagggagtggccatgcct

SEQ ID NO: 9467593 - DNA, 22 bp, Homo sapiens
ggcctagttttttctggtaggt

SEQ ID NO: 9467594 - DNA, 21 bp, Homo sapiens
ggcctaggggcagatggtgct

SEQ ID NO: 9467595 - DNA, 22 bp, Homo sapiens
ggcctatgagaggcagcatgtt

SEQ ID NO: 9467596 - DNA, 22 bp, Homo sapiens
ggcctatgttcctgggctaggg

SEQ ID NO: 9467597 - DNA, 22 bp, Homo sapiens
ggcctcagaaatagagtaaaat

SEQ ID NO: 9467598 - DNA, 22 bp, Homo sapiens
ggcctagagcagggctaaggtc

SEQ ID NO: 9467599 - DNA, 22 bp, Homo sapiens
ggcctagaaacaagggggaatt

SEQ ID NO: 9467600 - DNA, 22 bp, Homo sapiens
ggcctagcctctcctgagagag

SEQ ID NO: 9467601 - DNA, 21 bp, Homo sapiens
ggccctggttacgcctcctct

SEQ ID NO: 9467602 - DNA, 22 bp, Homo sapiens
ggccgtgctccaaagtcatcgt

SEQ ID NO: 9467603 - DNA, 22 bp, Homo sapiens
ggccgtgctccaaagtcatcgt

SEQ ID NO: 9467604 - DNA, 22 bp, Homo sapiens
ggccctggcagccacgaaagcc

SEQ ID NO: 9467605 - DNA, 22 bp, Homo sapiens
ggccctggcagccacgaaagcc

SEQ ID NO: 9467606 - DNA, 22 bp, Homo sapiens
ggccctgggatgctcagcagtg

SEQ ID NO: 9467607 - DNA, 22 bp, Homo sapiens
ggccctgggatgctcagcagtg

SEQ ID NO: 9467608 - DNA, 22 bp, Homo sapiens
ggccctgggatgctcagcagtg

SEQ ID NO: 9467609 - DNA, 22 bp, Homo sapiens
ggccctgggatgctcagcagtg

SEQ ID NO: 9467610 - DNA, 22 bp, Homo sapiens
ggccctgggccctctagcttgt

SEQ ID NO: 9467611 - DNA, 22 bp, Homo sapiens
ggccctgggccctctagcttgt

SEQ ID NO: 9467612 - DNA, 22 bp, Homo sapiens
ggccctgggcagaggagtgggc

SEQ ID NO: 9467613 - DNA, 22 bp, Homo sapiens
ggccctgggcagaggagtgggc

SEQ ID NO: 9467614 - DNA, 22 bp, Homo sapiens
ggccctgggcagaggagtgggc

SEQ ID NO: 9467615 - DNA, 22 bp, Homo sapiens
ggccctggtcctaggggtggaa

SEQ ID NO: 9467616 - DNA, 22 bp, Homo sapiens
ggccctggtcctaggggtggaa

SEQ ID NO: 9467617 - DNA, 22 bp, Homo sapiens
ggccaggcgatgacccctccac

SEQ ID NO: 9467618 - DNA, 19 bp, Homo sapiens
ggccaggctgactgtggtc

SEQ ID NO: 9467619 - DNA, 22 bp, Homo sapiens
ggccctggcagccacgaaagcc

SEQ ID NO: 9467620 - DNA, 22 bp, Homo sapiens
ggccctggcagccacgaaagcc

SEQ ID NO: 9467621 - DNA, 22 bp, Homo sapiens
ggccctggcagccacgaaagcc

SEQ ID NO: 9467622 - DNA, 22 bp, Homo sapiens
ggccaggcgatgacccctccac

SEQ ID NO: 9467623 - DNA, 22 bp, Homo sapiens
ggccaggccaagagggttggaa

SEQ ID NO: 9467624 - DNA, 22 bp, Homo sapiens
ggccaggccaagagggttggaa

SEQ ID NO: 9467625 - DNA, 22 bp, Homo sapiens
ggccaggcactgtgtgagatat

SEQ ID NO: 9467626 - DNA, 22 bp, Homo sapiens
ggccaggaggcaggggctcaat

SEQ ID NO: 9467627 - DNA, 22 bp, Homo sapiens
ggccaggcactgtgtgagatat

SEQ ID NO: 9467628 - DNA, 22 bp, Homo sapiens
ggccaggcactgtgtgagatat

SEQ ID NO: 9467629 - DNA, 22 bp, Homo sapiens
ggccaggcactgtgtgagatat

SEQ ID NO: 9467630 - DNA, 22 bp, Homo sapiens
ggccaggaagggaagatcagca

SEQ ID NO: 9467631 - DNA, 22 bp, Homo sapiens
ggccaggaagggaagatcagca

SEQ ID NO: 9467632 - DNA, 22 bp, Homo sapiens
ggccaggagatggacaccacat

SEQ ID NO: 9467633 - DNA, 22 bp, Homo sapiens
ggccaggagaggagggcactga

SEQ ID NO: 9467634 - DNA, 22 bp, Homo sapiens
ggccaggagcaagccaggctct

SEQ ID NO: 9467635 - DNA, 22 bp, Homo sapiens
ggccaggagctgcacagggctc

SEQ ID NO: 9467636 - DNA, 22 bp, Homo sapiens
ggccaggagcaagccaggctct

SEQ ID NO: 9467637 - DNA, 22 bp, Homo sapiens
ggccaggaggcaggggctcaat

SEQ ID NO: 9467638 - DNA, 22 bp, Homo sapiens
ggccaggaggcaggggctcaat

SEQ ID NO: 9467639 - DNA, 22 bp, Homo sapiens
ggcagggtgtggagttgggaca

SEQ ID NO: 9467640 - DNA, 22 bp, Homo sapiens
ggcagggtgtggagttgggaca

SEQ ID NO: 9467641 - DNA, 22 bp, Homo sapiens
ggcagggtgtggagttgggaca

SEQ ID NO: 9467642 - DNA, 22 bp, Homo sapiens
ggcagggtgtggagttgggaca

SEQ ID NO: 9467643 - DNA, 22 bp, Homo sapiens
ggcagggtttctccattctgcc

SEQ ID NO: 9467644 - DNA, 22 bp, Homo sapiens
ggcaggtacagcaagaggacaa

SEQ ID NO: 9467645 - DNA, 22 bp, Homo sapiens
ggcaggtagcctagaggaggtt

SEQ ID NO: 9467646 - DNA, 19 bp, Homo sapiens
ggcaggtagagggccagtc

SEQ ID NO: 9467647 - DNA, 17 bp, Homo sapiens
ggcagggtgctgggtat

SEQ ID NO: 9467648 - DNA, 17 bp, Homo sapiens
ggcagggtgctgggtat

SEQ ID NO: 9467649 - DNA, 17 bp, Homo sapiens
ggcagggtgctgggtat

SEQ ID NO: 9467650 - DNA, 22 bp, Homo sapiens
ggcagggtggcagaggctcaga

SEQ ID NO: 9467651 - DNA, 22 bp, Homo sapiens
ggcaggtgagagctctttgaaa

SEQ ID NO: 9467652 - DNA, 22 bp, Homo sapiens
ggcagtgggtggatctcaggga

SEQ ID NO: 9467653 - DNA, 22 bp, Homo sapiens
ggcaggtgacggggatgagtat

SEQ ID NO: 9467654 - DNA, 22 bp, Homo sapiens
ggcaggtgacggggatgagtat

SEQ ID NO: 9467655 - DNA, 22 bp, Homo sapiens
ggcaggtgacggggatgagtat

SEQ ID NO: 9467656 - DNA, 22 bp, Homo sapiens
ggcaggtgacctggcctcccag

SEQ ID NO: 9467657 - DNA, 17 bp, Homo sapiens
ggcaggtgacagacacc

SEQ ID NO: 9467658 - DNA, 17 bp, Homo sapiens
ggcaggtgacagacacc

SEQ ID NO: 9467659 - DNA, 22 bp, Homo sapiens
ggcaggtagcctagaggaggtt

SEQ ID NO: 9467660 - DNA, 22 bp, Homo sapiens
ggcaggagctctccagtttgcc

SEQ ID NO: 9467661 - DNA, 22 bp, Homo sapiens
ggcaggaggaagagttagcacc

SEQ ID NO: 9467662 - DNA, 18 bp, Homo sapiens
ggcaggggtgaaccacag

SEQ ID NO: 9467663 - DNA, 18 bp, Homo sapiens
ggcaggagcaagaatagg

SEQ ID NO: 9467664 - DNA, 18 bp, Homo sapiens
ggcaggagcaagaatagg

SEQ ID NO: 9467665 - DNA, 22 bp, Homo sapiens
ggcaggagctcaggttggttcc

SEQ ID NO: 9467666 - DNA, 22 bp, Homo sapiens
ggcaggagaatggcgtgaactc

SEQ ID NO: 9467667 - DNA, 22 bp, Homo sapiens
ggcagggtccacacctgggaaa

SEQ ID NO: 9467668 - DNA, 22 bp, Homo sapiens
ggcagggtaaaccgaggtaagt

SEQ ID NO: 9467669 - DNA, 22 bp, Homo sapiens
ggcagggtctggactgaaagct

SEQ ID NO: 9467670 - DNA, 22 bp, Homo sapiens
ggcaggggttcattttgtctta

SEQ ID NO: 9467671 - DNA, 22 bp, Homo sapiens
ggcaggggttcattttgtctta

SEQ ID NO: 9467672 - DNA, 22 bp, Homo sapiens
ggcaggggttcattttgtctta

SEQ ID NO: 9467673 - DNA, 22 bp, Homo sapiens
ggcaggggtggccttcctttgg

SEQ ID NO: 9467674 - DNA, 22 bp, Homo sapiens
ggcaggggtggccttcctttgg

SEQ ID NO: 9467675 - DNA, 22 bp, Homo sapiens
ggcaggggtgaggccactctga

SEQ ID NO: 9467676 - DNA, 22 bp, Homo sapiens
ggcaggggtgaggccactctga

SEQ ID NO: 9467677 - DNA, 22 bp, Homo sapiens
ggcaggggtgaggccactctga

SEQ ID NO: 9467678 - DNA, 22 bp, Homo sapiens
ggcaggggtgaggccactctga

SEQ ID NO: 9467679 - DNA, 18 bp, Homo sapiens
ggcaggggtgaaccacag

SEQ ID NO: 9467680 - DNA, 22 bp, Homo sapiens
ggcaggggtgaggccactctga

SEQ ID NO: 9467681 - DNA, 22 bp, Homo sapiens
ggccagctttgagctgcaggaa

SEQ ID NO: 9467682 - DNA, 22 bp, Homo sapiens
ggccagctttgagctgcaggaa

SEQ ID NO: 9467683 - DNA, 22 bp, Homo sapiens
ggccagctttctgtcttctagg

SEQ ID NO: 9467684 - DNA, 22 bp, Homo sapiens
ggccagctttctgtcttctagg

SEQ ID NO: 9467685 - DNA, 22 bp, Homo sapiens
ggccaggaacttttgggatggg

SEQ ID NO: 9467686 - DNA, 22 bp, Homo sapiens
ggccagcttctctgctgcctgt

SEQ ID NO: 9467687 - DNA, 22 bp, Homo sapiens
ggccagcttctggacaaagtcc

SEQ ID NO: 9467688 - DNA, 22 bp, Homo sapiens
ggccagcttctggacaaagtcc

SEQ ID NO: 9467689 - DNA, 22 bp, Homo sapiens
ggccagcttctctgctgcctgt

SEQ ID NO: 9467690 - DNA, 22 bp, Homo sapiens
ggccagcttattagctcagagg

SEQ ID NO: 9467691 - DNA, 22 bp, Homo sapiens
ggccagcttattagctcagagg

SEQ ID NO: 9467692 - DNA, 22 bp, Homo sapiens
ggccagctgtgggattttctgc

SEQ ID NO: 9467693 - DNA, 22 bp, Homo sapiens
ggccagctgtgggattttctgc

SEQ ID NO: 9467694 - DNA, 22 bp, Homo sapiens
ggccagctgtggggccgagcct

SEQ ID NO: 9467695 - DNA, 22 bp, Homo sapiens
ggccagctgtaagctgctgaat

SEQ ID NO: 9467696 - DNA, 19 bp, Homo sapiens
ggccagctgtctcctgcta

SEQ ID NO: 9467697 - DNA, 19 bp, Homo sapiens
ggccagctgtctcctgcta

SEQ ID NO: 9467698 - DNA, 22 bp, Homo sapiens
ggcatgcatgcatgcacctgtg

SEQ ID NO: 9467699 - DNA, 22 bp, Homo sapiens
ggcatgctgcgtacagatgaac

SEQ ID NO: 9467700 - DNA, 22 bp, Homo sapiens
ggcatgctctgggggtcctccg

SEQ ID NO: 9467701 - DNA, 22 bp, Homo sapiens
ggccagctgggccaccaggtgc

SEQ ID NO: 9467702 - DNA, 22 bp, Homo sapiens
ggcatgcttctgagatgtctcc

SEQ ID NO: 9467703 - DNA, 22 bp, Homo sapiens
ggccagctgggccaccaggtgc

SEQ ID NO: 9467704 - DNA, 22 bp, Homo sapiens
ggccagctgtaagctgctgaat

SEQ ID NO: 9467705 - DNA, 22 bp, Homo sapiens
ggccagctgtaagctgctgaat

SEQ ID NO: 9467706 - DNA, 22 bp, Homo sapiens
ggcatgcatcaccacgccacgc

SEQ ID NO: 9467707 - DNA, 22 bp, Homo sapiens
ggcatgagtggcagtgggcagt

SEQ ID NO: 9467708 - DNA, 22 bp, Homo sapiens
ggcatgagtggcagtgggcagt

SEQ ID NO: 9467709 - DNA, 22 bp, Homo sapiens
ggcatgagtaacgtgagtgagg

SEQ ID NO: 9467710 - DNA, 22 bp, Homo sapiens
ggcatgagtaacgtgagtgagg

SEQ ID NO: 9467711 - DNA, 22 bp, Homo sapiens
ggcatccaaataccaagatgta

SEQ ID NO: 9467712 - DNA, 22 bp, Homo sapiens
ggcatccaaataccaagatgta

SEQ ID NO: 9467713 - DNA, 20 bp, Homo sapiens
ggcatccttttggtcacagc

SEQ ID NO: 9467714 - DNA, 20 bp, Homo sapiens
ggcatccttctgacccagag

SEQ ID NO: 9467715 - DNA, 22 bp, Homo sapiens
ggcatccagttctgatcaacaa

SEQ ID NO: 9467716 - DNA, 22 bp, Homo sapiens
ggcatctcgcattcttgtttct

SEQ ID NO: 9467717 - DNA, 21 bp, Homo sapiens
ggcatgagggcagtgagcaga

SEQ ID NO: 9467718 - DNA, 22 bp, Homo sapiens
ggcatgagcacgaagtggtacc

SEQ ID NO: 9467719 - DNA, 21 bp, Homo sapiens
ggcatgagggcagtgagcaga

SEQ ID NO: 9467720 - DNA, 21 bp, Homo sapiens
ggcatgagggcagtgagcaga

SEQ ID NO: 9467721 - DNA, 20 bp, Homo sapiens
ggcatgagatgtgagggagg

SEQ ID NO: 9467722 - DNA, 20 bp, Homo sapiens
ggcatgagatgtgagggagg

SEQ ID NO: 9467723 - DNA, 20 bp, Homo sapiens
ggcatgagatgtgagggagg

SEQ ID NO: 9467724 - DNA, 22 bp, Homo sapiens
ggcatgagaggtcctggggatt

SEQ ID NO: 9467725 - DNA, 22 bp, Homo sapiens
ggcatgagaggtcctggggatt

SEQ ID NO: 9467726 - DNA, 22 bp, Homo sapiens
ggcatcttgttgctcaaatcta

SEQ ID NO: 9467727 - DNA, 18 bp, Homo sapiens
ggcatctgcacagcagcc

SEQ ID NO: 9467728 - DNA, 22 bp, Homo sapiens
ggcatctggatctgcttctccc

SEQ ID NO: 9467729 - DNA, 22 bp, Homo sapiens
ggcatctgtccatctctccagc

SEQ ID NO: 9467730 - DNA, 20 bp, Homo sapiens
ggtgcaggtaacgctgtgct

SEQ ID NO: 9467731 - DNA, 21 bp, Homo sapiens
ggtgcaggtaatgatgatata

SEQ ID NO: 9467732 - DNA, 20 bp, Homo sapiens
ggtgcaggtaacgctgtgct

SEQ ID NO: 9467733 - DNA, 22 bp, Homo sapiens
ggtgcatgtgagaaagactggg

SEQ ID NO: 9467734 - DNA, 22 bp, Homo sapiens
ggtgcagggagaggcaggcccc

SEQ ID NO: 9467735 - DNA, 22 bp, Homo sapiens
ggtgcagggagaggcaggcccc

SEQ ID NO: 9467736 - DNA, 22 bp, Homo sapiens
ggtgcagggagaggcaggcccc

SEQ ID NO: 9467737 - DNA, 22 bp, Homo sapiens
ggtgcagggagaggcaggcccc

SEQ ID NO: 9467738 - DNA, 22 bp, Homo sapiens
ggtgcagggagaggcaggcccc

SEQ ID NO: 9467739 - DNA, 22 bp, Homo sapiens
ggtgcagggagaggcaggcccc

SEQ ID NO: 9467740 - DNA, 22 bp, Homo sapiens
ggtgcaggcggtggggcaagta

SEQ ID NO: 9467741 - DNA, 22 bp, Homo sapiens
ggtgaattctcagcttttacaa

SEQ ID NO: 9467742 - DNA, 22 bp, Homo sapiens
ggtgaagtaatgaaacagggag

SEQ ID NO: 9467743 - DNA, 22 bp, Homo sapiens
ggtgaataagctgaacacttgg

SEQ ID NO: 9467744 - DNA, 22 bp, Homo sapiens
ggtgaagtatgaggaaatggag

SEQ ID NO: 9467745 - DNA, 22 bp, Homo sapiens
ggtgaattaatgatggtaaggc

SEQ ID NO: 9467746 - DNA, 22 bp, Homo sapiens
ggtgaagggccttaggagacag

SEQ ID NO: 9467747 - DNA, 22 bp, Homo sapiens
ggtgaaggcacaagagggcaag

SEQ ID NO: 9467748 - DNA, 22 bp, Homo sapiens
ggtgaagggccttaggagacag

SEQ ID NO: 9467749 - DNA, 22 bp, Homo sapiens
ggtgaagcgtatttgtggagct

SEQ ID NO: 9467750 - DNA, 22 bp, Homo sapiens
ggtgaaggcacaagagggcaag

SEQ ID NO: 9467751 - DNA, 22 bp, Homo sapiens
ggtgaaggtggaacgcagagca

SEQ ID NO: 9467752 - DNA, 22 bp, Homo sapiens
ggtgaagtaataccaggtgtac

SEQ ID NO: 9467753 - DNA, 22 bp, Homo sapiens
ggtgaaggtctactgtgtgcca

SEQ ID NO: 9467754 - DNA, 22 bp, Homo sapiens
ggtgaaggtggaacgcagagca

SEQ ID NO: 9467755 - DNA, 22 bp, Homo sapiens
ggtgaaggtcagagcaggaaaa

SEQ ID NO: 9467756 - DNA, 22 bp, Homo sapiens
ggtgaaggtcagagcaggaaaa

SEQ ID NO: 9467757 - DNA, 22 bp, Homo sapiens
ggtgaaggtcagagcaggaaaa

SEQ ID NO: 9467758 - DNA, 22 bp, Homo sapiens
ggtcttgtttatataaggtggt

SEQ ID NO: 9467759 - DNA, 22 bp, Homo sapiens
ggtctttctttgatagtggaga

SEQ ID NO: 9467760 - DNA, 22 bp, Homo sapiens
ggtgaacattgatgtggttaca

SEQ ID NO: 9467761 - DNA, 22 bp, Homo sapiens
ggtgaagcgtatttgtggagct

SEQ ID NO: 9467762 - DNA, 21 bp, Homo sapiens
ggtcttccaaataaggagaaa

SEQ ID NO: 9467763 - DNA, 21 bp, Homo sapiens
ggtcttcccactgtctggtga

SEQ ID NO: 9467764 - DNA, 22 bp, Homo sapiens
ggtcttccgagaggcctgtgct

SEQ ID NO: 9467765 - DNA, 22 bp, Homo sapiens
ggtcttctctatgagctggtct

SEQ ID NO: 9467766 - DNA, 22 bp, Homo sapiens
ggtctgtgtgctttgggaagtg

SEQ ID NO: 9467767 - DNA, 17 bp, Homo sapiens
ggtctgtgtctagggaa

SEQ ID NO: 9467768 - DNA, 22 bp, Homo sapiens
ggtcccaagcaatgcccttggc

SEQ ID NO: 9467769 - DNA, 22 bp, Homo sapiens
ggtccatgataggaagttccga

SEQ ID NO: 9467770 - DNA, 22 bp, Homo sapiens
ggtctggcctcgggcaccccca

SEQ ID NO: 9467771 - DNA, 22 bp, Homo sapiens
ggtctggcctggcattctatgg

SEQ ID NO: 9467772 - DNA, 22 bp, Homo sapiens
ggtctggcctcgggcaccccca

SEQ ID NO: 9467773 - DNA, 22 bp, Homo sapiens
ggtctgtgtcataggctgagtt

SEQ ID NO: 9467774 - DNA, 22 bp, Homo sapiens
ggtctgtgatcttatggattct

SEQ ID NO: 9467775 - DNA, 22 bp, Homo sapiens
ggtctgtgctctggagcctctg

SEQ ID NO: 9467776 - DNA, 17 bp, Homo sapiens
ggtctggggccattggc

SEQ ID NO: 9467777 - DNA, 22 bp, Homo sapiens
ggtgggcaacatttggcctgag

SEQ ID NO: 9467778 - DNA, 22 bp, Homo sapiens
ggtgggcaacatttggcctgag

SEQ ID NO: 9467779 - DNA, 22 bp, Homo sapiens
ggtgggatgcctctggagaagt

SEQ ID NO: 9467780 - DNA, 21 bp, Homo sapiens
ggtgggcacaggagagcagag

SEQ ID NO: 9467781 - DNA, 21 bp, Homo sapiens
ggtgggcacaggagagcagag

SEQ ID NO: 9467782 - DNA, 22 bp, Homo sapiens
ggtgggcaacatttggcctgag

SEQ ID NO: 9467783 - DNA, 16 bp, Homo sapiens
ggtgggaggtgaggtg

SEQ ID NO: 9467784 - DNA, 16 bp, Homo sapiens
ggtgggaggtgaggtg

SEQ ID NO: 9467785 - DNA, 16 bp, Homo sapiens
ggtgggaggtgaggtg

SEQ ID NO: 9467786 - DNA, 16 bp, Homo sapiens
ggtgggaggtgaggtg

SEQ ID NO: 9467787 - DNA, 22 bp, Homo sapiens
ggtgggagtggaacgtggaaga

SEQ ID NO: 9467788 - DNA, 22 bp, Homo sapiens
ggtgggagtggaacgtggaaga

SEQ ID NO: 9467789 - DNA, 22 bp, Homo sapiens
ggtgggagtggaacgtggaaga

SEQ ID NO: 9467790 - DNA, 22 bp, Homo sapiens
ggtgggaggcaggctgctccca

SEQ ID NO: 9467791 - DNA, 22 bp, Homo sapiens
ggtgggaggcaggctgctccca

SEQ ID NO: 9467792 - DNA, 22 bp, Homo sapiens
ggtgggagggctgcgttcctct

SEQ ID NO: 9467793 - DNA, 22 bp, Homo sapiens
ggtgggagggctgcgttcctct

SEQ ID NO: 9467794 - DNA, 22 bp, Homo sapiens
ggtgggagccaacacccttctg

SEQ ID NO: 9467795 - DNA, 22 bp, Homo sapiens
ggtgggaggactgtttgaggca

SEQ ID NO: 9467796 - DNA, 22 bp, Homo sapiens
ggtggctgcaatggctaacttc

SEQ ID NO: 9467797 - DNA, 22 bp, Homo sapiens
ggtggctgaatcaaatcaggcc

SEQ ID NO: 9467798 - DNA, 22 bp, Homo sapiens
ggtggctgaatcaaatcaggcc

SEQ ID NO: 9467799 - DNA, 22 bp, Homo sapiens
ggtgggagagctctgtctccag

SEQ ID NO: 9467800 - DNA, 22 bp, Homo sapiens
ggtgggagagctctgtctccag

SEQ ID NO: 9467801 - DNA, 22 bp, Homo sapiens
ggtgggagagcttgctttgatg

SEQ ID NO: 9467802 - DNA, 22 bp, Homo sapiens
ggtgccaggctcccagctcagg

SEQ ID NO: 9467803 - DNA, 22 bp, Homo sapiens
ggtgccagcctagtgcagtggt

SEQ ID NO: 9467804 - DNA, 22 bp, Homo sapiens
ggtgccaggctcccagctcagg

SEQ ID NO: 9467805 - DNA, 22 bp, Homo sapiens
ggtgccagtgggtctcaggata

SEQ ID NO: 9467806 - DNA, 22 bp, Homo sapiens
ggtgccagtgggtctcaggata

SEQ ID NO: 9467807 - DNA, 22 bp, Homo sapiens
ggtgccagagtggcccaggggc

SEQ ID NO: 9467808 - DNA, 22 bp, Homo sapiens
ggtgccagagtggcccaggggc

SEQ ID NO: 9467809 - DNA, 23 bp, Homo sapiens
ggtgccaagcttctatgtttagc

SEQ ID NO: 9467810 - DNA, 22 bp, Homo sapiens
ggtgccaatttatttagccaag

SEQ ID NO: 9467811 - DNA, 22 bp, Homo sapiens
ggtgccagatgaggcccgcgat

SEQ ID NO: 9467812 - DNA, 22 bp, Homo sapiens
ggtggctgaagcagtcttcggg

SEQ ID NO: 9467813 - DNA, 22 bp, Homo sapiens
ggtggctgaagcagtcttcggg

SEQ ID NO: 9467814 - DNA, 22 bp, Homo sapiens
ggtggctctgttgtcaactgat

SEQ ID NO: 9467815 - DNA, 22 bp, Homo sapiens
ggtgctcaagagggcatcctct

SEQ ID NO: 9467816 - DNA, 22 bp, Homo sapiens
ggtgcggagactccatgaggcc

SEQ ID NO: 9467817 - DNA, 20 bp, Homo sapiens
ggtgcgaggccagagcagac

SEQ ID NO: 9467818 - DNA, 22 bp, Homo sapiens
ggtgcccagcgaagtggctgtg

SEQ ID NO: 9467819 - DNA, 22 bp, Homo sapiens
ggtgcccgccggcaaccctcgg

SEQ ID NO: 9467820 - DNA, 22 bp, Homo sapiens
ggtgcccagagccaggaatgag

SEQ ID NO: 9467821 - DNA, 22 bp, Homo sapiens
ggtgcccacctgtcttcctgga

SEQ ID NO: 9467822 - DNA, 22 bp, Homo sapiens
ggtgcctgatggtgatgaggtc

SEQ ID NO: 9467823 - DNA, 19 bp, Homo sapiens
ggtagaagggaagtgtttt

SEQ ID NO: 9467824 - DNA, 22 bp, Homo sapiens
ggtaccaccaattcagctgcca

SEQ ID NO: 9467825 - DNA, 22 bp, Homo sapiens
ggtaccaccaattcagctgcca

SEQ ID NO: 9467826 - DNA, 22 bp, Homo sapiens
ggtaccaccaattcagctgcca

SEQ ID NO: 9467827 - DNA, 22 bp, Homo sapiens
ggtaccaccaattcagctgcca

SEQ ID NO: 9467828 - DNA, 22 bp, Homo sapiens
ggtaataaaattgtgtcaaaca

SEQ ID NO: 9467829 - DNA, 22 bp, Homo sapiens
ggtaataagatctgttacatgg

SEQ ID NO: 9467830 - DNA, 22 bp, Homo sapiens
ggtaataagatctgttacatgg

SEQ ID NO: 9467831 - DNA, 22 bp, Homo sapiens
ggtaataagatctgttacatgg

SEQ ID NO: 9467832 - DNA, 22 bp, Homo sapiens
ggtaattagattgattaaattg

SEQ ID NO: 9467833 - DNA, 22 bp, Homo sapiens
ggtacaatgtcttacagaccca

SEQ ID NO: 9467834 - DNA, 22 bp, Homo sapiens
ggtacaaagttagatttaactt

SEQ ID NO: 9467835 - DNA, 22 bp, Homo sapiens
ggtaagcacttcatgtacatga

SEQ ID NO: 9467836 - DNA, 22 bp, Homo sapiens
ggtaacttagctcatggctgtg

SEQ ID NO: 9467837 - DNA, 22 bp, Homo sapiens
ggtaacttagctcatggctgtg

SEQ ID NO: 9467838 - DNA, 22 bp, Homo sapiens
ggtaacttagctcatggctgtg

SEQ ID NO: 9467839 - DNA, 22 bp, Homo sapiens
ggtaacaaccctacaaatccac

SEQ ID NO: 9467840 - DNA, 22 bp, Homo sapiens
ggtaacaaggccgatagaaaca

SEQ ID NO: 9467841 - DNA, 22 bp, Homo sapiens
ggtaacagtatgtagagtaaga

SEQ ID NO: 9467842 - DNA, 22 bp, Homo sapiens
ggtaacagttacagtaacagta

SEQ ID NO: 9467843 - DNA, 22 bp, Homo sapiens
gggtccagatggtgagagttaa

SEQ ID NO: 9467844 - DNA, 22 bp, Homo sapiens
gggtccagcgacagcaggctca

SEQ ID NO: 9467845 - DNA, 22 bp, Homo sapiens
ggtaaaaatcacaaatacttta

SEQ ID NO: 9467846 - DNA, 22 bp, Homo sapiens
ggtaaaaatcacaaatacttta

SEQ ID NO: 9467847 - DNA, 22 bp, Homo sapiens
ggtaaaatgcagattcttagcc

SEQ ID NO: 9467848 - DNA, 22 bp, Homo sapiens
gggtccacctgagcagcagcct

SEQ ID NO: 9467849 - DNA, 22 bp, Homo sapiens
gggtcagggctgcctgggctca

SEQ ID NO: 9467850 - DNA, 22 bp, Homo sapiens
gggtcagggctggctgtcgtca

SEQ ID NO: 9467851 - DNA, 22 bp, Homo sapiens
gggtcagggctggctgtcgtca

SEQ ID NO: 9467852 - DNA, 22 bp, Homo sapiens
gggtccagacactccagaggaa

SEQ ID NO: 9467853 - DNA, 22 bp, Homo sapiens
gggtccagagttgaagaggtta

SEQ ID NO: 9467854 - DNA, 23 bp, Homo sapiens
gggtccagagacaggcatgggtg

SEQ ID NO: 9467855 - DNA, 23 bp, Homo sapiens
gggtccagagacaggcatgggtg

SEQ ID NO: 9467856 - DNA, 22 bp, Homo sapiens
gggtcaggctcagcagggcagc

SEQ ID NO: 9467857 - DNA, 22 bp, Homo sapiens
gggtcagggctgcctgggctca

SEQ ID NO: 9467858 - DNA, 22 bp, Homo sapiens
gggtcaggcctcaaggtgggct

SEQ ID NO: 9467859 - DNA, 22 bp, Homo sapiens
gggtcaggctagcccagacttc

SEQ ID NO: 9467860 - DNA, 22 bp, Homo sapiens
gggtcaggctagcccagacttc

SEQ ID NO: 9467861 - DNA, 22 bp, Homo sapiens
gggtcaggcctcaaggtgggct

SEQ ID NO: 9467862 - DNA, 22 bp, Homo sapiens
gggtcaggcctcaaggtgggct

SEQ ID NO: 9467863 - DNA, 22 bp, Homo sapiens
ggtcagggtataatcaagtgag

SEQ ID NO: 9467864 - DNA, 22 bp, Homo sapiens
ggtcagggggatctgtgaggta

SEQ ID NO: 9467865 - DNA, 22 bp, Homo sapiens
ggtcagggggatctgtgaggta

SEQ ID NO: 9467866 - DNA, 18 bp, Homo sapiens
ggtcaggggcggagagaa

SEQ ID NO: 9467867 - DNA, 22 bp, Homo sapiens
ggtccagccaggtgctcatgcc

SEQ ID NO: 9467868 - DNA, 23 bp, Homo sapiens
ggtccaggaaaggcagcagcacc

SEQ ID NO: 9467869 - DNA, 23 bp, Homo sapiens
ggtccaggaaaggcagcagcacc

SEQ ID NO: 9467870 - DNA, 23 bp, Homo sapiens
ggtccaggaaaggcagcagcacc

SEQ ID NO: 9467871 - DNA, 22 bp, Homo sapiens
ggtccaggtatgtggtgtgaat

SEQ ID NO: 9467872 - DNA, 22 bp, Homo sapiens
ggtccaggtcctgtgacagcag

SEQ ID NO: 9467873 - DNA, 22 bp, Homo sapiens
ggtccaggtttgctctacttgt

SEQ ID NO: 9467874 - DNA, 22 bp, Homo sapiens
ggtccaggatcaaggcatcacc

SEQ ID NO: 9467875 - DNA, 22 bp, Homo sapiens
ggtccagggaactttgaaggat

SEQ ID NO: 9467876 - DNA, 20 bp, Homo sapiens
ggtagcagctgctgtcatcc

SEQ ID NO: 9467877 - DNA, 22 bp, Homo sapiens
ggtagcagggctgtgagtcaga

SEQ ID NO: 9467878 - DNA, 22 bp, Homo sapiens
ggtagactgtcaaacactagcc

SEQ ID NO: 9467879 - DNA, 20 bp, Homo sapiens
ggtagctgctgcagttggta

SEQ ID NO: 9467880 - DNA, 22 bp, Homo sapiens
ggtagctgcagcaggctggcaa

SEQ ID NO: 9467881 - DNA, 20 bp, Homo sapiens
ggtagctgctgcagttggta

SEQ ID NO: 9467882 - DNA, 20 bp, Homo sapiens
ggtagctgctgcagttggta

SEQ ID NO: 9467883 - DNA, 22 bp, Homo sapiens
ggtaggagtgaagacttaagat

SEQ ID NO: 9467884 - DNA, 22 bp, Homo sapiens
ggtaggagtattttgcagcagt

SEQ ID NO: 9467885 - DNA, 22 bp, Homo sapiens
ggtaggaagatagagcaaagtt

SEQ ID NO: 9467886 - DNA, 22 bp, Homo sapiens
ggtaggagtattttgcagcagt

SEQ ID NO: 9467887 - DNA, 22 bp, Homo sapiens
ggtcaggatccaagtctgtgct

SEQ ID NO: 9467888 - DNA, 22 bp, Homo sapiens
ggtcaggatccaagtctgtgct

SEQ ID NO: 9467889 - DNA, 19 bp, Homo sapiens
ggtcaggaatttgacaata

SEQ ID NO: 9467890 - DNA, 22 bp, Homo sapiens
ggtcagccttggatttggtagc

SEQ ID NO: 9467891 - DNA, 20 bp, Homo sapiens
ggtcagcctggggctccagg

SEQ ID NO: 9467892 - DNA, 22 bp, Homo sapiens
ggtcagccttggatttggtagc

SEQ ID NO: 9467893 - DNA, 22 bp, Homo sapiens
ggtcagcagtttctttgaattt

SEQ ID NO: 9467894 - DNA, 22 bp, Homo sapiens
ggtcagcatctggttgagggca

SEQ ID NO: 9467895 - DNA, 22 bp, Homo sapiens
ggtcagcatctggttgagggca

SEQ ID NO: 9467896 - DNA, 22 bp, Homo sapiens
ggtcagcccctgctcaaggccg

SEQ ID NO: 9467897 - DNA, 22 bp, Homo sapiens
ggggcaggagcccttcttcagc

SEQ ID NO: 9467898 - DNA, 22 bp, Homo sapiens
ggggcaggagcccttcttcagc

SEQ ID NO: 9467899 - DNA, 22 bp, Homo sapiens
ggggcaggagcccttcttcagc

SEQ ID NO: 9467900 - DNA, 22 bp, Homo sapiens
ggggcaggagcccttcttcagc

SEQ ID NO: 9467901 - DNA, 22 bp, Homo sapiens
ggggcagctcccgagggcagga

SEQ ID NO: 9467902 - DNA, 22 bp, Homo sapiens
ggggcaggagcccttcttcagc

SEQ ID NO: 9467903 - DNA, 22 bp, Homo sapiens
ggggcaggaggtgttctctttt

SEQ ID NO: 9467904 - DNA, 22 bp, Homo sapiens
ggggctgttgaagttagttgag

SEQ ID NO: 9467905 - DNA, 22 bp, Homo sapiens
ggggctgtttttggaatggctg

SEQ ID NO: 9467906 - DNA, 22 bp, Homo sapiens
ggggcttctttctgccaccgac

SEQ ID NO: 9467907 - DNA, 22 bp, Homo sapiens
ggggcttccagcgcccgccggt

SEQ ID NO: 9467908 - DNA, 22 bp, Homo sapiens
gggggaagaaagaacatggcat

SEQ ID NO: 9467909 - DNA, 22 bp, Homo sapiens
gggggaaatagaaatgcttaga

SEQ ID NO: 9467910 - DNA, 22 bp, Homo sapiens
gggggaagaaagaacatggcat

SEQ ID NO: 9467911 - DNA, 22 bp, Homo sapiens
gggggaagaaagaacatggcat

SEQ ID NO: 9467912 - DNA, 22 bp, Homo sapiens
gggggaagactgggctagtgat

SEQ ID NO: 9467913 - DNA, 22 bp, Homo sapiens
gggggaagactgggctagtgat

SEQ ID NO: 9467914 - DNA, 22 bp, Homo sapiens
gggggaagactgggctagtgat

SEQ ID NO: 9467915 - DNA, 22 bp, Homo sapiens
gggggaagactgggctagtgat

SEQ ID NO: 9467916 - DNA, 22 bp, Homo sapiens
gggggaagactgggctagtgat

SEQ ID NO: 9467917 - DNA, 22 bp, Homo sapiens
gggggagaagattctgctgctt

SEQ ID NO: 9467918 - DNA, 22 bp, Homo sapiens
gggggagaagattctgctgctt

SEQ ID NO: 9467919 - DNA, 22 bp, Homo sapiens
gggggaagtaattataaaccaa

SEQ ID NO: 9467920 - DNA, 22 bp, Homo sapiens
gggggaagaggcatgaagtcct

SEQ ID NO: 9467921 - DNA, 21 bp, Homo sapiens
gggggaagaggagttgctagt

SEQ ID NO: 9467922 - DNA, 22 bp, Homo sapiens
gggggcggagcacgtgaccacg

SEQ ID NO: 9467923 - DNA, 22 bp, Homo sapiens
gggggcgggagacagcagtgac

SEQ ID NO: 9467924 - DNA, 23 bp, Homo sapiens
gggggcgtgtcatggagggccac

SEQ ID NO: 9467925 - DNA, 23 bp, Homo sapiens
gggggcgtgtcatggagggccac

SEQ ID NO: 9467926 - DNA, 22 bp, Homo sapiens
gggggctaccgtctctggagct

SEQ ID NO: 9467927 - DNA, 22 bp, Homo sapiens
gggtatgatagggaggtgaaat

SEQ ID NO: 9467928 - DNA, 22 bp, Homo sapiens
gggtatgagatataggtgaata

SEQ ID NO: 9467929 - DNA, 23 bp, Homo sapiens
gggggccgtcctggggattatag

SEQ ID NO: 9467930 - DNA, 22 bp, Homo sapiens
gggggccagtgtctcttccttg

SEQ ID NO: 9467931 - DNA, 22 bp, Homo sapiens
gggggccatcttcaaggatgtg

SEQ ID NO: 9467932 - DNA, 22 bp, Homo sapiens
gggggcggagcacgtgaccacg

SEQ ID NO: 9467933 - DNA, 22 bp, Homo sapiens
gggggccagtcatctcccaaga

SEQ ID NO: 9467934 - DNA, 20 bp, Homo sapiens
gggggccagcagcagacgcc

SEQ ID NO: 9467935 - DNA, 22 bp, Homo sapiens
gggggagagacgagcggctctg

SEQ ID NO: 9467936 - DNA, 22 bp, Homo sapiens
gggggagagacgagcggctctg

SEQ ID NO: 9467937 - DNA, 22 bp, Homo sapiens
gggctgggatggcttgaagatt

SEQ ID NO: 9467938 - DNA, 22 bp, Homo sapiens
gggctgggaatggctaagtatg

SEQ ID NO: 9467939 - DNA, 22 bp, Homo sapiens
gggctgggaatggctaagtatg

SEQ ID NO: 9467940 - DNA, 22 bp, Homo sapiens
gggctgggaatggctaagtatg

SEQ ID NO: 9467941 - DNA, 22 bp, Homo sapiens
gggctgggatggcttgaagatt

SEQ ID NO: 9467942 - DNA, 22 bp, Homo sapiens
gggctgggatggcttgaagatt

SEQ ID NO: 9467943 - DNA, 22 bp, Homo sapiens
gggctgggatggcttgaagatt

SEQ ID NO: 9467944 - DNA, 22 bp, Homo sapiens
gggctgggatggcttgaagatt

SEQ ID NO: 9467945 - DNA, 22 bp, Homo sapiens
gggctgggatggcttgaagatt

SEQ ID NO: 9467946 - DNA, 22 bp, Homo sapiens
gggctgggatggcttgaagatt

SEQ ID NO: 9467947 - DNA, 22 bp, Homo sapiens
gggctggctcccaggtgttgaa

SEQ ID NO: 9467948 - DNA, 22 bp, Homo sapiens
gggctggctcccaggtgttgaa

SEQ ID NO: 9467949 - DNA, 22 bp, Homo sapiens
gggctggctcccaggtgttgaa

SEQ ID NO: 9467950 - DNA, 22 bp, Homo sapiens
gggctggctctgtctagaaagg

SEQ ID NO: 9467951 - DNA, 22 bp, Homo sapiens
gggctggctgattttcctctct

SEQ ID NO: 9467952 - DNA, 22 bp, Homo sapiens
gggctggctctgtctagaaagg

SEQ ID NO: 9467953 - DNA, 22 bp, Homo sapiens
gggctggctctgtctagaaagg

SEQ ID NO: 9467954 - DNA, 22 bp, Homo sapiens
gggctggctgattttcctctct

SEQ ID NO: 9467955 - DNA, 22 bp, Homo sapiens
gggctgggaatggctaagtatg

SEQ ID NO: 9467956 - DNA, 22 bp, Homo sapiens
gggctgggaatggctaagtatg

SEQ ID NO: 9467957 - DNA, 22 bp, Homo sapiens
gggctgggcatggtgttccctc

SEQ ID NO: 9467958 - DNA, 22 bp, Homo sapiens
gggctggggctcaataatttgt

SEQ ID NO: 9467959 - DNA, 22 bp, Homo sapiens
gggctgggcatggtgttccctc

SEQ ID NO: 9467960 - DNA, 22 bp, Homo sapiens
gggctgggcatggtgttccctc

SEQ ID NO: 9467961 - DNA, 22 bp, Homo sapiens
gggctggggctcaataatttgt

SEQ ID NO: 9467962 - DNA, 22 bp, Homo sapiens
gggctggggctcaataatttgt

SEQ ID NO: 9467963 - DNA, 22 bp, Homo sapiens
gggctggggctcaataatttgt

SEQ ID NO: 9467964 - DNA, 22 bp, Homo sapiens
gggctggggctcaataatttgt

SEQ ID NO: 9467965 - DNA, 22 bp, Homo sapiens
gggctggggctcaataatttgt

SEQ ID NO: 9467966 - DNA, 22 bp, Homo sapiens
gggctgggcatggtgttccctc

SEQ ID NO: 9467967 - DNA, 22 bp, Homo sapiens
gggctgggattgcttgctgtga

SEQ ID NO: 9467968 - DNA, 22 bp, Homo sapiens
gggctgggattgcttgctgtga

SEQ ID NO: 9467969 - DNA, 22 bp, Homo sapiens
gggctgggattgcttgctgtga

SEQ ID NO: 9467970 - DNA, 22 bp, Homo sapiens
gggctgggattgcttgctgtga

SEQ ID NO: 9467971 - DNA, 22 bp, Homo sapiens
gggctgggattgcttgctgtga

SEQ ID NO: 9467972 - DNA, 22 bp, Homo sapiens
gggctgggattgcttgctgtga

SEQ ID NO: 9467973 - DNA, 22 bp, Homo sapiens
ggggatggaggcgtgtggtcct

SEQ ID NO: 9467974 - DNA, 22 bp, Homo sapiens
ggggatggaggcgtgtggtcct

SEQ ID NO: 9467975 - DNA, 22 bp, Homo sapiens
ggggatggaggcgtgtggtcct

SEQ ID NO: 9467976 - DNA, 22 bp, Homo sapiens
ggggatggaatgtagtagtgat

SEQ ID NO: 9467977 - DNA, 22 bp, Homo sapiens
ggggatggaggcgtgtggtcct

SEQ ID NO: 9467978 - DNA, 22 bp, Homo sapiens
ggggatggaggcgtgtggtcct

SEQ ID NO: 9467979 - DNA, 22 bp, Homo sapiens
ggggatggaatgtagtagtgat

SEQ ID NO: 9467980 - DNA, 22 bp, Homo sapiens
ggggatggaatgtagtagtgat

SEQ ID NO: 9467981 - DNA, 22 bp, Homo sapiens
ggggatggaatgtagtagtgat

SEQ ID NO: 9467982 - DNA, 22 bp, Homo sapiens
gggctgggcatggtgttccctc

SEQ ID NO: 9467983 - DNA, 22 bp, Homo sapiens
ggggatggaatgtagtagtgat

SEQ ID NO: 9467984 - DNA, 22 bp, Homo sapiens
ggggatggaatgtagtagtgat

SEQ ID NO: 9467985 - DNA, 22 bp, Homo sapiens
ggggatggtagaccggtgacgt

SEQ ID NO: 9467986 - DNA, 22 bp, Homo sapiens
ggggatggtagaccggtgacgt

SEQ ID NO: 9467987 - DNA, 22 bp, Homo sapiens
ggggatggtgggaaggcaatct

SEQ ID NO: 9467988 - DNA, 22 bp, Homo sapiens
ggggatggattccgggtccctg

SEQ ID NO: 9467989 - DNA, 22 bp, Homo sapiens
ggggatggattccgggtccctg

SEQ ID NO: 9467990 - DNA, 22 bp, Homo sapiens
ggggcactttactgcctcatct

SEQ ID NO: 9467991 - DNA, 22 bp, Homo sapiens
ggggcacctcctcttggcaatt

SEQ ID NO: 9467992 - DNA, 22 bp, Homo sapiens
ggggcacacttttggtagatat

SEQ ID NO: 9467993 - DNA, 22 bp, Homo sapiens
ggggatggtgggaaggcaatct

SEQ ID NO: 9467994 - DNA, 22 bp, Homo sapiens
ggggcaatgtccaagtcagttg

SEQ ID NO: 9467995 - DNA, 22 bp, Homo sapiens
ggggcagaagtagtgcccctga

SEQ ID NO: 9467996 - DNA, 22 bp, Homo sapiens
ggggcagctcccgagggcagga

SEQ ID NO: 9467997 - DNA, 22 bp, Homo sapiens
ggggcagctaccggaagtaggg

SEQ ID NO: 9467998 - DNA, 22 bp, Homo sapiens
ggggcagctaccggaagtaggg

SEQ ID NO: 9467999 - DNA, 22 bp, Homo sapiens
ggggcagaaagcccacagagtg

SEQ ID NO: 9468000 - DNA, 22 bp, Homo sapiens
ggggcagaaagcccacagagtg

SEQ ID NO: 9468001 - DNA, 22 bp, Homo sapiens
ggggcagaaagcccacagagtg

SEQ ID NO: 9468002 - DNA, 22 bp, Homo sapiens
ggggcagaaagcccacagagtg

SEQ ID NO: 9468003 - DNA, 23 bp, Homo sapiens
gggcatctgctattacagcactg

SEQ ID NO: 9468004 - DNA, 22 bp, Homo sapiens
gggcatccagagggatgcctgg

SEQ ID NO: 9468005 - DNA, 22 bp, Homo sapiens
gggcagtgttgtggttctctat

SEQ ID NO: 9468006 - DNA, 22 bp, Homo sapiens
gggcagtttattctagatggtt

SEQ ID NO: 9468007 - DNA, 22 bp, Homo sapiens
gggcatgcctgagcctgccact

SEQ ID NO: 9468008 - DNA, 22 bp, Homo sapiens
gggcatgagagggcagctggca

SEQ ID NO: 9468009 - DNA, 20 bp, Homo sapiens
gggcatctttgctcctgttt

SEQ ID NO: 9468010 - DNA, 22 bp, Homo sapiens
gggcatgagaggcaggcaagtg

SEQ ID NO: 9468011 - DNA, 22 bp, Homo sapiens
gggcatgacttttggagtggga

SEQ ID NO: 9468012 - DNA, 22 bp, Homo sapiens
gggcatgacttttggagtggga

SEQ ID NO: 9468013 - DNA, 22 bp, Homo sapiens
gggcctcaggttctggagaagg

SEQ ID NO: 9468014 - DNA, 22 bp, Homo sapiens
gggcctgaaaccttcagggctt

SEQ ID NO: 9468015 - DNA, 22 bp, Homo sapiens
gggcctccgtgtgctggtgctc

SEQ ID NO: 9468016 - DNA, 22 bp, Homo sapiens
gggcctccggggtgagctgtgg

SEQ ID NO: 9468017 - DNA, 22 bp, Homo sapiens
gggcctgccaggctttcagcat

SEQ ID NO: 9468018 - DNA, 22 bp, Homo sapiens
gggcctgcaggttctgagaggc

SEQ ID NO: 9468019 - DNA, 22 bp, Homo sapiens
gggcctgcaggttctgagaggc

SEQ ID NO: 9468020 - DNA, 22 bp, Homo sapiens
gggcctgattagcaggctagct

SEQ ID NO: 9468021 - DNA, 22 bp, Homo sapiens
gggcctgagactgagggtgagg

SEQ ID NO: 9468022 - DNA, 22 bp, Homo sapiens
gggcctgagctactaggtaggt

SEQ ID NO: 9468023 - DNA, 22 bp, Homo sapiens
gggcctgagactgagggtgagg

SEQ ID NO: 9468024 - DNA, 22 bp, Homo sapiens
gggcctgccattgctgccccag

SEQ ID NO: 9468025 - DNA, 22 bp, Homo sapiens
gggcctggcatgcagccccgtt

SEQ ID NO: 9468026 - DNA, 22 bp, Homo sapiens
gggcctggtgcttctgactcct

SEQ ID NO: 9468027 - DNA, 22 bp, Homo sapiens
gggctccaaggaggccagcctg

SEQ ID NO: 9468028 - DNA, 22 bp, Homo sapiens
gggcctggggacaccaccatga

SEQ ID NO: 9468029 - DNA, 22 bp, Homo sapiens
gggcctgggaacttgcatttag

SEQ ID NO: 9468030 - DNA, 21 bp, Homo sapiens
gggcctggctgcgcaggacgg

SEQ ID NO: 9468031 - DNA, 21 bp, Homo sapiens
gggcctggctgcgcaggacgg

SEQ ID NO: 9468032 - DNA, 21 bp, Homo sapiens
gggcctggctgcgcaggacgg

SEQ ID NO: 9468033 - DNA, 21 bp, Homo sapiens
gggcctggctgcgcaggacgg

SEQ ID NO: 9468034 - DNA, 21 bp, Homo sapiens
gggcctggctgcgcaggacgg

SEQ ID NO: 9468035 - DNA, 22 bp, Homo sapiens
gggctccagcagaggcagccgg

SEQ ID NO: 9468036 - DNA, 22 bp, Homo sapiens
gggctccagcagaggcagccgg

SEQ ID NO: 9468037 - DNA, 22 bp, Homo sapiens
gggctccagccactggctgagg

SEQ ID NO: 9468038 - DNA, 22 bp, Homo sapiens
gggctccagccaggtgtcccca

SEQ ID NO: 9468039 - DNA, 22 bp, Homo sapiens
gggctccagcccgggaccaggt

SEQ ID NO: 9468040 - DNA, 22 bp, Homo sapiens
gggctccacagcagtgagtgga

SEQ ID NO: 9468041 - DNA, 22 bp, Homo sapiens
gggctccacctagggacactgg

SEQ ID NO: 9468042 - DNA, 22 bp, Homo sapiens
gggctccagagtccatgttctt

SEQ ID NO: 9468043 - DNA, 21 bp, Homo sapiens
gggctccagagatgtagcttc

SEQ ID NO: 9468044 - DNA, 22 bp, Homo sapiens
gggctccagtttggccaggaag

SEQ ID NO: 9468045 - DNA, 22 bp, Homo sapiens
gggctccagtttggccaggaag

SEQ ID NO: 9468046 - DNA, 22 bp, Homo sapiens
gggctccagtttggccaggaag

SEQ ID NO: 9468047 - DNA, 22 bp, Homo sapiens
gggctccatcacaggctccatc

SEQ ID NO: 9468048 - DNA, 22 bp, Homo sapiens
gggctccatcacaggctccatc

SEQ ID NO: 9468049 - DNA, 22 bp, Homo sapiens
gggctccatcacaggctccatc

SEQ ID NO: 9468050 - DNA, 22 bp, Homo sapiens
gggctccagctgtttgccatga

SEQ ID NO: 9468051 - DNA, 23 bp, Homo sapiens
gggctccagtctctgctcagttg

SEQ ID NO: 9468052 - DNA, 22 bp, Homo sapiens
gggctggctcccaggtgttgaa

SEQ ID NO: 9468053 - DNA, 22 bp, Homo sapiens
gggctggctcccaggtgttgaa

SEQ ID NO: 9468054 - DNA, 22 bp, Homo sapiens
gggctggctaagacttttctgt

SEQ ID NO: 9468055 - DNA, 22 bp, Homo sapiens
gggctggctaagacttttctgt

SEQ ID NO: 9468056 - DNA, 20 bp, Homo sapiens
gggctggctcaactggatcc

SEQ ID NO: 9468057 - DNA, 22 bp, Homo sapiens
gggctggcgggaaaggcaattc

SEQ ID NO: 9468058 - DNA, 22 bp, Homo sapiens
gggctggctaagacttttctgt

SEQ ID NO: 9468059 - DNA, 22 bp, Homo sapiens
gggctggcgggaaaggcaattc

SEQ ID NO: 9468060 - DNA, 22 bp, Homo sapiens
gggctggcgggaaaggcaattc

SEQ ID NO: 9468061 - DNA, 20 bp, Homo sapiens
gggctggcgcatggggaaag

SEQ ID NO: 9468062 - DNA, 22 bp, Homo sapiens
gggctggcatcggttgctgaga

SEQ ID NO: 9468063 - DNA, 22 bp, Homo sapiens
gggctggcgggaaaggcaattc

SEQ ID NO: 9468064 - DNA, 22 bp, Homo sapiens
gggctctgaatcccaggtctgc

SEQ ID NO: 9468065 - DNA, 22 bp, Homo sapiens
gggctctgaatcccaggtctgc

SEQ ID NO: 9468066 - DNA, 22 bp, Homo sapiens
gggctcctcctctgactgtggc

SEQ ID NO: 9468067 - DNA, 22 bp, Homo sapiens
gggctcctcctctgactgtggc

SEQ ID NO: 9468068 - DNA, 22 bp, Homo sapiens
gggctcggcatctgtggactct

SEQ ID NO: 9468069 - DNA, 22 bp, Homo sapiens
gggctctcatgagtgtgtggta

SEQ ID NO: 9468070 - DNA, 22 bp, Homo sapiens
gggctctcatgagtgtgtggta

SEQ ID NO: 9468071 - DNA, 21 bp, Homo sapiens
gggctctcctgaggccatgaa

SEQ ID NO: 9468072 - DNA, 21 bp, Homo sapiens
gggctctcctgaggccatgaa

SEQ ID NO: 9468073 - DNA, 22 bp, Homo sapiens
gtcatttaaagaccattgtggg

SEQ ID NO: 9468074 - DNA, 22 bp, Homo sapiens
gtcatttaggtctgtcagaaat

SEQ ID NO: 9468075 - DNA, 22 bp, Homo sapiens
gtcattgcagtggcaaatcaca

SEQ ID NO: 9468076 - DNA, 22 bp, Homo sapiens
gtcattgggggccatctcagag

SEQ ID NO: 9468077 - DNA, 22 bp, Homo sapiens
gtcatttatcatcagaagtcat

SEQ ID NO: 9468078 - DNA, 22 bp, Homo sapiens
gtcatttatcatcagaagtcat

SEQ ID NO: 9468079 - DNA, 22 bp, Homo sapiens
gtcatttatcttcagaatttct

SEQ ID NO: 9468080 - DNA, 22 bp, Homo sapiens
gtcatttatcttcagaatttct

SEQ ID NO: 9468081 - DNA, 22 bp, Homo sapiens
gtccctggatctgggacagctg

SEQ ID NO: 9468082 - DNA, 22 bp, Homo sapiens
gtcctattagcatattgaatac

SEQ ID NO: 9468083 - DNA, 22 bp, Homo sapiens
gtccctggagctgagcagtgct

SEQ ID NO: 9468084 - DNA, 22 bp, Homo sapiens
gtccctggagctgagcagtgct

SEQ ID NO: 9468085 - DNA, 22 bp, Homo sapiens
gtccctggagctgagcagtgct

SEQ ID NO: 9468086 - DNA, 22 bp, Homo sapiens
gtcctcagcaccagaactaggg

SEQ ID NO: 9468087 - DNA, 22 bp, Homo sapiens
gtcctcagagtgggcaggtcct

SEQ ID NO: 9468088 - DNA, 22 bp, Homo sapiens
gtcctcagagtgggcaggtcct

SEQ ID NO: 9468089 - DNA, 23 bp, Homo sapiens
gtcctattttttgaaatactgag

SEQ ID NO: 9468090 - DNA, 22 bp, Homo sapiens
gtcctcagaagcctgcttagct

SEQ ID NO: 9468091 - DNA, 22 bp, Homo sapiens
gtcctcagagtgggcaggtcct

SEQ ID NO: 9468092 - DNA, 22 bp, Homo sapiens
gtcctcagaagcctgcttagct

SEQ ID NO: 9468093 - DNA, 21 bp, Homo sapiens
gtcctcagctgatgggagctg

SEQ ID NO: 9468094 - DNA, 22 bp, Homo sapiens
gtcctcaggaaggctttctgac

SEQ ID NO: 9468095 - DNA, 22 bp, Homo sapiens
gtcctcaggaaggctttctgac

SEQ ID NO: 9468096 - DNA, 22 bp, Homo sapiens
gtcctcaggcttgagtgtttat

SEQ ID NO: 9468097 - DNA, 22 bp, Homo sapiens
gtcctcagggaatgtggcgggt

SEQ ID NO: 9468098 - DNA, 22 bp, Homo sapiens
gtctcctcttcatatacctgtt

SEQ ID NO: 9468099 - DNA, 22 bp, Homo sapiens
gtctcctccctttcattcacct

SEQ ID NO: 9468100 - DNA, 22 bp, Homo sapiens
gtctcctcttcatatacctgtt

SEQ ID NO: 9468101 - DNA, 20 bp, Homo sapiens
gtctcctctttgcattccta

SEQ ID NO: 9468102 - DNA, 22 bp, Homo sapiens
gtctcctatagctgcactgaat

SEQ ID NO: 9468103 - DNA, 22 bp, Homo sapiens
gtctcctccagtaggaagtggc

SEQ ID NO: 9468104 - DNA, 22 bp, Homo sapiens
gtctcctccatggagatggtat

SEQ ID NO: 9468105 - DNA, 22 bp, Homo sapiens
gtctcctccatggagatggtat

SEQ ID NO: 9468106 - DNA, 22 bp, Homo sapiens
gtctccggccgccctggtgctg

SEQ ID NO: 9468107 - DNA, 22 bp, Homo sapiens
gtctcccatgtccctgtccagt

SEQ ID NO: 9468108 - DNA, 22 bp, Homo sapiens
gtctcccatgtccctgtccagt

SEQ ID NO: 9468109 - DNA, 22 bp, Homo sapiens
gtctcccatcgtttgtgaggaa

SEQ ID NO: 9468110 - DNA, 23 bp, Homo sapiens
gtctcccatagcgctcccaggct

SEQ ID NO: 9468111 - DNA, 22 bp, Homo sapiens
gtctcccatcgtttgtgaggaa

SEQ ID NO: 9468112 - DNA, 22 bp, Homo sapiens
gtcctctgcttcatgccctgat

SEQ ID NO: 9468113 - DNA, 22 bp, Homo sapiens
gtcctctgcttcatgccctgat

SEQ ID NO: 9468114 - DNA, 22 bp, Homo sapiens
gtcctctgcttcatgccctgat

SEQ ID NO: 9468115 - DNA, 22 bp, Homo sapiens
gtctcccactttctggcctctt

SEQ ID NO: 9468116 - DNA, 22 bp, Homo sapiens
gtctcccactttctggcctctt

SEQ ID NO: 9468117 - DNA, 22 bp, Homo sapiens
gtctcccaatccgggacagcct

SEQ ID NO: 9468118 - DNA, 22 bp, Homo sapiens
gtctcccactttctggcctctt

SEQ ID NO: 9468119 - DNA, 22 bp, Homo sapiens
gtctcccaatccgggacagcct

SEQ ID NO: 9468120 - DNA, 22 bp, Homo sapiens
gtcctctgagggggctgcacgc

SEQ ID NO: 9468121 - DNA, 22 bp, Homo sapiens
gtcctctgactcagccttggga

SEQ ID NO: 9468122 - DNA, 22 bp, Homo sapiens
gtcctctgactcagccttggga

SEQ ID NO: 9468123 - DNA, 22 bp, Homo sapiens
gtcctctgactcagccttggga

SEQ ID NO: 9468124 - DNA, 22 bp, Homo sapiens
gtcctctgcccaggtcaaggtt

SEQ ID NO: 9468125 - DNA, 22 bp, Homo sapiens
gtcctctgatttctaggtatat

SEQ ID NO: 9468126 - DNA, 22 bp, Homo sapiens
gtcctctccaggaggctctgat

SEQ ID NO: 9468127 - DNA, 22 bp, Homo sapiens
gtcctctccaggaggctctgat

SEQ ID NO: 9468128 - DNA, 22 bp, Homo sapiens
gtcctcagtcagtttggtgggg

SEQ ID NO: 9468129 - DNA, 22 bp, Homo sapiens
gtcacagtgtatctcttcagct

SEQ ID NO: 9468130 - DNA, 22 bp, Homo sapiens
gtcacatgccagtgcacacagg

SEQ ID NO: 9468131 - DNA, 22 bp, Homo sapiens
gtcacatgccagtgcacacagg

SEQ ID NO: 9468132 - DNA, 22 bp, Homo sapiens
gtcaccagcaccaatgccacat

SEQ ID NO: 9468133 - DNA, 22 bp, Homo sapiens
gtcacattcatgcagaatcaaa

SEQ ID NO: 9468134 - DNA, 22 bp, Homo sapiens
gtcaggctggggctgctgccag

SEQ ID NO: 9468135 - DNA, 22 bp, Homo sapiens
gtcaccaggtctgatgcagcca

SEQ ID NO: 9468136 - DNA, 22 bp, Homo sapiens
gtcaccagcaccaatgccacat

SEQ ID NO: 9468137 - DNA, 19 bp, Homo sapiens
gtcacatttgtctcccagg

SEQ ID NO: 9468138 - DNA, 22 bp, Homo sapiens
gtcagggatccactgctcttct

SEQ ID NO: 9468139 - DNA, 21 bp, Homo sapiens
gtcagggattcaagtgctcac

SEQ ID NO: 9468140 - DNA, 22 bp, Homo sapiens
gtcacagtatcatgtttgaatg

SEQ ID NO: 9468141 - DNA, 22 bp, Homo sapiens
gtcacaggtgtggaggtgctgg

SEQ ID NO: 9468142 - DNA, 22 bp, Homo sapiens
gtcacaaaggtgagggacatga

SEQ ID NO: 9468143 - DNA, 22 bp, Homo sapiens
gtcacaaatcccctcagcaact

SEQ ID NO: 9468144 - DNA, 22 bp, Homo sapiens
gtcaatatcttggttgtactat

SEQ ID NO: 9468145 - DNA, 17 bp, Homo sapiens
gtcaatattgttgacag

SEQ ID NO: 9468146 - DNA, 22 bp, Homo sapiens
gtcaatatcgccaagtgtctct

SEQ ID NO: 9468147 - DNA, 22 bp, Homo sapiens
gtcaatatcttggttgtactat

SEQ ID NO: 9468148 - DNA, 22 bp, Homo sapiens
gtcaatatattctgtctctttg

SEQ ID NO: 9468149 - DNA, 22 bp, Homo sapiens
gtcaatatcgccaagtgtctct

SEQ ID NO: 9468150 - DNA, 22 bp, Homo sapiens
gtcaatataggtttcaaacatg

SEQ ID NO: 9468151 - DNA, 22 bp, Homo sapiens
gtcaatataggtttcaaacatg

SEQ ID NO: 9468152 - DNA, 22 bp, Homo sapiens
gtcaatatagatcaatgcacag

SEQ ID NO: 9468153 - DNA, 22 bp, Homo sapiens
gtcaatatagatcaatgcacag

SEQ ID NO: 9468154 - DNA, 22 bp, Homo sapiens
gtcaatataggtttcaaacatg

SEQ ID NO: 9468155 - DNA, 22 bp, Homo sapiens
gtcagtgtttaacaaccagctc

SEQ ID NO: 9468156 - DNA, 22 bp, Homo sapiens
gtcagtgtggttgctggcttgg

SEQ ID NO: 9468157 - DNA, 22 bp, Homo sapiens
gtcagtgttataagtttagcca

SEQ ID NO: 9468158 - DNA, 22 bp, Homo sapiens
gtcagtgtggttgctggcttgg

SEQ ID NO: 9468159 - DNA, 22 bp, Homo sapiens
gtcagtgtgagttgattccata

SEQ ID NO: 9468160 - DNA, 22 bp, Homo sapiens
gtcagtgtgagataatcttgga

SEQ ID NO: 9468161 - DNA, 20 bp, Homo sapiens
gtcagtgtcttcagtagtga

SEQ ID NO: 9468162 - DNA, 22 bp, Homo sapiens
gtcagtttgactcagtgttata

SEQ ID NO: 9468163 - DNA, 22 bp, Homo sapiens
gtcattcaactgcacattaggt

SEQ ID NO: 9468164 - DNA, 22 bp, Homo sapiens
gtcattcagagatgcaggtaga

SEQ ID NO: 9468165 - DNA, 22 bp, Homo sapiens
gtcattcaaactgtatcacttg

SEQ ID NO: 9468166 - DNA, 22 bp, Homo sapiens
gtcattcagagatgcaggtaga

SEQ ID NO: 9468167 - DNA, 18 bp, Homo sapiens
gtcagtagagcctgtccc

SEQ ID NO: 9468168 - DNA, 22 bp, Homo sapiens
gtcagtaggaacctagggtcaa

SEQ ID NO: 9468169 - DNA, 22 bp, Homo sapiens
gtcaggtggctggtgattcaac

SEQ ID NO: 9468170 - DNA, 22 bp, Homo sapiens
gtcagtgccaccagccactgcc

SEQ ID NO: 9468171 - DNA, 22 bp, Homo sapiens
gtcagtgcttgaagggcagaga

SEQ ID NO: 9468172 - DNA, 22 bp, Homo sapiens
gtcagtaggaacctagggtcaa

SEQ ID NO: 9468173 - DNA, 22 bp, Homo sapiens
gtcagtcatattgtacagatat

SEQ ID NO: 9468174 - DNA, 22 bp, Homo sapiens
gtcagtgtagcaggtgcaagcc

SEQ ID NO: 9468175 - DNA, 22 bp, Homo sapiens
gtcagtgtaggttcatcagtgg

SEQ ID NO: 9468176 - DNA, 22 bp, Homo sapiens
gtcagtgtcttaacagagatta

SEQ ID NO: 9468177 - DNA, 22 bp, Homo sapiens
gtagctgatattagcaatgagt

SEQ ID NO: 9468178 - DNA, 22 bp, Homo sapiens
gtagctatttatgatactcatg

SEQ ID NO: 9468179 - DNA, 22 bp, Homo sapiens
gtagctatttatgatactcatg

SEQ ID NO: 9468180 - DNA, 22 bp, Homo sapiens
gtagcttattagggataatagt

SEQ ID NO: 9468181 - DNA, 22 bp, Homo sapiens
gtagcttattagggataatagt

SEQ ID NO: 9468182 - DNA, 22 bp, Homo sapiens
gtagcttcaagtactctccctg

SEQ ID NO: 9468183 - DNA, 22 bp, Homo sapiens
gtagctgatcctgaggacaggg

SEQ ID NO: 9468184 - DNA, 22 bp, Homo sapiens
gtagctgatattagcaatgagt

SEQ ID NO: 9468185 - DNA, 22 bp, Homo sapiens
gtagctgcctttctggcccagg

SEQ ID NO: 9468186 - DNA, 22 bp, Homo sapiens
gtaggaaagggagtgaagggaa

SEQ ID NO: 9468187 - DNA, 22 bp, Homo sapiens
gtaggaaagggagtgaagggaa

SEQ ID NO: 9468188 - DNA, 22 bp, Homo sapiens
gtagcttccagaaagtgtcttt

SEQ ID NO: 9468189 - DNA, 22 bp, Homo sapiens
gtaggaagctctgaggctagtt

SEQ ID NO: 9468190 - DNA, 22 bp, Homo sapiens
gtaggaaagtaaatgaaataca

SEQ ID NO: 9468191 - DNA, 22 bp, Homo sapiens
gtcaacataggcctcagtgagg

SEQ ID NO: 9468192 - DNA, 17 bp, Homo sapiens
gtcaacaggatttcttt

SEQ ID NO: 9468193 - DNA, 22 bp, Homo sapiens
gtcaacttatctctttatctgt

SEQ ID NO: 9468194 - DNA, 22 bp, Homo sapiens
gtcaacatttactgccctggcc

SEQ ID NO: 9468195 - DNA, 22 bp, Homo sapiens
gtcaactttaagatgatctttt

SEQ ID NO: 9468196 - DNA, 22 bp, Homo sapiens
gtcaacttatctctttatctgt

SEQ ID NO: 9468197 - DNA, 22 bp, Homo sapiens
gtcaataattgatagatattgg

SEQ ID NO: 9468198 - DNA, 22 bp, Homo sapiens
gtcaataattttatggagagaa

SEQ ID NO: 9468199 - DNA, 22 bp, Homo sapiens
gtcaataattttatggagagaa

SEQ ID NO: 9468200 - DNA, 22 bp, Homo sapiens
gtcaataagtttgtaactggat

SEQ ID NO: 9468201 - DNA, 22 bp, Homo sapiens
gtcaataattgatagatattgg

SEQ ID NO: 9468202 - DNA, 19 bp, Homo sapiens
gtcaataaaagttaggggt

SEQ ID NO: 9468203 - DNA, 22 bp, Homo sapiens
gtcaagttaagataaggtcatg

SEQ ID NO: 9468204 - DNA, 22 bp, Homo sapiens
gtcaagtttatccgctcattca

SEQ ID NO: 9468205 - DNA, 22 bp, Homo sapiens
gtcaagtcatgactcaaaggaa

SEQ ID NO: 9468206 - DNA, 22 bp, Homo sapiens
gtcaagggtacagcacgcttct

SEQ ID NO: 9468207 - DNA, 22 bp, Homo sapiens
gtagatggaggggctgcagggc

SEQ ID NO: 9468208 - DNA, 22 bp, Homo sapiens
gtagatgagctcacatgacctt

SEQ ID NO: 9468209 - DNA, 22 bp, Homo sapiens
gtagatgagctcacatgacctt

SEQ ID NO: 9468210 - DNA, 22 bp, Homo sapiens
gtagatcatgagaatgtttttg

SEQ ID NO: 9468211 - DNA, 22 bp, Homo sapiens
gtagaggctcagagagccgcag

SEQ ID NO: 9468212 - DNA, 22 bp, Homo sapiens
gtagaggggtgattctgtgaga

SEQ ID NO: 9468213 - DNA, 22 bp, Homo sapiens
gtagaggtagacttccttgtct

SEQ ID NO: 9468214 - DNA, 22 bp, Homo sapiens
gtagaggctgaaatctgagggc

SEQ ID NO: 9468215 - DNA, 22 bp, Homo sapiens
gtagaggctgaaatctgagggc

SEQ ID NO: 9468216 - DNA, 22 bp, Homo sapiens
gtagagcaggacttgagatgtt

SEQ ID NO: 9468217 - DNA, 22 bp, Homo sapiens
gtagaccatttatctggggagt

SEQ ID NO: 9468218 - DNA, 22 bp, Homo sapiens
gtagaccatttatctggggagt

SEQ ID NO: 9468219 - DNA, 22 bp, Homo sapiens
gtaatgatgtctgagaagtatg

SEQ ID NO: 9468220 - DNA, 22 bp, Homo sapiens
gtagcccacctggggagggcga

SEQ ID NO: 9468221 - DNA, 22 bp, Homo sapiens
gtagcccacctggggagggcga

SEQ ID NO: 9468222 - DNA, 22 bp, Homo sapiens
gtagcagcttcagcccaaatta

SEQ ID NO: 9468223 - DNA, 22 bp, Homo sapiens
gtagcaggtattctggtgtgag

SEQ ID NO: 9468224 - DNA, 22 bp, Homo sapiens
gtagccagatctgctgtgtctg

SEQ ID NO: 9468225 - DNA, 22 bp, Homo sapiens
gtagcagctctccagggttcac

SEQ ID NO: 9468226 - DNA, 22 bp, Homo sapiens
gtagcagctctgagcatgctgc

SEQ ID NO: 9468227 - DNA, 22 bp, Homo sapiens
gtagcagagggcccaggtaact

SEQ ID NO: 9468228 - DNA, 22 bp, Homo sapiens
gtagcagcagagcaggtcctcc

SEQ ID NO: 9468229 - DNA, 22 bp, Homo sapiens
gtagattccagtggtctgtgtc

SEQ ID NO: 9468230 - DNA, 22 bp, Homo sapiens
gtaatccaaagtaacattaaac

SEQ ID NO: 9468231 - DNA, 22 bp, Homo sapiens
gtaatctcagctacttgggagg

SEQ ID NO: 9468232 - DNA, 22 bp, Homo sapiens
gtaatctcagctacttgggagg

SEQ ID NO: 9468233 - DNA, 22 bp, Homo sapiens
gtaatgaatagatggtggcagg

SEQ ID NO: 9468234 - DNA, 22 bp, Homo sapiens
gtaatgaatcaacattaatgat

SEQ ID NO: 9468235 - DNA, 20 bp, Homo sapiens
gtaatgaatgtaaacagtaa

SEQ ID NO: 9468236 - DNA, 22 bp, Homo sapiens
gtaataatactagtcagccttg

SEQ ID NO: 9468237 - DNA, 22 bp, Homo sapiens
gtaataatggtccccaaacact

SEQ ID NO: 9468238 - DNA, 22 bp, Homo sapiens
gtaataatttgctacctggtgg

SEQ ID NO: 9468239 - DNA, 22 bp, Homo sapiens
gtaataatttgctacctggtgg

SEQ ID NO: 9468240 - DNA, 22 bp, Homo sapiens
gtaatagatgaaacaatgtgga

SEQ ID NO: 9468241 - DNA, 22 bp, Homo sapiens
gtaatagaacactcagcatgga

SEQ ID NO: 9468242 - DNA, 17 bp, Homo sapiens
gtaatataataagcctt

SEQ ID NO: 9468243 - DNA, 19 bp, Homo sapiens
gtaacagctctgggttcac

SEQ ID NO: 9468244 - DNA, 22 bp, Homo sapiens
gtaacacttggctgcaacctgg

SEQ ID NO: 9468245 - DNA, 22 bp, Homo sapiens
gtaacactggcaccgtctcaca

SEQ ID NO: 9468246 - DNA, 22 bp, Homo sapiens
gtaacaaagtttctaggtgctg

SEQ ID NO: 9468247 - DNA, 22 bp, Homo sapiens
gtaacaaaggataacttggttt

SEQ ID NO: 9468248 - DNA, 22 bp, Homo sapiens
gtaacactagctctgtcacttt

SEQ ID NO: 9468249 - DNA, 22 bp, Homo sapiens
gtaacactctaaagggatgcac

SEQ ID NO: 9468250 - DNA, 22 bp, Homo sapiens
gtaacaaagtttctaggtgctg

SEQ ID NO: 9468251 - DNA, 19 bp, Homo sapiens
gtaacagtggacattttag

SEQ ID NO: 9468252 - DNA, 22 bp, Homo sapiens
gtaacatagtttgtgcttcatc

SEQ ID NO: 9468253 - DNA, 22 bp, Homo sapiens
gtaaggctttttagaagcacat

SEQ ID NO: 9468254 - DNA, 22 bp, Homo sapiens
gtaacaaaggataacttggttt

SEQ ID NO: 9468255 - DNA, 22 bp, Homo sapiens
gtaacaaaggataacttggttt

SEQ ID NO: 9468256 - DNA, 22 bp, Homo sapiens
gtaacaaaggataacttggttt

SEQ ID NO: 9468257 - DNA, 22 bp, Homo sapiens
gtaacaaacggttccaagatgc

SEQ ID NO: 9468258 - DNA, 22 bp, Homo sapiens
gtaacaaacggttccaagatgc

SEQ ID NO: 9468259 - DNA, 22 bp, Homo sapiens
gtaacaaacggttccaagatgc

SEQ ID NO: 9468260 - DNA, 22 bp, Homo sapiens
gtaaattatttcaagatcatct

SEQ ID NO: 9468261 - DNA, 22 bp, Homo sapiens
gtaaattatttcaagatcatct

SEQ ID NO: 9468262 - DNA, 22 bp, Homo sapiens
gtaaattatttcaagatcatct

SEQ ID NO: 9468263 - DNA, 22 bp, Homo sapiens
gtaaatgagtcaaatgggggaa

SEQ ID NO: 9468264 - DNA, 22 bp, Homo sapiens
gtaaatgccacttaatgtaaag

SEQ ID NO: 9468265 - DNA, 22 bp, Homo sapiens
gtaaatcatggtcagaataaat

SEQ ID NO: 9468266 - DNA, 22 bp, Homo sapiens
gtaaatgtgaatgtcatttagc

SEQ ID NO: 9468267 - DNA, 22 bp, Homo sapiens
gtaaatgctagccctttaaagt

SEQ ID NO: 9468268 - DNA, 22 bp, Homo sapiens
gtaaatgtcctgctacagagtg

SEQ ID NO: 9468269 - DNA, 22 bp, Homo sapiens
gtaaatgtgactccacctgagt

SEQ ID NO: 9468270 - DNA, 22 bp, Homo sapiens
gtaaatgtgaatgtcatttagc

SEQ ID NO: 9468271 - DNA, 22 bp, Homo sapiens
gtaaatgtgcttcttttaactt

SEQ ID NO: 9468272 - DNA, 22 bp, Homo sapiens
ggtgggcacccgagactggatc

SEQ ID NO: 9468273 - DNA, 21 bp, Homo sapiens
ggtgggcacaggagagcagag

SEQ ID NO: 9468274 - DNA, 22 bp, Homo sapiens
gtaaatattccctcggttccta

SEQ ID NO: 9468275 - DNA, 22 bp, Homo sapiens
gtaaatattccctcggttccta

SEQ ID NO: 9468276 - DNA, 22 bp, Homo sapiens
gtaaatattccctcggttccta

SEQ ID NO: 9468277 - DNA, 22 bp, Homo sapiens
gtaaatattccctcggttccta

SEQ ID NO: 9468278 - DNA, 22 bp, Homo sapiens
gtaaatattccctcggttccta

SEQ ID NO: 9468279 - DNA, 22 bp, Homo sapiens
gtaaatattccctcggttccta

SEQ ID NO: 9468280 - DNA, 22 bp, Homo sapiens
ggtgggcagctcttggcaggca

SEQ ID NO: 9468281 - DNA, 22 bp, Homo sapiens
ggtgggcaggcgaggcccaggt

SEQ ID NO: 9468282 - DNA, 22 bp, Homo sapiens
ggtgggcaggcgaggcccaggt

SEQ ID NO: 9468283 - DNA, 22 bp, Homo sapiens
ggtgggcagctcttggcaggca

SEQ ID NO: 9468284 - DNA, 22 bp, Homo sapiens
ggtgggcagctcttggcaggca

SEQ ID NO: 9468285 - DNA, 22 bp, Homo sapiens
gtgcccaggggccagctgccgg

SEQ ID NO: 9468286 - DNA, 22 bp, Homo sapiens
gtgcccaggggccagctgccgg

SEQ ID NO: 9468287 - DNA, 22 bp, Homo sapiens
gtgcacagaaacatacaatgtg

SEQ ID NO: 9468288 - DNA, 22 bp, Homo sapiens
gtgcccaggtgtccctgagaag

SEQ ID NO: 9468289 - DNA, 22 bp, Homo sapiens
gtgccctgacacacctggtgtg

SEQ ID NO: 9468290 - DNA, 22 bp, Homo sapiens
gtgcccaggtgtccctgagaag

SEQ ID NO: 9468291 - DNA, 22 bp, Homo sapiens
gtgccctgagcttatgcattct

SEQ ID NO: 9468292 - DNA, 22 bp, Homo sapiens
gtgccctgatgcaattgtctca

SEQ ID NO: 9468293 - DNA, 22 bp, Homo sapiens
gtgccctgatgcaattgtctca

SEQ ID NO: 9468294 - DNA, 22 bp, Homo sapiens
gtgccctggaggggttgaaggg

SEQ ID NO: 9468295 - DNA, 22 bp, Homo sapiens
gtgccctgatcgctaggctccc

SEQ ID NO: 9468296 - DNA, 22 bp, Homo sapiens
gtgccctgagtgggtaggagag

SEQ ID NO: 9468297 - DNA, 22 bp, Homo sapiens
gtgcaaggtacatccttgatgt

SEQ ID NO: 9468298 - DNA, 22 bp, Homo sapiens
gtgcaataaataaatagattgt

SEQ ID NO: 9468299 - DNA, 22 bp, Homo sapiens
gtgcaaattccactggaaagct

SEQ ID NO: 9468300 - DNA, 22 bp, Homo sapiens
gtgcaaatgtaattgtggtttt

SEQ ID NO: 9468301 - DNA, 22 bp, Homo sapiens
gtgcaatctgttgactggactt

SEQ ID NO: 9468302 - DNA, 22 bp, Homo sapiens
gtgcaatgtatgtctcaatgat

SEQ ID NO: 9468303 - DNA, 22 bp, Homo sapiens
gtgcaatgtctgtgatatgaaa

SEQ ID NO: 9468304 - DNA, 22 bp, Homo sapiens
gtgcacactcttggggcacttt

SEQ ID NO: 9468305 - DNA, 22 bp, Homo sapiens
gtgcacacatacatgaacgctg

SEQ ID NO: 9468306 - DNA, 22 bp, Homo sapiens
gtgcacacaagcaatgcactta

SEQ ID NO: 9468307 - DNA, 22 bp, Homo sapiens
gtgattatttgtgattaaggag

SEQ ID NO: 9468308 - DNA, 22 bp, Homo sapiens
gtgattatatttctatgtgaat

SEQ ID NO: 9468309 - DNA, 22 bp, Homo sapiens
gtgattatgttatattaaggca

SEQ ID NO: 9468310 - DNA, 22 bp, Homo sapiens
gtgattaatgccaatgggcctt

SEQ ID NO: 9468311 - DNA, 22 bp, Homo sapiens
gtgattaatgctgttggagata

SEQ ID NO: 9468312 - DNA, 22 bp, Homo sapiens
gtgattatagaatgctacaaag

SEQ ID NO: 9468313 - DNA, 22 bp, Homo sapiens
gtgattaataatggccatgcat

SEQ ID NO: 9468314 - DNA, 15 bp, Homo sapiens
gtgattaagtgcgtt

SEQ ID NO: 9468315 - DNA, 22 bp, Homo sapiens
gtgattaagcatttcagaattt

SEQ ID NO: 9468316 - DNA, 22 bp, Homo sapiens
gtgattctgaaatattagaaaa

SEQ ID NO: 9468317 - DNA, 22 bp, Homo sapiens
gtgattctgatatagctaaagt

SEQ ID NO: 9468318 - DNA, 22 bp, Homo sapiens
gtgattctgaaatattagaaaa

SEQ ID NO: 9468319 - DNA, 22 bp, Homo sapiens
gtgattcattcgattagtattt

SEQ ID NO: 9468320 - DNA, 22 bp, Homo sapiens
gtgattctcaaattgtgatatc

SEQ ID NO: 9468321 - DNA, 22 bp, Homo sapiens
gtgattctggcaggcagaaggg

SEQ ID NO: 9468322 - DNA, 22 bp, Homo sapiens
gtgattctttgatctatgaaag

SEQ ID NO: 9468323 - DNA, 22 bp, Homo sapiens
gtgattcttcctgctggcatac

SEQ ID NO: 9468324 - DNA, 22 bp, Homo sapiens
gtgatttctaatcatctgaatg

SEQ ID NO: 9468325 - DNA, 22 bp, Homo sapiens
gtgatttcaaatatagagtgag

SEQ ID NO: 9468326 - DNA, 23 bp, Homo sapiens
gtgatttcagggaacagaatcag

SEQ ID NO: 9468327 - DNA, 22 bp, Homo sapiens
gtgcaaatgtaattgtgatttt

SEQ ID NO: 9468328 - DNA, 22 bp, Homo sapiens
gtgcaaatgtaattgccattga

SEQ ID NO: 9468329 - DNA, 22 bp, Homo sapiens
gtgcaaaagtaaatgtggtttt

SEQ ID NO: 9468330 - DNA, 22 bp, Homo sapiens
gtgcaaaagtaactgtggtttt

SEQ ID NO: 9468331 - DNA, 22 bp, Homo sapiens
gtgcaaaagtaactgtggtttt

SEQ ID NO: 9468332 - DNA, 22 bp, Homo sapiens
gtgcaaaagtaaatgtggtttt

SEQ ID NO: 9468333 - DNA, 22 bp, Homo sapiens
gtgcaaaaggcattgtggtttt

SEQ ID NO: 9468334 - DNA, 22 bp, Homo sapiens
gtgcaaaaggcattgtggtttt

SEQ ID NO: 9468335 - DNA, 22 bp, Homo sapiens
gtgcaaaagcagttgtggtttt

SEQ ID NO: 9468336 - DNA, 22 bp, Homo sapiens
gtgcaaaagcagttggattttt

SEQ ID NO: 9468337 - DNA, 22 bp, Homo sapiens
gtgcaaaagcagttgtggtttt

SEQ ID NO: 9468338 - DNA, 22 bp, Homo sapiens
gtgcaaaaataattgtggtttt

SEQ ID NO: 9468339 - DNA, 22 bp, Homo sapiens
gtgattttgagacctatatagt

SEQ ID NO: 9468340 - DNA, 22 bp, Homo sapiens
gtgattttctcctcctagaagt

SEQ ID NO: 9468341 - DNA, 22 bp, Homo sapiens
gtgcaaaaatctatcaccagca

SEQ ID NO: 9468342 - DNA, 22 bp, Homo sapiens
gtgcaaaagcaattgcagtttt

SEQ ID NO: 9468343 - DNA, 22 bp, Homo sapiens
gtgcaaaaataattgtggtttt

SEQ ID NO: 9468344 - DNA, 22 bp, Homo sapiens
gtgcaaaagcagttggattttt

SEQ ID NO: 9468345 - DNA, 22 bp, Homo sapiens
gtgcaaaagcagttggattttt

SEQ ID NO: 9468346 - DNA, 22 bp, Homo sapiens
gtgcaaaagcaattgcagtttt

SEQ ID NO: 9468347 - DNA, 22 bp, Homo sapiens
gtgccctggctcacagtgtctc

SEQ ID NO: 9468348 - DNA, 22 bp, Homo sapiens
gtgccctggctcacagtgtctc

SEQ ID NO: 9468349 - DNA, 22 bp, Homo sapiens
gtgccctggctcacagtgtctc

SEQ ID NO: 9468350 - DNA, 22 bp, Homo sapiens
gtgccctgggccttcagggcca

SEQ ID NO: 9468351 - DNA, 22 bp, Homo sapiens
gtgccctggtccccagcatata

SEQ ID NO: 9468352 - DNA, 22 bp, Homo sapiens
gtgccctggggtgaacccctgg

SEQ ID NO: 9468353 - DNA, 21 bp, Homo sapiens
gtgccctgttcccacatgccc

SEQ ID NO: 9468354 - DNA, 21 bp, Homo sapiens
gtgccctgttcccacatgccc

SEQ ID NO: 9468355 - DNA, 22 bp, Homo sapiens
gtgccctgttcatttctctccc

SEQ ID NO: 9468356 - DNA, 20 bp, Homo sapiens
gtgccctgtgggctattttc

SEQ ID NO: 9468357 - DNA, 22 bp, Homo sapiens
gtgccctgtctcttgtctccag

SEQ ID NO: 9468358 - DNA, 22 bp, Homo sapiens
gtgccctgtctcttgtctccag

SEQ ID NO: 9468359 - DNA, 22 bp, Homo sapiens
gtgcctcagcaccgcctgcagc

SEQ ID NO: 9468360 - DNA, 22 bp, Homo sapiens
gtgcctccaggctcgactagtc

SEQ ID NO: 9468361 - DNA, 22 bp, Homo sapiens
gtgccgtgggccttagtgatct

SEQ ID NO: 9468362 - DNA, 22 bp, Homo sapiens
gtgcctccaggctcgactagtc

SEQ ID NO: 9468363 - DNA, 22 bp, Homo sapiens
gtgcctccatcagtgcctccaa

SEQ ID NO: 9468364 - DNA, 22 bp, Homo sapiens
gtgcctcccgggaccatgcact

SEQ ID NO: 9468365 - DNA, 22 bp, Homo sapiens
gtgcctcccgggaccatgcact

SEQ ID NO: 9468366 - DNA, 22 bp, Homo sapiens
gtgcctctgagctctgctacag

SEQ ID NO: 9468367 - DNA, 22 bp, Homo sapiens
gtgcctccttaaattctgcacc

SEQ ID NO: 9468368 - DNA, 22 bp, Homo sapiens
gtgcctccttaaattctgcacc

SEQ ID NO: 9468369 - DNA, 22 bp, Homo sapiens
gtgcctcccggggctcttcctt

SEQ ID NO: 9468370 - DNA, 22 bp, Homo sapiens
gtgcctcccggggctcttcctt

SEQ ID NO: 9468371 - DNA, 22 bp, Homo sapiens
gtgcctccctgttgactagggt

SEQ ID NO: 9468372 - DNA, 22 bp, Homo sapiens
gtgcctccctgttgactagggt

SEQ ID NO: 9468373 - DNA, 22 bp, Homo sapiens
gtgcttgcagtgagatgagatg

SEQ ID NO: 9468374 - DNA, 23 bp, Homo sapiens
gtgcttgaaagatgcagaattaa

SEQ ID NO: 9468375 - DNA, 22 bp, Homo sapiens
gtgctgtattgagacaaggtcg

SEQ ID NO: 9468376 - DNA, 22 bp, Homo sapiens
gtgctgtattgagacaaggtcg

SEQ ID NO: 9468377 - DNA, 22 bp, Homo sapiens
gtgctgggggtttctgtaggtc

SEQ ID NO: 9468378 - DNA, 22 bp, Homo sapiens
gtgctgggtgctgcagacaggt

SEQ ID NO: 9468379 - DNA, 22 bp, Homo sapiens
gtgctgggtgctgcagacaggt

SEQ ID NO: 9468380 - DNA, 22 bp, Homo sapiens
gtgctgggggtttctgtaggtc

SEQ ID NO: 9468381 - DNA, 22 bp, Homo sapiens
gtgctgggggtttctgtaggtc

SEQ ID NO: 9468382 - DNA, 22 bp, Homo sapiens
gtgctgtaacaacagagtgtct

SEQ ID NO: 9468383 - DNA, 22 bp, Homo sapiens
gtgctgtatatgcaagaggaag

SEQ ID NO: 9468384 - DNA, 22 bp, Homo sapiens
gtgctgtatatgcaagaggaag

SEQ ID NO: 9468385 - DNA, 22 bp, Homo sapiens
gtgctgtatcagaatctgctct

SEQ ID NO: 9468386 - DNA, 22 bp, Homo sapiens
gtgctgggtgctgcagacaggt

SEQ ID NO: 9468387 - DNA, 22 bp, Homo sapiens
gtgctgggtgctgcagacaggt

SEQ ID NO: 9468388 - DNA, 22 bp, Homo sapiens
gtgctgggtgctgcagacaggt

SEQ ID NO: 9468389 - DNA, 22 bp, Homo sapiens
gtgctgggtgctgcagacaggt

SEQ ID NO: 9468390 - DNA, 22 bp, Homo sapiens
gtgctggtatatgactgagttt

SEQ ID NO: 9468391 - DNA, 22 bp, Homo sapiens
gtgctggggagataggaagaga

SEQ ID NO: 9468392 - DNA, 22 bp, Homo sapiens
gtgctgggggtttctgtaggtc

SEQ ID NO: 9468393 - DNA, 22 bp, Homo sapiens
gtgctggggagataggaagaga

SEQ ID NO: 9468394 - DNA, 22 bp, Homo sapiens
gtgctggggagataggaagaga

SEQ ID NO: 9468395 - DNA, 22 bp, Homo sapiens
gtgctggggagataggaagaga

SEQ ID NO: 9468396 - DNA, 22 bp, Homo sapiens
gtgctgggctccaccccagagg

SEQ ID NO: 9468397 - DNA, 22 bp, Homo sapiens
gtgctgggctccaccccagagg

SEQ ID NO: 9468398 - DNA, 22 bp, Homo sapiens
gtgctgggccctgagaccaggg

SEQ ID NO: 9468399 - DNA, 22 bp, Homo sapiens
gtgctgggccctgagaccaggg

SEQ ID NO: 9468400 - DNA, 22 bp, Homo sapiens
gtgctgggccctgagaccaggg

SEQ ID NO: 9468401 - DNA, 22 bp, Homo sapiens
gtgctgggccctgagaccaggg

SEQ ID NO: 9468402 - DNA, 22 bp, Homo sapiens
gtgctgggattacaggtgtgag

SEQ ID NO: 9468403 - DNA, 22 bp, Homo sapiens
gtgctgggattacaggtgtgag

SEQ ID NO: 9468404 - DNA, 22 bp, Homo sapiens
gtgctgggattacaggtgtgag

SEQ ID NO: 9468405 - DNA, 22 bp, Homo sapiens
gtgctgggattacaggtgtgag

SEQ ID NO: 9468406 - DNA, 22 bp, Homo sapiens
gtgagtgtcagtcaaaggtttt

SEQ ID NO: 9468407 - DNA, 22 bp, Homo sapiens
gtgagtctttggagacagttca

SEQ ID NO: 9468408 - DNA, 23 bp, Homo sapiens
gtgagtcttgcctttgctgtgga

SEQ ID NO: 9468409 - DNA, 22 bp, Homo sapiens
gtgagtcaatgtattgcagcaa

SEQ ID NO: 9468410 - DNA, 22 bp, Homo sapiens
gtgagtcaatgtattgcagcaa

SEQ ID NO: 9468411 - DNA, 22 bp, Homo sapiens
gtgataaaatagaaacagtggt

SEQ ID NO: 9468412 - DNA, 22 bp, Homo sapiens
gtgataaaattcaaatagctct

SEQ ID NO: 9468413 - DNA, 22 bp, Homo sapiens
gtgataaagacgtgtcataatt

SEQ ID NO: 9468414 - DNA, 22 bp, Homo sapiens
gtgataaaggggaggaagtgtg

SEQ ID NO: 9468415 - DNA, 22 bp, Homo sapiens
gtgagtgttaacccactgcttc

SEQ ID NO: 9468416 - DNA, 22 bp, Homo sapiens
gtgagttgggggattagaagct

SEQ ID NO: 9468417 - DNA, 22 bp, Homo sapiens
gtgataaaatagaaacagtggt

SEQ ID NO: 9468418 - DNA, 22 bp, Homo sapiens
gtgagtgtcagtcaaaggtttt

SEQ ID NO: 9468419 - DNA, 22 bp, Homo sapiens
gtgagtgttaacccactgcttc

SEQ ID NO: 9468420 - DNA, 22 bp, Homo sapiens
gtgagtgccaggtgaagtatgt

SEQ ID NO: 9468421 - DNA, 22 bp, Homo sapiens
gtgatgtcacagaataagtgat

SEQ ID NO: 9468422 - DNA, 22 bp, Homo sapiens
gtgatgtggggaccgtcctggc

SEQ ID NO: 9468423 - DNA, 22 bp, Homo sapiens
gtgatgtcttgtacatatgatt

SEQ ID NO: 9468424 - DNA, 22 bp, Homo sapiens
gtgatgtggggaccgtcctggc

SEQ ID NO: 9468425 - DNA, 22 bp, Homo sapiens
gtgattaactgcagttagagct

SEQ ID NO: 9468426 - DNA, 22 bp, Homo sapiens
gtgatgtcacacccttgataga

SEQ ID NO: 9468427 - DNA, 22 bp, Homo sapiens
gtgatggatgtgtatcttttta

SEQ ID NO: 9468428 - DNA, 22 bp, Homo sapiens
gtgatggagtcaaggctagaac

SEQ ID NO: 9468429 - DNA, 22 bp, Homo sapiens
gtgatggagtcaaggctagaac

SEQ ID NO: 9468430 - DNA, 22 bp, Homo sapiens
gtgatggaataatccaagattt

SEQ ID NO: 9468431 - DNA, 22 bp, Homo sapiens
gtgatggaataatccaagattt

SEQ ID NO: 9468432 - DNA, 22 bp, Homo sapiens
gtgatggaagtcttgttccggg

SEQ ID NO: 9468433 - DNA, 23 bp, Homo sapiens
gtgatattaaggatagagacaag

SEQ ID NO: 9468434 - DNA, 22 bp, Homo sapiens
gtgataagacagtaggcacaag

SEQ ID NO: 9468435 - DNA, 22 bp, Homo sapiens
gtgaggcagggaaagaggataa

SEQ ID NO: 9468436 - DNA, 22 bp, Homo sapiens
gtcttcttttcagtctgcttgt

SEQ ID NO: 9468437 - DNA, 22 bp, Homo sapiens
gtcttctggggccaggcccgct

SEQ ID NO: 9468438 - DNA, 22 bp, Homo sapiens
gtcttctgcctccattagagtt

SEQ ID NO: 9468439 - DNA, 22 bp, Homo sapiens
gtcttctggaagagagccagct

SEQ ID NO: 9468440 - DNA, 22 bp, Homo sapiens
gtcttctgtctgtctggcatgt

SEQ ID NO: 9468441 - DNA, 22 bp, Homo sapiens
gtcttctgttctgtgaggcttc

SEQ ID NO: 9468442 - DNA, 22 bp, Homo sapiens
gtcttctgtctgtctggcatgt

SEQ ID NO: 9468443 - DNA, 22 bp, Homo sapiens
gtcttctgtctgtctggcatgt

SEQ ID NO: 9468444 - DNA, 22 bp, Homo sapiens
gtgaggtgggctggccagagac

SEQ ID NO: 9468445 - DNA, 22 bp, Homo sapiens
gtgaggtgggctgggctctatg

SEQ ID NO: 9468446 - DNA, 22 bp, Homo sapiens
gtgaggtgggctggccagagac

SEQ ID NO: 9468447 - DNA, 22 bp, Homo sapiens
gtgaggtgactagcaggtgggg

SEQ ID NO: 9468448 - DNA, 22 bp, Homo sapiens
gtgaggtgactagcaggtgggg

SEQ ID NO: 9468449 - DNA, 22 bp, Homo sapiens
gtgaggccgcacgccccggagt

SEQ ID NO: 9468450 - DNA, 22 bp, Homo sapiens
gtgaggccgcacgccccggagt

SEQ ID NO: 9468451 - DNA, 22 bp, Homo sapiens
gtgaggcgaaggtgctggcgcc

SEQ ID NO: 9468452 - DNA, 22 bp, Homo sapiens
gtgaggctactcagctgtccga

SEQ ID NO: 9468453 - DNA, 22 bp, Homo sapiens
gtctctgacctgcgtccctcct

SEQ ID NO: 9468454 - DNA, 22 bp, Homo sapiens
gtctggggtactttcatctgat

SEQ ID NO: 9468455 - DNA, 22 bp, Homo sapiens
gtctctgaagtcagtttttcta

SEQ ID NO: 9468456 - DNA, 22 bp, Homo sapiens
gtctctctgctaggcctccagt

SEQ ID NO: 9468457 - DNA, 22 bp, Homo sapiens
gtctctctgactggtccacacc

SEQ ID NO: 9468458 - DNA, 22 bp, Homo sapiens
gtctctctgactggtccacacc

SEQ ID NO: 9468459 - DNA, 22 bp, Homo sapiens
gtctctatcatagctgaaccct

SEQ ID NO: 9468460 - DNA, 22 bp, Homo sapiens
gtctctatcatagctgaaccct

SEQ ID NO: 9468461 - DNA, 22 bp, Homo sapiens
gtctccttgtggatctcaagga

SEQ ID NO: 9468462 - DNA, 22 bp, Homo sapiens
gtctctatcatagctgaaccct

SEQ ID NO: 9468463 - DNA, 22 bp, Homo sapiens
gtctcctgtcctgcaggatgga

SEQ ID NO: 9468464 - DNA, 22 bp, Homo sapiens
gtctcctgtcctgcaggatgga

SEQ ID NO: 9468465 - DNA, 22 bp, Homo sapiens
gtctccttgtggatctcaagga

SEQ ID NO: 9468466 - DNA, 22 bp, Homo sapiens
gtctccttgtggatctcaagga

SEQ ID NO: 9468467 - DNA, 22 bp, Homo sapiens
gtctcctggcttttgtcccagt

SEQ ID NO: 9468468 - DNA, 22 bp, Homo sapiens
gtctcctgagactgcagtcacc

SEQ ID NO: 9468469 - DNA, 22 bp, Homo sapiens
gtctcctgagccttgactgcaa

SEQ ID NO: 9468470 - DNA, 22 bp, Homo sapiens
gtctcctgagccttgactgcaa

SEQ ID NO: 9468471 - DNA, 20 bp, Homo sapiens
gtctcctctttgcattccta

SEQ ID NO: 9468472 - DNA, 22 bp, Homo sapiens
gtctcctgagccttgactgcaa

SEQ ID NO: 9468473 - DNA, 22 bp, Homo sapiens
gtctcctgaggcatccattgaa

SEQ ID NO: 9468474 - DNA, 22 bp, Homo sapiens
gtctcctgaggcatccattgaa

SEQ ID NO: 9468475 - DNA, 22 bp, Homo sapiens
gtctcctgaggcatccattgaa

SEQ ID NO: 9468476 - DNA, 22 bp, Homo sapiens
gtctcctgaggcatccattgaa

SEQ ID NO: 9468477 - DNA, 22 bp, Homo sapiens
gtctcctgccacactcagtccc

SEQ ID NO: 9468478 - DNA, 22 bp, Homo sapiens
gtctcctggctgcagctaagac

SEQ ID NO: 9468479 - DNA, 22 bp, Homo sapiens
gtctcctggctgcagctaagac

SEQ ID NO: 9468480 - DNA, 22 bp, Homo sapiens
gtctcctggctgcagctaagac

SEQ ID NO: 9468481 - DNA, 22 bp, Homo sapiens
gtctcctggcctccagtttctc

SEQ ID NO: 9468482 - DNA, 22 bp, Homo sapiens
gtctcctggcctccagtttctc

SEQ ID NO: 9468483 - DNA, 22 bp, Homo sapiens
gtctcctggcctccagtttctc

SEQ ID NO: 9468484 - DNA, 22 bp, Homo sapiens
gtctcctgcccccggtgcttgg

SEQ ID NO: 9468485 - DNA, 22 bp, Homo sapiens
gtctcctgcccccggtgcttgg

SEQ ID NO: 9468486 - DNA, 22 bp, Homo sapiens
gtctcctgctagcaagcaccac

SEQ ID NO: 9468487 - DNA, 22 bp, Homo sapiens
gtcttctgatctggttagccat

SEQ ID NO: 9468488 - DNA, 22 bp, Homo sapiens
gtcttctaagtatcaaagcaga

SEQ ID NO: 9468489 - DNA, 22 bp, Homo sapiens
gtcttcctaatttgctattagg

SEQ ID NO: 9468490 - DNA, 22 bp, Homo sapiens
gtcttctgcaactgcacctgcc

SEQ ID NO: 9468491 - DNA, 22 bp, Homo sapiens
gtcttctgcccaggcagacgga

SEQ ID NO: 9468492 - DNA, 22 bp, Homo sapiens
gtcttcagtggcaaatggatct

SEQ ID NO: 9468493 - DNA, 22 bp, Homo sapiens
gtcttcattcaacaaatattca

SEQ ID NO: 9468494 - DNA, 22 bp, Homo sapiens
gtcttatttaacctaaatttct

SEQ ID NO: 9468495 - DNA, 20 bp, Homo sapiens
gtcttatttaacacatgact

SEQ ID NO: 9468496 - DNA, 20 bp, Homo sapiens
gtcttatttaacacatgact

SEQ ID NO: 9468497 - DNA, 22 bp, Homo sapiens
gtcttatttaaggcttatacaa

SEQ ID NO: 9468498 - DNA, 22 bp, Homo sapiens
gtcttatttaaggacaagaaga

SEQ ID NO: 9468499 - DNA, 22 bp, Homo sapiens
gtcttatttaaggacaagaaga

SEQ ID NO: 9468500 - DNA, 22 bp, Homo sapiens
gtcttattttctgtctactaaa

SEQ ID NO: 9468501 - DNA, 22 bp, Homo sapiens
gtcttattttctgtctactaaa

SEQ ID NO: 9468502 - DNA, 22 bp, Homo sapiens
gtcttatttaaagagatcatac

SEQ ID NO: 9468503 - DNA, 22 bp, Homo sapiens
gtcttatttaaagagatcatac

SEQ ID NO: 9468504 - DNA, 22 bp, Homo sapiens
gtcttatttaaagagatcatac

SEQ ID NO: 9468505 - DNA, 22 bp, Homo sapiens
gtcttattgcgtatgtatacaa

SEQ ID NO: 9468506 - DNA, 22 bp, Homo sapiens
gtcttattatgaggttagactt

SEQ ID NO: 9468507 - DNA, 22 bp, Homo sapiens
gtcttattgggtccaaggtggc

SEQ ID NO: 9468508 - DNA, 22 bp, Homo sapiens
gtcttattgcgtatgtatacaa

SEQ ID NO: 9468509 - DNA, 22 bp, Homo sapiens
gtcttattaaaaatctaatccc

SEQ ID NO: 9468510 - DNA, 22 bp, Homo sapiens
gtcttattaaaaatctaatccc

SEQ ID NO: 9468511 - DNA, 22 bp, Homo sapiens
gtcttattaaaatgcagtttct

SEQ ID NO: 9468512 - DNA, 22 bp, Homo sapiens
gtcttattaaaatgcagtttct

SEQ ID NO: 9468513 - DNA, 22 bp, Homo sapiens
gtcttattaaaatgcagtttct

SEQ ID NO: 9468514 - DNA, 22 bp, Homo sapiens
gtcttattatgaggttagactt

SEQ ID NO: 9468515 - DNA, 22 bp, Homo sapiens
gtcttattaggttaaccctgct

SEQ ID NO: 9468516 - DNA, 22 bp, Homo sapiens
gtcttattatgaggttagactt

SEQ ID NO: 9468517 - DNA, 22 bp, Homo sapiens
gtcttattaaattgaaccctca

SEQ ID NO: 9468518 - DNA, 22 bp, Homo sapiens
gtctggggtgaggcccgggatt

SEQ ID NO: 9468519 - DNA, 22 bp, Homo sapiens
gtcttagatttcaccgataatg

SEQ ID NO: 9468520 - DNA, 22 bp, Homo sapiens
gcagcagctcagccgggcactg

SEQ ID NO: 9468521 - DNA, 22 bp, Homo sapiens
gcagcagctcagccgggcactg

SEQ ID NO: 9468522 - DNA, 22 bp, Homo sapiens
gcagcagctcagccgggcactg

SEQ ID NO: 9468523 - DNA, 22 bp, Homo sapiens
gcagcagctcagccgggcactg

SEQ ID NO: 9468524 - DNA, 22 bp, Homo sapiens
gcagcagctcagttctgggagg

SEQ ID NO: 9468525 - DNA, 22 bp, Homo sapiens
gcagcagctcagttctgggagg

SEQ ID NO: 9468526 - DNA, 22 bp, Homo sapiens
gcagcagctctgaatgggcccc

SEQ ID NO: 9468527 - DNA, 22 bp, Homo sapiens
gcagcagctgacagtgggtgcc

SEQ ID NO: 9468528 - DNA, 22 bp, Homo sapiens
gcagcagctccctatccaggct

SEQ ID NO: 9468529 - DNA, 22 bp, Homo sapiens
gcagcagctctcaaagtggtct

SEQ ID NO: 9468530 - DNA, 22 bp, Homo sapiens
gcagcagctctgaatgggcccc

SEQ ID NO: 9468531 - DNA, 22 bp, Homo sapiens
gcagcagcggggcccctgcgcg

SEQ ID NO: 9468532 - DNA, 22 bp, Homo sapiens
gcagcagcggggcccctgcgcg

SEQ ID NO: 9468533 - DNA, 22 bp, Homo sapiens
gcagcagccgacatggattgca

SEQ ID NO: 9468534 - DNA, 22 bp, Homo sapiens
gcagcagcccagggctctcaga

SEQ ID NO: 9468535 - DNA, 22 bp, Homo sapiens
gcagcagcccagggctctcaga

SEQ ID NO: 9468536 - DNA, 22 bp, Homo sapiens
gcagaggaggacccaggaatta

SEQ ID NO: 9468537 - DNA, 22 bp, Homo sapiens
gcagaggagcaagttgctacag

SEQ ID NO: 9468538 - DNA, 23 bp, Homo sapiens
gcagaggagcaagctggacacca

SEQ ID NO: 9468539 - DNA, 22 bp, Homo sapiens
gcagaggagcaagttgctacag

SEQ ID NO: 9468540 - DNA, 22 bp, Homo sapiens
gcagaggaggacccaggaatta

SEQ ID NO: 9468541 - DNA, 22 bp, Homo sapiens
gcagaggaggacccaggaatta

SEQ ID NO: 9468542 - DNA, 22 bp, Homo sapiens
gcagaggaggacccaggaatta

SEQ ID NO: 9468543 - DNA, 22 bp, Homo sapiens
gcagcaggaataggataagcaa

SEQ ID NO: 9468544 - DNA, 22 bp, Homo sapiens
gcagcaggaataggataagcaa

SEQ ID NO: 9468545 - DNA, 22 bp, Homo sapiens
gcagcaggaataggataagcaa

SEQ ID NO: 9468546 - DNA, 22 bp, Homo sapiens
gcagcaggaataggataagcaa

SEQ ID NO: 9468547 - DNA, 22 bp, Homo sapiens
gcagcaggaataggataagcaa

SEQ ID NO: 9468548 - DNA, 22 bp, Homo sapiens
gcagcagctgacagtgggtgcc

SEQ ID NO: 9468549 - DNA, 22 bp, Homo sapiens
gcagcaggaatttaaatttata

SEQ ID NO: 9468550 - DNA, 22 bp, Homo sapiens
gcagcaggagagtaatagcggt

SEQ ID NO: 9468551 - DNA, 22 bp, Homo sapiens
gcagcaggagagtaatagcggt

SEQ ID NO: 9468552 - DNA, 22 bp, Homo sapiens
gcagcaggagagtttgtcctgc

SEQ ID NO: 9468553 - DNA, 22 bp, Homo sapiens
gcagcaggagagtttgtcctgc

SEQ ID NO: 9468554 - DNA, 22 bp, Homo sapiens
gcagcaggagagtaatagcggt

SEQ ID NO: 9468555 - DNA, 22 bp, Homo sapiens
gcagcaggagagtaatagcggt

SEQ ID NO: 9468556 - DNA, 22 bp, Homo sapiens
gcagcaggactgccgttaaagt

SEQ ID NO: 9468557 - DNA, 22 bp, Homo sapiens
gcagcaggcacggtctcgacat

SEQ ID NO: 9468558 - DNA, 22 bp, Homo sapiens
gcagcaggcacttaccgttgct

SEQ ID NO: 9468559 - DNA, 22 bp, Homo sapiens
gcagcaggtctgtcaatgtcat

SEQ ID NO: 9468560 - DNA, 22 bp, Homo sapiens
gcagcaggtctgtcaatgtcat

SEQ ID NO: 9468561 - DNA, 22 bp, Homo sapiens
gcagcaggtctgtcaatgtcat

SEQ ID NO: 9468562 - DNA, 22 bp, Homo sapiens
gcagcaggtctgtcaatgtcat

SEQ ID NO: 9468563 - DNA, 22 bp, Homo sapiens
gcagcaggtgtgcttttaatga

SEQ ID NO: 9468564 - DNA, 22 bp, Homo sapiens
gcagcaggatggccaattgcca

SEQ ID NO: 9468565 - DNA, 22 bp, Homo sapiens
gcagcaggatggccaattgcca

SEQ ID NO: 9468566 - DNA, 22 bp, Homo sapiens
gcagcaggagagtttgtcctgc

SEQ ID NO: 9468567 - DNA, 22 bp, Homo sapiens
gcagcaggatggccaattgcca

SEQ ID NO: 9468568 - DNA, 22 bp, Homo sapiens
gcagcaggcacggtctcgacat

SEQ ID NO: 9468569 - DNA, 22 bp, Homo sapiens
gcagcaggcacggtctcgacat

SEQ ID NO: 9468570 - DNA, 22 bp, Homo sapiens
gcagctgccagtccccttccag

SEQ ID NO: 9468571 - DNA, 22 bp, Homo sapiens
gcagctgcaggcaggcttgctg

SEQ ID NO: 9468572 - DNA, 22 bp, Homo sapiens
gcagctgcaggcaggcttgctg

SEQ ID NO: 9468573 - DNA, 22 bp, Homo sapiens
gcagctgccccgactgtgagtc

SEQ ID NO: 9468574 - DNA, 22 bp, Homo sapiens
gcagctgcaagcacttctggca

SEQ ID NO: 9468575 - DNA, 22 bp, Homo sapiens
gcagctgcaataggcatcaagc

SEQ ID NO: 9468576 - DNA, 22 bp, Homo sapiens
gcagcatttgtggaatgggccc

SEQ ID NO: 9468577 - DNA, 22 bp, Homo sapiens
gcagcattgcacttttgttctt

SEQ ID NO: 9468578 - DNA, 22 bp, Homo sapiens
gcagcattgtgaggtcctgccc

SEQ ID NO: 9468579 - DNA, 22 bp, Homo sapiens
gcagctgcaagcacttctggca

SEQ ID NO: 9468580 - DNA, 22 bp, Homo sapiens
gcagccacagaggagggatgca

SEQ ID NO: 9468581 - DNA, 22 bp, Homo sapiens
gcagccacactgttacagaatg

SEQ ID NO: 9468582 - DNA, 22 bp, Homo sapiens
gcagcagtggttttatcatttt

SEQ ID NO: 9468583 - DNA, 22 bp, Homo sapiens
gcagcagtgtgggctgaaccta

SEQ ID NO: 9468584 - DNA, 22 bp, Homo sapiens
gcagcagtgtctcccatcttgc

SEQ ID NO: 9468585 - DNA, 22 bp, Homo sapiens
gcagcagtggctgcaggtccca

SEQ ID NO: 9468586 - DNA, 22 bp, Homo sapiens
gcagcagtggctgcaggtccca

SEQ ID NO: 9468587 - DNA, 22 bp, Homo sapiens
gcagcagtggtctgtagaagga

SEQ ID NO: 9468588 - DNA, 22 bp, Homo sapiens
gcagcagtggctgcaggtccca

SEQ ID NO: 9468589 - DNA, 22 bp, Homo sapiens
gcagcagtggtctgtagaagga

SEQ ID NO: 9468590 - DNA, 22 bp, Homo sapiens
gcagcaggtgtgcttttaatga

SEQ ID NO: 9468591 - DNA, 20 bp, Homo sapiens
gcagcagtgcaagtcctctt

SEQ ID NO: 9468592 - DNA, 19 bp, Homo sapiens
gcagcagtggaaggaaaaa

SEQ ID NO: 9468593 - DNA, 22 bp, Homo sapiens
gcagcagtgctttggaatcctg

SEQ ID NO: 9468594 - DNA, 20 bp, Homo sapiens
gcagcagtgcaagtcctctt

SEQ ID NO: 9468595 - DNA, 20 bp, Homo sapiens
gcagcagtgcaagtcctctt

SEQ ID NO: 9468596 - DNA, 20 bp, Homo sapiens
gcagcagtgcaagtcctctt

SEQ ID NO: 9468597 - DNA, 22 bp, Homo sapiens
gcagcagtgcgggcagctacag

SEQ ID NO: 9468598 - DNA, 22 bp, Homo sapiens
gcagcatggagttgtggaatga

SEQ ID NO: 9468599 - DNA, 22 bp, Homo sapiens
gcagcatggagaagtagctaga

SEQ ID NO: 9468600 - DNA, 21 bp, Homo sapiens
gcagcatgagaaagccccaaa

SEQ ID NO: 9468601 - DNA, 22 bp, Homo sapiens
gcagcattaccaagacatggca

SEQ ID NO: 9468602 - DNA, 22 bp, Homo sapiens
gcagcatcctgggccacagtcc

SEQ ID NO: 9468603 - DNA, 22 bp, Homo sapiens
gcagcatcctgggccacagtcc

SEQ ID NO: 9468604 - DNA, 22 bp, Homo sapiens
gcagcatccttggcctccaccc

SEQ ID NO: 9468605 - DNA, 22 bp, Homo sapiens
gcagcatccttggcctccaccc

SEQ ID NO: 9468606 - DNA, 22 bp, Homo sapiens
gcagcatctagggcactggcct

SEQ ID NO: 9468607 - DNA, 22 bp, Homo sapiens
gcagcatctgtacatagacgct

SEQ ID NO: 9468608 - DNA, 22 bp, Homo sapiens
gcagcatcaatccatgcttctc

SEQ ID NO: 9468609 - DNA, 22 bp, Homo sapiens
gcagcatcaggttcactgcgtg

SEQ ID NO: 9468610 - DNA, 22 bp, Homo sapiens
gcagcatccccaggcagcaggg

SEQ ID NO: 9468611 - DNA, 22 bp, Homo sapiens
gcagcatccccaggcagcaggg

SEQ ID NO: 9468612 - DNA, 16 bp, Homo sapiens
gcaggagtaccacttg

SEQ ID NO: 9468613 - DNA, 22 bp, Homo sapiens
gcaggaggttgagccaggactg

SEQ ID NO: 9468614 - DNA, 22 bp, Homo sapiens
gcaggaggttgagccaggactg

SEQ ID NO: 9468615 - DNA, 22 bp, Homo sapiens
gcaggaggccaggtatgcttta

SEQ ID NO: 9468616 - DNA, 22 bp, Homo sapiens
gcaggaggttgagccaggactg

SEQ ID NO: 9468617 - DNA, 22 bp, Homo sapiens
gcaggagtatgcagctatggtt

SEQ ID NO: 9468618 - DNA, 22 bp, Homo sapiens
gcaggagtatgcagctatggtt

SEQ ID NO: 9468619 - DNA, 22 bp, Homo sapiens
gcaggagtatctatacattaaa

SEQ ID NO: 9468620 - DNA, 22 bp, Homo sapiens
gcaggagtcagccctaccttga

SEQ ID NO: 9468621 - DNA, 22 bp, Homo sapiens
gcaggagtcactgacttggtcc

SEQ ID NO: 9468622 - DNA, 22 bp, Homo sapiens
gcaggagtcccagaaggttttg

SEQ ID NO: 9468623 - DNA, 22 bp, Homo sapiens
gcaggagtatgcagctatggtt

SEQ ID NO: 9468624 - DNA, 22 bp, Homo sapiens
gcaggagtcagccctaccttga

SEQ ID NO: 9468625 - DNA, 22 bp, Homo sapiens
gcaggagtgacatggatgtgga

SEQ ID NO: 9468626 - DNA, 22 bp, Homo sapiens
gcaggagtgacatggatgtgga

SEQ ID NO: 9468627 - DNA, 22 bp, Homo sapiens
gcaggagtggagaccatgggga

SEQ ID NO: 9468628 - DNA, 22 bp, Homo sapiens
gcaggagtgtatttgcatgtaa

SEQ ID NO: 9468629 - DNA, 22 bp, Homo sapiens
gcaggagtggagaccatgggga

SEQ ID NO: 9468630 - DNA, 22 bp, Homo sapiens
gcaggagtgtggtgggacatcc

SEQ ID NO: 9468631 - DNA, 22 bp, Homo sapiens
gcaggagttaaaatatgtaatg

SEQ ID NO: 9468632 - DNA, 22 bp, Homo sapiens
gcaggagtgtgtctaatactca

SEQ ID NO: 9468633 - DNA, 22 bp, Homo sapiens
gcaggagtgtggtgggacatcc

SEQ ID NO: 9468634 - DNA, 22 bp, Homo sapiens
gcaggagttaaaatatgtaatg

SEQ ID NO: 9468635 - DNA, 22 bp, Homo sapiens
gcaggagttagaggtttaatct

SEQ ID NO: 9468636 - DNA, 22 bp, Homo sapiens
gcaggcctctaattcaccgcag

SEQ ID NO: 9468637 - DNA, 22 bp, Homo sapiens
gcaggcctctgttgagggcctt

SEQ ID NO: 9468638 - DNA, 22 bp, Homo sapiens
gcaggcctctgttgagggcctt

SEQ ID NO: 9468639 - DNA, 22 bp, Homo sapiens
gcaggcctctgttgagggcctt

SEQ ID NO: 9468640 - DNA, 22 bp, Homo sapiens
gcagctggatttcaagagggag

SEQ ID NO: 9468641 - DNA, 22 bp, Homo sapiens
gcagctggatttcaagagggag

SEQ ID NO: 9468642 - DNA, 22 bp, Homo sapiens
gcagctggcccctttccttgtt

SEQ ID NO: 9468643 - DNA, 22 bp, Homo sapiens
gcagctggcccctttccttgtt

SEQ ID NO: 9468644 - DNA, 22 bp, Homo sapiens
gcaggagctgctctcctgacga

SEQ ID NO: 9468645 - DNA, 22 bp, Homo sapiens
gcaggagctggaaagtgatgtt

SEQ ID NO: 9468646 - DNA, 22 bp, Homo sapiens
gcaggaggatcacttgagccca

SEQ ID NO: 9468647 - DNA, 22 bp, Homo sapiens
gcaggaggatcacttgagccca

SEQ ID NO: 9468648 - DNA, 22 bp, Homo sapiens
gcaggaggagcattaactgagc

SEQ ID NO: 9468649 - DNA, 22 bp, Homo sapiens
gcaggagctttgcttactgctg

SEQ ID NO: 9468650 - DNA, 22 bp, Homo sapiens
gcagctggacccacacggctta

SEQ ID NO: 9468651 - DNA, 22 bp, Homo sapiens
gcagctggacccacacggctta

SEQ ID NO: 9468652 - DNA, 22 bp, Homo sapiens
gcagctggagaaataccaccct

SEQ ID NO: 9468653 - DNA, 22 bp, Homo sapiens
gcagctggagcatcttctcatc

SEQ ID NO: 9468654 - DNA, 22 bp, Homo sapiens
gcagctggagcatcttctcatc

SEQ ID NO: 9468655 - DNA, 22 bp, Homo sapiens
gcagctggatttcaagagggag

SEQ ID NO: 9468656 - DNA, 22 bp, Homo sapiens
gcagctggagccagccagacac

SEQ ID NO: 9468657 - DNA, 22 bp, Homo sapiens
gcagctggatttcaagagggag

SEQ ID NO: 9468658 - DNA, 22 bp, Homo sapiens
gcagggccttagcagcggctgc

SEQ ID NO: 9468659 - DNA, 22 bp, Homo sapiens
gcagggccttagcagcggctgc

SEQ ID NO: 9468660 - DNA, 22 bp, Homo sapiens
gcagggccttagcagcggctgc

SEQ ID NO: 9468661 - DNA, 22 bp, Homo sapiens
gcaggctgatagaggattccat

SEQ ID NO: 9468662 - DNA, 22 bp, Homo sapiens
gcaggctgatagaggattccat

SEQ ID NO: 9468663 - DNA, 22 bp, Homo sapiens
gcaggctgagtattaccctagt

SEQ ID NO: 9468664 - DNA, 22 bp, Homo sapiens
gcaggctgatgactggagttgg

SEQ ID NO: 9468665 - DNA, 22 bp, Homo sapiens
gcaggctgatgactggagttgg

SEQ ID NO: 9468666 - DNA, 22 bp, Homo sapiens
gcaggctgatgactggagttgg

SEQ ID NO: 9468667 - DNA, 22 bp, Homo sapiens
gcagggctaggtcttctagggc

SEQ ID NO: 9468668 - DNA, 22 bp, Homo sapiens
gcagggctagatatttgcaagt

SEQ ID NO: 9468669 - DNA, 22 bp, Homo sapiens
gcagggctattggaaggagatg

SEQ ID NO: 9468670 - DNA, 22 bp, Homo sapiens
gcagggcgcgtttgagcgggct

SEQ ID NO: 9468671 - DNA, 22 bp, Homo sapiens
gcagggcgcgtttgagcgggct

SEQ ID NO: 9468672 - DNA, 22 bp, Homo sapiens
gcagggcggcccagagcaggcc

SEQ ID NO: 9468673 - DNA, 22 bp, Homo sapiens
gcaggctgagttgggaaaccaa

SEQ ID NO: 9468674 - DNA, 22 bp, Homo sapiens
gcaggctgagtattaccctagt

SEQ ID NO: 9468675 - DNA, 22 bp, Homo sapiens
gcaggctgagtattaccctagt

SEQ ID NO: 9468676 - DNA, 22 bp, Homo sapiens
gcaggctgagagtccaagaagg

SEQ ID NO: 9468677 - DNA, 22 bp, Homo sapiens
gcaggctgaaactcggggtcta

SEQ ID NO: 9468678 - DNA, 22 bp, Homo sapiens
gcaggctgaaactcggggtcta

SEQ ID NO: 9468679 - DNA, 22 bp, Homo sapiens
gcaggctgaaactcggggtcta

SEQ ID NO: 9468680 - DNA, 22 bp, Homo sapiens
gcaggctcgttggaagtcccct

SEQ ID NO: 9468681 - DNA, 22 bp, Homo sapiens
gcaggctccaaggcctgggaga

SEQ ID NO: 9468682 - DNA, 22 bp, Homo sapiens
gcaggctccaaggcctgggaga

SEQ ID NO: 9468683 - DNA, 22 bp, Homo sapiens
gcaggctcccttgcagagcagg

SEQ ID NO: 9468684 - DNA, 22 bp, Homo sapiens
gcaggctccaggccggcccctt

SEQ ID NO: 9468685 - DNA, 22 bp, Homo sapiens
gcaggctcccttgcagagcagg

SEQ ID NO: 9468686 - DNA, 22 bp, Homo sapiens
gcaggctcccttgcagagcagg

SEQ ID NO: 9468687 - DNA, 20 bp, Homo sapiens
gcaggctccgggcttgggag

SEQ ID NO: 9468688 - DNA, 20 bp, Homo sapiens
gcaggctccgggcttgggag

SEQ ID NO: 9468689 - DNA, 22 bp, Homo sapiens
gcaggctcgttggaagtcccct

SEQ ID NO: 9468690 - DNA, 19 bp, Homo sapiens
gcaggcctcttgggaatta

SEQ ID NO: 9468691 - DNA, 19 bp, Homo sapiens
gcaggcctcttgggaatta

SEQ ID NO: 9468692 - DNA, 22 bp, Homo sapiens
gcaggctcaaaagctggtagga

SEQ ID NO: 9468693 - DNA, 22 bp, Homo sapiens
gcaggctcagagcagattagca

SEQ ID NO: 9468694 - DNA, 22 bp, Homo sapiens
gcaggctccaactggaggagtt

SEQ ID NO: 9468695 - DNA, 22 bp, Homo sapiens
gagggtcccgagccctgtcaga

SEQ ID NO: 9468696 - DNA, 22 bp, Homo sapiens
gagggtcccgagccctgtcaga

SEQ ID NO: 9468697 - DNA, 22 bp, Homo sapiens
gagggtcccgagccctgtcaga

SEQ ID NO: 9468698 - DNA, 22 bp, Homo sapiens
gagggtccccatgcagagctca

SEQ ID NO: 9468699 - DNA, 22 bp, Homo sapiens
gagggtccccatgcagagctca

SEQ ID NO: 9468700 - DNA, 22 bp, Homo sapiens
gagggtccctgctcagggccag

SEQ ID NO: 9468701 - DNA, 22 bp, Homo sapiens
gcaaatcaccacctagctggat

SEQ ID NO: 9468702 - DNA, 19 bp, Homo sapiens
gcaaatctgaccaaatagt

SEQ ID NO: 9468703 - DNA, 21 bp, Homo sapiens
gcaaatgagttaactaactca

SEQ ID NO: 9468704 - DNA, 21 bp, Homo sapiens
gcaaatgagttaactaactca

SEQ ID NO: 9468705 - DNA, 22 bp, Homo sapiens
gcaaatgctaaagtgtagagac

SEQ ID NO: 9468706 - DNA, 22 bp, Homo sapiens
gcaagaacgaatcctacttgct

SEQ ID NO: 9468707 - DNA, 22 bp, Homo sapiens
gcaagaaaagagccttcagtgg

SEQ ID NO: 9468708 - DNA, 22 bp, Homo sapiens
gcaagcaagtatctggcaggga

SEQ ID NO: 9468709 - DNA, 22 bp, Homo sapiens
gcaagcaagtatctggcaggga

SEQ ID NO: 9468710 - DNA, 22 bp, Homo sapiens
gcaagcaatggacggtgacttt

SEQ ID NO: 9468711 - DNA, 22 bp, Homo sapiens
gcaagcaagcaggtagagctga

SEQ ID NO: 9468712 - DNA, 23 bp, Homo sapiens
gcaagcaaggcagggtaaagaga

SEQ ID NO: 9468713 - DNA, 22 bp, Homo sapiens
gcaagcaaaatgggagattccc

SEQ ID NO: 9468714 - DNA, 22 bp, Homo sapiens
gcaagcaaattatttataggca

SEQ ID NO: 9468715 - DNA, 22 bp, Homo sapiens
gcaagagtttctggagcagagt

SEQ ID NO: 9468716 - DNA, 19 bp, Homo sapiens
gcaagagcttaggaggggt

SEQ ID NO: 9468717 - DNA, 22 bp, Homo sapiens
gcaagagacttttatgtctgcc

SEQ ID NO: 9468718 - DNA, 22 bp, Homo sapiens
gaggggctgggtagggcaaccc

SEQ ID NO: 9468719 - DNA, 22 bp, Homo sapiens
gaggggctgggtagggcaaccc

SEQ ID NO: 9468720 - DNA, 22 bp, Homo sapiens
gaggggctgtggagctctctgg

SEQ ID NO: 9468721 - DNA, 22 bp, Homo sapiens
gaggggctgtggagctctctgg

SEQ ID NO: 9468722 - DNA, 22 bp, Homo sapiens
gaggggctgtggagctctctgg

SEQ ID NO: 9468723 - DNA, 22 bp, Homo sapiens
gaggggctgtggagctctctgg

SEQ ID NO: 9468724 - DNA, 22 bp, Homo sapiens
gagggggaaagtccctggagtc

SEQ ID NO: 9468725 - DNA, 22 bp, Homo sapiens
gagggggacgtatcctggtatg

SEQ ID NO: 9468726 - DNA, 22 bp, Homo sapiens
gagggggagatgtgcacacact

SEQ ID NO: 9468727 - DNA, 22 bp, Homo sapiens
gagggggagatgtgcacacact

SEQ ID NO: 9468728 - DNA, 22 bp, Homo sapiens
gaggggtggccctggcgtgtac

SEQ ID NO: 9468729 - DNA, 22 bp, Homo sapiens
gaggggtggccctggcgtgtac

SEQ ID NO: 9468730 - DNA, 22 bp, Homo sapiens
gaggggtgggctggaagttata

SEQ ID NO: 9468731 - DNA, 22 bp, Homo sapiens
gaggggtggcgttggcatttag

SEQ ID NO: 9468732 - DNA, 22 bp, Homo sapiens
gaggggtgtggagccatcagtt

SEQ ID NO: 9468733 - DNA, 22 bp, Homo sapiens
gaggggtgtggagccatcagtt

SEQ ID NO: 9468734 - DNA, 22 bp, Homo sapiens
gaggggtccaggaggcacttac

SEQ ID NO: 9468735 - DNA, 22 bp, Homo sapiens
gaggggtcacatgggctggctt

SEQ ID NO: 9468736 - DNA, 22 bp, Homo sapiens
gagggggcgaacagaagcaagg

SEQ ID NO: 9468737 - DNA, 22 bp, Homo sapiens
gagggggcgaacagaagcaagg

SEQ ID NO: 9468738 - DNA, 22 bp, Homo sapiens
gcacagccttgccctgtgccct

SEQ ID NO: 9468739 - DNA, 22 bp, Homo sapiens
gcacagccttgccctgtgccct

SEQ ID NO: 9468740 - DNA, 22 bp, Homo sapiens
gcacagctccgcttcctcacac

SEQ ID NO: 9468741 - DNA, 22 bp, Homo sapiens
gcacagctcagcatgggaggac

SEQ ID NO: 9468742 - DNA, 18 bp, Homo sapiens
gcacagctaggagggtcc

SEQ ID NO: 9468743 - DNA, 22 bp, Homo sapiens
gcacagctggactctgcctggc

SEQ ID NO: 9468744 - DNA, 20 bp, Homo sapiens
gcacagctgagttcagggtc

SEQ ID NO: 9468745 - DNA, 22 bp, Homo sapiens
gcacagctcgagctcaggaggg

SEQ ID NO: 9468746 - DNA, 22 bp, Homo sapiens
gcacagctctccccaagacgaa

SEQ ID NO: 9468747 - DNA, 22 bp, Homo sapiens
gcacagctctccccaagacgaa

SEQ ID NO: 9468748 - DNA, 22 bp, Homo sapiens
gcacagctggactctgcctggc

SEQ ID NO: 9468749 - DNA, 22 bp, Homo sapiens
gcacaggaggccgatgctcatg

SEQ ID NO: 9468750 - DNA, 22 bp, Homo sapiens
gcacaggatgatgggttgaggg

SEQ ID NO: 9468751 - DNA, 19 bp, Homo sapiens
gcacaggacatctgatgga

SEQ ID NO: 9468752 - DNA, 22 bp, Homo sapiens
gcacaggcaatagatacagcta

SEQ ID NO: 9468753 - DNA, 22 bp, Homo sapiens
gcacaggcacagagggccactg

SEQ ID NO: 9468754 - DNA, 22 bp, Homo sapiens
gcaagctgcttaagctcattgt

SEQ ID NO: 9468755 - DNA, 18 bp, Homo sapiens
gcaagccctctccattaa

SEQ ID NO: 9468756 - DNA, 22 bp, Homo sapiens
gcaagctgatgtgatagtgaaa

SEQ ID NO: 9468757 - DNA, 22 bp, Homo sapiens
gcaagcagttacccaggattcg

SEQ ID NO: 9468758 - DNA, 22 bp, Homo sapiens
gcaagcagttgtggcttctgag

SEQ ID NO: 9468759 - DNA, 22 bp, Homo sapiens
gcaagcagcccagaacagctct

SEQ ID NO: 9468760 - DNA, 22 bp, Homo sapiens
gcaagcttcatatggcattttc

SEQ ID NO: 9468761 - DNA, 22 bp, Homo sapiens
gcaaggaacaaatgctctgctt

SEQ ID NO: 9468762 - DNA, 22 bp, Homo sapiens
gcaaggaacaaatgctctgctt

SEQ ID NO: 9468763 - DNA, 22 bp, Homo sapiens
gcaaggaacaaatgctctgctt

SEQ ID NO: 9468764 - DNA, 22 bp, Homo sapiens
gcacagcagctgggggccctgg

SEQ ID NO: 9468765 - DNA, 20 bp, Homo sapiens
gcaagcttattagtgatatt

SEQ ID NO: 9468766 - DNA, 22 bp, Homo sapiens
gcacagccagcatctgagggat

SEQ ID NO: 9468767 - DNA, 22 bp, Homo sapiens
gcacagccagcatctgagggat

SEQ ID NO: 9468768 - DNA, 21 bp, Homo sapiens
gcacagcatgagtgttggcat

SEQ ID NO: 9468769 - DNA, 21 bp, Homo sapiens
gcacagcatgagtgttggcat

SEQ ID NO: 9468770 - DNA, 22 bp, Homo sapiens
gcacagcatgaagagaggaagc

SEQ ID NO: 9468771 - DNA, 21 bp, Homo sapiens
gcacagcatgagtgttggcat

SEQ ID NO: 9468772 - DNA, 22 bp, Homo sapiens
gcacagcatgaagagaggaagc

SEQ ID NO: 9468773 - DNA, 22 bp, Homo sapiens
gcagaggagcaagctggacacc

SEQ ID NO: 9468774 - DNA, 22 bp, Homo sapiens
gcagaggagcaagctggacacc

SEQ ID NO: 9468775 - DNA, 22 bp, Homo sapiens
gcagaggagcaagctggacacc

SEQ ID NO: 9468776 - DNA, 22 bp, Homo sapiens
gcagaggagcaagctggacacc

SEQ ID NO: 9468777 - DNA, 22 bp, Homo sapiens
gcagaggactcaatcaaggtat

SEQ ID NO: 9468778 - DNA, 22 bp, Homo sapiens
gcagaggagatgaagatacttt

SEQ ID NO: 9468779 - DNA, 22 bp, Homo sapiens
gcagaggacagggatttagatt

SEQ ID NO: 9468780 - DNA, 22 bp, Homo sapiens
gcacttggaggtgcccacacag

SEQ ID NO: 9468781 - DNA, 22 bp, Homo sapiens
gcagaggacacaggagggcaag

SEQ ID NO: 9468782 - DNA, 22 bp, Homo sapiens
gcagaggacacaggagggcaag

SEQ ID NO: 9468783 - DNA, 21 bp, Homo sapiens
gcagaggaatggtatacataa

SEQ ID NO: 9468784 - DNA, 22 bp, Homo sapiens
gcagaggacacaggagggcaag

SEQ ID NO: 9468785 - DNA, 22 bp, Homo sapiens
gcagaggacacaggagggcaag

SEQ ID NO: 9468786 - DNA, 22 bp, Homo sapiens
gcagaggacacaggagggcaag

SEQ ID NO: 9468787 - DNA, 22 bp, Homo sapiens
gcagaggacacaggagggcaag

SEQ ID NO: 9468788 - DNA, 22 bp, Homo sapiens
gcactgggaatgctgatgggct

SEQ ID NO: 9468789 - DNA, 22 bp, Homo sapiens
gcactgggaatgctgatgggct

SEQ ID NO: 9468790 - DNA, 22 bp, Homo sapiens
gcactgggaatgctgatgggct

SEQ ID NO: 9468791 - DNA, 22 bp, Homo sapiens
gcactgggaatgctgatgggct

SEQ ID NO: 9468792 - DNA, 22 bp, Homo sapiens
gcactgggagtctgtgggggtt

SEQ ID NO: 9468793 - DNA, 22 bp, Homo sapiens
gcactgggagctgcctgccggt

SEQ ID NO: 9468794 - DNA, 22 bp, Homo sapiens
gcactgggagtctgtgggggtt

SEQ ID NO: 9468795 - DNA, 22 bp, Homo sapiens
gcactgggaatgtgagcagctg

SEQ ID NO: 9468796 - DNA, 22 bp, Homo sapiens
gcactgggaatgtgagcagctg

SEQ ID NO: 9468797 - DNA, 22 bp, Homo sapiens
gcactgggagctgcctgccggt

SEQ ID NO: 9468798 - DNA, 16 bp, Homo sapiens
gcactgggatgtcttc

SEQ ID NO: 9468799 - DNA, 22 bp, Homo sapiens
gcactgggagtctgtgggggtt

SEQ ID NO: 9468800 - DNA, 22 bp, Homo sapiens
gcactgggctccaggaaggagg

SEQ ID NO: 9468801 - DNA, 22 bp, Homo sapiens
gcactgggctccaggaaggagg

SEQ ID NO: 9468802 - DNA, 23 bp, Homo sapiens
gcactgggctctcagcaaggtgt

SEQ ID NO: 9468803 - DNA, 22 bp, Homo sapiens
gcactgggctccaggaaggagg

SEQ ID NO: 9468804 - DNA, 22 bp, Homo sapiens
gcactgtgatcaaggctaagca

SEQ ID NO: 9468805 - DNA, 22 bp, Homo sapiens
gcacttagggtatgtactgggc

SEQ ID NO: 9468806 - DNA, 22 bp, Homo sapiens
gcactgttctaggtgcagagct

SEQ ID NO: 9468807 - DNA, 22 bp, Homo sapiens
gcactgtgctagaagccagggg

SEQ ID NO: 9468808 - DNA, 22 bp, Homo sapiens
gcacttcaccactgtcctggtt

SEQ ID NO: 9468809 - DNA, 22 bp, Homo sapiens
gcacttccatctgtcaccaggt

SEQ ID NO: 9468810 - DNA, 22 bp, Homo sapiens
gcacttccatctgtcaccaggt

SEQ ID NO: 9468811 - DNA, 22 bp, Homo sapiens
gcactgctttctgagtcattgt

SEQ ID NO: 9468812 - DNA, 22 bp, Homo sapiens
gcactgctccagtctctgcttt

SEQ ID NO: 9468813 - DNA, 22 bp, Homo sapiens
gcactgctccaggtgtggcttg

SEQ ID NO: 9468814 - DNA, 22 bp, Homo sapiens
gcactgcttttacctaggtgag

SEQ ID NO: 9468815 - DNA, 22 bp, Homo sapiens
gcactggagatacagagatgaa

SEQ ID NO: 9468816 - DNA, 22 bp, Homo sapiens
gcactgggaagaatgagcctgt

SEQ ID NO: 9468817 - DNA, 22 bp, Homo sapiens
gcactggattttgatctgcaag

SEQ ID NO: 9468818 - DNA, 22 bp, Homo sapiens
gcactgggaagaatgagcctgt

SEQ ID NO: 9468819 - DNA, 22 bp, Homo sapiens
gcactgggaagaatgagcctgt

SEQ ID NO: 9468820 - DNA, 22 bp, Homo sapiens
gcactgggaatgagggcagctt

SEQ ID NO: 9468821 - DNA, 22 bp, Homo sapiens
gcactgggaatgagggcagctt

SEQ ID NO: 9468822 - DNA, 22 bp, Homo sapiens
gcactgccacataatctcagca

SEQ ID NO: 9468823 - DNA, 22 bp, Homo sapiens
gcactgcaggtgggtggagagg

SEQ ID NO: 9468824 - DNA, 22 bp, Homo sapiens
gcactgagtctgtcatgctgca

SEQ ID NO: 9468825 - DNA, 22 bp, Homo sapiens
gcactgagtctgtcatgctgca

SEQ ID NO: 9468826 - DNA, 22 bp, Homo sapiens
gcactgatgcaaaaatcactca

SEQ ID NO: 9468827 - DNA, 22 bp, Homo sapiens
gcactgatgcaaaaatcactca

SEQ ID NO: 9468828 - DNA, 22 bp, Homo sapiens
gcactgattacccattgctgct

SEQ ID NO: 9468829 - DNA, 23 bp, Homo sapiens
gcactgccatgtgctctgcaggc

SEQ ID NO: 9468830 - DNA, 23 bp, Homo sapiens
gcactgccatgtgctctgcaggc

SEQ ID NO: 9468831 - DNA, 23 bp, Homo sapiens
gcactgccatgtgctctgcaggc

SEQ ID NO: 9468832 - DNA, 23 bp, Homo sapiens
gcactgccatgtgctctgcaggc

SEQ ID NO: 9468833 - DNA, 22 bp, Homo sapiens
gcactgccatcaatgcatgaca

SEQ ID NO: 9468834 - DNA, 22 bp, Homo sapiens
gcactgccatcaatgcatgaca

SEQ ID NO: 9468835 - DNA, 22 bp, Homo sapiens
gcactgcctgtgttcagggtaa

SEQ ID NO: 9468836 - DNA, 21 bp, Homo sapiens
gcactgctagaaccccctgga

SEQ ID NO: 9468837 - DNA, 22 bp, Homo sapiens
gcactgctatttagctccatca

SEQ ID NO: 9468838 - DNA, 22 bp, Homo sapiens
gcactgctccaggtgtggcttg

SEQ ID NO: 9468839 - DNA, 21 bp, Homo sapiens
gcactgagcatctcctctgcc

SEQ ID NO: 9468840 - DNA, 17 bp, Homo sapiens
gcactgagccacagttt

SEQ ID NO: 9468841 - DNA, 22 bp, Homo sapiens
gcactgagcaccagccacagat

SEQ ID NO: 9468842 - DNA, 22 bp, Homo sapiens
gcacctgggcaaggattcagag

SEQ ID NO: 9468843 - DNA, 21 bp, Homo sapiens
gcactcagtcactactcaaga

SEQ ID NO: 9468844 - DNA, 22 bp, Homo sapiens
gcacctgggacccagaggcacc

SEQ ID NO: 9468845 - DNA, 22 bp, Homo sapiens
gcacaggccatgggaggacagc

SEQ ID NO: 9468846 - DNA, 22 bp, Homo sapiens
gcacctggctgcccaggtggag

SEQ ID NO: 9468847 - DNA, 22 bp, Homo sapiens
gcacctgggacccagaggcacc

SEQ ID NO: 9468848 - DNA, 22 bp, Homo sapiens
gcacctgggacccagaggcacc

SEQ ID NO: 9468849 - DNA, 22 bp, Homo sapiens
gcacaggcacagagggccactg

SEQ ID NO: 9468850 - DNA, 22 bp, Homo sapiens
gcacaggcacagagggccactg

SEQ ID NO: 9468851 - DNA, 22 bp, Homo sapiens
gcactctcctggctgccacagt

SEQ ID NO: 9468852 - DNA, 22 bp, Homo sapiens
gcactctcctggctgccacagt

SEQ ID NO: 9468853 - DNA, 17 bp, Homo sapiens
gcactcccccacctcct

SEQ ID NO: 9468854 - DNA, 21 bp, Homo sapiens
gcactcagtcactactcaaga

SEQ ID NO: 9468855 - DNA, 22 bp, Homo sapiens
gcactctgtgatctgcagagcc

SEQ ID NO: 9468856 - DNA, 22 bp, Homo sapiens
gcactctgtttctcctgtcagc

SEQ ID NO: 9468857 - DNA, 18 bp, Homo sapiens
gcactctgactgcagagc

SEQ ID NO: 9468858 - DNA, 18 bp, Homo sapiens
gcactctgactgcagagc

SEQ ID NO: 9468859 - DNA, 22 bp, Homo sapiens
gcactctgccaggtctcctgat

SEQ ID NO: 9468860 - DNA, 22 bp, Homo sapiens
gcactctgccaggtctcctgat

SEQ ID NO: 9468861 - DNA, 22 bp, Homo sapiens
gcactctgtgatctgcagagcc

SEQ ID NO: 9468862 - DNA, 22 bp, Homo sapiens
gccagagaggccttagaatcca

SEQ ID NO: 9468863 - DNA, 22 bp, Homo sapiens
gccagagcacaggctggtagta

SEQ ID NO: 9468864 - DNA, 22 bp, Homo sapiens
gccagagcacaggctggtagta

SEQ ID NO: 9468865 - DNA, 22 bp, Homo sapiens
gccagagcagaatagagtggcc

SEQ ID NO: 9468866 - DNA, 22 bp, Homo sapiens
gccaagggggcagtgcatgggt

SEQ ID NO: 9468867 - DNA, 22 bp, Homo sapiens
gccaagggggcagtgcatgggt

SEQ ID NO: 9468868 - DNA, 22 bp, Homo sapiens
gccagagacacttggaggtaga

SEQ ID NO: 9468869 - DNA, 22 bp, Homo sapiens
gccagagagagtccctgggcct

SEQ ID NO: 9468870 - DNA, 22 bp, Homo sapiens
gccagagcatgcactgcctgca

SEQ ID NO: 9468871 - DNA, 22 bp, Homo sapiens
gccagagcatgcactgcctgca

SEQ ID NO: 9468872 - DNA, 22 bp, Homo sapiens
gccagagccacttttgggtgat

SEQ ID NO: 9468873 - DNA, 22 bp, Homo sapiens
gccagagcatcgcaccctccat

SEQ ID NO: 9468874 - DNA, 21 bp, Homo sapiens
gccagagcagtacaatgaggt

SEQ ID NO: 9468875 - DNA, 22 bp, Homo sapiens
gccagagcagaatagagtggcc

SEQ ID NO: 9468876 - DNA, 22 bp, Homo sapiens
gcatttttctaatcattggcat

SEQ ID NO: 9468877 - DNA, 22 bp, Homo sapiens
gcattttataaagagttatttg

SEQ ID NO: 9468878 - DNA, 22 bp, Homo sapiens
gcattttgaggctgggggagca

SEQ ID NO: 9468879 - DNA, 22 bp, Homo sapiens
gcattttataaagagttatttg

SEQ ID NO: 9468880 - DNA, 22 bp, Homo sapiens
gcattttaatgaggtttatgag

SEQ ID NO: 9468881 - DNA, 22 bp, Homo sapiens
gcatttgtacaaaatgcagtag

SEQ ID NO: 9468882 - DNA, 22 bp, Homo sapiens
gcatttgtgtggcggaaggatt

SEQ ID NO: 9468883 - DNA, 22 bp, Homo sapiens
gcatttgtgttcttcctagagc

SEQ ID NO: 9468884 - DNA, 22 bp, Homo sapiens
gcatttgtgtggcggaaggatt

SEQ ID NO: 9468885 - DNA, 22 bp, Homo sapiens
gcatttgttgactgaccttccc

SEQ ID NO: 9468886 - DNA, 22 bp, Homo sapiens
gcatttgtgttcttcctagagc

SEQ ID NO: 9468887 - DNA, 18 bp, Homo sapiens
gcattttaatctgaggca

SEQ ID NO: 9468888 - DNA, 22 bp, Homo sapiens
gcattttaataagattcatagg

SEQ ID NO: 9468889 - DNA, 22 bp, Homo sapiens
gcattttaatgaggtttatgag

SEQ ID NO: 9468890 - DNA, 22 bp, Homo sapiens
gccaaggaaggcttcctggaag

SEQ ID NO: 9468891 - DNA, 22 bp, Homo sapiens
gccaaggaaggcttcctggaag

SEQ ID NO: 9468892 - DNA, 22 bp, Homo sapiens
gccaagcctgtagacacaagct

SEQ ID NO: 9468893 - DNA, 22 bp, Homo sapiens
gccaagcctgtagacacaagct

SEQ ID NO: 9468894 - DNA, 22 bp, Homo sapiens
gccaaggccctgtctgttttac

SEQ ID NO: 9468895 - DNA, 22 bp, Homo sapiens
gccaaggcctctgcaggatgag

SEQ ID NO: 9468896 - DNA, 22 bp, Homo sapiens
gccaaggcctctgcaggatgag

SEQ ID NO: 9468897 - DNA, 22 bp, Homo sapiens
gccaaggcctctgcaggatgag

SEQ ID NO: 9468898 - DNA, 22 bp, Homo sapiens
gccaaggctgaggccctgggct

SEQ ID NO: 9468899 - DNA, 22 bp, Homo sapiens
gccaaggctgaggccctgggct

SEQ ID NO: 9468900 - DNA, 22 bp, Homo sapiens
gccaaggcctgcagcacctcat

SEQ ID NO: 9468901 - DNA, 22 bp, Homo sapiens
gccaaggcctgcagcacctcat

SEQ ID NO: 9468902 - DNA, 22 bp, Homo sapiens
gccaaggataccagctgtgaga

SEQ ID NO: 9468903 - DNA, 22 bp, Homo sapiens
gccaaggcctctgcaggatgag

SEQ ID NO: 9468904 - DNA, 20 bp, Homo sapiens
gccaaggaggagaaacaggc

SEQ ID NO: 9468905 - DNA, 22 bp, Homo sapiens
gccagccccttagggctctccc

SEQ ID NO: 9468906 - DNA, 22 bp, Homo sapiens
gccagccccttagggctctccc

SEQ ID NO: 9468907 - DNA, 22 bp, Homo sapiens
gccagcccctccatcctgttca

SEQ ID NO: 9468908 - DNA, 22 bp, Homo sapiens
gccagccccagacatcctatcg

SEQ ID NO: 9468909 - DNA, 22 bp, Homo sapiens
gccagcccctccatcctgttca

SEQ ID NO: 9468910 - DNA, 22 bp, Homo sapiens
gccagcccattaacccctgtcc

SEQ ID NO: 9468911 - DNA, 22 bp, Homo sapiens
gccagccccagacatcctatcg

SEQ ID NO: 9468912 - DNA, 21 bp, Homo sapiens
gccagccatgcttgcctaggc

SEQ ID NO: 9468913 - DNA, 21 bp, Homo sapiens
gccagccatgcttgcctaggc

SEQ ID NO: 9468914 - DNA, 22 bp, Homo sapiens
gccagccataggccagcactgg

SEQ ID NO: 9468915 - DNA, 22 bp, Homo sapiens
gccagcccagctccaggggaaa

SEQ ID NO: 9468916 - DNA, 22 bp, Homo sapiens
gccagcccagctccaggggaaa

SEQ ID NO: 9468917 - DNA, 22 bp, Homo sapiens
gccagcccagctccaggggaaa

SEQ ID NO: 9468918 - DNA, 22 bp, Homo sapiens
gccagcccattaacccctgtcc

SEQ ID NO: 9468919 - DNA, 22 bp, Homo sapiens
gccagcagtggccaccaccagg

SEQ ID NO: 9468920 - DNA, 22 bp, Homo sapiens
gccagcagtcctgctgtgtgcc

SEQ ID NO: 9468921 - DNA, 23 bp, Homo sapiens
gccagcatagatcattctgagta

SEQ ID NO: 9468922 - DNA, 22 bp, Homo sapiens
gccagcatcctggtggtggttg

SEQ ID NO: 9468923 - DNA, 22 bp, Homo sapiens
gccagcatagtaagcagtcatc

SEQ ID NO: 9468924 - DNA, 22 bp, Homo sapiens
gccagcatcctgcattagggtg

SEQ ID NO: 9468925 - DNA, 22 bp, Homo sapiens
gccagcattccttggctcctgg

SEQ ID NO: 9468926 - DNA, 22 bp, Homo sapiens
gccagcagtatgtcctggcagt

SEQ ID NO: 9468927 - DNA, 23 bp, Homo sapiens
gccagagctgcctgcccttgctg

SEQ ID NO: 9468928 - DNA, 22 bp, Homo sapiens
gccagagcttcccccgagtgtg

SEQ ID NO: 9468929 - DNA, 22 bp, Homo sapiens
gccagagctgagacacgagtcc

SEQ ID NO: 9468930 - DNA, 22 bp, Homo sapiens
gccagagctgagacacgagtcc

SEQ ID NO: 9468931 - DNA, 22 bp, Homo sapiens
gccagagctgagtgaggttctt

SEQ ID NO: 9468932 - DNA, 22 bp, Homo sapiens
gccagaggaacgctgcgcgccc

SEQ ID NO: 9468933 - DNA, 23 bp, Homo sapiens
gccagaggaacgcagagctttct

SEQ ID NO: 9468934 - DNA, 22 bp, Homo sapiens
gccagaggcccaaggacagctg

SEQ ID NO: 9468935 - DNA, 22 bp, Homo sapiens
gccagaggcccaaggacagctg

SEQ ID NO: 9468936 - DNA, 22 bp, Homo sapiens
gccagcagggcggagccatcta

SEQ ID NO: 9468937 - DNA, 22 bp, Homo sapiens
gccagcagggcccaaatgctgg

SEQ ID NO: 9468938 - DNA, 22 bp, Homo sapiens
gccagcagggcccaaatgctgg

SEQ ID NO: 9468939 - DNA, 22 bp, Homo sapiens
gccagcaggttgtcaaggagct

SEQ ID NO: 9468940 - DNA, 22 bp, Homo sapiens
gccagcaggttgtcaaggagct

SEQ ID NO: 9468941 - DNA, 22 bp, Homo sapiens
gccagcaggttgtcaaggagct

SEQ ID NO: 9468942 - DNA, 22 bp, Homo sapiens
gccagcagtatgtcctggcagt

SEQ ID NO: 9468943 - DNA, 22 bp, Homo sapiens
gcatttcatgtagattgagaac

SEQ ID NO: 9468944 - DNA, 22 bp, Homo sapiens
gcatttctgtgcatacacatga

SEQ ID NO: 9468945 - DNA, 22 bp, Homo sapiens
gcatttctgtgcatacacatga

SEQ ID NO: 9468946 - DNA, 22 bp, Homo sapiens
gcatttctgtgcatacacatga

SEQ ID NO: 9468947 - DNA, 22 bp, Homo sapiens
gcatttggaaaatgtttggctt

SEQ ID NO: 9468948 - DNA, 22 bp, Homo sapiens
gcatttggaacttggttgagat

SEQ ID NO: 9468949 - DNA, 22 bp, Homo sapiens
gcatttggtgatgcaccgttta

SEQ ID NO: 9468950 - DNA, 22 bp, Homo sapiens
gcatttggaacttggttgagat

SEQ ID NO: 9468951 - DNA, 21 bp, Homo sapiens
gcatttggttttgtcaatgct

SEQ ID NO: 9468952 - DNA, 21 bp, Homo sapiens
gcatttggtgccctgtctgct

SEQ ID NO: 9468953 - DNA, 22 bp, Homo sapiens
gcatctcttacccacgagccag

SEQ ID NO: 9468954 - DNA, 22 bp, Homo sapiens
gcatctgtgtttctagctagga

SEQ ID NO: 9468955 - DNA, 20 bp, Homo sapiens
gcatgaggaatcattgcagc

SEQ ID NO: 9468956 - DNA, 22 bp, Homo sapiens
gcatgaggggggttaggaagtt

SEQ ID NO: 9468957 - DNA, 20 bp, Homo sapiens
gcatgaggaatcattgcagc

SEQ ID NO: 9468958 - DNA, 22 bp, Homo sapiens
gcatgatgaaggaggaggagtc

SEQ ID NO: 9468959 - DNA, 22 bp, Homo sapiens
gcatgaggggggttaggaagtt

SEQ ID NO: 9468960 - DNA, 22 bp, Homo sapiens
gcatgaggttcttggccagcat

SEQ ID NO: 9468961 - DNA, 19 bp, Homo sapiens
gcataaatacactattgtc

SEQ ID NO: 9468962 - DNA, 19 bp, Homo sapiens
gcataaatacactattgtc

SEQ ID NO: 9468963 - DNA, 22 bp, Homo sapiens
gcataaacttaagattttgttt

SEQ ID NO: 9468964 - DNA, 22 bp, Homo sapiens
gcataaacttaagattttgttt

SEQ ID NO: 9468965 - DNA, 22 bp, Homo sapiens
gcataaactccaaaaggcaggg

SEQ ID NO: 9468966 - DNA, 22 bp, Homo sapiens
gcataattaaacaggcaagatt

SEQ ID NO: 9468967 - DNA, 22 bp, Homo sapiens
gcataacaaatatgctttaaat

SEQ ID NO: 9468968 - DNA, 22 bp, Homo sapiens
gcataattaaacaggcaagatt

SEQ ID NO: 9468969 - DNA, 22 bp, Homo sapiens
gcataaatgttctttcagattt

SEQ ID NO: 9468970 - DNA, 22 bp, Homo sapiens
gcataacaaatatgctttaaat

SEQ ID NO: 9468971 - DNA, 22 bp, Homo sapiens
gcataaatgtgcacacacatgt

SEQ ID NO: 9468972 - DNA, 22 bp, Homo sapiens
gcataaatgtgcacacacatgt

SEQ ID NO: 9468973 - DNA, 22 bp, Homo sapiens
gcatccagtcttggctcctgga

SEQ ID NO: 9468974 - DNA, 22 bp, Homo sapiens
gcatccagtcttggctcctgga

SEQ ID NO: 9468975 - DNA, 22 bp, Homo sapiens
gcatccaggctgcccctctgcg

SEQ ID NO: 9468976 - DNA, 22 bp, Homo sapiens
gcatccaggtagagcttgcggg

SEQ ID NO: 9468977 - DNA, 22 bp, Homo sapiens
gcatccagaggtagccactgtg

SEQ ID NO: 9468978 - DNA, 22 bp, Homo sapiens
gcatccagaggtagccactgtg

SEQ ID NO: 9468979 - DNA, 22 bp, Homo sapiens
gcatccagaggtagccactgtg

SEQ ID NO: 9468980 - DNA, 22 bp, Homo sapiens
gcatccaaatgtttcatttctt

SEQ ID NO: 9468981 - DNA, 22 bp, Homo sapiens
gcatctaaggtggataacttct

SEQ ID NO: 9468982 - DNA, 22 bp, Homo sapiens
gcatccctctgaggggccaggc

SEQ ID NO: 9468983 - DNA, 22 bp, Homo sapiens
gcatcctggctctaggtgtcat

SEQ ID NO: 9468984 - DNA, 22 bp, Homo sapiens
gcatcctctgagagctctagat

SEQ ID NO: 9468985 - DNA, 19 bp, Homo sapiens
gcatccatggaggccgctt

SEQ ID NO: 9468986 - DNA, 22 bp, Homo sapiens
gcatccagtcttggctcctgga

SEQ ID NO: 9468987 - DNA, 22 bp, Homo sapiens
gcagtcttttctgtgactggct

SEQ ID NO: 9468988 - DNA, 22 bp, Homo sapiens
gcagtctttttcttctagctaa

SEQ ID NO: 9468989 - DNA, 22 bp, Homo sapiens
gcagtcttttctgtgactggct

SEQ ID NO: 9468990 - DNA, 22 bp, Homo sapiens
gcagtctttttcttctagctaa

SEQ ID NO: 9468991 - DNA, 22 bp, Homo sapiens
gcagtgaaaaagtgcaccctgt

SEQ ID NO: 9468992 - DNA, 18 bp, Homo sapiens
gcagtgaagaaagagctt

SEQ ID NO: 9468993 - DNA, 22 bp, Homo sapiens
gcagtgaagatggcaggttggg

SEQ ID NO: 9468994 - DNA, 22 bp, Homo sapiens
gcagtgaacataacacagaagg

SEQ ID NO: 9468995 - DNA, 22 bp, Homo sapiens
gcagtgaaacaataggatcaaa

SEQ ID NO: 9468996 - DNA, 22 bp, Homo sapiens
gcagtctttgagtatcttcaaa

SEQ ID NO: 9468997 - DNA, 22 bp, Homo sapiens
gcagtctttgaatgtgaaatag

SEQ ID NO: 9468998 - DNA, 22 bp, Homo sapiens
gcagtcttgccacagggtttca

SEQ ID NO: 9468999 - DNA, 19 bp, Homo sapiens
gcagtctgttgaagggcag

SEQ ID NO: 9469000 - DNA, 20 bp, Homo sapiens
gcagtctgtcacagagcatg

SEQ ID NO: 9469001 - DNA, 22 bp, Homo sapiens
gcagtctctcaggatttaagct

SEQ ID NO: 9469002 - DNA, 22 bp, Homo sapiens
gcagtctccatatacatttaca

SEQ ID NO: 9469003 - DNA, 18 bp, Homo sapiens
gcagtctctctggtcttc

SEQ ID NO: 9469004 - DNA, 22 bp, Homo sapiens
gcagtcctctcattggcctcct

SEQ ID NO: 9469005 - DNA, 22 bp, Homo sapiens
gcagtcctggaggaaggtgtga

SEQ ID NO: 9469006 - DNA, 22 bp, Homo sapiens
gcagtcctggaggaaggtgtga

SEQ ID NO: 9469007 - DNA, 22 bp, Homo sapiens
gcagtcctctcattggcctcct

SEQ ID NO: 9469008 - DNA, 22 bp, Homo sapiens
gcagtccttaggagaggaagta

SEQ ID NO: 9469009 - DNA, 22 bp, Homo sapiens
gcagtcctctcattggcctcct

SEQ ID NO: 9469010 - DNA, 22 bp, Homo sapiens
gcagtcctcatcctttagcagt

SEQ ID NO: 9469011 - DNA, 22 bp, Homo sapiens
gcagtcctagggtgctctgcag

SEQ ID NO: 9469012 - DNA, 22 bp, Homo sapiens
gcagtcctagggtgctctgcag

SEQ ID NO: 9469013 - DNA, 20 bp, Homo sapiens
gcagtcccatttctgagcct

SEQ ID NO: 9469014 - DNA, 22 bp, Homo sapiens
gcagtcatcagtcctttaatta

SEQ ID NO: 9469015 - DNA, 22 bp, Homo sapiens
gcagtcatggaaaaatgtatac

SEQ ID NO: 9469016 - DNA, 22 bp, Homo sapiens
gcagtcatctgagctaactact

SEQ ID NO: 9469017 - DNA, 22 bp, Homo sapiens
gcagtcatttaacctctctgtg

SEQ ID NO: 9469018 - DNA, 22 bp, Homo sapiens
gcagtcatgggtagaactcaag

SEQ ID NO: 9469019 - DNA, 22 bp, Homo sapiens
gcagtcatttaacctctctgtg

SEQ ID NO: 9469020 - DNA, 22 bp, Homo sapiens
gcagtcataactaatattggtt

SEQ ID NO: 9469021 - DNA, 22 bp, Homo sapiens
gcagtcaggttaaggccttccc

SEQ ID NO: 9469022 - DNA, 22 bp, Homo sapiens
gcagtcagtaaggcagccagaa

SEQ ID NO: 9469023 - DNA, 22 bp, Homo sapiens
gcagtcacagggagatggtgac

SEQ ID NO: 9469024 - DNA, 21 bp, Homo sapiens
gcagtcactcggttggctacc

SEQ ID NO: 9469025 - DNA, 21 bp, Homo sapiens
gcagtcactcggttggctacc

SEQ ID NO: 9469026 - DNA, 22 bp, Homo sapiens
gcagtattgccctgcctgcagg

SEQ ID NO: 9469027 - DNA, 22 bp, Homo sapiens
gcagggctcattgccaggcatt

SEQ ID NO: 9469028 - DNA, 22 bp, Homo sapiens
gcagggctcattgccaggcatt

SEQ ID NO: 9469029 - DNA, 22 bp, Homo sapiens
gcagggctcattgccaggcatt

SEQ ID NO: 9469030 - DNA, 22 bp, Homo sapiens
gcagggctccactgtggccaag

SEQ ID NO: 9469031 - DNA, 22 bp, Homo sapiens
gcagggctcaacaggacacccc

SEQ ID NO: 9469032 - DNA, 22 bp, Homo sapiens
gcagggctcagccgctcccacc

SEQ ID NO: 9469033 - DNA, 22 bp, Homo sapiens
gcagggctcagccgctcccacc

SEQ ID NO: 9469034 - DNA, 22 bp, Homo sapiens
gccagtgcctgctgctcagggc

SEQ ID NO: 9469035 - DNA, 21 bp, Homo sapiens
gccagtgctgtctgtgtgatc

SEQ ID NO: 9469036 - DNA, 22 bp, Homo sapiens
gccagtcttcatattcatggtg

SEQ ID NO: 9469037 - DNA, 22 bp, Homo sapiens
gccagtgcctcgccgcgctcct

SEQ ID NO: 9469038 - DNA, 22 bp, Homo sapiens
gccagtgcttgtggagctggca

SEQ ID NO: 9469039 - DNA, 22 bp, Homo sapiens
gccagtggagactgaaacccat

SEQ ID NO: 9469040 - DNA, 22 bp, Homo sapiens
gccagtggagcacatggtgaag

SEQ ID NO: 9469041 - DNA, 22 bp, Homo sapiens
gccagtctccctcagtcctctg

SEQ ID NO: 9469042 - DNA, 22 bp, Homo sapiens
gccagtctgctcccacaagttc

SEQ ID NO: 9469043 - DNA, 22 bp, Homo sapiens
gccaggttgctgacgacgatct

SEQ ID NO: 9469044 - DNA, 22 bp, Homo sapiens
gccagtggcatgcggcagggac

SEQ ID NO: 9469045 - DNA, 22 bp, Homo sapiens
gccagtggaggacccatggaga

SEQ ID NO: 9469046 - DNA, 22 bp, Homo sapiens
gccagtggcttgccaggcagga

SEQ ID NO: 9469047 - DNA, 22 bp, Homo sapiens
gccagtggcttgccaggcagga

SEQ ID NO: 9469048 - DNA, 22 bp, Homo sapiens
gccagtggccctctggagaagg

SEQ ID NO: 9469049 - DNA, 22 bp, Homo sapiens
gccagtggccctctggagaagg

SEQ ID NO: 9469050 - DNA, 22 bp, Homo sapiens
gcccacagtacgaggctcaggc

SEQ ID NO: 9469051 - DNA, 20 bp, Homo sapiens
gcccactctaatccactgtc

SEQ ID NO: 9469052 - DNA, 22 bp, Homo sapiens
gcccactctggagcctgttccc

SEQ ID NO: 9469053 - DNA, 22 bp, Homo sapiens
gcccacagtacgaggctcaggc

SEQ ID NO: 9469054 - DNA, 22 bp, Homo sapiens
gcccacagtacgaggctcaggc

SEQ ID NO: 9469055 - DNA, 22 bp, Homo sapiens
gcccacagtacgaggctcaggc

SEQ ID NO: 9469056 - DNA, 22 bp, Homo sapiens
gcccacagtacgaggctcaggc

SEQ ID NO: 9469057 - DNA, 22 bp, Homo sapiens
gcccagagtgagtcctgggccc

SEQ ID NO: 9469058 - DNA, 22 bp, Homo sapiens
gcccagagtgagtcctgggccc

SEQ ID NO: 9469059 - DNA, 22 bp, Homo sapiens
gcccagagtgagtcctgggccc

SEQ ID NO: 9469060 - DNA, 22 bp, Homo sapiens
gcccagagtgagtcctgggccc

SEQ ID NO: 9469061 - DNA, 22 bp, Homo sapiens
gcccagagtgagtcctgggccc

SEQ ID NO: 9469062 - DNA, 18 bp, Homo sapiens
gcccagaggtctgggccc

SEQ ID NO: 9469063 - DNA, 18 bp, Homo sapiens
gcccagaggtctgggccc

SEQ ID NO: 9469064 - DNA, 18 bp, Homo sapiens
gcccagaggtctgggccc

SEQ ID NO: 9469065 - DNA, 21 bp, Homo sapiens
gcccagagtcctcccactcca

SEQ ID NO: 9469066 - DNA, 21 bp, Homo sapiens
gcccagagtcctcccactcca

SEQ ID NO: 9469067 - DNA, 18 bp, Homo sapiens
gcccagaggtctgggccc

SEQ ID NO: 9469068 - DNA, 18 bp, Homo sapiens
gcccagagccctcttatt

SEQ ID NO: 9469069 - DNA, 18 bp, Homo sapiens
gcccagagccctcttatt

SEQ ID NO: 9469070 - DNA, 23 bp, Homo sapiens
gcccagagaggctcaccaggaat

SEQ ID NO: 9469071 - DNA, 23 bp, Homo sapiens
gcccagagaggctcaccaggaat

SEQ ID NO: 9469072 - DNA, 21 bp, Homo sapiens
gcccagagggagccaagccca

SEQ ID NO: 9469073 - DNA, 18 bp, Homo sapiens
gcccagaggtctgggccc

SEQ ID NO: 9469074 - DNA, 18 bp, Homo sapiens
gcccagaggtctgggccc

SEQ ID NO: 9469075 - DNA, 22 bp, Homo sapiens
gcccagagggaagaggtgtcat

SEQ ID NO: 9469076 - DNA, 22 bp, Homo sapiens
gcccagagggaagaggtgtcat

SEQ ID NO: 9469077 - DNA, 22 bp, Homo sapiens
gcccagagggaagaggtgtcat

SEQ ID NO: 9469078 - DNA, 22 bp, Homo sapiens
gcccagagagatgaagtgatgg

SEQ ID NO: 9469079 - DNA, 22 bp, Homo sapiens
gcccagagagatgaagtgatgg

SEQ ID NO: 9469080 - DNA, 22 bp, Homo sapiens
gcccagagagatgaagtgatgg

SEQ ID NO: 9469081 - DNA, 22 bp, Homo sapiens
gcccagagagatgctgtagacc

SEQ ID NO: 9469082 - DNA, 22 bp, Homo sapiens
gcccagagagatgctgtagacc

SEQ ID NO: 9469083 - DNA, 22 bp, Homo sapiens
gcccagaagttgaggctgcagt

SEQ ID NO: 9469084 - DNA, 22 bp, Homo sapiens
gcccagaagttgaggctgcagt

SEQ ID NO: 9469085 - DNA, 22 bp, Homo sapiens
gcccagaagttgaggctgcagt

SEQ ID NO: 9469086 - DNA, 22 bp, Homo sapiens
gcccagaagtgactcagcactg

SEQ ID NO: 9469087 - DNA, 22 bp, Homo sapiens
gcccagaagtgactcagcactg

SEQ ID NO: 9469088 - DNA, 21 bp, Homo sapiens
gcccagaagactggctctgcc

SEQ ID NO: 9469089 - DNA, 21 bp, Homo sapiens
gcccagaagactggctctgcc

SEQ ID NO: 9469090 - DNA, 21 bp, Homo sapiens
gcccagaagactggctctgcc

SEQ ID NO: 9469091 - DNA, 22 bp, Homo sapiens
gcccactggctggagtgctggt

SEQ ID NO: 9469092 - DNA, 22 bp, Homo sapiens
gcccagaaagactgcctaacag

SEQ ID NO: 9469093 - DNA, 22 bp, Homo sapiens
gcccagaaagcatcattgtgga

SEQ ID NO: 9469094 - DNA, 22 bp, Homo sapiens
gcccagaaagcatcattgtgga

SEQ ID NO: 9469095 - DNA, 22 bp, Homo sapiens
gcccagaaagcatcattgtgga

SEQ ID NO: 9469096 - DNA, 22 bp, Homo sapiens
gcccagaaagcatcattgtgga

SEQ ID NO: 9469097 - DNA, 22 bp, Homo sapiens
gcccagaacagtgtcacatgtc

SEQ ID NO: 9469098 - DNA, 22 bp, Homo sapiens
gcccagaaatgaacttgctgtg

SEQ ID NO: 9469099 - DNA, 22 bp, Homo sapiens
gcccagaaatgaacttgctgtg

SEQ ID NO: 9469100 - DNA, 22 bp, Homo sapiens
gcccagaaatgaacttgctgtg

SEQ ID NO: 9469101 - DNA, 22 bp, Homo sapiens
gcccagaaatgaacttgctgtg

SEQ ID NO: 9469102 - DNA, 22 bp, Homo sapiens
gccaggcacagttctaggtgct

SEQ ID NO: 9469103 - DNA, 23 bp, Homo sapiens
gccaggcacatggtggacacgca

SEQ ID NO: 9469104 - DNA, 23 bp, Homo sapiens
gccaggcacatggtggacacgca

SEQ ID NO: 9469105 - DNA, 22 bp, Homo sapiens
gccaggtccagggtggagcgct

SEQ ID NO: 9469106 - DNA, 22 bp, Homo sapiens
gccaggatgactatacaacagc

SEQ ID NO: 9469107 - DNA, 22 bp, Homo sapiens
gccaggagttcagatgcatgtt

SEQ ID NO: 9469108 - DNA, 22 bp, Homo sapiens
gccaggtgtagtggccacacct

SEQ ID NO: 9469109 - DNA, 22 bp, Homo sapiens
gccaggtgtcctcacagtgagg

SEQ ID NO: 9469110 - DNA, 22 bp, Homo sapiens
gccaggttctggggaggtacaa

SEQ ID NO: 9469111 - DNA, 22 bp, Homo sapiens
gccaggtgggagacagacagca

SEQ ID NO: 9469112 - DNA, 22 bp, Homo sapiens
gccaggtctgggtagcagagga

SEQ ID NO: 9469113 - DNA, 22 bp, Homo sapiens
gccaggtcgtctccatgtccaa

SEQ ID NO: 9469114 - DNA, 22 bp, Homo sapiens
gccaggtcccctcatggctcct

SEQ ID NO: 9469115 - DNA, 22 bp, Homo sapiens
gccaggtcccctcatggctcct

SEQ ID NO: 9469116 - DNA, 22 bp, Homo sapiens
gccaggtctgcaggcatcctga

SEQ ID NO: 9469117 - DNA, 22 bp, Homo sapiens
gccaggtctcataaatgcagct

SEQ ID NO: 9469118 - DNA, 22 bp, Homo sapiens
gccaggagaatgctagcagagg

SEQ ID NO: 9469119 - DNA, 22 bp, Homo sapiens
gccaggagaatgctagcagagg

SEQ ID NO: 9469120 - DNA, 22 bp, Homo sapiens
gccaggagagctccttcaggtt

SEQ ID NO: 9469121 - DNA, 22 bp, Homo sapiens
gccaggagagctccttcaggtt

SEQ ID NO: 9469122 - DNA, 22 bp, Homo sapiens
gccaggagccctgggcaagttc

SEQ ID NO: 9469123 - DNA, 22 bp, Homo sapiens
gccaggagccctgggcaagttc

SEQ ID NO: 9469124 - DNA, 22 bp, Homo sapiens
gccaggaggctgctgtgtaggc

SEQ ID NO: 9469125 - DNA, 22 bp, Homo sapiens
gccaggagtgtgtggctatgtt

SEQ ID NO: 9469126 - DNA, 22 bp, Homo sapiens
gccaggagccctgggcaagttc

SEQ ID NO: 9469127 - DNA, 22 bp, Homo sapiens
gccaggaatttcaagagccact

SEQ ID NO: 9469128 - DNA, 19 bp, Homo sapiens
gccaggacatcctcctgct

SEQ ID NO: 9469129 - DNA, 22 bp, Homo sapiens
gccaggacctcagatgcagggc

SEQ ID NO: 9469130 - DNA, 22 bp, Homo sapiens
gccaggaccctggagggcatct

SEQ ID NO: 9469131 - DNA, 22 bp, Homo sapiens
gccaggactgagaatgggagca

SEQ ID NO: 9469132 - DNA, 22 bp, Homo sapiens
gccaggagaaaaggcgaatgat

SEQ ID NO: 9469133 - DNA, 22 bp, Homo sapiens
gccaggacggtgaatgggctac

SEQ ID NO: 9469134 - DNA, 22 bp, Homo sapiens
gccaggactcttcctagaaggt

SEQ ID NO: 9469135 - DNA, 22 bp, Homo sapiens
gccaggactcttcctagaaggt

SEQ ID NO: 9469136 - DNA, 22 bp, Homo sapiens
gccaggacctcccagagctttc

SEQ ID NO: 9469137 - DNA, 22 bp, Homo sapiens
gccctctgttattgcatcctta

SEQ ID NO: 9469138 - DNA, 22 bp, Homo sapiens
gccctctggtgggtgagccccg

SEQ ID NO: 9469139 - DNA, 22 bp, Homo sapiens
gccctctggtgggtgagccccg

SEQ ID NO: 9469140 - DNA, 22 bp, Homo sapiens
gccctctggtggccgcctcggc

SEQ ID NO: 9469141 - DNA, 22 bp, Homo sapiens
gccctctggtggccgcctcggc

SEQ ID NO: 9469142 - DNA, 22 bp, Homo sapiens
gccctctggcacagagatgcag

SEQ ID NO: 9469143 - DNA, 22 bp, Homo sapiens
gccctctggcacagagatgcag

SEQ ID NO: 9469144 - DNA, 22 bp, Homo sapiens
gccctctggcagccttggctgg

SEQ ID NO: 9469145 - DNA, 22 bp, Homo sapiens
gccctctggcagccttggctgg

SEQ ID NO: 9469146 - DNA, 22 bp, Homo sapiens
gccctctggggcacacagagga

SEQ ID NO: 9469147 - DNA, 22 bp, Homo sapiens
gccctctggggcacacagagga

SEQ ID NO: 9469148 - DNA, 18 bp, Homo sapiens
gccctctggctgctgatg

SEQ ID NO: 9469149 - DNA, 18 bp, Homo sapiens
gccctctggctgctgatg

SEQ ID NO: 9469150 - DNA, 20 bp, Homo sapiens
gcccatgaggactgcagctg

SEQ ID NO: 9469151 - DNA, 20 bp, Homo sapiens
gcccatgaggactgcagctg

SEQ ID NO: 9469152 - DNA, 23 bp, Homo sapiens
gcccatgctgttgggcccgagca

SEQ ID NO: 9469153 - DNA, 22 bp, Homo sapiens
gcccatggacacccaagtgcca

SEQ ID NO: 9469154 - DNA, 22 bp, Homo sapiens
gcccatccatggggtcatggcc

SEQ ID NO: 9469155 - DNA, 22 bp, Homo sapiens
gcccagtggtaaaagcaggcct

SEQ ID NO: 9469156 - DNA, 22 bp, Homo sapiens
gcccagtggtaaaagcaggcct

SEQ ID NO: 9469157 - DNA, 22 bp, Homo sapiens
gcccagtggtaaaagcaggcct

SEQ ID NO: 9469158 - DNA, 22 bp, Homo sapiens
gcccagtggtaaaagcaggcct

SEQ ID NO: 9469159 - DNA, 22 bp, Homo sapiens
gcccaggggagtagtcaattta

SEQ ID NO: 9469160 - DNA, 22 bp, Homo sapiens
gcccaggggcagcgcatagtgg

SEQ ID NO: 9469161 - DNA, 22 bp, Homo sapiens
gcccaggggcagcgcatagtgg

SEQ ID NO: 9469162 - DNA, 22 bp, Homo sapiens
gcccagggcttcaaagagagaa

SEQ ID NO: 9469163 - DNA, 22 bp, Homo sapiens
gcccagggcttcaaagagagaa

SEQ ID NO: 9469164 - DNA, 21 bp, Homo sapiens
gcccagagttaagcccaccca

SEQ ID NO: 9469165 - DNA, 22 bp, Homo sapiens
gcccagagttcaaggctgcagt

SEQ ID NO: 9469166 - DNA, 22 bp, Homo sapiens
gcccagagttcaaggctgcagt

SEQ ID NO: 9469167 - DNA, 22 bp, Homo sapiens
gcccagagttcaaggctgcagt

SEQ ID NO: 9469168 - DNA, 21 bp, Homo sapiens
gcccagagttaagcccaccca

SEQ ID NO: 9469169 - DNA, 22 bp, Homo sapiens
gcccagagtggccacttggctc

SEQ ID NO: 9469170 - DNA, 22 bp, Homo sapiens
gcccagagtggccacttggctc

SEQ ID NO: 9469171 - DNA, 22 bp, Homo sapiens
gcccagagttcaaggctgcagt

SEQ ID NO: 9469172 - DNA, 22 bp, Homo sapiens
gcccagagttcaaggctgcagt

SEQ ID NO: 9469173 - DNA, 22 bp, Homo sapiens
gcccagagttcaaggctgcagt

SEQ ID NO: 9469174 - DNA, 22 bp, Homo sapiens
gcccagagttcaaggctgcagt

SEQ ID NO: 9469175 - DNA, 22 bp, Homo sapiens
gcccagagtttgaagatacagt

SEQ ID NO: 9469176 - DNA, 22 bp, Homo sapiens
gcccagagtttgaagatacagt

SEQ ID NO: 9469177 - DNA, 22 bp, Homo sapiens
gcccagagtttgaagatacagt

SEQ ID NO: 9469178 - DNA, 22 bp, Homo sapiens
gcccagcaaggaccaagggccg

SEQ ID NO: 9469179 - DNA, 22 bp, Homo sapiens
gcccaggctggagtgcagtggt

SEQ ID NO: 9469180 - DNA, 22 bp, Homo sapiens
gcccaggctggagtgcagtggt

SEQ ID NO: 9469181 - DNA, 22 bp, Homo sapiens
gcccaggctggagtgcagtggt

SEQ ID NO: 9469182 - DNA, 22 bp, Homo sapiens
gcccaggctggagtgcagtggt

SEQ ID NO: 9469183 - DNA, 22 bp, Homo sapiens
gcccaggctggagtgcagtggt

SEQ ID NO: 9469184 - DNA, 22 bp, Homo sapiens
gcccaggctggagttcagtggt

SEQ ID NO: 9469185 - DNA, 23 bp, Homo sapiens
gcccagggactgggaatcagtgg

SEQ ID NO: 9469186 - DNA, 22 bp, Homo sapiens
gcccagggcagggcaagagtga

SEQ ID NO: 9469187 - DNA, 22 bp, Homo sapiens
gcccagggctgcaagtggacgc

SEQ ID NO: 9469188 - DNA, 22 bp, Homo sapiens
gcccagggcgatggtcggggcc

SEQ ID NO: 9469189 - DNA, 22 bp, Homo sapiens
gcccagggcgatggtcggggcc

SEQ ID NO: 9469190 - DNA, 22 bp, Homo sapiens
gcccagggcgatggtcggggcc

SEQ ID NO: 9469191 - DNA, 22 bp, Homo sapiens
gcccagggcgatggtcggggcc

SEQ ID NO: 9469192 - DNA, 22 bp, Homo sapiens
gcccagggcgatggtcggggcc

SEQ ID NO: 9469193 - DNA, 22 bp, Homo sapiens
gcccagggcgatggtcggggcc

SEQ ID NO: 9469194 - DNA, 22 bp, Homo sapiens
gcccagggcgatggtcggggcc

SEQ ID NO: 9469195 - DNA, 22 bp, Homo sapiens
gccctgaagctgagggtgttaa

SEQ ID NO: 9469196 - DNA, 22 bp, Homo sapiens
gccctgaacgaggggtctggag

SEQ ID NO: 9469197 - DNA, 22 bp, Homo sapiens
gccctctgttattgcatcctta

SEQ ID NO: 9469198 - DNA, 22 bp, Homo sapiens
gccctgacactttgcagctgag

SEQ ID NO: 9469199 - DNA, 22 bp, Homo sapiens
gccctgaattcctcaggctgtg

SEQ ID NO: 9469200 - DNA, 22 bp, Homo sapiens
gccctgaccttcactgactctc

SEQ ID NO: 9469201 - DNA, 22 bp, Homo sapiens
gccctgagactgagcatgggtt

SEQ ID NO: 9469202 - DNA, 22 bp, Homo sapiens
gccctgagactgagcatgggtt

SEQ ID NO: 9469203 - DNA, 22 bp, Homo sapiens
gccctgagactgaagaactgtc

SEQ ID NO: 9469204 - DNA, 22 bp, Homo sapiens
gccctgagactgaagaactgtc

SEQ ID NO: 9469205 - DNA, 19 bp, Homo sapiens
gccctgagagcttgggttc

SEQ ID NO: 9469206 - DNA, 19 bp, Homo sapiens
gccctgagagcttgggttc

SEQ ID NO: 9469207 - DNA, 22 bp, Homo sapiens
gccctgagactgagcatgggtt

SEQ ID NO: 9469208 - DNA, 22 bp, Homo sapiens
gccctgagactgagcatgggtt

SEQ ID NO: 9469209 - DNA, 22 bp, Homo sapiens
gccctgagaatgtgtgtgtcta

SEQ ID NO: 9469210 - DNA, 22 bp, Homo sapiens
gccctgagaatgtgtgtgtcta

SEQ ID NO: 9469211 - DNA, 22 bp, Homo sapiens
gccctgagactgaagaactgtc

SEQ ID NO: 9469212 - DNA, 22 bp, Homo sapiens
gccctgagactgaagaactgtc

SEQ ID NO: 9469213 - DNA, 22 bp, Homo sapiens
gccctgagaatgtgtgtgtcta

SEQ ID NO: 9469214 - DNA, 22 bp, Homo sapiens
gccctgagaatgtgtgtgtcta

SEQ ID NO: 9469215 - DNA, 22 bp, Homo sapiens
gccctgagaagaagtcggaggg

SEQ ID NO: 9469216 - DNA, 22 bp, Homo sapiens
gccctgagaagaagtcggaggg

SEQ ID NO: 9469217 - DNA, 22 bp, Homo sapiens
gccctgagaagaagtcggaggg

SEQ ID NO: 9469218 - DNA, 23 bp, Homo sapiens
gccctgactgcggcctcccactc

SEQ ID NO: 9469219 - DNA, 22 bp, Homo sapiens
gccctgagcctatgagcctctc

SEQ ID NO: 9469220 - DNA, 22 bp, Homo sapiens
gccctgagcctatgagcctctc

SEQ ID NO: 9469221 - DNA, 22 bp, Homo sapiens
gccctgagcctatgagcctctc

SEQ ID NO: 9469222 - DNA, 22 bp, Homo sapiens
gccctgagcctatgagcctctc

SEQ ID NO: 9469223 - DNA, 22 bp, Homo sapiens
gccctgagcctatgagcctctc

SEQ ID NO: 9469224 - DNA, 22 bp, Homo sapiens
gccctgagctagtgtgggcagg

SEQ ID NO: 9469225 - DNA, 22 bp, Homo sapiens
gccctgagctagtgtgggcagg

SEQ ID NO: 9469226 - DNA, 22 bp, Homo sapiens
gccctgaggcaaaagaacagtc

SEQ ID NO: 9469227 - DNA, 22 bp, Homo sapiens
gccctgaggcaaaagaacagtc

SEQ ID NO: 9469228 - DNA, 22 bp, Homo sapiens
gccctgaggcaaaagaacagtc

SEQ ID NO: 9469229 - DNA, 22 bp, Homo sapiens
gccctgaggatttgcatttcct

SEQ ID NO: 9469230 - DNA, 22 bp, Homo sapiens
gccctgagctagtgtgggcagg

SEQ ID NO: 9469231 - DNA, 22 bp, Homo sapiens
gccctgagctagtgtgggcagg

SEQ ID NO: 9469232 - DNA, 22 bp, Homo sapiens
gccctgagctagtgtgggcagg

SEQ ID NO: 9469233 - DNA, 22 bp, Homo sapiens
gccctgagcactgctgctgggg

SEQ ID NO: 9469234 - DNA, 22 bp, Homo sapiens
gccctgagcactgctgctgggg

SEQ ID NO: 9469235 - DNA, 22 bp, Homo sapiens
gccctgagcactgctgctgggg

SEQ ID NO: 9469236 - DNA, 22 bp, Homo sapiens
gccctgagccaccaatgccatt

SEQ ID NO: 9469237 - DNA, 22 bp, Homo sapiens
gccctgagcactgctgctgggg

SEQ ID NO: 9469238 - DNA, 22 bp, Homo sapiens
gccctgagcactgctgctgggg

SEQ ID NO: 9469239 - DNA, 22 bp, Homo sapiens
gccctgagccaccaatgccatt

SEQ ID NO: 9469240 - DNA, 22 bp, Homo sapiens
gccctgagccaccaatgccatt

SEQ ID NO: 9469241 - DNA, 22 bp, Homo sapiens
gccctgagaggcaatgactctt

SEQ ID NO: 9469242 - DNA, 22 bp, Homo sapiens
gccctgagattcttggattctg

SEQ ID NO: 9469243 - DNA, 22 bp, Homo sapiens
gccctgagattcttggattctg

SEQ ID NO: 9469244 - DNA, 22 bp, Homo sapiens
gccctgagaggcaatgactctt

SEQ ID NO: 9469245 - DNA, 19 bp, Homo sapiens
gccctgagagcttgggttc

SEQ ID NO: 9469246 - DNA, 22 bp, Homo sapiens
gccctgagcacacagtagcaaa

SEQ ID NO: 9469247 - DNA, 22 bp, Homo sapiens
gccctgagcacacagtagcaaa

SEQ ID NO: 9469248 - DNA, 22 bp, Homo sapiens
gccctgagcacacagtagcaaa

SEQ ID NO: 9469249 - DNA, 22 bp, Homo sapiens
gccctgagcacacagtagcaaa

SEQ ID NO: 9469250 - DNA, 22 bp, Homo sapiens
gccctgagcacacagtagcaaa

SEQ ID NO: 9469251 - DNA, 22 bp, Homo sapiens
gccctgagattcttggattctg

SEQ ID NO: 9469252 - DNA, 22 bp, Homo sapiens
gcctcagctcccagcccaggct

SEQ ID NO: 9469253 - DNA, 22 bp, Homo sapiens
gcctcagctcccagcccaggct

SEQ ID NO: 9469254 - DNA, 22 bp, Homo sapiens
gcctcagctcccagcccaggct

SEQ ID NO: 9469255 - DNA, 22 bp, Homo sapiens
gcctcagctcccagcccaggct

SEQ ID NO: 9469256 - DNA, 22 bp, Homo sapiens
gcctcagctcccagcccaggct

SEQ ID NO: 9469257 - DNA, 22 bp, Homo sapiens
gcctcaggccgccctgctgctc

SEQ ID NO: 9469258 - DNA, 22 bp, Homo sapiens
gcctcaggccgccctgctgctc

SEQ ID NO: 9469259 - DNA, 22 bp, Homo sapiens
gcctcagctgttgcaggggccc

SEQ ID NO: 9469260 - DNA, 22 bp, Homo sapiens
gcctcagctgttgcaggggccc

SEQ ID NO: 9469261 - DNA, 22 bp, Homo sapiens
gcctcagccggcggacgccagg

SEQ ID NO: 9469262 - DNA, 22 bp, Homo sapiens
gcctcagccggcggacgccagg

SEQ ID NO: 9469263 - DNA, 20 bp, Homo sapiens
gcctcagccaacccatgggg

SEQ ID NO: 9469264 - DNA, 22 bp, Homo sapiens
gcctcagccggcggacgccagg

SEQ ID NO: 9469265 - DNA, 22 bp, Homo sapiens
gcctcagccggcggacgccagg

SEQ ID NO: 9469266 - DNA, 22 bp, Homo sapiens
gcctcagctcccagcccaggct

SEQ ID NO: 9469267 - DNA, 20 bp, Homo sapiens
gcctcagccaacccatgggg

SEQ ID NO: 9469268 - DNA, 20 bp, Homo sapiens
gcctcagccaacccatgggg

SEQ ID NO: 9469269 - DNA, 20 bp, Homo sapiens
gcctcagccaacccatgggg

SEQ ID NO: 9469270 - DNA, 20 bp, Homo sapiens
gcctcagccaacccatgggg

SEQ ID NO: 9469271 - DNA, 22 bp, Homo sapiens
gcctagagagggagtgccacac

SEQ ID NO: 9469272 - DNA, 22 bp, Homo sapiens
gcctagagaagcttactgaagc

SEQ ID NO: 9469273 - DNA, 22 bp, Homo sapiens
gccctgagggacctcaccccat

SEQ ID NO: 9469274 - DNA, 22 bp, Homo sapiens
gccctgagggacctcaccccat

SEQ ID NO: 9469275 - DNA, 22 bp, Homo sapiens
gccctgaggggtggtgtctgta

SEQ ID NO: 9469276 - DNA, 22 bp, Homo sapiens
gccctgaggggtggtgtctgta

SEQ ID NO: 9469277 - DNA, 22 bp, Homo sapiens
gccctgaggggtggtgtctgta

SEQ ID NO: 9469278 - DNA, 22 bp, Homo sapiens
gccctgaggggtggtgtctgta

SEQ ID NO: 9469279 - DNA, 22 bp, Homo sapiens
gccctgaggggtggtgtctgta

SEQ ID NO: 9469280 - DNA, 22 bp, Homo sapiens
gccctgagggtctgggttccca

SEQ ID NO: 9469281 - DNA, 22 bp, Homo sapiens
gccctgaggggtggtgtctgta

SEQ ID NO: 9469282 - DNA, 22 bp, Homo sapiens
gccctgagggtctgggttccca

SEQ ID NO: 9469283 - DNA, 22 bp, Homo sapiens
gccctgagggtctgggttccca

SEQ ID NO: 9469284 - DNA, 22 bp, Homo sapiens
gccctgagggtctgggttccca

SEQ ID NO: 9469285 - DNA, 22 bp, Homo sapiens
gccctgagggtctgggttccca

SEQ ID NO: 9469286 - DNA, 22 bp, Homo sapiens
gcctcaggcctatagctgctgt

SEQ ID NO: 9469287 - DNA, 22 bp, Homo sapiens
gcctcaggcctatagctgctgt

SEQ ID NO: 9469288 - DNA, 22 bp, Homo sapiens
gcctcaggcctatagctgctgt

SEQ ID NO: 9469289 - DNA, 22 bp, Homo sapiens
gcctcagggataggatgagcat

SEQ ID NO: 9469290 - DNA, 21 bp, Homo sapiens
gcctggctagaagctcctagc

SEQ ID NO: 9469291 - DNA, 22 bp, Homo sapiens
gcctcagggataggatgagcat

SEQ ID NO: 9469292 - DNA, 22 bp, Homo sapiens
gcctcagggataggatgagcat

SEQ ID NO: 9469293 - DNA, 22 bp, Homo sapiens
gcctcagggataggatgagcat

SEQ ID NO: 9469294 - DNA, 22 bp, Homo sapiens
gcctggctgctagccagaggca

SEQ ID NO: 9469295 - DNA, 22 bp, Homo sapiens
gcctggctgctcagccactcac

SEQ ID NO: 9469296 - DNA, 22 bp, Homo sapiens
gcctggctgctcagccactcac

SEQ ID NO: 9469297 - DNA, 22 bp, Homo sapiens
gcctggctgctggttctgagga

SEQ ID NO: 9469298 - DNA, 22 bp, Homo sapiens
gcctggctgccggccttggcaa

SEQ ID NO: 9469299 - DNA, 22 bp, Homo sapiens
gcctggctgccggccttggcaa

SEQ ID NO: 9469300 - DNA, 18 bp, Homo sapiens
gcctggctgccaacccag

SEQ ID NO: 9469301 - DNA, 22 bp, Homo sapiens
gcctggctatggcctcccccat

SEQ ID NO: 9469302 - DNA, 22 bp, Homo sapiens
gcctggcttgccagccctggcg

SEQ ID NO: 9469303 - DNA, 22 bp, Homo sapiens
gcctggcttgccagccctggcg

SEQ ID NO: 9469304 - DNA, 22 bp, Homo sapiens
gcctggggaacttgatcctgtc

SEQ ID NO: 9469305 - DNA, 22 bp, Homo sapiens
gcctggggaacttgatcctgtc

SEQ ID NO: 9469306 - DNA, 22 bp, Homo sapiens
gcctggggaacttgatcctgtc

SEQ ID NO: 9469307 - DNA, 21 bp, Homo sapiens
gcctggcttcacaggcactga

SEQ ID NO: 9469308 - DNA, 21 bp, Homo sapiens
gcctggcttcacaggcactga

SEQ ID NO: 9469309 - DNA, 22 bp, Homo sapiens
gcctggcttcccttggagcatt

SEQ ID NO: 9469310 - DNA, 18 bp, Homo sapiens
gcctggcttcggagccgc

SEQ ID NO: 9469311 - DNA, 22 bp, Homo sapiens
gcctggctggtcactgcctggc

SEQ ID NO: 9469312 - DNA, 22 bp, Homo sapiens
gcctggctggtcactgcctggc

SEQ ID NO: 9469313 - DNA, 22 bp, Homo sapiens
gcctggctgtcaaacccagaag

SEQ ID NO: 9469314 - DNA, 22 bp, Homo sapiens
gcctggctgtctggcaaggttc

SEQ ID NO: 9469315 - DNA, 22 bp, Homo sapiens
gcctggctgtcaaacccagaag

SEQ ID NO: 9469316 - DNA, 22 bp, Homo sapiens
gcctggctgggctgaatgctta

SEQ ID NO: 9469317 - DNA, 22 bp, Homo sapiens
gcctggctgggcaccaggggag

SEQ ID NO: 9469318 - DNA, 22 bp, Homo sapiens
gcctggctgcttagcctacttc

SEQ ID NO: 9469319 - DNA, 22 bp, Homo sapiens
gcctggctgggcaccaggggag

SEQ ID NO: 9469320 - DNA, 19 bp, Homo sapiens
gcctggctgggatgagccc

SEQ ID NO: 9469321 - DNA, 22 bp, Homo sapiens
gcctggtggtatcctggcaaga

SEQ ID NO: 9469322 - DNA, 22 bp, Homo sapiens
gcctggtggacactgggcatca

SEQ ID NO: 9469323 - DNA, 22 bp, Homo sapiens
gccttaggggtcagacagagct

SEQ ID NO: 9469324 - DNA, 18 bp, Homo sapiens
gccttcagactgcatgct

SEQ ID NO: 9469325 - DNA, 22 bp, Homo sapiens
gccttattacctgcactttgaa

SEQ ID NO: 9469326 - DNA, 22 bp, Homo sapiens
gccttcagagtaccatgtcctc

SEQ ID NO: 9469327 - DNA, 22 bp, Homo sapiens
gccttcaggtgtccctgtgggc

SEQ ID NO: 9469328 - DNA, 22 bp, Homo sapiens
gccttcagtagtgtcagctgta

SEQ ID NO: 9469329 - DNA, 22 bp, Homo sapiens
gccttcaggaaatcagtccttg

SEQ ID NO: 9469330 - DNA, 22 bp, Homo sapiens
gcctggtctctttcatgtcagt

SEQ ID NO: 9469331 - DNA, 22 bp, Homo sapiens
gcctggtctctggggttgggta

SEQ ID NO: 9469332 - DNA, 22 bp, Homo sapiens
gcctggtgaaaggcagagagcg

SEQ ID NO: 9469333 - DNA, 22 bp, Homo sapiens
gcctggtgaaaggcagagagcg

SEQ ID NO: 9469334 - DNA, 22 bp, Homo sapiens
gcctggggccagcttgggctga

SEQ ID NO: 9469335 - DNA, 22 bp, Homo sapiens
gcctggggccagcttgggctga

SEQ ID NO: 9469336 - DNA, 22 bp, Homo sapiens
gcctggggccagcttgggctga

SEQ ID NO: 9469337 - DNA, 22 bp, Homo sapiens
gcctggggaacttgatcctgtc

SEQ ID NO: 9469338 - DNA, 22 bp, Homo sapiens
gcctggggaacttgatcctgtc

SEQ ID NO: 9469339 - DNA, 22 bp, Homo sapiens
gcctggggaacttgatcctgtc

SEQ ID NO: 9469340 - DNA, 22 bp, Homo sapiens
gcctggggcatgcagctgatac

SEQ ID NO: 9469341 - DNA, 22 bp, Homo sapiens
gcctggggcatgcagctgatac

SEQ ID NO: 9469342 - DNA, 22 bp, Homo sapiens
gcctggggcatgcagctgatac

SEQ ID NO: 9469343 - DNA, 22 bp, Homo sapiens
gcctggggtctctgactcacag

SEQ ID NO: 9469344 - DNA, 22 bp, Homo sapiens
gcctggggtctctgactcacag

SEQ ID NO: 9469345 - DNA, 22 bp, Homo sapiens
gcctggggggcatgtcataata

SEQ ID NO: 9469346 - DNA, 22 bp, Homo sapiens
gcctggggtcccttgttggcac

SEQ ID NO: 9469347 - DNA, 22 bp, Homo sapiens
gcctggggtcccttgttggcac

SEQ ID NO: 9469348 - DNA, 22 bp, Homo sapiens
gctcaccaagcagagactctgg

SEQ ID NO: 9469349 - DNA, 22 bp, Homo sapiens
gctcaccactgctagagtctat

SEQ ID NO: 9469350 - DNA, 21 bp, Homo sapiens
gctcaccagttgggaatagac

SEQ ID NO: 9469351 - DNA, 22 bp, Homo sapiens
gctcaccttcgtccagcagccg

SEQ ID NO: 9469352 - DNA, 22 bp, Homo sapiens
gctcaggcatgtatgtggttgc

SEQ ID NO: 9469353 - DNA, 22 bp, Homo sapiens
gctcaggcccagcggctggtgt

SEQ ID NO: 9469354 - DNA, 18 bp, Homo sapiens
gctcaggccctagtcagt

SEQ ID NO: 9469355 - DNA, 22 bp, Homo sapiens
gctcagctgggaccaatgtgtt

SEQ ID NO: 9469356 - DNA, 22 bp, Homo sapiens
gctcagctgggaccaatgtgtt

SEQ ID NO: 9469357 - DNA, 22 bp, Homo sapiens
gctcagctggagagggacgggt

SEQ ID NO: 9469358 - DNA, 21 bp, Homo sapiens
gctcagctgcttggttcctgt

SEQ ID NO: 9469359 - DNA, 21 bp, Homo sapiens
gctcagctgcttggttcctgt

SEQ ID NO: 9469360 - DNA, 22 bp, Homo sapiens
gctcagctggaccatcgtgttt

SEQ ID NO: 9469361 - DNA, 22 bp, Homo sapiens
gctcagctggaccatcgtgttt

SEQ ID NO: 9469362 - DNA, 22 bp, Homo sapiens
gctcacagccggctggcagggg

SEQ ID NO: 9469363 - DNA, 22 bp, Homo sapiens
gctcacagccggctggcagggg

SEQ ID NO: 9469364 - DNA, 22 bp, Homo sapiens
gctcacagccggctggcagggg

SEQ ID NO: 9469365 - DNA, 22 bp, Homo sapiens
gctcacagtacagtgctggctc

SEQ ID NO: 9469366 - DNA, 22 bp, Homo sapiens
gctcacagtacagtgctggctc

SEQ ID NO: 9469367 - DNA, 22 bp, Homo sapiens
gctcacagtctgctgagtgcag

SEQ ID NO: 9469368 - DNA, 22 bp, Homo sapiens
gctcacagtctgctgagtgcag

SEQ ID NO: 9469369 - DNA, 22 bp, Homo sapiens
gctcacaggtctgtggctattg

SEQ ID NO: 9469370 - DNA, 22 bp, Homo sapiens
gctcacaggggcagacgagttg

SEQ ID NO: 9469371 - DNA, 22 bp, Homo sapiens
gctatcccaccaaggtcccagt

SEQ ID NO: 9469372 - DNA, 22 bp, Homo sapiens
gcggggggaggaacatcttgca

SEQ ID NO: 9469373 - DNA, 22 bp, Homo sapiens
gcggggggaggaacatcttgca

SEQ ID NO: 9469374 - DNA, 22 bp, Homo sapiens
gctatgaacatgagaatgcaaa

SEQ ID NO: 9469375 - DNA, 22 bp, Homo sapiens
gctatgaaggagaggaaggttt

SEQ ID NO: 9469376 - DNA, 22 bp, Homo sapiens
gctatgaatatccatgatcagc

SEQ ID NO: 9469377 - DNA, 22 bp, Homo sapiens
gctatgaacatgagaatgcaaa

SEQ ID NO: 9469378 - DNA, 22 bp, Homo sapiens
gctatgaaacacatttagttca

SEQ ID NO: 9469379 - DNA, 22 bp, Homo sapiens
gcggggcccggacccagcctct

SEQ ID NO: 9469380 - DNA, 22 bp, Homo sapiens
gcggggcctgactctgacccgc

SEQ ID NO: 9469381 - DNA, 22 bp, Homo sapiens
gctcaactgctaactgttttga

SEQ ID NO: 9469382 - DNA, 19 bp, Homo sapiens
gctcaacagctcgggtcct

SEQ ID NO: 9469383 - DNA, 22 bp, Homo sapiens
gctcaagggatgggagtgggtg

SEQ ID NO: 9469384 - DNA, 21 bp, Homo sapiens
gctcaagtttctctggcaaca

SEQ ID NO: 9469385 - DNA, 22 bp, Homo sapiens
gctcaaggcaggcagacatgag

SEQ ID NO: 9469386 - DNA, 22 bp, Homo sapiens
gctcaagggatgggagtgggtg

SEQ ID NO: 9469387 - DNA, 22 bp, Homo sapiens
gctcaagggatgggagtgggtg

SEQ ID NO: 9469388 - DNA, 22 bp, Homo sapiens
gctcaagccttctgcccacctc

SEQ ID NO: 9469389 - DNA, 22 bp, Homo sapiens
gcggcaggagtaaaggaggaag

SEQ ID NO: 9469390 - DNA, 22 bp, Homo sapiens
gcggcccgagcaggacgggtgg

SEQ ID NO: 9469391 - DNA, 22 bp, Homo sapiens
gcggcgcctaagccccgacctc

SEQ ID NO: 9469392 - DNA, 22 bp, Homo sapiens
gcgggaagaacgaccaggctcg

SEQ ID NO: 9469393 - DNA, 22 bp, Homo sapiens
gcgggcgctcaggctgcagctg

SEQ ID NO: 9469394 - DNA, 22 bp, Homo sapiens
gcgggccaccttggagagcgct

SEQ ID NO: 9469395 - DNA, 18 bp, Homo sapiens
gcgctggctgtcctgtcc

SEQ ID NO: 9469396 - DNA, 22 bp, Homo sapiens
gcgctgaggctggaggcgcacg

SEQ ID NO: 9469397 - DNA, 22 bp, Homo sapiens
gcgcgtctgtgtgtgcaggcat

SEQ ID NO: 9469398 - DNA, 22 bp, Homo sapiens
gcgcggcctcacccctcggtga

SEQ ID NO: 9469399 - DNA, 22 bp, Homo sapiens
gcgctcaggtgccaggcctgcg

SEQ ID NO: 9469400 - DNA, 22 bp, Homo sapiens
gcgctcagaaaagattttcttc

SEQ ID NO: 9469401 - DNA, 22 bp, Homo sapiens
gcggagcggagctgccggtgat

SEQ ID NO: 9469402 - DNA, 22 bp, Homo sapiens
gcggagggagataggccttgct

SEQ ID NO: 9469403 - DNA, 22 bp, Homo sapiens
gcggagggagataggccttgct

SEQ ID NO: 9469404 - DNA, 22 bp, Homo sapiens
gccttctgtccaaccccacgat

SEQ ID NO: 9469405 - DNA, 22 bp, Homo sapiens
gccttctgtgctcctggccttt

SEQ ID NO: 9469406 - DNA, 22 bp, Homo sapiens
gccttctgtgctcctggccttt

SEQ ID NO: 9469407 - DNA, 22 bp, Homo sapiens
gccttctgattgctggactgac

SEQ ID NO: 9469408 - DNA, 22 bp, Homo sapiens
gccttctgattgctggactgac

SEQ ID NO: 9469409 - DNA, 22 bp, Homo sapiens
gccttctgatcgctggactgac

SEQ ID NO: 9469410 - DNA, 22 bp, Homo sapiens
gccttctgcgctcgtgtctccg

SEQ ID NO: 9469411 - DNA, 22 bp, Homo sapiens
gccttctgatatctcttggcat

SEQ ID NO: 9469412 - DNA, 22 bp, Homo sapiens
gccttctgatcgctggactgac

SEQ ID NO: 9469413 - DNA, 22 bp, Homo sapiens
gccttctctgtgagctcctagg

SEQ ID NO: 9469414 - DNA, 22 bp, Homo sapiens
gccttctctgtgagctcctagg

SEQ ID NO: 9469415 - DNA, 17 bp, Homo sapiens
gccttctctgccctcac

SEQ ID NO: 9469416 - DNA, 22 bp, Homo sapiens
gccttccacctaggcctctgct

SEQ ID NO: 9469417 - DNA, 22 bp, Homo sapiens
gccttccacctaggcctctgct

SEQ ID NO: 9469418 - DNA, 22 bp, Homo sapiens
gccttgcaggaaggagggacag

SEQ ID NO: 9469419 - DNA, 22 bp, Homo sapiens
gccttgccaaggggcagcagag

SEQ ID NO: 9469420 - DNA, 21 bp, Homo sapiens
gccttgccacatgtgccacag

SEQ ID NO: 9469421 - DNA, 22 bp, Homo sapiens
gccttttgaaatagaaatctga

SEQ ID NO: 9469422 - DNA, 22 bp, Homo sapiens
gccttttgatctataactgtgt

SEQ ID NO: 9469423 - DNA, 22 bp, Homo sapiens
gccttttttaaactccaagtct

SEQ ID NO: 9469424 - DNA, 22 bp, Homo sapiens
gcgcctggcacacagcaagggc

SEQ ID NO: 9469425 - DNA, 22 bp, Homo sapiens
gcgcgctgagtgtccgttgggg

SEQ ID NO: 9469426 - DNA, 22 bp, Homo sapiens
gcgccccatctacagtactttt

SEQ ID NO: 9469427 - DNA, 22 bp, Homo sapiens
gcgccccatctacagtactttt

SEQ ID NO: 9469428 - DNA, 22 bp, Homo sapiens
gcgccccatctacagtactttt

SEQ ID NO: 9469429 - DNA, 22 bp, Homo sapiens
gctcctggtgcaaagtttcttc

SEQ ID NO: 9469430 - DNA, 22 bp, Homo sapiens
gctcctggtctggagcttcaag

SEQ ID NO: 9469431 - DNA, 22 bp, Homo sapiens
gctcctggtctggagcttcaag

SEQ ID NO: 9469432 - DNA, 21 bp, Homo sapiens
gctcaggctcttgacagagca

SEQ ID NO: 9469433 - DNA, 22 bp, Homo sapiens
gctcaggctggattgcagtggc

SEQ ID NO: 9469434 - DNA, 22 bp, Homo sapiens
gctcaggctggattgcagtggc

SEQ ID NO: 9469435 - DNA, 19 bp, Homo sapiens
gctcaggctgtgtgtgggg

SEQ ID NO: 9469436 - DNA, 19 bp, Homo sapiens
gctcaggctgtgtgtgggg

SEQ ID NO: 9469437 - DNA, 22 bp, Homo sapiens
gctcaggcttcttctataaaga

SEQ ID NO: 9469438 - DNA, 22 bp, Homo sapiens
gctcagggaaagagctcctgtc

SEQ ID NO: 9469439 - DNA, 22 bp, Homo sapiens
gctcagggaaagagctcctgtc

SEQ ID NO: 9469440 - DNA, 22 bp, Homo sapiens
gctcaggcctcggacacacaat

SEQ ID NO: 9469441 - DNA, 22 bp, Homo sapiens
gctcaggcctggcccatgggac

SEQ ID NO: 9469442 - DNA, 22 bp, Homo sapiens
gctcaggcctggcccatgggac

SEQ ID NO: 9469443 - DNA, 22 bp, Homo sapiens
gctcaggcctccagaggggcaa

SEQ ID NO: 9469444 - DNA, 22 bp, Homo sapiens
gctcaggcctcggacacacaat

SEQ ID NO: 9469445 - DNA, 22 bp, Homo sapiens
gctcaggcctccagaggggcaa

SEQ ID NO: 9469446 - DNA, 22 bp, Homo sapiens
gctcaggcctccagaggggcaa

SEQ ID NO: 9469447 - DNA, 22 bp, Homo sapiens
gctcaggcctcactccatttgg

SEQ ID NO: 9469448 - DNA, 18 bp, Homo sapiens
gctcaggccctagtcagt

SEQ ID NO: 9469449 - DNA, 21 bp, Homo sapiens
gctcaggctcaggttcaggtt

SEQ ID NO: 9469450 - DNA, 22 bp, Homo sapiens
gctcaggcctggctatccattg

SEQ ID NO: 9469451 - DNA, 22 bp, Homo sapiens
gctcaggcctggctatccattg

SEQ ID NO: 9469452 - DNA, 21 bp, Homo sapiens
gctcaggctcttgacagagca

SEQ ID NO: 9469453 - DNA, 22 bp, Homo sapiens
gctcaggctctcccaggggaat

SEQ ID NO: 9469454 - DNA, 22 bp, Homo sapiens
gctcctggtgctgtagagattt

SEQ ID NO: 9469455 - DNA, 21 bp, Homo sapiens
gctcctggtgctgcgtggcgc

SEQ ID NO: 9469456 - DNA, 21 bp, Homo sapiens
gctcctggtgctgcgtggcgc

SEQ ID NO: 9469457 - DNA, 21 bp, Homo sapiens
gctcctggtgctgcgtggcgc

SEQ ID NO: 9469458 - DNA, 20 bp, Homo sapiens
gctcctgtcctggtggaggg

SEQ ID NO: 9469459 - DNA, 22 bp, Homo sapiens
gctcctgtccttagccccagag

SEQ ID NO: 9469460 - DNA, 22 bp, Homo sapiens
gctcctgtgaggacacagccgc

SEQ ID NO: 9469461 - DNA, 22 bp, Homo sapiens
gctcctgtcttggggcactggc

SEQ ID NO: 9469462 - DNA, 22 bp, Homo sapiens
gctcctgtcagtcatcaggtgc

SEQ ID NO: 9469463 - DNA, 22 bp, Homo sapiens
gctcctgtcatcaaacaatcct

SEQ ID NO: 9469464 - DNA, 18 bp, Homo sapiens
gctcctggttggaaagaa

SEQ ID NO: 9469465 - DNA, 18 bp, Homo sapiens
gctcctggttggaaagaa

SEQ ID NO: 9469466 - DNA, 22 bp, Homo sapiens
gctcctgtgaaggcattaggtg

SEQ ID NO: 9469467 - DNA, 22 bp, Homo sapiens
gctcctgttttcttccagaaat

SEQ ID NO: 9469468 - DNA, 22 bp, Homo sapiens
gctccttcaggtggtagctgtt

SEQ ID NO: 9469469 - DNA, 22 bp, Homo sapiens
gctctatgttgaccttcagtgg

SEQ ID NO: 9469470 - DNA, 22 bp, Homo sapiens
gctctattactttcaataaaaa

SEQ ID NO: 9469471 - DNA, 22 bp, Homo sapiens
gctctcagaagtaacttgtcca

SEQ ID NO: 9469472 - DNA, 22 bp, Homo sapiens
gctctcactttaggttggaccg

SEQ ID NO: 9469473 - DNA, 22 bp, Homo sapiens
gctctcagcccactgaggggaa

SEQ ID NO: 9469474 - DNA, 21 bp, Homo sapiens
gctctcagctgcctgctggtt

SEQ ID NO: 9469475 - DNA, 23 bp, Homo sapiens
gctctgctctgtttcatagacag

SEQ ID NO: 9469476 - DNA, 23 bp, Homo sapiens
gctctggcagcttgtgtcagcac

SEQ ID NO: 9469477 - DNA, 23 bp, Homo sapiens
gctctggcagcttgtgtcagcac

SEQ ID NO: 9469478 - DNA, 22 bp, Homo sapiens
gctctggcagctgatattagga

SEQ ID NO: 9469479 - DNA, 22 bp, Homo sapiens
gctctggcactggcgcgggatg

SEQ ID NO: 9469480 - DNA, 17 bp, Homo sapiens
gctctggcacaggattg

SEQ ID NO: 9469481 - DNA, 22 bp, Homo sapiens
gctctggctactgtggctaccg

SEQ ID NO: 9469482 - DNA, 22 bp, Homo sapiens
gctgaagagagatgcgtccagc

SEQ ID NO: 9469483 - DNA, 21 bp, Homo sapiens
gctctggcctactgttccctc

SEQ ID NO: 9469484 - DNA, 22 bp, Homo sapiens
gctctggcccaaaccctttcta

SEQ ID NO: 9469485 - DNA, 22 bp, Homo sapiens
gctctggccagaccctcagtgg

SEQ ID NO: 9469486 - DNA, 22 bp, Homo sapiens
gctctggctactccaccctgtt

SEQ ID NO: 9469487 - DNA, 21 bp, Homo sapiens
gctctggcctactgttccctc

SEQ ID NO: 9469488 - DNA, 22 bp, Homo sapiens
gctctggctactccaccctgtt

SEQ ID NO: 9469489 - DNA, 22 bp, Homo sapiens
gctctggctactccaccctgtt

SEQ ID NO: 9469490 - DNA, 22 bp, Homo sapiens
gctctgccttctcactgggttc

SEQ ID NO: 9469491 - DNA, 22 bp, Homo sapiens
gctctgccttctcactgggttc

SEQ ID NO: 9469492 - DNA, 22 bp, Homo sapiens
gctctgcctcccctagtgttac

SEQ ID NO: 9469493 - DNA, 22 bp, Homo sapiens
gctctgccctgggccgttgtaa

SEQ ID NO: 9469494 - DNA, 17 bp, Homo sapiens
gctctgcctctcccacc

SEQ ID NO: 9469495 - DNA, 17 bp, Homo sapiens
gctctgcctctcccacc

SEQ ID NO: 9469496 - DNA, 22 bp, Homo sapiens
gctctgcctctttgctgcgtca

SEQ ID NO: 9469497 - DNA, 22 bp, Homo sapiens
gctctgcctggtcgcgtgctgg

SEQ ID NO: 9469498 - DNA, 22 bp, Homo sapiens
gctctgcctctttgctgcgtca

SEQ ID NO: 9469499 - DNA, 17 bp, Homo sapiens
gctctgccccagcctct

SEQ ID NO: 9469500 - DNA, 17 bp, Homo sapiens
gctctgccccagcctct

SEQ ID NO: 9469501 - DNA, 22 bp, Homo sapiens
gctctgcccagtgccctgagac

SEQ ID NO: 9469502 - DNA, 22 bp, Homo sapiens
gctctgcccagtgccctgagac

SEQ ID NO: 9469503 - DNA, 22 bp, Homo sapiens
gctctgcccagtgccctgagac

SEQ ID NO: 9469504 - DNA, 18 bp, Homo sapiens
gctctgcccaggctgccc

SEQ ID NO: 9469505 - DNA, 18 bp, Homo sapiens
gctctgcccaggctgccc

SEQ ID NO: 9469506 - DNA, 22 bp, Homo sapiens
gctctcaggtacaaagctgtgt

SEQ ID NO: 9469507 - DNA, 22 bp, Homo sapiens
gctctcagggtgatggcatact

SEQ ID NO: 9469508 - DNA, 21 bp, Homo sapiens
gctctcagctgcctgctggtt

SEQ ID NO: 9469509 - DNA, 22 bp, Homo sapiens
gctctccaaaccctgtggcttt

SEQ ID NO: 9469510 - DNA, 22 bp, Homo sapiens
gctgccagctgcggcccacgcg

SEQ ID NO: 9469511 - DNA, 22 bp, Homo sapiens
gctgccagccagggtgggatcc

SEQ ID NO: 9469512 - DNA, 21 bp, Homo sapiens
gctgccaggattttgcaggaa

SEQ ID NO: 9469513 - DNA, 22 bp, Homo sapiens
gctgccaggacggagaggagcg

SEQ ID NO: 9469514 - DNA, 22 bp, Homo sapiens
gctgccagggaggtggtggagg

SEQ ID NO: 9469515 - DNA, 22 bp, Homo sapiens
gctgccagggaggtggtggagg

SEQ ID NO: 9469516 - DNA, 22 bp, Homo sapiens
gctgccagtagttggagctcca

SEQ ID NO: 9469517 - DNA, 22 bp, Homo sapiens
gctgccagtagttggagctcca

SEQ ID NO: 9469518 - DNA, 22 bp, Homo sapiens
gctgccagtgtggcatgatgca

SEQ ID NO: 9469519 - DNA, 22 bp, Homo sapiens
gctgccagttccttcttactcc

SEQ ID NO: 9469520 - DNA, 22 bp, Homo sapiens
gctgccagttccttcttactcc

SEQ ID NO: 9469521 - DNA, 22 bp, Homo sapiens
gctgccatcagagttcaggaat

SEQ ID NO: 9469522 - DNA, 22 bp, Homo sapiens
gctgcagctttaggatccagtg

SEQ ID NO: 9469523 - DNA, 22 bp, Homo sapiens
gctgcagactgggaggcaggtg

SEQ ID NO: 9469524 - DNA, 22 bp, Homo sapiens
gctgcagacctcatgcaggtgg

SEQ ID NO: 9469525 - DNA, 22 bp, Homo sapiens
gctgcagacctcatgcaggtgg

SEQ ID NO: 9469526 - DNA, 22 bp, Homo sapiens
gctgcaggagctggagctgtgg

SEQ ID NO: 9469527 - DNA, 22 bp, Homo sapiens
gctgcagggggtgggcgtctcc

SEQ ID NO: 9469528 - DNA, 22 bp, Homo sapiens
gctgcaggttgggcaacagagt

SEQ ID NO: 9469529 - DNA, 22 bp, Homo sapiens
gctgccagaagaggaggggtta

SEQ ID NO: 9469530 - DNA, 22 bp, Homo sapiens
gctgaaggcccggaggacaggg

SEQ ID NO: 9469531 - DNA, 22 bp, Homo sapiens
gctgaaggcccggaggacaggg

SEQ ID NO: 9469532 - DNA, 19 bp, Homo sapiens
gctgaaggaggtgcctgca

SEQ ID NO: 9469533 - DNA, 20 bp, Homo sapiens
gctgaagattcccatgcaag

SEQ ID NO: 9469534 - DNA, 22 bp, Homo sapiens
gctgaagataagtgaagaggct

SEQ ID NO: 9469535 - DNA, 22 bp, Homo sapiens
gctgaagatgcatcccttctct

SEQ ID NO: 9469536 - DNA, 22 bp, Homo sapiens
gctgaagataagtgaagaggct

SEQ ID NO: 9469537 - DNA, 22 bp, Homo sapiens
gctgaagataagtgaagaggct

SEQ ID NO: 9469538 - DNA, 22 bp, Homo sapiens
gctgaagctgacacatagtgct

SEQ ID NO: 9469539 - DNA, 22 bp, Homo sapiens
gctgaagctgcagcaggaggaa

SEQ ID NO: 9469540 - DNA, 22 bp, Homo sapiens
gctgaagctgacacatagtgct

SEQ ID NO: 9469541 - DNA, 22 bp, Homo sapiens
gctgaataagagtctactttgc

SEQ ID NO: 9469542 - DNA, 22 bp, Homo sapiens
gctgaataagagtctactttgc

SEQ ID NO: 9469543 - DNA, 22 bp, Homo sapiens
gctgaaggtctctggagaggtc

SEQ ID NO: 9469544 - DNA, 22 bp, Homo sapiens
gctgaaggtgtgtggagagagg

SEQ ID NO: 9469545 - DNA, 22 bp, Homo sapiens
gctgaaggtctctggagaggtc

SEQ ID NO: 9469546 - DNA, 22 bp, Homo sapiens
gctgaatagaagtcttcaaagg

SEQ ID NO: 9469547 - DNA, 22 bp, Homo sapiens
gctgaatacagcatgccttatg

SEQ ID NO: 9469548 - DNA, 22 bp, Homo sapiens
gctgaatacagcatgccttatg

SEQ ID NO: 9469549 - DNA, 22 bp, Homo sapiens
gctgaataattctttgttgtgg

SEQ ID NO: 9469550 - DNA, 22 bp, Homo sapiens
gctgaataatgtgtaatgtctc

SEQ ID NO: 9469551 - DNA, 22 bp, Homo sapiens
gctgaataggactgtcatctct

SEQ ID NO: 9469552 - DNA, 22 bp, Homo sapiens
gctgaatagaagtcttcaaagg

SEQ ID NO: 9469553 - DNA, 22 bp, Homo sapiens
gctgaataattctttgttgtgg

SEQ ID NO: 9469554 - DNA, 22 bp, Homo sapiens
gctgaataatgtgtaatgtctc

SEQ ID NO: 9469555 - DNA, 22 bp, Homo sapiens
gctgaatacagcatgccttatg

SEQ ID NO: 9469556 - DNA, 22 bp, Homo sapiens
gctgatagactgaatgttggga

SEQ ID NO: 9469557 - DNA, 22 bp, Homo sapiens
gctgatagactgaatgttggga

SEQ ID NO: 9469558 - DNA, 22 bp, Homo sapiens
gctgaataggactgtcatctct

SEQ ID NO: 9469559 - DNA, 22 bp, Homo sapiens
gctgatgcagggttgagaggag

SEQ ID NO: 9469560 - DNA, 22 bp, Homo sapiens
gctgattttgagaagcacagtc

SEQ ID NO: 9469561 - DNA, 22 bp, Homo sapiens
gctgattttgagaagcacagtc

SEQ ID NO: 9469562 - DNA, 22 bp, Homo sapiens
gctgattttgtcacatagcaag

SEQ ID NO: 9469563 - DNA, 22 bp, Homo sapiens
gctgcacagaacagtcattggc

SEQ ID NO: 9469564 - DNA, 22 bp, Homo sapiens
gctgcacttgagcctgggagaa

SEQ ID NO: 9469565 - DNA, 22 bp, Homo sapiens
gctgcactttgactgctggggt

SEQ ID NO: 9469566 - DNA, 22 bp, Homo sapiens
gctgcagaatttccttctcatt

SEQ ID NO: 9469567 - DNA, 22 bp, Homo sapiens
ggaccctgggcagctggctgct

SEQ ID NO: 9469568 - DNA, 22 bp, Homo sapiens
ggaccctggagacccactggga

SEQ ID NO: 9469569 - DNA, 22 bp, Homo sapiens
ggaccctgcgtgtatccacact

SEQ ID NO: 9469570 - DNA, 22 bp, Homo sapiens
ggaccctgcagccacccgacat

SEQ ID NO: 9469571 - DNA, 22 bp, Homo sapiens
ggaccctggagacccactggga

SEQ ID NO: 9469572 - DNA, 22 bp, Homo sapiens
ggaccctggagacccactggga

SEQ ID NO: 9469573 - DNA, 22 bp, Homo sapiens
ggaccctgggcagctggctgct

SEQ ID NO: 9469574 - DNA, 22 bp, Homo sapiens
ggaccctgggcttgctcctggg

SEQ ID NO: 9469575 - DNA, 22 bp, Homo sapiens
ggaccctgggcttgctcctggg

SEQ ID NO: 9469576 - DNA, 22 bp, Homo sapiens
ggaccctgtaaagtcgtgtcca

SEQ ID NO: 9469577 - DNA, 23 bp, Homo sapiens
ggaccctgtggagggtgagagtc

SEQ ID NO: 9469578 - DNA, 23 bp, Homo sapiens
ggaccctgtggagggtgagagtc

SEQ ID NO: 9469579 - DNA, 22 bp, Homo sapiens
ggaccggtggcttcctcgggtc

SEQ ID NO: 9469580 - DNA, 22 bp, Homo sapiens
ggacctgaacataaaacgaggc

SEQ ID NO: 9469581 - DNA, 22 bp, Homo sapiens
ggacagagggcaggagcccaga

SEQ ID NO: 9469582 - DNA, 22 bp, Homo sapiens
ggacagagggcaggagcccaga

SEQ ID NO: 9469583 - DNA, 22 bp, Homo sapiens
ggacagagggcaggagcccaga

SEQ ID NO: 9469584 - DNA, 22 bp, Homo sapiens
ggacagagggcaggagcccaga

SEQ ID NO: 9469585 - DNA, 21 bp, Homo sapiens
ggacagaggagaaggcaccct

SEQ ID NO: 9469586 - DNA, 22 bp, Homo sapiens
ggacccagaggggagtctggca

SEQ ID NO: 9469587 - DNA, 22 bp, Homo sapiens
ggacccagctctgagaccctgc

SEQ ID NO: 9469588 - DNA, 22 bp, Homo sapiens
ggacccagctctgagaccctgc

SEQ ID NO: 9469589 - DNA, 18 bp, Homo sapiens
ggacccagggcctcaccc

SEQ ID NO: 9469590 - DNA, 18 bp, Homo sapiens
ggacccagggcctcaccc

SEQ ID NO: 9469591 - DNA, 22 bp, Homo sapiens
ggacccaggtagggaggaagat

SEQ ID NO: 9469592 - DNA, 22 bp, Homo sapiens
ggacccaggtagggaggaagat

SEQ ID NO: 9469593 - DNA, 22 bp, Homo sapiens
ggacccaggtagggaggaagat

SEQ ID NO: 9469594 - DNA, 17 bp, Homo sapiens
ggacacctggagtctcc

SEQ ID NO: 9469595 - DNA, 19 bp, Homo sapiens
ggacaccctatcaatacct

SEQ ID NO: 9469596 - DNA, 19 bp, Homo sapiens
ggacaccctatcaatacct

SEQ ID NO: 9469597 - DNA, 21 bp, Homo sapiens
ggacaccagtcacactggatt

SEQ ID NO: 9469598 - DNA, 22 bp, Homo sapiens
ggacaccccgggtaccaggtct

SEQ ID NO: 9469599 - DNA, 22 bp, Homo sapiens
ggacacgtggctgaaggcggcc

SEQ ID NO: 9469600 - DNA, 22 bp, Homo sapiens
ggacacgtggctgaaggcggcc

SEQ ID NO: 9469601 - DNA, 17 bp, Homo sapiens
ggacacctggagtctcc

SEQ ID NO: 9469602 - DNA, 22 bp, Homo sapiens
ggacactgaagaatctcagatg

SEQ ID NO: 9469603 - DNA, 22 bp, Homo sapiens
ggacactgaagaatctcagatg

SEQ ID NO: 9469604 - DNA, 23 bp, Homo sapiens
ggacactgctataaaggatctgc

SEQ ID NO: 9469605 - DNA, 21 bp, Homo sapiens
ggacactgataatcttgttgc

SEQ ID NO: 9469606 - DNA, 23 bp, Homo sapiens
ggacactgtgcagatgctagtgc

SEQ ID NO: 9469607 - DNA, 22 bp, Homo sapiens
ggacactggccacatttcaaaa

SEQ ID NO: 9469608 - DNA, 22 bp, Homo sapiens
ggacactggccacatttcaaaa

SEQ ID NO: 9469609 - DNA, 20 bp, Homo sapiens
ggacactgtagatttcaaac

SEQ ID NO: 9469610 - DNA, 20 bp, Homo sapiens
ggacactgtagatttcaaac

SEQ ID NO: 9469611 - DNA, 22 bp, Homo sapiens
ggacactgtataagttagagta

SEQ ID NO: 9469612 - DNA, 22 bp, Homo sapiens
ggacactgttcatggggagggg

SEQ ID NO: 9469613 - DNA, 22 bp, Homo sapiens
ggacactgttcatggggagggg

SEQ ID NO: 9469614 - DNA, 22 bp, Homo sapiens
ggacagaaaccatatgagtgta

SEQ ID NO: 9469615 - DNA, 22 bp, Homo sapiens
ggacagaaaccatatgagtgta

SEQ ID NO: 9469616 - DNA, 22 bp, Homo sapiens
ggacagaaaccatatgagtgta

SEQ ID NO: 9469617 - DNA, 22 bp, Homo sapiens
ggacagaaattcttgttggaca

SEQ ID NO: 9469618 - DNA, 22 bp, Homo sapiens
ggacagagagtgaatatgacat

SEQ ID NO: 9469619 - DNA, 22 bp, Homo sapiens
ggacagagagtgaatatgacat

SEQ ID NO: 9469620 - DNA, 22 bp, Homo sapiens
ggacagagcagacgagcagcgg

SEQ ID NO: 9469621 - DNA, 19 bp, Homo sapiens
ggacagacgcagagatctg

SEQ ID NO: 9469622 - DNA, 22 bp, Homo sapiens
ggacagagccctggtggcctaa

SEQ ID NO: 9469623 - DNA, 22 bp, Homo sapiens
ggacagagccctggtggcctaa

SEQ ID NO: 9469624 - DNA, 22 bp, Homo sapiens
ggacagagcagacgagcagcgg

SEQ ID NO: 9469625 - DNA, 22 bp, Homo sapiens
ggacagagcagacgagcagcgg

SEQ ID NO: 9469626 - DNA, 22 bp, Homo sapiens
ggagaggagattgtggcatttt

SEQ ID NO: 9469627 - DNA, 22 bp, Homo sapiens
ggagaggagctattgggggctc

SEQ ID NO: 9469628 - DNA, 22 bp, Homo sapiens
ggagaggacatggctcccacag

SEQ ID NO: 9469629 - DNA, 22 bp, Homo sapiens
ggagaggaaatgccagcacttc

SEQ ID NO: 9469630 - DNA, 22 bp, Homo sapiens
ggagagcttggagtgcgatttt

SEQ ID NO: 9469631 - DNA, 22 bp, Homo sapiens
ggagaggaaatgccagcacttc

SEQ ID NO: 9469632 - DNA, 22 bp, Homo sapiens
ggagaggaaatgccagcacttc

SEQ ID NO: 9469633 - DNA, 22 bp, Homo sapiens
ggagaggaaatgccagcacttc

SEQ ID NO: 9469634 - DNA, 22 bp, Homo sapiens
ggagaggatgttttagtaactt

SEQ ID NO: 9469635 - DNA, 22 bp, Homo sapiens
ggagaggcgatgagtcacagcc

SEQ ID NO: 9469636 - DNA, 22 bp, Homo sapiens
ggagaggcttccagagtcgtgc

SEQ ID NO: 9469637 - DNA, 22 bp, Homo sapiens
ggagaggcttccagagtcgtgc

SEQ ID NO: 9469638 - DNA, 19 bp, Homo sapiens
ggagaggctggagggatgc

SEQ ID NO: 9469639 - DNA, 19 bp, Homo sapiens
ggagaggctggagggatgc

SEQ ID NO: 9469640 - DNA, 19 bp, Homo sapiens
ggagaggctggagggatgc

SEQ ID NO: 9469641 - DNA, 22 bp, Homo sapiens
ggactgaggacatgtgaggcat

SEQ ID NO: 9469642 - DNA, 22 bp, Homo sapiens
ggactctgtagaggttctcatt

SEQ ID NO: 9469643 - DNA, 22 bp, Homo sapiens
ggagagaggagcccactgctgt

SEQ ID NO: 9469644 - DNA, 22 bp, Homo sapiens
ggagagagatgccgccttgctc

SEQ ID NO: 9469645 - DNA, 22 bp, Homo sapiens
ggagagctggtagctggctcca

SEQ ID NO: 9469646 - DNA, 22 bp, Homo sapiens
ggagagagatgccgccttgctc

SEQ ID NO: 9469647 - DNA, 22 bp, Homo sapiens
ggagagagagctcattagctgc

SEQ ID NO: 9469648 - DNA, 22 bp, Homo sapiens
ggagagagatgccgccttgctc

SEQ ID NO: 9469649 - DNA, 20 bp, Homo sapiens
ggactacaatttgcagtgtg

SEQ ID NO: 9469650 - DNA, 18 bp, Homo sapiens
ggactacaggcacaggga

SEQ ID NO: 9469651 - DNA, 18 bp, Homo sapiens
ggactacaggcacaggga

SEQ ID NO: 9469652 - DNA, 22 bp, Homo sapiens
ggacggggagctggaaagggga

SEQ ID NO: 9469653 - DNA, 22 bp, Homo sapiens
ggacctgccctggctcagatgc

SEQ ID NO: 9469654 - DNA, 22 bp, Homo sapiens
ggacctggaagtttggtgatcc

SEQ ID NO: 9469655 - DNA, 22 bp, Homo sapiens
ggaccttcctggctcctggggt

SEQ ID NO: 9469656 - DNA, 22 bp, Homo sapiens
ggacctggcaatttgcatctct

SEQ ID NO: 9469657 - DNA, 22 bp, Homo sapiens
ggacggctctctggcactgtgg

SEQ ID NO: 9469658 - DNA, 22 bp, Homo sapiens
ggacgcagcgagggaagcagcc

SEQ ID NO: 9469659 - DNA, 22 bp, Homo sapiens
ggacctttgagggggaattggt

SEQ ID NO: 9469660 - DNA, 22 bp, Homo sapiens
ggacgcagccgagggagcaggg

SEQ ID NO: 9469661 - DNA, 22 bp, Homo sapiens
ggaacattttttaaggcagaaa

SEQ ID NO: 9469662 - DNA, 15 bp, Homo sapiens
ggaacatttctgttt

SEQ ID NO: 9469663 - DNA, 22 bp, Homo sapiens
ggaacatttcctggcagagagg

SEQ ID NO: 9469664 - DNA, 22 bp, Homo sapiens
ggaacatttaaattcttatttg

SEQ ID NO: 9469665 - DNA, 22 bp, Homo sapiens
ggaacattggcattttaaggct

SEQ ID NO: 9469666 - DNA, 22 bp, Homo sapiens
ggaaccttgataataagttgtt

SEQ ID NO: 9469667 - DNA, 22 bp, Homo sapiens
ggaacccatgattatggttagg

SEQ ID NO: 9469668 - DNA, 22 bp, Homo sapiens
ggaacagggatttggcctggtt

SEQ ID NO: 9469669 - DNA, 20 bp, Homo sapiens
ggaacatgaatgtgagtggc

SEQ ID NO: 9469670 - DNA, 22 bp, Homo sapiens
ggaacatactgtgtagactttg

SEQ ID NO: 9469671 - DNA, 22 bp, Homo sapiens
ggaacatactgtgtagactttg

SEQ ID NO: 9469672 - DNA, 22 bp, Homo sapiens
ggaacattggcattttaaggct

SEQ ID NO: 9469673 - DNA, 22 bp, Homo sapiens
ggaacattctagagtgttgtga

SEQ ID NO: 9469674 - DNA, 21 bp, Homo sapiens
ggaacattgttaatagtctct

SEQ ID NO: 9469675 - DNA, 22 bp, Homo sapiens
ggaagccagaaagtgagaatat

SEQ ID NO: 9469676 - DNA, 22 bp, Homo sapiens
ggaagccacccagctttgatag

SEQ ID NO: 9469677 - DNA, 22 bp, Homo sapiens
ggaagccagaaagtgagaatat

SEQ ID NO: 9469678 - DNA, 22 bp, Homo sapiens
ggaagccagagtgctgggcagg

SEQ ID NO: 9469679 - DNA, 22 bp, Homo sapiens
ggaagccagagtgctgggcagg

SEQ ID NO: 9469680 - DNA, 22 bp, Homo sapiens
ggaagcaggaggctggggtaaa

SEQ ID NO: 9469681 - DNA, 22 bp, Homo sapiens
ggaagccaggcccagagatgct

SEQ ID NO: 9469682 - DNA, 22 bp, Homo sapiens
ggaagccaggcccagagatgct

SEQ ID NO: 9469683 - DNA, 22 bp, Homo sapiens
ggaagccaggctgggggatctg

SEQ ID NO: 9469684 - DNA, 22 bp, Homo sapiens
ggaagccaggctgggggatctg

SEQ ID NO: 9469685 - DNA, 20 bp, Homo sapiens
ggaagccagggtgcagggga

SEQ ID NO: 9469686 - DNA, 22 bp, Homo sapiens
ggaagccaggccaatgagaaca

SEQ ID NO: 9469687 - DNA, 22 bp, Homo sapiens
ggaagccaggccaatgagaaca

SEQ ID NO: 9469688 - DNA, 20 bp, Homo sapiens
ggaagccagcatccttgagg

SEQ ID NO: 9469689 - DNA, 22 bp, Homo sapiens
ggaagccagagtgctgggcagg

SEQ ID NO: 9469690 - DNA, 22 bp, Homo sapiens
ggaagctttctctgtttcctta

SEQ ID NO: 9469691 - DNA, 22 bp, Homo sapiens
ggaaggaaattggggcagttgt

SEQ ID NO: 9469692 - DNA, 22 bp, Homo sapiens
ggaaggaacaaaccctgtgtgg

SEQ ID NO: 9469693 - DNA, 18 bp, Homo sapiens
ggaaggaagaatgcattt

SEQ ID NO: 9469694 - DNA, 18 bp, Homo sapiens
ggaaggaagaatgcattt

SEQ ID NO: 9469695 - DNA, 18 bp, Homo sapiens
ggaaggaagaatgcattt

SEQ ID NO: 9469696 - DNA, 18 bp, Homo sapiens
ggaaggaagaatgcattt

SEQ ID NO: 9469697 - DNA, 21 bp, Homo sapiens
ggacaccagtcacactggatt

SEQ ID NO: 9469698 - DNA, 21 bp, Homo sapiens
ggacaccagtcacactggatt

SEQ ID NO: 9469699 - DNA, 22 bp, Homo sapiens
ggaaggaagtgaccaggatatc

SEQ ID NO: 9469700 - DNA, 22 bp, Homo sapiens
ggaaggaagtgaccaggatatc

SEQ ID NO: 9469701 - DNA, 22 bp, Homo sapiens
ggaagccatgagggacagttct

SEQ ID NO: 9469702 - DNA, 22 bp, Homo sapiens
ggaagccatgagggacagttct

SEQ ID NO: 9469703 - DNA, 22 bp, Homo sapiens
ggaagccaggttactgttcaga

SEQ ID NO: 9469704 - DNA, 22 bp, Homo sapiens
ggaagccaggttactgttcaga

SEQ ID NO: 9469705 - DNA, 22 bp, Homo sapiens
ggaagccagttgcttggtgtgg

SEQ ID NO: 9469706 - DNA, 22 bp, Homo sapiens
ggaagctgttatcatctgtatc

SEQ ID NO: 9469707 - DNA, 22 bp, Homo sapiens
ggaagctgttcctgtgtggcca

SEQ ID NO: 9469708 - DNA, 22 bp, Homo sapiens
ggaagctgttcctgtgtggcca

SEQ ID NO: 9469709 - DNA, 22 bp, Homo sapiens
ggaagctgttgtgagtgcagca

SEQ ID NO: 9469710 - DNA, 22 bp, Homo sapiens
ggaaagtggtggtggaaagagg

SEQ ID NO: 9469711 - DNA, 22 bp, Homo sapiens
ggaaagggcagaggccttggag

SEQ ID NO: 9469712 - DNA, 22 bp, Homo sapiens
ggaaatcatgggagagttggaa

SEQ ID NO: 9469713 - DNA, 20 bp, Homo sapiens
ggaaatcaccaggctccacc

SEQ ID NO: 9469714 - DNA, 22 bp, Homo sapiens
ggaaatattttgtctaatttgt

SEQ ID NO: 9469715 - DNA, 22 bp, Homo sapiens
ggaaatattttgtctaatttgt

SEQ ID NO: 9469716 - DNA, 22 bp, Homo sapiens
ggaaatcaaggggacaaattgt

SEQ ID NO: 9469717 - DNA, 22 bp, Homo sapiens
ggaaatatcttgtactatgtga

SEQ ID NO: 9469718 - DNA, 22 bp, Homo sapiens
ggaaatataagcagtttgtgtg

SEQ ID NO: 9469719 - DNA, 22 bp, Homo sapiens
ggaaatattgattgctctgtat

SEQ ID NO: 9469720 - DNA, 22 bp, Homo sapiens
ggaaatattttgtctaatttgt

SEQ ID NO: 9469721 - DNA, 22 bp, Homo sapiens
ggaaaggagatattggagagtg

SEQ ID NO: 9469722 - DNA, 22 bp, Homo sapiens
ggaaaggagatgaataggatta

SEQ ID NO: 9469723 - DNA, 22 bp, Homo sapiens
ggaaaggcaggggccctgccca

SEQ ID NO: 9469724 - DNA, 22 bp, Homo sapiens
ggaaaggcaggggccctgccca

SEQ ID NO: 9469725 - DNA, 22 bp, Homo sapiens
ggaaagggagttttgcttatga

SEQ ID NO: 9469726 - DNA, 22 bp, Homo sapiens
ggaaaggctaacagtcatggaa

SEQ ID NO: 9469727 - DNA, 22 bp, Homo sapiens
gcttcctggaacaactgttgct

SEQ ID NO: 9469728 - DNA, 22 bp, Homo sapiens
gcttcctgagtacaccctcatc

SEQ ID NO: 9469729 - DNA, 22 bp, Homo sapiens
gcttcctgagtacaccctcatc

SEQ ID NO: 9469730 - DNA, 22 bp, Homo sapiens
ggaaaggagatattggagagtg

SEQ ID NO: 9469731 - DNA, 18 bp, Homo sapiens
gcttcctgaaagctgccc

SEQ ID NO: 9469732 - DNA, 22 bp, Homo sapiens
gcttcctgagagagacagttcc

SEQ ID NO: 9469733 - DNA, 22 bp, Homo sapiens
gcttcctccatctggggcttgc

SEQ ID NO: 9469734 - DNA, 22 bp, Homo sapiens
gcttcctccatctggggcttgc

SEQ ID NO: 9469735 - DNA, 17 bp, Homo sapiens
gcttcctcatgcagttc

SEQ ID NO: 9469736 - DNA, 22 bp, Homo sapiens
gcttcctccctgctgctcacta

SEQ ID NO: 9469737 - DNA, 22 bp, Homo sapiens
gcttcctcgctgggcagaggca

SEQ ID NO: 9469738 - DNA, 22 bp, Homo sapiens
gcttcctcgctgggcagaggca

SEQ ID NO: 9469739 - DNA, 22 bp, Homo sapiens
gcttcctcctggaggtcactca

SEQ ID NO: 9469740 - DNA, 22 bp, Homo sapiens
gcttcctcctggaggtcactca

SEQ ID NO: 9469741 - DNA, 23 bp, Homo sapiens
gcttcccagacaatactgcttcc

SEQ ID NO: 9469742 - DNA, 22 bp, Homo sapiens
gcttcccaggcgcctgaccttt

SEQ ID NO: 9469743 - DNA, 22 bp, Homo sapiens
gcttcccaggcgcctgaccttt

SEQ ID NO: 9469744 - DNA, 22 bp, Homo sapiens
gcttcccacagctggactgggg

SEQ ID NO: 9469745 - DNA, 22 bp, Homo sapiens
gcttcccattatggaaactctt

SEQ ID NO: 9469746 - DNA, 22 bp, Homo sapiens
gctggctcccagaggccccagc

SEQ ID NO: 9469747 - DNA, 22 bp, Homo sapiens
gctggctcccagaggccccagc

SEQ ID NO: 9469748 - DNA, 22 bp, Homo sapiens
gctggctcccagaggccccagc

SEQ ID NO: 9469749 - DNA, 22 bp, Homo sapiens
gctggctcaagtgtgcttccca

SEQ ID NO: 9469750 - DNA, 22 bp, Homo sapiens
gctggctcaagtgtgcttccca

SEQ ID NO: 9469751 - DNA, 22 bp, Homo sapiens
gctggctcagggactagagttt

SEQ ID NO: 9469752 - DNA, 22 bp, Homo sapiens
gctggctcagggggattagcaa

SEQ ID NO: 9469753 - DNA, 21 bp, Homo sapiens
gctggctcaaatgcttgtgtc

SEQ ID NO: 9469754 - DNA, 21 bp, Homo sapiens
gctggctcaaatgcttgtgtc

SEQ ID NO: 9469755 - DNA, 22 bp, Homo sapiens
gctggctcaagtgtgcttccca

SEQ ID NO: 9469756 - DNA, 22 bp, Homo sapiens
gctggcagggacagctgcgtgt

SEQ ID NO: 9469757 - DNA, 22 bp, Homo sapiens
gctggcagggacagctgcgtgt

SEQ ID NO: 9469758 - DNA, 22 bp, Homo sapiens
gctggcagctggaagttgggct

SEQ ID NO: 9469759 - DNA, 22 bp, Homo sapiens
gctggcaggagaaacggggtgc

SEQ ID NO: 9469760 - DNA, 22 bp, Homo sapiens
gctggcaggatagaagtctaat

SEQ ID NO: 9469761 - DNA, 22 bp, Homo sapiens
gctggcaggagcctttcccttt

SEQ ID NO: 9469762 - DNA, 22 bp, Homo sapiens
gctggcaggataacttctaagc

SEQ ID NO: 9469763 - DNA, 22 bp, Homo sapiens
gctggcagccaagtgaagaggg

SEQ ID NO: 9469764 - DNA, 22 bp, Homo sapiens
gctggcagagacaagaagacta

SEQ ID NO: 9469765 - DNA, 22 bp, Homo sapiens
gctggcagagacaagaagacta

SEQ ID NO: 9469766 - DNA, 22 bp, Homo sapiens
gctggcaaggtgctggagggcc

SEQ ID NO: 9469767 - DNA, 19 bp, Homo sapiens
gctggatggatcctggagt

SEQ ID NO: 9469768 - DNA, 22 bp, Homo sapiens
gctgcccaatggtagtgtcttt

SEQ ID NO: 9469769 - DNA, 21 bp, Homo sapiens
gctgcccaaccctgcatctcc

SEQ ID NO: 9469770 - DNA, 22 bp, Homo sapiens
gctgccatgccacagcactcac

SEQ ID NO: 9469771 - DNA, 22 bp, Homo sapiens
gctgccatggcctcctgcaagg

SEQ ID NO: 9469772 - DNA, 22 bp, Homo sapiens
gctgccattatgggaacgagaa

SEQ ID NO: 9469773 - DNA, 22 bp, Homo sapiens
gctggcactgggaaggactgag

SEQ ID NO: 9469774 - DNA, 22 bp, Homo sapiens
gctggcagactgggggcagaac

SEQ ID NO: 9469775 - DNA, 22 bp, Homo sapiens
gctggcagactgggggcagaac

SEQ ID NO: 9469776 - DNA, 22 bp, Homo sapiens
gctggcagacttcctctggaac

SEQ ID NO: 9469777 - DNA, 22 bp, Homo sapiens
gctggcagacttcctctggaac

SEQ ID NO: 9469778 - DNA, 22 bp, Homo sapiens
gctggcagactgggggcagaac

SEQ ID NO: 9469779 - DNA, 22 bp, Homo sapiens
gctggcagaatttcttcttgct

SEQ ID NO: 9469780 - DNA, 22 bp, Homo sapiens
gctgggagaggccctgaagtga

SEQ ID NO: 9469781 - DNA, 22 bp, Homo sapiens
gctgggactgagacagtgacct

SEQ ID NO: 9469782 - DNA, 22 bp, Homo sapiens
gctgggagacagacttggaacc

SEQ ID NO: 9469783 - DNA, 22 bp, Homo sapiens
gctgggaggaatttggggaata

SEQ ID NO: 9469784 - DNA, 22 bp, Homo sapiens
gctgggagcaaagccatgcata

SEQ ID NO: 9469785 - DNA, 22 bp, Homo sapiens
gctgggagaggccctgaagtga

SEQ ID NO: 9469786 - DNA, 22 bp, Homo sapiens
gctgggacaacaggtgagcacc

SEQ ID NO: 9469787 - DNA, 22 bp, Homo sapiens
gctgggaatgattttggagagg

SEQ ID NO: 9469788 - DNA, 22 bp, Homo sapiens
gctgggaatgattttggagagg

SEQ ID NO: 9469789 - DNA, 22 bp, Homo sapiens
gctgggacaggcttggccctgt

SEQ ID NO: 9469790 - DNA, 22 bp, Homo sapiens
gctgggacaggcttggccctgt

SEQ ID NO: 9469791 - DNA, 22 bp, Homo sapiens
gctgggactgagacagtgacct

SEQ ID NO: 9469792 - DNA, 22 bp, Homo sapiens
gctgggactgagacagtgacct

SEQ ID NO: 9469793 - DNA, 22 bp, Homo sapiens
gctgggaagtgcaagatcaagg

SEQ ID NO: 9469794 - DNA, 22 bp, Homo sapiens
gctgggaagtgcaagatcaagg

SEQ ID NO: 9469795 - DNA, 22 bp, Homo sapiens
gctgggaagagatgcacatgat

SEQ ID NO: 9469796 - DNA, 22 bp, Homo sapiens
gctgggaagaacaggagagaat

SEQ ID NO: 9469797 - DNA, 22 bp, Homo sapiens
gctgggaaccatgggaaggcag

SEQ ID NO: 9469798 - DNA, 22 bp, Homo sapiens
gctgggaagaacaggagagaat

SEQ ID NO: 9469799 - DNA, 22 bp, Homo sapiens
gctggctctgcacccaggcctc

SEQ ID NO: 9469800 - DNA, 22 bp, Homo sapiens
gctggctctgatgggctccagg

SEQ ID NO: 9469801 - DNA, 21 bp, Homo sapiens
gctggctctctgacgtgcttt

SEQ ID NO: 9469802 - DNA, 22 bp, Homo sapiens
gctggctctgatgggctccagg

SEQ ID NO: 9469803 - DNA, 22 bp, Homo sapiens
gctggctctgcacccaggcctc

SEQ ID NO: 9469804 - DNA, 22 bp, Homo sapiens
gctggctctgccccacctgttc

SEQ ID NO: 9469805 - DNA, 22 bp, Homo sapiens
gctggctctgccccacctgttc

SEQ ID NO: 9469806 - DNA, 22 bp, Homo sapiens
gctggctctgtggtagttggca

SEQ ID NO: 9469807 - DNA, 22 bp, Homo sapiens
gctggctctgccccacctgttc

SEQ ID NO: 9469808 - DNA, 22 bp, Homo sapiens
gctggctcctctgtcctcacgg

SEQ ID NO: 9469809 - DNA, 22 bp, Homo sapiens
gctggctcccattggtccttcc

SEQ ID NO: 9469810 - DNA, 22 bp, Homo sapiens
gctggctctacatttgaggtca

SEQ ID NO: 9469811 - DNA, 21 bp, Homo sapiens
gctggctctctgacgtgcttt

SEQ ID NO: 9469812 - DNA, 22 bp, Homo sapiens
gctggctgagttctgtcgtctg

SEQ ID NO: 9469813 - DNA, 22 bp, Homo sapiens
gctggctcttcagtggagatag

SEQ ID NO: 9469814 - DNA, 22 bp, Homo sapiens
gctggctgagttctgtcgtctg

SEQ ID NO: 9469815 - DNA, 22 bp, Homo sapiens
gctggctgagttctgtcgtctg

SEQ ID NO: 9469816 - DNA, 22 bp, Homo sapiens
gctggctgcacaggggctcact

SEQ ID NO: 9469817 - DNA, 22 bp, Homo sapiens
gctggctgcacaggggctcact

SEQ ID NO: 9469818 - DNA, 18 bp, Homo sapiens
gctggctgcacttctgct

SEQ ID NO: 9469819 - DNA, 22 bp, Homo sapiens
gctggctgcagattttagaggt

SEQ ID NO: 9469820 - DNA, 18 bp, Homo sapiens
gctggctgcacttctgct

SEQ ID NO: 9469821 - DNA, 22 bp, Homo sapiens
gctggctgcagattttagaggt

SEQ ID NO: 9469822 - DNA, 22 bp, Homo sapiens
gctggctgcagattttagaggt

SEQ ID NO: 9469823 - DNA, 22 bp, Homo sapiens
gctggctgccaatttcagagct

SEQ ID NO: 9469824 - DNA, 22 bp, Homo sapiens
gctggctgccaatttcagagct

SEQ ID NO: 9469825 - DNA, 22 bp, Homo sapiens
gctggctgccttactttgtgga

SEQ ID NO: 9469826 - DNA, 22 bp, Homo sapiens
gctggctgccaatttcagagct

SEQ ID NO: 9469827 - DNA, 20 bp, Homo sapiens
gctgggaacaggattgaatc

SEQ ID NO: 9469828 - DNA, 22 bp, Homo sapiens
gcttccaatgcttctatcacat

SEQ ID NO: 9469829 - DNA, 22 bp, Homo sapiens
gcttcatttgagaacctctgtg

SEQ ID NO: 9469830 - DNA, 22 bp, Homo sapiens
gcttcccaaacttgtggataga

SEQ ID NO: 9469831 - DNA, 22 bp, Homo sapiens
gcttccagtcctcagaggctgg

SEQ ID NO: 9469832 - DNA, 22 bp, Homo sapiens
gcttccagtaagttgctgccat

SEQ ID NO: 9469833 - DNA, 22 bp, Homo sapiens
gctgtgcagtagtaggtacagt

SEQ ID NO: 9469834 - DNA, 22 bp, Homo sapiens
gctgtgcagtagtaggtacagt

SEQ ID NO: 9469835 - DNA, 21 bp, Homo sapiens
gctgtgcaggtgcccctgctc

SEQ ID NO: 9469836 - DNA, 22 bp, Homo sapiens
gctgtgcagccaagtgcctctg

SEQ ID NO: 9469837 - DNA, 22 bp, Homo sapiens
gctgtgcccagccattctagat

SEQ ID NO: 9469838 - DNA, 22 bp, Homo sapiens
gctgtgcccagctccagctctg

SEQ ID NO: 9469839 - DNA, 22 bp, Homo sapiens
gctgtgcccatattctgctgac

SEQ ID NO: 9469840 - DNA, 22 bp, Homo sapiens
gctgtgcccatattctgctgac

SEQ ID NO: 9469841 - DNA, 22 bp, Homo sapiens
gctgtgcccagctccagctctg

SEQ ID NO: 9469842 - DNA, 22 bp, Homo sapiens
gctgtgcagtgggagttcggtg

SEQ ID NO: 9469843 - DNA, 20 bp, Homo sapiens
gctgtgccatgaccctcgag

SEQ ID NO: 9469844 - DNA, 22 bp, Homo sapiens
gctgtgcatcttcattctggac

SEQ ID NO: 9469845 - DNA, 22 bp, Homo sapiens
gctgtgcataagtataataaac

SEQ ID NO: 9469846 - DNA, 21 bp, Homo sapiens
gctgtgcagaggatggagtgg

SEQ ID NO: 9469847 - DNA, 22 bp, Homo sapiens
gctgtgcagaggtgagaatcca

SEQ ID NO: 9469848 - DNA, 22 bp, Homo sapiens
gctgtgcagagcacagggtccc

SEQ ID NO: 9469849 - DNA, 23 bp, Homo sapiens
gctgtgcacgagccactgcctgt

SEQ ID NO: 9469850 - DNA, 22 bp, Homo sapiens
gctgtgatccttgagagaaggt

SEQ ID NO: 9469851 - DNA, 22 bp, Homo sapiens
gctgtgatacagaaagacagag

SEQ ID NO: 9469852 - DNA, 22 bp, Homo sapiens
gctgtgcaaatcgatttgttgg

SEQ ID NO: 9469853 - DNA, 22 bp, Homo sapiens
gctgtgagtgagctgcctaggc

SEQ ID NO: 9469854 - DNA, 22 bp, Homo sapiens
gctgtgagggtctagtgaggtg

SEQ ID NO: 9469855 - DNA, 22 bp, Homo sapiens
gctgtgagtggaggaggctgag

SEQ ID NO: 9469856 - DNA, 22 bp, Homo sapiens
gctgtgagtggaggaggctgag

SEQ ID NO: 9469857 - DNA, 22 bp, Homo sapiens
gctgtgagggcttctgaggcat

SEQ ID NO: 9469858 - DNA, 22 bp, Homo sapiens
gctgtgagggtctagtgaggtg

SEQ ID NO: 9469859 - DNA, 22 bp, Homo sapiens
gctgtgagggcttctgaggcat

SEQ ID NO: 9469860 - DNA, 22 bp, Homo sapiens
gctgtgagctgcctgtgtcaca

SEQ ID NO: 9469861 - DNA, 22 bp, Homo sapiens
gctgtcttgggtagaaagaggt

SEQ ID NO: 9469862 - DNA, 22 bp, Homo sapiens
gctgtcttgctcactcttgcag

SEQ ID NO: 9469863 - DNA, 22 bp, Homo sapiens
gctgtctttcccctgctccaga

SEQ ID NO: 9469864 - DNA, 22 bp, Homo sapiens
gctgtgaacatgcacatggagt

SEQ ID NO: 9469865 - DNA, 22 bp, Homo sapiens
gctgtgaagaggccactgcatg

SEQ ID NO: 9469866 - DNA, 22 bp, Homo sapiens
gctgtgagccgctgctgagcat

SEQ ID NO: 9469867 - DNA, 22 bp, Homo sapiens
gctgtgagcactgctgggtgga

SEQ ID NO: 9469868 - DNA, 22 bp, Homo sapiens
gctgtgagcactgctgggtgga

SEQ ID NO: 9469869 - DNA, 22 bp, Homo sapiens
gctgtgagaaacagggagtgtc

SEQ ID NO: 9469870 - DNA, 22 bp, Homo sapiens
gctggtagacctcactgcactc

SEQ ID NO: 9469871 - DNA, 16 bp, Homo sapiens
gctggtcaagcagcag

SEQ ID NO: 9469872 - DNA, 22 bp, Homo sapiens
gctggtcactctgggagctgct

SEQ ID NO: 9469873 - DNA, 22 bp, Homo sapiens
gctggtatttgcagcctgtcat

SEQ ID NO: 9469874 - DNA, 22 bp, Homo sapiens
gctgtcttcacttcctggtttc

SEQ ID NO: 9469875 - DNA, 22 bp, Homo sapiens
gctgtctgttcgagcgtgtgtt

SEQ ID NO: 9469876 - DNA, 22 bp, Homo sapiens
gctgggttttcttccgggccta

SEQ ID NO: 9469877 - DNA, 22 bp, Homo sapiens
gctgggttttcttccgggccta

SEQ ID NO: 9469878 - DNA, 22 bp, Homo sapiens
gctgggttttcttccgggccta

SEQ ID NO: 9469879 - DNA, 22 bp, Homo sapiens
gctgggttttcttccgggccta

SEQ ID NO: 9469880 - DNA, 22 bp, Homo sapiens
gctgggttttcttccgggccta

SEQ ID NO: 9469881 - DNA, 22 bp, Homo sapiens
gctgggttttcttccgggccta

SEQ ID NO: 9469882 - DNA, 22 bp, Homo sapiens
gctgggtgtcacggggctcgtg

SEQ ID NO: 9469883 - DNA, 22 bp, Homo sapiens
gctgggtcctatgctggtagag

SEQ ID NO: 9469884 - DNA, 22 bp, Homo sapiens
gctgggtctctccctggtcctg

SEQ ID NO: 9469885 - DNA, 22 bp, Homo sapiens
gctgggtctggatgctcaggtg

SEQ ID NO: 9469886 - DNA, 22 bp, Homo sapiens
gctgggtctggctgtgagccgg

SEQ ID NO: 9469887 - DNA, 22 bp, Homo sapiens
gctgggtggatcggaggctctg

SEQ ID NO: 9469888 - DNA, 22 bp, Homo sapiens
gctgggtggatcggaggctctg

SEQ ID NO: 9469889 - DNA, 22 bp, Homo sapiens
gctgggtgtcacggggctcgtg

SEQ ID NO: 9469890 - DNA, 22 bp, Homo sapiens
gctgggtggatcggaggctctg

SEQ ID NO: 9469891 - DNA, 22 bp, Homo sapiens
gctgggtccatggtcctcgggt

SEQ ID NO: 9469892 - DNA, 21 bp, Homo sapiens
gctgggtcagcaggtcctctg

SEQ ID NO: 9469893 - DNA, 22 bp, Homo sapiens
gctgggtcccaagcctggggag

SEQ ID NO: 9469894 - DNA, 22 bp, Homo sapiens
gctgggtcccaagcctggggag

SEQ ID NO: 9469895 - DNA, 22 bp, Homo sapiens
gctgggtcagaatctccctgtg

SEQ ID NO: 9469896 - DNA, 18 bp, Homo sapiens
gctggggttgagctctcc

SEQ ID NO: 9469897 - DNA, 22 bp, Homo sapiens
gctgggtcagaatctccctgtg

SEQ ID NO: 9469898 - DNA, 21 bp, Homo sapiens
gctgggtcagcaggtcctctg

SEQ ID NO: 9469899 - DNA, 22 bp, Homo sapiens
gctggggtctgtgaggagggct

SEQ ID NO: 9469900 - DNA, 22 bp, Homo sapiens
gctggggtctgtgaggagggct

SEQ ID NO: 9469901 - DNA, 18 bp, Homo sapiens
gctggggttgagctctcc

SEQ ID NO: 9469902 - DNA, 18 bp, Homo sapiens
gctggggttgagctctcc

SEQ ID NO: 9469903 - DNA, 22 bp, Homo sapiens
gctgggagtcgcgtctgtggcc

SEQ ID NO: 9469904 - DNA, 22 bp, Homo sapiens
gctgggagtcgcgtctgtggcc

SEQ ID NO: 9469905 - DNA, 20 bp, Homo sapiens
gctgggggtgtgctgagtga

SEQ ID NO: 9469906 - DNA, 20 bp, Homo sapiens
gctgggggtgtgctgagtga

SEQ ID NO: 9469907 - DNA, 20 bp, Homo sapiens
gctgggggtgtgctgagtga

SEQ ID NO: 9469908 - DNA, 16 bp, Homo sapiens
gctgggagggagaggt

SEQ ID NO: 9469909 - DNA, 22 bp, Homo sapiens
gctgggaggatctctccctgtc

SEQ ID NO: 9469910 - DNA, 16 bp, Homo sapiens
gctgggagggagaggt

SEQ ID NO: 9469911 - DNA, 22 bp, Homo sapiens
ttggaacatccaggacagatat

SEQ ID NO: 9469912 - DNA, 22 bp, Homo sapiens
ttggaacatgccggggtccagg

SEQ ID NO: 9469913 - DNA, 22 bp, Homo sapiens
ttggaacatgccggggtccagg

SEQ ID NO: 9469914 - DNA, 20 bp, Homo sapiens
ttggaacagtggatcagcag

SEQ ID NO: 9469915 - DNA, 22 bp, Homo sapiens
ttggaacagaaacagacaaata

SEQ ID NO: 9469916 - DNA, 22 bp, Homo sapiens
ttggaacagaaacagacaaata

SEQ ID NO: 9469917 - DNA, 22 bp, Homo sapiens
ttggaacagaaacagacaaata

SEQ ID NO: 9469918 - DNA, 22 bp, Homo sapiens
ttggaagacagtgaaacagcac

SEQ ID NO: 9469919 - DNA, 22 bp, Homo sapiens
ttggaagacagtgaaacagcac

SEQ ID NO: 9469920 - DNA, 22 bp, Homo sapiens
ttggaagacagtgaaacagcac

SEQ ID NO: 9469921 - DNA, 22 bp, Homo sapiens
ttggaagacagccgtctttatt

SEQ ID NO: 9469922 - DNA, 22 bp, Homo sapiens
ttggaagacagccgtctttatt

SEQ ID NO: 9469923 - DNA, 22 bp, Homo sapiens
ttggaagacaatgctgattctc

SEQ ID NO: 9469924 - DNA, 22 bp, Homo sapiens
ttggaagaaatatcaatagtgt

SEQ ID NO: 9469925 - DNA, 22 bp, Homo sapiens
ttggaagacaatgctgattctc

SEQ ID NO: 9469926 - DNA, 22 bp, Homo sapiens
ttggaagaaatatcaatagtgt

SEQ ID NO: 9469927 - DNA, 22 bp, Homo sapiens
ttggaagaaatatcaatagtgt

SEQ ID NO: 9469928 - DNA, 23 bp, Homo sapiens
ttggaacacagtaaatgcacaat

SEQ ID NO: 9469929 - DNA, 22 bp, Homo sapiens
ttggaacactagaatctgtact

SEQ ID NO: 9469930 - DNA, 22 bp, Homo sapiens
ttggaacagaaacagacaaata

SEQ ID NO: 9469931 - DNA, 22 bp, Homo sapiens
ttgctttattcacatctatatt

SEQ ID NO: 9469932 - DNA, 22 bp, Homo sapiens
ttgctttatgtgtatgacttga

SEQ ID NO: 9469933 - DNA, 22 bp, Homo sapiens
ttgctttatgtgtatgacttga

SEQ ID NO: 9469934 - DNA, 22 bp, Homo sapiens
ttgctttattcacatctatatt

SEQ ID NO: 9469935 - DNA, 22 bp, Homo sapiens
ttgctttattcacatctatatt

SEQ ID NO: 9469936 - DNA, 22 bp, Homo sapiens
ttgctttaggtatagaatccat

SEQ ID NO: 9469937 - DNA, 22 bp, Homo sapiens
ttgctttagggcaaatatttca

SEQ ID NO: 9469938 - DNA, 22 bp, Homo sapiens
ttgctttatattcaagagagga

SEQ ID NO: 9469939 - DNA, 22 bp, Homo sapiens
ttgcttgactttgtgtacctgt

SEQ ID NO: 9469940 - DNA, 22 bp, Homo sapiens
ttgcttgatgcttatatacttg

SEQ ID NO: 9469941 - DNA, 22 bp, Homo sapiens
ttgcttcttagatattcctctc

SEQ ID NO: 9469942 - DNA, 22 bp, Homo sapiens
ttgcttcttagatattcctctc

SEQ ID NO: 9469943 - DNA, 22 bp, Homo sapiens
ttgcttcttagatattcctctc

SEQ ID NO: 9469944 - DNA, 18 bp, Homo sapiens
ttgcttcttttctctagg

SEQ ID NO: 9469945 - DNA, 23 bp, Homo sapiens
ttgcttctgtgcaattcagtact

SEQ ID NO: 9469946 - DNA, 23 bp, Homo sapiens
ttgcttctgtgcaattcagtact

SEQ ID NO: 9469947 - DNA, 23 bp, Homo sapiens
ttgcttctgtgcaattcagtact

SEQ ID NO: 9469948 - DNA, 23 bp, Homo sapiens
ttgcttctgtgcaattcagtact

SEQ ID NO: 9469949 - DNA, 22 bp, Homo sapiens
ttgcttctggaactttctgttc

SEQ ID NO: 9469950 - DNA, 22 bp, Homo sapiens
ttgcttctaagtataaatatga

SEQ ID NO: 9469951 - DNA, 22 bp, Homo sapiens
ttgctttaccatttgatctcta

SEQ ID NO: 9469952 - DNA, 22 bp, Homo sapiens
ttgctttacctgtggtatattt

SEQ ID NO: 9469953 - DNA, 22 bp, Homo sapiens
ttgctttactttgccattcgtt

SEQ ID NO: 9469954 - DNA, 22 bp, Homo sapiens
ttgctttacaaaaattgatggt

SEQ ID NO: 9469955 - DNA, 22 bp, Homo sapiens
ttgctttacatgttctggtaaa

SEQ ID NO: 9469956 - DNA, 22 bp, Homo sapiens
ttgctttaaggtatctggagaa

SEQ ID NO: 9469957 - DNA, 22 bp, Homo sapiens
ttgctttaatgagattttgcca

SEQ ID NO: 9469958 - DNA, 22 bp, Homo sapiens
ttggaatgcacactgagcctgc

SEQ ID NO: 9469959 - DNA, 22 bp, Homo sapiens
ttggaatgttttaatataaatt

SEQ ID NO: 9469960 - DNA, 22 bp, Homo sapiens
ttggaattcagcttgcttataa

SEQ ID NO: 9469961 - DNA, 20 bp, Homo sapiens
ttggatgtgcatggccgtgc

SEQ ID NO: 9469962 - DNA, 22 bp, Homo sapiens
ttggatgggcattaggaaagtc

SEQ ID NO: 9469963 - DNA, 22 bp, Homo sapiens
ttggagggacagatggctaggc

SEQ ID NO: 9469964 - DNA, 22 bp, Homo sapiens
ttggaggattgctctcagccca

SEQ ID NO: 9469965 - DNA, 22 bp, Homo sapiens
ttggaggcaatgggaaggaggc

SEQ ID NO: 9469966 - DNA, 18 bp, Homo sapiens
ttggaggatgtccatgaa

SEQ ID NO: 9469967 - DNA, 22 bp, Homo sapiens
ttggaagtaatgaagaggtggg

SEQ ID NO: 9469968 - DNA, 22 bp, Homo sapiens
ttggaagtaatgaagaggtggg

SEQ ID NO: 9469969 - DNA, 21 bp, Homo sapiens
ttggaagataatgcttatgat

SEQ ID NO: 9469970 - DNA, 22 bp, Homo sapiens
ttggaagaggaaaatgagccta

SEQ ID NO: 9469971 - DNA, 22 bp, Homo sapiens
ttggaagagtagagttgaataa

SEQ ID NO: 9469972 - DNA, 22 bp, Homo sapiens
ttggaagagagccacagttaat

SEQ ID NO: 9469973 - DNA, 22 bp, Homo sapiens
ttggaagaccagaggccttgtc

SEQ ID NO: 9469974 - DNA, 22 bp, Homo sapiens
ttggcactcagcaagtgttaat

SEQ ID NO: 9469975 - DNA, 22 bp, Homo sapiens
ttggcactcatcctggttgttt

SEQ ID NO: 9469976 - DNA, 22 bp, Homo sapiens
ttggcactcatcctggttgttt

SEQ ID NO: 9469977 - DNA, 22 bp, Homo sapiens
ttggcactctccctgcactggt

SEQ ID NO: 9469978 - DNA, 22 bp, Homo sapiens
ttggcactgcagatgaattgca

SEQ ID NO: 9469979 - DNA, 22 bp, Homo sapiens
ttggcactgaccaaagaagtcc

SEQ ID NO: 9469980 - DNA, 22 bp, Homo sapiens
ttggcactctccctgcactggt

SEQ ID NO: 9469981 - DNA, 22 bp, Homo sapiens
ttggcactcaaagccctctgca

SEQ ID NO: 9469982 - DNA, 22 bp, Homo sapiens
ttggcactcaaaattttatcgg

SEQ ID NO: 9469983 - DNA, 22 bp, Homo sapiens
ttggcactcaactgtcgttgtt

SEQ ID NO: 9469984 - DNA, 22 bp, Homo sapiens
ttggcactcaaaatagatggtt

SEQ ID NO: 9469985 - DNA, 22 bp, Homo sapiens
ttggcactattcactccatggg

SEQ ID NO: 9469986 - DNA, 22 bp, Homo sapiens
ttggcactattgacattttggg

SEQ ID NO: 9469987 - DNA, 22 bp, Homo sapiens
ttggcacctgatatgtgacctt

SEQ ID NO: 9469988 - DNA, 22 bp, Homo sapiens
ttggcacttcacgagacagcta

SEQ ID NO: 9469989 - DNA, 22 bp, Homo sapiens
ttggcactgtgcctggcacatt

SEQ ID NO: 9469990 - DNA, 22 bp, Homo sapiens
ttggcacttcacgagacagcta

SEQ ID NO: 9469991 - DNA, 22 bp, Homo sapiens
ttggcactgcattgaccacacc

SEQ ID NO: 9469992 - DNA, 22 bp, Homo sapiens
ttggcactttctcagcagcctg

SEQ ID NO: 9469993 - DNA, 22 bp, Homo sapiens
ttggcactttgaatgagctcag

SEQ ID NO: 9469994 - DNA, 22 bp, Homo sapiens
ttggcacttttaggcagtaccg

SEQ ID NO: 9469995 - DNA, 22 bp, Homo sapiens
ttggcactttgaatgagctcag

SEQ ID NO: 9469996 - DNA, 22 bp, Homo sapiens
ttggcagaattaaccactgaag

SEQ ID NO: 9469997 - DNA, 22 bp, Homo sapiens
ttggcagaatgggcagcttgag

SEQ ID NO: 9469998 - DNA, 22 bp, Homo sapiens
ttggcagactgggtcctgggga

SEQ ID NO: 9469999 - DNA, 22 bp, Homo sapiens
ttggcagactgacaatctgttt

SEQ ID NO: 9470000 - DNA, 22 bp, Homo sapiens
ttggcagaattaaccactgaag

SEQ ID NO: 9470001 - DNA, 22 bp, Homo sapiens
ttggcagaaatgtggctgggag

SEQ ID NO: 9470002 - DNA, 22 bp, Homo sapiens
ttggcagaatgggcagcttgag

SEQ ID NO: 9470003 - DNA, 22 bp, Homo sapiens
ttggcactattcactccatggg

SEQ ID NO: 9470004 - DNA, 22 bp, Homo sapiens
ttggcacacagtaagccctaag

SEQ ID NO: 9470005 - DNA, 22 bp, Homo sapiens
ttggcacagaaaaactcactgt

SEQ ID NO: 9470006 - DNA, 22 bp, Homo sapiens
ttggcacagagctgcagcctgg

SEQ ID NO: 9470007 - DNA, 22 bp, Homo sapiens
ttggcacagagctgcagcctgg

SEQ ID NO: 9470008 - DNA, 22 bp, Homo sapiens
ttggcaatatttactgaagttg

SEQ ID NO: 9470009 - DNA, 22 bp, Homo sapiens
ttggcaatcaattctgacgtct

SEQ ID NO: 9470010 - DNA, 22 bp, Homo sapiens
ttggcaaaatttaaagaagtga

SEQ ID NO: 9470011 - DNA, 22 bp, Homo sapiens
ttggcaaaatttaaagaagtga

SEQ ID NO: 9470012 - DNA, 22 bp, Homo sapiens
ttggattacatgaaatgcagaa

SEQ ID NO: 9470013 - DNA, 22 bp, Homo sapiens
ttgctaccattgataccagcac

SEQ ID NO: 9470014 - DNA, 22 bp, Homo sapiens
ttgctaatttaactaccttgtt

SEQ ID NO: 9470015 - DNA, 22 bp, Homo sapiens
ttgctaatttgtataatgaaaa

SEQ ID NO: 9470016 - DNA, 22 bp, Homo sapiens
ttgctacatggtttcaaagctg

SEQ ID NO: 9470017 - DNA, 22 bp, Homo sapiens
ttgctaatcatatttcatcact

SEQ ID NO: 9470018 - DNA, 22 bp, Homo sapiens
ttgctaatcatatttcatcact

SEQ ID NO: 9470019 - DNA, 22 bp, Homo sapiens
ttgctataaatggtttcatatt

SEQ ID NO: 9470020 - DNA, 22 bp, Homo sapiens
ttgctaagttatagagtatctt

SEQ ID NO: 9470021 - DNA, 22 bp, Homo sapiens
ttgctaatagaagatttgggaa

SEQ ID NO: 9470022 - DNA, 22 bp, Homo sapiens
ttgctaataaagtttttatgtg

SEQ ID NO: 9470023 - DNA, 22 bp, Homo sapiens
ttgctaataaagtttttatgtg

SEQ ID NO: 9470024 - DNA, 22 bp, Homo sapiens
ttgctaaaggattttgtattta

SEQ ID NO: 9470025 - DNA, 22 bp, Homo sapiens
ttgctaaatccctataatattc

SEQ ID NO: 9470026 - DNA, 22 bp, Homo sapiens
ttgctaaaggattttgtattta

SEQ ID NO: 9470027 - DNA, 22 bp, Homo sapiens
ttgctaaaaatggaattatagg

SEQ ID NO: 9470028 - DNA, 22 bp, Homo sapiens
ttgcgggcctttagttcttgac

SEQ ID NO: 9470029 - DNA, 22 bp, Homo sapiens
ttgctaaaaatggaattatagg

SEQ ID NO: 9470030 - DNA, 22 bp, Homo sapiens
ttgctcaggcttagagctacta

SEQ ID NO: 9470031 - DNA, 22 bp, Homo sapiens
ttgcttcagagggagacacttt

SEQ ID NO: 9470032 - DNA, 22 bp, Homo sapiens
ttgctcagtggcagggctggta

SEQ ID NO: 9470033 - DNA, 22 bp, Homo sapiens
ttgcttcagagggagacacttt

SEQ ID NO: 9470034 - DNA, 22 bp, Homo sapiens
ttgctcagcactggagccagct

SEQ ID NO: 9470035 - DNA, 22 bp, Homo sapiens
ttgcttcctctgtgcaatcctc

SEQ ID NO: 9470036 - DNA, 22 bp, Homo sapiens
ttgcttcctctagtttcttgaa

SEQ ID NO: 9470037 - DNA, 22 bp, Homo sapiens
ttgcttcattttgggactctag

SEQ ID NO: 9470038 - DNA, 22 bp, Homo sapiens
ttgcttcattttcccagtacgg

SEQ ID NO: 9470039 - DNA, 22 bp, Homo sapiens
ttgcttcattaagttctcacag

SEQ ID NO: 9470040 - DNA, 22 bp, Homo sapiens
ttgcttcatggagatggacgaa

SEQ ID NO: 9470041 - DNA, 22 bp, Homo sapiens
ttgcctccttttaaggaaatca

SEQ ID NO: 9470042 - DNA, 22 bp, Homo sapiens
ttgcctccttttaaggaaatca

SEQ ID NO: 9470043 - DNA, 22 bp, Homo sapiens
ttgcctgctacggtcttcactg

SEQ ID NO: 9470044 - DNA, 22 bp, Homo sapiens
ttgcctcaagattttttattga

SEQ ID NO: 9470045 - DNA, 22 bp, Homo sapiens
ttgcctcccagcatgggcagct

SEQ ID NO: 9470046 - DNA, 22 bp, Homo sapiens
ttgcctcccagcatgggcagct

SEQ ID NO: 9470047 - DNA, 22 bp, Homo sapiens
ttgcctccttttaaggaaatca

SEQ ID NO: 9470048 - DNA, 22 bp, Homo sapiens
ttgcccagagctgcctgttaca

SEQ ID NO: 9470049 - DNA, 22 bp, Homo sapiens
ttgcccactctgtttcccaaga

SEQ ID NO: 9470050 - DNA, 22 bp, Homo sapiens
ttgcccactcatgcttttgata

SEQ ID NO: 9470051 - DNA, 22 bp, Homo sapiens
ttgcccagagtcacccagctca

SEQ ID NO: 9470052 - DNA, 22 bp, Homo sapiens
ttgccatcccttacctcagtca

SEQ ID NO: 9470053 - DNA, 22 bp, Homo sapiens
ttgcccactcagccctgtggag

SEQ ID NO: 9470054 - DNA, 22 bp, Homo sapiens
ttgcccaccttagtcttcagac

SEQ ID NO: 9470055 - DNA, 22 bp, Homo sapiens
ttgcccaccttcttttcgtgcc

SEQ ID NO: 9470056 - DNA, 22 bp, Homo sapiens
ttgcccaccatccaataaaatg

SEQ ID NO: 9470057 - DNA, 22 bp, Homo sapiens
ttgcctttgacggtgcagcagt

SEQ ID NO: 9470058 - DNA, 22 bp, Homo sapiens
ttgccttgttattctctcagaa

SEQ ID NO: 9470059 - DNA, 22 bp, Homo sapiens
ttgccttgttattctctcagaa

SEQ ID NO: 9470060 - DNA, 22 bp, Homo sapiens
ttgcctttaacccctgaaaggc

SEQ ID NO: 9470061 - DNA, 22 bp, Homo sapiens
ttgccttatagtgctctgcatt

SEQ ID NO: 9470062 - DNA, 22 bp, Homo sapiens
ttgcctggtcctgtgggtgctg

SEQ ID NO: 9470063 - DNA, 22 bp, Homo sapiens
ttgcctgggcaacatagaactc

SEQ ID NO: 9470064 - DNA, 22 bp, Homo sapiens
ttgcctgggctagtaagccaga

SEQ ID NO: 9470065 - DNA, 22 bp, Homo sapiens
ttgcctggagggacatggagac

SEQ ID NO: 9470066 - DNA, 22 bp, Homo sapiens
ttgcctggagggacatggagac

SEQ ID NO: 9470067 - DNA, 22 bp, Homo sapiens
ttgcctggactctgctggtatt

SEQ ID NO: 9470068 - DNA, 22 bp, Homo sapiens
ttgcctggcttgtagatggggg

SEQ ID NO: 9470069 - DNA, 22 bp, Homo sapiens
ttgcctggatggtccccagaga

SEQ ID NO: 9470070 - DNA, 22 bp, Homo sapiens
ttgcctggattctaccacagaa

SEQ ID NO: 9470071 - DNA, 22 bp, Homo sapiens
ttgaggtcaaagaagtgagtgg

SEQ ID NO: 9470072 - DNA, 22 bp, Homo sapiens
ttgaggtattgatattttatga

SEQ ID NO: 9470073 - DNA, 22 bp, Homo sapiens
ttgcatttcccattgagtaatg

SEQ ID NO: 9470074 - DNA, 19 bp, Homo sapiens
ttgcatttcatgtttgatt

SEQ ID NO: 9470075 - DNA, 19 bp, Homo sapiens
ttgcatttcatgtttgatt

SEQ ID NO: 9470076 - DNA, 22 bp, Homo sapiens
ttgcatttcactttcagtaggc

SEQ ID NO: 9470077 - DNA, 22 bp, Homo sapiens
ttgagtcagtaattccatttct

SEQ ID NO: 9470078 - DNA, 22 bp, Homo sapiens
ttgcatttgacaaattatttaa

SEQ ID NO: 9470079 - DNA, 22 bp, Homo sapiens
ttgcatttgacaaattatttaa

SEQ ID NO: 9470080 - DNA, 22 bp, Homo sapiens
ttgcatttcctgtactgtttga

SEQ ID NO: 9470081 - DNA, 22 bp, Homo sapiens
ttgcatttcctgtactgtttga

SEQ ID NO: 9470082 - DNA, 22 bp, Homo sapiens
ttgcatttcctgtactgtttga

SEQ ID NO: 9470083 - DNA, 22 bp, Homo sapiens
ttgcatttgtttgagtagaatg

SEQ ID NO: 9470084 - DNA, 22 bp, Homo sapiens
ttgcatttgtggcatgggtgtt

SEQ ID NO: 9470085 - DNA, 22 bp, Homo sapiens
ttgcatttgtttgagtagaatg

SEQ ID NO: 9470086 - DNA, 22 bp, Homo sapiens
ttgcatttgctcatttgatatg

SEQ ID NO: 9470087 - DNA, 22 bp, Homo sapiens
ttgcattttggttgtaaatatg

SEQ ID NO: 9470088 - DNA, 22 bp, Homo sapiens
ttgcatttttgagcacgaagtt

SEQ ID NO: 9470089 - DNA, 22 bp, Homo sapiens
ttgccaagtttaatgaatgact

SEQ ID NO: 9470090 - DNA, 22 bp, Homo sapiens
ttgccactaactagctgtgaga

SEQ ID NO: 9470091 - DNA, 22 bp, Homo sapiens
ttgcatttttacaagtagccag

SEQ ID NO: 9470092 - DNA, 22 bp, Homo sapiens
ttgcatttttagatgcttctgt

SEQ ID NO: 9470093 - DNA, 22 bp, Homo sapiens
ttgccaggagacatctggagcc

SEQ ID NO: 9470094 - DNA, 22 bp, Homo sapiens
ttgccaggagacaaagtgggcc

SEQ ID NO: 9470095 - DNA, 22 bp, Homo sapiens
ttgccaggcttgtttctaggct

SEQ ID NO: 9470096 - DNA, 22 bp, Homo sapiens
ttgccaggctctggttccagcc

SEQ ID NO: 9470097 - DNA, 22 bp, Homo sapiens
ttgccagggaacagggagaggc

SEQ ID NO: 9470098 - DNA, 22 bp, Homo sapiens
ttgccagggccagtgggggtgt

SEQ ID NO: 9470099 - DNA, 22 bp, Homo sapiens
ttgccagggctttggtggcatc

SEQ ID NO: 9470100 - DNA, 22 bp, Homo sapiens
ttgccagtattaatagcacttt

SEQ ID NO: 9470101 - DNA, 22 bp, Homo sapiens
ttgccagggtcaggatgagatc

SEQ ID NO: 9470102 - DNA, 22 bp, Homo sapiens
ttgccaggggacatctggagcc

SEQ ID NO: 9470103 - DNA, 22 bp, Homo sapiens
ttgttatttaggtctgggttag

SEQ ID NO: 9470104 - DNA, 22 bp, Homo sapiens
ttgttatttacaacaatcctat

SEQ ID NO: 9470105 - DNA, 22 bp, Homo sapiens
ttgttattattactaagtcttc

SEQ ID NO: 9470106 - DNA, 22 bp, Homo sapiens
ttgttcataaagacagttcaga

SEQ ID NO: 9470107 - DNA, 22 bp, Homo sapiens
ttgttcatcaggtgacacatac

SEQ ID NO: 9470108 - DNA, 22 bp, Homo sapiens
ttgttcataaagacagttcaga

SEQ ID NO: 9470109 - DNA, 21 bp, Homo sapiens
ttgttcctatctgcctcctgc

SEQ ID NO: 9470110 - DNA, 22 bp, Homo sapiens
ttgttcctttccatttctgagt

SEQ ID NO: 9470111 - DNA, 21 bp, Homo sapiens
ttgttcctatctgcctcctgc

SEQ ID NO: 9470112 - DNA, 22 bp, Homo sapiens
ttgttcatctggaacccagagc

SEQ ID NO: 9470113 - DNA, 22 bp, Homo sapiens
ttgtgctctgtgttatttaagg

SEQ ID NO: 9470114 - DNA, 22 bp, Homo sapiens
ttgtgctctgtgttatttaagg

SEQ ID NO: 9470115 - DNA, 22 bp, Homo sapiens
ttgtggaagccctatgagagac

SEQ ID NO: 9470116 - DNA, 22 bp, Homo sapiens
ttgtggaagccctatgagagac

SEQ ID NO: 9470117 - DNA, 22 bp, Homo sapiens
ttgtggaagccctatgagagac

SEQ ID NO: 9470118 - DNA, 22 bp, Homo sapiens
ttgtggaaatacagactccaag

SEQ ID NO: 9470119 - DNA, 22 bp, Homo sapiens
ttgtgcccagaagaaagtgatt

SEQ ID NO: 9470120 - DNA, 22 bp, Homo sapiens
ttgtgcccgggcccgggcctct

SEQ ID NO: 9470121 - DNA, 22 bp, Homo sapiens
ttgtgccctcaaagggtgcgtc

SEQ ID NO: 9470122 - DNA, 22 bp, Homo sapiens
ttgtgcatttctctgagtgtgt

SEQ ID NO: 9470123 - DNA, 22 bp, Homo sapiens
ttgtgcaatttaaaatcttcct

SEQ ID NO: 9470124 - DNA, 22 bp, Homo sapiens
ttgtgcaaggtaaagagggctt

SEQ ID NO: 9470125 - DNA, 22 bp, Homo sapiens
ttgtgcaatagttttctcatga

SEQ ID NO: 9470126 - DNA, 22 bp, Homo sapiens
ttgtgcaatcccctcattttat

SEQ ID NO: 9470127 - DNA, 22 bp, Homo sapiens
ttgtgagatgatttgaaagtgt

SEQ ID NO: 9470128 - DNA, 22 bp, Homo sapiens
ttgtgagagccaaacatgtaag

SEQ ID NO: 9470129 - DNA, 22 bp, Homo sapiens
ttgtgagtagtgccgcaataaa

SEQ ID NO: 9470130 - DNA, 22 bp, Homo sapiens
ttgtacttgccatagaacaaca

SEQ ID NO: 9470131 - DNA, 22 bp, Homo sapiens
ttgtacttaaatatgcaaatag

SEQ ID NO: 9470132 - DNA, 22 bp, Homo sapiens
ttgtagaaaattagatgcatgg

SEQ ID NO: 9470133 - DNA, 22 bp, Homo sapiens
ttgtactttggggaaatgttga

SEQ ID NO: 9470134 - DNA, 22 bp, Homo sapiens
ttgtacttttgtcaggtggaca

SEQ ID NO: 9470135 - DNA, 22 bp, Homo sapiens
ttgtagaagcagggtgccctct

SEQ ID NO: 9470136 - DNA, 22 bp, Homo sapiens
ttgtagaacatgcagcacaatg

SEQ ID NO: 9470137 - DNA, 22 bp, Homo sapiens
ttgtagaatcattatttctagt

SEQ ID NO: 9470138 - DNA, 22 bp, Homo sapiens
ttgtagaacatgcagcacaatg

SEQ ID NO: 9470139 - DNA, 22 bp, Homo sapiens
ttgtagaaaattagatgcatgg

SEQ ID NO: 9470140 - DNA, 18 bp, Homo sapiens
ttgtagcaaatggcagtg

SEQ ID NO: 9470141 - DNA, 22 bp, Homo sapiens
ttgtagaatcattatttctagt

SEQ ID NO: 9470142 - DNA, 22 bp, Homo sapiens
ttggggtcccacaggctgcctg

SEQ ID NO: 9470143 - DNA, 19 bp, Homo sapiens
ttggggtgaatgccagaca

SEQ ID NO: 9470144 - DNA, 18 bp, Homo sapiens
ttggggtgaggccaggaa

SEQ ID NO: 9470145 - DNA, 22 bp, Homo sapiens
ttggggggttgaggagtagata

SEQ ID NO: 9470146 - DNA, 22 bp, Homo sapiens
ttggggggttgaggagtagata

SEQ ID NO: 9470147 - DNA, 22 bp, Homo sapiens
ttggggtaaggaaatatggctt

SEQ ID NO: 9470148 - DNA, 22 bp, Homo sapiens
ttggggcagttattctgtgccc

SEQ ID NO: 9470149 - DNA, 20 bp, Homo sapiens
ttggggcatccaccgaatgg

SEQ ID NO: 9470150 - DNA, 20 bp, Homo sapiens
ttggggcatccaccgaatgg

SEQ ID NO: 9470151 - DNA, 22 bp, Homo sapiens
ttggggcatgattagattatga

SEQ ID NO: 9470152 - DNA, 20 bp, Homo sapiens
ttggggcatccaccgaatgg

SEQ ID NO: 9470153 - DNA, 22 bp, Homo sapiens
ttgggggcagagggagcatctg

SEQ ID NO: 9470154 - DNA, 22 bp, Homo sapiens
ttgggggcatattgagtagtgg

SEQ ID NO: 9470155 - DNA, 22 bp, Homo sapiens
ttgggggcatattgagtagtgg

SEQ ID NO: 9470156 - DNA, 22 bp, Homo sapiens
ttgtattagctgtaaattttct

SEQ ID NO: 9470157 - DNA, 22 bp, Homo sapiens
ttgtattccagccaccacaggc

SEQ ID NO: 9470158 - DNA, 22 bp, Homo sapiens
ttgtattcatttggccatactg

SEQ ID NO: 9470159 - DNA, 22 bp, Homo sapiens
ttgtattcattgcttacccaat

SEQ ID NO: 9470160 - DNA, 22 bp, Homo sapiens
ttgtattaattgaaatgaatgc

SEQ ID NO: 9470161 - DNA, 22 bp, Homo sapiens
ttgtattaattgaaatgaatgc

SEQ ID NO: 9470162 - DNA, 22 bp, Homo sapiens
ttgtattctttatgacttccct

SEQ ID NO: 9470163 - DNA, 22 bp, Homo sapiens
ttgtattctttatgacttccct

SEQ ID NO: 9470164 - DNA, 22 bp, Homo sapiens
ttgtattcttccttagcagtac

SEQ ID NO: 9470165 - DNA, 22 bp, Homo sapiens
ttgtattcttccttagcagtac

SEQ ID NO: 9470166 - DNA, 22 bp, Homo sapiens
ttgtattcctgggtcaaggaga

SEQ ID NO: 9470167 - DNA, 22 bp, Homo sapiens
ttgtattcctgggtcaaggaga

SEQ ID NO: 9470168 - DNA, 20 bp, Homo sapiens
ttgtattccttgaatcaggt

SEQ ID NO: 9470169 - DNA, 22 bp, Homo sapiens
ttgtattctgttacagcaacat

SEQ ID NO: 9470170 - DNA, 22 bp, Homo sapiens
ttgtatttcctataacctttct

SEQ ID NO: 9470171 - DNA, 22 bp, Homo sapiens
ttgtatttcctataacctttct

SEQ ID NO: 9470172 - DNA, 22 bp, Homo sapiens
ttgtatttatattgaatagctt

SEQ ID NO: 9470173 - DNA, 22 bp, Homo sapiens
ttgtatttatattgaatagctt

SEQ ID NO: 9470174 - DNA, 23 bp, Homo sapiens
ttgtatctctggaaattcttcaa

SEQ ID NO: 9470175 - DNA, 22 bp, Homo sapiens
ttgtatgtctcaatatcctgtc

SEQ ID NO: 9470176 - DNA, 22 bp, Homo sapiens
ttgtatgatcaaaagaaatgta

SEQ ID NO: 9470177 - DNA, 22 bp, Homo sapiens
ttgtatgagtatggtgtatagg

SEQ ID NO: 9470178 - DNA, 22 bp, Homo sapiens
ttgtatagcccagagagtgaga

SEQ ID NO: 9470179 - DNA, 22 bp, Homo sapiens
ttgtatagcccagagagtgaga

SEQ ID NO: 9470180 - DNA, 22 bp, Homo sapiens
ttgtatagcccagagagtgaga

SEQ ID NO: 9470181 - DNA, 22 bp, Homo sapiens
ttgtagtggccaaagaactctt

SEQ ID NO: 9470182 - DNA, 22 bp, Homo sapiens
ttgtataagaagttggcagata

SEQ ID NO: 9470183 - DNA, 22 bp, Homo sapiens
ttggcccactctcagaatgtgg

SEQ ID NO: 9470184 - DNA, 22 bp, Homo sapiens
ttggcccagactcggggactga

SEQ ID NO: 9470185 - DNA, 20 bp, Homo sapiens
ttggcagcagctcagccacc

SEQ ID NO: 9470186 - DNA, 22 bp, Homo sapiens
ttggcccagcatgcgggtctgt

SEQ ID NO: 9470187 - DNA, 22 bp, Homo sapiens
ttggccctagactctaagtccg

SEQ ID NO: 9470188 - DNA, 22 bp, Homo sapiens
ttggcccagggtcagcggcgct

SEQ ID NO: 9470189 - DNA, 22 bp, Homo sapiens
ttggcagcagagtgtggtgctc

SEQ ID NO: 9470190 - DNA, 22 bp, Homo sapiens
ttggcagcacggggaacgtctg

SEQ ID NO: 9470191 - DNA, 22 bp, Homo sapiens
ttggcagcaagaggctcttctg

SEQ ID NO: 9470192 - DNA, 22 bp, Homo sapiens
ttggcagatttgtcagtaagct

SEQ ID NO: 9470193 - DNA, 22 bp, Homo sapiens
ttggcagatgagaccaggggtt

SEQ ID NO: 9470194 - DNA, 22 bp, Homo sapiens
ttggcagatgaacacaactgga

SEQ ID NO: 9470195 - DNA, 22 bp, Homo sapiens
ttggcagagggaccagcctaca

SEQ ID NO: 9470196 - DNA, 22 bp, Homo sapiens
ttggcagaggggccacctgccc

SEQ ID NO: 9470197 - DNA, 22 bp, Homo sapiens
ttggcagagagtatgctgaaga

SEQ ID NO: 9470198 - DNA, 22 bp, Homo sapiens
ttggcagaggccgaggtgaaga

SEQ ID NO: 9470199 - DNA, 22 bp, Homo sapiens
ttggcagagggaccagcctaca

SEQ ID NO: 9470200 - DNA, 22 bp, Homo sapiens
ttggcagagccccagccttgga

SEQ ID NO: 9470201 - DNA, 22 bp, Homo sapiens
ttggcagagccccagccttgga

SEQ ID NO: 9470202 - DNA, 22 bp, Homo sapiens
ttggccctttatgggatgggca

SEQ ID NO: 9470203 - DNA, 22 bp, Homo sapiens
ttggccctttatgggatgggca

SEQ ID NO: 9470204 - DNA, 22 bp, Homo sapiens
ttggcctcatggacagctcatc

SEQ ID NO: 9470205 - DNA, 22 bp, Homo sapiens
ttggcctattccagcagctgtg

SEQ ID NO: 9470206 - DNA, 22 bp, Homo sapiens
ttggcctctcccatactgtcca

SEQ ID NO: 9470207 - DNA, 22 bp, Homo sapiens
ttggccctggggccagcttcga

SEQ ID NO: 9470208 - DNA, 22 bp, Homo sapiens
ttggccctggggccagcttcga

SEQ ID NO: 9470209 - DNA, 22 bp, Homo sapiens
ttggccctggcacacccccacg

SEQ ID NO: 9470210 - DNA, 22 bp, Homo sapiens
ttggccctgaggttatcatcta

SEQ ID NO: 9470211 - DNA, 22 bp, Homo sapiens
ttggccctccacctggctgtgc

SEQ ID NO: 9470212 - DNA, 22 bp, Homo sapiens
ttggccctagatgattaagttg

SEQ ID NO: 9470213 - DNA, 22 bp, Homo sapiens
ttggccctgaggaggcagctgc

SEQ ID NO: 9470214 - DNA, 22 bp, Homo sapiens
ttggccctccacctggctgtgc

SEQ ID NO: 9470215 - DNA, 22 bp, Homo sapiens
ttggccttgtacatcatattaa

SEQ ID NO: 9470216 - DNA, 22 bp, Homo sapiens
ttggccttctggtgttcatttt

SEQ ID NO: 9470217 - DNA, 22 bp, Homo sapiens
ttggctggtttcaagaaggcat

SEQ ID NO: 9470218 - DNA, 22 bp, Homo sapiens
ttggctgtatgtacatctgtta

SEQ ID NO: 9470219 - DNA, 22 bp, Homo sapiens
ttggctggtttcaagaaggcat

SEQ ID NO: 9470220 - DNA, 22 bp, Homo sapiens
ttggctggtaagccaaatgaaa

SEQ ID NO: 9470221 - DNA, 22 bp, Homo sapiens
ttggctgggcacagtgtctcat

SEQ ID NO: 9470222 - DNA, 22 bp, Homo sapiens
ttggctgctggtctttggatat

SEQ ID NO: 9470223 - DNA, 22 bp, Homo sapiens
ttggctcattaaagatgataat

SEQ ID NO: 9470224 - DNA, 22 bp, Homo sapiens
ttggctcatgctgttttgtgca

SEQ ID NO: 9470225 - DNA, 22 bp, Homo sapiens
ttggctcccactaactccagca

SEQ ID NO: 9470226 - DNA, 22 bp, Homo sapiens
ttggctcccactaactccagca

SEQ ID NO: 9470227 - DNA, 22 bp, Homo sapiens
ttggctcagtgtgagggagatg

SEQ ID NO: 9470228 - DNA, 22 bp, Homo sapiens
ttggctcagtgtgagggagatg

SEQ ID NO: 9470229 - DNA, 22 bp, Homo sapiens
ttggctcaggctttcattgtaa

SEQ ID NO: 9470230 - DNA, 22 bp, Homo sapiens
ttggctcagtgtgagggagatg

SEQ ID NO: 9470231 - DNA, 22 bp, Homo sapiens
ttggctcatgctgttttgtgca

SEQ ID NO: 9470232 - DNA, 22 bp, Homo sapiens
ttggctcattaaagatgataat

SEQ ID NO: 9470233 - DNA, 20 bp, Homo sapiens
ttggctcatgcaacacctac

SEQ ID NO: 9470234 - DNA, 20 bp, Homo sapiens
ttggctcatgcaacacctac

SEQ ID NO: 9470235 - DNA, 22 bp, Homo sapiens
ttggctcaaaacttagattcca

SEQ ID NO: 9470236 - DNA, 22 bp, Homo sapiens
ttggctcaaaacttagattcca

SEQ ID NO: 9470237 - DNA, 22 bp, Homo sapiens
ttggctcacaaggacggttgct

SEQ ID NO: 9470238 - DNA, 22 bp, Homo sapiens
ttggctcacaaggacggttgct

SEQ ID NO: 9470239 - DNA, 22 bp, Homo sapiens
ttggcctttgtcatcaagatca

SEQ ID NO: 9470240 - DNA, 21 bp, Homo sapiens
ttggcctttgtctcagacact

SEQ ID NO: 9470241 - DNA, 22 bp, Homo sapiens
ttggctcacatgattatggagg

SEQ ID NO: 9470242 - DNA, 22 bp, Homo sapiens
ttggctcacatgattatggagg

SEQ ID NO: 9470243 - DNA, 22 bp, Homo sapiens
ttggctcacctggagcctgttg

SEQ ID NO: 9470244 - DNA, 22 bp, Homo sapiens
ttggctcacctggagcctgttg

SEQ ID NO: 9470245 - DNA, 22 bp, Homo sapiens
ttggctcacctgtctacccaga

SEQ ID NO: 9470246 - DNA, 22 bp, Homo sapiens
ttggctcacctgtctacccaga

SEQ ID NO: 9470247 - DNA, 22 bp, Homo sapiens
ttggctcacctgtctacccaga

SEQ ID NO: 9470248 - DNA, 20 bp, Homo sapiens
ttggctcagatttttatggg

SEQ ID NO: 9470249 - DNA, 20 bp, Homo sapiens
ttggctcagatttttatggg

SEQ ID NO: 9470250 - DNA, 22 bp, Homo sapiens
ttggctcaggctttcattgtaa

SEQ ID NO: 9470251 - DNA, 22 bp, Homo sapiens
ttggctcaggacccctgtgact

SEQ ID NO: 9470252 - DNA, 22 bp, Homo sapiens
ttggctcaggacccctgtgact

SEQ ID NO: 9470253 - DNA, 22 bp, Homo sapiens
ttggctcagcatcttggtgcca

SEQ ID NO: 9470254 - DNA, 22 bp, Homo sapiens
ttggctcagcatcttggtgcca

SEQ ID NO: 9470255 - DNA, 22 bp, Homo sapiens
ttggctcagctgggactgttga

SEQ ID NO: 9470256 - DNA, 22 bp, Homo sapiens
ttggctcagctgggactgttga

SEQ ID NO: 9470257 - DNA, 22 bp, Homo sapiens
ttggcttccaggggcttttaca

SEQ ID NO: 9470258 - DNA, 22 bp, Homo sapiens
ttggcttctgatgtattcctga

SEQ ID NO: 9470259 - DNA, 22 bp, Homo sapiens
ttggcttcctgcacttgagttt

SEQ ID NO: 9470260 - DNA, 22 bp, Homo sapiens
ttggcttcattgatctcacttt

SEQ ID NO: 9470261 - DNA, 22 bp, Homo sapiens
ttggcttcaatgtcagagacag

SEQ ID NO: 9470262 - DNA, 22 bp, Homo sapiens
ttggcttctttagtcagtttgg

SEQ ID NO: 9470263 - DNA, 22 bp, Homo sapiens
ttggcttgatgactggcagtgt

SEQ ID NO: 9470264 - DNA, 22 bp, Homo sapiens
ttggcttgatgactggcagtgt

SEQ ID NO: 9470265 - DNA, 22 bp, Homo sapiens
ttggcttcttataatgcaatag

SEQ ID NO: 9470266 - DNA, 22 bp, Homo sapiens
ttggcttctgttttggctctgt

SEQ ID NO: 9470267 - DNA, 22 bp, Homo sapiens
ttggcttcttataatgcaatag

SEQ ID NO: 9470268 - DNA, 22 bp, Homo sapiens
ttgggaactctaacattttgca

SEQ ID NO: 9470269 - DNA, 22 bp, Homo sapiens
ttgggaaatatggattgttatt

SEQ ID NO: 9470270 - DNA, 22 bp, Homo sapiens
ttgggaaacagtatagctaaca

SEQ ID NO: 9470271 - DNA, 22 bp, Homo sapiens
ttgggaaagccacaaattggag

SEQ ID NO: 9470272 - DNA, 22 bp, Homo sapiens
ttggctttctctgtatctgaat

SEQ ID NO: 9470273 - DNA, 18 bp, Homo sapiens
ttggctttgagaactggt

SEQ ID NO: 9470274 - DNA, 22 bp, Homo sapiens
ttggggcagagaggatacggca

SEQ ID NO: 9470275 - DNA, 22 bp, Homo sapiens
ttggggcagagaggatacggca

SEQ ID NO: 9470276 - DNA, 22 bp, Homo sapiens
ttggggcacctccccagcattt

SEQ ID NO: 9470277 - DNA, 22 bp, Homo sapiens
ttggggcacctccccagcattt

SEQ ID NO: 9470278 - DNA, 22 bp, Homo sapiens
ttggggcacctccccagcattt

SEQ ID NO: 9470279 - DNA, 22 bp, Homo sapiens
ttggggataagaattgaatgca

SEQ ID NO: 9470280 - DNA, 22 bp, Homo sapiens
ttgggctttaattccagagagg

SEQ ID NO: 9470281 - DNA, 22 bp, Homo sapiens
ttgggcttgacaagctgtcaag

SEQ ID NO: 9470282 - DNA, 22 bp, Homo sapiens
ttgggctggcagaggtggtctt

SEQ ID NO: 9470283 - DNA, 22 bp, Homo sapiens
ttgggctggcagaggtggtctt

SEQ ID NO: 9470284 - DNA, 22 bp, Homo sapiens
ttgggctggcagaggtggtctt

SEQ ID NO: 9470285 - DNA, 22 bp, Homo sapiens
ttgggctggcccttgtctctgg

SEQ ID NO: 9470286 - DNA, 22 bp, Homo sapiens
ttgggctggcccttgtctctgg

SEQ ID NO: 9470287 - DNA, 22 bp, Homo sapiens
ttgggctgggcaagaatcaatg

SEQ ID NO: 9470288 - DNA, 22 bp, Homo sapiens
ttgggctgatctgtggaagaag

SEQ ID NO: 9470289 - DNA, 22 bp, Homo sapiens
ttgggctgaggagggcgtggcc

SEQ ID NO: 9470290 - DNA, 22 bp, Homo sapiens
ttgggctggataagtctttgtt

SEQ ID NO: 9470291 - DNA, 22 bp, Homo sapiens
ttgggctggagatgatctgctg

SEQ ID NO: 9470292 - DNA, 22 bp, Homo sapiens
ttgggctggagatgatctgctg

SEQ ID NO: 9470293 - DNA, 22 bp, Homo sapiens
ttgggctgaaccctgcagctga

SEQ ID NO: 9470294 - DNA, 22 bp, Homo sapiens
ttgggctgaagtagagggcaga

SEQ ID NO: 9470295 - DNA, 22 bp, Homo sapiens
ttgggctgaagtagagggcaga

SEQ ID NO: 9470296 - DNA, 22 bp, Homo sapiens
ttgggctcctgttgatcctgtc

SEQ ID NO: 9470297 - DNA, 23 bp, Homo sapiens
ttgggctcagtggcaggaagagt

SEQ ID NO: 9470298 - DNA, 22 bp, Homo sapiens
ttgggctcaggagtttgagacc

SEQ ID NO: 9470299 - DNA, 22 bp, Homo sapiens
ttgggctcaggagtttgagacc

SEQ ID NO: 9470300 - DNA, 22 bp, Homo sapiens
ttgggctcaggagtttgagacc

SEQ ID NO: 9470301 - DNA, 21 bp, Homo sapiens
ttgggccttttctggtagctt

SEQ ID NO: 9470302 - DNA, 22 bp, Homo sapiens
tttatctttggatcttcagaaa

SEQ ID NO: 9470303 - DNA, 22 bp, Homo sapiens
tttatgaaccactctacacctt

SEQ ID NO: 9470304 - DNA, 22 bp, Homo sapiens
tttatctttggatcttcagaaa

SEQ ID NO: 9470305 - DNA, 22 bp, Homo sapiens
tttatgaactacagatataact

SEQ ID NO: 9470306 - DNA, 22 bp, Homo sapiens
tttatgacaagcattactgatt

SEQ ID NO: 9470307 - DNA, 22 bp, Homo sapiens
tttatgaactacagatataact

SEQ ID NO: 9470308 - DNA, 22 bp, Homo sapiens
tttatgaactacagatataact

SEQ ID NO: 9470309 - DNA, 22 bp, Homo sapiens
tttatgtaatttcataggtgtg

SEQ ID NO: 9470310 - DNA, 22 bp, Homo sapiens
tttatgtacatatccacaagga

SEQ ID NO: 9470311 - DNA, 22 bp, Homo sapiens
tttatgtaatttcataggtgtg

SEQ ID NO: 9470312 - DNA, 21 bp, Homo sapiens
tttatgtacttcatagagtag

SEQ ID NO: 9470313 - DNA, 21 bp, Homo sapiens
tttatgtacttcatagagtag

SEQ ID NO: 9470314 - DNA, 21 bp, Homo sapiens
tttatgtacttcatagagtag

SEQ ID NO: 9470315 - DNA, 22 bp, Homo sapiens
tttatgacccaagaagatacca

SEQ ID NO: 9470316 - DNA, 22 bp, Homo sapiens
tttatgacattacaatatcaag

SEQ ID NO: 9470317 - DNA, 22 bp, Homo sapiens
tttatgacttctaatctgaagc

SEQ ID NO: 9470318 - DNA, 22 bp, Homo sapiens
tttatgacttctaatctgaagc

SEQ ID NO: 9470319 - DNA, 22 bp, Homo sapiens
tttatgagcaccttggcccaga

SEQ ID NO: 9470320 - DNA, 22 bp, Homo sapiens
tttatgtttgcattttcaaaga

SEQ ID NO: 9470321 - DNA, 22 bp, Homo sapiens
tttatgtttgacaatgatctgg

SEQ ID NO: 9470322 - DNA, 22 bp, Homo sapiens
tttatgtttgacaatgatctgg

SEQ ID NO: 9470323 - DNA, 22 bp, Homo sapiens
tttatgttcctcttgagctttc

SEQ ID NO: 9470324 - DNA, 22 bp, Homo sapiens
tttattgccctgtagtacagga

SEQ ID NO: 9470325 - DNA, 21 bp, Homo sapiens
tttatgtacttcatagagtag

SEQ ID NO: 9470326 - DNA, 21 bp, Homo sapiens
tttatgtacttcatagagtag

SEQ ID NO: 9470327 - DNA, 22 bp, Homo sapiens
tttatgtcaaaactacagttgg

SEQ ID NO: 9470328 - DNA, 22 bp, Homo sapiens
tttatgtagttacggactatca

SEQ ID NO: 9470329 - DNA, 22 bp, Homo sapiens
tttatgttcctcttgagctttc

SEQ ID NO: 9470330 - DNA, 22 bp, Homo sapiens
tttatgtgatgcatcccagaaa

SEQ ID NO: 9470331 - DNA, 19 bp, Homo sapiens
tttatgtcattgaggtcat

SEQ ID NO: 9470332 - DNA, 22 bp, Homo sapiens
tttatgtcactttgaaagagag

SEQ ID NO: 9470333 - DNA, 22 bp, Homo sapiens
tttattgtcttcgtggtgccta

SEQ ID NO: 9470334 - DNA, 22 bp, Homo sapiens
tttattgtcttcgtggtgccta

SEQ ID NO: 9470335 - DNA, 22 bp, Homo sapiens
tttattgtgttgaaactgaatt

SEQ ID NO: 9470336 - DNA, 22 bp, Homo sapiens
tttattgtgttgaaactgaatt

SEQ ID NO: 9470337 - DNA, 22 bp, Homo sapiens
tttatttataagccacttgctg

SEQ ID NO: 9470338 - DNA, 22 bp, Homo sapiens
tttattgtctatgaactgcttg

SEQ ID NO: 9470339 - DNA, 22 bp, Homo sapiens
tttattgtcaatctattcccag

SEQ ID NO: 9470340 - DNA, 22 bp, Homo sapiens
tttattgtcaatctattcccag

SEQ ID NO: 9470341 - DNA, 22 bp, Homo sapiens
tttattgtcaatctattcccag

SEQ ID NO: 9470342 - DNA, 22 bp, Homo sapiens
tttattgggcctggaggatcta

SEQ ID NO: 9470343 - DNA, 22 bp, Homo sapiens
tttattgggcctggaggatcta

SEQ ID NO: 9470344 - DNA, 20 bp, Homo sapiens
tttattggcctttcaggaac

SEQ ID NO: 9470345 - DNA, 22 bp, Homo sapiens
tttattgggtgcagtgcccaca

SEQ ID NO: 9470346 - DNA, 22 bp, Homo sapiens
tttattgggtgcagtgcccaca

SEQ ID NO: 9470347 - DNA, 22 bp, Homo sapiens
tttattggatatttacaagata

SEQ ID NO: 9470348 - DNA, 22 bp, Homo sapiens
tttattggatatttacaagata

SEQ ID NO: 9470349 - DNA, 22 bp, Homo sapiens
tttattggatggatggatggat

SEQ ID NO: 9470350 - DNA, 22 bp, Homo sapiens
tttattggatatttacaagata

SEQ ID NO: 9470351 - DNA, 22 bp, Homo sapiens
tttattggatatttacaagata

SEQ ID NO: 9470352 - DNA, 22 bp, Homo sapiens
tttattggatgggtcagctcta

SEQ ID NO: 9470353 - DNA, 22 bp, Homo sapiens
tttattggatgggtcagctcta

SEQ ID NO: 9470354 - DNA, 22 bp, Homo sapiens
tttattggatggatggatggat

SEQ ID NO: 9470355 - DNA, 20 bp, Homo sapiens
tttattggcctttcaggaac

SEQ ID NO: 9470356 - DNA, 20 bp, Homo sapiens
tttattggcctttcaggaac

SEQ ID NO: 9470357 - DNA, 22 bp, Homo sapiens
tttattggaacacagccatgac

SEQ ID NO: 9470358 - DNA, 22 bp, Homo sapiens
tttattggaacacagccatgac

SEQ ID NO: 9470359 - DNA, 22 bp, Homo sapiens
tttattgccctgtagtacagga

SEQ ID NO: 9470360 - DNA, 22 bp, Homo sapiens
tttagtgtttgcgtgtactcct

SEQ ID NO: 9470361 - DNA, 22 bp, Homo sapiens
tttagtgtttgcgtgtactcct

SEQ ID NO: 9470362 - DNA, 22 bp, Homo sapiens
tttagtgtggcactgatgttca

SEQ ID NO: 9470363 - DNA, 22 bp, Homo sapiens
tttagtgtttgcgtgtactcct

SEQ ID NO: 9470364 - DNA, 22 bp, Homo sapiens
tttagtgtgacagtccccagta

SEQ ID NO: 9470365 - DNA, 22 bp, Homo sapiens
tttagtgtggcactgatgttca

SEQ ID NO: 9470366 - DNA, 22 bp, Homo sapiens
tttagtgtagcctaagcagaat

SEQ ID NO: 9470367 - DNA, 22 bp, Homo sapiens
tttagtgtgacagtccccagta

SEQ ID NO: 9470368 - DNA, 22 bp, Homo sapiens
tttagtgtagcctaagcagaat

SEQ ID NO: 9470369 - DNA, 22 bp, Homo sapiens
tttagtgtagcctaagcagaat

SEQ ID NO: 9470370 - DNA, 22 bp, Homo sapiens
tttagtgtagcattcagagtca

SEQ ID NO: 9470371 - DNA, 22 bp, Homo sapiens
tttagtgtagcctaagcagaat

SEQ ID NO: 9470372 - DNA, 22 bp, Homo sapiens
tttagtgtagcattcagagtca

SEQ ID NO: 9470373 - DNA, 22 bp, Homo sapiens
tttagtgtaattctgccttttg

SEQ ID NO: 9470374 - DNA, 22 bp, Homo sapiens
tttagtgtagcattcagagtca

SEQ ID NO: 9470375 - DNA, 22 bp, Homo sapiens
tttagtgtagcattcagagtca

SEQ ID NO: 9470376 - DNA, 22 bp, Homo sapiens
tttagtgtaattctgccttttg

SEQ ID NO: 9470377 - DNA, 22 bp, Homo sapiens
tttagtgtaagcataaagaaca

SEQ ID NO: 9470378 - DNA, 22 bp, Homo sapiens
tttagtgtaagcataaagaaca

SEQ ID NO: 9470379 - DNA, 22 bp, Homo sapiens
tttagtgtaagcataaagaaca

SEQ ID NO: 9470380 - DNA, 22 bp, Homo sapiens
tttagtgtaagcataaagaaca

SEQ ID NO: 9470381 - DNA, 22 bp, Homo sapiens
tttagtgctttgctattcatgg

SEQ ID NO: 9470382 - DNA, 22 bp, Homo sapiens
tttatctgttgtacatttatgc

SEQ ID NO: 9470383 - DNA, 22 bp, Homo sapiens
tttatctgttgtacctgcattg

SEQ ID NO: 9470384 - DNA, 22 bp, Homo sapiens
tttatctgttgtacatttatgc

SEQ ID NO: 9470385 - DNA, 22 bp, Homo sapiens
tttatctgttgtacctgcattg

SEQ ID NO: 9470386 - DNA, 22 bp, Homo sapiens
tttatcttctgcagttctggct

SEQ ID NO: 9470387 - DNA, 22 bp, Homo sapiens
tttatctttaggactttgcaga

SEQ ID NO: 9470388 - DNA, 22 bp, Homo sapiens
tttatctttaggactttgcaga

SEQ ID NO: 9470389 - DNA, 22 bp, Homo sapiens
tttatcttctgcagttctggct

SEQ ID NO: 9470390 - DNA, 22 bp, Homo sapiens
tttatctggactgtgatataaa

SEQ ID NO: 9470391 - DNA, 22 bp, Homo sapiens
tttatctggactgtgatataaa

SEQ ID NO: 9470392 - DNA, 22 bp, Homo sapiens
tttatctgtagagcttcaccta

SEQ ID NO: 9470393 - DNA, 22 bp, Homo sapiens
tttatctgggattttgcagtct

SEQ ID NO: 9470394 - DNA, 22 bp, Homo sapiens
tttatctggactgtgatataaa

SEQ ID NO: 9470395 - DNA, 22 bp, Homo sapiens
tttatctgtatatctcaagtgt

SEQ ID NO: 9470396 - DNA, 22 bp, Homo sapiens
tttatctgtggtaaataacatt

SEQ ID NO: 9470397 - DNA, 22 bp, Homo sapiens
tttatctgtgggagttgtttgg

SEQ ID NO: 9470398 - DNA, 22 bp, Homo sapiens
tttatctgtggtaaataacatt

SEQ ID NO: 9470399 - DNA, 22 bp, Homo sapiens
tttatctgtcatttcccatatc

SEQ ID NO: 9470400 - DNA, 22 bp, Homo sapiens
tttaggatattaatgttcagag

SEQ ID NO: 9470401 - DNA, 22 bp, Homo sapiens
tttaggataactccagttttcc

SEQ ID NO: 9470402 - DNA, 18 bp, Homo sapiens
tttaggaattccaagaga

SEQ ID NO: 9470403 - DNA, 22 bp, Homo sapiens
tttagcatgttcctttcataga

SEQ ID NO: 9470404 - DNA, 22 bp, Homo sapiens
tttagcattaagcttttcaaat

SEQ ID NO: 9470405 - DNA, 22 bp, Homo sapiens
tttagcattaagcttttcaaat

SEQ ID NO: 9470406 - DNA, 22 bp, Homo sapiens
tttagcattactaaaatgaaaa

SEQ ID NO: 9470407 - DNA, 22 bp, Homo sapiens
tttagcattcctgggatgattt

SEQ ID NO: 9470408 - DNA, 22 bp, Homo sapiens
tttagccaactatatgactagt

SEQ ID NO: 9470409 - DNA, 22 bp, Homo sapiens
tttagcttcagttctagcttct

SEQ ID NO: 9470410 - DNA, 19 bp, Homo sapiens
tttagcttacgtttcattg

SEQ ID NO: 9470411 - DNA, 22 bp, Homo sapiens
tttagcttgaaagttttggagg

SEQ ID NO: 9470412 - DNA, 22 bp, Homo sapiens
tttagctaagacatagattctt

SEQ ID NO: 9470413 - DNA, 22 bp, Homo sapiens
tttagcgtagctgacagctaat

SEQ ID NO: 9470414 - DNA, 22 bp, Homo sapiens
tttagctaagacatagattctt

SEQ ID NO: 9470415 - DNA, 22 bp, Homo sapiens
ttgttgtcattgtagaggattt

SEQ ID NO: 9470416 - DNA, 22 bp, Homo sapiens
ttgtttaaaagaaatcatagaa

SEQ ID NO: 9470417 - DNA, 21 bp, Homo sapiens
ttgttcttccagaagcaaagt

SEQ ID NO: 9470418 - DNA, 22 bp, Homo sapiens
ttgttcttccatcatccctcag

SEQ ID NO: 9470419 - DNA, 22 bp, Homo sapiens
ttgttcttgccaagacatgaag

SEQ ID NO: 9470420 - DNA, 22 bp, Homo sapiens
ttgttgatgtggacgtctggaa

SEQ ID NO: 9470421 - DNA, 22 bp, Homo sapiens
ttgttgcagagatgaatgacat

SEQ ID NO: 9470422 - DNA, 22 bp, Homo sapiens
ttgttgcagagatgaatgacat

SEQ ID NO: 9470423 - DNA, 22 bp, Homo sapiens
ttgttcttttgcttagacagat

SEQ ID NO: 9470424 - DNA, 22 bp, Homo sapiens
ttgttctttatcctggaagcct

SEQ ID NO: 9470425 - DNA, 22 bp, Homo sapiens
ttgttctttatcctggaagcct

SEQ ID NO: 9470426 - DNA, 22 bp, Homo sapiens
ttgttcttgtctttgccttcac

SEQ ID NO: 9470427 - DNA, 22 bp, Homo sapiens
ttgttcttgtctttgccttcac

SEQ ID NO: 9470428 - DNA, 22 bp, Homo sapiens
tttaacatgtaattgctgcttt

SEQ ID NO: 9470429 - DNA, 22 bp, Homo sapiens
tttaacatgttcaagaaacata

SEQ ID NO: 9470430 - DNA, 22 bp, Homo sapiens
tttaacatgttcaagaaacata

SEQ ID NO: 9470431 - DNA, 22 bp, Homo sapiens
tttaacatgttcaagaaacata

SEQ ID NO: 9470432 - DNA, 22 bp, Homo sapiens
tttaacatgtgaattttggaag

SEQ ID NO: 9470433 - DNA, 22 bp, Homo sapiens
tttaacatgtgaattttggaag

SEQ ID NO: 9470434 - DNA, 22 bp, Homo sapiens
tttaaattatagttaatgtctg

SEQ ID NO: 9470435 - DNA, 22 bp, Homo sapiens
tttaaattatagttaatgtctg

SEQ ID NO: 9470436 - DNA, 22 bp, Homo sapiens
tttaaattatagttaatgtctg

SEQ ID NO: 9470437 - DNA, 22 bp, Homo sapiens
tttaaattatagttaatgtctg

SEQ ID NO: 9470438 - DNA, 22 bp, Homo sapiens
tttaaattatagttaatgtctg

SEQ ID NO: 9470439 - DNA, 22 bp, Homo sapiens
tttaaattatagttaatgtctg

SEQ ID NO: 9470440 - DNA, 22 bp, Homo sapiens
tttaaattatagttaatgtctg

SEQ ID NO: 9470441 - DNA, 22 bp, Homo sapiens
tttaacagatgtgaaattttca

SEQ ID NO: 9470442 - DNA, 23 bp, Homo sapiens
tttaactttccaataattcattg

SEQ ID NO: 9470443 - DNA, 23 bp, Homo sapiens
tttaactttccaataattcattg

SEQ ID NO: 9470444 - DNA, 23 bp, Homo sapiens
tttaactttccaataattcattg

SEQ ID NO: 9470445 - DNA, 22 bp, Homo sapiens
tttaagaagttatgttataaat

SEQ ID NO: 9470446 - DNA, 22 bp, Homo sapiens
tttaacttagaagagatatcct

SEQ ID NO: 9470447 - DNA, 22 bp, Homo sapiens
tttaacttagaagagatatcct

SEQ ID NO: 9470448 - DNA, 23 bp, Homo sapiens
tttaaccttggtcaagaatttcc

SEQ ID NO: 9470449 - DNA, 23 bp, Homo sapiens
tttaacatttgaacatgtggcca

SEQ ID NO: 9470450 - DNA, 22 bp, Homo sapiens
tttaaccagaaaggtactcatc

SEQ ID NO: 9470451 - DNA, 22 bp, Homo sapiens
tttaaccagtttacaaagaatt

SEQ ID NO: 9470452 - DNA, 22 bp, Homo sapiens
tttaaccagtttacaaagaatt

SEQ ID NO: 9470453 - DNA, 22 bp, Homo sapiens
tttaacatgttcaagaaacata

SEQ ID NO: 9470454 - DNA, 23 bp, Homo sapiens
tttaacatttgaacatgtggcca

SEQ ID NO: 9470455 - DNA, 22 bp, Homo sapiens
tttaacatgttcaagaaacata

SEQ ID NO: 9470456 - DNA, 22 bp, Homo sapiens
tttacagaatgttgaatttggg

SEQ ID NO: 9470457 - DNA, 22 bp, Homo sapiens
tttacagaatgtcaatttctat

SEQ ID NO: 9470458 - DNA, 22 bp, Homo sapiens
tttacagaatgtcaatttctat

SEQ ID NO: 9470459 - DNA, 22 bp, Homo sapiens
tttacagaatgtcaatttctat

SEQ ID NO: 9470460 - DNA, 22 bp, Homo sapiens
tttacagaatgtcaatttctat

SEQ ID NO: 9470461 - DNA, 22 bp, Homo sapiens
tttacagaagagaaggatgctt

SEQ ID NO: 9470462 - DNA, 22 bp, Homo sapiens
tttacacttgaggaaactgagg

SEQ ID NO: 9470463 - DNA, 22 bp, Homo sapiens
tttacagagaatgtacataaag

SEQ ID NO: 9470464 - DNA, 22 bp, Homo sapiens
tttacagagaatgtacataaag

SEQ ID NO: 9470465 - DNA, 22 bp, Homo sapiens
tttacagacaacttaatagggg

SEQ ID NO: 9470466 - DNA, 22 bp, Homo sapiens
tttacagagaatgtacataaag

SEQ ID NO: 9470467 - DNA, 22 bp, Homo sapiens
tttacagagaatgtacataaag

SEQ ID NO: 9470468 - DNA, 22 bp, Homo sapiens
tttacagagagagaactggact

SEQ ID NO: 9470469 - DNA, 22 bp, Homo sapiens
tttacagatctgttgatttgtt

SEQ ID NO: 9470470 - DNA, 22 bp, Homo sapiens
tttacagaggtgtcctgcattg

SEQ ID NO: 9470471 - DNA, 22 bp, Homo sapiens
tttacagattctgggtattagg

SEQ ID NO: 9470472 - DNA, 22 bp, Homo sapiens
tttacagctagacatacctgag

SEQ ID NO: 9470473 - DNA, 22 bp, Homo sapiens
tttacagatgtggaaagtgagc

SEQ ID NO: 9470474 - DNA, 22 bp, Homo sapiens
tttacagatgtggaaagtgagc

SEQ ID NO: 9470475 - DNA, 22 bp, Homo sapiens
tttacagatgtggaaagtgagc

SEQ ID NO: 9470476 - DNA, 22 bp, Homo sapiens
tttacagatgaggatactgagg

SEQ ID NO: 9470477 - DNA, 22 bp, Homo sapiens
tttacagatgaggaaactgaga

SEQ ID NO: 9470478 - DNA, 22 bp, Homo sapiens
tttacagatgaggaaactgaga

SEQ ID NO: 9470479 - DNA, 22 bp, Homo sapiens
tttacagatgaggaaactgaga

SEQ ID NO: 9470480 - DNA, 22 bp, Homo sapiens
tttaagactcttgtagtacaca

SEQ ID NO: 9470481 - DNA, 22 bp, Homo sapiens
tttaagactcttgtagtacaca

SEQ ID NO: 9470482 - DNA, 22 bp, Homo sapiens
tttaagaagttatgttataaat

SEQ ID NO: 9470483 - DNA, 22 bp, Homo sapiens
tttaagaagttatgttataaat

SEQ ID NO: 9470484 - DNA, 22 bp, Homo sapiens
tttaagaagttatgttataaat

SEQ ID NO: 9470485 - DNA, 22 bp, Homo sapiens
tttaagaagttatgttataaat

SEQ ID NO: 9470486 - DNA, 22 bp, Homo sapiens
tttaagacagtgcaagctgaat

SEQ ID NO: 9470487 - DNA, 20 bp, Homo sapiens
tttaagaagtttctgaggaa

SEQ ID NO: 9470488 - DNA, 22 bp, Homo sapiens
tttaagaagttatgttataaat

SEQ ID NO: 9470489 - DNA, 22 bp, Homo sapiens
tttaagatctatcccattttgt

SEQ ID NO: 9470490 - DNA, 22 bp, Homo sapiens
tttacaagtcagggactgttct

SEQ ID NO: 9470491 - DNA, 22 bp, Homo sapiens
tttacacatacctctttaaagt

SEQ ID NO: 9470492 - DNA, 22 bp, Homo sapiens
tttacaagtttacagaatgatg

SEQ ID NO: 9470493 - DNA, 22 bp, Homo sapiens
tttacaagtttacagaatgatg

SEQ ID NO: 9470494 - DNA, 22 bp, Homo sapiens
tttacaccaaaatgacacagag

SEQ ID NO: 9470495 - DNA, 22 bp, Homo sapiens
tttacacattattttcagtgtg

SEQ ID NO: 9470496 - DNA, 22 bp, Homo sapiens
tttacacattattttcagtgtg

SEQ ID NO: 9470497 - DNA, 22 bp, Homo sapiens
tttacactgacagcacataagg

SEQ ID NO: 9470498 - DNA, 22 bp, Homo sapiens
tttcataatactgtacatgaaa

SEQ ID NO: 9470499 - DNA, 22 bp, Homo sapiens
tttcataatactgtacatgaaa

SEQ ID NO: 9470500 - DNA, 22 bp, Homo sapiens
tttcataatactgtacatgaaa

SEQ ID NO: 9470501 - DNA, 22 bp, Homo sapiens
tttcataatactgtacatgaaa

SEQ ID NO: 9470502 - DNA, 22 bp, Homo sapiens
tttcataatactgtacatgaaa

SEQ ID NO: 9470503 - DNA, 22 bp, Homo sapiens
tttcataagggtttctagactt

SEQ ID NO: 9470504 - DNA, 22 bp, Homo sapiens
tttcataaacagtagaagacta

SEQ ID NO: 9470505 - DNA, 22 bp, Homo sapiens
tttcataacctcaagctacagt

SEQ ID NO: 9470506 - DNA, 22 bp, Homo sapiens
tttcataaacagtagaagacta

SEQ ID NO: 9470507 - DNA, 22 bp, Homo sapiens
tttcataacctcaagctacagt

SEQ ID NO: 9470508 - DNA, 22 bp, Homo sapiens
tttcataagggtttctagactt

SEQ ID NO: 9470509 - DNA, 22 bp, Homo sapiens
tttcataatactgtacatgaaa

SEQ ID NO: 9470510 - DNA, 22 bp, Homo sapiens
tttcataatagtgcagtttgtt

SEQ ID NO: 9470511 - DNA, 22 bp, Homo sapiens
tttcataatagtgcagtttgtt

SEQ ID NO: 9470512 - DNA, 22 bp, Homo sapiens
tttcataatactgtacatgaaa

SEQ ID NO: 9470513 - DNA, 22 bp, Homo sapiens
tttcataatatccagagatttt

SEQ ID NO: 9470514 - DNA, 22 bp, Homo sapiens
tttcataatatccagagatttt

SEQ ID NO: 9470515 - DNA, 22 bp, Homo sapiens
tttcataatagtgcagtttgtt

SEQ ID NO: 9470516 - DNA, 22 bp, Homo sapiens
tttcataatatccagagatttt

SEQ ID NO: 9470517 - DNA, 22 bp, Homo sapiens
tttcataatgtcacagtcaaaa

SEQ ID NO: 9470518 - DNA, 22 bp, Homo sapiens
tttcataatgtcacagtcaaaa

SEQ ID NO: 9470519 - DNA, 22 bp, Homo sapiens
tttcataatctgtcaagtgggg

SEQ ID NO: 9470520 - DNA, 22 bp, Homo sapiens
tttcatcatcaaaatagtgagg

SEQ ID NO: 9470521 - DNA, 22 bp, Homo sapiens
tttcatcatgttggcagattgg

SEQ ID NO: 9470522 - DNA, 22 bp, Homo sapiens
tttcatctaacactacataggg

SEQ ID NO: 9470523 - DNA, 22 bp, Homo sapiens
tttcatctaacactacataggg

SEQ ID NO: 9470524 - DNA, 22 bp, Homo sapiens
tttcatctctctaaaagacagt

SEQ ID NO: 9470525 - DNA, 22 bp, Homo sapiens
tttcatctctctaaaagacagt

SEQ ID NO: 9470526 - DNA, 22 bp, Homo sapiens
tttcatctatttgctttgtgaa

SEQ ID NO: 9470527 - DNA, 22 bp, Homo sapiens
tttcatatgggcattggcaata

SEQ ID NO: 9470528 - DNA, 22 bp, Homo sapiens
tttcatatgggcattggcaata

SEQ ID NO: 9470529 - DNA, 22 bp, Homo sapiens
tttcatattattccttgagtct

SEQ ID NO: 9470530 - DNA, 22 bp, Homo sapiens
tttcatattattccttgagtct

SEQ ID NO: 9470531 - DNA, 22 bp, Homo sapiens
tttcatattgtccagtcagcgc

SEQ ID NO: 9470532 - DNA, 22 bp, Homo sapiens
tttcatattgtccagtcagcgc

SEQ ID NO: 9470533 - DNA, 22 bp, Homo sapiens
tttcataatgtcacagtcaaaa

SEQ ID NO: 9470534 - DNA, 22 bp, Homo sapiens
tttcatagctgaaaatgttgaa

SEQ ID NO: 9470535 - DNA, 22 bp, Homo sapiens
tttcatagccttctaatgagtt

SEQ ID NO: 9470536 - DNA, 22 bp, Homo sapiens
tttcatagccttctaatgagtt

SEQ ID NO: 9470537 - DNA, 22 bp, Homo sapiens
tttcatagctgaaaatgttgaa

SEQ ID NO: 9470538 - DNA, 22 bp, Homo sapiens
tttccaggtattaatactgtat

SEQ ID NO: 9470539 - DNA, 23 bp, Homo sapiens
tttccaggtgaccgtcagaatta

SEQ ID NO: 9470540 - DNA, 22 bp, Homo sapiens
tttccaggtgcatagaaaacag

SEQ ID NO: 9470541 - DNA, 22 bp, Homo sapiens
tttccagtaagtggcaaggagc

SEQ ID NO: 9470542 - DNA, 22 bp, Homo sapiens
tttccaggtgcatagaaaacag

SEQ ID NO: 9470543 - DNA, 22 bp, Homo sapiens
tttccaggtatcaagcttcagg

SEQ ID NO: 9470544 - DNA, 22 bp, Homo sapiens
tttccaggtatcaagcttcagg

SEQ ID NO: 9470545 - DNA, 22 bp, Homo sapiens
tttccaggtatcaagcttcagg

SEQ ID NO: 9470546 - DNA, 22 bp, Homo sapiens
tttccagggctctgtagaagaa

SEQ ID NO: 9470547 - DNA, 18 bp, Homo sapiens
tttccagggattaggtgg

SEQ ID NO: 9470548 - DNA, 22 bp, Homo sapiens
tttccagtgaaattttgaatgt

SEQ ID NO: 9470549 - DNA, 22 bp, Homo sapiens
tttccagtgagcaaatgtagaa

SEQ ID NO: 9470550 - DNA, 22 bp, Homo sapiens
tttccagtgattgctgctctca

SEQ ID NO: 9470551 - DNA, 22 bp, Homo sapiens
tttccagtgaaattttgaatgt

SEQ ID NO: 9470552 - DNA, 22 bp, Homo sapiens
tttccaaataaggtcacattct

SEQ ID NO: 9470553 - DNA, 22 bp, Homo sapiens
tttccaaataaggtcacattct

SEQ ID NO: 9470554 - DNA, 22 bp, Homo sapiens
tttccaaataaggtcacactca

SEQ ID NO: 9470555 - DNA, 22 bp, Homo sapiens
tttcatcttatttgtctacatc

SEQ ID NO: 9470556 - DNA, 22 bp, Homo sapiens
tttcatcttatttgtctacatc

SEQ ID NO: 9470557 - DNA, 22 bp, Homo sapiens
tttcatcttatttgtctacatc

SEQ ID NO: 9470558 - DNA, 22 bp, Homo sapiens
tttcatctgtgctgccaagact

SEQ ID NO: 9470559 - DNA, 22 bp, Homo sapiens
tttcatctgtgctgccaagact

SEQ ID NO: 9470560 - DNA, 22 bp, Homo sapiens
tttccaggaagtaaggataatc

SEQ ID NO: 9470561 - DNA, 22 bp, Homo sapiens
tttccaggaagtaaggataatc

SEQ ID NO: 9470562 - DNA, 22 bp, Homo sapiens
tttccaggagaaagagagcctt

SEQ ID NO: 9470563 - DNA, 22 bp, Homo sapiens
tttccaggcagaggagttgtga

SEQ ID NO: 9470564 - DNA, 22 bp, Homo sapiens
tttccaggcagaggagttgtga

SEQ ID NO: 9470565 - DNA, 22 bp, Homo sapiens
tttccaaataaggtcacattct

SEQ ID NO: 9470566 - DNA, 22 bp, Homo sapiens
tttccagagctgagaaggcttg

SEQ ID NO: 9470567 - DNA, 22 bp, Homo sapiens
tttccagttgttctagaaagct

SEQ ID NO: 9470568 - DNA, 22 bp, Homo sapiens
tttccagtgggccccttgaaat

SEQ ID NO: 9470569 - DNA, 22 bp, Homo sapiens
tttccatatttaatcaaaataa

SEQ ID NO: 9470570 - DNA, 22 bp, Homo sapiens
tttcccaagaccatagatggaa

SEQ ID NO: 9470571 - DNA, 22 bp, Homo sapiens
tttcccaagaaaaataattgga

SEQ ID NO: 9470572 - DNA, 22 bp, Homo sapiens
tttccttgcacattggtttcca

SEQ ID NO: 9470573 - DNA, 22 bp, Homo sapiens
tttccttgcacattggtttcca

SEQ ID NO: 9470574 - DNA, 22 bp, Homo sapiens
tttcctttgagggtcctacact

SEQ ID NO: 9470575 - DNA, 22 bp, Homo sapiens
tttccttgcacattggtttcca

SEQ ID NO: 9470576 - DNA, 22 bp, Homo sapiens
tttcccagaggtatgaataagt

SEQ ID NO: 9470577 - DNA, 22 bp, Homo sapiens
tttcctttgggagcatgaattt

SEQ ID NO: 9470578 - DNA, 22 bp, Homo sapiens
tttcctttgcccaatacatgtc

SEQ ID NO: 9470579 - DNA, 22 bp, Homo sapiens
tttcctttgggagcatgaattt

SEQ ID NO: 9470580 - DNA, 22 bp, Homo sapiens
tttcctttgggagcatgaattt

SEQ ID NO: 9470581 - DNA, 22 bp, Homo sapiens
tttcctttgggagcatgaattt

SEQ ID NO: 9470582 - DNA, 22 bp, Homo sapiens
tttctaacagcaaatgtttatc

SEQ ID NO: 9470583 - DNA, 22 bp, Homo sapiens
tttctaacagcaaatgtttatc

SEQ ID NO: 9470584 - DNA, 22 bp, Homo sapiens
tttctaagaaagtaatggttat

SEQ ID NO: 9470585 - DNA, 22 bp, Homo sapiens
tttctaagaaagtaatggttat

SEQ ID NO: 9470586 - DNA, 22 bp, Homo sapiens
tttctaacgtagacagggaggt

SEQ ID NO: 9470587 - DNA, 22 bp, Homo sapiens
tttctaagacatttgtcatctt

SEQ ID NO: 9470588 - DNA, 22 bp, Homo sapiens
tttctaagaatattgctcttaa

SEQ ID NO: 9470589 - DNA, 22 bp, Homo sapiens
tttctaagaatattgctcttaa

SEQ ID NO: 9470590 - DNA, 19 bp, Homo sapiens
tttctaagctaaatgcttc

SEQ ID NO: 9470591 - DNA, 22 bp, Homo sapiens
tttctaagcttagtatgaggca

SEQ ID NO: 9470592 - DNA, 22 bp, Homo sapiens
tttctaagatgtggtttcaagg

SEQ ID NO: 9470593 - DNA, 22 bp, Homo sapiens
tttctaagatgtggtttcaagg

SEQ ID NO: 9470594 - DNA, 19 bp, Homo sapiens
tttctaagctaaatgcttc

SEQ ID NO: 9470595 - DNA, 19 bp, Homo sapiens
tttctaagctaaatgcttc

SEQ ID NO: 9470596 - DNA, 21 bp, Homo sapiens
tttctaaggaggaagaaaaga

SEQ ID NO: 9470597 - DNA, 21 bp, Homo sapiens
tttctaaggaggaagaaaaga

SEQ ID NO: 9470598 - DNA, 22 bp, Homo sapiens
tttctaaggctaggtcttaagg

SEQ ID NO: 9470599 - DNA, 22 bp, Homo sapiens
tttctaaggctaggtcttaagg

SEQ ID NO: 9470600 - DNA, 22 bp, Homo sapiens
tttctaaggtgaggtagaaaat

SEQ ID NO: 9470601 - DNA, 22 bp, Homo sapiens
tttctaaaatagattttatggt

SEQ ID NO: 9470602 - DNA, 22 bp, Homo sapiens
tttctaaaatagattttatggt

SEQ ID NO: 9470603 - DNA, 22 bp, Homo sapiens
tttctaaaatagattttatggt

SEQ ID NO: 9470604 - DNA, 22 bp, Homo sapiens
tttctaaacaaagggagtttgg

SEQ ID NO: 9470605 - DNA, 22 bp, Homo sapiens
tttctaaaatagattttatggt

SEQ ID NO: 9470606 - DNA, 22 bp, Homo sapiens
tttcgaatgatgtttggaatat

SEQ ID NO: 9470607 - DNA, 22 bp, Homo sapiens
tttccttttataaggcttgagg

SEQ ID NO: 9470608 - DNA, 21 bp, Homo sapiens
tttcgcatgtgttaactgtga

SEQ ID NO: 9470609 - DNA, 22 bp, Homo sapiens
tttcgagggccttaagtattcc

SEQ ID NO: 9470610 - DNA, 21 bp, Homo sapiens
tttcgcatgtgttaactgtga

SEQ ID NO: 9470611 - DNA, 22 bp, Homo sapiens
tttcctttgtgcaggccttggg

SEQ ID NO: 9470612 - DNA, 22 bp, Homo sapiens
tttcctttgtgcaggccttggg

SEQ ID NO: 9470613 - DNA, 22 bp, Homo sapiens
tttccttttataaggcttgagg

SEQ ID NO: 9470614 - DNA, 22 bp, Homo sapiens
tttcaagcatgtcaagttagtc

SEQ ID NO: 9470615 - DNA, 22 bp, Homo sapiens
tttcaaggatgttatataaatg

SEQ ID NO: 9470616 - DNA, 22 bp, Homo sapiens
tttcaaggatgttatataaatg

SEQ ID NO: 9470617 - DNA, 17 bp, Homo sapiens
tttcaaggttacgttcc

SEQ ID NO: 9470618 - DNA, 17 bp, Homo sapiens
tttcaaggttacgttcc

SEQ ID NO: 9470619 - DNA, 22 bp, Homo sapiens
tttcaagggaatatgaaattca

SEQ ID NO: 9470620 - DNA, 22 bp, Homo sapiens
tttcaaggtgcaggagggtttt

SEQ ID NO: 9470621 - DNA, 22 bp, Homo sapiens
tttcaaggctagttttaattag

SEQ ID NO: 9470622 - DNA, 22 bp, Homo sapiens
tttcaagtcattctataatatc

SEQ ID NO: 9470623 - DNA, 21 bp, Homo sapiens
tttatttatataggacacatg

SEQ ID NO: 9470624 - DNA, 22 bp, Homo sapiens
tttatttataagccacttgctg

SEQ ID NO: 9470625 - DNA, 22 bp, Homo sapiens
tttatttataagccacttgctg

SEQ ID NO: 9470626 - DNA, 21 bp, Homo sapiens
tttatttatataggacacatg

SEQ ID NO: 9470627 - DNA, 22 bp, Homo sapiens
tttatttatccttctggattgc

SEQ ID NO: 9470628 - DNA, 23 bp, Homo sapiens
tttatttatttaggctgagggat

SEQ ID NO: 9470629 - DNA, 22 bp, Homo sapiens
tttatttatccttctggattgc

SEQ ID NO: 9470630 - DNA, 22 bp, Homo sapiens
tttatttatccttctggattgc

SEQ ID NO: 9470631 - DNA, 22 bp, Homo sapiens
tttcacaacgttgtggtgagag

SEQ ID NO: 9470632 - DNA, 22 bp, Homo sapiens
tttcacaacgttgtggtgagag

SEQ ID NO: 9470633 - DNA, 22 bp, Homo sapiens
tttcacaacacaatctcgttaa

SEQ ID NO: 9470634 - DNA, 19 bp, Homo sapiens
tttcaatggcttagagaaa

SEQ ID NO: 9470635 - DNA, 18 bp, Homo sapiens
tttcacaacctccagagg

SEQ ID NO: 9470636 - DNA, 22 bp, Homo sapiens
tttcacaactgcttatttgaga

SEQ ID NO: 9470637 - DNA, 22 bp, Homo sapiens
tttcacaagacagctactgttg

SEQ ID NO: 9470638 - DNA, 22 bp, Homo sapiens
tttcacaagtttcaggattctg

SEQ ID NO: 9470639 - DNA, 22 bp, Homo sapiens
tttcacaagacagctactgttg

SEQ ID NO: 9470640 - DNA, 22 bp, Homo sapiens
tttcacaagtttcaggattctg

SEQ ID NO: 9470641 - DNA, 22 bp, Homo sapiens
tttcaagtttagtgtgttcaaa

SEQ ID NO: 9470642 - DNA, 22 bp, Homo sapiens
tttcaagtttagtgtgttcaaa

SEQ ID NO: 9470643 - DNA, 22 bp, Homo sapiens
tttcaataacaaagctcatttt

SEQ ID NO: 9470644 - DNA, 22 bp, Homo sapiens
tttcaatgacacaaaagagaaa

SEQ ID NO: 9470645 - DNA, 22 bp, Homo sapiens
tttcaagttgttgcattaaatg

SEQ ID NO: 9470646 - DNA, 22 bp, Homo sapiens
tttcaagtgtcctgattaatgg

SEQ ID NO: 9470647 - DNA, 22 bp, Homo sapiens
tttcaagttaaatggggtcttt

SEQ ID NO: 9470648 - DNA, 22 bp, Homo sapiens
tttcaagtgactatggtttttg

SEQ ID NO: 9470649 - DNA, 22 bp, Homo sapiens
tttcaagtgactatggtttttg

SEQ ID NO: 9470650 - DNA, 22 bp, Homo sapiens
tttcaagtgtcctgattaatgg

SEQ ID NO: 9470651 - DNA, 22 bp, Homo sapiens
tttcaagtggggacatttgaga

SEQ ID NO: 9470652 - DNA, 22 bp, Homo sapiens
tttcagtgtatcttccaaaagc

SEQ ID NO: 9470653 - DNA, 22 bp, Homo sapiens
tttcacatttgttttaagaagt

SEQ ID NO: 9470654 - DNA, 22 bp, Homo sapiens
tttcacatttaggcgtgaattg

SEQ ID NO: 9470655 - DNA, 22 bp, Homo sapiens
tttcacatttgttttaagaagt

SEQ ID NO: 9470656 - DNA, 23 bp, Homo sapiens
tttcacatttactgttagatggc

SEQ ID NO: 9470657 - DNA, 23 bp, Homo sapiens
tttcacatttactgttagatggc

SEQ ID NO: 9470658 - DNA, 22 bp, Homo sapiens
tttcacatttaggcgtgaattg

SEQ ID NO: 9470659 - DNA, 22 bp, Homo sapiens
tttcacatttaggcgtgaattg

SEQ ID NO: 9470660 - DNA, 22 bp, Homo sapiens
tttcagtgtgagtgtcttattt

SEQ ID NO: 9470661 - DNA, 22 bp, Homo sapiens
tttcataaacagtagaagacta

SEQ ID NO: 9470662 - DNA, 22 bp, Homo sapiens
tttcataaacagtagaagacta

SEQ ID NO: 9470663 - DNA, 22 bp, Homo sapiens
tttcacattcttctgaatctac

SEQ ID NO: 9470664 - DNA, 22 bp, Homo sapiens
tttcacattggcttctatttct

SEQ ID NO: 9470665 - DNA, 22 bp, Homo sapiens
tttcacattggcttctatttct

SEQ ID NO: 9470666 - DNA, 22 bp, Homo sapiens
tttcacattggcttctatttct

SEQ ID NO: 9470667 - DNA, 23 bp, Homo sapiens
tttcacatttactgttagatggc

SEQ ID NO: 9470668 - DNA, 22 bp, Homo sapiens
tttcacattcttctgaatctac

SEQ ID NO: 9470669 - DNA, 22 bp, Homo sapiens
tttcacattcttctgaatctac

SEQ ID NO: 9470670 - DNA, 22 bp, Homo sapiens
tttcacattcttctgaatctac

SEQ ID NO: 9470671 - DNA, 22 bp, Homo sapiens
tttcacattcttctgaatctac

SEQ ID NO: 9470672 - DNA, 22 bp, Homo sapiens
tttcacattcagatatagactt

SEQ ID NO: 9470673 - DNA, 22 bp, Homo sapiens
tttcacattctctggttatcga

SEQ ID NO: 9470674 - DNA, 22 bp, Homo sapiens
tttcacatgtggaatgccaggt

SEQ ID NO: 9470675 - DNA, 23 bp, Homo sapiens
tttcacattaatgtttagcagga

SEQ ID NO: 9470676 - DNA, 23 bp, Homo sapiens
tttcacattaatgtttagcagga

SEQ ID NO: 9470677 - DNA, 23 bp, Homo sapiens
tttcacattaatgtttagcagga

SEQ ID NO: 9470678 - DNA, 23 bp, Homo sapiens
tttcacattaatgtttagcagga

SEQ ID NO: 9470679 - DNA, 23 bp, Homo sapiens
tttcacattaatgtttagcagga

SEQ ID NO: 9470680 - DNA, 22 bp, Homo sapiens
tttcacattagatatgtcattt

SEQ ID NO: 9470681 - DNA, 22 bp, Homo sapiens
tttcacattagatatgtcattt

SEQ ID NO: 9470682 - DNA, 22 bp, Homo sapiens
tttcacattagatatgtcattt

SEQ ID NO: 9470683 - DNA, 22 bp, Homo sapiens
tttcacattagatatgtcattt

SEQ ID NO: 9470684 - DNA, 22 bp, Homo sapiens
tttcacattcagatatagactt

SEQ ID NO: 9470685 - DNA, 22 bp, Homo sapiens
tttcacattcagatatagactt

SEQ ID NO: 9470686 - DNA, 22 bp, Homo sapiens
tttcacatggtactgcctgttt

SEQ ID NO: 9470687 - DNA, 22 bp, Homo sapiens
tttcacatggtactgcctgttt

SEQ ID NO: 9470688 - DNA, 22 bp, Homo sapiens
tttcacatgtatataggcatta

SEQ ID NO: 9470689 - DNA, 22 bp, Homo sapiens
tttcacatgtatataggcatta

SEQ ID NO: 9470690 - DNA, 22 bp, Homo sapiens
tttcacatgtatataggcatta

SEQ ID NO: 9470691 - DNA, 22 bp, Homo sapiens
tttcacatgtatataggcatta

SEQ ID NO: 9470692 - DNA, 22 bp, Homo sapiens
tttcacatgtgctgttgtcaat

SEQ ID NO: 9470693 - DNA, 22 bp, Homo sapiens
tttcacatgtgctgttgtcaat

SEQ ID NO: 9470694 - DNA, 22 bp, Homo sapiens
tttcacatgtggaatgccaggt

SEQ ID NO: 9470695 - DNA, 22 bp, Homo sapiens
tttcacatgcagcagggaagtg

SEQ ID NO: 9470696 - DNA, 22 bp, Homo sapiens
tttcacatgcagcagggaagtg

SEQ ID NO: 9470697 - DNA, 22 bp, Homo sapiens
tttcacatgcagcagggaagtg

SEQ ID NO: 9470698 - DNA, 22 bp, Homo sapiens
tttcacatggaagctctcgaga

SEQ ID NO: 9470699 - DNA, 22 bp, Homo sapiens
tttcacatggactttttgttct

SEQ ID NO: 9470700 - DNA, 22 bp, Homo sapiens
tttcacatggaagctctcgaga

SEQ ID NO: 9470701 - DNA, 22 bp, Homo sapiens
tttcacatggactttttgttct

SEQ ID NO: 9470702 - DNA, 22 bp, Homo sapiens
tttcacatcctgaagccccact

SEQ ID NO: 9470703 - DNA, 20 bp, Homo sapiens
tttcacatctgtccctttaa

SEQ ID NO: 9470704 - DNA, 20 bp, Homo sapiens
tttcacatctgtccctttaa

SEQ ID NO: 9470705 - DNA, 22 bp, Homo sapiens
tttcacatcatgggatggaagc

SEQ ID NO: 9470706 - DNA, 22 bp, Homo sapiens
tttcacatcccgcgcgccctta

SEQ ID NO: 9470707 - DNA, 22 bp, Homo sapiens
tttcacatcatgggatggaagc

SEQ ID NO: 9470708 - DNA, 22 bp, Homo sapiens
tttcacatcatgggatggaagc

SEQ ID NO: 9470709 - DNA, 22 bp, Homo sapiens
tttcacaatcaaatggtgaaat

SEQ ID NO: 9470710 - DNA, 22 bp, Homo sapiens
tttcacaatcaaatggtgaaat

SEQ ID NO: 9470711 - DNA, 22 bp, Homo sapiens
tttcacaggagttgtaccattt

SEQ ID NO: 9470712 - DNA, 22 bp, Homo sapiens
tttcacaggggcaacctccatg

SEQ ID NO: 9470713 - DNA, 22 bp, Homo sapiens
tttcacatatcaactctatcct

SEQ ID NO: 9470714 - DNA, 22 bp, Homo sapiens
tttcacatcagaggtagattag

SEQ ID NO: 9470715 - DNA, 22 bp, Homo sapiens
tttcacatcagaggtagattag

SEQ ID NO: 9470716 - DNA, 22 bp, Homo sapiens
tttcacatcagaggtagattag

SEQ ID NO: 9470717 - DNA, 22 bp, Homo sapiens
tttcacatatggttgttgattg

SEQ ID NO: 9470718 - DNA, 22 bp, Homo sapiens
tttcacatatggttgttgattg

SEQ ID NO: 9470719 - DNA, 22 bp, Homo sapiens
ttctggagttgtgacctcaggg

SEQ ID NO: 9470720 - DNA, 22 bp, Homo sapiens
ttctggagttgtgacctcaggg

SEQ ID NO: 9470721 - DNA, 22 bp, Homo sapiens
ttctggagtttgaagatcaggt

SEQ ID NO: 9470722 - DNA, 22 bp, Homo sapiens
ttctggagtttgaagatcaggt

SEQ ID NO: 9470723 - DNA, 22 bp, Homo sapiens
ttctggagtttgaagatcaggt

SEQ ID NO: 9470724 - DNA, 22 bp, Homo sapiens
ttctggctttcttgtcaggatg

SEQ ID NO: 9470725 - DNA, 22 bp, Homo sapiens
ttctggatatggattttggtga

SEQ ID NO: 9470726 - DNA, 22 bp, Homo sapiens
ttctggctttgaccaagttcaa

SEQ ID NO: 9470727 - DNA, 22 bp, Homo sapiens
ttctggcttttcatgttccagt

SEQ ID NO: 9470728 - DNA, 22 bp, Homo sapiens
ttctgggacatctggacagttt

SEQ ID NO: 9470729 - DNA, 22 bp, Homo sapiens
ttctggagtcattggggctgat

SEQ ID NO: 9470730 - DNA, 22 bp, Homo sapiens
ttctggagtcccacagccaggg

SEQ ID NO: 9470731 - DNA, 22 bp, Homo sapiens
ttctggagtcccacagccaggg

SEQ ID NO: 9470732 - DNA, 22 bp, Homo sapiens
ttctggagtattcctggcagcc

SEQ ID NO: 9470733 - DNA, 22 bp, Homo sapiens
ttctggagtattcctggcacct

SEQ ID NO: 9470734 - DNA, 22 bp, Homo sapiens
ttctggagtattcctggcagcc

SEQ ID NO: 9470735 - DNA, 22 bp, Homo sapiens
ttctggagtgtattgggtctgc

SEQ ID NO: 9470736 - DNA, 22 bp, Homo sapiens
ttctggagttcaggtccctaaa

SEQ ID NO: 9470737 - DNA, 22 bp, Homo sapiens
ttctggagtgtggaccgctgtt

SEQ ID NO: 9470738 - DNA, 22 bp, Homo sapiens
ttctggagtcttcaattttaga

SEQ ID NO: 9470739 - DNA, 22 bp, Homo sapiens
ttctggagtgataaaacaccac

SEQ ID NO: 9470740 - DNA, 22 bp, Homo sapiens
ttctggagtgataaaacaccac

SEQ ID NO: 9470741 - DNA, 22 bp, Homo sapiens
ttctggagtattcctggcacct

SEQ ID NO: 9470742 - DNA, 22 bp, Homo sapiens
ttctggaggttattaggagtct

SEQ ID NO: 9470743 - DNA, 22 bp, Homo sapiens
ttctggaggttattaggagtct

SEQ ID NO: 9470744 - DNA, 19 bp, Homo sapiens
ttctggaggttaccctgag

SEQ ID NO: 9470745 - DNA, 19 bp, Homo sapiens
ttctggaggttaccctgag

SEQ ID NO: 9470746 - DNA, 22 bp, Homo sapiens
ttctggaggtgtgaccattagc

SEQ ID NO: 9470747 - DNA, 22 bp, Homo sapiens
ttctggagggcatgctgctgcc

SEQ ID NO: 9470748 - DNA, 22 bp, Homo sapiens
ttctggagggcatgctgctgcc

SEQ ID NO: 9470749 - DNA, 22 bp, Homo sapiens
ttctggagggcctgatcacaca

SEQ ID NO: 9470750 - DNA, 22 bp, Homo sapiens
ttctggagggcatgctgctgcc

SEQ ID NO: 9470751 - DNA, 22 bp, Homo sapiens
ttctggaggctctaagggacaa

SEQ ID NO: 9470752 - DNA, 22 bp, Homo sapiens
ttctgggagaatctaaatggtt

SEQ ID NO: 9470753 - DNA, 22 bp, Homo sapiens
ttctgggagagaaagggccttg

SEQ ID NO: 9470754 - DNA, 22 bp, Homo sapiens
ttctgggaggctggctgtcata

SEQ ID NO: 9470755 - DNA, 20 bp, Homo sapiens
ttctgggatgcctgcatctt

SEQ ID NO: 9470756 - DNA, 22 bp, Homo sapiens
ttctgggagtttgggtcggctg

SEQ ID NO: 9470757 - DNA, 19 bp, Homo sapiens
ttctgggaggggctgactg

SEQ ID NO: 9470758 - DNA, 22 bp, Homo sapiens
ttcttcagatcctacaagtctg

SEQ ID NO: 9470759 - DNA, 22 bp, Homo sapiens
ttcttcagactccctctttaag

SEQ ID NO: 9470760 - DNA, 22 bp, Homo sapiens
ttcttcagagagtagaagcaag

SEQ ID NO: 9470761 - DNA, 22 bp, Homo sapiens
ttcttcagagagtagaagcaag

SEQ ID NO: 9470762 - DNA, 22 bp, Homo sapiens
ttcttcctcacactctcaccca

SEQ ID NO: 9470763 - DNA, 22 bp, Homo sapiens
ttcttctcggctgtcagatagt

SEQ ID NO: 9470764 - DNA, 22 bp, Homo sapiens
ttcttctcggctgtcagatagt

SEQ ID NO: 9470765 - DNA, 22 bp, Homo sapiens
ttcttccttggtttcctggata

SEQ ID NO: 9470766 - DNA, 22 bp, Homo sapiens
ttcttcctcacactctcaccca

SEQ ID NO: 9470767 - DNA, 22 bp, Homo sapiens
ttcttcctctgtaaaaggtgac

SEQ ID NO: 9470768 - DNA, 22 bp, Homo sapiens
ttctttctttgtagtcctgaac

SEQ ID NO: 9470769 - DNA, 22 bp, Homo sapiens
ttctttgcccttaatgaaataa

SEQ ID NO: 9470770 - DNA, 22 bp, Homo sapiens
ttctttgcccatgtttcctaag

SEQ ID NO: 9470771 - DNA, 22 bp, Homo sapiens
ttctttggaataagtcaagctg

SEQ ID NO: 9470772 - DNA, 23 bp, Homo sapiens
ttctttggaattgggctgcaagg

SEQ ID NO: 9470773 - DNA, 23 bp, Homo sapiens
ttctttggaattgggctgcaagg

SEQ ID NO: 9470774 - DNA, 22 bp, Homo sapiens
ttctttggcatttcctgtatgt

SEQ ID NO: 9470775 - DNA, 22 bp, Homo sapiens
ttctttggcttacgtctggcct

SEQ ID NO: 9470776 - DNA, 22 bp, Homo sapiens
ttctttggcttacgtctggcct

SEQ ID NO: 9470777 - DNA, 22 bp, Homo sapiens
ttctttggctgccagtctggag

SEQ ID NO: 9470778 - DNA, 22 bp, Homo sapiens
ttctttggctgccagtctggag

SEQ ID NO: 9470779 - DNA, 22 bp, Homo sapiens
ttctttgggattgtagctgtct

SEQ ID NO: 9470780 - DNA, 22 bp, Homo sapiens
ttctttgggattgtagctgtct

SEQ ID NO: 9470781 - DNA, 22 bp, Homo sapiens
ttctttgggcaattgctggccc

SEQ ID NO: 9470782 - DNA, 22 bp, Homo sapiens
ttctttgggcaattgctggccc

SEQ ID NO: 9470783 - DNA, 22 bp, Homo sapiens
ttctttggggaatattctggtt

SEQ ID NO: 9470784 - DNA, 22 bp, Homo sapiens
ttctttgggctcagagagggag

SEQ ID NO: 9470785 - DNA, 22 bp, Homo sapiens
ttctttggggtctccagcatag

SEQ ID NO: 9470786 - DNA, 22 bp, Homo sapiens
ttctttggggaatattctggtt

SEQ ID NO: 9470787 - DNA, 22 bp, Homo sapiens
ttctttggggtctccagcatag

SEQ ID NO: 9470788 - DNA, 22 bp, Homo sapiens
ttctttggtgggagattgaggt

SEQ ID NO: 9470789 - DNA, 22 bp, Homo sapiens
ttcttcttcaagtgctgcattc

SEQ ID NO: 9470790 - DNA, 22 bp, Homo sapiens
ttcttcttcaagtgctgcattc

SEQ ID NO: 9470791 - DNA, 22 bp, Homo sapiens
ttcttcttaatgtcctgggaac

SEQ ID NO: 9470792 - DNA, 22 bp, Homo sapiens
ttcttcttcatttctgacgatg

SEQ ID NO: 9470793 - DNA, 22 bp, Homo sapiens
ttctttctcaacatgaatgttt

SEQ ID NO: 9470794 - DNA, 22 bp, Homo sapiens
ttctttcttagcaatctatggt

SEQ ID NO: 9470795 - DNA, 22 bp, Homo sapiens
ttcttctgattgccttctgcaa

SEQ ID NO: 9470796 - DNA, 22 bp, Homo sapiens
ttcttctgattgccttctgcaa

SEQ ID NO: 9470797 - DNA, 22 bp, Homo sapiens
ttcttctgttggcagagcatac

SEQ ID NO: 9470798 - DNA, 22 bp, Homo sapiens
ttcttctgttggcagagcatac

SEQ ID NO: 9470799 - DNA, 20 bp, Homo sapiens
ttcttctctagttatcttca

SEQ ID NO: 9470800 - DNA, 22 bp, Homo sapiens
ttgagatagatctcatcttccc

SEQ ID NO: 9470801 - DNA, 22 bp, Homo sapiens
ttgagatagatctcatcttccc

SEQ ID NO: 9470802 - DNA, 22 bp, Homo sapiens
ttgagagtttgggggcaatatg

SEQ ID NO: 9470803 - DNA, 22 bp, Homo sapiens
ttgagagttttcaatagattgg

SEQ ID NO: 9470804 - DNA, 22 bp, Homo sapiens
ttgagagtgccaagcatcctcc

SEQ ID NO: 9470805 - DNA, 22 bp, Homo sapiens
ttgagagtgccaagcatcctcc

SEQ ID NO: 9470806 - DNA, 22 bp, Homo sapiens
ttgagagttctgaatgagtaac

SEQ ID NO: 9470807 - DNA, 22 bp, Homo sapiens
ttgagagttaccagcagaggaa

SEQ ID NO: 9470808 - DNA, 22 bp, Homo sapiens
ttgagagtggcttgttgactgc

SEQ ID NO: 9470809 - DNA, 22 bp, Homo sapiens
ttgagaggatggattagacaaa

SEQ ID NO: 9470810 - DNA, 22 bp, Homo sapiens
ttgagagaggaaacatagtctc

SEQ ID NO: 9470811 - DNA, 22 bp, Homo sapiens
ttgagaggatggattagacaaa

SEQ ID NO: 9470812 - DNA, 22 bp, Homo sapiens
ttgagaggctgttgacattctg

SEQ ID NO: 9470813 - DNA, 22 bp, Homo sapiens
ttgagagtctgagtttggacta

SEQ ID NO: 9470814 - DNA, 22 bp, Homo sapiens
ttgagagtctatcaaatagctt

SEQ ID NO: 9470815 - DNA, 22 bp, Homo sapiens
ttgagagtcgattttgaactag

SEQ ID NO: 9470816 - DNA, 22 bp, Homo sapiens
ttgagagtagagatggcagggc

SEQ ID NO: 9470817 - DNA, 22 bp, Homo sapiens
ttgagagtcatttaaggtgttg

SEQ ID NO: 9470818 - DNA, 22 bp, Homo sapiens
ttgagggaacatgagaatcatc

SEQ ID NO: 9470819 - DNA, 22 bp, Homo sapiens
ttgagggacagaggtgctgtct

SEQ ID NO: 9470820 - DNA, 22 bp, Homo sapiens
ttgagggacagaggtgctgtct

SEQ ID NO: 9470821 - DNA, 22 bp, Homo sapiens
ttgagggagaaagctgaggtgt

SEQ ID NO: 9470822 - DNA, 22 bp, Homo sapiens
ttgagggagaaagccgaggtgt

SEQ ID NO: 9470823 - DNA, 22 bp, Homo sapiens
ttgagggagaaagttggagtag

SEQ ID NO: 9470824 - DNA, 22 bp, Homo sapiens
ttgaggcccggcaggccgagcg

SEQ ID NO: 9470825 - DNA, 22 bp, Homo sapiens
ttgaggcctgctggaaggtgtt

SEQ ID NO: 9470826 - DNA, 22 bp, Homo sapiens
ttgaggcctgctggaaggtgtt

SEQ ID NO: 9470827 - DNA, 22 bp, Homo sapiens
ttgaggcccggcaggccgagcg

SEQ ID NO: 9470828 - DNA, 22 bp, Homo sapiens
ttgaggcccggcaggccgagcg

SEQ ID NO: 9470829 - DNA, 22 bp, Homo sapiens
ttgaggccccatggatgagaac

SEQ ID NO: 9470830 - DNA, 22 bp, Homo sapiens
ttgagggtctggatctgctgct

SEQ ID NO: 9470831 - DNA, 22 bp, Homo sapiens
ttgaggtaataaacagccattc

SEQ ID NO: 9470832 - DNA, 22 bp, Homo sapiens
ttgaggtatattcacatatatc

SEQ ID NO: 9470833 - DNA, 22 bp, Homo sapiens
ttgaggtagttctattgtgagt

SEQ ID NO: 9470834 - DNA, 21 bp, Homo sapiens
ttgaggggtattgcttttctc

SEQ ID NO: 9470835 - DNA, 19 bp, Homo sapiens
ttgaggggccaggggagat

SEQ ID NO: 9470836 - DNA, 22 bp, Homo sapiens
ttgagggattttaaatgaacaa

SEQ ID NO: 9470837 - DNA, 22 bp, Homo sapiens
ttgagggatttacagaggtggg

SEQ ID NO: 9470838 - DNA, 22 bp, Homo sapiens
ttgagggatttacagaggtggg

SEQ ID NO: 9470839 - DNA, 22 bp, Homo sapiens
ttgagggatttacagaggtggg

SEQ ID NO: 9470840 - DNA, 22 bp, Homo sapiens
ttgagggattgcaccagaagag

SEQ ID NO: 9470841 - DNA, 22 bp, Homo sapiens
ttgagggagcacagattcttat

SEQ ID NO: 9470842 - DNA, 22 bp, Homo sapiens
ttgagggagatgttgacttcag

SEQ ID NO: 9470843 - DNA, 22 bp, Homo sapiens
ttgagaaccactgagttagata

SEQ ID NO: 9470844 - DNA, 22 bp, Homo sapiens
ttgagaacaggagtgttctttt

SEQ ID NO: 9470845 - DNA, 22 bp, Homo sapiens
ttgagaactactttattattct

SEQ ID NO: 9470846 - DNA, 22 bp, Homo sapiens
ttgagaaggtggtcatttgcaa

SEQ ID NO: 9470847 - DNA, 22 bp, Homo sapiens
ttgagaatgatgagattcttcc

SEQ ID NO: 9470848 - DNA, 22 bp, Homo sapiens
ttgagaatgatgagattcttcc

SEQ ID NO: 9470849 - DNA, 22 bp, Homo sapiens
ttgagacactttgggcatcact

SEQ ID NO: 9470850 - DNA, 22 bp, Homo sapiens
ttgagagaaaaaatttattggt

SEQ ID NO: 9470851 - DNA, 22 bp, Homo sapiens
ttgagactcgagtctctcagac

SEQ ID NO: 9470852 - DNA, 22 bp, Homo sapiens
ttgagacacaaggcacagtaag

SEQ ID NO: 9470853 - DNA, 22 bp, Homo sapiens
ttgagaatgtgttttgctaagt

SEQ ID NO: 9470854 - DNA, 22 bp, Homo sapiens
ttgagaatgatgagattcttcc

SEQ ID NO: 9470855 - DNA, 18 bp, Homo sapiens
ttgagaaataagcactaa

SEQ ID NO: 9470856 - DNA, 18 bp, Homo sapiens
ttgagaaataagcactaa

SEQ ID NO: 9470857 - DNA, 18 bp, Homo sapiens
ttgagaaataagcactaa

SEQ ID NO: 9470858 - DNA, 19 bp, Homo sapiens
ttgagaaagttgatttggg

SEQ ID NO: 9470859 - DNA, 19 bp, Homo sapiens
ttgagaaagttgatttggg

SEQ ID NO: 9470860 - DNA, 22 bp, Homo sapiens
ttgagaaaggtaagaacccaca

SEQ ID NO: 9470861 - DNA, 22 bp, Homo sapiens
ttgagaaaggtaagaacccaca

SEQ ID NO: 9470862 - DNA, 22 bp, Homo sapiens
ttgagaaactctgggttagaat

SEQ ID NO: 9470863 - DNA, 22 bp, Homo sapiens
ttgagaaaggggtcaatatctc

SEQ ID NO: 9470864 - DNA, 22 bp, Homo sapiens
ttgagaaaggggtcaatatctc

SEQ ID NO: 9470865 - DNA, 22 bp, Homo sapiens
ttgagaaaggggtcaatatctc

SEQ ID NO: 9470866 - DNA, 16 bp, Homo sapiens
ttgagaaatgaagttt

SEQ ID NO: 9470867 - DNA, 16 bp, Homo sapiens
ttgagaaatgaagttt

SEQ ID NO: 9470868 - DNA, 22 bp, Homo sapiens
ttgagaaatacttttgtagcct

SEQ ID NO: 9470869 - DNA, 22 bp, Homo sapiens
ttgagaaatacttttgtagcct

SEQ ID NO: 9470870 - DNA, 22 bp, Homo sapiens
ttgagaaatacttttgtagcct

SEQ ID NO: 9470871 - DNA, 22 bp, Homo sapiens
ttgagaaataagcatgtctaga

SEQ ID NO: 9470872 - DNA, 22 bp, Homo sapiens
ttgagaaataagcatgtctaga

SEQ ID NO: 9470873 - DNA, 22 bp, Homo sapiens
ttgagaaatgttttttaagctg

SEQ ID NO: 9470874 - DNA, 22 bp, Homo sapiens
ttgagaaatgttttttaagctg

SEQ ID NO: 9470875 - DNA, 19 bp, Homo sapiens
ttgagaaatgggaaaagca

SEQ ID NO: 9470876 - DNA, 22 bp, Homo sapiens
ttgagaaatgttttttaagctg

SEQ ID NO: 9470877 - DNA, 22 bp, Homo sapiens
ttgaaaatatcacaggagcagc

SEQ ID NO: 9470878 - DNA, 19 bp, Homo sapiens
ttgaaaatatggatctgag

SEQ ID NO: 9470879 - DNA, 20 bp, Homo sapiens
ttgaaaatgcattgtgcagt

SEQ ID NO: 9470880 - DNA, 19 bp, Homo sapiens
ttgaaaatatggatctgag

SEQ ID NO: 9470881 - DNA, 22 bp, Homo sapiens
ttgaaaatatcacaggagcagc

SEQ ID NO: 9470882 - DNA, 22 bp, Homo sapiens
ttgaaaatatcacaggagcagc

SEQ ID NO: 9470883 - DNA, 22 bp, Homo sapiens
ttgaaaatggtaagcatgatat

SEQ ID NO: 9470884 - DNA, 22 bp, Homo sapiens
ttgaaaatggtaagcatgatat

SEQ ID NO: 9470885 - DNA, 22 bp, Homo sapiens
ttgaaacagtagctcatagacc

SEQ ID NO: 9470886 - DNA, 22 bp, Homo sapiens
ttgaaacataaaatatttcctg

SEQ ID NO: 9470887 - DNA, 22 bp, Homo sapiens
ttgaaacagtagctcatagacc

SEQ ID NO: 9470888 - DNA, 22 bp, Homo sapiens
ttgaaacagacaagtaaatgtc

SEQ ID NO: 9470889 - DNA, 22 bp, Homo sapiens
ttctttttggatagctgatgaa

SEQ ID NO: 9470890 - DNA, 22 bp, Homo sapiens
ttctttttggatagctgatgaa

SEQ ID NO: 9470891 - DNA, 22 bp, Homo sapiens
ttctttttggatagctgatgaa

SEQ ID NO: 9470892 - DNA, 22 bp, Homo sapiens
ttgaaaaaattggtagaggatg

SEQ ID NO: 9470893 - DNA, 22 bp, Homo sapiens
ttgaaaaaattggtagaggatg

SEQ ID NO: 9470894 - DNA, 22 bp, Homo sapiens
ttctttttatcttcccataaga

SEQ ID NO: 9470895 - DNA, 22 bp, Homo sapiens
ttctttttggatagctgatgaa

SEQ ID NO: 9470896 - DNA, 22 bp, Homo sapiens
ttctttttatcttcccataaga

SEQ ID NO: 9470897 - DNA, 22 bp, Homo sapiens
ttctttttatcttcccataaga

SEQ ID NO: 9470898 - DNA, 22 bp, Homo sapiens
ttgaaaactttctagaccaaga

SEQ ID NO: 9470899 - DNA, 22 bp, Homo sapiens
ttgaaaaaattggtagaggatg

SEQ ID NO: 9470900 - DNA, 23 bp, Homo sapiens
ttgaaaaatatagtcccattgtc

SEQ ID NO: 9470901 - DNA, 22 bp, Homo sapiens
ttgaaacattacctgtatttcc

SEQ ID NO: 9470902 - DNA, 22 bp, Homo sapiens
ttgaaacattctcctattgatt

SEQ ID NO: 9470903 - DNA, 22 bp, Homo sapiens
ttgaaactcatcttagtgatgt

SEQ ID NO: 9470904 - DNA, 22 bp, Homo sapiens
ttgaaacattctcctattgatt

SEQ ID NO: 9470905 - DNA, 22 bp, Homo sapiens
ttgaaactgggaagcagggggt

SEQ ID NO: 9470906 - DNA, 22 bp, Homo sapiens
ttgaaagaggcaaagtttgatc

SEQ ID NO: 9470907 - DNA, 22 bp, Homo sapiens
ttgaaagacattatttatatat

SEQ ID NO: 9470908 - DNA, 22 bp, Homo sapiens
ttgaaagaactcttcagagata

SEQ ID NO: 9470909 - DNA, 22 bp, Homo sapiens
ttgaaaggaatacagaggccta

SEQ ID NO: 9470910 - DNA, 23 bp, Homo sapiens
ttgacagtaggtggttttcattg

SEQ ID NO: 9470911 - DNA, 19 bp, Homo sapiens
ttgaaagattagctttcta

SEQ ID NO: 9470912 - DNA, 22 bp, Homo sapiens
ttgaaagatagtgaagccagcc

SEQ ID NO: 9470913 - DNA, 22 bp, Homo sapiens
ttgagaaactaacggcttgagc

SEQ ID NO: 9470914 - DNA, 22 bp, Homo sapiens
ttgagaaacctggcagtagaga

SEQ ID NO: 9470915 - DNA, 22 bp, Homo sapiens
ttgagaaacctggcagtagaga

SEQ ID NO: 9470916 - DNA, 22 bp, Homo sapiens
ttgaccattatacactggcttg

SEQ ID NO: 9470917 - DNA, 22 bp, Homo sapiens
ttgaccatacctccaggcagtt

SEQ ID NO: 9470918 - DNA, 22 bp, Homo sapiens
ttgacattttgtcatattgaca

SEQ ID NO: 9470919 - DNA, 21 bp, Homo sapiens
ttgaccaagggtgcgtgctcc

SEQ ID NO: 9470920 - DNA, 22 bp, Homo sapiens
ttgaccactgaatggttctgaa

SEQ ID NO: 9470921 - DNA, 22 bp, Homo sapiens
ttccctctccaggagccctgag

SEQ ID NO: 9470922 - DNA, 22 bp, Homo sapiens
ttccctctccaggagccctgag

SEQ ID NO: 9470923 - DNA, 22 bp, Homo sapiens
ttccctcccccagcctggcagg

SEQ ID NO: 9470924 - DNA, 22 bp, Homo sapiens
ttccctcccccagcctggcagg

SEQ ID NO: 9470925 - DNA, 22 bp, Homo sapiens
ttccctccgaacctcagtgctg

SEQ ID NO: 9470926 - DNA, 22 bp, Homo sapiens
ttccctccgaacctcagtgctg

SEQ ID NO: 9470927 - DNA, 21 bp, Homo sapiens
ttcctttttatggcttagtgg

SEQ ID NO: 9470928 - DNA, 22 bp, Homo sapiens
ttcctttagtgtcatatacttt

SEQ ID NO: 9470929 - DNA, 21 bp, Homo sapiens
ttcctttttatggcttagtgg

SEQ ID NO: 9470930 - DNA, 22 bp, Homo sapiens
ttcctttagtgtcatatacttt

SEQ ID NO: 9470931 - DNA, 22 bp, Homo sapiens
ttccctgagtctccctgagtct

SEQ ID NO: 9470932 - DNA, 22 bp, Homo sapiens
ttccttgttgaaaatgtctgca

SEQ ID NO: 9470933 - DNA, 22 bp, Homo sapiens
ttccctgcaacctttccctggg

SEQ ID NO: 9470934 - DNA, 22 bp, Homo sapiens
ttccttgtttcaagccatccac

SEQ ID NO: 9470935 - DNA, 22 bp, Homo sapiens
ttccttgttgaaaatgtctgca

SEQ ID NO: 9470936 - DNA, 22 bp, Homo sapiens
ttccctgaagacctcatgtgac

SEQ ID NO: 9470937 - DNA, 22 bp, Homo sapiens
ttccctgaagacctcatgtgac

SEQ ID NO: 9470938 - DNA, 22 bp, Homo sapiens
ttctaaattttggaagatgcag

SEQ ID NO: 9470939 - DNA, 22 bp, Homo sapiens
ttctaactccacttcccactcc

SEQ ID NO: 9470940 - DNA, 22 bp, Homo sapiens
ttctaactctgttatgtgtttc

SEQ ID NO: 9470941 - DNA, 22 bp, Homo sapiens
ttctaactctacactagctttg

SEQ ID NO: 9470942 - DNA, 22 bp, Homo sapiens
ttctaactctgttatgtgtttc

SEQ ID NO: 9470943 - DNA, 22 bp, Homo sapiens
ttctaaagtgcaatctgacaga

SEQ ID NO: 9470944 - DNA, 22 bp, Homo sapiens
ttctaaatggggatcctttctg

SEQ ID NO: 9470945 - DNA, 22 bp, Homo sapiens
ttctaaatggggatcctttctg

SEQ ID NO: 9470946 - DNA, 22 bp, Homo sapiens
ttctaaagtgcaatctgacaga

SEQ ID NO: 9470947 - DNA, 22 bp, Homo sapiens
ttctaaagtgcaatctgacaga

SEQ ID NO: 9470948 - DNA, 22 bp, Homo sapiens
ttctaaatgtaaatagtatgat

SEQ ID NO: 9470949 - DNA, 22 bp, Homo sapiens
ttctaaatgtaaatagtatgat

SEQ ID NO: 9470950 - DNA, 22 bp, Homo sapiens
ttctaaattttggaagatgcag

SEQ ID NO: 9470951 - DNA, 22 bp, Homo sapiens
ttctaaaataagtttatctggt

SEQ ID NO: 9470952 - DNA, 22 bp, Homo sapiens
ttctaaaataagtttatctggt

SEQ ID NO: 9470953 - DNA, 22 bp, Homo sapiens
ttctaaagactcatggaagtgg

SEQ ID NO: 9470954 - DNA, 22 bp, Homo sapiens
ttctaaacttcaattctaaatt

SEQ ID NO: 9470955 - DNA, 22 bp, Homo sapiens
ttctaaacttcaattctaaatt

SEQ ID NO: 9470956 - DNA, 22 bp, Homo sapiens
ttctaaacggcttcacaggaat

SEQ ID NO: 9470957 - DNA, 22 bp, Homo sapiens
ttctaaaaccaattctgcttct

SEQ ID NO: 9470958 - DNA, 22 bp, Homo sapiens
ttctaaaaccaattctgcttct

SEQ ID NO: 9470959 - DNA, 22 bp, Homo sapiens
ttcgttttctaggaccaacaga

SEQ ID NO: 9470960 - DNA, 22 bp, Homo sapiens
ttcgttttctaggaccaacaga

SEQ ID NO: 9470961 - DNA, 22 bp, Homo sapiens
ttcgtgtggagatgtttctgca

SEQ ID NO: 9470962 - DNA, 22 bp, Homo sapiens
ttctcaagaacatatgtagggt

SEQ ID NO: 9470963 - DNA, 22 bp, Homo sapiens
ttctcaaggacaaaatgacatg

SEQ ID NO: 9470964 - DNA, 22 bp, Homo sapiens
ttctcaaagaaagctgtcatta

SEQ ID NO: 9470965 - DNA, 22 bp, Homo sapiens
ttctcaaagaaagctgtcatta

SEQ ID NO: 9470966 - DNA, 22 bp, Homo sapiens
ttctcaaagtgtgctccctgga

SEQ ID NO: 9470967 - DNA, 22 bp, Homo sapiens
ttctcaaagggtggtttgcaaa

SEQ ID NO: 9470968 - DNA, 22 bp, Homo sapiens
ttctcaaagggtggtttgcaaa

SEQ ID NO: 9470969 - DNA, 22 bp, Homo sapiens
ttctcaaagaaagctgtcatta

SEQ ID NO: 9470970 - DNA, 22 bp, Homo sapiens
ttctcaaagaaagctgtcatta

SEQ ID NO: 9470971 - DNA, 19 bp, Homo sapiens
ttctatgattaacatgaga

SEQ ID NO: 9470972 - DNA, 22 bp, Homo sapiens
ttctatgattcatttagaagtt

SEQ ID NO: 9470973 - DNA, 22 bp, Homo sapiens
ttctcaaagaaagctgtcatta

SEQ ID NO: 9470974 - DNA, 22 bp, Homo sapiens
ttctatatgacttctaggcagg

SEQ ID NO: 9470975 - DNA, 22 bp, Homo sapiens
ttctatgaaggtaagatgtacg

SEQ ID NO: 9470976 - DNA, 22 bp, Homo sapiens
ttctatgaaggtaagatgtacg

SEQ ID NO: 9470977 - DNA, 22 bp, Homo sapiens
ttctcagaattgactgggagca

SEQ ID NO: 9470978 - DNA, 22 bp, Homo sapiens
ttctcactatgtatgtagattg

SEQ ID NO: 9470979 - DNA, 22 bp, Homo sapiens
ttctcacaaatccatccaggag

SEQ ID NO: 9470980 - DNA, 22 bp, Homo sapiens
ttctcacaaatccatccaggag

SEQ ID NO: 9470981 - DNA, 22 bp, Homo sapiens
ttctcacactttccactgaggt

SEQ ID NO: 9470982 - DNA, 22 bp, Homo sapiens
ttctcacactttccactgaggt

SEQ ID NO: 9470983 - DNA, 22 bp, Homo sapiens
ttctcagaggctgctaagtgca

SEQ ID NO: 9470984 - DNA, 19 bp, Homo sapiens
ttctccagcctgacctgag

SEQ ID NO: 9470985 - DNA, 19 bp, Homo sapiens
ttctccagcctgacctgag

SEQ ID NO: 9470986 - DNA, 19 bp, Homo sapiens
ttctccagcctgacctgag

SEQ ID NO: 9470987 - DNA, 22 bp, Homo sapiens
ttctccagctcatcagggaggg

SEQ ID NO: 9470988 - DNA, 21 bp, Homo sapiens
ttctccaggcaaccatttcag

SEQ ID NO: 9470989 - DNA, 19 bp, Homo sapiens
ttctccagcctgacctgag

SEQ ID NO: 9470990 - DNA, 22 bp, Homo sapiens
ttctccagcacattttctttga

SEQ ID NO: 9470991 - DNA, 22 bp, Homo sapiens
ttctccagagtttctctcactg

SEQ ID NO: 9470992 - DNA, 19 bp, Homo sapiens
ttctccagcctgacctgag

SEQ ID NO: 9470993 - DNA, 19 bp, Homo sapiens
ttctccagcctgacctgag

SEQ ID NO: 9470994 - DNA, 19 bp, Homo sapiens
ttctccaggctgcagaggg

SEQ ID NO: 9470995 - DNA, 19 bp, Homo sapiens
ttctccagggacttaggga

SEQ ID NO: 9470996 - DNA, 22 bp, Homo sapiens
ttctccaggcttgggccaggtc

SEQ ID NO: 9470997 - DNA, 22 bp, Homo sapiens
ttctgaggaggagcaaaaactc

SEQ ID NO: 9470998 - DNA, 22 bp, Homo sapiens
ttctgaggcactggctctccca

SEQ ID NO: 9470999 - DNA, 22 bp, Homo sapiens
ttctgaggcatagaggatgaga

SEQ ID NO: 9471000 - DNA, 22 bp, Homo sapiens
ttctgaggccattaccaataaa

SEQ ID NO: 9471001 - DNA, 22 bp, Homo sapiens
ttctgagctacatagtactggg

SEQ ID NO: 9471002 - DNA, 22 bp, Homo sapiens
ttctgagctgcaacactaacat

SEQ ID NO: 9471003 - DNA, 20 bp, Homo sapiens
ttctctttgggtccagagaa

SEQ ID NO: 9471004 - DNA, 22 bp, Homo sapiens
ttctctttatgtatttagtggg

SEQ ID NO: 9471005 - DNA, 22 bp, Homo sapiens
ttctctttatgtatttagtggg

SEQ ID NO: 9471006 - DNA, 22 bp, Homo sapiens
ttctctttatgtatttagtggg

SEQ ID NO: 9471007 - DNA, 22 bp, Homo sapiens
ttctctttctacagtgtgattg

SEQ ID NO: 9471008 - DNA, 22 bp, Homo sapiens
ttctctttgacattattcaggt

SEQ ID NO: 9471009 - DNA, 22 bp, Homo sapiens
ttctctttctgctgggctggaa

SEQ ID NO: 9471010 - DNA, 22 bp, Homo sapiens
ttctctttctacagtgtgattg

SEQ ID NO: 9471011 - DNA, 22 bp, Homo sapiens
ttctgaggccattaccaataaa

SEQ ID NO: 9471012 - DNA, 22 bp, Homo sapiens
ttctgaggctttcccgtcccct

SEQ ID NO: 9471013 - DNA, 22 bp, Homo sapiens
ttctgagggaggttctctggga

SEQ ID NO: 9471014 - DNA, 22 bp, Homo sapiens
ttctgagggaaccttgttcttg

SEQ ID NO: 9471015 - DNA, 22 bp, Homo sapiens
ttctgagggctaatgtactgta

SEQ ID NO: 9471016 - DNA, 22 bp, Homo sapiens
ttctgagggaggttctctggga

SEQ ID NO: 9471017 - DNA, 22 bp, Homo sapiens
ttctgaggtccatgcagtactg

SEQ ID NO: 9471018 - DNA, 22 bp, Homo sapiens
ttctgagggctaatgtactgta

SEQ ID NO: 9471019 - DNA, 22 bp, Homo sapiens
ttctgatgatggcggctggagc

SEQ ID NO: 9471020 - DNA, 22 bp, Homo sapiens
ttctgatactggaatcgatgcc

SEQ ID NO: 9471021 - DNA, 22 bp, Homo sapiens
ttctgattgctgatgaggccca

SEQ ID NO: 9471022 - DNA, 22 bp, Homo sapiens
ttctgattgctgatgaggccca

SEQ ID NO: 9471023 - DNA, 22 bp, Homo sapiens
ttctggaggctccagggaagaa

SEQ ID NO: 9471024 - DNA, 22 bp, Homo sapiens
ttctggaggcgggcgacctcgc

SEQ ID NO: 9471025 - DNA, 20 bp, Homo sapiens
ttctggaggctacaagtctg

SEQ ID NO: 9471026 - DNA, 20 bp, Homo sapiens
ttctggaggctacaagtctg

SEQ ID NO: 9471027 - DNA, 20 bp, Homo sapiens
ttctggaggctacaagtctg

SEQ ID NO: 9471028 - DNA, 22 bp, Homo sapiens
ttctggaggagaaagggtgggc

SEQ ID NO: 9471029 - DNA, 22 bp, Homo sapiens
ttctggaggagaaagggtgggc

SEQ ID NO: 9471030 - DNA, 22 bp, Homo sapiens
ttctggaggccccttccttctc

SEQ ID NO: 9471031 - DNA, 22 bp, Homo sapiens
ttctggaggccagctgccacct

SEQ ID NO: 9471032 - DNA, 22 bp, Homo sapiens
ttctggaggccagctgccacct

SEQ ID NO: 9471033 - DNA, 19 bp, Homo sapiens
ttctgccctctcttctagc

SEQ ID NO: 9471034 - DNA, 22 bp, Homo sapiens
ttctggagcttggcttgtatgt

SEQ ID NO: 9471035 - DNA, 22 bp, Homo sapiens
ttctggaggacaactgttttca

SEQ ID NO: 9471036 - DNA, 22 bp, Homo sapiens
ttctgcctgatgtagtcatacc

SEQ ID NO: 9471037 - DNA, 22 bp, Homo sapiens
ttctgcatttctaataagttcc

SEQ ID NO: 9471038 - DNA, 22 bp, Homo sapiens
ttctgcatttctaataagttcc

SEQ ID NO: 9471039 - DNA, 22 bp, Homo sapiens
ttctgcatttaaaatattacta

SEQ ID NO: 9471040 - DNA, 22 bp, Homo sapiens
ttctgcattgacttttatttcc

SEQ ID NO: 9471041 - DNA, 22 bp, Homo sapiens
ttctgccaaaggctttgttttg

SEQ ID NO: 9471042 - DNA, 22 bp, Homo sapiens
ttctgccaaaggctttgttttg

SEQ ID NO: 9471043 - DNA, 22 bp, Homo sapiens
ttctgcagcatgaggctggagc

SEQ ID NO: 9471044 - DNA, 22 bp, Homo sapiens
ttctgcagcatgaggctggagc

SEQ ID NO: 9471045 - DNA, 23 bp, Homo sapiens
ttctgcatgtttcagagctggga

SEQ ID NO: 9471046 - DNA, 21 bp, Homo sapiens
ttctgcattaaggtggagata

SEQ ID NO: 9471047 - DNA, 22 bp, Homo sapiens
ttctctgtggattgggtgagag

SEQ ID NO: 9471048 - DNA, 22 bp, Homo sapiens
ttctctgtgagggtgctggatt

SEQ ID NO: 9471049 - DNA, 19 bp, Homo sapiens
ttctctgtgctagactctg

SEQ ID NO: 9471050 - DNA, 22 bp, Homo sapiens
ttctctggtttgctgtttctga

SEQ ID NO: 9471051 - DNA, 22 bp, Homo sapiens
ttctctgtagttgcctggtgga

SEQ ID NO: 9471052 - DNA, 22 bp, Homo sapiens
ttctcttagctgtaaagtcaat

SEQ ID NO: 9471053 - DNA, 22 bp, Homo sapiens
ttctcttagctgtaaagtcaat

SEQ ID NO: 9471054 - DNA, 22 bp, Homo sapiens
ttctcttagcactttgtgttac

SEQ ID NO: 9471055 - DNA, 22 bp, Homo sapiens
ttctctgttttcccctcgatgt

SEQ ID NO: 9471056 - DNA, 22 bp, Homo sapiens
ttctctgttttcccctcgatgt

SEQ ID NO: 9471057 - DNA, 22 bp, Homo sapiens
ttctcttattctggatatgcag

SEQ ID NO: 9471058 - DNA, 22 bp, Homo sapiens
ttctcttattctggatatgcag

SEQ ID NO: 9471059 - DNA, 22 bp, Homo sapiens
ttctcttagctgtaaagtcaat

SEQ ID NO: 9471060 - DNA, 22 bp, Homo sapiens
ttctcttagtattgctagttta

SEQ ID NO: 9471061 - DNA, 22 bp, Homo sapiens
ttctcttatctggcattattgg

SEQ ID NO: 9471062 - DNA, 17 bp, Homo sapiens
ttctcttcctggatagt

SEQ ID NO: 9471063 - DNA, 22 bp, Homo sapiens
ttctcttcccactttctgtatt

SEQ ID NO: 9471064 - DNA, 17 bp, Homo sapiens
ttctcttcctggatagt

SEQ ID NO: 9471065 - DNA, 22 bp, Homo sapiens
ttctcttcatctcagtaaatgt

SEQ ID NO: 9471066 - DNA, 22 bp, Homo sapiens
ttctcttcatctcagtaaatgt

SEQ ID NO: 9471067 - DNA, 22 bp, Homo sapiens
ttctcttcatctcagtaaatgt

SEQ ID NO: 9471068 - DNA, 22 bp, Homo sapiens
ttctcttcccactttctgtatt

SEQ ID NO: 9471069 - DNA, 22 bp, Homo sapiens
ttctcttctgttcagtgcccaa

SEQ ID NO: 9471070 - DNA, 22 bp, Homo sapiens
ttctcttgactaccagttagga

SEQ ID NO: 9471071 - DNA, 17 bp, Homo sapiens
ttctcttcctggatagt

SEQ ID NO: 9471072 - DNA, 23 bp, Homo sapiens
ttctctttagatttacattactc

SEQ ID NO: 9471073 - DNA, 23 bp, Homo sapiens
ttctctttagatttacattactc

SEQ ID NO: 9471074 - DNA, 23 bp, Homo sapiens
ttctctttagatttacattactc

SEQ ID NO: 9471075 - DNA, 22 bp, Homo sapiens
ttctcccactccgtgcttcagt

SEQ ID NO: 9471076 - DNA, 22 bp, Homo sapiens
ttctccctgccaaagctgcctc

SEQ ID NO: 9471077 - DNA, 21 bp, Homo sapiens
ttctccccagcgaatcctcgg

SEQ ID NO: 9471078 - DNA, 22 bp, Homo sapiens
ttctccagttatattatgttaa

SEQ ID NO: 9471079 - DNA, 22 bp, Homo sapiens
ttctccagtttctcccttcagt

SEQ ID NO: 9471080 - DNA, 20 bp, Homo sapiens
ttctccagtgcggtagccat

SEQ ID NO: 9471081 - DNA, 20 bp, Homo sapiens
ttctccagtgcggtagccat

SEQ ID NO: 9471082 - DNA, 17 bp, Homo sapiens
ttctcctctgtgtcctt

SEQ ID NO: 9471083 - DNA, 18 bp, Homo sapiens
ttctctggtggatgttat

SEQ ID NO: 9471084 - DNA, 22 bp, Homo sapiens
ttctccgctaagttctctgcag

SEQ ID NO: 9471085 - DNA, 22 bp, Homo sapiens
ttctccgctaagttctctgcag

SEQ ID NO: 9471086 - DNA, 22 bp, Homo sapiens
ttctccgctaagttctctgcag

SEQ ID NO: 9471087 - DNA, 22 bp, Homo sapiens
ttctccgctaagttctctgcag

SEQ ID NO: 9471088 - DNA, 22 bp, Homo sapiens
ttctccctgtcctatcaagact

SEQ ID NO: 9471089 - DNA, 22 bp, Homo sapiens
ttctcctcagcaaggcagcttt

SEQ ID NO: 9471090 - DNA, 22 bp, Homo sapiens
ttagttattaggtggcagagct

SEQ ID NO: 9471091 - DNA, 22 bp, Homo sapiens
ttagttatactactgaatggag

SEQ ID NO: 9471092 - DNA, 20 bp, Homo sapiens
ttagttgagtagctcctgaa

SEQ ID NO: 9471093 - DNA, 22 bp, Homo sapiens
ttagttcttgggtgaacttttg

SEQ ID NO: 9471094 - DNA, 22 bp, Homo sapiens
ttagttctcatgaattttaagt

SEQ ID NO: 9471095 - DNA, 22 bp, Homo sapiens
ttagttctcatgaattttaagt

SEQ ID NO: 9471096 - DNA, 22 bp, Homo sapiens
ttagttcttgggtgaacttttg

SEQ ID NO: 9471097 - DNA, 22 bp, Homo sapiens
ttagttctcatgaattttaagt

SEQ ID NO: 9471098 - DNA, 22 bp, Homo sapiens
ttataagagtatatagtgtact

SEQ ID NO: 9471099 - DNA, 23 bp, Homo sapiens
ttataagaagcatcacaggaaga

SEQ ID NO: 9471100 - DNA, 22 bp, Homo sapiens
ttataagactgtagtgagtatt

SEQ ID NO: 9471101 - DNA, 22 bp, Homo sapiens
ttataagagtatatagtgtact

SEQ ID NO: 9471102 - DNA, 22 bp, Homo sapiens
ttataattctggcataggctgt

SEQ ID NO: 9471103 - DNA, 22 bp, Homo sapiens
ttataattctggcataggctgt

SEQ ID NO: 9471104 - DNA, 22 bp, Homo sapiens
ttagtttataattcatttctgt

SEQ ID NO: 9471105 - DNA, 22 bp, Homo sapiens
ttagttgtaaaatggaatttgt

SEQ ID NO: 9471106 - DNA, 22 bp, Homo sapiens
ttataactttggatatgacaag

SEQ ID NO: 9471107 - DNA, 22 bp, Homo sapiens
ttatacaggagattccttactt

SEQ ID NO: 9471108 - DNA, 22 bp, Homo sapiens
ttatacaggagattccttactt

SEQ ID NO: 9471109 - DNA, 22 bp, Homo sapiens
ttatacagtttatacttagaat

SEQ ID NO: 9471110 - DNA, 22 bp, Homo sapiens
ttatacagggagtttccctgca

SEQ ID NO: 9471111 - DNA, 22 bp, Homo sapiens
ttatacagggagtttccctgca

SEQ ID NO: 9471112 - DNA, 23 bp, Homo sapiens
ttatgcaagcttcctggtctcag

SEQ ID NO: 9471113 - DNA, 22 bp, Homo sapiens
ttatgcaaggacttattacagt

SEQ ID NO: 9471114 - DNA, 22 bp, Homo sapiens
ttataattctggcataggctgt

SEQ ID NO: 9471115 - DNA, 22 bp, Homo sapiens
ttataattctggcataggctgt

SEQ ID NO: 9471116 - DNA, 22 bp, Homo sapiens
ttataattctggcataggctgt

SEQ ID NO: 9471117 - DNA, 22 bp, Homo sapiens
ttataattgcttattagaccca

SEQ ID NO: 9471118 - DNA, 22 bp, Homo sapiens
ttatacagcattgctagtgatg

SEQ ID NO: 9471119 - DNA, 22 bp, Homo sapiens
ttatacacgtttatggagctac

SEQ ID NO: 9471120 - DNA, 22 bp, Homo sapiens
ttatggaaatgaaattttattg

SEQ ID NO: 9471121 - DNA, 22 bp, Homo sapiens
ttatggaaaatacaattataag

SEQ ID NO: 9471122 - DNA, 22 bp, Homo sapiens
ttatggaagtgcaaattgtgtg

SEQ ID NO: 9471123 - DNA, 22 bp, Homo sapiens
ttatggaataacctttctgaaa

SEQ ID NO: 9471124 - DNA, 22 bp, Homo sapiens
ttatggaaaatacaattataag

SEQ ID NO: 9471125 - DNA, 22 bp, Homo sapiens
ttatggaaaatacaattataag

SEQ ID NO: 9471126 - DNA, 22 bp, Homo sapiens
ttatggaagtgcaaattgtgtg

SEQ ID NO: 9471127 - DNA, 22 bp, Homo sapiens
ttatgcttaaaatcactaggat

SEQ ID NO: 9471128 - DNA, 22 bp, Homo sapiens
ttatgctagttgaaataacaca

SEQ ID NO: 9471129 - DNA, 22 bp, Homo sapiens
ttatgctgttaggaaaatcaaa

SEQ ID NO: 9471130 - DNA, 22 bp, Homo sapiens
ttatggaaaactccagagagta

SEQ ID NO: 9471131 - DNA, 22 bp, Homo sapiens
ttatgctaagtgaaataagcca

SEQ ID NO: 9471132 - DNA, 22 bp, Homo sapiens
ttatgctaacctcatcttctcc

SEQ ID NO: 9471133 - DNA, 22 bp, Homo sapiens
ttatgctaagtggaataagcca

SEQ ID NO: 9471134 - DNA, 22 bp, Homo sapiens
ttatgctagtatagtccttaga

SEQ ID NO: 9471135 - DNA, 22 bp, Homo sapiens
ttatgcatgagataaaaattgg

SEQ ID NO: 9471136 - DNA, 22 bp, Homo sapiens
ttatgcctccgaaacctggagt

SEQ ID NO: 9471137 - DNA, 22 bp, Homo sapiens
ttatgcaggtacatgctgaaaa

SEQ ID NO: 9471138 - DNA, 22 bp, Homo sapiens
ttatgcatatagcagatacgag

SEQ ID NO: 9471139 - DNA, 22 bp, Homo sapiens
ttatgcagatggcatgaggagg

SEQ ID NO: 9471140 - DNA, 22 bp, Homo sapiens
ttatgtcttaagtatgctaatt

SEQ ID NO: 9471141 - DNA, 22 bp, Homo sapiens
ttatgtcttaagtatgctaatt

SEQ ID NO: 9471142 - DNA, 22 bp, Homo sapiens
ttatgtgtgtacatgcatatgt

SEQ ID NO: 9471143 - DNA, 22 bp, Homo sapiens
ttatgttatgaatggatgatct

SEQ ID NO: 9471144 - DNA, 22 bp, Homo sapiens
ttatggaatggagaaagtctgc

SEQ ID NO: 9471145 - DNA, 22 bp, Homo sapiens
ttatggaatacttatgctgcag

SEQ ID NO: 9471146 - DNA, 22 bp, Homo sapiens
ttatggaatttgcaaaaggtta

SEQ ID NO: 9471147 - DNA, 21 bp, Homo sapiens
ttatggagaaggaaagtaagg

SEQ ID NO: 9471148 - DNA, 22 bp, Homo sapiens
ttatggaatggagaaagtctgc

SEQ ID NO: 9471149 - DNA, 22 bp, Homo sapiens
ttatggaatttgcaaaaggtta

SEQ ID NO: 9471150 - DNA, 23 bp, Homo sapiens
ttatggagtgccagacatttggc

SEQ ID NO: 9471151 - DNA, 22 bp, Homo sapiens
ttatggagtgcttacctgccag

SEQ ID NO: 9471152 - DNA, 22 bp, Homo sapiens
ttatggagcagacagctggtca

SEQ ID NO: 9471153 - DNA, 22 bp, Homo sapiens
ttatggagactttcagaagcgg

SEQ ID NO: 9471154 - DNA, 22 bp, Homo sapiens
ttagtgtgtccagttctgaaaa

SEQ ID NO: 9471155 - DNA, 22 bp, Homo sapiens
ttagtgtgcatggatctgtgga

SEQ ID NO: 9471156 - DNA, 22 bp, Homo sapiens
ttagtgtgtccagttctgaaaa

SEQ ID NO: 9471157 - DNA, 22 bp, Homo sapiens
ttagtgtctggctatatttaaa

SEQ ID NO: 9471158 - DNA, 22 bp, Homo sapiens
ttagtgtcttcttcatcctctg

SEQ ID NO: 9471159 - DNA, 22 bp, Homo sapiens
ttagtgtctggctatatttaaa

SEQ ID NO: 9471160 - DNA, 22 bp, Homo sapiens
ttagtgtctttcaaaaggttta

SEQ ID NO: 9471161 - DNA, 22 bp, Homo sapiens
ttagttaaaattctgctgacat

SEQ ID NO: 9471162 - DNA, 22 bp, Homo sapiens
ttagttaaaattctgctgacat

SEQ ID NO: 9471163 - DNA, 22 bp, Homo sapiens
ttagtgtttaaaggtttcagag

SEQ ID NO: 9471164 - DNA, 22 bp, Homo sapiens
ttagttaattgactatgttgca

SEQ ID NO: 9471165 - DNA, 22 bp, Homo sapiens
ttagtgttcacagccactctat

SEQ ID NO: 9471166 - DNA, 22 bp, Homo sapiens
ttagtgttagggcctgttacct

SEQ ID NO: 9471167 - DNA, 22 bp, Homo sapiens
ttagtggtactcagggagggaa

SEQ ID NO: 9471168 - DNA, 22 bp, Homo sapiens
ttagtggtaaggatgaaatttc

SEQ ID NO: 9471169 - DNA, 22 bp, Homo sapiens
ttagtgctcatccagatggggg

SEQ ID NO: 9471170 - DNA, 22 bp, Homo sapiens
ttagtgcttctgtccaaatata

SEQ ID NO: 9471171 - DNA, 22 bp, Homo sapiens
ttagtggagagttattatcagc

SEQ ID NO: 9471172 - DNA, 22 bp, Homo sapiens
ttagtggagagttattatcagc

SEQ ID NO: 9471173 - DNA, 22 bp, Homo sapiens
ttagtgtattttcaaatgtaga

SEQ ID NO: 9471174 - DNA, 22 bp, Homo sapiens
ttagtgtctacctttatctaaa

SEQ ID NO: 9471175 - DNA, 17 bp, Homo sapiens
ttagtgtatctgttttg

SEQ ID NO: 9471176 - DNA, 22 bp, Homo sapiens
ttagtgtacttagtgctctaag

SEQ ID NO: 9471177 - DNA, 17 bp, Homo sapiens
ttagtgtatctgttttg

SEQ ID NO: 9471178 - DNA, 23 bp, Homo sapiens
ttagtgtaaggcaggcacagttg

SEQ ID NO: 9471179 - DNA, 23 bp, Homo sapiens
ttagtgtaaggcaggcacagttg

SEQ ID NO: 9471180 - DNA, 22 bp, Homo sapiens
ttagtgtaaattgtgcttgaga

SEQ ID NO: 9471181 - DNA, 22 bp, Homo sapiens
ttagtgtacttagtgctctaag

SEQ ID NO: 9471182 - DNA, 22 bp, Homo sapiens
tcctctggcccagctgcctctg

SEQ ID NO: 9471183 - DNA, 22 bp, Homo sapiens
tcctctggcccagctgcctctg

SEQ ID NO: 9471184 - DNA, 22 bp, Homo sapiens
tcctctggcccagctgcctctg

SEQ ID NO: 9471185 - DNA, 22 bp, Homo sapiens
tcctctggcccagctgcctctg

SEQ ID NO: 9471186 - DNA, 22 bp, Homo sapiens
tcctctggatataagcctcacc

SEQ ID NO: 9471187 - DNA, 22 bp, Homo sapiens
tcctctggccttggaatccttt

SEQ ID NO: 9471188 - DNA, 22 bp, Homo sapiens
tcctctggctctttccctagga

SEQ ID NO: 9471189 - DNA, 21 bp, Homo sapiens
tcctctgctctcataccacaa

SEQ ID NO: 9471190 - DNA, 22 bp, Homo sapiens
tcctctggatataagcctcacc

SEQ ID NO: 9471191 - DNA, 20 bp, Homo sapiens
tcctccttgcagagcccaga

SEQ ID NO: 9471192 - DNA, 21 bp, Homo sapiens
tcctccttcaagtcctggcct

SEQ ID NO: 9471193 - DNA, 19 bp, Homo sapiens
tcctccttacttcctcttg

SEQ ID NO: 9471194 - DNA, 19 bp, Homo sapiens
tcctccttacttcctcttg

SEQ ID NO: 9471195 - DNA, 22 bp, Homo sapiens
tcctcctgtttctcaggcctgg

SEQ ID NO: 9471196 - DNA, 21 bp, Homo sapiens
tcctcctgtagagggtcctgg

SEQ ID NO: 9471197 - DNA, 21 bp, Homo sapiens
tcctcctgtagagggtcctgg

SEQ ID NO: 9471198 - DNA, 21 bp, Homo sapiens
tcctcctggccaggcggcccc

SEQ ID NO: 9471199 - DNA, 21 bp, Homo sapiens
tcctcctgtagagggtcctgg

SEQ ID NO: 9471200 - DNA, 22 bp, Homo sapiens
tcctcctgtttctcaggcctgg

SEQ ID NO: 9471201 - DNA, 22 bp, Homo sapiens
tcctcctgtttctcaggcctgg

SEQ ID NO: 9471202 - DNA, 22 bp, Homo sapiens
tcctcctgtctaccagttcctg

SEQ ID NO: 9471203 - DNA, 22 bp, Homo sapiens
tcctcctgtctaccagttcctg

SEQ ID NO: 9471204 - DNA, 22 bp, Homo sapiens
tcctcctgtctaccagttcctg

SEQ ID NO: 9471205 - DNA, 22 bp, Homo sapiens
tcctcctgtctaccagttcctg

SEQ ID NO: 9471206 - DNA, 22 bp, Homo sapiens
tcctctccagcaaactggctat

SEQ ID NO: 9471207 - DNA, 22 bp, Homo sapiens
tcctctactcgcttgccctttg

SEQ ID NO: 9471208 - DNA, 20 bp, Homo sapiens
tcctctaattttaagctgta

SEQ ID NO: 9471209 - DNA, 23 bp, Homo sapiens
tcctcgcaggagggagatgatgc

SEQ ID NO: 9471210 - DNA, 23 bp, Homo sapiens
tcctcgcaggagggagatgatgc

SEQ ID NO: 9471211 - DNA, 23 bp, Homo sapiens
tcctcgcaggagggagatgatgc

SEQ ID NO: 9471212 - DNA, 22 bp, Homo sapiens
ttatttaaaagtggtaagattc

SEQ ID NO: 9471213 - DNA, 22 bp, Homo sapiens
ttatttaaaagtggtaagattc

SEQ ID NO: 9471214 - DNA, 22 bp, Homo sapiens
ttatttaaaagtggtaagattc

SEQ ID NO: 9471215 - DNA, 22 bp, Homo sapiens
ttatttaatgtgatctgaagag

SEQ ID NO: 9471216 - DNA, 22 bp, Homo sapiens
ttatttaatgtgatctgaagag

SEQ ID NO: 9471217 - DNA, 22 bp, Homo sapiens
ttattgtttgggtataatttga

SEQ ID NO: 9471218 - DNA, 22 bp, Homo sapiens
ttattgtttgggtataatttga

SEQ ID NO: 9471219 - DNA, 22 bp, Homo sapiens
ttattgtttgggtataatttga

SEQ ID NO: 9471220 - DNA, 22 bp, Homo sapiens
ttattgtttgggtataatttga

SEQ ID NO: 9471221 - DNA, 22 bp, Homo sapiens
ttattgtttactagtttgcaga

SEQ ID NO: 9471222 - DNA, 22 bp, Homo sapiens
ttattgtttgggtataatttga

SEQ ID NO: 9471223 - DNA, 22 bp, Homo sapiens
ttattgtttgggtataatttga

SEQ ID NO: 9471224 - DNA, 22 bp, Homo sapiens
ttattgtttgggtataatttga

SEQ ID NO: 9471225 - DNA, 22 bp, Homo sapiens
ttattgtttgggtataatttga

SEQ ID NO: 9471226 - DNA, 22 bp, Homo sapiens
ttattgttagtgagactgtaga

SEQ ID NO: 9471227 - DNA, 22 bp, Homo sapiens
ttattgtttaaagccatgtaaa

SEQ ID NO: 9471228 - DNA, 22 bp, Homo sapiens
ttattgttagtgagactgtaga

SEQ ID NO: 9471229 - DNA, 22 bp, Homo sapiens
ttatgtttgagtatatgactca

SEQ ID NO: 9471230 - DNA, 22 bp, Homo sapiens
ttatgttttatggctatatcat

SEQ ID NO: 9471231 - DNA, 22 bp, Homo sapiens
ttatgtttgagtatatgactca

SEQ ID NO: 9471232 - DNA, 22 bp, Homo sapiens
ttatttactggatggccttggg

SEQ ID NO: 9471233 - DNA, 22 bp, Homo sapiens
ttatttacaactcttctcttcc

SEQ ID NO: 9471234 - DNA, 22 bp, Homo sapiens
ttatttacaactcttctcttcc

SEQ ID NO: 9471235 - DNA, 22 bp, Homo sapiens
ttatttacaactcttctcttcc

SEQ ID NO: 9471236 - DNA, 22 bp, Homo sapiens
ttatttaattttctcactcaga

SEQ ID NO: 9471237 - DNA, 22 bp, Homo sapiens
ttatttaatgtgatctgaagag

SEQ ID NO: 9471238 - DNA, 22 bp, Homo sapiens
ttatttaatgtgatctgaagag

SEQ ID NO: 9471239 - DNA, 22 bp, Homo sapiens
ttatttgtggcatccatgttgg

SEQ ID NO: 9471240 - DNA, 22 bp, Homo sapiens
ttatttgtggcatatgagacga

SEQ ID NO: 9471241 - DNA, 22 bp, Homo sapiens
ttatttgtggcatatgagacga

SEQ ID NO: 9471242 - DNA, 22 bp, Homo sapiens
ttatttgtggcatatgagacga

SEQ ID NO: 9471243 - DNA, 20 bp, Homo sapiens
ttatttgtttactttggtcc

SEQ ID NO: 9471244 - DNA, 20 bp, Homo sapiens
ttatttgtttactttggtcc

SEQ ID NO: 9471245 - DNA, 22 bp, Homo sapiens
ttatttatatctctgcagttta

SEQ ID NO: 9471246 - DNA, 22 bp, Homo sapiens
ttatttatatctctgcagttta

SEQ ID NO: 9471247 - DNA, 22 bp, Homo sapiens
ttatttatatctctgcagttta

SEQ ID NO: 9471248 - DNA, 22 bp, Homo sapiens
ttatttatatctctgcagttta

SEQ ID NO: 9471249 - DNA, 22 bp, Homo sapiens
ttatttatggcactgttggtgg

SEQ ID NO: 9471250 - DNA, 22 bp, Homo sapiens
ttattttggtaaatgtttgcct

SEQ ID NO: 9471251 - DNA, 22 bp, Homo sapiens
ttattttggtaaatgtttgcct

SEQ ID NO: 9471252 - DNA, 22 bp, Homo sapiens
ttattttgtagctctgatcttt

SEQ ID NO: 9471253 - DNA, 23 bp, Homo sapiens
ttcaaaactggaaaatcagatgc

SEQ ID NO: 9471254 - DNA, 21 bp, Homo sapiens
ttcaaaatggtgtgtttgtct

SEQ ID NO: 9471255 - DNA, 21 bp, Homo sapiens
ttcaaaatggtgtgtttgtct

SEQ ID NO: 9471256 - DNA, 21 bp, Homo sapiens
ttcaaaatggtgtgtttgtct

SEQ ID NO: 9471257 - DNA, 22 bp, Homo sapiens
ttcaaaagcggtccaggaagat

SEQ ID NO: 9471258 - DNA, 22 bp, Homo sapiens
ttattttctcctcagaaagtgg

SEQ ID NO: 9471259 - DNA, 22 bp, Homo sapiens
ttattttctcctcagaaagtgg

SEQ ID NO: 9471260 - DNA, 22 bp, Homo sapiens
ttattttctcctcagaaagtgg

SEQ ID NO: 9471261 - DNA, 22 bp, Homo sapiens
ttattttgagagaatgtgtgct

SEQ ID NO: 9471262 - DNA, 22 bp, Homo sapiens
ttattttgccacaggtgacctt

SEQ ID NO: 9471263 - DNA, 22 bp, Homo sapiens
ttattttggtaaatgtttgcct

SEQ ID NO: 9471264 - DNA, 22 bp, Homo sapiens
ttattttggtaaatgtttgcct

SEQ ID NO: 9471265 - DNA, 22 bp, Homo sapiens
ttattttaccttcctctgagct

SEQ ID NO: 9471266 - DNA, 22 bp, Homo sapiens
ttattttaccttcctctgagct

SEQ ID NO: 9471267 - DNA, 22 bp, Homo sapiens
ttattttaccttcctctgagct

SEQ ID NO: 9471268 - DNA, 22 bp, Homo sapiens
ttattttaccttcctctgagct

SEQ ID NO: 9471269 - DNA, 22 bp, Homo sapiens
ttattttcagctaggaaagcca

SEQ ID NO: 9471270 - DNA, 22 bp, Homo sapiens
ttattttcagctaggaaagcca

SEQ ID NO: 9471271 - DNA, 22 bp, Homo sapiens
ttattttctcctcagaaagtgg

SEQ ID NO: 9471272 - DNA, 22 bp, Homo sapiens
ttattttctcctcagaaagtgg

SEQ ID NO: 9471273 - DNA, 22 bp, Homo sapiens
ttcaagatcttccaaaggatac

SEQ ID NO: 9471274 - DNA, 22 bp, Homo sapiens
ttcaagatcgagtttaaagtga

SEQ ID NO: 9471275 - DNA, 22 bp, Homo sapiens
ttcaagatccagcacaacagtg

SEQ ID NO: 9471276 - DNA, 22 bp, Homo sapiens
ttcaaggagattggagtctact

SEQ ID NO: 9471277 - DNA, 21 bp, Homo sapiens
ttcaagatatttaaaaggtgg

SEQ ID NO: 9471278 - DNA, 22 bp, Homo sapiens
ttcaagataataggaatgaaaa

SEQ ID NO: 9471279 - DNA, 22 bp, Homo sapiens
ttcaagaaggtacatttacatc

SEQ ID NO: 9471280 - DNA, 22 bp, Homo sapiens
ttcaaacaaaactctttcctat

SEQ ID NO: 9471281 - DNA, 22 bp, Homo sapiens
ttcaaacaaaactctttcctat

SEQ ID NO: 9471282 - DNA, 22 bp, Homo sapiens
ttcaaaattgttctaagctctg

SEQ ID NO: 9471283 - DNA, 22 bp, Homo sapiens
ttcaaaattgttctaagctctg

SEQ ID NO: 9471284 - DNA, 21 bp, Homo sapiens
ttcaaaatggtgtgtttgtct

SEQ ID NO: 9471285 - DNA, 22 bp, Homo sapiens
ttcatacatttttactaacagc

SEQ ID NO: 9471286 - DNA, 22 bp, Homo sapiens
ttcatacatttttactaacagc

SEQ ID NO: 9471287 - DNA, 22 bp, Homo sapiens
ttcatactcactccaataactg

SEQ ID NO: 9471288 - DNA, 22 bp, Homo sapiens
ttcatactgtgtttccaagttt

SEQ ID NO: 9471289 - DNA, 22 bp, Homo sapiens
ttcatactgtgtttccaagttt

SEQ ID NO: 9471290 - DNA, 22 bp, Homo sapiens
ttcatagagcagctcactgaat

SEQ ID NO: 9471291 - DNA, 23 bp, Homo sapiens
ttcatagagagatggtgagaatt

SEQ ID NO: 9471292 - DNA, 22 bp, Homo sapiens
ttcatagaaagtgcttagattg

SEQ ID NO: 9471293 - DNA, 22 bp, Homo sapiens
ttcatactgtttaagttctgtt

SEQ ID NO: 9471294 - DNA, 22 bp, Homo sapiens
ttcatacaatgggatattatga

SEQ ID NO: 9471295 - DNA, 23 bp, Homo sapiens
ttcatacagaaacatcacttcat

SEQ ID NO: 9471296 - DNA, 22 bp, Homo sapiens
ttcatacagtggctgcactcca

SEQ ID NO: 9471297 - DNA, 22 bp, Homo sapiens
ttcatacatgtgtactgttcca

SEQ ID NO: 9471298 - DNA, 22 bp, Homo sapiens
ttcatacatgtgtactgttcca

SEQ ID NO: 9471299 - DNA, 22 bp, Homo sapiens
ttcatacatgtgtactgttcca

SEQ ID NO: 9471300 - DNA, 22 bp, Homo sapiens
ttcagaatgacttatgtaaggc

SEQ ID NO: 9471301 - DNA, 22 bp, Homo sapiens
ttcagaatctatgtgccagctc

SEQ ID NO: 9471302 - DNA, 22 bp, Homo sapiens
ttcagacaggcagctgggctgg

SEQ ID NO: 9471303 - DNA, 19 bp, Homo sapiens
ttcagacagactaggtata

SEQ ID NO: 9471304 - DNA, 22 bp, Homo sapiens
ttcagacacagcgctgggaaat

SEQ ID NO: 9471305 - DNA, 22 bp, Homo sapiens
ttcatattgcttccgtggagtg

SEQ ID NO: 9471306 - DNA, 22 bp, Homo sapiens
ttcatattgcttccgtggagtg

SEQ ID NO: 9471307 - DNA, 22 bp, Homo sapiens
ttcatattcaaatactctgctt

SEQ ID NO: 9471308 - DNA, 22 bp, Homo sapiens
ttcatattttctgcttgctcac

SEQ ID NO: 9471309 - DNA, 22 bp, Homo sapiens
ttcatcaatgtgtttaataatg

SEQ ID NO: 9471310 - DNA, 20 bp, Homo sapiens
ttcatcagcaaagcacagca

SEQ ID NO: 9471311 - DNA, 22 bp, Homo sapiens
ttcatcaatgtgtttaataatg

SEQ ID NO: 9471312 - DNA, 22 bp, Homo sapiens
ttcatattatgatttgaaatgc

SEQ ID NO: 9471313 - DNA, 22 bp, Homo sapiens
ttcatattatgatttgaaatgc

SEQ ID NO: 9471314 - DNA, 22 bp, Homo sapiens
ttcatattatgatttgaaatgc

SEQ ID NO: 9471315 - DNA, 22 bp, Homo sapiens
ttcatattatgatttgaaatgc

SEQ ID NO: 9471316 - DNA, 22 bp, Homo sapiens
ttcatattcaaatactctgctt

SEQ ID NO: 9471317 - DNA, 22 bp, Homo sapiens
ttcatattcaaatactctgctt

SEQ ID NO: 9471318 - DNA, 22 bp, Homo sapiens
ttcatatatatgcactacgtac

SEQ ID NO: 9471319 - DNA, 22 bp, Homo sapiens
ttcatatgcagattaacaaata

SEQ ID NO: 9471320 - DNA, 22 bp, Homo sapiens
ttcatatgtgaactcagtgatg

SEQ ID NO: 9471321 - DNA, 22 bp, Homo sapiens
ttcatataaatggaatcagaat

SEQ ID NO: 9471322 - DNA, 22 bp, Homo sapiens
ttcatagtgacatgcattctgg

SEQ ID NO: 9471323 - DNA, 22 bp, Homo sapiens
ttcataggcagcactggctcct

SEQ ID NO: 9471324 - DNA, 22 bp, Homo sapiens
ttcatagtgcttaatttgataa

SEQ ID NO: 9471325 - DNA, 22 bp, Homo sapiens
ttcatagtgcttaatttgataa

SEQ ID NO: 9471326 - DNA, 22 bp, Homo sapiens
ttcatagtgtttccttccagtg

SEQ ID NO: 9471327 - DNA, 22 bp, Homo sapiens
ttcatagtgtttccttccagtg

SEQ ID NO: 9471328 - DNA, 22 bp, Homo sapiens
ttcatagtgtttccttccagtg

SEQ ID NO: 9471329 - DNA, 22 bp, Homo sapiens
ttcatagttcagcaaaagagaa

SEQ ID NO: 9471330 - DNA, 22 bp, Homo sapiens
ttcatataaatggaatcagaat

SEQ ID NO: 9471331 - DNA, 22 bp, Homo sapiens
ttcatataaatggaatcagaat

SEQ ID NO: 9471332 - DNA, 22 bp, Homo sapiens
ttcagaaggattttaacacatg

SEQ ID NO: 9471333 - DNA, 22 bp, Homo sapiens
ttcagaaggattttaacacatg

SEQ ID NO: 9471334 - DNA, 22 bp, Homo sapiens
ttcagaaggtaggaatgtccct

SEQ ID NO: 9471335 - DNA, 22 bp, Homo sapiens
ttcagaaggtgcagcctgggcc

SEQ ID NO: 9471336 - DNA, 22 bp, Homo sapiens
ttcagaaggtaggaatgtccct

SEQ ID NO: 9471337 - DNA, 22 bp, Homo sapiens
ttcagaaggtgcagcctgggcc

SEQ ID NO: 9471338 - DNA, 22 bp, Homo sapiens
ttcagaactgtctgtccttttc

SEQ ID NO: 9471339 - DNA, 17 bp, Homo sapiens
ttcagaagcattttggc

SEQ ID NO: 9471340 - DNA, 22 bp, Homo sapiens
ttcagaagttttcaaaactaag

SEQ ID NO: 9471341 - DNA, 21 bp, Homo sapiens
ttcagaagttgagggcaggtt

SEQ ID NO: 9471342 - DNA, 22 bp, Homo sapiens
ttcagaagtagctaagcagtca

SEQ ID NO: 9471343 - DNA, 22 bp, Homo sapiens
ttcagaacaaccatggttagat

SEQ ID NO: 9471344 - DNA, 22 bp, Homo sapiens
ttcagaaattcatggagttcag

SEQ ID NO: 9471345 - DNA, 22 bp, Homo sapiens
ttcagaacaatatgaacagaac

SEQ ID NO: 9471346 - DNA, 22 bp, Homo sapiens
ttcagaaatccctcttctaccc

SEQ ID NO: 9471347 - DNA, 22 bp, Homo sapiens
ttcagaaatccctcttctaccc

SEQ ID NO: 9471348 - DNA, 22 bp, Homo sapiens
ttcagaaatcgagtttcatgtc

SEQ ID NO: 9471349 - DNA, 22 bp, Homo sapiens
ttcagaaatcgagtttcatgtc

SEQ ID NO: 9471350 - DNA, 22 bp, Homo sapiens
ttcactgtgaactcatattcag

SEQ ID NO: 9471351 - DNA, 22 bp, Homo sapiens
ttcactgtcctgcaactctaga

SEQ ID NO: 9471352 - DNA, 22 bp, Homo sapiens
ttcagaaatccctcttctaccc

SEQ ID NO: 9471353 - DNA, 22 bp, Homo sapiens
ttcagaaataaaatatcccaac

SEQ ID NO: 9471354 - DNA, 22 bp, Homo sapiens
ttcaagtcatgttaactgcttc

SEQ ID NO: 9471355 - DNA, 22 bp, Homo sapiens
ttcaagtcaatttttgaatgac

SEQ ID NO: 9471356 - DNA, 22 bp, Homo sapiens
ttcaatatctctaagaatgagg

SEQ ID NO: 9471357 - DNA, 22 bp, Homo sapiens
ttcaatatctctaagaatgagg

SEQ ID NO: 9471358 - DNA, 22 bp, Homo sapiens
ttcaatatctctaagaatgagg

SEQ ID NO: 9471359 - DNA, 22 bp, Homo sapiens
ttcaatatcattgtttagtctc

SEQ ID NO: 9471360 - DNA, 22 bp, Homo sapiens
ttcaaggtaagtatgagaaagc

SEQ ID NO: 9471361 - DNA, 22 bp, Homo sapiens
ttcaaggtaagtatgagaaagc

SEQ ID NO: 9471362 - DNA, 22 bp, Homo sapiens
ttcaaggttcagggagaaattg

SEQ ID NO: 9471363 - DNA, 22 bp, Homo sapiens
ttcaatatgatattagctgtgg

SEQ ID NO: 9471364 - DNA, 22 bp, Homo sapiens
ttcaatcattagaatctcaggc

SEQ ID NO: 9471365 - DNA, 22 bp, Homo sapiens
ttcaatcattagaatctcaggc

SEQ ID NO: 9471366 - DNA, 22 bp, Homo sapiens
ttcaatatctctaagaatgagg

SEQ ID NO: 9471367 - DNA, 22 bp, Homo sapiens
ttcaatatctctaagaatgagg

SEQ ID NO: 9471368 - DNA, 22 bp, Homo sapiens
ttcaatatgatattagctgtgg

SEQ ID NO: 9471369 - DNA, 20 bp, Homo sapiens
ttcaatatgaccctggggag

SEQ ID NO: 9471370 - DNA, 22 bp, Homo sapiens
ttcaatatgatattagctgtgg

SEQ ID NO: 9471371 - DNA, 17 bp, Homo sapiens
ttcaatgattaatgcat

SEQ ID NO: 9471372 - DNA, 17 bp, Homo sapiens
ttcaatgattaatgcat

SEQ ID NO: 9471373 - DNA, 22 bp, Homo sapiens
ttcaatcattgcaaagtaatgg

SEQ ID NO: 9471374 - DNA, 22 bp, Homo sapiens
ttcaatcatttttacatagtcc

SEQ ID NO: 9471375 - DNA, 22 bp, Homo sapiens
ttcaatgagcccaagaacgtga

SEQ ID NO: 9471376 - DNA, 22 bp, Homo sapiens
ttccaaaacaatattctgtgaa

SEQ ID NO: 9471377 - DNA, 22 bp, Homo sapiens
ttccaaaacaatattctgtgaa

SEQ ID NO: 9471378 - DNA, 22 bp, Homo sapiens
ttccaaaacaatattctgtgaa

SEQ ID NO: 9471379 - DNA, 22 bp, Homo sapiens
ttccaaaacaatattctgtgaa

SEQ ID NO: 9471380 - DNA, 19 bp, Homo sapiens
ttccaaaatcaggatttga

SEQ ID NO: 9471381 - DNA, 19 bp, Homo sapiens
ttccaaaatcaggatttga

SEQ ID NO: 9471382 - DNA, 19 bp, Homo sapiens
ttccaaaatcaggatttga

SEQ ID NO: 9471383 - DNA, 19 bp, Homo sapiens
ttccaaaatcaggatttga

SEQ ID NO: 9471384 - DNA, 22 bp, Homo sapiens
ttcatttttaccgcgtgtcaaa

SEQ ID NO: 9471385 - DNA, 22 bp, Homo sapiens
ttcatcaggcatcatgctcaag

SEQ ID NO: 9471386 - DNA, 21 bp, Homo sapiens
ttcatcagccagaaatcaagc

SEQ ID NO: 9471387 - DNA, 21 bp, Homo sapiens
ttcatcagccagaaatcaagc

SEQ ID NO: 9471388 - DNA, 22 bp, Homo sapiens
ttccaagagctttaattgttga

SEQ ID NO: 9471389 - DNA, 17 bp, Homo sapiens
ttccaaggagcatttga

SEQ ID NO: 9471390 - DNA, 22 bp, Homo sapiens
ttccaagagtaaattcaaattg

SEQ ID NO: 9471391 - DNA, 22 bp, Homo sapiens
ttccaaggcgatggcgcagaac

SEQ ID NO: 9471392 - DNA, 22 bp, Homo sapiens
ttccaaggattgaaatgtagtc

SEQ ID NO: 9471393 - DNA, 22 bp, Homo sapiens
ttccaatagtgtgaccttatag

SEQ ID NO: 9471394 - DNA, 22 bp, Homo sapiens
ttccaatagtgtgaccttatag

SEQ ID NO: 9471395 - DNA, 22 bp, Homo sapiens
ttccaatccaaacttcaccttt

SEQ ID NO: 9471396 - DNA, 22 bp, Homo sapiens
ttccaatccaaacttcaccttt

SEQ ID NO: 9471397 - DNA, 22 bp, Homo sapiens
ttccagtttgcagttgacacta

SEQ ID NO: 9471398 - DNA, 22 bp, Homo sapiens
ttccaattgcagatcagataca

SEQ ID NO: 9471399 - DNA, 21 bp, Homo sapiens
ttccagttttaattaaattgt

SEQ ID NO: 9471400 - DNA, 22 bp, Homo sapiens
ttccatatgtatatagctgtta

SEQ ID NO: 9471401 - DNA, 22 bp, Homo sapiens
ttccatacgactgaggtctcgg

SEQ ID NO: 9471402 - DNA, 18 bp, Homo sapiens
ttccataatgtatgtaac

SEQ ID NO: 9471403 - DNA, 22 bp, Homo sapiens
ttccataattaagtggagagaa

SEQ ID NO: 9471404 - DNA, 22 bp, Homo sapiens
ttccataatcaccttattcttt

SEQ ID NO: 9471405 - DNA, 22 bp, Homo sapiens
ttccataatcaccttattcttt

SEQ ID NO: 9471406 - DNA, 22 bp, Homo sapiens
ttccataatcaccttattcttt

SEQ ID NO: 9471407 - DNA, 22 bp, Homo sapiens
ttccataatgagattcccagcc

SEQ ID NO: 9471408 - DNA, 22 bp, Homo sapiens
ttccataaaggtgatagtatac

SEQ ID NO: 9471409 - DNA, 22 bp, Homo sapiens
ttccataaaggtgatagtatac

SEQ ID NO: 9471410 - DNA, 22 bp, Homo sapiens
ttccataataacctgagagaaa

SEQ ID NO: 9471411 - DNA, 22 bp, Homo sapiens
ttccaagtgttgagattagagg

SEQ ID NO: 9471412 - DNA, 22 bp, Homo sapiens
ttccaagtgtcagatcagattt

SEQ ID NO: 9471413 - DNA, 22 bp, Homo sapiens
ttccaagtgtcagatcagattt

SEQ ID NO: 9471414 - DNA, 22 bp, Homo sapiens
ttccaagtgtcagatcagattt

SEQ ID NO: 9471415 - DNA, 22 bp, Homo sapiens
ttccaataaaatgttatttgca

SEQ ID NO: 9471416 - DNA, 22 bp, Homo sapiens
ttccaagttaggcgagctggtg

SEQ ID NO: 9471417 - DNA, 22 bp, Homo sapiens
ttccaagtgttgagattagagg

SEQ ID NO: 9471418 - DNA, 22 bp, Homo sapiens
ttccaagtgaaagtagctttgt

SEQ ID NO: 9471419 - DNA, 22 bp, Homo sapiens
ttccaagtgcccatatttcatc

SEQ ID NO: 9471420 - DNA, 22 bp, Homo sapiens
ttccaagtgcccatatttcatc

SEQ ID NO: 9471421 - DNA, 22 bp, Homo sapiens
ttccaaggctaggttgtaaagg

SEQ ID NO: 9471422 - DNA, 22 bp, Homo sapiens
ttccaaggctaggttgtaaagg

SEQ ID NO: 9471423 - DNA, 22 bp, Homo sapiens
ttccaaggctgctatttgtttc

SEQ ID NO: 9471424 - DNA, 22 bp, Homo sapiens
ttccaagggaatgtttatgagt

SEQ ID NO: 9471425 - DNA, 22 bp, Homo sapiens
ttccaaggctgtcctcactttg

SEQ ID NO: 9471426 - DNA, 22 bp, Homo sapiens
ttcccagacctgtaggatcaga

SEQ ID NO: 9471427 - DNA, 22 bp, Homo sapiens
ttcccagactccacactgaggc

SEQ ID NO: 9471428 - DNA, 22 bp, Homo sapiens
ttcccagaattgttgggaactg

SEQ ID NO: 9471429 - DNA, 22 bp, Homo sapiens
ttccatgctaagacacgcaggg

SEQ ID NO: 9471430 - DNA, 21 bp, Homo sapiens
ttccattatctctcagccatc

SEQ ID NO: 9471431 - DNA, 22 bp, Homo sapiens
ttccattgagtacctggagaca

SEQ ID NO: 9471432 - DNA, 22 bp, Homo sapiens
ttccattggtaaaatgagagtg

SEQ ID NO: 9471433 - DNA, 19 bp, Homo sapiens
ttcccagagccatgagtga

SEQ ID NO: 9471434 - DNA, 19 bp, Homo sapiens
ttcccagagccatgagtga

SEQ ID NO: 9471435 - DNA, 22 bp, Homo sapiens
ttcccagaggagatttgcttat

SEQ ID NO: 9471436 - DNA, 22 bp, Homo sapiens
ttcccagaggagatttgcttat

SEQ ID NO: 9471437 - DNA, 22 bp, Homo sapiens
ttcccagagaaggatgaaaaag

SEQ ID NO: 9471438 - DNA, 22 bp, Homo sapiens
ttcccagagataagacgtctta

SEQ ID NO: 9471439 - DNA, 22 bp, Homo sapiens
ttccatgcaagaagtatggctc

SEQ ID NO: 9471440 - DNA, 22 bp, Homo sapiens
ttccatgcctctatttagaatt

SEQ ID NO: 9471441 - DNA, 22 bp, Homo sapiens
ttccatgagtagcagtatttcc

SEQ ID NO: 9471442 - DNA, 22 bp, Homo sapiens
ttccatccatgtcccgtttctg

SEQ ID NO: 9471443 - DNA, 22 bp, Homo sapiens
ttccatcattaacaccacaagg

SEQ ID NO: 9471444 - DNA, 22 bp, Homo sapiens
ttccatctttcagctttgttgg

SEQ ID NO: 9471445 - DNA, 22 bp, Homo sapiens
ttccatcctaataaaagaagtt

SEQ ID NO: 9471446 - DNA, 22 bp, Homo sapiens
ttccatctgctaggtaaatgaa

SEQ ID NO: 9471447 - DNA, 22 bp, Homo sapiens
ttccatctgagagctgtgaaga

SEQ ID NO: 9471448 - DNA, 17 bp, Homo sapiens
ttcccctgaccaagcct

SEQ ID NO: 9471449 - DNA, 22 bp, Homo sapiens
ttccccaggtgattctcatggc

SEQ ID NO: 9471450 - DNA, 22 bp, Homo sapiens
ttcccccacctggggtacagga

SEQ ID NO: 9471451 - DNA, 22 bp, Homo sapiens
ttcccctctcagatctggccta

SEQ ID NO: 9471452 - DNA, 22 bp, Homo sapiens
ttccccagtaacatacatgtga

SEQ ID NO: 9471453 - DNA, 22 bp, Homo sapiens
ttcccaggctgtgctaccagag

SEQ ID NO: 9471454 - DNA, 22 bp, Homo sapiens
ttcccagattggagggcagggg

SEQ ID NO: 9471455 - DNA, 21 bp, Homo sapiens
ttcccatcttttctgagtctg

SEQ ID NO: 9471456 - DNA, 22 bp, Homo sapiens
ttcccatcgtctccttcacctt

SEQ ID NO: 9471457 - DNA, 21 bp, Homo sapiens
ttccccaaggcctcaggggca

SEQ ID NO: 9471458 - DNA, 22 bp, Homo sapiens
ttcccatttgtggtagtgaatt

SEQ ID NO: 9471459 - DNA, 22 bp, Homo sapiens
ttccccaggctggagtgcagtg

SEQ ID NO: 9471460 - DNA, 22 bp, Homo sapiens
ttcccaggtaattctgaggcag

SEQ ID NO: 9471461 - DNA, 22 bp, Homo sapiens
ttcccaggtaattctgaggcag

SEQ ID NO: 9471462 - DNA, 22 bp, Homo sapiens
ttcccaggtaattctgaggcag

SEQ ID NO: 9471463 - DNA, 22 bp, Homo sapiens
ttcccagtgaggaagcaatgca

SEQ ID NO: 9471464 - DNA, 22 bp, Homo sapiens
ttttttcctgagccttgtggtc

SEQ ID NO: 9471465 - DNA, 22 bp, Homo sapiens
ttttttcctgagccttgtggtc

SEQ ID NO: 9471466 - DNA, 22 bp, Homo sapiens
ttttttcctctgtgatggcaaa

SEQ ID NO: 9471467 - DNA, 22 bp, Homo sapiens
ttttttcctctgtgatggcaaa

SEQ ID NO: 9471468 - DNA, 22 bp, Homo sapiens
ttttttcctctgtgatggcaaa

SEQ ID NO: 9471469 - DNA, 22 bp, Homo sapiens
ttttttccttcatgacttaaga

SEQ ID NO: 9471470 - DNA, 21 bp, Homo sapiens
ttttttcttgcgtgaggcctg

SEQ ID NO: 9471471 - DNA, 22 bp, Homo sapiens
ttttttccttcatgacttaaga

SEQ ID NO: 9471472 - DNA, 22 bp, Homo sapiens
ttttttcctgagccttgtggtc

SEQ ID NO: 9471473 - DNA, 22 bp, Homo sapiens
ttttttccttcatgacttaaga

SEQ ID NO: 9471474 - DNA, 22 bp, Homo sapiens
ttttttccagcttctagaggcc

SEQ ID NO: 9471475 - DNA, 22 bp, Homo sapiens
ttttttccagcttctagaggcc

SEQ ID NO: 9471476 - DNA, 22 bp, Homo sapiens
ttttttccagcttctagaggcc

SEQ ID NO: 9471477 - DNA, 22 bp, Homo sapiens
ttttttccagcttctagaggcc

SEQ ID NO: 9471478 - DNA, 22 bp, Homo sapiens
ttttttcctctgtgatggcaaa

SEQ ID NO: 9471479 - DNA, 22 bp, Homo sapiens
ttttttccaggaagccactgga

SEQ ID NO: 9471480 - DNA, 22 bp, Homo sapiens
ttttttccaggaagccactgga

SEQ ID NO: 9471481 - DNA, 21 bp, Homo sapiens
ttttttcttgcgtgaggcctg

SEQ ID NO: 9471482 - DNA, 21 bp, Homo sapiens
ttttttcttgcgtgaggcctg

SEQ ID NO: 9471483 - DNA, 21 bp, Homo sapiens
ttttttcttgcgtgaggcctg

SEQ ID NO: 9471484 - DNA, 22 bp, Homo sapiens
ttttttgcacactctgctaaat

SEQ ID NO: 9471485 - DNA, 22 bp, Homo sapiens
ttttgtatgagaagtgctttac

SEQ ID NO: 9471486 - DNA, 22 bp, Homo sapiens
ttttgtatagtcaaagacaaga

SEQ ID NO: 9471487 - DNA, 22 bp, Homo sapiens
ttttgtatagtcaaagacaaga

SEQ ID NO: 9471488 - DNA, 22 bp, Homo sapiens
ttttgtatgagaagtgctttac

SEQ ID NO: 9471489 - DNA, 22 bp, Homo sapiens
ttttgtatagtcaaagacaaga

SEQ ID NO: 9471490 - DNA, 22 bp, Homo sapiens
ttttgtaatttcctgacgacta

SEQ ID NO: 9471491 - DNA, 22 bp, Homo sapiens
ttttgtaatttcctgacgacta

SEQ ID NO: 9471492 - DNA, 22 bp, Homo sapiens
ttttgtaagaaactgccaagcc

SEQ ID NO: 9471493 - DNA, 22 bp, Homo sapiens
ttttgtaagaaactgccaagcc

SEQ ID NO: 9471494 - DNA, 22 bp, Homo sapiens
ttttgtaagaaactgccaagcc

SEQ ID NO: 9471495 - DNA, 22 bp, Homo sapiens
ttttgtgagatgcgtatgaatg

SEQ ID NO: 9471496 - DNA, 22 bp, Homo sapiens
ttttgtgacagaaagattaagt

SEQ ID NO: 9471497 - DNA, 22 bp, Homo sapiens
ttttgtgacacttcttgagaca

SEQ ID NO: 9471498 - DNA, 22 bp, Homo sapiens
ttttgtgacagaaagattaagt

SEQ ID NO: 9471499 - DNA, 22 bp, Homo sapiens
ttttgtgaatagtttatctaag

SEQ ID NO: 9471500 - DNA, 19 bp, Homo sapiens
ttttgtcttcccttagttt

SEQ ID NO: 9471501 - DNA, 22 bp, Homo sapiens
ttttgtgaatagtttatctaag

SEQ ID NO: 9471502 - DNA, 19 bp, Homo sapiens
ttttgtcttcccttagttt

SEQ ID NO: 9471503 - DNA, 22 bp, Homo sapiens
ttttgtctaagaactttgcaaa

SEQ ID NO: 9471504 - DNA, 22 bp, Homo sapiens
ttttgtctaagaactttgcaaa

SEQ ID NO: 9471505 - DNA, 22 bp, Homo sapiens
ttttgtctaagaactttgcaaa

SEQ ID NO: 9471506 - DNA, 22 bp, Homo sapiens
ttttgtgagcccataaatgcca

SEQ ID NO: 9471507 - DNA, 22 bp, Homo sapiens
ttttgtgagcccataaatgcca

SEQ ID NO: 9471508 - DNA, 22 bp, Homo sapiens
ttttgtgagctgagaaatgtat

SEQ ID NO: 9471509 - DNA, 19 bp, Homo sapiens
ttttgtgtagctgctggtt

SEQ ID NO: 9471510 - DNA, 22 bp, Homo sapiens
ttttgtgtagagatggggtctt

SEQ ID NO: 9471511 - DNA, 22 bp, Homo sapiens
ttttgtgatggcattacattta

SEQ ID NO: 9471512 - DNA, 22 bp, Homo sapiens
tttttgtagtcattagaagagg

SEQ ID NO: 9471513 - DNA, 22 bp, Homo sapiens
ttttgttgacctctcccacctt

SEQ ID NO: 9471514 - DNA, 22 bp, Homo sapiens
tttttgttcccagagaatttgt

SEQ ID NO: 9471515 - DNA, 22 bp, Homo sapiens
tttttgtggtgcagactaaagc

SEQ ID NO: 9471516 - DNA, 22 bp, Homo sapiens
tttttgtgtatcctgctccatg

SEQ ID NO: 9471517 - DNA, 22 bp, Homo sapiens
tttttgtgtatcctgctccatg

SEQ ID NO: 9471518 - DNA, 22 bp, Homo sapiens
ttttttccaacttaagacttca

SEQ ID NO: 9471519 - DNA, 22 bp, Homo sapiens
ttttttccaacttaagacttca

SEQ ID NO: 9471520 - DNA, 22 bp, Homo sapiens
ttttttccaacttaagacttca

SEQ ID NO: 9471521 - DNA, 22 bp, Homo sapiens
ttttttatctatggtagtacca

SEQ ID NO: 9471522 - DNA, 22 bp, Homo sapiens
ttttttatatcaactgaagtct

SEQ ID NO: 9471523 - DNA, 22 bp, Homo sapiens
ttttggtacctacagctgaatt

SEQ ID NO: 9471524 - DNA, 22 bp, Homo sapiens
ttttgtaagaaactgccaagcc

SEQ ID NO: 9471525 - DNA, 19 bp, Homo sapiens
ttttccttctatatgtttc

SEQ ID NO: 9471526 - DNA, 19 bp, Homo sapiens
ttttccttctatatgtttc

SEQ ID NO: 9471527 - DNA, 19 bp, Homo sapiens
ttttccttctatatgtttc

SEQ ID NO: 9471528 - DNA, 19 bp, Homo sapiens
ttttccttctatatgtttc

SEQ ID NO: 9471529 - DNA, 22 bp, Homo sapiens
ttttccttctagagcagatttc

SEQ ID NO: 9471530 - DNA, 18 bp, Homo sapiens
ttttccttccaccttgaa

SEQ ID NO: 9471531 - DNA, 18 bp, Homo sapiens
ttttccttccaccttgaa

SEQ ID NO: 9471532 - DNA, 22 bp, Homo sapiens
ttttccttctagagcagatttc

SEQ ID NO: 9471533 - DNA, 22 bp, Homo sapiens
ttttccttctagagcagatttc

SEQ ID NO: 9471534 - DNA, 22 bp, Homo sapiens
ttttccttctagagcagatttc

SEQ ID NO: 9471535 - DNA, 22 bp, Homo sapiens
ttttggtaaataatcaactttg

SEQ ID NO: 9471536 - DNA, 22 bp, Homo sapiens
ttttggctctgtctgtatcttt

SEQ ID NO: 9471537 - DNA, 22 bp, Homo sapiens
ttttcctctgtatgcgtgagat

SEQ ID NO: 9471538 - DNA, 22 bp, Homo sapiens
ttttcctctgcagagcagttag

SEQ ID NO: 9471539 - DNA, 22 bp, Homo sapiens
ttttcctctgagctttgaataa

SEQ ID NO: 9471540 - DNA, 22 bp, Homo sapiens
ttttcctctgcaataaaagcag

SEQ ID NO: 9471541 - DNA, 20 bp, Homo sapiens
ttttcctcgtgtttgttcta

SEQ ID NO: 9471542 - DNA, 20 bp, Homo sapiens
ttttcctcgtgtttgttcta

SEQ ID NO: 9471543 - DNA, 22 bp, Homo sapiens
ttttcctcaggaatgctaagct

SEQ ID NO: 9471544 - DNA, 20 bp, Homo sapiens
ttttcctcgtgtttgttcta

SEQ ID NO: 9471545 - DNA, 22 bp, Homo sapiens
ttttcctctgagctttgaataa

SEQ ID NO: 9471546 - DNA, 22 bp, Homo sapiens
ttttccttcacctcttgagcct

SEQ ID NO: 9471547 - DNA, 22 bp, Homo sapiens
ttttccttcacctcttgagcct

SEQ ID NO: 9471548 - DNA, 22 bp, Homo sapiens
ttttccttcacctcttgagcct

SEQ ID NO: 9471549 - DNA, 22 bp, Homo sapiens
ttttccttcatatcccttatgt

SEQ ID NO: 9471550 - DNA, 22 bp, Homo sapiens
ttttccttcatatcccttatgt

SEQ ID NO: 9471551 - DNA, 22 bp, Homo sapiens
ttttccttcacctcttgagcct

SEQ ID NO: 9471552 - DNA, 22 bp, Homo sapiens
ttttccttcatatcccttatgt

SEQ ID NO: 9471553 - DNA, 22 bp, Homo sapiens
ttttcctctgcagagcagttag

SEQ ID NO: 9471554 - DNA, 22 bp, Homo sapiens
ttttccttagcttctctgcgag

SEQ ID NO: 9471555 - DNA, 22 bp, Homo sapiens
ttttccttaacagagggagaaa

SEQ ID NO: 9471556 - DNA, 22 bp, Homo sapiens
ttttccttagcttctctgcgag

SEQ ID NO: 9471557 - DNA, 22 bp, Homo sapiens
ttttccttcacctcttgagcct

SEQ ID NO: 9471558 - DNA, 22 bp, Homo sapiens
ttttccttcacctcttgagcct

SEQ ID NO: 9471559 - DNA, 22 bp, Homo sapiens
ttttcctatatgcaaagaatgc

SEQ ID NO: 9471560 - DNA, 22 bp, Homo sapiens
ttttcctcacctaactcaaggt

SEQ ID NO: 9471561 - DNA, 22 bp, Homo sapiens
ttttcctagtaggcctattaga

SEQ ID NO: 9471562 - DNA, 22 bp, Homo sapiens
ttttcctactgataaacagtta

SEQ ID NO: 9471563 - DNA, 22 bp, Homo sapiens
ttttcctactgataaacagtta

SEQ ID NO: 9471564 - DNA, 22 bp, Homo sapiens
ttttccagagctgtctcttgca

SEQ ID NO: 9471565 - DNA, 22 bp, Homo sapiens
ttttccagatggatactagaat

SEQ ID NO: 9471566 - DNA, 21 bp, Homo sapiens
ttttcccactgaaagctccca

SEQ ID NO: 9471567 - DNA, 20 bp, Homo sapiens
tttgtctgttaagtgtttct

SEQ ID NO: 9471568 - DNA, 22 bp, Homo sapiens
tttgtctgttattgttctcatg

SEQ ID NO: 9471569 - DNA, 20 bp, Homo sapiens
tttgtctgttaagtgtttct

SEQ ID NO: 9471570 - DNA, 22 bp, Homo sapiens
tttgtctgttattgttctcatg

SEQ ID NO: 9471571 - DNA, 19 bp, Homo sapiens
tttgtctctgaataatatt

SEQ ID NO: 9471572 - DNA, 20 bp, Homo sapiens
tttgtctgttaagtgtttct

SEQ ID NO: 9471573 - DNA, 22 bp, Homo sapiens
tttgtccttgaatcaattcaca

SEQ ID NO: 9471574 - DNA, 22 bp, Homo sapiens
tttgtctaattgcaaggcaagt

SEQ ID NO: 9471575 - DNA, 22 bp, Homo sapiens
tttgtctataaattactactgc

SEQ ID NO: 9471576 - DNA, 22 bp, Homo sapiens
tttgtctacaaaaagtgtacag

SEQ ID NO: 9471577 - DNA, 22 bp, Homo sapiens
tttgtcttatccaatctctcag

SEQ ID NO: 9471578 - DNA, 22 bp, Homo sapiens
tttgtcttcatccttcgagctg

SEQ ID NO: 9471579 - DNA, 22 bp, Homo sapiens
tttgtcttatccaatctctcag

SEQ ID NO: 9471580 - DNA, 22 bp, Homo sapiens
tttgtcttcatccttcgagctg

SEQ ID NO: 9471581 - DNA, 22 bp, Homo sapiens
tttgtgagtgcacatgcccaca

SEQ ID NO: 9471582 - DNA, 22 bp, Homo sapiens
tttgtgatctcctccctctaga

SEQ ID NO: 9471583 - DNA, 22 bp, Homo sapiens
tttgtgattaattttcaacctc

SEQ ID NO: 9471584 - DNA, 19 bp, Homo sapiens
tttgtgcagcaacattaat

SEQ ID NO: 9471585 - DNA, 22 bp, Homo sapiens
tttgtgctgaagatccagagca

SEQ ID NO: 9471586 - DNA, 22 bp, Homo sapiens
ttttacagtcagtcaaactcag

SEQ ID NO: 9471587 - DNA, 22 bp, Homo sapiens
ttttacagttccatgcaaagcg

SEQ ID NO: 9471588 - DNA, 22 bp, Homo sapiens
ttttacagttccatgcaaagcg

SEQ ID NO: 9471589 - DNA, 22 bp, Homo sapiens
ttttacacttcggttgtgtgca

SEQ ID NO: 9471590 - DNA, 22 bp, Homo sapiens
ttttacacctcagatgagcaga

SEQ ID NO: 9471591 - DNA, 22 bp, Homo sapiens
ttttacacctcagatgagcaga

SEQ ID NO: 9471592 - DNA, 22 bp, Homo sapiens
ttttacaagctgagtcgttaaa

SEQ ID NO: 9471593 - DNA, 22 bp, Homo sapiens
tttgtgtaccttgtacatttgt

SEQ ID NO: 9471594 - DNA, 22 bp, Homo sapiens
tttgtggcaggagcggagaccg

SEQ ID NO: 9471595 - DNA, 23 bp, Homo sapiens
ttttaatttggacataagaagat

SEQ ID NO: 9471596 - DNA, 22 bp, Homo sapiens
ttttaattttagcccttctggt

SEQ ID NO: 9471597 - DNA, 22 bp, Homo sapiens
ttttacaagctgagtcgttaaa

SEQ ID NO: 9471598 - DNA, 22 bp, Homo sapiens
ttttacaagctgagtcgttaaa

SEQ ID NO: 9471599 - DNA, 22 bp, Homo sapiens
ttttacaaatgaggagctggag

SEQ ID NO: 9471600 - DNA, 22 bp, Homo sapiens
ttttattgggagtcctctactg

SEQ ID NO: 9471601 - DNA, 22 bp, Homo sapiens
ttttattgggagtcctctactg

SEQ ID NO: 9471602 - DNA, 22 bp, Homo sapiens
ttttattgggagtcctctactg

SEQ ID NO: 9471603 - DNA, 22 bp, Homo sapiens
ttttattgggagtcctctactg

SEQ ID NO: 9471604 - DNA, 22 bp, Homo sapiens
ttttagaagtgcctatcctatg

SEQ ID NO: 9471605 - DNA, 22 bp, Homo sapiens
ttttagaagtgcctatcctatg

SEQ ID NO: 9471606 - DNA, 22 bp, Homo sapiens
ttttattggtaatgataaaagt

SEQ ID NO: 9471607 - DNA, 22 bp, Homo sapiens
ttttattggtaatgataaaagt

SEQ ID NO: 9471608 - DNA, 22 bp, Homo sapiens
ttttattggtaatgataaaagt

SEQ ID NO: 9471609 - DNA, 22 bp, Homo sapiens
ttttattggtaatgataaaagt

SEQ ID NO: 9471610 - DNA, 22 bp, Homo sapiens
ttttattggtaatgataaaagt

SEQ ID NO: 9471611 - DNA, 22 bp, Homo sapiens
ttttattggtaatgataaaagt

SEQ ID NO: 9471612 - DNA, 22 bp, Homo sapiens
ttttattggtaatgataaaagt

SEQ ID NO: 9471613 - DNA, 22 bp, Homo sapiens
ttttattggtaatgataaaagt

SEQ ID NO: 9471614 - DNA, 22 bp, Homo sapiens
ttttacttcattcctgacttca

SEQ ID NO: 9471615 - DNA, 22 bp, Homo sapiens
ttttacttaattcttggtcatg

SEQ ID NO: 9471616 - DNA, 22 bp, Homo sapiens
ttttacttaattcttggtcatg

SEQ ID NO: 9471617 - DNA, 22 bp, Homo sapiens
ttttactttggatacagtactt

SEQ ID NO: 9471618 - DNA, 22 bp, Homo sapiens
ttttacttcattcctgacttca

SEQ ID NO: 9471619 - DNA, 22 bp, Homo sapiens
ttttacattgggaaatgcctct

SEQ ID NO: 9471620 - DNA, 22 bp, Homo sapiens
ttttagaaagatccctggcagg

SEQ ID NO: 9471621 - DNA, 22 bp, Homo sapiens
ttttagaaagatccctggcagg

SEQ ID NO: 9471622 - DNA, 22 bp, Homo sapiens
ttttagaaatactgatttagtg

SEQ ID NO: 9471623 - DNA, 22 bp, Homo sapiens
ttttagaaagatccctggcagg

SEQ ID NO: 9471624 - DNA, 22 bp, Homo sapiens
ttttagaaagatccctggcagg

SEQ ID NO: 9471625 - DNA, 22 bp, Homo sapiens
ttttagaaggaatgctatggtg

SEQ ID NO: 9471626 - DNA, 22 bp, Homo sapiens
ttttagaaggaatgctatggtg

SEQ ID NO: 9471627 - DNA, 22 bp, Homo sapiens
ttttagaaatactgatttagtg

SEQ ID NO: 9471628 - DNA, 22 bp, Homo sapiens
ttttagaaatactgatttagtg

SEQ ID NO: 9471629 - DNA, 22 bp, Homo sapiens
ttttattgtcaatgaagacaga

SEQ ID NO: 9471630 - DNA, 22 bp, Homo sapiens
ttttattgtcaatgaagacaga

SEQ ID NO: 9471631 - DNA, 22 bp, Homo sapiens
ttttattgtcaatgaagacaga

SEQ ID NO: 9471632 - DNA, 22 bp, Homo sapiens
ttttattgtcaatgaagacaga

SEQ ID NO: 9471633 - DNA, 22 bp, Homo sapiens
ttttattgtcaatgaagacaga

SEQ ID NO: 9471634 - DNA, 22 bp, Homo sapiens
ttttattgtcaatgaagacaga

SEQ ID NO: 9471635 - DNA, 22 bp, Homo sapiens
ttttattgtctgtattgcctat

SEQ ID NO: 9471636 - DNA, 22 bp, Homo sapiens
ttttattgtctgtattgcctat

SEQ ID NO: 9471637 - DNA, 22 bp, Homo sapiens
ttttattgtctgtattgcctat

SEQ ID NO: 9471638 - DNA, 22 bp, Homo sapiens
ttttattgtctgtattgcctat

SEQ ID NO: 9471639 - DNA, 22 bp, Homo sapiens
ttttattgtctcccagttctgg

SEQ ID NO: 9471640 - DNA, 22 bp, Homo sapiens
ttttattgtctcccagttctgg

SEQ ID NO: 9471641 - DNA, 22 bp, Homo sapiens
ttttattgtctcccagttctgg

SEQ ID NO: 9471642 - DNA, 22 bp, Homo sapiens
ttttattgtctcccagttctgg

SEQ ID NO: 9471643 - DNA, 22 bp, Homo sapiens
ttttattgtctcccagttctgg

SEQ ID NO: 9471644 - DNA, 16 bp, Homo sapiens
ttttattgtgacagcc

SEQ ID NO: 9471645 - DNA, 16 bp, Homo sapiens
ttttattgtgacagcc

SEQ ID NO: 9471646 - DNA, 22 bp, Homo sapiens
ttttcaaagactggaggctgat

SEQ ID NO: 9471647 - DNA, 16 bp, Homo sapiens
ttttattgtgacagcc

SEQ ID NO: 9471648 - DNA, 16 bp, Homo sapiens
ttttattgtgacagcc

SEQ ID NO: 9471649 - DNA, 22 bp, Homo sapiens
ttttattgtctgtattgcctat

SEQ ID NO: 9471650 - DNA, 22 bp, Homo sapiens
ttttattgtctgtattgcctat

SEQ ID NO: 9471651 - DNA, 22 bp, Homo sapiens
ttttcaattttgaggcagtggt

SEQ ID NO: 9471652 - DNA, 22 bp, Homo sapiens
ttttcacaagggtccaactagt

SEQ ID NO: 9471653 - DNA, 22 bp, Homo sapiens
ttttccactttagtgcaataac

SEQ ID NO: 9471654 - DNA, 22 bp, Homo sapiens
ttttccactttagtgcaataac

SEQ ID NO: 9471655 - DNA, 22 bp, Homo sapiens
tttctagtcagccatatctagt

SEQ ID NO: 9471656 - DNA, 22 bp, Homo sapiens
tttctagtcagccatatctagt

SEQ ID NO: 9471657 - DNA, 22 bp, Homo sapiens
tttctagtcctcatgcatcatt

SEQ ID NO: 9471658 - DNA, 22 bp, Homo sapiens
tttctagtctcgatctcttaat

SEQ ID NO: 9471659 - DNA, 22 bp, Homo sapiens
tttctagtcctcatgcatcatt

SEQ ID NO: 9471660 - DNA, 22 bp, Homo sapiens
tttctagtctcgatctcttaat

SEQ ID NO: 9471661 - DNA, 22 bp, Homo sapiens
tttctagtaaaagctaattacc

SEQ ID NO: 9471662 - DNA, 22 bp, Homo sapiens
tttctaggtttacaatactgca

SEQ ID NO: 9471663 - DNA, 22 bp, Homo sapiens
tttctaggtgttcacagagcat

SEQ ID NO: 9471664 - DNA, 22 bp, Homo sapiens
tttctaggtgttcacagagcat

SEQ ID NO: 9471665 - DNA, 22 bp, Homo sapiens
tttctagtatataactagatct

SEQ ID NO: 9471666 - DNA, 22 bp, Homo sapiens
tttctagtatataactagatct

SEQ ID NO: 9471667 - DNA, 22 bp, Homo sapiens
tttctagtaatcaatataaagt

SEQ ID NO: 9471668 - DNA, 22 bp, Homo sapiens
tttctagtaatcaatataaagt

SEQ ID NO: 9471669 - DNA, 22 bp, Homo sapiens
tttctagtggttaagatttaca

SEQ ID NO: 9471670 - DNA, 22 bp, Homo sapiens
tttctagtcttccctacctccc

SEQ ID NO: 9471671 - DNA, 22 bp, Homo sapiens
tttctagtgggtattccctgtt

SEQ ID NO: 9471672 - DNA, 22 bp, Homo sapiens
tttctagtgggtattccctgtt

SEQ ID NO: 9471673 - DNA, 19 bp, Homo sapiens
tttctagtttcagcttgtc

SEQ ID NO: 9471674 - DNA, 22 bp, Homo sapiens
tttctataactggactggattg

SEQ ID NO: 9471675 - DNA, 22 bp, Homo sapiens
tttctataactggactggattg

SEQ ID NO: 9471676 - DNA, 22 bp, Homo sapiens
tttctataaaaagtgctaggat

SEQ ID NO: 9471677 - DNA, 22 bp, Homo sapiens
tttctatatcttacctattgta

SEQ ID NO: 9471678 - DNA, 22 bp, Homo sapiens
tttctaggacatgataggatat

SEQ ID NO: 9471679 - DNA, 22 bp, Homo sapiens
tttctaggaaaagatagaagga

SEQ ID NO: 9471680 - DNA, 22 bp, Homo sapiens
tttctaggacatgataggatat

SEQ ID NO: 9471681 - DNA, 22 bp, Homo sapiens
tttctaggcacagtgtcttccc

SEQ ID NO: 9471682 - DNA, 22 bp, Homo sapiens
tttctaggcacagtgtcttccc

SEQ ID NO: 9471683 - DNA, 22 bp, Homo sapiens
tttctagggctcttgtcttctg

SEQ ID NO: 9471684 - DNA, 22 bp, Homo sapiens
tttctagggctcttgtcttctg

SEQ ID NO: 9471685 - DNA, 22 bp, Homo sapiens
tttctaggtcttccatactgcc

SEQ ID NO: 9471686 - DNA, 22 bp, Homo sapiens
tttctagacatttctatgtaca

SEQ ID NO: 9471687 - DNA, 22 bp, Homo sapiens
tttctagacatttctatgtaca

SEQ ID NO: 9471688 - DNA, 22 bp, Homo sapiens
tttctagagtgggcatgtctta

SEQ ID NO: 9471689 - DNA, 22 bp, Homo sapiens
tttctagagtgggcatgtctta

SEQ ID NO: 9471690 - DNA, 22 bp, Homo sapiens
tttctagagttcatcatggtaa

SEQ ID NO: 9471691 - DNA, 22 bp, Homo sapiens
tttctagagttcatcatggtaa

SEQ ID NO: 9471692 - DNA, 22 bp, Homo sapiens
tttctagatcaaacttttatat

SEQ ID NO: 9471693 - DNA, 22 bp, Homo sapiens
tttgaaatgtatcagtataggt

SEQ ID NO: 9471694 - DNA, 22 bp, Homo sapiens
tttgaaatgtatcagtataggt

SEQ ID NO: 9471695 - DNA, 22 bp, Homo sapiens
tttgaaatgtatcagtataggt

SEQ ID NO: 9471696 - DNA, 22 bp, Homo sapiens
tttgaaatgtatcagtataggt

SEQ ID NO: 9471697 - DNA, 22 bp, Homo sapiens
tttgaaatatgaggcattatga

SEQ ID NO: 9471698 - DNA, 22 bp, Homo sapiens
tttgaaatatgaggcattatga

SEQ ID NO: 9471699 - DNA, 22 bp, Homo sapiens
tttgaaatatgtgatgagagag

SEQ ID NO: 9471700 - DNA, 22 bp, Homo sapiens
tttctattggcgtcactgttgt

SEQ ID NO: 9471701 - DNA, 22 bp, Homo sapiens
tttctattggcgtcactgttgt

SEQ ID NO: 9471702 - DNA, 22 bp, Homo sapiens
tttctattggcgtcactgttgt

SEQ ID NO: 9471703 - DNA, 22 bp, Homo sapiens
tttctattggcgtcactgttgt

SEQ ID NO: 9471704 - DNA, 22 bp, Homo sapiens
tttctattgatctaataaacat

SEQ ID NO: 9471705 - DNA, 22 bp, Homo sapiens
tttctattggcgtcactgttgt

SEQ ID NO: 9471706 - DNA, 22 bp, Homo sapiens
tttctattgatctaataaacat

SEQ ID NO: 9471707 - DNA, 22 bp, Homo sapiens
tttctattgatctaataaacat

SEQ ID NO: 9471708 - DNA, 22 bp, Homo sapiens
tttctattgatctaataaacat

SEQ ID NO: 9471709 - DNA, 22 bp, Homo sapiens
tttctattgatctaataaacat

SEQ ID NO: 9471710 - DNA, 22 bp, Homo sapiens
tttctattctggatctgtggca

SEQ ID NO: 9471711 - DNA, 22 bp, Homo sapiens
tttgacattaaggaacatatat

SEQ ID NO: 9471712 - DNA, 22 bp, Homo sapiens
tttgacatgaagtagcttataa

SEQ ID NO: 9471713 - DNA, 22 bp, Homo sapiens
tttgacatgtgcttataacttt

SEQ ID NO: 9471714 - DNA, 22 bp, Homo sapiens
tttgagaaggtgacaaattcta

SEQ ID NO: 9471715 - DNA, 22 bp, Homo sapiens
tttgagaaggtgacaaattcta

SEQ ID NO: 9471716 - DNA, 19 bp, Homo sapiens
tttgagaagttattatcta

SEQ ID NO: 9471717 - DNA, 22 bp, Homo sapiens
tttgacattgaaagcagaatcg

SEQ ID NO: 9471718 - DNA, 22 bp, Homo sapiens
tttgacagtcccctgatgtttg

SEQ ID NO: 9471719 - DNA, 22 bp, Homo sapiens
tttgacagtcccctgatgtttg

SEQ ID NO: 9471720 - DNA, 22 bp, Homo sapiens
tttgacagtgatgatatataca

SEQ ID NO: 9471721 - DNA, 22 bp, Homo sapiens
tttgacagtaataaagcacaag

SEQ ID NO: 9471722 - DNA, 22 bp, Homo sapiens
tttgacagcttgcagtgagacc

SEQ ID NO: 9471723 - DNA, 22 bp, Homo sapiens
tttgaagaagctgacctatttt

SEQ ID NO: 9471724 - DNA, 22 bp, Homo sapiens
tttgaagacatattgttacata

SEQ ID NO: 9471725 - DNA, 22 bp, Homo sapiens
tttgaagacagatcaatataag

SEQ ID NO: 9471726 - DNA, 22 bp, Homo sapiens
tttgaagacagatcaatataag

SEQ ID NO: 9471727 - DNA, 22 bp, Homo sapiens
tttgaagaccttatctctaaat

SEQ ID NO: 9471728 - DNA, 22 bp, Homo sapiens
tttgaagacatttgaatacttt

SEQ ID NO: 9471729 - DNA, 22 bp, Homo sapiens
tttgaagactactgggagtgaa

SEQ ID NO: 9471730 - DNA, 22 bp, Homo sapiens
tttgaagactactgggagtgaa

SEQ ID NO: 9471731 - DNA, 22 bp, Homo sapiens
tttgaacatgctgcatgataat

SEQ ID NO: 9471732 - DNA, 22 bp, Homo sapiens
tttgaacaggagtatctatagt

SEQ ID NO: 9471733 - DNA, 22 bp, Homo sapiens
tttgaacaggagtatctatagt

SEQ ID NO: 9471734 - DNA, 22 bp, Homo sapiens
tttgaacaagagcttcacatta

SEQ ID NO: 9471735 - DNA, 22 bp, Homo sapiens
tttgaacaagagcttcacatta

SEQ ID NO: 9471736 - DNA, 22 bp, Homo sapiens
tttgcatttctaatgagctccg

SEQ ID NO: 9471737 - DNA, 22 bp, Homo sapiens
tttgcatttgttcaagtattga

SEQ ID NO: 9471738 - DNA, 22 bp, Homo sapiens
tttgctgaactaaaattctgaa

SEQ ID NO: 9471739 - DNA, 22 bp, Homo sapiens
tttgcattgcattaagtattct

SEQ ID NO: 9471740 - DNA, 22 bp, Homo sapiens
tttgctgtgaatccattactgt

SEQ ID NO: 9471741 - DNA, 22 bp, Homo sapiens
tttgctgtcagccgctattttc

SEQ ID NO: 9471742 - DNA, 22 bp, Homo sapiens
tttgcttcacaagtatggttct

SEQ ID NO: 9471743 - DNA, 22 bp, Homo sapiens
tttgcttgacccttgtgctgaa

SEQ ID NO: 9471744 - DNA, 22 bp, Homo sapiens
tttgcttaaagttctttctggt

SEQ ID NO: 9471745 - DNA, 22 bp, Homo sapiens
tttgcttaaaagcggagcaaga

SEQ ID NO: 9471746 - DNA, 22 bp, Homo sapiens
tttgcttaaagttctttctggt

SEQ ID NO: 9471747 - DNA, 22 bp, Homo sapiens
tttgcttaactggtagaatgcg

SEQ ID NO: 9471748 - DNA, 22 bp, Homo sapiens
tttgctgaatagattgtaaact

SEQ ID NO: 9471749 - DNA, 21 bp, Homo sapiens
tttgctgaagattttaggctg

SEQ ID NO: 9471750 - DNA, 22 bp, Homo sapiens
tttgctgaataaatgtgtgact

SEQ ID NO: 9471751 - DNA, 22 bp, Homo sapiens
tttgctgaccccattctgagtc

SEQ ID NO: 9471752 - DNA, 22 bp, Homo sapiens
tttgctgactggatgcagttgg

SEQ ID NO: 9471753 - DNA, 22 bp, Homo sapiens
tttgctgactggatgcagttgg

SEQ ID NO: 9471754 - DNA, 22 bp, Homo sapiens
tttgctgatattttgctgatac

SEQ ID NO: 9471755 - DNA, 22 bp, Homo sapiens
tttgctgggctctgtgccagac

SEQ ID NO: 9471756 - DNA, 19 bp, Homo sapiens
tttgagaagttattatcta

SEQ ID NO: 9471757 - DNA, 18 bp, Homo sapiens
tttgagaatgcatgactg

SEQ ID NO: 9471758 - DNA, 20 bp, Homo sapiens
tttgagaccagtctgcccaa

SEQ ID NO: 9471759 - DNA, 20 bp, Homo sapiens
tttgagaccagtctgcccaa

SEQ ID NO: 9471760 - DNA, 20 bp, Homo sapiens
tttgagaccagtctgcccaa

SEQ ID NO: 9471761 - DNA, 22 bp, Homo sapiens
tttgagcagaagggtgacatgc

SEQ ID NO: 9471762 - DNA, 22 bp, Homo sapiens
tttgagctatgggcttggattt

SEQ ID NO: 9471763 - DNA, 22 bp, Homo sapiens
tttgcattatctcacttatata

SEQ ID NO: 9471764 - DNA, 22 bp, Homo sapiens
tttgcattatatttatagaaga

SEQ ID NO: 9471765 - DNA, 22 bp, Homo sapiens
tttgcattagtttagatttcaa

SEQ ID NO: 9471766 - DNA, 22 bp, Homo sapiens
tttgcagtttcattgctgaaat

SEQ ID NO: 9471767 - DNA, 22 bp, Homo sapiens
tttgcagttcatgttggaaaat

SEQ ID NO: 9471768 - DNA, 22 bp, Homo sapiens
tttgcagttcatctgagaaaaa

SEQ ID NO: 9471769 - DNA, 22 bp, Homo sapiens
tttgtcatttccctgattaaag

SEQ ID NO: 9471770 - DNA, 21 bp, Homo sapiens
tttgtccacctgtgttcacca

SEQ ID NO: 9471771 - DNA, 22 bp, Homo sapiens
tttgtcattctgtgtatttaaa

SEQ ID NO: 9471772 - DNA, 20 bp, Homo sapiens
tttgtccagcgtctactctg

SEQ ID NO: 9471773 - DNA, 22 bp, Homo sapiens
tttgtccagatgcacagataat

SEQ ID NO: 9471774 - DNA, 22 bp, Homo sapiens
tttgtcctataatcctcttaca

SEQ ID NO: 9471775 - DNA, 22 bp, Homo sapiens
tttgtcctataatcctcttaca

SEQ ID NO: 9471776 - DNA, 22 bp, Homo sapiens
tttgtcatatagactattgtga

SEQ ID NO: 9471777 - DNA, 22 bp, Homo sapiens
tttggtaaatgcaggttcttct

SEQ ID NO: 9471778 - DNA, 22 bp, Homo sapiens
tttggtaaccttgcattcttta

SEQ ID NO: 9471779 - DNA, 22 bp, Homo sapiens
tttgtcatgtccttaactgtct

SEQ ID NO: 9471780 - DNA, 22 bp, Homo sapiens
tttgtcatcagttattaatatg

SEQ ID NO: 9471781 - DNA, 22 bp, Homo sapiens
tttgggcatgttgtggccagct

SEQ ID NO: 9471782 - DNA, 22 bp, Homo sapiens
tttgggaaacttaggggtcaga

SEQ ID NO: 9471783 - DNA, 22 bp, Homo sapiens
tttgggcatatagctgttccct

SEQ ID NO: 9471784 - DNA, 22 bp, Homo sapiens
tttgggctgagatgtgggccga

SEQ ID NO: 9471785 - DNA, 22 bp, Homo sapiens
tttgggctgactgccaagggcc

SEQ ID NO: 9471786 - DNA, 22 bp, Homo sapiens
tttggggccagccccatgtctg

SEQ ID NO: 9471787 - DNA, 22 bp, Homo sapiens
tttggggctcagcaggctgttt

SEQ ID NO: 9471788 - DNA, 20 bp, Homo sapiens
tttggcttcaagtgcattgc

SEQ ID NO: 9471789 - DNA, 21 bp, Homo sapiens
tttggcttctctgctgcagcc

SEQ ID NO: 9471790 - DNA, 22 bp, Homo sapiens
tttggctttagtgccttctgat

SEQ ID NO: 9471791 - DNA, 22 bp, Homo sapiens
tttggcttgcactggcaccaac

SEQ ID NO: 9471792 - DNA, 22 bp, Homo sapiens
tttggcttaacttacatgatat

SEQ ID NO: 9471793 - DNA, 22 bp, Homo sapiens
tttggcttaacttacatgatat

SEQ ID NO: 9471794 - DNA, 22 bp, Homo sapiens
tttggctctgcgtcttcaccca

SEQ ID NO: 9471795 - DNA, 22 bp, Homo sapiens
tttggctctgtgtctccaccca

SEQ ID NO: 9471796 - DNA, 22 bp, Homo sapiens
tttggctctgtgtcttcaccca

SEQ ID NO: 9471797 - DNA, 22 bp, Homo sapiens
tttggcatttaataggtgatca

SEQ ID NO: 9471798 - DNA, 22 bp, Homo sapiens
tttggccaagaaagttctgtgg

SEQ ID NO: 9471799 - DNA, 22 bp, Homo sapiens
tttggccacttgggagtccagg

SEQ ID NO: 9471800 - DNA, 22 bp, Homo sapiens
tttggccacagatccttggggg

SEQ ID NO: 9471801 - DNA, 22 bp, Homo sapiens
tttggccacttcatagatcatt

SEQ ID NO: 9471802 - DNA, 22 bp, Homo sapiens
tttggcatagctctttgttcct

SEQ ID NO: 9471803 - DNA, 23 bp, Homo sapiens
tttggcatgttaacttcacttac

SEQ ID NO: 9471804 - DNA, 22 bp, Homo sapiens
tttggccttagtccagaagaag

SEQ ID NO: 9471805 - DNA, 18 bp, Homo sapiens
tttggccatgacctggct

SEQ ID NO: 9471806 - DNA, 22 bp, Homo sapiens
tttggccttagtccagaagaag

SEQ ID NO: 9471807 - DNA, 22 bp, Homo sapiens
tttggcctcatgaatttcttgc

SEQ ID NO: 9471808 - DNA, 22 bp, Homo sapiens
tttggcctcatgaatttcttgc

SEQ ID NO: 9471809 - DNA, 22 bp, Homo sapiens
ataaaaactgacccatcctttg

SEQ ID NO: 9471810 - DNA, 22 bp, Homo sapiens
ataaaaactgacccatcctttg

SEQ ID NO: 9471811 - DNA, 22 bp, Homo sapiens
ataaaatggtaaacgaagctga

SEQ ID NO: 9471812 - DNA, 22 bp, Homo sapiens
ataaaatttgctactgttaaat

SEQ ID NO: 9471813 - DNA, 22 bp, Homo sapiens
ataaaatttgctactgttaaat

SEQ ID NO: 9471814 - DNA, 22 bp, Homo sapiens
ataaaatttgctactgttaaat

SEQ ID NO: 9471815 - DNA, 22 bp, Homo sapiens
ataaaatttgctactgttaaat

SEQ ID NO: 9471816 - DNA, 22 bp, Homo sapiens
ataaaatttgctactgttaaat

SEQ ID NO: 9471817 - DNA, 22 bp, Homo sapiens
ataaaatttgctactgttaaat

SEQ ID NO: 9471818 - DNA, 22 bp, Homo sapiens
ataaaatttgctactgttaaat

SEQ ID NO: 9471819 - DNA, 22 bp, Homo sapiens
ataaaatttgctactgttaaat

SEQ ID NO: 9471820 - DNA, 22 bp, Homo sapiens
ataaacaagactggccaacttt

SEQ ID NO: 9471821 - DNA, 22 bp, Homo sapiens
ataaaatttgctactgttaaat

SEQ ID NO: 9471822 - DNA, 22 bp, Homo sapiens
ataaacaagactggccaacttt

SEQ ID NO: 9471823 - DNA, 22 bp, Homo sapiens
ataaacaagactggccaacttt

SEQ ID NO: 9471824 - DNA, 22 bp, Homo sapiens
actgtgcaaatgacaggcacac

SEQ ID NO: 9471825 - DNA, 22 bp, Homo sapiens
actgtgcacaattctaagtcct

SEQ ID NO: 9471826 - DNA, 21 bp, Homo sapiens
actgtgataatgctttttctg

SEQ ID NO: 9471827 - DNA, 22 bp, Homo sapiens
actgtgatgttctctatcttgg

SEQ ID NO: 9471828 - DNA, 22 bp, Homo sapiens
ataaacagtaaatgtgagcagt

SEQ ID NO: 9471829 - DNA, 22 bp, Homo sapiens
actgtgagcagcgacctgagga

SEQ ID NO: 9471830 - DNA, 21 bp, Homo sapiens
ataaacagcatgtgatccatg

SEQ ID NO: 9471831 - DNA, 22 bp, Homo sapiens
ataaacagcataaaatacgctt

SEQ ID NO: 9471832 - DNA, 22 bp, Homo sapiens
actgtgcaggtagatgcctggg

SEQ ID NO: 9471833 - DNA, 22 bp, Homo sapiens
actgtgcatgaaccgaaacaaa

SEQ ID NO: 9471834 - DNA, 22 bp, Homo sapiens
actgtgcagtgttgtaacccga

SEQ ID NO: 9471835 - DNA, 22 bp, Homo sapiens
actgtgcacacaaaaatagatt

SEQ ID NO: 9471836 - DNA, 22 bp, Homo sapiens
actgtgcaggggaagagagaaa

SEQ ID NO: 9471837 - DNA, 22 bp, Homo sapiens
actgtgcagctgagtgctaatt

SEQ ID NO: 9471838 - DNA, 22 bp, Homo sapiens
ataatccatgtctagagtaaag

SEQ ID NO: 9471839 - DNA, 22 bp, Homo sapiens
ataagtaggaaaatttgaatat

SEQ ID NO: 9471840 - DNA, 22 bp, Homo sapiens
ataaggttaacatcatcagtga

SEQ ID NO: 9471841 - DNA, 22 bp, Homo sapiens
actgtgccacaattcaccaggg

SEQ ID NO: 9471842 - DNA, 22 bp, Homo sapiens
actgtgcatggtatccttgatg

SEQ ID NO: 9471843 - DNA, 22 bp, Homo sapiens
actgtgcatttcatgtcttttc

SEQ ID NO: 9471844 - DNA, 22 bp, Homo sapiens
actgtgcatttgaagggatcat

SEQ ID NO: 9471845 - DNA, 22 bp, Homo sapiens
ataatccattaattaatgacca

SEQ ID NO: 9471846 - DNA, 22 bp, Homo sapiens
ataatctgacaaagacttaagc

SEQ ID NO: 9471847 - DNA, 22 bp, Homo sapiens
ataatcctgctttttcactatt

SEQ ID NO: 9471848 - DNA, 22 bp, Homo sapiens
ataatctgagctatttcatgag

SEQ ID NO: 9471849 - DNA, 22 bp, Homo sapiens
ataatctgtggatggttttgag

SEQ ID NO: 9471850 - DNA, 22 bp, Homo sapiens
ataatctggtctttgtatgagt

SEQ ID NO: 9471851 - DNA, 22 bp, Homo sapiens
ataatcttgtatttcctaaagt

SEQ ID NO: 9471852 - DNA, 22 bp, Homo sapiens
ataatcttgtatttcctaaagt

SEQ ID NO: 9471853 - DNA, 22 bp, Homo sapiens
ataatcttgtatttcctaaagt

SEQ ID NO: 9471854 - DNA, 22 bp, Homo sapiens
ataatgaatgcagagttatttt

SEQ ID NO: 9471855 - DNA, 22 bp, Homo sapiens
ataatgaatgcagagttatttt

SEQ ID NO: 9471856 - DNA, 22 bp, Homo sapiens
ataatgaatcagcatagggtga

SEQ ID NO: 9471857 - DNA, 22 bp, Homo sapiens
ataatgaatgcagagttatttt

SEQ ID NO: 9471858 - DNA, 22 bp, Homo sapiens
ataatgagcttttgaatactga

SEQ ID NO: 9471859 - DNA, 22 bp, Homo sapiens
ataatgacattcttagactgga

SEQ ID NO: 9471860 - DNA, 23 bp, Homo sapiens
ataatgcaagtggtggtaatctg

SEQ ID NO: 9471861 - DNA, 22 bp, Homo sapiens
ataatgatcaacagcatcttgc

SEQ ID NO: 9471862 - DNA, 22 bp, Homo sapiens
ataatgcacctttgagtatggc

SEQ ID NO: 9471863 - DNA, 22 bp, Homo sapiens
ataatgcagcttttcaatggcc

SEQ ID NO: 9471864 - DNA, 22 bp, Homo sapiens
ataatgcacctttgagtatggc

SEQ ID NO: 9471865 - DNA, 22 bp, Homo sapiens
actgtcactgtgatgttagaga

SEQ ID NO: 9471866 - DNA, 22 bp, Homo sapiens
actgtcactgacagaatcaaca

SEQ ID NO: 9471867 - DNA, 22 bp, Homo sapiens
actgtcacttgcaactgtgagg

SEQ ID NO: 9471868 - DNA, 22 bp, Homo sapiens
actgtcacttgcaactgtgagg

SEQ ID NO: 9471869 - DNA, 22 bp, Homo sapiens
actgtcacttgcaactgtgagg

SEQ ID NO: 9471870 - DNA, 22 bp, Homo sapiens
actgtcaggatggcagcttgtt

SEQ ID NO: 9471871 - DNA, 22 bp, Homo sapiens
ataaaaactgacccatcctttg

SEQ ID NO: 9471872 - DNA, 22 bp, Homo sapiens
actgtcagggatcatgaaagct

SEQ ID NO: 9471873 - DNA, 22 bp, Homo sapiens
actgtcatcagaagatgaaaat

SEQ ID NO: 9471874 - DNA, 19 bp, Homo sapiens
actgtcacataaaggaagg

SEQ ID NO: 9471875 - DNA, 19 bp, Homo sapiens
actgtcacataaaggaagg

SEQ ID NO: 9471876 - DNA, 19 bp, Homo sapiens
actgtcacataaaggaagg

SEQ ID NO: 9471877 - DNA, 22 bp, Homo sapiens
actgtcaagagattcaaattca

SEQ ID NO: 9471878 - DNA, 22 bp, Homo sapiens
actgtcaagagattcaaattca

SEQ ID NO: 9471879 - DNA, 22 bp, Homo sapiens
actgtcaaatgcaatgaactca

SEQ ID NO: 9471880 - DNA, 22 bp, Homo sapiens
actgtcacctaaattttcattg

SEQ ID NO: 9471881 - DNA, 22 bp, Homo sapiens
actgtcactaactaagtctagt

SEQ ID NO: 9471882 - DNA, 22 bp, Homo sapiens
actgtcaccatcagagcgggaa

SEQ ID NO: 9471883 - DNA, 22 bp, Homo sapiens
actgtcactccaactgagtcgt

SEQ ID NO: 9471884 - DNA, 22 bp, Homo sapiens
actgtcactactatgtgtttgt

SEQ ID NO: 9471885 - DNA, 22 bp, Homo sapiens
actgtcactaactaagtctagt

SEQ ID NO: 9471886 - DNA, 22 bp, Homo sapiens
actgtcaaaagagattatatta

SEQ ID NO: 9471887 - DNA, 22 bp, Homo sapiens
actgtattttgggtgtattttc

SEQ ID NO: 9471888 - DNA, 22 bp, Homo sapiens
actgtatttttgaatcattgtg

SEQ ID NO: 9471889 - DNA, 21 bp, Homo sapiens
actgtattgttttcaaggatc

SEQ ID NO: 9471890 - DNA, 22 bp, Homo sapiens
actgtatttccaacagacaaat

SEQ ID NO: 9471891 - DNA, 22 bp, Homo sapiens
actgtatttccaacagacaaat

SEQ ID NO: 9471892 - DNA, 22 bp, Homo sapiens
actgtatttggatataagatct

SEQ ID NO: 9471893 - DNA, 22 bp, Homo sapiens
actgtatttggatataagatct

SEQ ID NO: 9471894 - DNA, 22 bp, Homo sapiens
actgtagtgatgataattaagt

SEQ ID NO: 9471895 - DNA, 22 bp, Homo sapiens
actgtataaggcataggtaagc

SEQ ID NO: 9471896 - DNA, 22 bp, Homo sapiens
actgtatagatggagttgattt

SEQ ID NO: 9471897 - DNA, 22 bp, Homo sapiens
actgtataaggcataggtaagc

SEQ ID NO: 9471898 - DNA, 22 bp, Homo sapiens
actgtattggaaatatagcaaa

SEQ ID NO: 9471899 - DNA, 22 bp, Homo sapiens
actgtatagatggagttgattt

SEQ ID NO: 9471900 - DNA, 22 bp, Homo sapiens
actgtatattggacaaggaaaa

SEQ ID NO: 9471901 - DNA, 22 bp, Homo sapiens
actgtattcctactagaatcta

SEQ ID NO: 9471902 - DNA, 22 bp, Homo sapiens
actgtattcctactagaatcta

SEQ ID NO: 9471903 - DNA, 22 bp, Homo sapiens
actgtacctcaaactctggaac

SEQ ID NO: 9471904 - DNA, 22 bp, Homo sapiens
actgtacctcaaactctggaac

SEQ ID NO: 9471905 - DNA, 22 bp, Homo sapiens
actgtagaggcctggattgagg

SEQ ID NO: 9471906 - DNA, 22 bp, Homo sapiens
actgtagaggcctggattgagg

SEQ ID NO: 9471907 - DNA, 22 bp, Homo sapiens
actgtagaatggaaccaattgt

SEQ ID NO: 9471908 - DNA, 22 bp, Homo sapiens
actgtagagaatctgagaaaaa

SEQ ID NO: 9471909 - DNA, 22 bp, Homo sapiens
actgtactttagaaagtgtagt

SEQ ID NO: 9471910 - DNA, 22 bp, Homo sapiens
actgtactgaaaagtaagcaag

SEQ ID NO: 9471911 - DNA, 22 bp, Homo sapiens
actgggaatctcaggaacatgg

SEQ ID NO: 9471912 - DNA, 23 bp, Homo sapiens
actgggaagtttggagagacgca

SEQ ID NO: 9471913 - DNA, 22 bp, Homo sapiens
actgggaatggagcctgggcct

SEQ ID NO: 9471914 - DNA, 22 bp, Homo sapiens
actgggaagtcagagagaggct

SEQ ID NO: 9471915 - DNA, 22 bp, Homo sapiens
actgggactgtatgtgctggac

SEQ ID NO: 9471916 - DNA, 20 bp, Homo sapiens
actgggagctaacggagatt

SEQ ID NO: 9471917 - DNA, 22 bp, Homo sapiens
actgggaaatgaagtctggtgg

SEQ ID NO: 9471918 - DNA, 22 bp, Homo sapiens
actgggaacctgtgctaggagg

SEQ ID NO: 9471919 - DNA, 22 bp, Homo sapiens
actgggaaagtgctgcctgcag

SEQ ID NO: 9471920 - DNA, 22 bp, Homo sapiens
actgggaaaagctatggcaaat

SEQ ID NO: 9471921 - DNA, 22 bp, Homo sapiens
actgggaagactggaattgctc

SEQ ID NO: 9471922 - DNA, 22 bp, Homo sapiens
actgggaagacaagaaagatag

SEQ ID NO: 9471923 - DNA, 22 bp, Homo sapiens
actgggaagacaagaaagatag

SEQ ID NO: 9471924 - DNA, 22 bp, Homo sapiens
actgggaagatggaggcaagca

SEQ ID NO: 9471925 - DNA, 22 bp, Homo sapiens
actgggaagatggaggcaagca

SEQ ID NO: 9471926 - DNA, 22 bp, Homo sapiens
acttaaatagaactcctcaata

SEQ ID NO: 9471927 - DNA, 22 bp, Homo sapiens
acttaaatagaactcctcaata

SEQ ID NO: 9471928 - DNA, 23 bp, Homo sapiens
acttaaatggttctttatctcag

SEQ ID NO: 9471929 - DNA, 23 bp, Homo sapiens
acttaaatggttctttatctcag

SEQ ID NO: 9471930 - DNA, 23 bp, Homo sapiens
acttaaatggttctttatctcag

SEQ ID NO: 9471931 - DNA, 21 bp, Homo sapiens
acttaaattccttgatattta

SEQ ID NO: 9471932 - DNA, 20 bp, Homo sapiens
acttaacaccgactaatgat

SEQ ID NO: 9471933 - DNA, 21 bp, Homo sapiens
acttaaattccttgatattta

SEQ ID NO: 9471934 - DNA, 22 bp, Homo sapiens
ataatgcatttagaataattca

SEQ ID NO: 9471935 - DNA, 22 bp, Homo sapiens
ataatgcatttagaataattca

SEQ ID NO: 9471936 - DNA, 22 bp, Homo sapiens
ataatgcatttagaataattca

SEQ ID NO: 9471937 - DNA, 22 bp, Homo sapiens
ataatgctgggagaaattgtta

SEQ ID NO: 9471938 - DNA, 22 bp, Homo sapiens
acttaaagttataatttgctaa

SEQ ID NO: 9471939 - DNA, 22 bp, Homo sapiens
atacagatgttgaatgttatat

SEQ ID NO: 9471940 - DNA, 20 bp, Homo sapiens
atacacttgcccagcttgtg

SEQ ID NO: 9471941 - DNA, 20 bp, Homo sapiens
atacacttgcccagcttgtg

SEQ ID NO: 9471942 - DNA, 22 bp, Homo sapiens
acttagaagatgcagtaaagca

SEQ ID NO: 9471943 - DNA, 22 bp, Homo sapiens
acttagaagatgcagtaaagca

SEQ ID NO: 9471944 - DNA, 22 bp, Homo sapiens
acttagaaagggattctagatt

SEQ ID NO: 9471945 - DNA, 22 bp, Homo sapiens
acttacaatcaaccaccttgga

SEQ ID NO: 9471946 - DNA, 22 bp, Homo sapiens
acttaccagagaggatccgccc

SEQ ID NO: 9471947 - DNA, 22 bp, Homo sapiens
acttacaatcaaccaccttgga

SEQ ID NO: 9471948 - DNA, 22 bp, Homo sapiens
acttacaatcaaccaccttgga

SEQ ID NO: 9471949 - DNA, 22 bp, Homo sapiens
acttacaagctagggaagcttg

SEQ ID NO: 9471950 - DNA, 22 bp, Homo sapiens
acttacaagctagggaagcttg

SEQ ID NO: 9471951 - DNA, 22 bp, Homo sapiens
acttacaagttccctttctcag

SEQ ID NO: 9471952 - DNA, 22 bp, Homo sapiens
acttacaagttccctttctcag

SEQ ID NO: 9471953 - DNA, 22 bp, Homo sapiens
acttacaagttccctttctcag

SEQ ID NO: 9471954 - DNA, 22 bp, Homo sapiens
acttacaagctagggaagcttg

SEQ ID NO: 9471955 - DNA, 22 bp, Homo sapiens
acttacaagctagggaagcttg

SEQ ID NO: 9471956 - DNA, 22 bp, Homo sapiens
acttaacagacattatttacct

SEQ ID NO: 9471957 - DNA, 22 bp, Homo sapiens
acttaacagacattatttacct

SEQ ID NO: 9471958 - DNA, 22 bp, Homo sapiens
acttaagatagagcaagtctga

SEQ ID NO: 9471959 - DNA, 22 bp, Homo sapiens
acttctgaagcagagatttggg

SEQ ID NO: 9471960 - DNA, 19 bp, Homo sapiens
acttctgaggaactgcaca

SEQ ID NO: 9471961 - DNA, 22 bp, Homo sapiens
acttctcttccccggaactcta

SEQ ID NO: 9471962 - DNA, 22 bp, Homo sapiens
acttctctttagtactaaatgt

SEQ ID NO: 9471963 - DNA, 22 bp, Homo sapiens
acttctcttccccggaactcta

SEQ ID NO: 9471964 - DNA, 22 bp, Homo sapiens
acttctcttcataggtggcaat

SEQ ID NO: 9471965 - DNA, 22 bp, Homo sapiens
acttctcttcataggtggcaat

SEQ ID NO: 9471966 - DNA, 22 bp, Homo sapiens
atacagtaaccacattctatag

SEQ ID NO: 9471967 - DNA, 22 bp, Homo sapiens
atacagtaaccacattctatag

SEQ ID NO: 9471968 - DNA, 22 bp, Homo sapiens
atacagtaaccacattctatag

SEQ ID NO: 9471969 - DNA, 22 bp, Homo sapiens
atacagtaaccacattctatag

SEQ ID NO: 9471970 - DNA, 22 bp, Homo sapiens
atacaggttgaattttctttta

SEQ ID NO: 9471971 - DNA, 22 bp, Homo sapiens
atacagtaaccacattctatag

SEQ ID NO: 9471972 - DNA, 22 bp, Homo sapiens
atacaggttctctagggaacag

SEQ ID NO: 9471973 - DNA, 22 bp, Homo sapiens
atacaggtggacttcagttagt

SEQ ID NO: 9471974 - DNA, 22 bp, Homo sapiens
atacaggtgtacacacatgcaa

SEQ ID NO: 9471975 - DNA, 22 bp, Homo sapiens
atacaggtggacttcagttagt

SEQ ID NO: 9471976 - DNA, 22 bp, Homo sapiens
atacaggaactctctacacttt

SEQ ID NO: 9471977 - DNA, 22 bp, Homo sapiens
atacagcttacagttctaatgc

SEQ ID NO: 9471978 - DNA, 22 bp, Homo sapiens
atacagcttatgcatatatctc

SEQ ID NO: 9471979 - DNA, 22 bp, Homo sapiens
atacagcttatgcatatatctc

SEQ ID NO: 9471980 - DNA, 22 bp, Homo sapiens
atacaggtaatttgaataatag

SEQ ID NO: 9471981 - DNA, 22 bp, Homo sapiens
atacaggtaggggacatacatc

SEQ ID NO: 9471982 - DNA, 22 bp, Homo sapiens
atacaggatgctgaacatctct

SEQ ID NO: 9471983 - DNA, 22 bp, Homo sapiens
atacagctgccttctaactatg

SEQ ID NO: 9471984 - DNA, 22 bp, Homo sapiens
atacagcttacagttctaatgc

SEQ ID NO: 9471985 - DNA, 22 bp, Homo sapiens
atacagcagtgaataagataaa

SEQ ID NO: 9471986 - DNA, 22 bp, Homo sapiens
atacagcagtgaataagataaa

SEQ ID NO: 9471987 - DNA, 22 bp, Homo sapiens
atactggagaagccaagaagcc

SEQ ID NO: 9471988 - DNA, 21 bp, Homo sapiens
atactggagccatccccaaag

SEQ ID NO: 9471989 - DNA, 22 bp, Homo sapiens
atactgtacgtcccagatagga

SEQ ID NO: 9471990 - DNA, 23 bp, Homo sapiens
atactgaaactgttgtttatctg

SEQ ID NO: 9471991 - DNA, 22 bp, Homo sapiens
atactgaattaggtaaagcata

SEQ ID NO: 9471992 - DNA, 22 bp, Homo sapiens
atactgaattaggtaaagcata

SEQ ID NO: 9471993 - DNA, 22 bp, Homo sapiens
atactgaaggcattcagataac

SEQ ID NO: 9471994 - DNA, 22 bp, Homo sapiens
actttagatattcctctgtaca

SEQ ID NO: 9471995 - DNA, 22 bp, Homo sapiens
actttagtctgtttcattatct

SEQ ID NO: 9471996 - DNA, 22 bp, Homo sapiens
actttagtaaacttatgttact

SEQ ID NO: 9471997 - DNA, 22 bp, Homo sapiens
atactgtagaggcatagctagt

SEQ ID NO: 9471998 - DNA, 22 bp, Homo sapiens
atactgtagaggcatagctagt

SEQ ID NO: 9471999 - DNA, 22 bp, Homo sapiens
actttatttcctattgcatcca

SEQ ID NO: 9472000 - DNA, 22 bp, Homo sapiens
actttcaaaagagaagtcatga

SEQ ID NO: 9472001 - DNA, 22 bp, Homo sapiens
atacatgttgtaccatatgttt

SEQ ID NO: 9472002 - DNA, 22 bp, Homo sapiens
atacattagaatctggtactca

SEQ ID NO: 9472003 - DNA, 22 bp, Homo sapiens
atacatgttgtaccatatgttt

SEQ ID NO: 9472004 - DNA, 22 bp, Homo sapiens
atacatgttgtaccatatgttt

SEQ ID NO: 9472005 - DNA, 22 bp, Homo sapiens
atacattagtgaacaaaagaga

SEQ ID NO: 9472006 - DNA, 22 bp, Homo sapiens
atacattattgttaaagaacat

SEQ ID NO: 9472007 - DNA, 22 bp, Homo sapiens
atacattagtgaacaaaagaga

SEQ ID NO: 9472008 - DNA, 22 bp, Homo sapiens
atacattagtgaacaaaagaga

SEQ ID NO: 9472009 - DNA, 22 bp, Homo sapiens
atacattagctcatatgattaa

SEQ ID NO: 9472010 - DNA, 22 bp, Homo sapiens
atacattagctcatatgattaa

SEQ ID NO: 9472011 - DNA, 22 bp, Homo sapiens
atacattagctcatatgattaa

SEQ ID NO: 9472012 - DNA, 22 bp, Homo sapiens
atacattagctcatatgattaa

SEQ ID NO: 9472013 - DNA, 22 bp, Homo sapiens
atacattagctcatatgattaa

SEQ ID NO: 9472014 - DNA, 22 bp, Homo sapiens
atacatgttcgtgtacatgttc

SEQ ID NO: 9472015 - DNA, 22 bp, Homo sapiens
atacatgttcgtgtacatgttc

SEQ ID NO: 9472016 - DNA, 22 bp, Homo sapiens
atacatgttgagaaaatatctg

SEQ ID NO: 9472017 - DNA, 22 bp, Homo sapiens
atacatctatgcctttctgaca

SEQ ID NO: 9472018 - DNA, 22 bp, Homo sapiens
acttctgtatgtcctgcattca

SEQ ID NO: 9472019 - DNA, 22 bp, Homo sapiens
acttctgtaaagggaagacagt

SEQ ID NO: 9472020 - DNA, 22 bp, Homo sapiens
acttctggatagagtcagcttt

SEQ ID NO: 9472021 - DNA, 22 bp, Homo sapiens
acttctggaggcctagggaaga

SEQ ID NO: 9472022 - DNA, 22 bp, Homo sapiens
acttctggatagagtcagcttt

SEQ ID NO: 9472023 - DNA, 22 bp, Homo sapiens
acttctgtcctccaagccacgt

SEQ ID NO: 9472024 - DNA, 22 bp, Homo sapiens
acttctgtcctccaagccacgt

SEQ ID NO: 9472025 - DNA, 22 bp, Homo sapiens
acttcttcttcagctgggggat

SEQ ID NO: 9472026 - DNA, 20 bp, Homo sapiens
atatttcaggtagtgtgccc

SEQ ID NO: 9472027 - DNA, 22 bp, Homo sapiens
atatttcacgtaggttgttttc

SEQ ID NO: 9472028 - DNA, 22 bp, Homo sapiens
atatttataaggcaggcaagta

SEQ ID NO: 9472029 - DNA, 22 bp, Homo sapiens
atatttataaggcaggcaagta

SEQ ID NO: 9472030 - DNA, 21 bp, Homo sapiens
atatttctcataaggttatgg

SEQ ID NO: 9472031 - DNA, 22 bp, Homo sapiens
agaaagctccccatgagatgat

SEQ ID NO: 9472032 - DNA, 22 bp, Homo sapiens
atatttcatggggttccatact

SEQ ID NO: 9472033 - DNA, 22 bp, Homo sapiens
atatttcatggggttccatact

SEQ ID NO: 9472034 - DNA, 22 bp, Homo sapiens
atattcttccaaaacatcattt

SEQ ID NO: 9472035 - DNA, 22 bp, Homo sapiens
atattcttccaaaacatcattt

SEQ ID NO: 9472036 - DNA, 22 bp, Homo sapiens
atattcttccaaaacatcattt

SEQ ID NO: 9472037 - DNA, 22 bp, Homo sapiens
atattcttccaaaacatcattt

SEQ ID NO: 9472038 - DNA, 22 bp, Homo sapiens
atatttataagcaagcaggact

SEQ ID NO: 9472039 - DNA, 22 bp, Homo sapiens
atatttataagcaagcaggact

SEQ ID NO: 9472040 - DNA, 22 bp, Homo sapiens
atatttataagcaagcaggact

SEQ ID NO: 9472041 - DNA, 22 bp, Homo sapiens
atatttataaggcaggcaagta

SEQ ID NO: 9472042 - DNA, 22 bp, Homo sapiens
atattcttccaaaacatcattt

SEQ ID NO: 9472043 - DNA, 22 bp, Homo sapiens
atattcttccaaaacatcattt

SEQ ID NO: 9472044 - DNA, 22 bp, Homo sapiens
atattcttccaaaacatcattt

SEQ ID NO: 9472045 - DNA, 22 bp, Homo sapiens
atattcttccaaaacatcattt

SEQ ID NO: 9472046 - DNA, 22 bp, Homo sapiens
atattctgcttttgatgcattc

SEQ ID NO: 9472047 - DNA, 22 bp, Homo sapiens
atattctgggttagatatgttt

SEQ ID NO: 9472048 - DNA, 22 bp, Homo sapiens
atattcttatccttttctctgt

SEQ ID NO: 9472049 - DNA, 22 bp, Homo sapiens
atattcttccaaaacatcattt

SEQ ID NO: 9472050 - DNA, 22 bp, Homo sapiens
agaaaaggttgaaagtaggatt

SEQ ID NO: 9472051 - DNA, 21 bp, Homo sapiens
agaaaagtatttgaatcaaga

SEQ ID NO: 9472052 - DNA, 21 bp, Homo sapiens
agaaaagtatttgaatcaaga

SEQ ID NO: 9472053 - DNA, 22 bp, Homo sapiens
agaaaagtgctctagtgagagc

SEQ ID NO: 9472054 - DNA, 21 bp, Homo sapiens
agaaaagtatttgaatcaaga

SEQ ID NO: 9472055 - DNA, 22 bp, Homo sapiens
agaaaagttttctgagactgac

SEQ ID NO: 9472056 - DNA, 22 bp, Homo sapiens
agaaaagtttaaatcttggcac

SEQ ID NO: 9472057 - DNA, 22 bp, Homo sapiens
agaaaagtgctctagtgagagc

SEQ ID NO: 9472058 - DNA, 22 bp, Homo sapiens
atattacacacggtatcacggg

SEQ ID NO: 9472059 - DNA, 22 bp, Homo sapiens
atattacataaacatgagtgaa

SEQ ID NO: 9472060 - DNA, 22 bp, Homo sapiens
atattcatcgtgtagaaatact

SEQ ID NO: 9472061 - DNA, 22 bp, Homo sapiens
atattcatcgtgtagaaatact

SEQ ID NO: 9472062 - DNA, 22 bp, Homo sapiens
atattcattgaacacctactac

SEQ ID NO: 9472063 - DNA, 22 bp, Homo sapiens
atattcattgaacacctactac

SEQ ID NO: 9472064 - DNA, 22 bp, Homo sapiens
atattcattgaacacctactac

SEQ ID NO: 9472065 - DNA, 17 bp, Homo sapiens
atattccaagggcttgg

SEQ ID NO: 9472066 - DNA, 22 bp, Homo sapiens
atattctgcctcactacagttg

SEQ ID NO: 9472067 - DNA, 22 bp, Homo sapiens
atattctgcctcactacagttg

SEQ ID NO: 9472068 - DNA, 22 bp, Homo sapiens
atattccagttatatcaaatca

SEQ ID NO: 9472069 - DNA, 22 bp, Homo sapiens
atatggacttaaaatttgatgt

SEQ ID NO: 9472070 - DNA, 22 bp, Homo sapiens
atatggatgagataatgagcca

SEQ ID NO: 9472071 - DNA, 22 bp, Homo sapiens
atatggaatggtaatctacaat

SEQ ID NO: 9472072 - DNA, 22 bp, Homo sapiens
atatggaatggtaatctacaat

SEQ ID NO: 9472073 - DNA, 22 bp, Homo sapiens
agaaaaggttgaaagtaggatt

SEQ ID NO: 9472074 - DNA, 22 bp, Homo sapiens
agaaaaggttgaaagtaggatt

SEQ ID NO: 9472075 - DNA, 22 bp, Homo sapiens
agaaaaggttgaaagtaggatt

SEQ ID NO: 9472076 - DNA, 22 bp, Homo sapiens
agaaaagggcaggagggataca

SEQ ID NO: 9472077 - DNA, 22 bp, Homo sapiens
agaaaaggttgaaagtaggatt

SEQ ID NO: 9472078 - DNA, 22 bp, Homo sapiens
atatggaactattctgtgtaga

SEQ ID NO: 9472079 - DNA, 22 bp, Homo sapiens
atatggaactattctgtgtaga

SEQ ID NO: 9472080 - DNA, 22 bp, Homo sapiens
atatggaagttacctgacttca

SEQ ID NO: 9472081 - DNA, 22 bp, Homo sapiens
atatggaagagcctgggaattt

SEQ ID NO: 9472082 - DNA, 18 bp, Homo sapiens
atatggaatgcctggcta

SEQ ID NO: 9472083 - DNA, 18 bp, Homo sapiens
atatggaatgcctggcta

SEQ ID NO: 9472084 - DNA, 22 bp, Homo sapiens
atatggaagttacctgacttca

SEQ ID NO: 9472085 - DNA, 22 bp, Homo sapiens
atatggaagttacctgacttca

SEQ ID NO: 9472086 - DNA, 22 bp, Homo sapiens
atatggaaatagcaatatggtt

SEQ ID NO: 9472087 - DNA, 22 bp, Homo sapiens
atatggaaatagcaatatggtt

SEQ ID NO: 9472088 - DNA, 22 bp, Homo sapiens
atatggaactattctgtgtaga

SEQ ID NO: 9472089 - DNA, 17 bp, Homo sapiens
atatgctttgtatttat

SEQ ID NO: 9472090 - DNA, 22 bp, Homo sapiens
atatgaaagtaagcatgtgtgt

SEQ ID NO: 9472091 - DNA, 22 bp, Homo sapiens
atatgcttgactctttcacatc

SEQ ID NO: 9472092 - DNA, 22 bp, Homo sapiens
atatgcttgactctttcacatc

SEQ ID NO: 9472093 - DNA, 22 bp, Homo sapiens
atatgcttccaagttattccac

SEQ ID NO: 9472094 - DNA, 22 bp, Homo sapiens
atatgcttatgatggttaattt

SEQ ID NO: 9472095 - DNA, 22 bp, Homo sapiens
atatgcttacagcttaaaatcc

SEQ ID NO: 9472096 - DNA, 22 bp, Homo sapiens
atatgcttacagcttaaaatcc

SEQ ID NO: 9472097 - DNA, 22 bp, Homo sapiens
actttctattcccacagagata

SEQ ID NO: 9472098 - DNA, 22 bp, Homo sapiens
actttctattcccacagagata

SEQ ID NO: 9472099 - DNA, 22 bp, Homo sapiens
actttctattcccacagagata

SEQ ID NO: 9472100 - DNA, 22 bp, Homo sapiens
actttctaggtctcagtccttt

SEQ ID NO: 9472101 - DNA, 22 bp, Homo sapiens
actttctaggtctcagtccttt

SEQ ID NO: 9472102 - DNA, 23 bp, Homo sapiens
actttcccatagcatggcttcct

SEQ ID NO: 9472103 - DNA, 22 bp, Homo sapiens
actttcctggccctgtcctctg

SEQ ID NO: 9472104 - DNA, 22 bp, Homo sapiens
actttccttatggatggggaaa

SEQ ID NO: 9472105 - DNA, 22 bp, Homo sapiens
actttctaaaattgctagcact

SEQ ID NO: 9472106 - DNA, 22 bp, Homo sapiens
actttctaattgtctccagtgt

SEQ ID NO: 9472107 - DNA, 22 bp, Homo sapiens
actttcatttgtaataaacttc

SEQ ID NO: 9472108 - DNA, 22 bp, Homo sapiens
actttcatgttggtgaagggtt

SEQ ID NO: 9472109 - DNA, 22 bp, Homo sapiens
actttcatttgtaataaacttc

SEQ ID NO: 9472110 - DNA, 22 bp, Homo sapiens
actttcatttgtaataaacttc

SEQ ID NO: 9472111 - DNA, 22 bp, Homo sapiens
actttcatttgtgaagactgta

SEQ ID NO: 9472112 - DNA, 22 bp, Homo sapiens
actttcatgctctgagcactgg

SEQ ID NO: 9472113 - DNA, 22 bp, Homo sapiens
actttcaatttgcactaaccta

SEQ ID NO: 9472114 - DNA, 22 bp, Homo sapiens
actttcaagcaagaacactttg

SEQ ID NO: 9472115 - DNA, 22 bp, Homo sapiens
actttcaagaacttctttaatg

SEQ ID NO: 9472116 - DNA, 22 bp, Homo sapiens
actttcaagcaagaacactttg

SEQ ID NO: 9472117 - DNA, 22 bp, Homo sapiens
atcgtaaagccctatggcttca

SEQ ID NO: 9472118 - DNA, 22 bp, Homo sapiens
atctaaaaggagctctttatct

SEQ ID NO: 9472119 - DNA, 22 bp, Homo sapiens
atctaaaaggagctctttatct

SEQ ID NO: 9472120 - DNA, 22 bp, Homo sapiens
atctaaaatgtggttagttggt

SEQ ID NO: 9472121 - DNA, 22 bp, Homo sapiens
atctaaaatgtggttagttggt

SEQ ID NO: 9472122 - DNA, 23 bp, Homo sapiens
atctaaagtgttaaatagctggg

SEQ ID NO: 9472123 - DNA, 22 bp, Homo sapiens
atctaaagtgtcataagtagct

SEQ ID NO: 9472124 - DNA, 22 bp, Homo sapiens
atctaaactgtttactctctgc

SEQ ID NO: 9472125 - DNA, 22 bp, Homo sapiens
atctaaagtgtttcatgaaaga

SEQ ID NO: 9472126 - DNA, 22 bp, Homo sapiens
atctaaagtgtcataagtagct

SEQ ID NO: 9472127 - DNA, 22 bp, Homo sapiens
atctaaagtgtttcatgaaaga

SEQ ID NO: 9472128 - DNA, 22 bp, Homo sapiens
atctaagagttaacatcaagaa

SEQ ID NO: 9472129 - DNA, 22 bp, Homo sapiens
atctaataccctctttatttct

SEQ ID NO: 9472130 - DNA, 22 bp, Homo sapiens
atctatttctgctaataacaat

SEQ ID NO: 9472131 - DNA, 22 bp, Homo sapiens
atctaattttcactcatttgct

SEQ ID NO: 9472132 - DNA, 22 bp, Homo sapiens
atctcaaacatctttgaccata

SEQ ID NO: 9472133 - DNA, 22 bp, Homo sapiens
atctatttctgctaataacaat

SEQ ID NO: 9472134 - DNA, 22 bp, Homo sapiens
atctcaaacatctttgaccata

SEQ ID NO: 9472135 - DNA, 21 bp, Homo sapiens
atctcacagcccagagaagcc

SEQ ID NO: 9472136 - DNA, 22 bp, Homo sapiens
atctcacaggactgaaacgtaa

SEQ ID NO: 9472137 - DNA, 22 bp, Homo sapiens
atctcaccaagttattacgaga

SEQ ID NO: 9472138 - DNA, 22 bp, Homo sapiens
atctcaaatgattacaccaagc

SEQ ID NO: 9472139 - DNA, 22 bp, Homo sapiens
atctcaaatgattacaccaagc

SEQ ID NO: 9472140 - DNA, 22 bp, Homo sapiens
atctcaactaagcctaactttt

SEQ ID NO: 9472141 - DNA, 19 bp, Homo sapiens
atctcaaccctactctctg

SEQ ID NO: 9472142 - DNA, 22 bp, Homo sapiens
atctcaacatccctatggagtg

SEQ ID NO: 9472143 - DNA, 22 bp, Homo sapiens
agaacagggactggaggcttca

SEQ ID NO: 9472144 - DNA, 22 bp, Homo sapiens
atcatccaagcgtagttcttct

SEQ ID NO: 9472145 - DNA, 22 bp, Homo sapiens
agaacaggcagttggttggatt

SEQ ID NO: 9472146 - DNA, 22 bp, Homo sapiens
atcatccaagcgtagttcttct

SEQ ID NO: 9472147 - DNA, 22 bp, Homo sapiens
agaacaggaggaagccagctcc

SEQ ID NO: 9472148 - DNA, 22 bp, Homo sapiens
agaacaggaggaagccagctcc

SEQ ID NO: 9472149 - DNA, 22 bp, Homo sapiens
agaacaggcagttggttggatt

SEQ ID NO: 9472150 - DNA, 22 bp, Homo sapiens
atcatctagtttaactttcttt

SEQ ID NO: 9472151 - DNA, 20 bp, Homo sapiens
atcatctcaaagctgaggtt

SEQ ID NO: 9472152 - DNA, 22 bp, Homo sapiens
atcatctgcacagatcctattt

SEQ ID NO: 9472153 - DNA, 22 bp, Homo sapiens
atcatctgcacagatcctattt

SEQ ID NO: 9472154 - DNA, 22 bp, Homo sapiens
atcatctgcctcatcactgcat

SEQ ID NO: 9472155 - DNA, 22 bp, Homo sapiens
atcatctgggttaatgtgctca

SEQ ID NO: 9472156 - DNA, 22 bp, Homo sapiens
atcatctggcattcagattggc

SEQ ID NO: 9472157 - DNA, 22 bp, Homo sapiens
atcatctgggttaatgtgctca

SEQ ID NO: 9472158 - DNA, 22 bp, Homo sapiens
atcatccatggctgatcataaa

SEQ ID NO: 9472159 - DNA, 22 bp, Homo sapiens
atcatcctattgtgccccaggt

SEQ ID NO: 9472160 - DNA, 22 bp, Homo sapiens
atcatcctagaaggaagctagg

SEQ ID NO: 9472161 - DNA, 22 bp, Homo sapiens
atcatcctagaaggaagctagg

SEQ ID NO: 9472162 - DNA, 22 bp, Homo sapiens
atcatcgtcccttctcttgtca

SEQ ID NO: 9472163 - DNA, 22 bp, Homo sapiens
atcatcctattgtgccccaggt

SEQ ID NO: 9472164 - DNA, 22 bp, Homo sapiens
atcatcctagaaggaagctagg

SEQ ID NO: 9472165 - DNA, 22 bp, Homo sapiens
atcatcttgaaagtctatgttt

SEQ ID NO: 9472166 - DNA, 22 bp, Homo sapiens
atcatcttcgaaaaaagtcaga

SEQ ID NO: 9472167 - DNA, 22 bp, Homo sapiens
atcatcttcgaaaaaagtcaga

SEQ ID NO: 9472168 - DNA, 22 bp, Homo sapiens
atcatcttaaggtatctcaagc

SEQ ID NO: 9472169 - DNA, 22 bp, Homo sapiens
atcatcttaaggtatctcaagc

SEQ ID NO: 9472170 - DNA, 22 bp, Homo sapiens
atcatcttaaatctagaatgtg

SEQ ID NO: 9472171 - DNA, 22 bp, Homo sapiens
atcatctgtctctgcagttgaa

SEQ ID NO: 9472172 - DNA, 18 bp, Homo sapiens
atcctgggagcagacagc

SEQ ID NO: 9472173 - DNA, 18 bp, Homo sapiens
atcctgggagcagacagc

SEQ ID NO: 9472174 - DNA, 22 bp, Homo sapiens
atcgatcccgcgtaaggccccg

SEQ ID NO: 9472175 - DNA, 22 bp, Homo sapiens
atccttttcctttgggtgccct

SEQ ID NO: 9472176 - DNA, 22 bp, Homo sapiens
atcgcaagtttaaaaatctttg

SEQ ID NO: 9472177 - DNA, 22 bp, Homo sapiens
agaacactgggaagttactaac

SEQ ID NO: 9472178 - DNA, 20 bp, Homo sapiens
agaacactggtgtattgtga

SEQ ID NO: 9472179 - DNA, 22 bp, Homo sapiens
agaacactgctagtataatcac

SEQ ID NO: 9472180 - DNA, 22 bp, Homo sapiens
agaacactgctagtataatcac

SEQ ID NO: 9472181 - DNA, 22 bp, Homo sapiens
agaaattaggaaagtaacactt

SEQ ID NO: 9472182 - DNA, 22 bp, Homo sapiens
agaaattatgcagtagttttat

SEQ ID NO: 9472183 - DNA, 22 bp, Homo sapiens
agaacacatagagaagttttat

SEQ ID NO: 9472184 - DNA, 22 bp, Homo sapiens
agaacacatagagaagttttat

SEQ ID NO: 9472185 - DNA, 22 bp, Homo sapiens
agaaagtttgagaactgtagat

SEQ ID NO: 9472186 - DNA, 22 bp, Homo sapiens
agaaagtttatttcttgatgga

SEQ ID NO: 9472187 - DNA, 22 bp, Homo sapiens
agaaattaggaaagtaacactt

SEQ ID NO: 9472188 - DNA, 22 bp, Homo sapiens
agaaattaggaaagtaacactt

SEQ ID NO: 9472189 - DNA, 22 bp, Homo sapiens
agaaattaggaaagtaacactt

SEQ ID NO: 9472190 - DNA, 22 bp, Homo sapiens
agaacagaggccttatgtttca

SEQ ID NO: 9472191 - DNA, 22 bp, Homo sapiens
agaacagatgtgggcagacctg

SEQ ID NO: 9472192 - DNA, 22 bp, Homo sapiens
agaacactgtaaagtcattgaa

SEQ ID NO: 9472193 - DNA, 22 bp, Homo sapiens
agaacagaagggaggaaggcct

SEQ ID NO: 9472194 - DNA, 22 bp, Homo sapiens
agaacagcaacatcagacaaag

SEQ ID NO: 9472195 - DNA, 22 bp, Homo sapiens
agaacagcagcacgtcaagctg

SEQ ID NO: 9472196 - DNA, 22 bp, Homo sapiens
agaacagcctatagtggccttt

SEQ ID NO: 9472197 - DNA, 22 bp, Homo sapiens
agaacagccaataaaagagggg

SEQ ID NO: 9472198 - DNA, 22 bp, Homo sapiens
agaacagcagttatggttcatt

SEQ ID NO: 9472199 - DNA, 22 bp, Homo sapiens
agaacagccaactgtgtaggag

SEQ ID NO: 9472200 - DNA, 22 bp, Homo sapiens
agaaagggttctctgaggtgct

SEQ ID NO: 9472201 - DNA, 22 bp, Homo sapiens
agaaagtacagatgagacactt

SEQ ID NO: 9472202 - DNA, 22 bp, Homo sapiens
agaaaggtcaaaatcgtgacat

SEQ ID NO: 9472203 - DNA, 22 bp, Homo sapiens
agaaaggtggatgctctggaat

SEQ ID NO: 9472204 - DNA, 22 bp, Homo sapiens
agaaaggtggatgctctggaat

SEQ ID NO: 9472205 - DNA, 22 bp, Homo sapiens
agaaagctccccatgagatgat

SEQ ID NO: 9472206 - DNA, 22 bp, Homo sapiens
agaaagctggaagagctgggat

SEQ ID NO: 9472207 - DNA, 22 bp, Homo sapiens
agaaagggctattttgaggtag

SEQ ID NO: 9472208 - DNA, 22 bp, Homo sapiens
agaaagggtcactgaaagagga

SEQ ID NO: 9472209 - DNA, 22 bp, Homo sapiens
agaaagggtcactgaaagagga

SEQ ID NO: 9472210 - DNA, 22 bp, Homo sapiens
agaaagtctgctttctggatgg

SEQ ID NO: 9472211 - DNA, 22 bp, Homo sapiens
agaaagtgaacgtgttcagttt

SEQ ID NO: 9472212 - DNA, 22 bp, Homo sapiens
agaaagtgcctcccttgggagc

SEQ ID NO: 9472213 - DNA, 22 bp, Homo sapiens
agaaagttaaacagtgataaga

SEQ ID NO: 9472214 - DNA, 22 bp, Homo sapiens
agaaagtgtgtcatactaagtg

SEQ ID NO: 9472215 - DNA, 22 bp, Homo sapiens
agaaagtgcttccctttggact

SEQ ID NO: 9472216 - DNA, 22 bp, Homo sapiens
agaaagttagcagactcttggc

SEQ ID NO: 9472217 - DNA, 22 bp, Homo sapiens
agaaagttctgtgagttgttca

SEQ ID NO: 9472218 - DNA, 22 bp, Homo sapiens
agtatttggtgtggtattgacc

SEQ ID NO: 9472219 - DNA, 22 bp, Homo sapiens
agtatttgtggatttgtattgg

SEQ ID NO: 9472220 - DNA, 22 bp, Homo sapiens
agtatttgatcagatgatagta

SEQ ID NO: 9472221 - DNA, 22 bp, Homo sapiens
agtatttgtggatttgtattgg

SEQ ID NO: 9472222 - DNA, 22 bp, Homo sapiens
agtatttgatacagtcttctag

SEQ ID NO: 9472223 - DNA, 22 bp, Homo sapiens
agtatttgaagatgttgagtac

SEQ ID NO: 9472224 - DNA, 22 bp, Homo sapiens
agtatttcttcatatgattact

SEQ ID NO: 9472225 - DNA, 22 bp, Homo sapiens
agtatttcttcatatgattact

SEQ ID NO: 9472226 - DNA, 22 bp, Homo sapiens
agtcaaataagactgtcataag

SEQ ID NO: 9472227 - DNA, 22 bp, Homo sapiens
agtcaaagctacaggcatttga

SEQ ID NO: 9472228 - DNA, 22 bp, Homo sapiens
agtcaaagatgaccgagttcct

SEQ ID NO: 9472229 - DNA, 22 bp, Homo sapiens
agtcaaactgcctaggaagcag

SEQ ID NO: 9472230 - DNA, 21 bp, Homo sapiens
actagctttctggagaagtgt

SEQ ID NO: 9472231 - DNA, 22 bp, Homo sapiens
actaggaattcaagtagacaga

SEQ ID NO: 9472232 - DNA, 22 bp, Homo sapiens
actaggaattcaagtagacaga

SEQ ID NO: 9472233 - DNA, 22 bp, Homo sapiens
agtatacatatattagccttcg

SEQ ID NO: 9472234 - DNA, 22 bp, Homo sapiens
actagtattcttggtcttgtat

SEQ ID NO: 9472235 - DNA, 22 bp, Homo sapiens
actaggggctcaggcccaggga

SEQ ID NO: 9472236 - DNA, 22 bp, Homo sapiens
actaggggctcaggcccaggga

SEQ ID NO: 9472237 - DNA, 22 bp, Homo sapiens
actaggggctcaggcccaggga

SEQ ID NO: 9472238 - DNA, 22 bp, Homo sapiens
actagtctgccagggagaggca

SEQ ID NO: 9472239 - DNA, 20 bp, Homo sapiens
actagtctaaaagggctgac

SEQ ID NO: 9472240 - DNA, 22 bp, Homo sapiens
agtcccagctctgccacttact

SEQ ID NO: 9472241 - DNA, 22 bp, Homo sapiens
agtcccagctcagaaccactag

SEQ ID NO: 9472242 - DNA, 22 bp, Homo sapiens
agtcccagctcagaaccactag

SEQ ID NO: 9472243 - DNA, 22 bp, Homo sapiens
actcaggctgttttttccttgt

SEQ ID NO: 9472244 - DNA, 22 bp, Homo sapiens
actcaggcttcaggcacagctg

SEQ ID NO: 9472245 - DNA, 22 bp, Homo sapiens
agtccaggcgggtatagaggct

SEQ ID NO: 9472246 - DNA, 22 bp, Homo sapiens
actcaggctagggaaaaagtgg

SEQ ID NO: 9472247 - DNA, 22 bp, Homo sapiens
actcaggctacaggggcagaag

SEQ ID NO: 9472248 - DNA, 22 bp, Homo sapiens
actcaggctacaacgcgtggct

SEQ ID NO: 9472249 - DNA, 22 bp, Homo sapiens
actcaggctacaggggcagaag

SEQ ID NO: 9472250 - DNA, 22 bp, Homo sapiens
actcaggccccatcgcccatct

SEQ ID NO: 9472251 - DNA, 22 bp, Homo sapiens
actcaggcctccttctgtcctt

SEQ ID NO: 9472252 - DNA, 22 bp, Homo sapiens
actcaggctacaacgcgtggct

SEQ ID NO: 9472253 - DNA, 21 bp, Homo sapiens
actcaggcaccaggggatggc

SEQ ID NO: 9472254 - DNA, 22 bp, Homo sapiens
actcaggcactcagccctcgcc

SEQ ID NO: 9472255 - DNA, 22 bp, Homo sapiens
actcaggcactcagccctcgcc

SEQ ID NO: 9472256 - DNA, 19 bp, Homo sapiens
actcaggcaatgagaaaca

SEQ ID NO: 9472257 - DNA, 22 bp, Homo sapiens
actcaggagggatcagctatca

SEQ ID NO: 9472258 - DNA, 22 bp, Homo sapiens
agtcaaataagagagagatgtt

SEQ ID NO: 9472259 - DNA, 22 bp, Homo sapiens
agtcaaataagactgtcataag

SEQ ID NO: 9472260 - DNA, 22 bp, Homo sapiens
agtcaacaaaaatgtggagcct

SEQ ID NO: 9472261 - DNA, 22 bp, Homo sapiens
agtcaaatgagtaaatatataa

SEQ ID NO: 9472262 - DNA, 22 bp, Homo sapiens
agtcaaccggtattagtctgtt

SEQ ID NO: 9472263 - DNA, 22 bp, Homo sapiens
agtcaacatttgagatgcaatg

SEQ ID NO: 9472264 - DNA, 22 bp, Homo sapiens
agtcaaccatttagaagagtgt

SEQ ID NO: 9472265 - DNA, 22 bp, Homo sapiens
actcaggaaattgagataatgg

SEQ ID NO: 9472266 - DNA, 23 bp, Homo sapiens
actcagctttgggagatgactca

SEQ ID NO: 9472267 - DNA, 23 bp, Homo sapiens
actcagctttgggagatgactca

SEQ ID NO: 9472268 - DNA, 22 bp, Homo sapiens
agtcaaccggtattagtctgtt

SEQ ID NO: 9472269 - DNA, 22 bp, Homo sapiens
actcagcttcctacagctagaa

SEQ ID NO: 9472270 - DNA, 22 bp, Homo sapiens
aggtggctcctcccatggctgg

SEQ ID NO: 9472271 - DNA, 20 bp, Homo sapiens
aggtggctcctgctgggggt

SEQ ID NO: 9472272 - DNA, 22 bp, Homo sapiens
acgcccggtctccatagttttt

SEQ ID NO: 9472273 - DNA, 22 bp, Homo sapiens
acgcccggtctccatagttttt

SEQ ID NO: 9472274 - DNA, 22 bp, Homo sapiens
acgcctgtaatcccagcacttt

SEQ ID NO: 9472275 - DNA, 22 bp, Homo sapiens
acgcctgtaatcccagcacttt

SEQ ID NO: 9472276 - DNA, 22 bp, Homo sapiens
acgcagtttgtggacatttttt

SEQ ID NO: 9472277 - DNA, 22 bp, Homo sapiens
acgcccagactcccatactttg

SEQ ID NO: 9472278 - DNA, 22 bp, Homo sapiens
acgcccagactcccatactttg

SEQ ID NO: 9472279 - DNA, 22 bp, Homo sapiens
acgcctgtaatcccagcacttt

SEQ ID NO: 9472280 - DNA, 22 bp, Homo sapiens
acgcctgtaatcccagcacttt

SEQ ID NO: 9472281 - DNA, 22 bp, Homo sapiens
acgcctgtaatcccagcacttt

SEQ ID NO: 9472282 - DNA, 22 bp, Homo sapiens
acgcctgtaatcccagcacttt

SEQ ID NO: 9472283 - DNA, 22 bp, Homo sapiens
agtaaaaattgaggtgcaaaat

SEQ ID NO: 9472284 - DNA, 22 bp, Homo sapiens
agtaaaaattgaggtgcaaaat

SEQ ID NO: 9472285 - DNA, 22 bp, Homo sapiens
aggttcttttggccaacctcat

SEQ ID NO: 9472286 - DNA, 22 bp, Homo sapiens
acggcctggtgcagcaggtcgc

SEQ ID NO: 9472287 - DNA, 22 bp, Homo sapiens
aggttcttttggccaacctcat

SEQ ID NO: 9472288 - DNA, 22 bp, Homo sapiens
aggttcttggtgtccagatttc

SEQ ID NO: 9472289 - DNA, 22 bp, Homo sapiens
actagctgtgacagctgcgtgt

SEQ ID NO: 9472290 - DNA, 22 bp, Homo sapiens
actagattttggccattataca

SEQ ID NO: 9472291 - DNA, 22 bp, Homo sapiens
actagattttggccattataca

SEQ ID NO: 9472292 - DNA, 22 bp, Homo sapiens
actagacaggttgtactattgg

SEQ ID NO: 9472293 - DNA, 22 bp, Homo sapiens
agtaaacaggcatgatagtgtt

SEQ ID NO: 9472294 - DNA, 22 bp, Homo sapiens
agtaaacagaaagcaagatgat

SEQ ID NO: 9472295 - DNA, 22 bp, Homo sapiens
agtaaacagaaagcaagatgat

SEQ ID NO: 9472296 - DNA, 22 bp, Homo sapiens
agtaaacagaaagcaagatgat

SEQ ID NO: 9472297 - DNA, 22 bp, Homo sapiens
agtaaaattaatggatcagaag

SEQ ID NO: 9472298 - DNA, 22 bp, Homo sapiens
agtaaaatcaccatctctttgt

SEQ ID NO: 9472299 - DNA, 22 bp, Homo sapiens
agtaaaatcaccatctctttgt

SEQ ID NO: 9472300 - DNA, 22 bp, Homo sapiens
agtaaaatcaccatctctttgt

SEQ ID NO: 9472301 - DNA, 22 bp, Homo sapiens
agtaaaacagagaaatcactca

SEQ ID NO: 9472302 - DNA, 22 bp, Homo sapiens
agtaaaacagagaaatcactca

SEQ ID NO: 9472303 - DNA, 22 bp, Homo sapiens
agtaaacactgtctttatatat

SEQ ID NO: 9472304 - DNA, 22 bp, Homo sapiens
agtaaacactgtctttatatat

SEQ ID NO: 9472305 - DNA, 22 bp, Homo sapiens
agtaaacactaaaatgactgcg

SEQ ID NO: 9472306 - DNA, 22 bp, Homo sapiens
agtaaaattgtattggaaaaca

SEQ ID NO: 9472307 - DNA, 22 bp, Homo sapiens
agtaaaattgtattggaaaaca

SEQ ID NO: 9472308 - DNA, 22 bp, Homo sapiens
agtaaaatttctgctgaggaga

SEQ ID NO: 9472309 - DNA, 20 bp, Homo sapiens
acctggctctcaggagcaac

SEQ ID NO: 9472310 - DNA, 20 bp, Homo sapiens
acctggctctcaggagcaac

SEQ ID NO: 9472311 - DNA, 20 bp, Homo sapiens
acctggctctcaggagcaac

SEQ ID NO: 9472312 - DNA, 22 bp, Homo sapiens
acctggccatccagctggcatc

SEQ ID NO: 9472313 - DNA, 22 bp, Homo sapiens
acctggccatccagctggcatc

SEQ ID NO: 9472314 - DNA, 19 bp, Homo sapiens
acctggcctcttgagcaag

SEQ ID NO: 9472315 - DNA, 22 bp, Homo sapiens
acctggccccactgtgctgctg

SEQ ID NO: 9472316 - DNA, 22 bp, Homo sapiens
aggtggagatcagggactaagg

SEQ ID NO: 9472317 - DNA, 22 bp, Homo sapiens
aggtggagatcagggactaagg

SEQ ID NO: 9472318 - DNA, 22 bp, Homo sapiens
aggtggagacccagagaaggcg

SEQ ID NO: 9472319 - DNA, 22 bp, Homo sapiens
acctggctgagaacgtgcagct

SEQ ID NO: 9472320 - DNA, 22 bp, Homo sapiens
acctggccagtggggccgcgct

SEQ ID NO: 9472321 - DNA, 22 bp, Homo sapiens
acctggccagtggggccgcgct

SEQ ID NO: 9472322 - DNA, 22 bp, Homo sapiens
acctggccaatttttgtatttt

SEQ ID NO: 9472323 - DNA, 19 bp, Homo sapiens
acctggccagagttcaata

SEQ ID NO: 9472324 - DNA, 22 bp, Homo sapiens
acctggcaggaaggtgggtgat

SEQ ID NO: 9472325 - DNA, 22 bp, Homo sapiens
acctggcactacaggcacctgt

SEQ ID NO: 9472326 - DNA, 22 bp, Homo sapiens
aggtggccggtgccagccgggc

SEQ ID NO: 9472327 - DNA, 19 bp, Homo sapiens
aggtggccatgtccagcct

SEQ ID NO: 9472328 - DNA, 22 bp, Homo sapiens
aggtggccccaggcctctgcca

SEQ ID NO: 9472329 - DNA, 22 bp, Homo sapiens
aggtggcatgcctgagacataa

SEQ ID NO: 9472330 - DNA, 22 bp, Homo sapiens
aggtggcatttacaccatggga

SEQ ID NO: 9472331 - DNA, 22 bp, Homo sapiens
aggtggcatttacaccatggga

SEQ ID NO: 9472332 - DNA, 22 bp, Homo sapiens
acctggagtcatttgaggagta

SEQ ID NO: 9472333 - DNA, 22 bp, Homo sapiens
acctggatgctggccttgcctt

SEQ ID NO: 9472334 - DNA, 22 bp, Homo sapiens
aggtctctggggaactccaggg

SEQ ID NO: 9472335 - DNA, 22 bp, Homo sapiens
aggtctctaaaatagtcaaact

SEQ ID NO: 9472336 - DNA, 22 bp, Homo sapiens
aggtctcccaagggccagggag

SEQ ID NO: 9472337 - DNA, 20 bp, Homo sapiens
aggtcctgttccttgtctcc

SEQ ID NO: 9472338 - DNA, 22 bp, Homo sapiens
aggtcctgtgtccaggggcctg

SEQ ID NO: 9472339 - DNA, 22 bp, Homo sapiens
aggtcctgtgtccaggggcctg

SEQ ID NO: 9472340 - DNA, 22 bp, Homo sapiens
aggtcctgtggtttgggtaaaa

SEQ ID NO: 9472341 - DNA, 22 bp, Homo sapiens
aggtcctgtcttatctctgtaa

SEQ ID NO: 9472342 - DNA, 22 bp, Homo sapiens
aggtcctgtcttatctctgtaa

SEQ ID NO: 9472343 - DNA, 22 bp, Homo sapiens
aggtccagttttcagttctcat

SEQ ID NO: 9472344 - DNA, 22 bp, Homo sapiens
aggtcctgtctatcaccctcgc

SEQ ID NO: 9472345 - DNA, 22 bp, Homo sapiens
aggtcgagtttcggggctactt

SEQ ID NO: 9472346 - DNA, 22 bp, Homo sapiens
aggtcctgtttcttccctgggg

SEQ ID NO: 9472347 - DNA, 22 bp, Homo sapiens
aggtctcaaactggcaccctgt

SEQ ID NO: 9472348 - DNA, 22 bp, Homo sapiens
aggtctcaattcctgctcctgt

SEQ ID NO: 9472349 - DNA, 22 bp, Homo sapiens
aggtctcaatctcaggtggtca

SEQ ID NO: 9472350 - DNA, 22 bp, Homo sapiens
acctgaattgtcatatcttatt

SEQ ID NO: 9472351 - DNA, 22 bp, Homo sapiens
acctgaatttgaaatgtttatt

SEQ ID NO: 9472352 - DNA, 22 bp, Homo sapiens
acctgaaaattattatttccgc

SEQ ID NO: 9472353 - DNA, 22 bp, Homo sapiens
acctgaaaattattatttccgc

SEQ ID NO: 9472354 - DNA, 22 bp, Homo sapiens
acctgaaactcaactttatctc

SEQ ID NO: 9472355 - DNA, 22 bp, Homo sapiens
acctgaaactcaactttatctc

SEQ ID NO: 9472356 - DNA, 22 bp, Homo sapiens
acctgaaaccaacttgtgtact

SEQ ID NO: 9472357 - DNA, 22 bp, Homo sapiens
acctgaaaccaacttgtgtact

SEQ ID NO: 9472358 - DNA, 22 bp, Homo sapiens
acctctgtacctcctctgacag

SEQ ID NO: 9472359 - DNA, 22 bp, Homo sapiens
acctctgggcagcacctttgta

SEQ ID NO: 9472360 - DNA, 22 bp, Homo sapiens
acctctgtatagttgcctgtgg

SEQ ID NO: 9472361 - DNA, 22 bp, Homo sapiens
acctcttaatattgcaccttct

SEQ ID NO: 9472362 - DNA, 22 bp, Homo sapiens
acctctggccttcaggcatcat

SEQ ID NO: 9472363 - DNA, 20 bp, Homo sapiens
acctcctggaagcaggtgcc

SEQ ID NO: 9472364 - DNA, 22 bp, Homo sapiens
acctctgggaaaagtatggaaa

SEQ ID NO: 9472365 - DNA, 22 bp, Homo sapiens
acctctgggaaaagtatggaaa

SEQ ID NO: 9472366 - DNA, 22 bp, Homo sapiens
acctctggccttcaggcatcat

SEQ ID NO: 9472367 - DNA, 22 bp, Homo sapiens
acctcctgatgagagtaaagga

SEQ ID NO: 9472368 - DNA, 22 bp, Homo sapiens
acctcctccaaggagccatagg

SEQ ID NO: 9472369 - DNA, 22 bp, Homo sapiens
acctcccttgctaaagactgtg

SEQ ID NO: 9472370 - DNA, 20 bp, Homo sapiens
accctctgaatagtatctgg

SEQ ID NO: 9472371 - DNA, 19 bp, Homo sapiens
accctctccccactgggtc

SEQ ID NO: 9472372 - DNA, 22 bp, Homo sapiens
accctccaggctgcagctcctg

SEQ ID NO: 9472373 - DNA, 22 bp, Homo sapiens
accctcccatttccatgtagca

SEQ ID NO: 9472374 - DNA, 22 bp, Homo sapiens
accctcccatttccatgtagca

SEQ ID NO: 9472375 - DNA, 22 bp, Homo sapiens
accctcccatttccatgtagca

SEQ ID NO: 9472376 - DNA, 22 bp, Homo sapiens
accctccccaagaggtcgtgcc

SEQ ID NO: 9472377 - DNA, 22 bp, Homo sapiens
accctcgatatgatctgatgaa

SEQ ID NO: 9472378 - DNA, 22 bp, Homo sapiens
accctccccaagaggtcgtgcc

SEQ ID NO: 9472379 - DNA, 22 bp, Homo sapiens
accctctagagggaagcacttt

SEQ ID NO: 9472380 - DNA, 22 bp, Homo sapiens
aggtccagttgccagaatggcc

SEQ ID NO: 9472381 - DNA, 22 bp, Homo sapiens
aggtccagttgccagaatggcc

SEQ ID NO: 9472382 - DNA, 22 bp, Homo sapiens
acctgccagaatgctagtcctg

SEQ ID NO: 9472383 - DNA, 22 bp, Homo sapiens
acctgcagtggccactcctaat

SEQ ID NO: 9472384 - DNA, 22 bp, Homo sapiens
acctgccaagcatcagtggcag

SEQ ID NO: 9472385 - DNA, 22 bp, Homo sapiens
acctgagacttgggatgggaat

SEQ ID NO: 9472386 - DNA, 22 bp, Homo sapiens
acctgagacttgggatgggaat

SEQ ID NO: 9472387 - DNA, 22 bp, Homo sapiens
acctgagagctataaggtttta

SEQ ID NO: 9472388 - DNA, 21 bp, Homo sapiens
acctgagctccacctcctgcc

SEQ ID NO: 9472389 - DNA, 18 bp, Homo sapiens
acctgattggcgcagccc

SEQ ID NO: 9472390 - DNA, 22 bp, Homo sapiens
acctgaggcctccccagcagac

SEQ ID NO: 9472391 - DNA, 22 bp, Homo sapiens
actgcacttcagcctgggtgac

SEQ ID NO: 9472392 - DNA, 22 bp, Homo sapiens
actgcacttcagcctgggtgac

SEQ ID NO: 9472393 - DNA, 22 bp, Homo sapiens
actgcacttcagcctgggtgac

SEQ ID NO: 9472394 - DNA, 22 bp, Homo sapiens
actgcacttcagcctgggtgac

SEQ ID NO: 9472395 - DNA, 22 bp, Homo sapiens
actgcacttcagcctgggtgac

SEQ ID NO: 9472396 - DNA, 22 bp, Homo sapiens
agtggcagtggctgggcagagc

SEQ ID NO: 9472397 - DNA, 22 bp, Homo sapiens
actgcacttcagcctgggtgac

SEQ ID NO: 9472398 - DNA, 22 bp, Homo sapiens
actgcacttcagcctgggtgac

SEQ ID NO: 9472399 - DNA, 22 bp, Homo sapiens
actgcacttcagcctgggtgac

SEQ ID NO: 9472400 - DNA, 22 bp, Homo sapiens
agtggcagtggaaagcacacgg

SEQ ID NO: 9472401 - DNA, 22 bp, Homo sapiens
agtggcagtagatgagctggtt

SEQ ID NO: 9472402 - DNA, 22 bp, Homo sapiens
agtggcagtagatgagctggtt

SEQ ID NO: 9472403 - DNA, 22 bp, Homo sapiens
agtggcagtggctgggcagagc

SEQ ID NO: 9472404 - DNA, 22 bp, Homo sapiens
agtggcagtggaaagcacacgg

SEQ ID NO: 9472405 - DNA, 22 bp, Homo sapiens
agtggcagtggctgggcagagc

SEQ ID NO: 9472406 - DNA, 21 bp, Homo sapiens
actgagggccagagaggacct

SEQ ID NO: 9472407 - DNA, 21 bp, Homo sapiens
actgagggccagagaggacct

SEQ ID NO: 9472408 - DNA, 22 bp, Homo sapiens
actgaggggttggagagtgagg

SEQ ID NO: 9472409 - DNA, 22 bp, Homo sapiens
agtggcagggctggctgctgca

SEQ ID NO: 9472410 - DNA, 22 bp, Homo sapiens
agtggcagagccagggttggga

SEQ ID NO: 9472411 - DNA, 22 bp, Homo sapiens
agtggcaggtgtttcgtggtgc

SEQ ID NO: 9472412 - DNA, 22 bp, Homo sapiens
agtggcagggctggctgctgca

SEQ ID NO: 9472413 - DNA, 22 bp, Homo sapiens
agtggcagtagatgagctggtt

SEQ ID NO: 9472414 - DNA, 22 bp, Homo sapiens
agtggcagtagatgagctggtt

SEQ ID NO: 9472415 - DNA, 22 bp, Homo sapiens
agtggcagtaacattccacaat

SEQ ID NO: 9472416 - DNA, 22 bp, Homo sapiens
agtggcagtagatgagctggtt

SEQ ID NO: 9472417 - DNA, 20 bp, Homo sapiens
agtgtacagacactagaaat

SEQ ID NO: 9472418 - DNA, 20 bp, Homo sapiens
agtgtacagacactagaaat

SEQ ID NO: 9472419 - DNA, 22 bp, Homo sapiens
agtgtacagttctatgaatttc

SEQ ID NO: 9472420 - DNA, 22 bp, Homo sapiens
agtgtacagttctatgaatttc

SEQ ID NO: 9472421 - DNA, 22 bp, Homo sapiens
agtgtacagtgtagtggcgtta

SEQ ID NO: 9472422 - DNA, 22 bp, Homo sapiens
agtgtacatcagaacatatcaa

SEQ ID NO: 9472423 - DNA, 22 bp, Homo sapiens
agtgtacatcagaacatatcaa

SEQ ID NO: 9472424 - DNA, 22 bp, Homo sapiens
agtgtagaaggagaaatggatc

SEQ ID NO: 9472425 - DNA, 22 bp, Homo sapiens
actgcagagcttttcagttgag

SEQ ID NO: 9472426 - DNA, 22 bp, Homo sapiens
actgcagactctacagttataa

SEQ ID NO: 9472427 - DNA, 22 bp, Homo sapiens
actgcagagcttttcagttgag

SEQ ID NO: 9472428 - DNA, 22 bp, Homo sapiens
actgcagaggtggggtgcagag

SEQ ID NO: 9472429 - DNA, 21 bp, Homo sapiens
agtggggtctctgtggaggcc

SEQ ID NO: 9472430 - DNA, 21 bp, Homo sapiens
agtggggtctctgtggaggcc

SEQ ID NO: 9472431 - DNA, 22 bp, Homo sapiens
actgcagaggtggggtgcagag

SEQ ID NO: 9472432 - DNA, 22 bp, Homo sapiens
actgcacttcagcctgggtgtc

SEQ ID NO: 9472433 - DNA, 22 bp, Homo sapiens
actgcacttcagcctgggtgtc

SEQ ID NO: 9472434 - DNA, 22 bp, Homo sapiens
actgcacttcagcctgggtgtc

SEQ ID NO: 9472435 - DNA, 22 bp, Homo sapiens
actgcacttcagcctgggtgtc

SEQ ID NO: 9472436 - DNA, 22 bp, Homo sapiens
actgcacttcagcctgggtgtc

SEQ ID NO: 9472437 - DNA, 22 bp, Homo sapiens
actgcacttcagcctgggtgtc

SEQ ID NO: 9472438 - DNA, 22 bp, Homo sapiens
actgcacttcagcctgggtgtc

SEQ ID NO: 9472439 - DNA, 22 bp, Homo sapiens
actgcacttcagcctgggtgtc

SEQ ID NO: 9472440 - DNA, 21 bp, Homo sapiens
agtgtgtgataggcaggaaga

SEQ ID NO: 9472441 - DNA, 21 bp, Homo sapiens
agtgtgtgataggcaggaaga

SEQ ID NO: 9472442 - DNA, 22 bp, Homo sapiens
agtgttgtaataaatatcatct

SEQ ID NO: 9472443 - DNA, 22 bp, Homo sapiens
agtgtttacagagtagtggaaa

SEQ ID NO: 9472444 - DNA, 22 bp, Homo sapiens
agtgtttaagttacacacatat

SEQ ID NO: 9472445 - DNA, 22 bp, Homo sapiens
agtgtttaaactgaagtgatga

SEQ ID NO: 9472446 - DNA, 22 bp, Homo sapiens
actggctttgggttgccgcaga

SEQ ID NO: 9472447 - DNA, 22 bp, Homo sapiens
actgggaaaaactgctttgagg

SEQ ID NO: 9472448 - DNA, 22 bp, Homo sapiens
agtgtttaccccaatcagttta

SEQ ID NO: 9472449 - DNA, 20 bp, Homo sapiens
agtgtttagaatactattat

SEQ ID NO: 9472450 - DNA, 22 bp, Homo sapiens
agtgtttagcatgaagttcatt

SEQ ID NO: 9472451 - DNA, 22 bp, Homo sapiens
agtgtttagttaagatttcaaa

SEQ ID NO: 9472452 - DNA, 21 bp, Homo sapiens
actggaagtgggtcaggaagt

SEQ ID NO: 9472453 - DNA, 22 bp, Homo sapiens
actggaagccagttgacaatca

SEQ ID NO: 9472454 - DNA, 22 bp, Homo sapiens
actggaaattgagaggtcactg

SEQ ID NO: 9472455 - DNA, 22 bp, Homo sapiens
actggaaatgagatgatatcag

SEQ ID NO: 9472456 - DNA, 22 bp, Homo sapiens
actggaatgaagttaatctgat

SEQ ID NO: 9472457 - DNA, 22 bp, Homo sapiens
actggaattaggtttgtataca

SEQ ID NO: 9472458 - DNA, 22 bp, Homo sapiens
actggaattggatggaagtggt

SEQ ID NO: 9472459 - DNA, 22 bp, Homo sapiens
agtgtgtgaccttttaatttaa

SEQ ID NO: 9472460 - DNA, 22 bp, Homo sapiens
agtgtgtgaccttttaatttaa

SEQ ID NO: 9472461 - DNA, 21 bp, Homo sapiens
agtgtgtgataggcaggaaga

SEQ ID NO: 9472462 - DNA, 22 bp, Homo sapiens
actggaaaacactactacatgc

SEQ ID NO: 9472463 - DNA, 22 bp, Homo sapiens
actgcttttgatctcttctgta

SEQ ID NO: 9472464 - DNA, 22 bp, Homo sapiens
actggaaaattcaaatggggtc

SEQ ID NO: 9472465 - DNA, 22 bp, Homo sapiens
actgctttatctgagaagtcct

SEQ ID NO: 9472466 - DNA, 22 bp, Homo sapiens
actgctttatctgagaagtcct

SEQ ID NO: 9472467 - DNA, 22 bp, Homo sapiens
actgcttttagaaatctataga

SEQ ID NO: 9472468 - DNA, 22 bp, Homo sapiens
actgcttttagaaatctataga

SEQ ID NO: 9472469 - DNA, 18 bp, Homo sapiens
agtgcatgctaggggaag

SEQ ID NO: 9472470 - DNA, 20 bp, Homo sapiens
agtgcatggagggagagggc

SEQ ID NO: 9472471 - DNA, 23 bp, Homo sapiens
agtgcatgcttgacttagcaagc

SEQ ID NO: 9472472 - DNA, 22 bp, Homo sapiens
agtgcatgcgcttgggaggggt

SEQ ID NO: 9472473 - DNA, 22 bp, Homo sapiens
agtgcatgaaagcatacaaggc

SEQ ID NO: 9472474 - DNA, 22 bp, Homo sapiens
agtgcatgccttcctgtggatg

SEQ ID NO: 9472475 - DNA, 22 bp, Homo sapiens
agtgcatgaaagcatacaaggc

SEQ ID NO: 9472476 - DNA, 22 bp, Homo sapiens
agtgcatatatgaagagtatga

SEQ ID NO: 9472477 - DNA, 22 bp, Homo sapiens
agtgcagtggttaggagccagg

SEQ ID NO: 9472478 - DNA, 22 bp, Homo sapiens
agtgcagttaggatggggaatt

SEQ ID NO: 9472479 - DNA, 22 bp, Homo sapiens
actgaggcagtgaggtcggtct

SEQ ID NO: 9472480 - DNA, 22 bp, Homo sapiens
actgaggcccgaggatctcctg

SEQ ID NO: 9472481 - DNA, 22 bp, Homo sapiens
actgaggcccgaggatctcctg

SEQ ID NO: 9472482 - DNA, 22 bp, Homo sapiens
actgaggcgcagtccggctgtc

SEQ ID NO: 9472483 - DNA, 22 bp, Homo sapiens
actgaggcgcagtccggctgtc

SEQ ID NO: 9472484 - DNA, 22 bp, Homo sapiens
actgaggctagattgctgttct

SEQ ID NO: 9472485 - DNA, 22 bp, Homo sapiens
actgaggctagattgctgttct

SEQ ID NO: 9472486 - DNA, 22 bp, Homo sapiens
actgaggcttaaagagattagg

SEQ ID NO: 9472487 - DNA, 22 bp, Homo sapiens
actgaggcttaaagagattagg

SEQ ID NO: 9472488 - DNA, 22 bp, Homo sapiens
actgagggccaaaggcactgag

SEQ ID NO: 9472489 - DNA, 22 bp, Homo sapiens
actgagggccaaaggcactgag

SEQ ID NO: 9472490 - DNA, 22 bp, Homo sapiens
actgaggcttacaaaggtaaag

SEQ ID NO: 9472491 - DNA, 22 bp, Homo sapiens
actgaggcttacaaaggtaaag

SEQ ID NO: 9472492 - DNA, 22 bp, Homo sapiens
actgagggactcccacctggca

SEQ ID NO: 9472493 - DNA, 22 bp, Homo sapiens
actgaggcagaagggtaagtgg

SEQ ID NO: 9472494 - DNA, 22 bp, Homo sapiens
actgaggcagtgaggtcggtct

SEQ ID NO: 9472495 - DNA, 21 bp, Homo sapiens
actgaggcaatggatttttgt

SEQ ID NO: 9472496 - DNA, 22 bp, Homo sapiens
actgaggcagaagggtaagtgg

SEQ ID NO: 9472497 - DNA, 22 bp, Homo sapiens
actgaggatggataggtcatat

SEQ ID NO: 9472498 - DNA, 22 bp, Homo sapiens
actgaggacagtgaggagggct

SEQ ID NO: 9472499 - DNA, 22 bp, Homo sapiens
actctgtcacctactcactgta

SEQ ID NO: 9472500 - DNA, 22 bp, Homo sapiens
actctgtgaactctatcagata

SEQ ID NO: 9472501 - DNA, 21 bp, Homo sapiens
actctgtcttgagccatctgt

SEQ ID NO: 9472502 - DNA, 22 bp, Homo sapiens
actctgtgtgagtagagcctgt

SEQ ID NO: 9472503 - DNA, 22 bp, Homo sapiens
actcttactccctcaggcactg

SEQ ID NO: 9472504 - DNA, 22 bp, Homo sapiens
actcttatgggaacaaggatta

SEQ ID NO: 9472505 - DNA, 22 bp, Homo sapiens
actcttatagtattggttatta

SEQ ID NO: 9472506 - DNA, 22 bp, Homo sapiens
actctgtgttttggtggcagca

SEQ ID NO: 9472507 - DNA, 22 bp, Homo sapiens
agtgcagggggaaagggtgtct

SEQ ID NO: 9472508 - DNA, 22 bp, Homo sapiens
agtgcagggggaaagggtgtct

SEQ ID NO: 9472509 - DNA, 22 bp, Homo sapiens
agtgcagtaaatgggcattatg

SEQ ID NO: 9472510 - DNA, 22 bp, Homo sapiens
agtgcaggttaaggaactggcc

SEQ ID NO: 9472511 - DNA, 22 bp, Homo sapiens
agtgcaggttaaggaactggcc

SEQ ID NO: 9472512 - DNA, 22 bp, Homo sapiens
actcttcaccgctactgaaata

SEQ ID NO: 9472513 - DNA, 22 bp, Homo sapiens
agtgcaatgcagtagttcagca

SEQ ID NO: 9472514 - DNA, 22 bp, Homo sapiens
actcttcaccgctactgaaata

SEQ ID NO: 9472515 - DNA, 22 bp, Homo sapiens
actcttattttgaagtaataat

SEQ ID NO: 9472516 - DNA, 22 bp, Homo sapiens
actcttattccctcagaaatat

SEQ ID NO: 9472517 - DNA, 22 bp, Homo sapiens
actcttattccctcagaaatat

SEQ ID NO: 9472518 - DNA, 18 bp, Homo sapiens
agtcttgttctgttgccc

SEQ ID NO: 9472519 - DNA, 19 bp, Homo sapiens
agtcttgtggctttgtgca

SEQ ID NO: 9472520 - DNA, 22 bp, Homo sapiens
agtctttaacatttggagattg

SEQ ID NO: 9472521 - DNA, 18 bp, Homo sapiens
agtctttaaagatgttac

SEQ ID NO: 9472522 - DNA, 22 bp, Homo sapiens
agtcttgggttgcctgatattg

SEQ ID NO: 9472523 - DNA, 22 bp, Homo sapiens
agtctttaatgatcatgtattt

SEQ ID NO: 9472524 - DNA, 22 bp, Homo sapiens
agtctttacatgtgttatatat

SEQ ID NO: 9472525 - DNA, 22 bp, Homo sapiens
agtctttacatgtgttatatat

SEQ ID NO: 9472526 - DNA, 22 bp, Homo sapiens
agtctttagagtcttagtgttt

SEQ ID NO: 9472527 - DNA, 22 bp, Homo sapiens
agtctttagaaggtagttgagg

SEQ ID NO: 9472528 - DNA, 22 bp, Homo sapiens
actccttactaaaaggaacata

SEQ ID NO: 9472529 - DNA, 23 bp, Homo sapiens
actcgtggaattctctgcgatcg

SEQ ID NO: 9472530 - DNA, 23 bp, Homo sapiens
actcgtggaattctctgcgatcg

SEQ ID NO: 9472531 - DNA, 22 bp, Homo sapiens
actctaaaagtgaagtgtggtc

SEQ ID NO: 9472532 - DNA, 22 bp, Homo sapiens
agtcttctgggtgtttccagag

SEQ ID NO: 9472533 - DNA, 22 bp, Homo sapiens
agtcttcttgatcttttcagtg

SEQ ID NO: 9472534 - DNA, 22 bp, Homo sapiens
agtcttcttgatcttttcagtg

SEQ ID NO: 9472535 - DNA, 22 bp, Homo sapiens
agtcttctttcatttactcagt

SEQ ID NO: 9472536 - DNA, 22 bp, Homo sapiens
agtcttctttgtgttctctcat

SEQ ID NO: 9472537 - DNA, 22 bp, Homo sapiens
agtcttctttcatttactcagt

SEQ ID NO: 9472538 - DNA, 22 bp, Homo sapiens
actcctggtgctgatgaagaga

SEQ ID NO: 9472539 - DNA, 22 bp, Homo sapiens
actcctggttcccagttgagat

SEQ ID NO: 9472540 - DNA, 22 bp, Homo sapiens
actcctgtgggcatggcacccc

SEQ ID NO: 9472541 - DNA, 22 bp, Homo sapiens
actcctgtgggcatggcacccc

SEQ ID NO: 9472542 - DNA, 22 bp, Homo sapiens
actcctggtttgtgtcctggct

SEQ ID NO: 9472543 - DNA, 18 bp, Homo sapiens
agtcccatcttcagctct

SEQ ID NO: 9472544 - DNA, 21 bp, Homo sapiens
agtcccatccggtaagcaagc

SEQ ID NO: 9472545 - DNA, 22 bp, Homo sapiens
agtcccatcagatgatatgaga

SEQ ID NO: 9472546 - DNA, 22 bp, Homo sapiens
agtcccatatccgggttcaggg

SEQ ID NO: 9472547 - DNA, 22 bp, Homo sapiens
agtcccatgccaaatgcatcct

SEQ ID NO: 9472548 - DNA, 22 bp, Homo sapiens
agtcccatgaggaatggggacg

SEQ ID NO: 9472549 - DNA, 22 bp, Homo sapiens
agtcccagcttcccccatgcag

SEQ ID NO: 9472550 - DNA, 22 bp, Homo sapiens
agtcccaggcagccgagccggt

SEQ ID NO: 9472551 - DNA, 22 bp, Homo sapiens
agtcccagtgacttggccagaa

SEQ ID NO: 9472552 - DNA, 21 bp, Homo sapiens
agtcccaggggtgagtgatgt

SEQ ID NO: 9472553 - DNA, 21 bp, Homo sapiens
agtcccaggggtgagtgatgt

SEQ ID NO: 9472554 - DNA, 19 bp, Homo sapiens
agtcccaggcccgaaagag

SEQ ID NO: 9472555 - DNA, 22 bp, Homo sapiens
agtcccagtgagatgaaccagg

SEQ ID NO: 9472556 - DNA, 22 bp, Homo sapiens
agtcccagtgagatgaaccagg

SEQ ID NO: 9472557 - DNA, 22 bp, Homo sapiens
agtcccagtgagatgagccacg

SEQ ID NO: 9472558 - DNA, 22 bp, Homo sapiens
agtcccagtgagatgagccacg

SEQ ID NO: 9472559 - DNA, 22 bp, Homo sapiens
agtcccagtgagatgagccacg

SEQ ID NO: 9472560 - DNA, 22 bp, Homo sapiens
agtcccagttcggttcttcctc

SEQ ID NO: 9472561 - DNA, 22 bp, Homo sapiens
agtcccagttcggttcttcctc

SEQ ID NO: 9472562 - DNA, 22 bp, Homo sapiens
agtcccagttcggttcttcctc

SEQ ID NO: 9472563 - DNA, 20 bp, Homo sapiens
aggcactggatttcttatat

SEQ ID NO: 9472564 - DNA, 22 bp, Homo sapiens
aggcactgggaatatgctgagg

SEQ ID NO: 9472565 - DNA, 22 bp, Homo sapiens
aggcactgggaatatgctgagg

SEQ ID NO: 9472566 - DNA, 18 bp, Homo sapiens
aggcactggaattaaggg

SEQ ID NO: 9472567 - DNA, 22 bp, Homo sapiens
aggcactgcttctaagtaggaa

SEQ ID NO: 9472568 - DNA, 22 bp, Homo sapiens
aggcactgggggatgagcaagg

SEQ ID NO: 9472569 - DNA, 22 bp, Homo sapiens
aggcactgggggatgagcaagg

SEQ ID NO: 9472570 - DNA, 22 bp, Homo sapiens
aggcactgggggatgagcaagg

SEQ ID NO: 9472571 - DNA, 22 bp, Homo sapiens
aggcactgggtaattagtagct

SEQ ID NO: 9472572 - DNA, 22 bp, Homo sapiens
aggcactgggggatgagcaagg

SEQ ID NO: 9472573 - DNA, 20 bp, Homo sapiens
aggcactggggataggtaag

SEQ ID NO: 9472574 - DNA, 22 bp, Homo sapiens
acagtttatcgattcacctacc

SEQ ID NO: 9472575 - DNA, 21 bp, Homo sapiens
acagtttattagagtaagtgc

SEQ ID NO: 9472576 - DNA, 21 bp, Homo sapiens
acagtttattagagtaagtgc

SEQ ID NO: 9472577 - DNA, 21 bp, Homo sapiens
acagtttattagagtaagtgc

SEQ ID NO: 9472578 - DNA, 22 bp, Homo sapiens
acagtttgaataatttagatag

SEQ ID NO: 9472579 - DNA, 22 bp, Homo sapiens
acagtttgaataatttagatag

SEQ ID NO: 9472580 - DNA, 17 bp, Homo sapiens
acagtttgattttagca

SEQ ID NO: 9472581 - DNA, 22 bp, Homo sapiens
acagtttgcactgttcatcaaa

SEQ ID NO: 9472582 - DNA, 22 bp, Homo sapiens
acagtttgcactgttcatcaaa

SEQ ID NO: 9472583 - DNA, 22 bp, Homo sapiens
acagtttctccatttacacctt

SEQ ID NO: 9472584 - DNA, 20 bp, Homo sapiens
acagtttattttacttggtt

SEQ ID NO: 9472585 - DNA, 22 bp, Homo sapiens
aggatgagagatacatggagca

SEQ ID NO: 9472586 - DNA, 22 bp, Homo sapiens
aggatgagattgctgtgttgta

SEQ ID NO: 9472587 - DNA, 22 bp, Homo sapiens
aggatgagattccagggtcaat

SEQ ID NO: 9472588 - DNA, 22 bp, Homo sapiens
aggatgagattccagggtcaat

SEQ ID NO: 9472589 - DNA, 22 bp, Homo sapiens
aggatgaggctggcaggtcttg

SEQ ID NO: 9472590 - DNA, 22 bp, Homo sapiens
aggatgaggctggcaggtcttg

SEQ ID NO: 9472591 - DNA, 22 bp, Homo sapiens
aggatgaggctggcaggtcttg

SEQ ID NO: 9472592 - DNA, 22 bp, Homo sapiens
aggatggaattaggtagcaagt

SEQ ID NO: 9472593 - DNA, 21 bp, Homo sapiens
aggatggaaaggactaggggt

SEQ ID NO: 9472594 - DNA, 21 bp, Homo sapiens
aggatggaaaggactaggggt

SEQ ID NO: 9472595 - DNA, 22 bp, Homo sapiens
acagtttaggatgagagaacac

SEQ ID NO: 9472596 - DNA, 22 bp, Homo sapiens
acagtttataaaaataatgagg

SEQ ID NO: 9472597 - DNA, 22 bp, Homo sapiens
acagtttataaaaataatgagg

SEQ ID NO: 9472598 - DNA, 22 bp, Homo sapiens
acagtttataaaaataatgagg

SEQ ID NO: 9472599 - DNA, 20 bp, Homo sapiens
acagtttatccagttagcag

SEQ ID NO: 9472600 - DNA, 22 bp, Homo sapiens
acagtttatcgattcacctacc

SEQ ID NO: 9472601 - DNA, 19 bp, Homo sapiens
aggatggagcaggcggtga

SEQ ID NO: 9472602 - DNA, 19 bp, Homo sapiens
aggatggagcaggcggtga

SEQ ID NO: 9472603 - DNA, 22 bp, Homo sapiens
aggatggattctgtatgtggga

SEQ ID NO: 9472604 - DNA, 22 bp, Homo sapiens
acagtttagaatgccacatagt

SEQ ID NO: 9472605 - DNA, 22 bp, Homo sapiens
acagtttagaatgccacatagt

SEQ ID NO: 9472606 - DNA, 22 bp, Homo sapiens
acatagagcattggatatggga

SEQ ID NO: 9472607 - DNA, 22 bp, Homo sapiens
acatagatgcctctgctgcttc

SEQ ID NO: 9472608 - DNA, 22 bp, Homo sapiens
acatagatttaagagcaattag

SEQ ID NO: 9472609 - DNA, 22 bp, Homo sapiens
acatagaacttcccagtgagca

SEQ ID NO: 9472610 - DNA, 21 bp, Homo sapiens
acatacattatctttttaaaa

SEQ ID NO: 9472611 - DNA, 21 bp, Homo sapiens
acatacattatctttttaaaa

SEQ ID NO: 9472612 - DNA, 22 bp, Homo sapiens
acatagaaggaagagtagtagg

SEQ ID NO: 9472613 - DNA, 22 bp, Homo sapiens
acatagaacttcgatgtctttt

SEQ ID NO: 9472614 - DNA, 22 bp, Homo sapiens
aggcagctagagagtgaaactg

SEQ ID NO: 9472615 - DNA, 17 bp, Homo sapiens
aggcagctcagaacatc

SEQ ID NO: 9472616 - DNA, 22 bp, Homo sapiens
aggcagctaagatggataatga

SEQ ID NO: 9472617 - DNA, 22 bp, Homo sapiens
acatagcagaggactgagcaga

SEQ ID NO: 9472618 - DNA, 22 bp, Homo sapiens
acatagcacgtctcaatttgga

SEQ ID NO: 9472619 - DNA, 22 bp, Homo sapiens
acatagcataaagaatgactct

SEQ ID NO: 9472620 - DNA, 22 bp, Homo sapiens
acatagcataaagaatgactct

SEQ ID NO: 9472621 - DNA, 22 bp, Homo sapiens
acatagcataaagaatgactct

SEQ ID NO: 9472622 - DNA, 22 bp, Homo sapiens
acataggccaatatccagagct

SEQ ID NO: 9472623 - DNA, 22 bp, Homo sapiens
acataggcagagctttaaagct

SEQ ID NO: 9472624 - DNA, 19 bp, Homo sapiens
acatagctggctacactgt

SEQ ID NO: 9472625 - DNA, 22 bp, Homo sapiens
acatagcttaaatgagaagata

SEQ ID NO: 9472626 - DNA, 22 bp, Homo sapiens
acatagctcagcataatcgtgg

SEQ ID NO: 9472627 - DNA, 22 bp, Homo sapiens
aggcagctgccctctccttcct

SEQ ID NO: 9472628 - DNA, 22 bp, Homo sapiens
aggcagctgccctctccttcct

SEQ ID NO: 9472629 - DNA, 22 bp, Homo sapiens
aggcagctgccctctccttcct

SEQ ID NO: 9472630 - DNA, 21 bp, Homo sapiens
aggcagctggaaggcctggct

SEQ ID NO: 9472631 - DNA, 22 bp, Homo sapiens
aggcagctggaaaactccaggc

SEQ ID NO: 9472632 - DNA, 22 bp, Homo sapiens
aggcagctggaaaactccaggc

SEQ ID NO: 9472633 - DNA, 21 bp, Homo sapiens
aggcagctcaggcccagagag

SEQ ID NO: 9472634 - DNA, 17 bp, Homo sapiens
aggcagctcagaacatc

SEQ ID NO: 9472635 - DNA, 22 bp, Homo sapiens
aggcagctctgtggcctcccag

SEQ ID NO: 9472636 - DNA, 22 bp, Homo sapiens
aggcagctgaccacagtatgat

SEQ ID NO: 9472637 - DNA, 22 bp, Homo sapiens
aggcagctgaggtctggcgccc

SEQ ID NO: 9472638 - DNA, 22 bp, Homo sapiens
acatattaactgcactacacta

SEQ ID NO: 9472639 - DNA, 22 bp, Homo sapiens
acatattaactgcactacacta

SEQ ID NO: 9472640 - DNA, 22 bp, Homo sapiens
acatattaactgcactacacta

SEQ ID NO: 9472641 - DNA, 21 bp, Homo sapiens
aggcagctggaaggcctggct

SEQ ID NO: 9472642 - DNA, 22 bp, Homo sapiens
aggcagctggaggcagagacta

SEQ ID NO: 9472643 - DNA, 22 bp, Homo sapiens
acatatttccatgcagcatgtc

SEQ ID NO: 9472644 - DNA, 22 bp, Homo sapiens
acatatttccatgcagcatgtc

SEQ ID NO: 9472645 - DNA, 22 bp, Homo sapiens
acatattccattgttgggatcc

SEQ ID NO: 9472646 - DNA, 22 bp, Homo sapiens
acatattgagctctaaaagtac

SEQ ID NO: 9472647 - DNA, 22 bp, Homo sapiens
acatattgagctctaaaagtac

SEQ ID NO: 9472648 - DNA, 22 bp, Homo sapiens
acatattgagctctaaaagtac

SEQ ID NO: 9472649 - DNA, 22 bp, Homo sapiens
acatattggcaaactggaggca

SEQ ID NO: 9472650 - DNA, 22 bp, Homo sapiens
acatattggcttagctctgtga

SEQ ID NO: 9472651 - DNA, 22 bp, Homo sapiens
acatattggcttagctctgtga

SEQ ID NO: 9472652 - DNA, 20 bp, Homo sapiens
acaggttcattctgtgtgac

SEQ ID NO: 9472653 - DNA, 20 bp, Homo sapiens
acaggttcattctgtgtgac

SEQ ID NO: 9472654 - DNA, 22 bp, Homo sapiens
acaggtttgctgctgttttagg

SEQ ID NO: 9472655 - DNA, 22 bp, Homo sapiens
acaggtttagctcttagtagtc

SEQ ID NO: 9472656 - DNA, 21 bp, Homo sapiens
aggacacagagacacctattg

SEQ ID NO: 9472657 - DNA, 22 bp, Homo sapiens
aggacacagactgattgcagca

SEQ ID NO: 9472658 - DNA, 22 bp, Homo sapiens
aggacacaggcaggaggagatc

SEQ ID NO: 9472659 - DNA, 22 bp, Homo sapiens
aggacacagctgctctgcagag

SEQ ID NO: 9472660 - DNA, 22 bp, Homo sapiens
acagtaaagccttctggttgac

SEQ ID NO: 9472661 - DNA, 22 bp, Homo sapiens
acagtaaacaatgcagcaaatt

SEQ ID NO: 9472662 - DNA, 22 bp, Homo sapiens
acagtaaataatgcatgttgat

SEQ ID NO: 9472663 - DNA, 16 bp, Homo sapiens
acagtaaagctggaca

SEQ ID NO: 9472664 - DNA, 22 bp, Homo sapiens
acagtaaataatgcatgttgat

SEQ ID NO: 9472665 - DNA, 22 bp, Homo sapiens
acaggtttgtctgatgtaatga

SEQ ID NO: 9472666 - DNA, 22 bp, Homo sapiens
acaggtttttgtggatatatgt

SEQ ID NO: 9472667 - DNA, 22 bp, Homo sapiens
acagtaaacaatgcagcaaatt

SEQ ID NO: 9472668 - DNA, 22 bp, Homo sapiens
acagtaaaacatttttattagg

SEQ ID NO: 9472669 - DNA, 22 bp, Homo sapiens
aggagcaaatgatgagacagca

SEQ ID NO: 9472670 - DNA, 22 bp, Homo sapiens
aggagcaaggaagctacagttt

SEQ ID NO: 9472671 - DNA, 22 bp, Homo sapiens
aggagcaaatgatgagacagca

SEQ ID NO: 9472672 - DNA, 22 bp, Homo sapiens
aggagcaaatgatgagacagca

SEQ ID NO: 9472673 - DNA, 22 bp, Homo sapiens
aggagcaaatgatgagacagca

SEQ ID NO: 9472674 - DNA, 22 bp, Homo sapiens
acagtaaatcaacagaatatct

SEQ ID NO: 9472675 - DNA, 22 bp, Homo sapiens
aggagatggagctcagtgggca

SEQ ID NO: 9472676 - DNA, 22 bp, Homo sapiens
aggagcagaactgttgtggagg

SEQ ID NO: 9472677 - DNA, 22 bp, Homo sapiens
aggagcagaactgattctgact

SEQ ID NO: 9472678 - DNA, 22 bp, Homo sapiens
aggagcagaactgattctgact

SEQ ID NO: 9472679 - DNA, 22 bp, Homo sapiens
aggagcagaactgattctgact

SEQ ID NO: 9472680 - DNA, 22 bp, Homo sapiens
aggagcagaactgattctgact

SEQ ID NO: 9472681 - DNA, 22 bp, Homo sapiens
aggagcagaactgattctgact

SEQ ID NO: 9472682 - DNA, 22 bp, Homo sapiens
acagtatatatagtctaaaagc

SEQ ID NO: 9472683 - DNA, 21 bp, Homo sapiens
acagtatattagatatttgaa

SEQ ID NO: 9472684 - DNA, 22 bp, Homo sapiens
acagtatatatggttatctgat

SEQ ID NO: 9472685 - DNA, 22 bp, Homo sapiens
aggagcagaatttaatgtgcag

SEQ ID NO: 9472686 - DNA, 22 bp, Homo sapiens
aggagcagaccgtagtcctgca

SEQ ID NO: 9472687 - DNA, 22 bp, Homo sapiens
aggagcagaccgtagtcctgca

SEQ ID NO: 9472688 - DNA, 22 bp, Homo sapiens
acagtacaccactgtgtacagt

SEQ ID NO: 9472689 - DNA, 22 bp, Homo sapiens
aggagcagaccgtagtcctgca

SEQ ID NO: 9472690 - DNA, 22 bp, Homo sapiens
acagtgggatgaggctggcccc

SEQ ID NO: 9472691 - DNA, 22 bp, Homo sapiens
acagtgtctcctggtacccagt

SEQ ID NO: 9472692 - DNA, 20 bp, Homo sapiens
acagtgggtggggagcactg

SEQ ID NO: 9472693 - DNA, 23 bp, Homo sapiens
acagtgtctgctgcaagatatct

SEQ ID NO: 9472694 - DNA, 23 bp, Homo sapiens
acagtgtctgctgcaagatatct

SEQ ID NO: 9472695 - DNA, 22 bp, Homo sapiens
acagtgtctgacacattgtagc

SEQ ID NO: 9472696 - DNA, 22 bp, Homo sapiens
acagtgtctgacacgtaggaag

SEQ ID NO: 9472697 - DNA, 22 bp, Homo sapiens
acagtctgcctctcagagcagc

SEQ ID NO: 9472698 - DNA, 22 bp, Homo sapiens
acagtctgcctctcagagcagc

SEQ ID NO: 9472699 - DNA, 22 bp, Homo sapiens
acagtgtgacaattgtgtcaga

SEQ ID NO: 9472700 - DNA, 22 bp, Homo sapiens
acagtgtgacaattgtgtcaga

SEQ ID NO: 9472701 - DNA, 19 bp, Homo sapiens
acagtgtctgtatataaat

SEQ ID NO: 9472702 - DNA, 22 bp, Homo sapiens
acagtgtggggtgagatggaac

SEQ ID NO: 9472703 - DNA, 22 bp, Homo sapiens
acagtgtggggtgagatggaac

SEQ ID NO: 9472704 - DNA, 22 bp, Homo sapiens
acagtgtggaaagtcaacttga

SEQ ID NO: 9472705 - DNA, 22 bp, Homo sapiens
acagtgtggtttgagcactggg

SEQ ID NO: 9472706 - DNA, 22 bp, Homo sapiens
acagtgtggttgtttctggtta

SEQ ID NO: 9472707 - DNA, 22 bp, Homo sapiens
acagtgtggtttgagcactggg

SEQ ID NO: 9472708 - DNA, 22 bp, Homo sapiens
acagtgtggtttgagcactggg

SEQ ID NO: 9472709 - DNA, 22 bp, Homo sapiens
acagtgtgtcctaaaggtctgg

SEQ ID NO: 9472710 - DNA, 22 bp, Homo sapiens
acagtgtgtgggaaatgtgact

SEQ ID NO: 9472711 - DNA, 22 bp, Homo sapiens
acagtgtgtgctttcccttacg

SEQ ID NO: 9472712 - DNA, 22 bp, Homo sapiens
acagtctcttgcttgaatacta

SEQ ID NO: 9472713 - DNA, 22 bp, Homo sapiens
acagtctcttggaattttcaga

SEQ ID NO: 9472714 - DNA, 22 bp, Homo sapiens
acagtctctccacactgcaggg

SEQ ID NO: 9472715 - DNA, 22 bp, Homo sapiens
acagtctctgttgctgctgttt

SEQ ID NO: 9472716 - DNA, 22 bp, Homo sapiens
acagtctaggcctaggtcaaaa

SEQ ID NO: 9472717 - DNA, 22 bp, Homo sapiens
acagtctaggtgtgtgatttaa

SEQ ID NO: 9472718 - DNA, 21 bp, Homo sapiens
acagtctccccagatctctcc

SEQ ID NO: 9472719 - DNA, 23 bp, Homo sapiens
acagtcgtaggtatccttttcct

SEQ ID NO: 9472720 - DNA, 22 bp, Homo sapiens
acagtccttgtgtggaacatta

SEQ ID NO: 9472721 - DNA, 22 bp, Homo sapiens
acagtcctagctgcaaagaagt

SEQ ID NO: 9472722 - DNA, 22 bp, Homo sapiens
acagtcctgtacaggccatatc

SEQ ID NO: 9472723 - DNA, 22 bp, Homo sapiens
acagtcaatgagtgagtgaatg

SEQ ID NO: 9472724 - DNA, 22 bp, Homo sapiens
acagtcaatcagaacagcatgt

SEQ ID NO: 9472725 - DNA, 21 bp, Homo sapiens
acagtcacaaaaccaaggcag

SEQ ID NO: 9472726 - DNA, 22 bp, Homo sapiens
acagtcaagaaatggcagagcc

SEQ ID NO: 9472727 - DNA, 22 bp, Homo sapiens
acagtatttgcgatactgatga

SEQ ID NO: 9472728 - DNA, 22 bp, Homo sapiens
acagtccccataccacctgtcc

SEQ ID NO: 9472729 - DNA, 19 bp, Homo sapiens
acagtccagctgtttgtac

SEQ ID NO: 9472730 - DNA, 22 bp, Homo sapiens
acagtcattagatacaatgtct

SEQ ID NO: 9472731 - DNA, 22 bp, Homo sapiens
acagtccagcctagtatgtata

SEQ ID NO: 9472732 - DNA, 22 bp, Homo sapiens
acagtcattagatacaatgtct

SEQ ID NO: 9472733 - DNA, 22 bp, Homo sapiens
agctgaagttcagtccagagaa

SEQ ID NO: 9472734 - DNA, 22 bp, Homo sapiens
agctgaagtttagaattgtgaa

SEQ ID NO: 9472735 - DNA, 22 bp, Homo sapiens
agctgaatcgaatggcccagtg

SEQ ID NO: 9472736 - DNA, 22 bp, Homo sapiens
agctgaatcttgactaggaaga

SEQ ID NO: 9472737 - DNA, 22 bp, Homo sapiens
agctgacataagcactttctaa

SEQ ID NO: 9472738 - DNA, 17 bp, Homo sapiens
agctgacatcaaaactt

SEQ ID NO: 9472739 - DNA, 22 bp, Homo sapiens
agctgacctggaagggggcacg

SEQ ID NO: 9472740 - DNA, 22 bp, Homo sapiens
agctgactgatgaagaggcctt

SEQ ID NO: 9472741 - DNA, 22 bp, Homo sapiens
agctgactctggcctctggtcc

SEQ ID NO: 9472742 - DNA, 22 bp, Homo sapiens
agctgagagctgtgtcaagata

SEQ ID NO: 9472743 - DNA, 22 bp, Homo sapiens
agctgagagctgtgtcaagata

SEQ ID NO: 9472744 - DNA, 22 bp, Homo sapiens
agctgaagcaacaacaggatgg

SEQ ID NO: 9472745 - DNA, 22 bp, Homo sapiens
agctctggttattgaagcaggg

SEQ ID NO: 9472746 - DNA, 22 bp, Homo sapiens
agctgaagggaggatatgtaca

SEQ ID NO: 9472747 - DNA, 22 bp, Homo sapiens
agctgaaggctagaacagctgg

SEQ ID NO: 9472748 - DNA, 20 bp, Homo sapiens
agctgaagcccttggggaaa

SEQ ID NO: 9472749 - DNA, 22 bp, Homo sapiens
agctctggggtggagcccagga

SEQ ID NO: 9472750 - DNA, 22 bp, Homo sapiens
agctctgggtcacggctgccga

SEQ ID NO: 9472751 - DNA, 22 bp, Homo sapiens
agctctggtgagatgttattca

SEQ ID NO: 9472752 - DNA, 22 bp, Homo sapiens
agctctggtatttctttaatcc

SEQ ID NO: 9472753 - DNA, 22 bp, Homo sapiens
agctctgggtcacggctgccga

SEQ ID NO: 9472754 - DNA, 22 bp, Homo sapiens
agctggaggggccagcaggtgt

SEQ ID NO: 9472755 - DNA, 22 bp, Homo sapiens
agctggaggggccagcaggtgt

SEQ ID NO: 9472756 - DNA, 22 bp, Homo sapiens
agctggaggggccagcaggtgt

SEQ ID NO: 9472757 - DNA, 22 bp, Homo sapiens
agctggaggggccagcaggtgt

SEQ ID NO: 9472758 - DNA, 22 bp, Homo sapiens
acagctgtattcaagttgcaag

SEQ ID NO: 9472759 - DNA, 22 bp, Homo sapiens
acagctgtatccccagagctca

SEQ ID NO: 9472760 - DNA, 22 bp, Homo sapiens
agctggaggggccagcaggtgt

SEQ ID NO: 9472761 - DNA, 23 bp, Homo sapiens
agctggaggctgtctactcccaa

SEQ ID NO: 9472762 - DNA, 22 bp, Homo sapiens
acagctggtgaatgttctctgt

SEQ ID NO: 9472763 - DNA, 22 bp, Homo sapiens
acagctgtatccccagagctca

SEQ ID NO: 9472764 - DNA, 22 bp, Homo sapiens
acagctgggtgctgctcagagc

SEQ ID NO: 9472765 - DNA, 22 bp, Homo sapiens
acagctgggtgtcccacttctg

SEQ ID NO: 9472766 - DNA, 22 bp, Homo sapiens
acagctgggtgtcccacttctg

SEQ ID NO: 9472767 - DNA, 22 bp, Homo sapiens
acagctggtgaatgttctctgt

SEQ ID NO: 9472768 - DNA, 22 bp, Homo sapiens
acagctggtgaatgttctctgt

SEQ ID NO: 9472769 - DNA, 22 bp, Homo sapiens
acagctgggtgtcccacttctg

SEQ ID NO: 9472770 - DNA, 22 bp, Homo sapiens
acagctgggaatcagctgggga

SEQ ID NO: 9472771 - DNA, 22 bp, Homo sapiens
acagctggccgaggctcaggga

SEQ ID NO: 9472772 - DNA, 22 bp, Homo sapiens
acagctggcaggggggcatgaa

SEQ ID NO: 9472773 - DNA, 22 bp, Homo sapiens
agctgagagcccctgccctgtg

SEQ ID NO: 9472774 - DNA, 22 bp, Homo sapiens
agctgagagctgtgtcaagata

SEQ ID NO: 9472775 - DNA, 22 bp, Homo sapiens
acagctgctcacctgtgagccc

SEQ ID NO: 9472776 - DNA, 22 bp, Homo sapiens
acaggagaattatctggaacaa

SEQ ID NO: 9472777 - DNA, 22 bp, Homo sapiens
acaggagaattatctggaacaa

SEQ ID NO: 9472778 - DNA, 22 bp, Homo sapiens
acaggagggacaccttcctgct

SEQ ID NO: 9472779 - DNA, 22 bp, Homo sapiens
acaggaggagctgtttcaggga

SEQ ID NO: 9472780 - DNA, 23 bp, Homo sapiens
acaggaggggacaggtggccgtg

SEQ ID NO: 9472781 - DNA, 22 bp, Homo sapiens
acaggagtagggctggtggaga

SEQ ID NO: 9472782 - DNA, 22 bp, Homo sapiens
acaggagtgaatctggcactta

SEQ ID NO: 9472783 - DNA, 22 bp, Homo sapiens
acaggagtggctctaccagacc

SEQ ID NO: 9472784 - DNA, 22 bp, Homo sapiens
acaggagtggagaggtgcctct

SEQ ID NO: 9472785 - DNA, 22 bp, Homo sapiens
acaggaggggcatgaaagacgg

SEQ ID NO: 9472786 - DNA, 23 bp, Homo sapiens
acaggaggggacaggtggccgtg

SEQ ID NO: 9472787 - DNA, 22 bp, Homo sapiens
agctggcaaggctttagattca

SEQ ID NO: 9472788 - DNA, 22 bp, Homo sapiens
agctggcaatgtaagtccctgg

SEQ ID NO: 9472789 - DNA, 21 bp, Homo sapiens
agctggcaatgttgtcctctt

SEQ ID NO: 9472790 - DNA, 21 bp, Homo sapiens
agctggcagatatggtgtctg

SEQ ID NO: 9472791 - DNA, 22 bp, Homo sapiens
agctggcacagaccaggagatc

SEQ ID NO: 9472792 - DNA, 22 bp, Homo sapiens
agctggcaccaaatatagtaaa

SEQ ID NO: 9472793 - DNA, 19 bp, Homo sapiens
agctggcactagaatccag

SEQ ID NO: 9472794 - DNA, 21 bp, Homo sapiens
agctggtgtcagagctctggg

SEQ ID NO: 9472795 - DNA, 22 bp, Homo sapiens
agctggtgtcacctccagtcca

SEQ ID NO: 9472796 - DNA, 21 bp, Homo sapiens
agctggtgtcagagctctggg

SEQ ID NO: 9472797 - DNA, 22 bp, Homo sapiens
agctggtgtgccactgttgggg

SEQ ID NO: 9472798 - DNA, 22 bp, Homo sapiens
agctggtgtgccactgttgggg

SEQ ID NO: 9472799 - DNA, 22 bp, Homo sapiens
agctggtgtcctcctggagctg

SEQ ID NO: 9472800 - DNA, 22 bp, Homo sapiens
agctggtgtcctcctggagctg

SEQ ID NO: 9472801 - DNA, 22 bp, Homo sapiens
agctggtgtgccagttccagtt

SEQ ID NO: 9472802 - DNA, 22 bp, Homo sapiens
agctggtgtgccagttccagtt

SEQ ID NO: 9472803 - DNA, 22 bp, Homo sapiens
acaggcacaggtgtgccccacc

SEQ ID NO: 9472804 - DNA, 22 bp, Homo sapiens
acaggcagagtcaggttgggtt

SEQ ID NO: 9472805 - DNA, 22 bp, Homo sapiens
agctggtggattatgctgtaca

SEQ ID NO: 9472806 - DNA, 22 bp, Homo sapiens
agctggtggggaagctgcaggt

SEQ ID NO: 9472807 - DNA, 18 bp, Homo sapiens
agctggtggggagacagc

SEQ ID NO: 9472808 - DNA, 18 bp, Homo sapiens
agctggtggggagacagc

SEQ ID NO: 9472809 - DNA, 22 bp, Homo sapiens
acaggatcgccctgttgcccag

SEQ ID NO: 9472810 - DNA, 21 bp, Homo sapiens
acaggataggacagtgttcct

SEQ ID NO: 9472811 - DNA, 22 bp, Homo sapiens
acaggagttcagaggacacccc

SEQ ID NO: 9472812 - DNA, 22 bp, Homo sapiens
acaggagttaaggctgagttga

SEQ ID NO: 9472813 - DNA, 22 bp, Homo sapiens
acaggagttaaccatgggaagt

SEQ ID NO: 9472814 - DNA, 22 bp, Homo sapiens
acaggagtttctgacagagaca

SEQ ID NO: 9472815 - DNA, 22 bp, Homo sapiens
acaggagtttaagaaatatttc

SEQ ID NO: 9472816 - DNA, 17 bp, Homo sapiens
acaggcagatcacctga

SEQ ID NO: 9472817 - DNA, 17 bp, Homo sapiens
acaggcagatcacctga

SEQ ID NO: 9472818 - DNA, 22 bp, Homo sapiens
acaggcagatgttttagttgta

SEQ ID NO: 9472819 - DNA, 22 bp, Homo sapiens
acaggcagatgttttagttgta

SEQ ID NO: 9472820 - DNA, 22 bp, Homo sapiens
acaggcagattaagggtaggca

SEQ ID NO: 9472821 - DNA, 22 bp, Homo sapiens
acaggcagattaagggtaggca

SEQ ID NO: 9472822 - DNA, 22 bp, Homo sapiens
acaggcagattaagggtaggca

SEQ ID NO: 9472823 - DNA, 22 bp, Homo sapiens
acaggcagattaagggtaggca

SEQ ID NO: 9472824 - DNA, 22 bp, Homo sapiens
acaggcagcaaaatcagcctca

SEQ ID NO: 9472825 - DNA, 22 bp, Homo sapiens
acaggcagcaaaatcagcctca

SEQ ID NO: 9472826 - DNA, 22 bp, Homo sapiens
acaggcagcactaatctctggt

SEQ ID NO: 9472827 - DNA, 22 bp, Homo sapiens
acaggcagcactaatctctggt

SEQ ID NO: 9472828 - DNA, 22 bp, Homo sapiens
acaggcaggcttcggccagagc

SEQ ID NO: 9472829 - DNA, 22 bp, Homo sapiens
acaggcaggcgggacagcccga

SEQ ID NO: 9472830 - DNA, 22 bp, Homo sapiens
acaggcaggcgggacagcccga

SEQ ID NO: 9472831 - DNA, 22 bp, Homo sapiens
acaggcaggcgggacagcccga

SEQ ID NO: 9472832 - DNA, 22 bp, Homo sapiens
acaggcaggcgggacagcccga

SEQ ID NO: 9472833 - DNA, 22 bp, Homo sapiens
acaggcaggcgggacagcccga

SEQ ID NO: 9472834 - DNA, 22 bp, Homo sapiens
acaggcaggcgggacagcccga

SEQ ID NO: 9472835 - DNA, 22 bp, Homo sapiens
acagggagatatcttcaatatc

SEQ ID NO: 9472836 - DNA, 22 bp, Homo sapiens
acagggagatatcttcaatatc

SEQ ID NO: 9472837 - DNA, 22 bp, Homo sapiens
acagggagatgggtgaaagcgg

SEQ ID NO: 9472838 - DNA, 22 bp, Homo sapiens
acagggagatgggtgaaagcgg

SEQ ID NO: 9472839 - DNA, 22 bp, Homo sapiens
acagggaatggagggatcagta

SEQ ID NO: 9472840 - DNA, 22 bp, Homo sapiens
acagggaatggagggatcagta

SEQ ID NO: 9472841 - DNA, 22 bp, Homo sapiens
acagggaatggagggatcagta

SEQ ID NO: 9472842 - DNA, 19 bp, Homo sapiens
acagggaatttccacagaa

SEQ ID NO: 9472843 - DNA, 22 bp, Homo sapiens
acagggaagttctgcaacagga

SEQ ID NO: 9472844 - DNA, 22 bp, Homo sapiens
acagggaatggagggatcagta

SEQ ID NO: 9472845 - DNA, 22 bp, Homo sapiens
acagggaatggagggatcagta

SEQ ID NO: 9472846 - DNA, 22 bp, Homo sapiens
acagggaagttctgcaacagga

SEQ ID NO: 9472847 - DNA, 22 bp, Homo sapiens
acagggaagttctgcaacagga

SEQ ID NO: 9472848 - DNA, 22 bp, Homo sapiens
acagggaagttctgcaacagga

SEQ ID NO: 9472849 - DNA, 22 bp, Homo sapiens
acagggaaggagcatagaaaaa

SEQ ID NO: 9472850 - DNA, 22 bp, Homo sapiens
acagggaaggatttagtgggaa

SEQ ID NO: 9472851 - DNA, 22 bp, Homo sapiens
acagggaaggatttagtgggaa

SEQ ID NO: 9472852 - DNA, 22 bp, Homo sapiens
acagggaaggatttagtgggaa

SEQ ID NO: 9472853 - DNA, 22 bp, Homo sapiens
acagggaagttctgcaacagga

SEQ ID NO: 9472854 - DNA, 22 bp, Homo sapiens
acaggcagggaccttggctaag

SEQ ID NO: 9472855 - DNA, 22 bp, Homo sapiens
acaggcagggacctcttgagtt

SEQ ID NO: 9472856 - DNA, 22 bp, Homo sapiens
acaggcagggacctcttgagtt

SEQ ID NO: 9472857 - DNA, 22 bp, Homo sapiens
acaggcaggcttcggccagagc

SEQ ID NO: 9472858 - DNA, 22 bp, Homo sapiens
acaggcaggcttcggccagagc

SEQ ID NO: 9472859 - DNA, 22 bp, Homo sapiens
acagggaaggacatgacttggc

SEQ ID NO: 9472860 - DNA, 22 bp, Homo sapiens
acagggaaggacatgacttggc

SEQ ID NO: 9472861 - DNA, 22 bp, Homo sapiens
acagggaagctcaggggctctg

SEQ ID NO: 9472862 - DNA, 22 bp, Homo sapiens
acaggctgttggggtccagggt

SEQ ID NO: 9472863 - DNA, 22 bp, Homo sapiens
acaggcagggaccttggctaag

SEQ ID NO: 9472864 - DNA, 22 bp, Homo sapiens
acaggcagggaccttggctaag

SEQ ID NO: 9472865 - DNA, 22 bp, Homo sapiens
aggacacaccaggtccagctgt

SEQ ID NO: 9472866 - DNA, 22 bp, Homo sapiens
aggacacacccagctcacgggg

SEQ ID NO: 9472867 - DNA, 22 bp, Homo sapiens
aggacacacagaatacaaatcc

SEQ ID NO: 9472868 - DNA, 22 bp, Homo sapiens
aggacacaccaggtccagctgt

SEQ ID NO: 9472869 - DNA, 22 bp, Homo sapiens
aggacacactgcaagagcctgg

SEQ ID NO: 9472870 - DNA, 22 bp, Homo sapiens
aggacacacccagctcacgggg

SEQ ID NO: 9472871 - DNA, 19 bp, Homo sapiens
acaggggctagcggaagca

SEQ ID NO: 9472872 - DNA, 19 bp, Homo sapiens
acaggggcctttccagggt

SEQ ID NO: 9472873 - DNA, 22 bp, Homo sapiens
aggacaatctctcctttatcag

SEQ ID NO: 9472874 - DNA, 19 bp, Homo sapiens
acaggggctagcggaagca

SEQ ID NO: 9472875 - DNA, 22 bp, Homo sapiens
aggacacacaaagagtgagaac

SEQ ID NO: 9472876 - DNA, 22 bp, Homo sapiens
aggacacacaaagagtgagaac

SEQ ID NO: 9472877 - DNA, 22 bp, Homo sapiens
aggacacacaaagagtgagaac

SEQ ID NO: 9472878 - DNA, 22 bp, Homo sapiens
aggacaattttggcatagttct

SEQ ID NO: 9472879 - DNA, 20 bp, Homo sapiens
acaggggcagcacaataatg

SEQ ID NO: 9472880 - DNA, 22 bp, Homo sapiens
acaggggcaagggctcacggcc

SEQ ID NO: 9472881 - DNA, 22 bp, Homo sapiens
acaggggcaagggctcacggcc

SEQ ID NO: 9472882 - DNA, 19 bp, Homo sapiens
acaggggcctttccagggt

SEQ ID NO: 9472883 - DNA, 22 bp, Homo sapiens
acaggggcaggcaggacccttt

SEQ ID NO: 9472884 - DNA, 22 bp, Homo sapiens
acaggggcaggcaggacccttt

SEQ ID NO: 9472885 - DNA, 22 bp, Homo sapiens
acaggggacctaggaccctcgg

SEQ ID NO: 9472886 - DNA, 22 bp, Homo sapiens
acaggggacctaggaccctcgg

SEQ ID NO: 9472887 - DNA, 22 bp, Homo sapiens
acaggggaatttactgtcatta

SEQ ID NO: 9472888 - DNA, 22 bp, Homo sapiens
acagggcttttaatcagtagtt

SEQ ID NO: 9472889 - DNA, 22 bp, Homo sapiens
aggaagaatgtttacatatcaa

SEQ ID NO: 9472890 - DNA, 22 bp, Homo sapiens
aggaagaatgtttacatatcaa

SEQ ID NO: 9472891 - DNA, 22 bp, Homo sapiens
aggaagaatgtttacatatcaa

SEQ ID NO: 9472892 - DNA, 22 bp, Homo sapiens
aggaagaatgtttacatatcaa

SEQ ID NO: 9472893 - DNA, 22 bp, Homo sapiens
aggaagaatgtttacatatcaa

SEQ ID NO: 9472894 - DNA, 22 bp, Homo sapiens
aggaagaacctaagaaagtctc

SEQ ID NO: 9472895 - DNA, 23 bp, Homo sapiens
aggaagagagagtgcctctttct

SEQ ID NO: 9472896 - DNA, 23 bp, Homo sapiens
aggaagagagagtgcctctttct

SEQ ID NO: 9472897 - DNA, 22 bp, Homo sapiens
acagggctatattcctcagagt

SEQ ID NO: 9472898 - DNA, 22 bp, Homo sapiens
acagggagccccagcatttcca

SEQ ID NO: 9472899 - DNA, 22 bp, Homo sapiens
acagggagccccagcatttcca

SEQ ID NO: 9472900 - DNA, 18 bp, Homo sapiens
acagggagggcgctgggg

SEQ ID NO: 9472901 - DNA, 22 bp, Homo sapiens
acagggagccccagcatttcca

SEQ ID NO: 9472902 - DNA, 22 bp, Homo sapiens
acagggagatgggtgaaagcgg

SEQ ID NO: 9472903 - DNA, 22 bp, Homo sapiens
acagggagatgggtgaaagcgg

SEQ ID NO: 9472904 - DNA, 22 bp, Homo sapiens
acagggagccccagcatttcca

SEQ ID NO: 9472905 - DNA, 21 bp, Homo sapiens
aggaagaaaggttggaggttg

SEQ ID NO: 9472906 - DNA, 21 bp, Homo sapiens
aggaagaaaggttggaggttg

SEQ ID NO: 9472907 - DNA, 22 bp, Homo sapiens
aggaagaaactgagctctgaca

SEQ ID NO: 9472908 - DNA, 22 bp, Homo sapiens
aggaagaaatgtgacttcaaac

SEQ ID NO: 9472909 - DNA, 22 bp, Homo sapiens
aggaagaacagataatggacgc

SEQ ID NO: 9472910 - DNA, 22 bp, Homo sapiens
aggaagaaatgtgacttcaaac

SEQ ID NO: 9472911 - DNA, 22 bp, Homo sapiens
aggaagaacagataatggacgc

SEQ ID NO: 9472912 - DNA, 22 bp, Homo sapiens
aggaagaacctaagaaagtctc

SEQ ID NO: 9472913 - DNA, 22 bp, Homo sapiens
aggaagaacagataatggacgc

SEQ ID NO: 9472914 - DNA, 22 bp, Homo sapiens
aggctgaaaacgagatggcaat

SEQ ID NO: 9472915 - DNA, 22 bp, Homo sapiens
aggctctttgagactacctgga

SEQ ID NO: 9472916 - DNA, 22 bp, Homo sapiens
aggctctttccactctggtgca

SEQ ID NO: 9472917 - DNA, 22 bp, Homo sapiens
aggctctgtttgctgtggtacc

SEQ ID NO: 9472918 - DNA, 22 bp, Homo sapiens
aggctctgtttgctgtggtacc

SEQ ID NO: 9472919 - DNA, 22 bp, Homo sapiens
aggcctgaggttcctgtgctca

SEQ ID NO: 9472920 - DNA, 22 bp, Homo sapiens
aggcctgcagcaggagcaaacc

SEQ ID NO: 9472921 - DNA, 18 bp, Homo sapiens
aggcctgcccagcactgt

SEQ ID NO: 9472922 - DNA, 22 bp, Homo sapiens
aggctctggctactacagagct

SEQ ID NO: 9472923 - DNA, 22 bp, Homo sapiens
aggctctgttattctagagggc

SEQ ID NO: 9472924 - DNA, 22 bp, Homo sapiens
aggctctgttattctagagggc

SEQ ID NO: 9472925 - DNA, 22 bp, Homo sapiens
aggctctgttattctagagggc

SEQ ID NO: 9472926 - DNA, 22 bp, Homo sapiens
aggctctggctactacagagct

SEQ ID NO: 9472927 - DNA, 22 bp, Homo sapiens
aggctctggctactacagagct

SEQ ID NO: 9472928 - DNA, 22 bp, Homo sapiens
acattgcaataataattctctt

SEQ ID NO: 9472929 - DNA, 22 bp, Homo sapiens
acattgcaattaggtacctatg

SEQ ID NO: 9472930 - DNA, 22 bp, Homo sapiens
acattgatcagcctcccatgca

SEQ ID NO: 9472931 - DNA, 22 bp, Homo sapiens
acattgatgaaaaggtatcatt

SEQ ID NO: 9472932 - DNA, 18 bp, Homo sapiens
acattgatggctttaagc

SEQ ID NO: 9472933 - DNA, 20 bp, Homo sapiens
acattgattatgtttgtaga

SEQ ID NO: 9472934 - DNA, 22 bp, Homo sapiens
aggctgagactgtgcattagtg

SEQ ID NO: 9472935 - DNA, 22 bp, Homo sapiens
aggctgagactgtgcattagtg

SEQ ID NO: 9472936 - DNA, 22 bp, Homo sapiens
aggctgagaaagtgggaagatg

SEQ ID NO: 9472937 - DNA, 22 bp, Homo sapiens
aggctgagaaagtgggaagatg

SEQ ID NO: 9472938 - DNA, 22 bp, Homo sapiens
aggctgagaaagtgggaagatg

SEQ ID NO: 9472939 - DNA, 22 bp, Homo sapiens
aggctgagaaagtgggaagatg

SEQ ID NO: 9472940 - DNA, 22 bp, Homo sapiens
aggctgacggcttgcttgtatc

SEQ ID NO: 9472941 - DNA, 22 bp, Homo sapiens
aggctgagaaagtgggaagatg

SEQ ID NO: 9472942 - DNA, 22 bp, Homo sapiens
aggctgagaaagtgggaagatg

SEQ ID NO: 9472943 - DNA, 22 bp, Homo sapiens
aggctgagaaagtgggaagatg

SEQ ID NO: 9472944 - DNA, 22 bp, Homo sapiens
acatttctatagtgcatctgtt

SEQ ID NO: 9472945 - DNA, 22 bp, Homo sapiens
acatttctagttgttcatctcc

SEQ ID NO: 9472946 - DNA, 22 bp, Homo sapiens
acatttctagttgttcatctcc

SEQ ID NO: 9472947 - DNA, 22 bp, Homo sapiens
acatttctaatttaatgtaaca

SEQ ID NO: 9472948 - DNA, 22 bp, Homo sapiens
acatttctaatttaatgtaaca

SEQ ID NO: 9472949 - DNA, 22 bp, Homo sapiens
acatttctaatttaatgtaaca

SEQ ID NO: 9472950 - DNA, 22 bp, Homo sapiens
acatttctaatttaatgtaaca

SEQ ID NO: 9472951 - DNA, 18 bp, Homo sapiens
acatttctaggtgaaagc

SEQ ID NO: 9472952 - DNA, 22 bp, Homo sapiens
acatttctaatttaatgtaaca

SEQ ID NO: 9472953 - DNA, 22 bp, Homo sapiens
acattgtagacttttcatatgt

SEQ ID NO: 9472954 - DNA, 19 bp, Homo sapiens
acattggacatggatcttg

SEQ ID NO: 9472955 - DNA, 22 bp, Homo sapiens
acattgtataatgattatcaca

SEQ ID NO: 9472956 - DNA, 22 bp, Homo sapiens
acatttcagaatcacacagctt

SEQ ID NO: 9472957 - DNA, 22 bp, Homo sapiens
acatttcactgttcacagcagg

SEQ ID NO: 9472958 - DNA, 22 bp, Homo sapiens
acatttcactgttcacagcagg

SEQ ID NO: 9472959 - DNA, 22 bp, Homo sapiens
acatttcactgttcacagcagg

SEQ ID NO: 9472960 - DNA, 22 bp, Homo sapiens
acatttcatttgcagtatggat

SEQ ID NO: 9472961 - DNA, 22 bp, Homo sapiens
acatttcagaatcacacagctt

SEQ ID NO: 9472962 - DNA, 22 bp, Homo sapiens
acatttcatttgcagtatggat

SEQ ID NO: 9472963 - DNA, 22 bp, Homo sapiens
acatttctttgctagacagcag

SEQ ID NO: 9472964 - DNA, 22 bp, Homo sapiens
acatttctttctattcagtagc

SEQ ID NO: 9472965 - DNA, 22 bp, Homo sapiens
acatttctttctattcagtagc

SEQ ID NO: 9472966 - DNA, 22 bp, Homo sapiens
acatttcttttcatctctatat

SEQ ID NO: 9472967 - DNA, 22 bp, Homo sapiens
acatttctcttagagttggact

SEQ ID NO: 9472968 - DNA, 22 bp, Homo sapiens
acatttcttgatgcctctgtga

SEQ ID NO: 9472969 - DNA, 22 bp, Homo sapiens
acatttcttgatgcctctgtga

SEQ ID NO: 9472970 - DNA, 22 bp, Homo sapiens
acatttcttcctaattatccct

SEQ ID NO: 9472971 - DNA, 22 bp, Homo sapiens
acatttcttcctaattatccct

SEQ ID NO: 9472972 - DNA, 18 bp, Homo sapiens
acatttctatgcttctgg

SEQ ID NO: 9472973 - DNA, 18 bp, Homo sapiens
acatttctatgcttctgg

SEQ ID NO: 9472974 - DNA, 18 bp, Homo sapiens
acatttctatgcttctgg

SEQ ID NO: 9472975 - DNA, 18 bp, Homo sapiens
acatttctatgcttctgg

SEQ ID NO: 9472976 - DNA, 22 bp, Homo sapiens
aggctgagctggcccttgaaat

SEQ ID NO: 9472977 - DNA, 22 bp, Homo sapiens
aggctgagctggcccttgaaat

SEQ ID NO: 9472978 - DNA, 22 bp, Homo sapiens
aggctgagctggcccttgaaat

SEQ ID NO: 9472979 - DNA, 22 bp, Homo sapiens
aggctgagctggtagtgagtac

SEQ ID NO: 9472980 - DNA, 22 bp, Homo sapiens
aggctgagctggtagtgagtac

SEQ ID NO: 9472981 - DNA, 22 bp, Homo sapiens
aggctgagctggtagtgagtac

SEQ ID NO: 9472982 - DNA, 22 bp, Homo sapiens
aggctgagctggtagtgagtac

SEQ ID NO: 9472983 - DNA, 22 bp, Homo sapiens
aggctgaggagggatgttgctt

SEQ ID NO: 9472984 - DNA, 22 bp, Homo sapiens
aggctgaggagggatgttgctt

SEQ ID NO: 9472985 - DNA, 22 bp, Homo sapiens
aggctgaggagggatgttgctt

SEQ ID NO: 9472986 - DNA, 22 bp, Homo sapiens
aggctgagctggtagtgagtac

SEQ ID NO: 9472987 - DNA, 22 bp, Homo sapiens
acatttggcatcttgtaacact

SEQ ID NO: 9472988 - DNA, 22 bp, Homo sapiens
acatttgattgatgaatcaaat

SEQ ID NO: 9472989 - DNA, 22 bp, Homo sapiens
acatttgaggatgttaagaatg

SEQ ID NO: 9472990 - DNA, 22 bp, Homo sapiens
acatttgataattataaagaca

SEQ ID NO: 9472991 - DNA, 22 bp, Homo sapiens
acatttgaaataaactcaagtg

SEQ ID NO: 9472992 - DNA, 22 bp, Homo sapiens
acatttcttttcatctctatat

SEQ ID NO: 9472993 - DNA, 22 bp, Homo sapiens
acatttcttttcatctctatat

SEQ ID NO: 9472994 - DNA, 22 bp, Homo sapiens
acatttgaaattctgaacagat

SEQ ID NO: 9472995 - DNA, 22 bp, Homo sapiens
acatttgacatttagtatcagc

SEQ ID NO: 9472996 - DNA, 22 bp, Homo sapiens
acatttgagcatctactaagtg

SEQ ID NO: 9472997 - DNA, 22 bp, Homo sapiens
acatttgagatgccttttaggt

SEQ ID NO: 9472998 - DNA, 22 bp, Homo sapiens
acatcattcagggcctcgttgg

SEQ ID NO: 9472999 - DNA, 22 bp, Homo sapiens
acatccagatctcagcatggct

SEQ ID NO: 9473000 - DNA, 22 bp, Homo sapiens
acatccagatctcagcatggct

SEQ ID NO: 9473001 - DNA, 22 bp, Homo sapiens
acatccatcttatgagataggt

SEQ ID NO: 9473002 - DNA, 21 bp, Homo sapiens
acatccagggtcctcactgcc

SEQ ID NO: 9473003 - DNA, 22 bp, Homo sapiens
acatcacagtagttaagccaga

SEQ ID NO: 9473004 - DNA, 22 bp, Homo sapiens
acatcacagtagttaagccaga

SEQ ID NO: 9473005 - DNA, 22 bp, Homo sapiens
acatcacagagcccagataaag

SEQ ID NO: 9473006 - DNA, 22 bp, Homo sapiens
acatcacagtagttaagccaga

SEQ ID NO: 9473007 - DNA, 22 bp, Homo sapiens
acatcagagggctcacatgatc

SEQ ID NO: 9473008 - DNA, 22 bp, Homo sapiens
acatcacagagcccagataaag

SEQ ID NO: 9473009 - DNA, 22 bp, Homo sapiens
acatcacagagcccagataaag

SEQ ID NO: 9473010 - DNA, 22 bp, Homo sapiens
acatcacagagcccagataaag

SEQ ID NO: 9473011 - DNA, 22 bp, Homo sapiens
acatcacacgccttccaggagg

SEQ ID NO: 9473012 - DNA, 22 bp, Homo sapiens
acatcacacgccttccaggagg

SEQ ID NO: 9473013 - DNA, 20 bp, Homo sapiens
acatcaactagtcacagaca

SEQ ID NO: 9473014 - DNA, 22 bp, Homo sapiens
acatattttgaaagctttctaa

SEQ ID NO: 9473015 - DNA, 22 bp, Homo sapiens
acatattttgaaagctttctaa

SEQ ID NO: 9473016 - DNA, 22 bp, Homo sapiens
acatattttgaaagctttctaa

SEQ ID NO: 9473017 - DNA, 22 bp, Homo sapiens
acatgccagaacttgtaccaat

SEQ ID NO: 9473018 - DNA, 22 bp, Homo sapiens
acatgcatacaagcacatgtag

SEQ ID NO: 9473019 - DNA, 22 bp, Homo sapiens
acatgccagcctcagcagcagt

SEQ ID NO: 9473020 - DNA, 22 bp, Homo sapiens
acatgcataagcctagccatca

SEQ ID NO: 9473021 - DNA, 22 bp, Homo sapiens
acatgcctccattgagctgtgg

SEQ ID NO: 9473022 - DNA, 22 bp, Homo sapiens
acatgctatgagagattacttc

SEQ ID NO: 9473023 - DNA, 22 bp, Homo sapiens
aggccaggcaacattctgaagt

SEQ ID NO: 9473024 - DNA, 22 bp, Homo sapiens
acatgctttgcacttacatcat

SEQ ID NO: 9473025 - DNA, 22 bp, Homo sapiens
acatgctttgcacttacatcat

SEQ ID NO: 9473026 - DNA, 22 bp, Homo sapiens
acatgctgggcaatgttgtttt

SEQ ID NO: 9473027 - DNA, 22 bp, Homo sapiens
acatgctctcctaaggccctgt

SEQ ID NO: 9473028 - DNA, 22 bp, Homo sapiens
acatgcttgtttttcacaacct

SEQ ID NO: 9473029 - DNA, 22 bp, Homo sapiens
acatgcttgtttttcacaacct

SEQ ID NO: 9473030 - DNA, 22 bp, Homo sapiens
acatgcttctgtttcaagaact

SEQ ID NO: 9473031 - DNA, 22 bp, Homo sapiens
aggccaggcctttctccattcc

SEQ ID NO: 9473032 - DNA, 22 bp, Homo sapiens
aggccaggcctttctccattcc

SEQ ID NO: 9473033 - DNA, 22 bp, Homo sapiens
aggccaggcgagacacccggct

SEQ ID NO: 9473034 - DNA, 22 bp, Homo sapiens
aggccaggcgagacacccggct

SEQ ID NO: 9473035 - DNA, 22 bp, Homo sapiens
aggccaggcgagacacccggct

SEQ ID NO: 9473036 - DNA, 22 bp, Homo sapiens
aggccagggcactgctctttag

SEQ ID NO: 9473037 - DNA, 22 bp, Homo sapiens
aggccagggcactgctctttag

SEQ ID NO: 9473038 - DNA, 22 bp, Homo sapiens
aggccaggggtgagcacttctg

SEQ ID NO: 9473039 - DNA, 22 bp, Homo sapiens
aggccaggggtgagcacttctg

SEQ ID NO: 9473040 - DNA, 22 bp, Homo sapiens
aggccagggtagggcccattgt

SEQ ID NO: 9473041 - DNA, 22 bp, Homo sapiens
aggccagggccagattagccac

SEQ ID NO: 9473042 - DNA, 22 bp, Homo sapiens
aggccagggccagattagccac

SEQ ID NO: 9473043 - DNA, 22 bp, Homo sapiens
aggccagggccagattagccac

SEQ ID NO: 9473044 - DNA, 22 bp, Homo sapiens
aggccagggccagattagccac

SEQ ID NO: 9473045 - DNA, 22 bp, Homo sapiens
aggccagggcactgctctttag

SEQ ID NO: 9473046 - DNA, 22 bp, Homo sapiens
acatgttagaaatgcagaatct

SEQ ID NO: 9473047 - DNA, 22 bp, Homo sapiens
acatgttaaacatcatggaatg

SEQ ID NO: 9473048 - DNA, 22 bp, Homo sapiens
acatgttagggacagagtatgt

SEQ ID NO: 9473049 - DNA, 22 bp, Homo sapiens
acatgtttaagtttaatgaaaa

SEQ ID NO: 9473050 - DNA, 22 bp, Homo sapiens
aggccagggtagggcccattgt

SEQ ID NO: 9473051 - DNA, 22 bp, Homo sapiens
aggcctctgggtctcctctgac

SEQ ID NO: 9473052 - DNA, 22 bp, Homo sapiens
acatgtttggctctatgctata

SEQ ID NO: 9473053 - DNA, 22 bp, Homo sapiens
acatgtttggctctatgctata

SEQ ID NO: 9473054 - DNA, 22 bp, Homo sapiens
acatgtttggctctatgctata

SEQ ID NO: 9473055 - DNA, 22 bp, Homo sapiens
acatgtttaagtttgttatatg

SEQ ID NO: 9473056 - DNA, 22 bp, Homo sapiens
acatgtttacattaggtgatat

SEQ ID NO: 9473057 - DNA, 22 bp, Homo sapiens
acatgtttaagtttaatgaaaa

SEQ ID NO: 9473058 - DNA, 22 bp, Homo sapiens
acatgtttaagtttaatgaaaa

SEQ ID NO: 9473059 - DNA, 20 bp, Homo sapiens
aggcctcttcatgacagctg

SEQ ID NO: 9473060 - DNA, 22 bp, Homo sapiens
aggcctcttcagggagcatgga

SEQ ID NO: 9473061 - DNA, 22 bp, Homo sapiens
aggcctctgtagggccctgaag

SEQ ID NO: 9473062 - DNA, 18 bp, Homo sapiens
aggcctctgtgtgcccag

SEQ ID NO: 9473063 - DNA, 20 bp, Homo sapiens
aggcctgagagatgactggg

SEQ ID NO: 9473064 - DNA, 22 bp, Homo sapiens
aggcctgagcagaggagtggac

SEQ ID NO: 9473065 - DNA, 22 bp, Homo sapiens
aggcctgaggaccttctggagg

SEQ ID NO: 9473066 - DNA, 22 bp, Homo sapiens
aggcctgaggaccagataaatg

SEQ ID NO: 9473067 - DNA, 22 bp, Homo sapiens
aggcctcttgtcttcctcacat

SEQ ID NO: 9473068 - DNA, 22 bp, Homo sapiens
aggcctgaaggaagatgagctg

SEQ ID NO: 9473069 - DNA, 22 bp, Homo sapiens
aggcctgaagtgtggagtgggg

SEQ ID NO: 9473070 - DNA, 22 bp, Homo sapiens
accagccaagactgcctggaat

SEQ ID NO: 9473071 - DNA, 22 bp, Homo sapiens
accagccaagactgcctggaat

SEQ ID NO: 9473072 - DNA, 22 bp, Homo sapiens
accagcatttgcagaaatggag

SEQ ID NO: 9473073 - DNA, 22 bp, Homo sapiens
accagcattgctttgggttata

SEQ ID NO: 9473074 - DNA, 21 bp, Homo sapiens
accagcattccacactgtccc

SEQ ID NO: 9473075 - DNA, 19 bp, Homo sapiens
accagcccactcccagttt

SEQ ID NO: 9473076 - DNA, 19 bp, Homo sapiens
accagcccactcccagttt

SEQ ID NO: 9473077 - DNA, 22 bp, Homo sapiens
accagccagccacagtggctcc

SEQ ID NO: 9473078 - DNA, 22 bp, Homo sapiens
accagcagttatgaggccagga

SEQ ID NO: 9473079 - DNA, 22 bp, Homo sapiens
accagcagttatgaggccagga

SEQ ID NO: 9473080 - DNA, 22 bp, Homo sapiens
accagcaggtggcagtatgtat

SEQ ID NO: 9473081 - DNA, 22 bp, Homo sapiens
accagcagggctgggccaatgg

SEQ ID NO: 9473082 - DNA, 22 bp, Homo sapiens
acatttgtatatatgcagcata

SEQ ID NO: 9473083 - DNA, 20 bp, Homo sapiens
acatttgtatctcccagtgg

SEQ ID NO: 9473084 - DNA, 22 bp, Homo sapiens
acatttgtatgcgtttttactg

SEQ ID NO: 9473085 - DNA, 22 bp, Homo sapiens
acatttgtacattggcatgtct

SEQ ID NO: 9473086 - DNA, 22 bp, Homo sapiens
acatttgtaggacagaggaaga

SEQ ID NO: 9473087 - DNA, 22 bp, Homo sapiens
acatttgtaggacagaggaaga

SEQ ID NO: 9473088 - DNA, 22 bp, Homo sapiens
accagagctggctctgagcacc

SEQ ID NO: 9473089 - DNA, 22 bp, Homo sapiens
acatttgtatgcgtttttactg

SEQ ID NO: 9473090 - DNA, 19 bp, Homo sapiens
acatttgtcaagagaaggt

SEQ ID NO: 9473091 - DNA, 19 bp, Homo sapiens
acatttgtcaagagaaggt

SEQ ID NO: 9473092 - DNA, 22 bp, Homo sapiens
accagcagcctagagcgttctt

SEQ ID NO: 9473093 - DNA, 22 bp, Homo sapiens
accagagctggcagagtatcaa

SEQ ID NO: 9473094 - DNA, 22 bp, Homo sapiens
accagcagagttgaggaggaca

SEQ ID NO: 9473095 - DNA, 22 bp, Homo sapiens
accagcagctgccagagtggag

SEQ ID NO: 9473096 - DNA, 22 bp, Homo sapiens
accagcagctgccagagtggag

SEQ ID NO: 9473097 - DNA, 22 bp, Homo sapiens
agggagacaaaagcagctgcca

SEQ ID NO: 9473098 - DNA, 22 bp, Homo sapiens
agggagacaaaagcagctgcca

SEQ ID NO: 9473099 - DNA, 22 bp, Homo sapiens
agggagacaaaagcagctgcca

SEQ ID NO: 9473100 - DNA, 22 bp, Homo sapiens
agggacagtctactgttcactg

SEQ ID NO: 9473101 - DNA, 22 bp, Homo sapiens
agggagacacatgaggaagtca

SEQ ID NO: 9473102 - DNA, 22 bp, Homo sapiens
agggagacaaaagcagctgcca

SEQ ID NO: 9473103 - DNA, 22 bp, Homo sapiens
aggcttgtggattggagcgagt

SEQ ID NO: 9473104 - DNA, 22 bp, Homo sapiens
aggctttaagcaagcatattgt

SEQ ID NO: 9473105 - DNA, 22 bp, Homo sapiens
agggacagtatccatctcacag

SEQ ID NO: 9473106 - DNA, 22 bp, Homo sapiens
agggacagtctactgttcactg

SEQ ID NO: 9473107 - DNA, 22 bp, Homo sapiens
agggacagtatccatctcacag

SEQ ID NO: 9473108 - DNA, 22 bp, Homo sapiens
agggacagtatccatctcacag

SEQ ID NO: 9473109 - DNA, 22 bp, Homo sapiens
agggacagtatccatctcacag

SEQ ID NO: 9473110 - DNA, 21 bp, Homo sapiens
aggctttacctctgggtaggt

SEQ ID NO: 9473111 - DNA, 22 bp, Homo sapiens
aggcttgggactgcttaggagc

SEQ ID NO: 9473112 - DNA, 20 bp, Homo sapiens
aggcttggcttggcaggaac

SEQ ID NO: 9473113 - DNA, 20 bp, Homo sapiens
aggcttggcttggcaggaac

SEQ ID NO: 9473114 - DNA, 20 bp, Homo sapiens
aggcttggcttggcaggaac

SEQ ID NO: 9473115 - DNA, 22 bp, Homo sapiens
accagccccaccgggactgcag

SEQ ID NO: 9473116 - DNA, 19 bp, Homo sapiens
accagcccactcccagttt

SEQ ID NO: 9473117 - DNA, 22 bp, Homo sapiens
accagccccaccgggactgcag

SEQ ID NO: 9473118 - DNA, 19 bp, Homo sapiens
aggcttggttgcagcaagc

SEQ ID NO: 9473119 - DNA, 22 bp, Homo sapiens
aggcttggtttatagaagtaat

SEQ ID NO: 9473120 - DNA, 18 bp, Homo sapiens
aggcttgggcccagcagc

SEQ ID NO: 9473121 - DNA, 22 bp, Homo sapiens
aggcttggtgccaaggagcctg

SEQ ID NO: 9473122 - DNA, 22 bp, Homo sapiens
aggcttggtgccaaggagcctg

SEQ ID NO: 9473123 - DNA, 22 bp, Homo sapiens
agggcagcacagctgtgctcct

SEQ ID NO: 9473124 - DNA, 22 bp, Homo sapiens
agggcagcacagctgtgctcct

SEQ ID NO: 9473125 - DNA, 19 bp, Homo sapiens
accaggcctcagaggccct

SEQ ID NO: 9473126 - DNA, 19 bp, Homo sapiens
accaggcctcagaggccct

SEQ ID NO: 9473127 - DNA, 19 bp, Homo sapiens
accaggcctcagaggccct

SEQ ID NO: 9473128 - DNA, 22 bp, Homo sapiens
agggcagcagctcctcctagct

SEQ ID NO: 9473129 - DNA, 22 bp, Homo sapiens
agggcagcagcccatggctctg

SEQ ID NO: 9473130 - DNA, 22 bp, Homo sapiens
agggcagcacaaggcatggact

SEQ ID NO: 9473131 - DNA, 22 bp, Homo sapiens
agggcagcacaaggcatggact

SEQ ID NO: 9473132 - DNA, 22 bp, Homo sapiens
agggcagcacaaggcatggact

SEQ ID NO: 9473133 - DNA, 22 bp, Homo sapiens
agggcagcaatttggttcctgg

SEQ ID NO: 9473134 - DNA, 22 bp, Homo sapiens
agggcagcaatgcagctgctgc

SEQ ID NO: 9473135 - DNA, 22 bp, Homo sapiens
agggcagcaatgcagctgctgc

SEQ ID NO: 9473136 - DNA, 22 bp, Homo sapiens
agggcagatggaacttccccga

SEQ ID NO: 9473137 - DNA, 22 bp, Homo sapiens
agggcagatggaacttccccga

SEQ ID NO: 9473138 - DNA, 21 bp, Homo sapiens
agggcagattagctgtaagag

SEQ ID NO: 9473139 - DNA, 21 bp, Homo sapiens
agggcagattagctgtaagag

SEQ ID NO: 9473140 - DNA, 21 bp, Homo sapiens
agggcagattagctgtaagag

SEQ ID NO: 9473141 - DNA, 22 bp, Homo sapiens
accagctcttctgctctagttg

SEQ ID NO: 9473142 - DNA, 22 bp, Homo sapiens
agggcacttcctctgggtccct

SEQ ID NO: 9473143 - DNA, 22 bp, Homo sapiens
accagctccaggcccctgctga

SEQ ID NO: 9473144 - DNA, 22 bp, Homo sapiens
accagctccaggcccctgctgg

SEQ ID NO: 9473145 - DNA, 22 bp, Homo sapiens
accagctctctagccctggtcc

SEQ ID NO: 9473146 - DNA, 22 bp, Homo sapiens
accagctctggacaggcatttc

SEQ ID NO: 9473147 - DNA, 22 bp, Homo sapiens
agggagagaagttatacaagat

SEQ ID NO: 9473148 - DNA, 22 bp, Homo sapiens
agggagagaagttatacaagat

SEQ ID NO: 9473149 - DNA, 22 bp, Homo sapiens
agggagagaagttatacaagat

SEQ ID NO: 9473150 - DNA, 22 bp, Homo sapiens
agggagagacatttccttcttg

SEQ ID NO: 9473151 - DNA, 18 bp, Homo sapiens
agggagagaccgcgggtc

SEQ ID NO: 9473152 - DNA, 22 bp, Homo sapiens
agggagaggagcgtttcacatc

SEQ ID NO: 9473153 - DNA, 22 bp, Homo sapiens
agggagaggagcgtttcacatc

SEQ ID NO: 9473154 - DNA, 22 bp, Homo sapiens
accagccccaccgggactgcag

SEQ ID NO: 9473155 - DNA, 22 bp, Homo sapiens
agggagaggagcgtttcacatc

SEQ ID NO: 9473156 - DNA, 22 bp, Homo sapiens
agggagaggagcgtttcacatc

SEQ ID NO: 9473157 - DNA, 18 bp, Homo sapiens
agggagagaccgcgggtc

SEQ ID NO: 9473158 - DNA, 18 bp, Homo sapiens
agggagagaccgcgggtc

SEQ ID NO: 9473159 - DNA, 22 bp, Homo sapiens
accagctcataattttcaaaac

SEQ ID NO: 9473160 - DNA, 22 bp, Homo sapiens
accagctcagagcaggctcctg

SEQ ID NO: 9473161 - DNA, 22 bp, Homo sapiens
accagctcagaagccagaaaga

SEQ ID NO: 9473162 - DNA, 22 bp, Homo sapiens
accagcctggccaacatggtga

SEQ ID NO: 9473163 - DNA, 22 bp, Homo sapiens
accagcctggccaacatggtga

SEQ ID NO: 9473164 - DNA, 22 bp, Homo sapiens
accagcctggccaacatggtga

SEQ ID NO: 9473165 - DNA, 22 bp, Homo sapiens
accagcctgtctgagtcgtggg

SEQ ID NO: 9473166 - DNA, 22 bp, Homo sapiens
accagcctgtctgagtcgtggg

SEQ ID NO: 9473167 - DNA, 17 bp, Homo sapiens
accagcctctcctgggg

SEQ ID NO: 9473168 - DNA, 22 bp, Homo sapiens
accagcctggccaacatggcaa

SEQ ID NO: 9473169 - DNA, 17 bp, Homo sapiens
accagcctctcctgggg

SEQ ID NO: 9473170 - DNA, 22 bp, Homo sapiens
accagcctggccaacatggcaa

SEQ ID NO: 9473171 - DNA, 22 bp, Homo sapiens
accagcctggccaacatggcaa

SEQ ID NO: 9473172 - DNA, 22 bp, Homo sapiens
accagcctggccaacatggcaa

SEQ ID NO: 9473173 - DNA, 22 bp, Homo sapiens
accagccctcaggtcagatact

SEQ ID NO: 9473174 - DNA, 22 bp, Homo sapiens
accagccccaccgggactgcag

SEQ ID NO: 9473175 - DNA, 22 bp, Homo sapiens
agggagaggctgaactatccta

SEQ ID NO: 9473176 - DNA, 22 bp, Homo sapiens
accagccctcaggtcagatact

SEQ ID NO: 9473177 - DNA, 22 bp, Homo sapiens
accagccctcaggtcagatact

SEQ ID NO: 9473178 - DNA, 17 bp, Homo sapiens
accagcctctcctgggg

SEQ ID NO: 9473179 - DNA, 22 bp, Homo sapiens
agggctgcccagtgtgagagct

SEQ ID NO: 9473180 - DNA, 22 bp, Homo sapiens
agggctgccatttctggcccaa

SEQ ID NO: 9473181 - DNA, 22 bp, Homo sapiens
agggctgccatttctggcccaa

SEQ ID NO: 9473182 - DNA, 22 bp, Homo sapiens
agggctgccatttctggcccaa

SEQ ID NO: 9473183 - DNA, 22 bp, Homo sapiens
acccaggagacggaggtgcagt

SEQ ID NO: 9473184 - DNA, 22 bp, Homo sapiens
acccaggagacggaggtgcagt

SEQ ID NO: 9473185 - DNA, 22 bp, Homo sapiens
acccagctaaccctaccctgga

SEQ ID NO: 9473186 - DNA, 20 bp, Homo sapiens
acccagctctgtgccctggg

SEQ ID NO: 9473187 - DNA, 22 bp, Homo sapiens
acccagctctttgatggtcttg

SEQ ID NO: 9473188 - DNA, 22 bp, Homo sapiens
acccagctgtttcccgtgtcat

SEQ ID NO: 9473189 - DNA, 22 bp, Homo sapiens
acccaggaaaacatggtgcaga

SEQ ID NO: 9473190 - DNA, 22 bp, Homo sapiens
acccaggaaaacatggtgcaga

SEQ ID NO: 9473191 - DNA, 22 bp, Homo sapiens
acccaggaaaacatggtgcaga

SEQ ID NO: 9473192 - DNA, 22 bp, Homo sapiens
acccaggaaaacatggtgcaga

SEQ ID NO: 9473193 - DNA, 22 bp, Homo sapiens
acccaggacaaaataaccaggt

SEQ ID NO: 9473194 - DNA, 22 bp, Homo sapiens
acccaggacacagagatgaccc

SEQ ID NO: 9473195 - DNA, 22 bp, Homo sapiens
acccaggacacagagatgaccc

SEQ ID NO: 9473196 - DNA, 22 bp, Homo sapiens
acccagataaatgacagggctt

SEQ ID NO: 9473197 - DNA, 22 bp, Homo sapiens
acccagagtgtctgtctcagtc

SEQ ID NO: 9473198 - DNA, 22 bp, Homo sapiens
acccagcatgacacctgcacat

SEQ ID NO: 9473199 - DNA, 22 bp, Homo sapiens
acccagccacagcattgaggga

SEQ ID NO: 9473200 - DNA, 22 bp, Homo sapiens
acccagccatgttcagttctct

SEQ ID NO: 9473201 - DNA, 22 bp, Homo sapiens
acccagccacagcattgaggga

SEQ ID NO: 9473202 - DNA, 22 bp, Homo sapiens
acccagcatgacacctgcacat

SEQ ID NO: 9473203 - DNA, 22 bp, Homo sapiens
acccagcctacaaagctcacct

SEQ ID NO: 9473204 - DNA, 22 bp, Homo sapiens
acccagcctacaaagctcacct

SEQ ID NO: 9473205 - DNA, 22 bp, Homo sapiens
acccagcctacaaagctcacct

SEQ ID NO: 9473206 - DNA, 19 bp, Homo sapiens
acccagcccaggagtggca

SEQ ID NO: 9473207 - DNA, 22 bp, Homo sapiens
acccagcctacaaagctcacct

SEQ ID NO: 9473208 - DNA, 19 bp, Homo sapiens
acccagcccaggagtggca

SEQ ID NO: 9473209 - DNA, 19 bp, Homo sapiens
acccagcccaggagtggca

SEQ ID NO: 9473210 - DNA, 22 bp, Homo sapiens
acccagcccagaatctggggcc

SEQ ID NO: 9473211 - DNA, 22 bp, Homo sapiens
acccagcccagaatctggggcc

SEQ ID NO: 9473212 - DNA, 19 bp, Homo sapiens
acccagcccaggagtggca

SEQ ID NO: 9473213 - DNA, 22 bp, Homo sapiens
acccagccatgttcagttctct

SEQ ID NO: 9473214 - DNA, 22 bp, Homo sapiens
acccagcccagaatctggggcc

SEQ ID NO: 9473215 - DNA, 22 bp, Homo sapiens
acccagcccagaatctggggcc

SEQ ID NO: 9473216 - DNA, 22 bp, Homo sapiens
acccagcccagaatctggggcc

SEQ ID NO: 9473217 - DNA, 22 bp, Homo sapiens
acccagagcagagcttggcttc

SEQ ID NO: 9473218 - DNA, 22 bp, Homo sapiens
accaggctggagtgcagtggcg

SEQ ID NO: 9473219 - DNA, 22 bp, Homo sapiens
accaggctgtgaagtgagacta

SEQ ID NO: 9473220 - DNA, 22 bp, Homo sapiens
acccagagcagagcttggcttc

SEQ ID NO: 9473221 - DNA, 22 bp, Homo sapiens
acccagagccagggtcaggagc

SEQ ID NO: 9473222 - DNA, 22 bp, Homo sapiens
acccagagcagagcttggcttc

SEQ ID NO: 9473223 - DNA, 22 bp, Homo sapiens
acccagagccagggtcaggagc

SEQ ID NO: 9473224 - DNA, 22 bp, Homo sapiens
accaggctccccttggatcctg

SEQ ID NO: 9473225 - DNA, 22 bp, Homo sapiens
accaggctgtgaagtgagacta

SEQ ID NO: 9473226 - DNA, 22 bp, Homo sapiens
accaggctggagtgcagtggcg

SEQ ID NO: 9473227 - DNA, 22 bp, Homo sapiens
accaggctggagtgcagtggcg

SEQ ID NO: 9473228 - DNA, 22 bp, Homo sapiens
accaggcctggctgggcagcca

SEQ ID NO: 9473229 - DNA, 22 bp, Homo sapiens
accaggcctggctgggcagcca

SEQ ID NO: 9473230 - DNA, 22 bp, Homo sapiens
accaggctccccttggatcctg

SEQ ID NO: 9473231 - DNA, 22 bp, Homo sapiens
acccaggctggagtgcagtggg

SEQ ID NO: 9473232 - DNA, 22 bp, Homo sapiens
acccaggctggagtgcagtggg

SEQ ID NO: 9473233 - DNA, 22 bp, Homo sapiens
acccaggctggagtgcagtggc

SEQ ID NO: 9473234 - DNA, 22 bp, Homo sapiens
acccaggctggagtgcagtgat

SEQ ID NO: 9473235 - DNA, 22 bp, Homo sapiens
acccaggctggagtgcagtgat

SEQ ID NO: 9473236 - DNA, 22 bp, Homo sapiens
acccaggctggagtgcagtggc

SEQ ID NO: 9473237 - DNA, 22 bp, Homo sapiens
acccaggctggagtgcagtggt

SEQ ID NO: 9473238 - DNA, 22 bp, Homo sapiens
acccaggctggagtgcagtggt

SEQ ID NO: 9473239 - DNA, 22 bp, Homo sapiens
acccaggctggagtgcagtgtc

SEQ ID NO: 9473240 - DNA, 22 bp, Homo sapiens
acccaggctggagtgcagtgtc

SEQ ID NO: 9473241 - DNA, 22 bp, Homo sapiens
acccaggctggagtgcagtgac

SEQ ID NO: 9473242 - DNA, 22 bp, Homo sapiens
acccaggctggagtgcagtgac

SEQ ID NO: 9473243 - DNA, 22 bp, Homo sapiens
agggctgctgaggaagccttgc

SEQ ID NO: 9473244 - DNA, 22 bp, Homo sapiens
agggctgctcctccttcaggcc

SEQ ID NO: 9473245 - DNA, 22 bp, Homo sapiens
agggctgctcctccttcaggcc

SEQ ID NO: 9473246 - DNA, 22 bp, Homo sapiens
agggctgctcctccttcaggcc

SEQ ID NO: 9473247 - DNA, 19 bp, Homo sapiens
agggctgctctggcctggg

SEQ ID NO: 9473248 - DNA, 22 bp, Homo sapiens
agggctgctcctccttcaggcc

SEQ ID NO: 9473249 - DNA, 19 bp, Homo sapiens
agggctgctctggcctggg

SEQ ID NO: 9473250 - DNA, 22 bp, Homo sapiens
agggctgcccagtgtgagagct

SEQ ID NO: 9473251 - DNA, 22 bp, Homo sapiens
agggctgccccagtccagccgg

SEQ ID NO: 9473252 - DNA, 22 bp, Homo sapiens
agggctgccccagtccagccgg

SEQ ID NO: 9473253 - DNA, 22 bp, Homo sapiens
agggctgcctgactccagagcc

SEQ ID NO: 9473254 - DNA, 22 bp, Homo sapiens
agggctgcccagtgtgagagct

SEQ ID NO: 9473255 - DNA, 22 bp, Homo sapiens
agggctgccccagtccagccgg

SEQ ID NO: 9473256 - DNA, 22 bp, Homo sapiens
agggctgcctgactccagagcc

SEQ ID NO: 9473257 - DNA, 22 bp, Homo sapiens
agggctgccccagtccagccgg

SEQ ID NO: 9473258 - DNA, 22 bp, Homo sapiens
agggctgctatgttgattcaga

SEQ ID NO: 9473259 - DNA, 22 bp, Homo sapiens
agggctgctatgttgattcaga

SEQ ID NO: 9473260 - DNA, 22 bp, Homo sapiens
agggctgctaccttaatcagtt

SEQ ID NO: 9473261 - DNA, 22 bp, Homo sapiens
agggctgcctgctctgcattga

SEQ ID NO: 9473262 - DNA, 22 bp, Homo sapiens
agggctgcctgactccagagcc

SEQ ID NO: 9473263 - DNA, 22 bp, Homo sapiens
accctcagtaatcgtgcagttt

SEQ ID NO: 9473264 - DNA, 22 bp, Homo sapiens
agggggctcagtgactgaagtg

SEQ ID NO: 9473265 - DNA, 22 bp, Homo sapiens
agggggctcagcatggatggag

SEQ ID NO: 9473266 - DNA, 22 bp, Homo sapiens
accctccactttatctgtcttt

SEQ ID NO: 9473267 - DNA, 22 bp, Homo sapiens
accctccactttatctgtcttt

SEQ ID NO: 9473268 - DNA, 22 bp, Homo sapiens
accctccactttatctgtcttt

SEQ ID NO: 9473269 - DNA, 22 bp, Homo sapiens
accctcatgaagctggcctgga

SEQ ID NO: 9473270 - DNA, 20 bp, Homo sapiens
accctccactgttcactgtg

SEQ ID NO: 9473271 - DNA, 22 bp, Homo sapiens
accctccacaccagtcttattt

SEQ ID NO: 9473272 - DNA, 22 bp, Homo sapiens
accctcagtaatcgtgcagttt

SEQ ID NO: 9473273 - DNA, 22 bp, Homo sapiens
agggggctcagcatggatggag

SEQ ID NO: 9473274 - DNA, 22 bp, Homo sapiens
agggggctcagcatggatggag

SEQ ID NO: 9473275 - DNA, 22 bp, Homo sapiens
agggggctcagcatggatggag

SEQ ID NO: 9473276 - DNA, 22 bp, Homo sapiens
agggggctcagcatggatggag

SEQ ID NO: 9473277 - DNA, 22 bp, Homo sapiens
agggggctcagcaggctctgga

SEQ ID NO: 9473278 - DNA, 22 bp, Homo sapiens
agggggctcagcaggctctgga

SEQ ID NO: 9473279 - DNA, 22 bp, Homo sapiens
agggggctcagcatggatggag

SEQ ID NO: 9473280 - DNA, 22 bp, Homo sapiens
agggggctcagcaggctctgga

SEQ ID NO: 9473281 - DNA, 22 bp, Homo sapiens
agggggcccttgcaggtgagcg

SEQ ID NO: 9473282 - DNA, 22 bp, Homo sapiens
agggggcattatgaggcttttc

SEQ ID NO: 9473283 - DNA, 22 bp, Homo sapiens
agggggcattatgaggcttttc

SEQ ID NO: 9473284 - DNA, 22 bp, Homo sapiens
agggggcaggagagacctgctg

SEQ ID NO: 9473285 - DNA, 22 bp, Homo sapiens
agggggagtttcagttagaaag

SEQ ID NO: 9473286 - DNA, 22 bp, Homo sapiens
agggggcaggagagacctgctg

SEQ ID NO: 9473287 - DNA, 22 bp, Homo sapiens
agggggcatcaggtcctggctc

SEQ ID NO: 9473288 - DNA, 22 bp, Homo sapiens
agggggcatcaggtcctggctc

SEQ ID NO: 9473289 - DNA, 22 bp, Homo sapiens
agggggcatcaggtcctggctc

SEQ ID NO: 9473290 - DNA, 22 bp, Homo sapiens
acccaggctggcgtgcagtggc

SEQ ID NO: 9473291 - DNA, 22 bp, Homo sapiens
agggggaggctgtgctgcgtct

SEQ ID NO: 9473292 - DNA, 22 bp, Homo sapiens
agccacagtctgtagccagctt

SEQ ID NO: 9473293 - DNA, 22 bp, Homo sapiens
agccacagtctgtagccagctt

SEQ ID NO: 9473294 - DNA, 22 bp, Homo sapiens
agccacagtctgtagccagctt

SEQ ID NO: 9473295 - DNA, 22 bp, Homo sapiens
agcatataaatggacatatttg

SEQ ID NO: 9473296 - DNA, 22 bp, Homo sapiens
agcatagttaatacttttggta

SEQ ID NO: 9473297 - DNA, 22 bp, Homo sapiens
agcataggcggtggtaggaccc

SEQ ID NO: 9473298 - DNA, 22 bp, Homo sapiens
agcatatacaaactcatataca

SEQ ID NO: 9473299 - DNA, 22 bp, Homo sapiens
agcatatacaaactcatataca

SEQ ID NO: 9473300 - DNA, 22 bp, Homo sapiens
agcatatacaaactcatataca

SEQ ID NO: 9473301 - DNA, 22 bp, Homo sapiens
agccacagtgcaagagagaaaa

SEQ ID NO: 9473302 - DNA, 22 bp, Homo sapiens
agccacagtgggctaccagctc

SEQ ID NO: 9473303 - DNA, 22 bp, Homo sapiens
agccacagtgcaagagagaaaa

SEQ ID NO: 9473304 - DNA, 22 bp, Homo sapiens
agccacagtgggctaccagctc

SEQ ID NO: 9473305 - DNA, 22 bp, Homo sapiens
agccaccaccactgaaaggtta

SEQ ID NO: 9473306 - DNA, 22 bp, Homo sapiens
agccacatttttctgctcctga

SEQ ID NO: 9473307 - DNA, 22 bp, Homo sapiens
agccaccaccactgaaaggtta

SEQ ID NO: 9473308 - DNA, 22 bp, Homo sapiens
agccacccattcccgagcccta

SEQ ID NO: 9473309 - DNA, 22 bp, Homo sapiens
agccacctctgtgcaggcctcg

SEQ ID NO: 9473310 - DNA, 22 bp, Homo sapiens
agccaccttcacatggtctatc

SEQ ID NO: 9473311 - DNA, 22 bp, Homo sapiens
agccacctctatcttgggctcc

SEQ ID NO: 9473312 - DNA, 22 bp, Homo sapiens
cagaataagctgtgttgtcaag

SEQ ID NO: 9473313 - DNA, 22 bp, Homo sapiens
cagaataagctgtgttgtcaag

SEQ ID NO: 9473314 - DNA, 22 bp, Homo sapiens
cagaataccctatagacagaat

SEQ ID NO: 9473315 - DNA, 22 bp, Homo sapiens
cagaataatattggtctcatag

SEQ ID NO: 9473316 - DNA, 22 bp, Homo sapiens
cagaataatattggtctcatag

SEQ ID NO: 9473317 - DNA, 22 bp, Homo sapiens
cagaataatattggtctcatag

SEQ ID NO: 9473318 - DNA, 22 bp, Homo sapiens
cagaaggagcgctaaggtccca

SEQ ID NO: 9473319 - DNA, 22 bp, Homo sapiens
cagaaatatttattgagtgaca

SEQ ID NO: 9473320 - DNA, 22 bp, Homo sapiens
cagaaatatttattgagtgaca

SEQ ID NO: 9473321 - DNA, 22 bp, Homo sapiens
cagaaatatttattgagtgaca

SEQ ID NO: 9473322 - DNA, 22 bp, Homo sapiens
cagaaatattccaagtactgca

SEQ ID NO: 9473323 - DNA, 22 bp, Homo sapiens
cagaaatattccaagtactgca

SEQ ID NO: 9473324 - DNA, 22 bp, Homo sapiens
cagaaatatgtgccatgcctta

SEQ ID NO: 9473325 - DNA, 22 bp, Homo sapiens
cagaaatatgtgccatgcctta

SEQ ID NO: 9473326 - DNA, 22 bp, Homo sapiens
cagaaatatcagttgaaagtgc

SEQ ID NO: 9473327 - DNA, 22 bp, Homo sapiens
cagaaatatcagttgaaagtgc

SEQ ID NO: 9473328 - DNA, 21 bp, Homo sapiens
cagaaatatgaatgatggtga

SEQ ID NO: 9473329 - DNA, 22 bp, Homo sapiens
cagaaatatcacctggactcta

SEQ ID NO: 9473330 - DNA, 22 bp, Homo sapiens
cagaaatatatatgggtcagag

SEQ ID NO: 9473331 - DNA, 19 bp, Homo sapiens
cagaaatagcgaagtgtaa

SEQ ID NO: 9473332 - DNA, 22 bp, Homo sapiens
agccactgtctgaacttctgtg

SEQ ID NO: 9473333 - DNA, 22 bp, Homo sapiens
agccactggcctgggcagctct

SEQ ID NO: 9473334 - DNA, 22 bp, Homo sapiens
cagacatatgttttaacagatt

SEQ ID NO: 9473335 - DNA, 21 bp, Homo sapiens
cagacatgagtctcagctttg

SEQ ID NO: 9473336 - DNA, 22 bp, Homo sapiens
cagacatgagatacagctgcta

SEQ ID NO: 9473337 - DNA, 22 bp, Homo sapiens
cagacagtggacttgataaagg

SEQ ID NO: 9473338 - DNA, 22 bp, Homo sapiens
cagacaggtagggacagaacat

SEQ ID NO: 9473339 - DNA, 22 bp, Homo sapiens
cagacaggtagggacagaacat

SEQ ID NO: 9473340 - DNA, 22 bp, Homo sapiens
cagacaggtagggacagaacat

SEQ ID NO: 9473341 - DNA, 22 bp, Homo sapiens
cagacaggtagggacagaacat

SEQ ID NO: 9473342 - DNA, 22 bp, Homo sapiens
cagacaggaagttcagaagaaa

SEQ ID NO: 9473343 - DNA, 22 bp, Homo sapiens
cagacagggtgggtttctgggc

SEQ ID NO: 9473344 - DNA, 22 bp, Homo sapiens
agccagagactgtgtctgtaat

SEQ ID NO: 9473345 - DNA, 22 bp, Homo sapiens
agccagagactgtgtctgtaat

SEQ ID NO: 9473346 - DNA, 22 bp, Homo sapiens
cagaatgagtagcatcttcacc

SEQ ID NO: 9473347 - DNA, 21 bp, Homo sapiens
cagaatgcattctttgaagga

SEQ ID NO: 9473348 - DNA, 22 bp, Homo sapiens
cagaatgagataacccagattg

SEQ ID NO: 9473349 - DNA, 22 bp, Homo sapiens
cagaatgaaatgtaagaacacc

SEQ ID NO: 9473350 - DNA, 22 bp, Homo sapiens
cagaatatgaccctaggccttt

SEQ ID NO: 9473351 - DNA, 22 bp, Homo sapiens
cagaatcaagtccaattagcac

SEQ ID NO: 9473352 - DNA, 22 bp, Homo sapiens
cagaatcagtgacacatgtata

SEQ ID NO: 9473353 - DNA, 22 bp, Homo sapiens
cagaatccacaacagaagttga

SEQ ID NO: 9473354 - DNA, 22 bp, Homo sapiens
cagaatccatgacagacgttga

SEQ ID NO: 9473355 - DNA, 22 bp, Homo sapiens
agccagaaaggggcattatctg

SEQ ID NO: 9473356 - DNA, 22 bp, Homo sapiens
agccactgtgcaggagcagtgt

SEQ ID NO: 9473357 - DNA, 22 bp, Homo sapiens
agccactgtgtgaccagctgtc

SEQ ID NO: 9473358 - DNA, 22 bp, Homo sapiens
cagaatggcttttatggctcag

SEQ ID NO: 9473359 - DNA, 22 bp, Homo sapiens
cagaatggcttttatggctcag

SEQ ID NO: 9473360 - DNA, 22 bp, Homo sapiens
cagaatgtatatgatctaaggt

SEQ ID NO: 9473361 - DNA, 22 bp, Homo sapiens
agcccaggctggagtgcagtgg

SEQ ID NO: 9473362 - DNA, 22 bp, Homo sapiens
agcccaggctggagtgcagtgg

SEQ ID NO: 9473363 - DNA, 22 bp, Homo sapiens
agcccagggaaccaggaagtgg

SEQ ID NO: 9473364 - DNA, 22 bp, Homo sapiens
agcccaggctggagtgcagtgg

SEQ ID NO: 9473365 - DNA, 22 bp, Homo sapiens
agcccaggctggagtgcagtgg

SEQ ID NO: 9473366 - DNA, 18 bp, Homo sapiens
agcccaggcatcgtctgc

SEQ ID NO: 9473367 - DNA, 18 bp, Homo sapiens
agcccaggcatcgtctgc

SEQ ID NO: 9473368 - DNA, 18 bp, Homo sapiens
agcccaggcatcgtctgc

SEQ ID NO: 9473369 - DNA, 20 bp, Homo sapiens
agcccaggcctgtgtgagtc

SEQ ID NO: 9473370 - DNA, 20 bp, Homo sapiens
agcccaggcctgtgtgagtc

SEQ ID NO: 9473371 - DNA, 20 bp, Homo sapiens
agcccaggcctgtgtgagtc

SEQ ID NO: 9473372 - DNA, 20 bp, Homo sapiens
agcccaggcctgtgtgagtc

SEQ ID NO: 9473373 - DNA, 20 bp, Homo sapiens
agcccaggcctgtgtgagtc

SEQ ID NO: 9473374 - DNA, 22 bp, Homo sapiens
cagagggacagtatgatgaaag

SEQ ID NO: 9473375 - DNA, 22 bp, Homo sapiens
agcccagggaaccaggaagtgg

SEQ ID NO: 9473376 - DNA, 22 bp, Homo sapiens
cagaggctcttcctcactgccc

SEQ ID NO: 9473377 - DNA, 22 bp, Homo sapiens
cagaggctcttcctcactgccc

SEQ ID NO: 9473378 - DNA, 22 bp, Homo sapiens
cagagggagccctccaggagca

SEQ ID NO: 9473379 - DNA, 22 bp, Homo sapiens
cagagggagccctccaggagca

SEQ ID NO: 9473380 - DNA, 22 bp, Homo sapiens
cagagggagtttctgaggttgc

SEQ ID NO: 9473381 - DNA, 22 bp, Homo sapiens
cagagggaccagaacatactgt

SEQ ID NO: 9473382 - DNA, 22 bp, Homo sapiens
cagagggaccagaacatactgt

SEQ ID NO: 9473383 - DNA, 22 bp, Homo sapiens
cagagggaccagaacatactgt

SEQ ID NO: 9473384 - DNA, 22 bp, Homo sapiens
cagagggaccagaacatactgt

SEQ ID NO: 9473385 - DNA, 22 bp, Homo sapiens
cagagggacagtgtaatgcata

SEQ ID NO: 9473386 - DNA, 22 bp, Homo sapiens
cagaggcatactcccagtcttg

SEQ ID NO: 9473387 - DNA, 22 bp, Homo sapiens
cagaggcatactcccagtcttg

SEQ ID NO: 9473388 - DNA, 22 bp, Homo sapiens
cagaggcatactcccagtcttg

SEQ ID NO: 9473389 - DNA, 22 bp, Homo sapiens
cagaggcatactcccagtcttg

SEQ ID NO: 9473390 - DNA, 22 bp, Homo sapiens
cagaggcatataattgctgggg

SEQ ID NO: 9473391 - DNA, 22 bp, Homo sapiens
cagaggcatataattgctgggg

SEQ ID NO: 9473392 - DNA, 22 bp, Homo sapiens
cagaggcatataattgctgggg

SEQ ID NO: 9473393 - DNA, 23 bp, Homo sapiens
cagaggcatcggattcaacatca

SEQ ID NO: 9473394 - DNA, 22 bp, Homo sapiens
agcccaggcagagggatgcttg

SEQ ID NO: 9473395 - DNA, 22 bp, Homo sapiens
agcccaggcagagggatgcttg

SEQ ID NO: 9473396 - DNA, 22 bp, Homo sapiens
agcccaggcagagggatgcttg

SEQ ID NO: 9473397 - DNA, 22 bp, Homo sapiens
agcccaggcagagggatgcttg

SEQ ID NO: 9473398 - DNA, 23 bp, Homo sapiens
cagaggcatcggattcaacatca

SEQ ID NO: 9473399 - DNA, 22 bp, Homo sapiens
cagaggcattactgaaaaggtg

SEQ ID NO: 9473400 - DNA, 20 bp, Homo sapiens
cagaggcattttcagactct

SEQ ID NO: 9473401 - DNA, 22 bp, Homo sapiens
cagaggcattactgaaaaggtg

SEQ ID NO: 9473402 - DNA, 22 bp, Homo sapiens
cagaggcagtggggttgctcct

SEQ ID NO: 9473403 - DNA, 22 bp, Homo sapiens
cagaggcagtggggttgctcct

SEQ ID NO: 9473404 - DNA, 22 bp, Homo sapiens
cagaggcagtggggttgctcct

SEQ ID NO: 9473405 - DNA, 22 bp, Homo sapiens
cagaggcagtggggttgctcct

SEQ ID NO: 9473406 - DNA, 21 bp, Homo sapiens
cagaggcaggtcctgggacgg

SEQ ID NO: 9473407 - DNA, 21 bp, Homo sapiens
cagaggcaggtcctgggacgg

SEQ ID NO: 9473408 - DNA, 21 bp, Homo sapiens
cagaggcaggtcctgggacgg

SEQ ID NO: 9473409 - DNA, 21 bp, Homo sapiens
cagaggcaggtcctgggacgg

SEQ ID NO: 9473410 - DNA, 22 bp, Homo sapiens
agcccagccggattcccagttc

SEQ ID NO: 9473411 - DNA, 22 bp, Homo sapiens
agcccagccggattcccagttc

SEQ ID NO: 9473412 - DNA, 22 bp, Homo sapiens
cagaggagttcagtacacagcc

SEQ ID NO: 9473413 - DNA, 22 bp, Homo sapiens
cagaggagttcagtacacagcc

SEQ ID NO: 9473414 - DNA, 21 bp, Homo sapiens
cagaggcaggctctgtgtgtg

SEQ ID NO: 9473415 - DNA, 21 bp, Homo sapiens
cagaggcaggctctgtgtgtg

SEQ ID NO: 9473416 - DNA, 22 bp, Homo sapiens
cagacttttgggaggtctgtgg

SEQ ID NO: 9473417 - DNA, 22 bp, Homo sapiens
cagagaaaaaatcctgctctca

SEQ ID NO: 9473418 - DNA, 22 bp, Homo sapiens
cagagaaaaaatcctgctctca

SEQ ID NO: 9473419 - DNA, 22 bp, Homo sapiens
cagacatgatgtaagcagaggc

SEQ ID NO: 9473420 - DNA, 22 bp, Homo sapiens
cagacatggaaatttagtgtta

SEQ ID NO: 9473421 - DNA, 22 bp, Homo sapiens
cagagaaaaaatcctgctctca

SEQ ID NO: 9473422 - DNA, 22 bp, Homo sapiens
cagagaaaaaatcctgctctca

SEQ ID NO: 9473423 - DNA, 22 bp, Homo sapiens
cagagaaactcagatagctgat

SEQ ID NO: 9473424 - DNA, 22 bp, Homo sapiens
cagagaaactcagatagctgat

SEQ ID NO: 9473425 - DNA, 22 bp, Homo sapiens
cagagaaagaagcccattcatt

SEQ ID NO: 9473426 - DNA, 22 bp, Homo sapiens
cagagaaagaagcccattcatt

SEQ ID NO: 9473427 - DNA, 22 bp, Homo sapiens
cagagaaagaagcccattcatt

SEQ ID NO: 9473428 - DNA, 22 bp, Homo sapiens
cagagaaagaagcccattcatt

SEQ ID NO: 9473429 - DNA, 22 bp, Homo sapiens
agccatcctactacctcagcat

SEQ ID NO: 9473430 - DNA, 22 bp, Homo sapiens
agcccaagcataggagggaggc

SEQ ID NO: 9473431 - DNA, 22 bp, Homo sapiens
agcccaagcctggctggcgatg

SEQ ID NO: 9473432 - DNA, 22 bp, Homo sapiens
agcccaagcctggctggcgatg

SEQ ID NO: 9473433 - DNA, 22 bp, Homo sapiens
agcccaagctatgaggtgacct

SEQ ID NO: 9473434 - DNA, 22 bp, Homo sapiens
cagagaaagggtgaattccttc

SEQ ID NO: 9473435 - DNA, 22 bp, Homo sapiens
cagagaaagggtgaattccttc

SEQ ID NO: 9473436 - DNA, 22 bp, Homo sapiens
cagagaaagggtgaattccttc

SEQ ID NO: 9473437 - DNA, 22 bp, Homo sapiens
cagagaaagaagcccattcatt

SEQ ID NO: 9473438 - DNA, 22 bp, Homo sapiens
cagagaaagaagcccattcatt

SEQ ID NO: 9473439 - DNA, 22 bp, Homo sapiens
cagagaaagacttgcccttagt

SEQ ID NO: 9473440 - DNA, 22 bp, Homo sapiens
cagagaaagacttgcccttagt

SEQ ID NO: 9473441 - DNA, 22 bp, Homo sapiens
agcccagcactgggggcccagc

SEQ ID NO: 9473442 - DNA, 22 bp, Homo sapiens
agcccagcagaaagtccagcct

SEQ ID NO: 9473443 - DNA, 22 bp, Homo sapiens
agcccagcagaaagtccagcct

SEQ ID NO: 9473444 - DNA, 22 bp, Homo sapiens
agcccagcagaaagtccagcct

SEQ ID NO: 9473445 - DNA, 22 bp, Homo sapiens
agcccagcagaaagtccagcct

SEQ ID NO: 9473446 - DNA, 22 bp, Homo sapiens
agcccagcaaagggaggttcag

SEQ ID NO: 9473447 - DNA, 22 bp, Homo sapiens
agcccagcaaagggaggttcag

SEQ ID NO: 9473448 - DNA, 22 bp, Homo sapiens
agcccagcaaagggaggttcag

SEQ ID NO: 9473449 - DNA, 22 bp, Homo sapiens
agcccagcaaaggggtttgaga

SEQ ID NO: 9473450 - DNA, 22 bp, Homo sapiens
agcccagcaaaggggtttgaga

SEQ ID NO: 9473451 - DNA, 22 bp, Homo sapiens
agcccagcccgggctgcgcttt

SEQ ID NO: 9473452 - DNA, 22 bp, Homo sapiens
agcccagcccgggctgcgcttt

SEQ ID NO: 9473453 - DNA, 22 bp, Homo sapiens
agcccagccactattaaatgtt

SEQ ID NO: 9473454 - DNA, 22 bp, Homo sapiens
agcccagcagtaagattagaga

SEQ ID NO: 9473455 - DNA, 22 bp, Homo sapiens
agcccagcagtaagattagaga

SEQ ID NO: 9473456 - DNA, 23 bp, Homo sapiens
agcccagcagagaacctaggtcc

SEQ ID NO: 9473457 - DNA, 23 bp, Homo sapiens
agcccagcagagaacctaggtcc

SEQ ID NO: 9473458 - DNA, 22 bp, Homo sapiens
agcccagataaagtacaaccat

SEQ ID NO: 9473459 - DNA, 22 bp, Homo sapiens
agcccagatggtagccctagaa

SEQ ID NO: 9473460 - DNA, 22 bp, Homo sapiens
agcccagatggtagccctagaa

SEQ ID NO: 9473461 - DNA, 22 bp, Homo sapiens
agcccagatggtagccctagaa

SEQ ID NO: 9473462 - DNA, 22 bp, Homo sapiens
agcccagataaagtacaaccat

SEQ ID NO: 9473463 - DNA, 22 bp, Homo sapiens
agcccagagggtagcagaagaa

SEQ ID NO: 9473464 - DNA, 22 bp, Homo sapiens
agcccagagggtagcagaagaa

SEQ ID NO: 9473465 - DNA, 22 bp, Homo sapiens
agcccagaggggtttgaggact

SEQ ID NO: 9473466 - DNA, 22 bp, Homo sapiens
agcccagaggggtttgaggact

SEQ ID NO: 9473467 - DNA, 22 bp, Homo sapiens
agcccagaggctgggcgtgcat

SEQ ID NO: 9473468 - DNA, 22 bp, Homo sapiens
agcccagaggctgggcgtgcat

SEQ ID NO: 9473469 - DNA, 22 bp, Homo sapiens
agcccagagcctctcctaaagg

SEQ ID NO: 9473470 - DNA, 22 bp, Homo sapiens
agcccagagcctctcctaaagg

SEQ ID NO: 9473471 - DNA, 22 bp, Homo sapiens
agcccagagacaatgctcagta

SEQ ID NO: 9473472 - DNA, 22 bp, Homo sapiens
agcccagagccccggccatgtt

SEQ ID NO: 9473473 - DNA, 22 bp, Homo sapiens
agcccagagacaatgctcagta

SEQ ID NO: 9473474 - DNA, 22 bp, Homo sapiens
agcccagaaatgaaaggatgat

SEQ ID NO: 9473475 - DNA, 22 bp, Homo sapiens
agcccagaaatgaaaggatgat

SEQ ID NO: 9473476 - DNA, 23 bp, Homo sapiens
agcccaccttgttagtcctgtgg

SEQ ID NO: 9473477 - DNA, 22 bp, Homo sapiens
agctcaggcaactctgggcccc

SEQ ID NO: 9473478 - DNA, 19 bp, Homo sapiens
cagctcaggactcagcccc

SEQ ID NO: 9473479 - DNA, 22 bp, Homo sapiens
cagctcaggaaggaaggccggc

SEQ ID NO: 9473480 - DNA, 22 bp, Homo sapiens
cagctcaggcactggcgcggga

SEQ ID NO: 9473481 - DNA, 19 bp, Homo sapiens
cagctcaggactcagcccc

SEQ ID NO: 9473482 - DNA, 22 bp, Homo sapiens
cagctcaggctctccatgctcc

SEQ ID NO: 9473483 - DNA, 22 bp, Homo sapiens
cagctcaggctctccatgctcc

SEQ ID NO: 9473484 - DNA, 22 bp, Homo sapiens
cagctcagtctggagagatgca

SEQ ID NO: 9473485 - DNA, 22 bp, Homo sapiens
cagctcaggctctccatgctcc

SEQ ID NO: 9473486 - DNA, 21 bp, Homo sapiens
agctcagccgggcacagtggc

SEQ ID NO: 9473487 - DNA, 22 bp, Homo sapiens
agctcagcttcctctccatgct

SEQ ID NO: 9473488 - DNA, 22 bp, Homo sapiens
agctcagcttcctctccatgct

SEQ ID NO: 9473489 - DNA, 22 bp, Homo sapiens
agctcagagataatcaagagac

SEQ ID NO: 9473490 - DNA, 22 bp, Homo sapiens
agctcagagataatcaagagac

SEQ ID NO: 9473491 - DNA, 21 bp, Homo sapiens
agctcagcaagatggaggctc

SEQ ID NO: 9473492 - DNA, 22 bp, Homo sapiens
agctcagcactgtcagcactcc

SEQ ID NO: 9473493 - DNA, 22 bp, Homo sapiens
agctcagcccgttagtaagccc

SEQ ID NO: 9473494 - DNA, 22 bp, Homo sapiens
agctcctgagtagctttactca

SEQ ID NO: 9473495 - DNA, 20 bp, Homo sapiens
agctcctgagggttactttc

SEQ ID NO: 9473496 - DNA, 22 bp, Homo sapiens
agctcctgatacatgcaggaat

SEQ ID NO: 9473497 - DNA, 23 bp, Homo sapiens
agctcctgaggccagcctctcct

SEQ ID NO: 9473498 - DNA, 23 bp, Homo sapiens
agctcctgaggccagcctctcct

SEQ ID NO: 9473499 - DNA, 23 bp, Homo sapiens
agctcctgaggccagcctctcct

SEQ ID NO: 9473500 - DNA, 23 bp, Homo sapiens
agctcctgaggccagcctctcct

SEQ ID NO: 9473501 - DNA, 22 bp, Homo sapiens
cagctctgagactgaggctatg

SEQ ID NO: 9473502 - DNA, 22 bp, Homo sapiens
cagctctgagactgaggctatg

SEQ ID NO: 9473503 - DNA, 22 bp, Homo sapiens
agctcctgattctcagagatag

SEQ ID NO: 9473504 - DNA, 22 bp, Homo sapiens
agctcctgatacatgcaggaat

SEQ ID NO: 9473505 - DNA, 22 bp, Homo sapiens
agctcctgatacatgcaggaat

SEQ ID NO: 9473506 - DNA, 22 bp, Homo sapiens
cagctcagtctggagagatgca

SEQ ID NO: 9473507 - DNA, 22 bp, Homo sapiens
cagctcagtctggagagatgca

SEQ ID NO: 9473508 - DNA, 22 bp, Homo sapiens
agctcctgaaaagcgcttgctt

SEQ ID NO: 9473509 - DNA, 22 bp, Homo sapiens
agctcctgaaaagcgcttgctt

SEQ ID NO: 9473510 - DNA, 22 bp, Homo sapiens
cagctccaaagccccactgtcc

SEQ ID NO: 9473511 - DNA, 22 bp, Homo sapiens
agctcctgaaaatccagactgg

SEQ ID NO: 9473512 - DNA, 18 bp, Homo sapiens
agctcctgaactctgtgg

SEQ ID NO: 9473513 - DNA, 18 bp, Homo sapiens
agctcctgaactctgtgg

SEQ ID NO: 9473514 - DNA, 22 bp, Homo sapiens
cagcagtgtctccagcatcaca

SEQ ID NO: 9473515 - DNA, 22 bp, Homo sapiens
cagcagtgtctccagcatcaca

SEQ ID NO: 9473516 - DNA, 22 bp, Homo sapiens
cagcagggtatacagggaattt

SEQ ID NO: 9473517 - DNA, 22 bp, Homo sapiens
cagcagggtatacagggaattt

SEQ ID NO: 9473518 - DNA, 22 bp, Homo sapiens
cagcagggtatacagggaattt

SEQ ID NO: 9473519 - DNA, 22 bp, Homo sapiens
cagcagggtatacagggaattt

SEQ ID NO: 9473520 - DNA, 22 bp, Homo sapiens
cagcagggtatacagggaattt

SEQ ID NO: 9473521 - DNA, 22 bp, Homo sapiens
cagcagggtatacagggaattt

SEQ ID NO: 9473522 - DNA, 22 bp, Homo sapiens
cagcagggtaggttgtatcagt

SEQ ID NO: 9473523 - DNA, 22 bp, Homo sapiens
cagcagggggcagcgcagatca

SEQ ID NO: 9473524 - DNA, 22 bp, Homo sapiens
cagcaggggtgtcattgtagtt

SEQ ID NO: 9473525 - DNA, 22 bp, Homo sapiens
cagcaggggaactgtgggccag

SEQ ID NO: 9473526 - DNA, 22 bp, Homo sapiens
cagcaggggaactgtgggccag

SEQ ID NO: 9473527 - DNA, 22 bp, Homo sapiens
cagcagggggcagcgcagatca

SEQ ID NO: 9473528 - DNA, 22 bp, Homo sapiens
cagcagttttgaagtgtggaga

SEQ ID NO: 9473529 - DNA, 22 bp, Homo sapiens
cagcagttttgaagtgtggaga

SEQ ID NO: 9473530 - DNA, 22 bp, Homo sapiens
cagcataggatgtggagccagg

SEQ ID NO: 9473531 - DNA, 22 bp, Homo sapiens
cagcataggatgtggagccagg

SEQ ID NO: 9473532 - DNA, 22 bp, Homo sapiens
cagcagttgtttcggattggga

SEQ ID NO: 9473533 - DNA, 22 bp, Homo sapiens
cagcagttctgtactttagagt

SEQ ID NO: 9473534 - DNA, 21 bp, Homo sapiens
cagcagtgtgtctgagctaga

SEQ ID NO: 9473535 - DNA, 21 bp, Homo sapiens
cagcagtgtgtctgagctaga

SEQ ID NO: 9473536 - DNA, 22 bp, Homo sapiens
cagcagttcaatccagtgcacg

SEQ ID NO: 9473537 - DNA, 22 bp, Homo sapiens
cagcagtgtgcaggtgtgctgg

SEQ ID NO: 9473538 - DNA, 22 bp, Homo sapiens
cagcagtgtgcaggtgtgctgg

SEQ ID NO: 9473539 - DNA, 22 bp, Homo sapiens
cagcagtgtggaagctgagggg

SEQ ID NO: 9473540 - DNA, 22 bp, Homo sapiens
cagcagtgtggaagctgagggg

SEQ ID NO: 9473541 - DNA, 22 bp, Homo sapiens
cagcagtgtggaagctgagggg

SEQ ID NO: 9473542 - DNA, 22 bp, Homo sapiens
cagcagtgtggaagctgagggg

SEQ ID NO: 9473543 - DNA, 22 bp, Homo sapiens
cagcatcaacattctcagctct

SEQ ID NO: 9473544 - DNA, 22 bp, Homo sapiens
cagccccacacggtctagctct

SEQ ID NO: 9473545 - DNA, 20 bp, Homo sapiens
cagcatcaaaggaaggtttg

SEQ ID NO: 9473546 - DNA, 22 bp, Homo sapiens
cagcatattactttaaaaaatc

SEQ ID NO: 9473547 - DNA, 22 bp, Homo sapiens
cagcatattactttaaaaaatc

SEQ ID NO: 9473548 - DNA, 23 bp, Homo sapiens
cagccctgaaatcgaggtgacac

SEQ ID NO: 9473549 - DNA, 22 bp, Homo sapiens
cagccccatggtgtgctccagc

SEQ ID NO: 9473550 - DNA, 22 bp, Homo sapiens
cagccctgagaaggaggatctc

SEQ ID NO: 9473551 - DNA, 23 bp, Homo sapiens
cagccctgaaatcgaggtgacac

SEQ ID NO: 9473552 - DNA, 22 bp, Homo sapiens
cagccctgagagaaccatctat

SEQ ID NO: 9473553 - DNA, 22 bp, Homo sapiens
cagccctgagcaaggcttttaa

SEQ ID NO: 9473554 - DNA, 22 bp, Homo sapiens
cagccctgagagaaccatctat

SEQ ID NO: 9473555 - DNA, 22 bp, Homo sapiens
cagccctgcacgctgcctccgc

SEQ ID NO: 9473556 - DNA, 22 bp, Homo sapiens
cagccctgcacgctgcctccgc

SEQ ID NO: 9473557 - DNA, 22 bp, Homo sapiens
cagccctgcagagggcgctcct

SEQ ID NO: 9473558 - DNA, 22 bp, Homo sapiens
cagccctgcagagggcgctcct

SEQ ID NO: 9473559 - DNA, 22 bp, Homo sapiens
cagccctgcacgctgcctccgc

SEQ ID NO: 9473560 - DNA, 22 bp, Homo sapiens
cagccctgagttagcccacgga

SEQ ID NO: 9473561 - DNA, 16 bp, Homo sapiens
cagccctgaggaagaa

SEQ ID NO: 9473562 - DNA, 22 bp, Homo sapiens
cagccctgagttagcccacgga

SEQ ID NO: 9473563 - DNA, 22 bp, Homo sapiens
cagccctgagttagcccacgga

SEQ ID NO: 9473564 - DNA, 22 bp, Homo sapiens
cagccctgagttagcccacgga

SEQ ID NO: 9473565 - DNA, 22 bp, Homo sapiens
cagaggtcaagatctgaagtga

SEQ ID NO: 9473566 - DNA, 22 bp, Homo sapiens
cagaggtcaggttggacattat

SEQ ID NO: 9473567 - DNA, 22 bp, Homo sapiens
cagaggtattttgataaacgcc

SEQ ID NO: 9473568 - DNA, 22 bp, Homo sapiens
cagaggtattttgataaacgcc

SEQ ID NO: 9473569 - DNA, 22 bp, Homo sapiens
cagagggccccctggccacagt

SEQ ID NO: 9473570 - DNA, 22 bp, Homo sapiens
cagaggtattgcaaaagcctag

SEQ ID NO: 9473571 - DNA, 22 bp, Homo sapiens
cagagggcactcggagtgacat

SEQ ID NO: 9473572 - DNA, 22 bp, Homo sapiens
cagagggcactcggagtgacat

SEQ ID NO: 9473573 - DNA, 22 bp, Homo sapiens
cagagggcactcggagtgacat

SEQ ID NO: 9473574 - DNA, 22 bp, Homo sapiens
cagagggatcatcttcctgaag

SEQ ID NO: 9473575 - DNA, 22 bp, Homo sapiens
cagagggatcatcttcctgaag

SEQ ID NO: 9473576 - DNA, 22 bp, Homo sapiens
cagagggagtttctgaggttgc

SEQ ID NO: 9473577 - DNA, 22 bp, Homo sapiens
cagagggagtttctgaggttgc

SEQ ID NO: 9473578 - DNA, 22 bp, Homo sapiens
cagaggtctgacactgaatggt

SEQ ID NO: 9473579 - DNA, 22 bp, Homo sapiens
cagaggtctgacactgaatggt

SEQ ID NO: 9473580 - DNA, 22 bp, Homo sapiens
cagaggtgacccatagtacctc

SEQ ID NO: 9473581 - DNA, 22 bp, Homo sapiens
agcctccctatgcaccttcagg

SEQ ID NO: 9473582 - DNA, 22 bp, Homo sapiens
cagaggtgctggagtgagtcct

SEQ ID NO: 9473583 - DNA, 22 bp, Homo sapiens
cagaggtgctggagtgagtcct

SEQ ID NO: 9473584 - DNA, 22 bp, Homo sapiens
agcctccctatgcaccttcagg

SEQ ID NO: 9473585 - DNA, 22 bp, Homo sapiens
cagaggtgcatacaggtcatta

SEQ ID NO: 9473586 - DNA, 22 bp, Homo sapiens
cagaggtgcatacaggtcatta

SEQ ID NO: 9473587 - DNA, 19 bp, Homo sapiens
cagaggtgatatatgccca

SEQ ID NO: 9473588 - DNA, 22 bp, Homo sapiens
cagaggtgcatacaggtcatta

SEQ ID NO: 9473589 - DNA, 22 bp, Homo sapiens
cagaggtgcatacaggtcatta

SEQ ID NO: 9473590 - DNA, 22 bp, Homo sapiens
cagaggtgcatacaggtcatta

SEQ ID NO: 9473591 - DNA, 22 bp, Homo sapiens
agcctctgtagaaagcagtgtg

SEQ ID NO: 9473592 - DNA, 22 bp, Homo sapiens
agcctctgtagaaagcagtgtg

SEQ ID NO: 9473593 - DNA, 22 bp, Homo sapiens
agcctctgtagaaagcagtgtg

SEQ ID NO: 9473594 - DNA, 22 bp, Homo sapiens
agcctctgtcaagcttttcaaa

SEQ ID NO: 9473595 - DNA, 22 bp, Homo sapiens
agcctctgtgactcacaggtca

SEQ ID NO: 9473596 - DNA, 22 bp, Homo sapiens
agcctctgtgactcacaggtca

SEQ ID NO: 9473597 - DNA, 22 bp, Homo sapiens
agcctctgtgactcacaggtca

SEQ ID NO: 9473598 - DNA, 22 bp, Homo sapiens
agcctctggtcctccctcagct

SEQ ID NO: 9473599 - DNA, 22 bp, Homo sapiens
agcctctggtcctccctcagct

SEQ ID NO: 9473600 - DNA, 22 bp, Homo sapiens
agcctctgggggagctgggagc

SEQ ID NO: 9473601 - DNA, 22 bp, Homo sapiens
agcctctggtcctccctcagct

SEQ ID NO: 9473602 - DNA, 22 bp, Homo sapiens
agcctctggtcctccctcagct

SEQ ID NO: 9473603 - DNA, 22 bp, Homo sapiens
agcctctggccctagactgctt

SEQ ID NO: 9473604 - DNA, 22 bp, Homo sapiens
agcctctgcacttcttacaggt

SEQ ID NO: 9473605 - DNA, 22 bp, Homo sapiens
agcctctgcacttcttacaggt

SEQ ID NO: 9473606 - DNA, 20 bp, Homo sapiens
agcctctgcccttcccactg

SEQ ID NO: 9473607 - DNA, 20 bp, Homo sapiens
agcctctgcccttcccactg

SEQ ID NO: 9473608 - DNA, 22 bp, Homo sapiens
agcctctgatggctcccaagga

SEQ ID NO: 9473609 - DNA, 22 bp, Homo sapiens
agcctctgcacgggcacgggtg

SEQ ID NO: 9473610 - DNA, 18 bp, Homo sapiens
agcctctggcagagagaa

SEQ ID NO: 9473611 - DNA, 18 bp, Homo sapiens
agcctctggcagagagaa

SEQ ID NO: 9473612 - DNA, 18 bp, Homo sapiens
agcctctggcagagagaa

SEQ ID NO: 9473613 - DNA, 22 bp, Homo sapiens
agcctctgctggccctggcact

SEQ ID NO: 9473614 - DNA, 22 bp, Homo sapiens
agcctggagttcccaggagaag

SEQ ID NO: 9473615 - DNA, 22 bp, Homo sapiens
agcctggagttcccaggagaag

SEQ ID NO: 9473616 - DNA, 22 bp, Homo sapiens
agcctggagttcccaggagaag

SEQ ID NO: 9473617 - DNA, 22 bp, Homo sapiens
agcctggatccatgtggctacc

SEQ ID NO: 9473618 - DNA, 22 bp, Homo sapiens
cagcagctgaggcgctggcgtg

SEQ ID NO: 9473619 - DNA, 22 bp, Homo sapiens
cagcagctgaggcgctggcgtg

SEQ ID NO: 9473620 - DNA, 22 bp, Homo sapiens
cagcagctgactccaagagagc

SEQ ID NO: 9473621 - DNA, 22 bp, Homo sapiens
agcctggatcctaggctcagct

SEQ ID NO: 9473622 - DNA, 22 bp, Homo sapiens
agcctggattcgtgcatccaca

SEQ ID NO: 9473623 - DNA, 23 bp, Homo sapiens
agcctggcacctgcagatcggag

SEQ ID NO: 9473624 - DNA, 22 bp, Homo sapiens
cagcagggcccccgggtgcgcc

SEQ ID NO: 9473625 - DNA, 22 bp, Homo sapiens
cagcagggcccccgggtgcgcc

SEQ ID NO: 9473626 - DNA, 22 bp, Homo sapiens
cagcaggggaactgtgggccag

SEQ ID NO: 9473627 - DNA, 22 bp, Homo sapiens
cagcagggctgtgctaccccat

SEQ ID NO: 9473628 - DNA, 22 bp, Homo sapiens
cagcagggcccccgggtgcgcc

SEQ ID NO: 9473629 - DNA, 22 bp, Homo sapiens
cagcagggcccccgggtgcgcc

SEQ ID NO: 9473630 - DNA, 22 bp, Homo sapiens
cagcagggcccccgggtgcgcc

SEQ ID NO: 9473631 - DNA, 22 bp, Homo sapiens
cagcaggataggtttctttgga

SEQ ID NO: 9473632 - DNA, 22 bp, Homo sapiens
cagcaggatatggtggagagag

SEQ ID NO: 9473633 - DNA, 22 bp, Homo sapiens
cagcagggaagctgtgctgttt

SEQ ID NO: 9473634 - DNA, 22 bp, Homo sapiens
cagcagggaagctgtgctgttt

SEQ ID NO: 9473635 - DNA, 22 bp, Homo sapiens
cagcagggaagctgtgctgttt

SEQ ID NO: 9473636 - DNA, 22 bp, Homo sapiens
agcctggcactgaggcagggcg

SEQ ID NO: 9473637 - DNA, 22 bp, Homo sapiens
cagcagctcactcaggtggctc

SEQ ID NO: 9473638 - DNA, 22 bp, Homo sapiens
cagcagctcactcaggtggctc

SEQ ID NO: 9473639 - DNA, 22 bp, Homo sapiens
cagcagctcactcaggtggctc

SEQ ID NO: 9473640 - DNA, 22 bp, Homo sapiens
cagcagctcactgaataatgac

SEQ ID NO: 9473641 - DNA, 22 bp, Homo sapiens
cagcagcattgctctggattcc

SEQ ID NO: 9473642 - DNA, 22 bp, Homo sapiens
cagcagcattgctctggattcc

SEQ ID NO: 9473643 - DNA, 22 bp, Homo sapiens
agcctcttccagctcctttcta

SEQ ID NO: 9473644 - DNA, 22 bp, Homo sapiens
agcctcttattctccaggactt

SEQ ID NO: 9473645 - DNA, 22 bp, Homo sapiens
agcctgagccccatccagctga

SEQ ID NO: 9473646 - DNA, 22 bp, Homo sapiens
agcctgagagccaagctgtgca

SEQ ID NO: 9473647 - DNA, 22 bp, Homo sapiens
agcctgagagccaagctgtgca

SEQ ID NO: 9473648 - DNA, 22 bp, Homo sapiens
agcctgagagccaagctgtgca

SEQ ID NO: 9473649 - DNA, 22 bp, Homo sapiens
cagcagctcagtctctcagtag

SEQ ID NO: 9473650 - DNA, 22 bp, Homo sapiens
cagcagctcagtctctcagtag

SEQ ID NO: 9473651 - DNA, 22 bp, Homo sapiens
cagcagctcagtctctcagtag

SEQ ID NO: 9473652 - DNA, 22 bp, Homo sapiens
cagcagctcccatccgctgagc

SEQ ID NO: 9473653 - DNA, 22 bp, Homo sapiens
cagcagctcccatccgctgagc

SEQ ID NO: 9473654 - DNA, 22 bp, Homo sapiens
cagcagctccaaagaatagcca

SEQ ID NO: 9473655 - DNA, 22 bp, Homo sapiens
cagcagctgactccaagagagc

SEQ ID NO: 9473656 - DNA, 22 bp, Homo sapiens
cagcagctcctctgcggctatg

SEQ ID NO: 9473657 - DNA, 22 bp, Homo sapiens
cagcagctcccatccgctgagc

SEQ ID NO: 9473658 - DNA, 22 bp, Homo sapiens
cagcagctcctctgcggctatg

SEQ ID NO: 9473659 - DNA, 22 bp, Homo sapiens
cagcagctcaggctgcttccca

SEQ ID NO: 9473660 - DNA, 22 bp, Homo sapiens
cagcagctcaggctgcttccca

SEQ ID NO: 9473661 - DNA, 22 bp, Homo sapiens
cagcagctcagtctctcagtag

SEQ ID NO: 9473662 - DNA, 22 bp, Homo sapiens
cagcagctcagtctctcagtag

SEQ ID NO: 9473663 - DNA, 22 bp, Homo sapiens
cagcagctcactgaataatgac

SEQ ID NO: 9473664 - DNA, 22 bp, Homo sapiens
cagcagctcaggctccttccca

SEQ ID NO: 9473665 - DNA, 22 bp, Homo sapiens
agcacaggtgaaacagtcaggt

SEQ ID NO: 9473666 - DNA, 22 bp, Homo sapiens
agcaaagctatctctatggaga

SEQ ID NO: 9473667 - DNA, 22 bp, Homo sapiens
agcaaagctaccaattattgag

SEQ ID NO: 9473668 - DNA, 20 bp, Homo sapiens
agcaaagcctttagagtttg

SEQ ID NO: 9473669 - DNA, 22 bp, Homo sapiens
agcaaagccgagacagccagtg

SEQ ID NO: 9473670 - DNA, 22 bp, Homo sapiens
agcaaagccgagacagccagtg

SEQ ID NO: 9473671 - DNA, 22 bp, Homo sapiens
agcaaagcactttgcatacata

SEQ ID NO: 9473672 - DNA, 22 bp, Homo sapiens
agcaaagcactttgcatacata

SEQ ID NO: 9473673 - DNA, 22 bp, Homo sapiens
agcaaagcactttgcatacata

SEQ ID NO: 9473674 - DNA, 22 bp, Homo sapiens
agcaaagccgagacagccagtg

SEQ ID NO: 9473675 - DNA, 22 bp, Homo sapiens
agcaaagcatcactccaatctg

SEQ ID NO: 9473676 - DNA, 18 bp, Homo sapiens
agcaaagcaagagatcac

SEQ ID NO: 9473677 - DNA, 22 bp, Homo sapiens
agcaaagcactttgcatacata

SEQ ID NO: 9473678 - DNA, 22 bp, Homo sapiens
agcaaagcactttgcatacata

SEQ ID NO: 9473679 - DNA, 18 bp, Homo sapiens
agcaaagcaagagatcac

SEQ ID NO: 9473680 - DNA, 18 bp, Homo sapiens
agcaaagcaagagatcac

SEQ ID NO: 9473681 - DNA, 22 bp, Homo sapiens
agcaaagatgtccggggcaagc

SEQ ID NO: 9473682 - DNA, 22 bp, Homo sapiens
agcaaagacagggacgaccaag

SEQ ID NO: 9473683 - DNA, 22 bp, Homo sapiens
agcaaagagtaattttgttttg

SEQ ID NO: 9473684 - DNA, 22 bp, Homo sapiens
agcaaagaagggttcttcatta

SEQ ID NO: 9473685 - DNA, 22 bp, Homo sapiens
agcaaagaagggttcttcatta

SEQ ID NO: 9473686 - DNA, 22 bp, Homo sapiens
agcaaagaagacacaggcttca

SEQ ID NO: 9473687 - DNA, 22 bp, Homo sapiens
agcaaagaagacacaggcttca

SEQ ID NO: 9473688 - DNA, 22 bp, Homo sapiens
agcaaagaaatggaggctcaga

SEQ ID NO: 9473689 - DNA, 22 bp, Homo sapiens
agcaaagaaatggaggctcaga

SEQ ID NO: 9473690 - DNA, 20 bp, Homo sapiens
agcaaactcttcccatcttc

SEQ ID NO: 9473691 - DNA, 22 bp, Homo sapiens
agcaaactaattgcagttctgg

SEQ ID NO: 9473692 - DNA, 22 bp, Homo sapiens
agcaaactaattgcagttctgg

SEQ ID NO: 9473693 - DNA, 22 bp, Homo sapiens
caaaataccacgacttgtttta

SEQ ID NO: 9473694 - DNA, 22 bp, Homo sapiens
caaaagtctgtcctttaacttc

SEQ ID NO: 9473695 - DNA, 22 bp, Homo sapiens
caaaagtagtgaagttgtacat

SEQ ID NO: 9473696 - DNA, 22 bp, Homo sapiens
caaaagtcttcctattctctta

SEQ ID NO: 9473697 - DNA, 22 bp, Homo sapiens
agcacatgcacagtgctacact

SEQ ID NO: 9473698 - DNA, 22 bp, Homo sapiens
agcacatgcacagtgctacact

SEQ ID NO: 9473699 - DNA, 22 bp, Homo sapiens
agcacatattcagttcatacaa

SEQ ID NO: 9473700 - DNA, 22 bp, Homo sapiens
caaatagacttcaatctcttga

SEQ ID NO: 9473701 - DNA, 22 bp, Homo sapiens
caaatagacttcaatctcttga

SEQ ID NO: 9473702 - DNA, 22 bp, Homo sapiens
caaatagacttcaatctcttga

SEQ ID NO: 9473703 - DNA, 22 bp, Homo sapiens
agcacatgtattctccttgaat

SEQ ID NO: 9473704 - DNA, 20 bp, Homo sapiens
agcacattaaacatactcct

SEQ ID NO: 9473705 - DNA, 22 bp, Homo sapiens
caaatagacttcaatctcttga

SEQ ID NO: 9473706 - DNA, 22 bp, Homo sapiens
caaatagattgttcaatcctga

SEQ ID NO: 9473707 - DNA, 22 bp, Homo sapiens
caaatagattgttcaatcctga

SEQ ID NO: 9473708 - DNA, 22 bp, Homo sapiens
caaatagattgttcaatcctga

SEQ ID NO: 9473709 - DNA, 22 bp, Homo sapiens
caaatagattgttcaatcctga

SEQ ID NO: 9473710 - DNA, 18 bp, Homo sapiens
caaatagcatgatgtcct

SEQ ID NO: 9473711 - DNA, 18 bp, Homo sapiens
caaatagcatgatgtcct

SEQ ID NO: 9473712 - DNA, 22 bp, Homo sapiens
caaatagtatgagcaatgattc

SEQ ID NO: 9473713 - DNA, 22 bp, Homo sapiens
caaatagtgaaacagatggggg

SEQ ID NO: 9473714 - DNA, 22 bp, Homo sapiens
caaatagtatgagcaatgattc

SEQ ID NO: 9473715 - DNA, 22 bp, Homo sapiens
caaatagtatgagcaatgattc

SEQ ID NO: 9473716 - DNA, 22 bp, Homo sapiens
caaatagtatgagcaatgattc

SEQ ID NO: 9473717 - DNA, 22 bp, Homo sapiens
caaatagtatgagcaatgattc

SEQ ID NO: 9473718 - DNA, 22 bp, Homo sapiens
agcacaggtgaaacagtcaggt

SEQ ID NO: 9473719 - DNA, 22 bp, Homo sapiens
agcacaggtgaaacagtcaggt

SEQ ID NO: 9473720 - DNA, 22 bp, Homo sapiens
agcacaggtgaaacagtcaggt

SEQ ID NO: 9473721 - DNA, 22 bp, Homo sapiens
agcacagtaaagcagtgtcaca

SEQ ID NO: 9473722 - DNA, 22 bp, Homo sapiens
agcacagtaaagcagtgtcaca

SEQ ID NO: 9473723 - DNA, 22 bp, Homo sapiens
agcacagtaaagcagtgtcaca

SEQ ID NO: 9473724 - DNA, 22 bp, Homo sapiens
agcacagtgcctgacatatatg

SEQ ID NO: 9473725 - DNA, 22 bp, Homo sapiens
agcacagtaattgatattactg

SEQ ID NO: 9473726 - DNA, 22 bp, Homo sapiens
agcacagtaattgatattactg

SEQ ID NO: 9473727 - DNA, 19 bp, Homo sapiens
agcacagtttccacatgca

SEQ ID NO: 9473728 - DNA, 22 bp, Homo sapiens
agcacagttttcattgcagggt

SEQ ID NO: 9473729 - DNA, 22 bp, Homo sapiens
agcacagtgctctggacagagt

SEQ ID NO: 9473730 - DNA, 22 bp, Homo sapiens
agcacagtgctctggacagagt

SEQ ID NO: 9473731 - DNA, 22 bp, Homo sapiens
agcacagtgcctgacatatatg

SEQ ID NO: 9473732 - DNA, 19 bp, Homo sapiens
agcacagtttccacatgca

SEQ ID NO: 9473733 - DNA, 22 bp, Homo sapiens
caactttaaatggctatgtctg

SEQ ID NO: 9473734 - DNA, 22 bp, Homo sapiens
caacttggctctctggctatcc

SEQ ID NO: 9473735 - DNA, 22 bp, Homo sapiens
caactttaatttgggtgtcaga

SEQ ID NO: 9473736 - DNA, 22 bp, Homo sapiens
agcaccaggccatggggtccct

SEQ ID NO: 9473737 - DNA, 22 bp, Homo sapiens
agcaccaggcagtatatcaaag

SEQ ID NO: 9473738 - DNA, 22 bp, Homo sapiens
agcaccaggtcgctggcacgct

SEQ ID NO: 9473739 - DNA, 22 bp, Homo sapiens
agcaccaggctgttggaagccc

SEQ ID NO: 9473740 - DNA, 22 bp, Homo sapiens
caacttcttggcttcctaatgg

SEQ ID NO: 9473741 - DNA, 22 bp, Homo sapiens
agcaccaggtcgctggcacgct

SEQ ID NO: 9473742 - DNA, 22 bp, Homo sapiens
agcaccaggctgttggaagccc

SEQ ID NO: 9473743 - DNA, 22 bp, Homo sapiens
agcaccaggctgttggaagccc

SEQ ID NO: 9473744 - DNA, 22 bp, Homo sapiens
caagagacgggcaaggcaagag

SEQ ID NO: 9473745 - DNA, 22 bp, Homo sapiens
caagactcacacacagaagagg

SEQ ID NO: 9473746 - DNA, 22 bp, Homo sapiens
caagactttggaaggctgaggc

SEQ ID NO: 9473747 - DNA, 22 bp, Homo sapiens
caagacctcaaaatgagagggg

SEQ ID NO: 9473748 - DNA, 22 bp, Homo sapiens
caagacttagagcatcttgaaa

SEQ ID NO: 9473749 - DNA, 22 bp, Homo sapiens
caagacttcaccgctctgtgct

SEQ ID NO: 9473750 - DNA, 22 bp, Homo sapiens
caagacattgattttgtacaga

SEQ ID NO: 9473751 - DNA, 22 bp, Homo sapiens
caagacattgattttgtacaga

SEQ ID NO: 9473752 - DNA, 22 bp, Homo sapiens
caagacatgcaattgccacttt

SEQ ID NO: 9473753 - DNA, 22 bp, Homo sapiens
agcaccagagctatgggcctgc

SEQ ID NO: 9473754 - DNA, 16 bp, Homo sapiens
agcaccagatcatatc

SEQ ID NO: 9473755 - DNA, 22 bp, Homo sapiens
agcaccagcaactatgggctgc

SEQ ID NO: 9473756 - DNA, 22 bp, Homo sapiens
agcaccagcaactatgggctgc

SEQ ID NO: 9473757 - DNA, 22 bp, Homo sapiens
agcaccagctcaaggtgcacct

SEQ ID NO: 9473758 - DNA, 22 bp, Homo sapiens
agcaccagctcaaggtgcacct

SEQ ID NO: 9473759 - DNA, 22 bp, Homo sapiens
agcaccagcgtgggggccgttg

SEQ ID NO: 9473760 - DNA, 22 bp, Homo sapiens
agcaccaggaaagaaggggcca

SEQ ID NO: 9473761 - DNA, 23 bp, Homo sapiens
agcaccaggaacagtgtggtcct

SEQ ID NO: 9473762 - DNA, 22 bp, Homo sapiens
agcaccaggcaccaaagggcct

SEQ ID NO: 9473763 - DNA, 22 bp, Homo sapiens
agcaccaggatattgttggaga

SEQ ID NO: 9473764 - DNA, 22 bp, Homo sapiens
caacagaaatcaattttcccat

SEQ ID NO: 9473765 - DNA, 22 bp, Homo sapiens
caacacttcttatacttactga

SEQ ID NO: 9473766 - DNA, 23 bp, Homo sapiens
caacactgccttcaggtgaagaa

SEQ ID NO: 9473767 - DNA, 20 bp, Homo sapiens
caacactgcccattgtttgc

SEQ ID NO: 9473768 - DNA, 20 bp, Homo sapiens
caacactgcccattgtttgc

SEQ ID NO: 9473769 - DNA, 22 bp, Homo sapiens
caaattaatgtgtctcaaaata

SEQ ID NO: 9473770 - DNA, 20 bp, Homo sapiens
caacactgcccattgtttgc

SEQ ID NO: 9473771 - DNA, 22 bp, Homo sapiens
caaatatctttggcaaagagaa

SEQ ID NO: 9473772 - DNA, 22 bp, Homo sapiens
caaatatctttggcaaagagaa

SEQ ID NO: 9473773 - DNA, 22 bp, Homo sapiens
caaatattccaggtacatccct

SEQ ID NO: 9473774 - DNA, 22 bp, Homo sapiens
caaattaatgtgtctcaaaata

SEQ ID NO: 9473775 - DNA, 22 bp, Homo sapiens
caaatagtgtcacattgtgagg

SEQ ID NO: 9473776 - DNA, 22 bp, Homo sapiens
caaatagtgtcacattgtgagg

SEQ ID NO: 9473777 - DNA, 22 bp, Homo sapiens
caaatagtttttcatgtattat

SEQ ID NO: 9473778 - DNA, 22 bp, Homo sapiens
caacagaaggtgtactactgaa

SEQ ID NO: 9473779 - DNA, 22 bp, Homo sapiens
caacagaaggtgtactactgaa

SEQ ID NO: 9473780 - DNA, 22 bp, Homo sapiens
caacagctgatctttgatgaag

SEQ ID NO: 9473781 - DNA, 22 bp, Homo sapiens
caacagctcagacacgggacct

SEQ ID NO: 9473782 - DNA, 22 bp, Homo sapiens
caacagctcagacacgggacct

SEQ ID NO: 9473783 - DNA, 22 bp, Homo sapiens
caacagctggaggcttggcccg

SEQ ID NO: 9473784 - DNA, 23 bp, Homo sapiens
caacagctgttagatatgggctt

SEQ ID NO: 9473785 - DNA, 22 bp, Homo sapiens
caacagctggaggcttggcccg

SEQ ID NO: 9473786 - DNA, 22 bp, Homo sapiens
agcacattagtatctaagaaca

SEQ ID NO: 9473787 - DNA, 22 bp, Homo sapiens
agcacattaagtgagttcatgt

SEQ ID NO: 9473788 - DNA, 23 bp, Homo sapiens
caacagctgttagatatgggctt

SEQ ID NO: 9473789 - DNA, 22 bp, Homo sapiens
caacagctttagaaacactttc

SEQ ID NO: 9473790 - DNA, 22 bp, Homo sapiens
agcacattaagtgagttcatgt

SEQ ID NO: 9473791 - DNA, 22 bp, Homo sapiens
agcagcaggctgggatgagtct

SEQ ID NO: 9473792 - DNA, 22 bp, Homo sapiens
agcagcaggctgtgtggactga

SEQ ID NO: 9473793 - DNA, 22 bp, Homo sapiens
agcagcaggctgtgtggactga

SEQ ID NO: 9473794 - DNA, 22 bp, Homo sapiens
agcagcaggctgtgtggactga

SEQ ID NO: 9473795 - DNA, 22 bp, Homo sapiens
agcagcaggctagggaactgct

SEQ ID NO: 9473796 - DNA, 22 bp, Homo sapiens
agcagcaggctagggaactgct

SEQ ID NO: 9473797 - DNA, 22 bp, Homo sapiens
agcagcaggctagggaactgct

SEQ ID NO: 9473798 - DNA, 22 bp, Homo sapiens
agcagcaggctagggaactgct

SEQ ID NO: 9473799 - DNA, 23 bp, Homo sapiens
agcagcaggaggtattgataagg

SEQ ID NO: 9473800 - DNA, 22 bp, Homo sapiens
agcagcaggattttcgttggga

SEQ ID NO: 9473801 - DNA, 22 bp, Homo sapiens
agcagcaggctagggaactgct

SEQ ID NO: 9473802 - DNA, 22 bp, Homo sapiens
agcagcaggattttcgttggga

SEQ ID NO: 9473803 - DNA, 22 bp, Homo sapiens
agcagcagattatggtctacat

SEQ ID NO: 9473804 - DNA, 22 bp, Homo sapiens
caagcagagactagatagctgt

SEQ ID NO: 9473805 - DNA, 22 bp, Homo sapiens
caagcagagactagatagctgt

SEQ ID NO: 9473806 - DNA, 20 bp, Homo sapiens
agcagcagatgttggaggtg

SEQ ID NO: 9473807 - DNA, 22 bp, Homo sapiens
agcagcaggaggccattgtctt

SEQ ID NO: 9473808 - DNA, 22 bp, Homo sapiens
agcagcaggaggccattgtctt

SEQ ID NO: 9473809 - DNA, 22 bp, Homo sapiens
agcagcaggaggctgtccacca

SEQ ID NO: 9473810 - DNA, 22 bp, Homo sapiens
caagagctagactttgtcagga

SEQ ID NO: 9473811 - DNA, 22 bp, Homo sapiens
caagagctagactttgtcagga

SEQ ID NO: 9473812 - DNA, 22 bp, Homo sapiens
caagatttagcctgctgcctgt

SEQ ID NO: 9473813 - DNA, 22 bp, Homo sapiens
caagatttagctcccttatctc

SEQ ID NO: 9473814 - DNA, 22 bp, Homo sapiens
caagatttatattttcacacaa

SEQ ID NO: 9473815 - DNA, 22 bp, Homo sapiens
caagagccataattttgagagt

SEQ ID NO: 9473816 - DNA, 17 bp, Homo sapiens
caagagagatgactgga

SEQ ID NO: 9473817 - DNA, 22 bp, Homo sapiens
caagagagatgcagctcactca

SEQ ID NO: 9473818 - DNA, 17 bp, Homo sapiens
caagagagatgactgga

SEQ ID NO: 9473819 - DNA, 17 bp, Homo sapiens
caagagagatgactgga

SEQ ID NO: 9473820 - DNA, 22 bp, Homo sapiens
caagagacttatgtggaaacct

SEQ ID NO: 9473821 - DNA, 22 bp, Homo sapiens
caagagacttatgtggaaacct

SEQ ID NO: 9473822 - DNA, 22 bp, Homo sapiens
caagcaatgctatactcattat

SEQ ID NO: 9473823 - DNA, 22 bp, Homo sapiens
caagcagacagtaggcctagaa

SEQ ID NO: 9473824 - DNA, 22 bp, Homo sapiens
caagatttccaaccctgggtaa

SEQ ID NO: 9473825 - DNA, 22 bp, Homo sapiens
caagatttgacttcgtggtttg

SEQ ID NO: 9473826 - DNA, 22 bp, Homo sapiens
caagatttgccagtggccaact

SEQ ID NO: 9473827 - DNA, 22 bp, Homo sapiens
caagatttggcattctgaggag

SEQ ID NO: 9473828 - DNA, 22 bp, Homo sapiens
caagatttggcaactttgtcat

SEQ ID NO: 9473829 - DNA, 22 bp, Homo sapiens
caagatttgtattgggcctctg

SEQ ID NO: 9473830 - DNA, 22 bp, Homo sapiens
caagatttgggggcacggaatc

SEQ ID NO: 9473831 - DNA, 19 bp, Homo sapiens
caagatttgttcacacatg

SEQ ID NO: 9473832 - DNA, 22 bp, Homo sapiens
caagattttatctccgtttctg

SEQ ID NO: 9473833 - DNA, 22 bp, Homo sapiens
agcagccacacgcctccttctc

SEQ ID NO: 9473834 - DNA, 22 bp, Homo sapiens
agcagccaaggtaacctgtgct

SEQ ID NO: 9473835 - DNA, 22 bp, Homo sapiens
agcagccaattggaggatgaag

SEQ ID NO: 9473836 - DNA, 22 bp, Homo sapiens
agcagccacagcagatctgagt

SEQ ID NO: 9473837 - DNA, 22 bp, Homo sapiens
agcagccacagtctgggacagg

SEQ ID NO: 9473838 - DNA, 22 bp, Homo sapiens
agcagccacccagctgctcatt

SEQ ID NO: 9473839 - DNA, 22 bp, Homo sapiens
agcagccacagtctgggacagg

SEQ ID NO: 9473840 - DNA, 22 bp, Homo sapiens
agcagccacagtctgggacagg

SEQ ID NO: 9473841 - DNA, 22 bp, Homo sapiens
agcagccacagtctgggacagg

SEQ ID NO: 9473842 - DNA, 22 bp, Homo sapiens
agcagccagaaagggcagtcga

SEQ ID NO: 9473843 - DNA, 22 bp, Homo sapiens
agcagccacccagctgctcatt

SEQ ID NO: 9473844 - DNA, 22 bp, Homo sapiens
agcagccagaaatccagaggtg

SEQ ID NO: 9473845 - DNA, 22 bp, Homo sapiens
agcagctcccctcatgctccac

SEQ ID NO: 9473846 - DNA, 22 bp, Homo sapiens
agcagctcccctcatgctccac

SEQ ID NO: 9473847 - DNA, 22 bp, Homo sapiens
agcagccagaaatccagaggtg

SEQ ID NO: 9473848 - DNA, 22 bp, Homo sapiens
agcagctccctcctcagccacc

SEQ ID NO: 9473849 - DNA, 22 bp, Homo sapiens
cacaagatggtttccagatgct

SEQ ID NO: 9473850 - DNA, 22 bp, Homo sapiens
cacaagatggtttccagatgct

SEQ ID NO: 9473851 - DNA, 22 bp, Homo sapiens
cacaagatggtcacataagtgc

SEQ ID NO: 9473852 - DNA, 22 bp, Homo sapiens
cacaagatggtcacataagtgc

SEQ ID NO: 9473853 - DNA, 22 bp, Homo sapiens
cacaagatggtcacataagtgc

SEQ ID NO: 9473854 - DNA, 20 bp, Homo sapiens
cacaagaggagttccctgag

SEQ ID NO: 9473855 - DNA, 22 bp, Homo sapiens
cacaaggacctcagatggatga

SEQ ID NO: 9473856 - DNA, 22 bp, Homo sapiens
cacaaggactggatggagtggg

SEQ ID NO: 9473857 - DNA, 22 bp, Homo sapiens
cacaaggactggatggagtggg

SEQ ID NO: 9473858 - DNA, 22 bp, Homo sapiens
cacaaggaggtcctgaggaagc

SEQ ID NO: 9473859 - DNA, 22 bp, Homo sapiens
cacaaggcacattccttgtcca

SEQ ID NO: 9473860 - DNA, 22 bp, Homo sapiens
cacaaggaggtcctgaggaagc

SEQ ID NO: 9473861 - DNA, 22 bp, Homo sapiens
cacaaggaggtcctgaggaagc

SEQ ID NO: 9473862 - DNA, 22 bp, Homo sapiens
agcagccaaatgaagattttac

SEQ ID NO: 9473863 - DNA, 22 bp, Homo sapiens
agcagcatttaagtttcttcta

SEQ ID NO: 9473864 - DNA, 22 bp, Homo sapiens
cacaaggctttcatctggcata

SEQ ID NO: 9473865 - DNA, 22 bp, Homo sapiens
cacaaggctgggacaagtgctg

SEQ ID NO: 9473866 - DNA, 22 bp, Homo sapiens
cacaaggctttcatctggcata

SEQ ID NO: 9473867 - DNA, 22 bp, Homo sapiens
cacaaggcacattccttgtcca

SEQ ID NO: 9473868 - DNA, 22 bp, Homo sapiens
cacaaggccctgggtcaccaca

SEQ ID NO: 9473869 - DNA, 22 bp, Homo sapiens
cacaaggccctgggtcaccaca

SEQ ID NO: 9473870 - DNA, 22 bp, Homo sapiens
cacaaggccttgtagaccacgg

SEQ ID NO: 9473871 - DNA, 22 bp, Homo sapiens
agcagcagggcatgtcttactc

SEQ ID NO: 9473872 - DNA, 22 bp, Homo sapiens
agcagcagggcatgtcttactc

SEQ ID NO: 9473873 - DNA, 22 bp, Homo sapiens
agcagcagggacaaaggaacag

SEQ ID NO: 9473874 - DNA, 22 bp, Homo sapiens
agcagcagggacaaaggaacag

SEQ ID NO: 9473875 - DNA, 22 bp, Homo sapiens
agcagcagggacaaaggaacag

SEQ ID NO: 9473876 - DNA, 22 bp, Homo sapiens
agcagcaggcttaaggaaaagt

SEQ ID NO: 9473877 - DNA, 21 bp, Homo sapiens
agcagcagggaagcctcatcc

SEQ ID NO: 9473878 - DNA, 22 bp, Homo sapiens
agcagcaggcttaaggaaaagt

SEQ ID NO: 9473879 - DNA, 21 bp, Homo sapiens
agcagcagggaagcctcatcc

SEQ ID NO: 9473880 - DNA, 21 bp, Homo sapiens
agcagcagggaagcctcatcc

SEQ ID NO: 9473881 - DNA, 22 bp, Homo sapiens
agcagcagggtgatagtgccca

SEQ ID NO: 9473882 - DNA, 22 bp, Homo sapiens
agcagcagggtgatagtgccca

SEQ ID NO: 9473883 - DNA, 22 bp, Homo sapiens
agcagcagggtgatagtgccca

SEQ ID NO: 9473884 - DNA, 22 bp, Homo sapiens
agcagcagggtcattgctcttt

SEQ ID NO: 9473885 - DNA, 22 bp, Homo sapiens
agcagcagggtcattgctcttt

SEQ ID NO: 9473886 - DNA, 22 bp, Homo sapiens
cacaagacttatttgtgtagaa

SEQ ID NO: 9473887 - DNA, 20 bp, Homo sapiens
cacaagagaatacacactgg

SEQ ID NO: 9473888 - DNA, 22 bp, Homo sapiens
cacaagagagtgcgcgttgcaa

SEQ ID NO: 9473889 - DNA, 22 bp, Homo sapiens
cacaagaaataagctgcctttc

SEQ ID NO: 9473890 - DNA, 22 bp, Homo sapiens
cacaagaaataagctgcctttc

SEQ ID NO: 9473891 - DNA, 22 bp, Homo sapiens
cacccaggctggattgcagtgg

SEQ ID NO: 9473892 - DNA, 22 bp, Homo sapiens
caccctgtcagttgcaggatag

SEQ ID NO: 9473893 - DNA, 22 bp, Homo sapiens
caccctgtacaaatggacatct

SEQ ID NO: 9473894 - DNA, 22 bp, Homo sapiens
cacccaggctggagtgcattgg

SEQ ID NO: 9473895 - DNA, 22 bp, Homo sapiens
cacctactttgtgcagatttta

SEQ ID NO: 9473896 - DNA, 19 bp, Homo sapiens
cacctacttttggatttgc

SEQ ID NO: 9473897 - DNA, 22 bp, Homo sapiens
caccctttgctgctcttcctcc

SEQ ID NO: 9473898 - DNA, 22 bp, Homo sapiens
caccgcggagtgatggagaaac

SEQ ID NO: 9473899 - DNA, 22 bp, Homo sapiens
cacctagggcatccctgcccca

SEQ ID NO: 9473900 - DNA, 22 bp, Homo sapiens
cacctagcattcctcttcctca

SEQ ID NO: 9473901 - DNA, 22 bp, Homo sapiens
cacctagcagagcactactgca

SEQ ID NO: 9473902 - DNA, 22 bp, Homo sapiens
cacctagggtttcgcctttctt

SEQ ID NO: 9473903 - DNA, 22 bp, Homo sapiens
cacctctgctgtccacaggatg

SEQ ID NO: 9473904 - DNA, 22 bp, Homo sapiens
cacctctttgatttgaggcaag

SEQ ID NO: 9473905 - DNA, 22 bp, Homo sapiens
cacctctttgatttgaggcaag

SEQ ID NO: 9473906 - DNA, 22 bp, Homo sapiens
cacctctttgatttgaggcaag

SEQ ID NO: 9473907 - DNA, 22 bp, Homo sapiens
cacctcaggcagcaaagtctca

SEQ ID NO: 9473908 - DNA, 22 bp, Homo sapiens
cacctcatggataagataaact

SEQ ID NO: 9473909 - DNA, 22 bp, Homo sapiens
cacctcatggataagataaact

SEQ ID NO: 9473910 - DNA, 22 bp, Homo sapiens
cacctcaggcagcaaagtctca

SEQ ID NO: 9473911 - DNA, 22 bp, Homo sapiens
cacctcatggataagataaact

SEQ ID NO: 9473912 - DNA, 22 bp, Homo sapiens
cacctcatgtcatcagtaaaat

SEQ ID NO: 9473913 - DNA, 22 bp, Homo sapiens
cacctcatgtcatcagtaaaat

SEQ ID NO: 9473914 - DNA, 22 bp, Homo sapiens
cacctctgcctcaagcttccca

SEQ ID NO: 9473915 - DNA, 22 bp, Homo sapiens
cacctctcagctaggagtaagt

SEQ ID NO: 9473916 - DNA, 22 bp, Homo sapiens
cacctctcatttctacagattc

SEQ ID NO: 9473917 - DNA, 22 bp, Homo sapiens
cactgcagatcagaggctgaga

SEQ ID NO: 9473918 - DNA, 22 bp, Homo sapiens
cactgcctgtgagctgtgtgcc

SEQ ID NO: 9473919 - DNA, 22 bp, Homo sapiens
cactgcctgtgagctgtgtgcc

SEQ ID NO: 9473920 - DNA, 22 bp, Homo sapiens
cacctgaatggaactttgaacc

SEQ ID NO: 9473921 - DNA, 22 bp, Homo sapiens
cacctgagcactggggccgccc

SEQ ID NO: 9473922 - DNA, 22 bp, Homo sapiens
cacctgaagatttagagattga

SEQ ID NO: 9473923 - DNA, 22 bp, Homo sapiens
cacctctttgatttgaggcaag

SEQ ID NO: 9473924 - DNA, 22 bp, Homo sapiens
cactgcacttcagcctgggtga

SEQ ID NO: 9473925 - DNA, 22 bp, Homo sapiens
cactgcttctggaggaatttgg

SEQ ID NO: 9473926 - DNA, 22 bp, Homo sapiens
cactgcttgattgacatgcacg

SEQ ID NO: 9473927 - DNA, 22 bp, Homo sapiens
cactgcttggttgcaacattgc

SEQ ID NO: 9473928 - DNA, 22 bp, Homo sapiens
agcatacaccctaaactgctta

SEQ ID NO: 9473929 - DNA, 22 bp, Homo sapiens
agcatacaccctaaactgctta

SEQ ID NO: 9473930 - DNA, 22 bp, Homo sapiens
agcatacaaacatttgaggcag

SEQ ID NO: 9473931 - DNA, 22 bp, Homo sapiens
agcatacaggtctgaaacagct

SEQ ID NO: 9473932 - DNA, 22 bp, Homo sapiens
agcatacaggtctgaaacagct

SEQ ID NO: 9473933 - DNA, 22 bp, Homo sapiens
agcatacagttgaaagtggctt

SEQ ID NO: 9473934 - DNA, 22 bp, Homo sapiens
agcatacattggtatgtggttt

SEQ ID NO: 9473935 - DNA, 23 bp, Homo sapiens
cactgccttcagttgcttcacct

SEQ ID NO: 9473936 - DNA, 23 bp, Homo sapiens
cactgccttcagttgcttcacct

SEQ ID NO: 9473937 - DNA, 22 bp, Homo sapiens
cactgccttcacctgccctatc

SEQ ID NO: 9473938 - DNA, 22 bp, Homo sapiens
cactgccttcacctgccctatc

SEQ ID NO: 9473939 - DNA, 22 bp, Homo sapiens
cactgccttcacctgccctatc

SEQ ID NO: 9473940 - DNA, 22 bp, Homo sapiens
cactgctacctctgcctcccgg

SEQ ID NO: 9473941 - DNA, 23 bp, Homo sapiens
cactgccttcagttgcttcacct

SEQ ID NO: 9473942 - DNA, 22 bp, Homo sapiens
cactgcctttggtgggaacact

SEQ ID NO: 9473943 - DNA, 22 bp, Homo sapiens
cactgctacctctgcctcccgg

SEQ ID NO: 9473944 - DNA, 22 bp, Homo sapiens
cactgctacctctgcctcccgg

SEQ ID NO: 9473945 - DNA, 22 bp, Homo sapiens
cactgctacctctgcctcccgg

SEQ ID NO: 9473946 - DNA, 22 bp, Homo sapiens
cactgctattattagacaatgt

SEQ ID NO: 9473947 - DNA, 22 bp, Homo sapiens
cactgctatgatgatgatattt

SEQ ID NO: 9473948 - DNA, 22 bp, Homo sapiens
cactgctacctctgcctcccgg

SEQ ID NO: 9473949 - DNA, 22 bp, Homo sapiens
cactgcttagttggtaaatgtg

SEQ ID NO: 9473950 - DNA, 22 bp, Homo sapiens
cactgcttataaattctaggca

SEQ ID NO: 9473951 - DNA, 22 bp, Homo sapiens
cactgcttatgtctccttttca

SEQ ID NO: 9473952 - DNA, 22 bp, Homo sapiens
cactgctgatttcataggcagg

SEQ ID NO: 9473953 - DNA, 22 bp, Homo sapiens
cactgcttagatcttccttcaa

SEQ ID NO: 9473954 - DNA, 22 bp, Homo sapiens
cactgctgtttttaccacactg

SEQ ID NO: 9473955 - DNA, 22 bp, Homo sapiens
cactgctgtttttaccacactg

SEQ ID NO: 9473956 - DNA, 22 bp, Homo sapiens
cactgctcgctgcagcatggcc

SEQ ID NO: 9473957 - DNA, 22 bp, Homo sapiens
cactgctgatttcataggcagg

SEQ ID NO: 9473958 - DNA, 22 bp, Homo sapiens
cacccaggctggagagcagtgg

SEQ ID NO: 9473959 - DNA, 22 bp, Homo sapiens
caccaggtggaaatgtcacagc

SEQ ID NO: 9473960 - DNA, 22 bp, Homo sapiens
caccaggtggaaatgtcacagc

SEQ ID NO: 9473961 - DNA, 22 bp, Homo sapiens
cacccaggctggaatgcagtgg

SEQ ID NO: 9473962 - DNA, 22 bp, Homo sapiens
cacccaggctggagtgcagtga

SEQ ID NO: 9473963 - DNA, 22 bp, Homo sapiens
cacccaggctggagtgcagtga

SEQ ID NO: 9473964 - DNA, 22 bp, Homo sapiens
cacccaggctggagtgcagtgg

SEQ ID NO: 9473965 - DNA, 22 bp, Homo sapiens
cacccaggctggagtgcagtgg

SEQ ID NO: 9473966 - DNA, 22 bp, Homo sapiens
agcagggtgtggtggccctgga

SEQ ID NO: 9473967 - DNA, 22 bp, Homo sapiens
agcagggtcctgaggtgagtca

SEQ ID NO: 9473968 - DNA, 22 bp, Homo sapiens
agcagggtatgttagagctgta

SEQ ID NO: 9473969 - DNA, 22 bp, Homo sapiens
agcaggggtggaaggtagcttt

SEQ ID NO: 9473970 - DNA, 22 bp, Homo sapiens
agcaggggtggaaggtagcttt

SEQ ID NO: 9473971 - DNA, 22 bp, Homo sapiens
agcaggggtggaaggtagcttt

SEQ ID NO: 9473972 - DNA, 22 bp, Homo sapiens
agcaggggtggaaggtagcttt

SEQ ID NO: 9473973 - DNA, 22 bp, Homo sapiens
agcaggggtggaaggtagcttt

SEQ ID NO: 9473974 - DNA, 22 bp, Homo sapiens
agcaggggtctctgctaatgaa

SEQ ID NO: 9473975 - DNA, 22 bp, Homo sapiens
agcaggggtctctgctaatgaa

SEQ ID NO: 9473976 - DNA, 22 bp, Homo sapiens
agcaggggtctctgctaatgaa

SEQ ID NO: 9473977 - DNA, 22 bp, Homo sapiens
agcaggggtctctgctaatgaa

SEQ ID NO: 9473978 - DNA, 22 bp, Homo sapiens
agcaggggtctctgctaatgaa

SEQ ID NO: 9473979 - DNA, 22 bp, Homo sapiens
agcaggggtaacagaaggaaag

SEQ ID NO: 9473980 - DNA, 22 bp, Homo sapiens
agcaggggtaacagaaggaaag

SEQ ID NO: 9473981 - DNA, 22 bp, Homo sapiens
agcagggggccacagtcacagc

SEQ ID NO: 9473982 - DNA, 22 bp, Homo sapiens
agcagggggccacagtcacagc

SEQ ID NO: 9473983 - DNA, 22 bp, Homo sapiens
agcagggggccacagtcacagc

SEQ ID NO: 9473984 - DNA, 22 bp, Homo sapiens
agcagggggccacagtcacagc

SEQ ID NO: 9473985 - DNA, 22 bp, Homo sapiens
agcagggggagttagactagat

SEQ ID NO: 9473986 - DNA, 22 bp, Homo sapiens
agcagggggagttagactagat

SEQ ID NO: 9473987 - DNA, 22 bp, Homo sapiens
agcagggggagttagactagat

SEQ ID NO: 9473988 - DNA, 22 bp, Homo sapiens
agcagggggcatccttgccctt

SEQ ID NO: 9473989 - DNA, 22 bp, Homo sapiens
agcagggggcatccttgccctt

SEQ ID NO: 9473990 - DNA, 22 bp, Homo sapiens
agcagggggcatccttgccctt

SEQ ID NO: 9473991 - DNA, 22 bp, Homo sapiens
agcagggggagttagactagat

SEQ ID NO: 9473992 - DNA, 22 bp, Homo sapiens
agcagggggagttagactagat

SEQ ID NO: 9473993 - DNA, 22 bp, Homo sapiens
agcaggggcagggttttgtgct

SEQ ID NO: 9473994 - DNA, 22 bp, Homo sapiens
agcaggggcagggttttgtgct

SEQ ID NO: 9473995 - DNA, 22 bp, Homo sapiens
agcaggggctcctccacagcca

SEQ ID NO: 9473996 - DNA, 22 bp, Homo sapiens
agcaggggcagggttttgtgct

SEQ ID NO: 9473997 - DNA, 22 bp, Homo sapiens
agcaggggctcctccacagcca

SEQ ID NO: 9473998 - DNA, 22 bp, Homo sapiens
agcaggggctcctccacagcca

SEQ ID NO: 9473999 - DNA, 22 bp, Homo sapiens
agcaggggctcctccacagcca

SEQ ID NO: 9474000 - DNA, 22 bp, Homo sapiens
agcaggggctcctccacagcca

SEQ ID NO: 9474001 - DNA, 22 bp, Homo sapiens
agcagggctggggcacgagcca

SEQ ID NO: 9474002 - DNA, 22 bp, Homo sapiens
agcagggctggggcacgagcca

SEQ ID NO: 9474003 - DNA, 22 bp, Homo sapiens
agcaggctgccttccaaagcct

SEQ ID NO: 9474004 - DNA, 23 bp, Homo sapiens
agcaggctgcttctccacagctg

SEQ ID NO: 9474005 - DNA, 22 bp, Homo sapiens
agcaggagtgtcccctggctgt

SEQ ID NO: 9474006 - DNA, 22 bp, Homo sapiens
agcaggagcccttatcaccagg

SEQ ID NO: 9474007 - DNA, 22 bp, Homo sapiens
agcaggagcatttccatgattc

SEQ ID NO: 9474008 - DNA, 22 bp, Homo sapiens
agcaggagtgtcccctggctgt

SEQ ID NO: 9474009 - DNA, 22 bp, Homo sapiens
agcaggagtgtcccctggctgt

SEQ ID NO: 9474010 - DNA, 22 bp, Homo sapiens
agcaggagtgtcccctggctgt

SEQ ID NO: 9474011 - DNA, 22 bp, Homo sapiens
cacacactgttaatgtaggagt

SEQ ID NO: 9474012 - DNA, 22 bp, Homo sapiens
agcaggagcatttccatgattc

SEQ ID NO: 9474013 - DNA, 22 bp, Homo sapiens
cacacacagttttgtattctgt

SEQ ID NO: 9474014 - DNA, 22 bp, Homo sapiens
cacacacagttttgtattctgt

SEQ ID NO: 9474015 - DNA, 22 bp, Homo sapiens
cacacacagttttgtattctgt

SEQ ID NO: 9474016 - DNA, 21 bp, Homo sapiens
agcaggcaaaggtgaagtctt

SEQ ID NO: 9474017 - DNA, 21 bp, Homo sapiens
agcaggcaaaggtgaagtctt

SEQ ID NO: 9474018 - DNA, 22 bp, Homo sapiens
agcaggagtttgatgcttttat

SEQ ID NO: 9474019 - DNA, 22 bp, Homo sapiens
agcaggcacgctccctgcgcga

SEQ ID NO: 9474020 - DNA, 17 bp, Homo sapiens
agcaggcacgtcagcac

SEQ ID NO: 9474021 - DNA, 22 bp, Homo sapiens
agcaggcacaagaaagggaggt

SEQ ID NO: 9474022 - DNA, 22 bp, Homo sapiens
agcaggcacaagaaagggaggt

SEQ ID NO: 9474023 - DNA, 22 bp, Homo sapiens
agcaggcaccagggctcgtcct

SEQ ID NO: 9474024 - DNA, 22 bp, Homo sapiens
agcaggcacaagaaagggaggt

SEQ ID NO: 9474025 - DNA, 22 bp, Homo sapiens
agcaggcacaagaaagggaggt

SEQ ID NO: 9474026 - DNA, 22 bp, Homo sapiens
cacacacagttttgtattctgt

SEQ ID NO: 9474027 - DNA, 22 bp, Homo sapiens
cacacaaatattctggaggcaa

SEQ ID NO: 9474028 - DNA, 22 bp, Homo sapiens
cacacaaatattctggaggcaa

SEQ ID NO: 9474029 - DNA, 22 bp, Homo sapiens
cacacaaatattctggaggcaa

SEQ ID NO: 9474030 - DNA, 22 bp, Homo sapiens
agcagctgccactggaatagga

SEQ ID NO: 9474031 - DNA, 21 bp, Homo sapiens
agcagctgcagtttctatctg

SEQ ID NO: 9474032 - DNA, 22 bp, Homo sapiens
agcagctgccagagagagttcc

SEQ ID NO: 9474033 - DNA, 22 bp, Homo sapiens
agcagctgccactggaatagga

SEQ ID NO: 9474034 - DNA, 22 bp, Homo sapiens
agcagctgccactggaatagga

SEQ ID NO: 9474035 - DNA, 22 bp, Homo sapiens
agcagctgccagagagagttcc

SEQ ID NO: 9474036 - DNA, 22 bp, Homo sapiens
agcagctgccagagagagttcc

SEQ ID NO: 9474037 - DNA, 22 bp, Homo sapiens
agcagctgctccacttgcttaa

SEQ ID NO: 9474038 - DNA, 22 bp, Homo sapiens
agcagctgccagagagagttcc

SEQ ID NO: 9474039 - DNA, 22 bp, Homo sapiens
agcagctgatcaaagcacttat

SEQ ID NO: 9474040 - DNA, 22 bp, Homo sapiens
agcagctgatcaaagcacttat

SEQ ID NO: 9474041 - DNA, 22 bp, Homo sapiens
agcagctgatcaaagcacttat

SEQ ID NO: 9474042 - DNA, 22 bp, Homo sapiens
agcagctgagccccagctgtga

SEQ ID NO: 9474043 - DNA, 22 bp, Homo sapiens
agcagctgatggggaaggagtt

SEQ ID NO: 9474044 - DNA, 22 bp, Homo sapiens
agcagctgatggggaaggagtt

SEQ ID NO: 9474045 - DNA, 22 bp, Homo sapiens
agcagctgatggggaaggagtt

SEQ ID NO: 9474046 - DNA, 22 bp, Homo sapiens
agcagctgatggggaaggagtt

SEQ ID NO: 9474047 - DNA, 22 bp, Homo sapiens
agcagctgatggggaaggagtt

SEQ ID NO: 9474048 - DNA, 22 bp, Homo sapiens
agcagctgcagagggctccccc

SEQ ID NO: 9474049 - DNA, 22 bp, Homo sapiens
agcagctgcagagggctccccc

SEQ ID NO: 9474050 - DNA, 22 bp, Homo sapiens
agcagctgcagagggctccccc

SEQ ID NO: 9474051 - DNA, 22 bp, Homo sapiens
agcagctgcagggagggtctgc

SEQ ID NO: 9474052 - DNA, 22 bp, Homo sapiens
agcagctgcagggagggtctgc

SEQ ID NO: 9474053 - DNA, 22 bp, Homo sapiens
agcagctgcagggagggtctgc

SEQ ID NO: 9474054 - DNA, 21 bp, Homo sapiens
agcagctgcagtttctatctg

SEQ ID NO: 9474055 - DNA, 22 bp, Homo sapiens
agcagctgcagggagggtctgc

SEQ ID NO: 9474056 - DNA, 22 bp, Homo sapiens
agcaggctccaggctggccatc

SEQ ID NO: 9474057 - DNA, 22 bp, Homo sapiens
agcaggctccttccttctctgg

SEQ ID NO: 9474058 - DNA, 22 bp, Homo sapiens
agcaggctgagcacccaggggg

SEQ ID NO: 9474059 - DNA, 22 bp, Homo sapiens
agcaggctgagcacccaggggg

SEQ ID NO: 9474060 - DNA, 22 bp, Homo sapiens
agcaggctccttccttctctgg

SEQ ID NO: 9474061 - DNA, 17 bp, Homo sapiens
agcaggctgcagaggcc

SEQ ID NO: 9474062 - DNA, 17 bp, Homo sapiens
agcaggctgcagaggcc

SEQ ID NO: 9474063 - DNA, 20 bp, Homo sapiens
agcaggctgcagggtgaaat

SEQ ID NO: 9474064 - DNA, 20 bp, Homo sapiens
agcaggctgcagggtgaaat

SEQ ID NO: 9474065 - DNA, 22 bp, Homo sapiens
agcaggctgatgggcatgcttg

SEQ ID NO: 9474066 - DNA, 22 bp, Homo sapiens
agcaggctgatgggcatgcttg

SEQ ID NO: 9474067 - DNA, 22 bp, Homo sapiens
agcaggctgatgggcatgcttg

SEQ ID NO: 9474068 - DNA, 22 bp, Homo sapiens
cacagtttctgaacactttgca

SEQ ID NO: 9474069 - DNA, 22 bp, Homo sapiens
cacagtttggtatagaagtgat

SEQ ID NO: 9474070 - DNA, 22 bp, Homo sapiens
cacagtttcaataattattctt

SEQ ID NO: 9474071 - DNA, 22 bp, Homo sapiens
agcaggcaggaaggcagcactg

SEQ ID NO: 9474072 - DNA, 22 bp, Homo sapiens
agcaggcaggaaggcagcactg

SEQ ID NO: 9474073 - DNA, 22 bp, Homo sapiens
agcaggcaggaaggcagcactg

SEQ ID NO: 9474074 - DNA, 22 bp, Homo sapiens
agcaggcagctgggggagttga

SEQ ID NO: 9474075 - DNA, 22 bp, Homo sapiens
agcaggcagcctaggaagtgaa

SEQ ID NO: 9474076 - DNA, 22 bp, Homo sapiens
agcaggcagcctaggaagtgaa

SEQ ID NO: 9474077 - DNA, 22 bp, Homo sapiens
agcaggcactatgccaggatct

SEQ ID NO: 9474078 - DNA, 22 bp, Homo sapiens
agcaggcactatgccaggatct

SEQ ID NO: 9474079 - DNA, 22 bp, Homo sapiens
agcaggcactatgccaggatct

SEQ ID NO: 9474080 - DNA, 22 bp, Homo sapiens
agcaggcactatgccaggatct

SEQ ID NO: 9474081 - DNA, 22 bp, Homo sapiens
agcaggcacttcatagggttcc

SEQ ID NO: 9474082 - DNA, 22 bp, Homo sapiens
agcaggcagccatttggaaggc

SEQ ID NO: 9474083 - DNA, 22 bp, Homo sapiens
agcaggcagccatttggaaggc

SEQ ID NO: 9474084 - DNA, 22 bp, Homo sapiens
agcaggcaggaggctactaagg

SEQ ID NO: 9474085 - DNA, 22 bp, Homo sapiens
cacagtcccgtgcttaccatgt

SEQ ID NO: 9474086 - DNA, 22 bp, Homo sapiens
cacagtcccgtgcttaccatgt

SEQ ID NO: 9474087 - DNA, 22 bp, Homo sapiens
cacagtcctacagagatcagag

SEQ ID NO: 9474088 - DNA, 22 bp, Homo sapiens
agcaggcaggaatggtggaaca

SEQ ID NO: 9474089 - DNA, 22 bp, Homo sapiens
agcaggcaggaaggcagcactg

SEQ ID NO: 9474090 - DNA, 22 bp, Homo sapiens
cacagtcctgccagagggcctt

SEQ ID NO: 9474091 - DNA, 19 bp, Homo sapiens
cacagtcctatgtttatca

SEQ ID NO: 9474092 - DNA, 22 bp, Homo sapiens
cacagtgttccagagcagtggt

SEQ ID NO: 9474093 - DNA, 22 bp, Homo sapiens
cacagtgttccagagcagtggt

SEQ ID NO: 9474094 - DNA, 22 bp, Homo sapiens
attattcaacacttgagaaatt

SEQ ID NO: 9474095 - DNA, 22 bp, Homo sapiens
attattcaaattcccactatac

SEQ ID NO: 9474096 - DNA, 23 bp, Homo sapiens
agaggcactaattattcagagat

SEQ ID NO: 9474097 - DNA, 22 bp, Homo sapiens
attattcaacacttgagaaatt

SEQ ID NO: 9474098 - DNA, 22 bp, Homo sapiens
agaggcactcgggagtctgtgg

SEQ ID NO: 9474099 - DNA, 22 bp, Homo sapiens
agaggcactccagccactggtc

SEQ ID NO: 9474100 - DNA, 22 bp, Homo sapiens
agaggcactccagccactggtc

SEQ ID NO: 9474101 - DNA, 22 bp, Homo sapiens
agaggcactcgggagtctgtgg

SEQ ID NO: 9474102 - DNA, 22 bp, Homo sapiens
attattattgttgatgttaggg

SEQ ID NO: 9474103 - DNA, 21 bp, Homo sapiens
attattatttctgtgtccagc

SEQ ID NO: 9474104 - DNA, 22 bp, Homo sapiens
attattattgttgatgttaggg

SEQ ID NO: 9474105 - DNA, 22 bp, Homo sapiens
attattattgttgatgttaggg

SEQ ID NO: 9474106 - DNA, 22 bp, Homo sapiens
attattatggttgctcttttcc

SEQ ID NO: 9474107 - DNA, 23 bp, Homo sapiens
attattaaggacatggactttgt

SEQ ID NO: 9474108 - DNA, 23 bp, Homo sapiens
attattaaggacatggactttgt

SEQ ID NO: 9474109 - DNA, 23 bp, Homo sapiens
attattaaggacatggactttgt

SEQ ID NO: 9474110 - DNA, 22 bp, Homo sapiens
attattaaagcttaggtcttat

SEQ ID NO: 9474111 - DNA, 23 bp, Homo sapiens
attattaaggacatggactttgt

SEQ ID NO: 9474112 - DNA, 22 bp, Homo sapiens
attattaaagcttaggtcttat

SEQ ID NO: 9474113 - DNA, 22 bp, Homo sapiens
attattaaagcttaggtcttat

SEQ ID NO: 9474114 - DNA, 22 bp, Homo sapiens
attattataaagtgcatgacct

SEQ ID NO: 9474115 - DNA, 21 bp, Homo sapiens
attattataaagaccacaggg

SEQ ID NO: 9474116 - DNA, 22 bp, Homo sapiens
agaggaggccaggcccacacct

SEQ ID NO: 9474117 - DNA, 22 bp, Homo sapiens
agaggaggctctgggatcgtcc

SEQ ID NO: 9474118 - DNA, 22 bp, Homo sapiens
agaggaggcagcttaactcagt

SEQ ID NO: 9474119 - DNA, 22 bp, Homo sapiens
agaggaggatttgtaaaggtct

SEQ ID NO: 9474120 - DNA, 22 bp, Homo sapiens
agaggaggatttgtaaaggtct

SEQ ID NO: 9474121 - DNA, 22 bp, Homo sapiens
agaggaggctgggtccagataa

SEQ ID NO: 9474122 - DNA, 22 bp, Homo sapiens
agaggaggctgggtccagataa

SEQ ID NO: 9474123 - DNA, 22 bp, Homo sapiens
attataggcttgagccaccgtg

SEQ ID NO: 9474124 - DNA, 22 bp, Homo sapiens
agaggaggctctgggatcgtcc

SEQ ID NO: 9474125 - DNA, 22 bp, Homo sapiens
agaggaggctctgggatcgtcc

SEQ ID NO: 9474126 - DNA, 22 bp, Homo sapiens
agaggaggatttgtaaaggtct

SEQ ID NO: 9474127 - DNA, 22 bp, Homo sapiens
agaggaggaagagctttaaaat

SEQ ID NO: 9474128 - DNA, 22 bp, Homo sapiens
agaggacaggttttccatgggc

SEQ ID NO: 9474129 - DNA, 22 bp, Homo sapiens
agaggacaggttttccatgggc

SEQ ID NO: 9474130 - DNA, 22 bp, Homo sapiens
agaggacaggttttccatgggc

SEQ ID NO: 9474131 - DNA, 22 bp, Homo sapiens
agaggacaggttttccatgggc

SEQ ID NO: 9474132 - DNA, 22 bp, Homo sapiens
agaggacaggttttccatgggc

SEQ ID NO: 9474133 - DNA, 22 bp, Homo sapiens
agaggagctgggaggccctcgt

SEQ ID NO: 9474134 - DNA, 22 bp, Homo sapiens
agagctggtgcatattcagaaa

SEQ ID NO: 9474135 - DNA, 22 bp, Homo sapiens
agagctggtttactcaggaatt

SEQ ID NO: 9474136 - DNA, 22 bp, Homo sapiens
agagctgggacttggactcaat

SEQ ID NO: 9474137 - DNA, 21 bp, Homo sapiens
agagctggtaggtaggtaggt

SEQ ID NO: 9474138 - DNA, 22 bp, Homo sapiens
atgtgtacactggacttctgat

SEQ ID NO: 9474139 - DNA, 22 bp, Homo sapiens
atgtgtacactggacttctgat

SEQ ID NO: 9474140 - DNA, 21 bp, Homo sapiens
agagctgggacttgcctgaga

SEQ ID NO: 9474141 - DNA, 21 bp, Homo sapiens
agagctgggacttgcctgaga

SEQ ID NO: 9474142 - DNA, 22 bp, Homo sapiens
agagctgtcacatagagccaga

SEQ ID NO: 9474143 - DNA, 22 bp, Homo sapiens
agagctggtttactcaggaatt

SEQ ID NO: 9474144 - DNA, 22 bp, Homo sapiens
agagctgtgaaaatgaggtttg

SEQ ID NO: 9474145 - DNA, 22 bp, Homo sapiens
agagctgtttattgatgtcaca

SEQ ID NO: 9474146 - DNA, 22 bp, Homo sapiens
agagctgtgttaagaacaggcc

SEQ ID NO: 9474147 - DNA, 22 bp, Homo sapiens
agagctgtgtcctgtgcactag

SEQ ID NO: 9474148 - DNA, 22 bp, Homo sapiens
agagctgtgtcctgtgcactag

SEQ ID NO: 9474149 - DNA, 22 bp, Homo sapiens
agagctgttcaacgtagcaatg

SEQ ID NO: 9474150 - DNA, 22 bp, Homo sapiens
atgtttactggtttatagaata

SEQ ID NO: 9474151 - DNA, 22 bp, Homo sapiens
atgtttagtcattcagctcctt

SEQ ID NO: 9474152 - DNA, 22 bp, Homo sapiens
atgtttatgacctccataagga

SEQ ID NO: 9474153 - DNA, 22 bp, Homo sapiens
atgtttatgcaaacatgtgagt

SEQ ID NO: 9474154 - DNA, 22 bp, Homo sapiens
atgtttatgcaaacatgtgagt

SEQ ID NO: 9474155 - DNA, 22 bp, Homo sapiens
atgtttatgcaaacatgtgagt

SEQ ID NO: 9474156 - DNA, 22 bp, Homo sapiens
atgtttatgcaaacatgtgagt

SEQ ID NO: 9474157 - DNA, 22 bp, Homo sapiens
atgtttacaaaaaggaggcttg

SEQ ID NO: 9474158 - DNA, 22 bp, Homo sapiens
atgtttacaattcagtattaca

SEQ ID NO: 9474159 - DNA, 22 bp, Homo sapiens
atgtttacaattcagtattaca

SEQ ID NO: 9474160 - DNA, 22 bp, Homo sapiens
atgtttactgaaaagatttcaa

SEQ ID NO: 9474161 - DNA, 22 bp, Homo sapiens
atgtttacagaggaagtgcctc

SEQ ID NO: 9474162 - DNA, 21 bp, Homo sapiens
atgtttacactgactactgtg

SEQ ID NO: 9474163 - DNA, 19 bp, Homo sapiens
atgtttacactcaggggct

SEQ ID NO: 9474164 - DNA, 22 bp, Homo sapiens
agaggacagacggaaagtgcca

SEQ ID NO: 9474165 - DNA, 22 bp, Homo sapiens
agaggacagcccccttgtctgg

SEQ ID NO: 9474166 - DNA, 22 bp, Homo sapiens
agaggacagagtgctggattta

SEQ ID NO: 9474167 - DNA, 22 bp, Homo sapiens
atgtttatggagcaggtattag

SEQ ID NO: 9474168 - DNA, 22 bp, Homo sapiens
agaggacaaaatgagaagtgct

SEQ ID NO: 9474169 - DNA, 22 bp, Homo sapiens
agaggaagctgagatgcctctt

SEQ ID NO: 9474170 - DNA, 21 bp, Homo sapiens
agagggagagtggcccttcca

SEQ ID NO: 9474171 - DNA, 22 bp, Homo sapiens
attccagacaggtaaattaggt

SEQ ID NO: 9474172 - DNA, 22 bp, Homo sapiens
attccagacaggtaaattaggt

SEQ ID NO: 9474173 - DNA, 22 bp, Homo sapiens
attccagagaggttctggaggt

SEQ ID NO: 9474174 - DNA, 21 bp, Homo sapiens
agagggagagtggcccttcca

SEQ ID NO: 9474175 - DNA, 21 bp, Homo sapiens
agagggagagtggcccttcca

SEQ ID NO: 9474176 - DNA, 22 bp, Homo sapiens
agagggagaagctaaaataact

SEQ ID NO: 9474177 - DNA, 22 bp, Homo sapiens
agagggagaaaagaatcagttg

SEQ ID NO: 9474178 - DNA, 22 bp, Homo sapiens
agagggagaagctaaaataact

SEQ ID NO: 9474179 - DNA, 22 bp, Homo sapiens
agagggagaagctaaaataact

SEQ ID NO: 9474180 - DNA, 22 bp, Homo sapiens
agagggagaaaagaatcagttg

SEQ ID NO: 9474181 - DNA, 22 bp, Homo sapiens
agagggagaaaagaatcagttg

SEQ ID NO: 9474182 - DNA, 22 bp, Homo sapiens
agagggagaaaagaatcagttg

SEQ ID NO: 9474183 - DNA, 22 bp, Homo sapiens
agagggagaaaagaatcagttg

SEQ ID NO: 9474184 - DNA, 22 bp, Homo sapiens
agagggaaaaactcatgtcatt

SEQ ID NO: 9474185 - DNA, 22 bp, Homo sapiens
agagggaaaaactcatgtcatt

SEQ ID NO: 9474186 - DNA, 18 bp, Homo sapiens
agagggaaagcaggctga

SEQ ID NO: 9474187 - DNA, 18 bp, Homo sapiens
agagggaaagcaggctga

SEQ ID NO: 9474188 - DNA, 17 bp, Homo sapiens
agagggaaaatgcggtt

SEQ ID NO: 9474189 - DNA, 22 bp, Homo sapiens
agagggaaatccaggagtgctt

SEQ ID NO: 9474190 - DNA, 22 bp, Homo sapiens
agagggaaatccaggagtgctt

SEQ ID NO: 9474191 - DNA, 18 bp, Homo sapiens
agagggaaagcaggctga

SEQ ID NO: 9474192 - DNA, 18 bp, Homo sapiens
agagggaaagcaggctga

SEQ ID NO: 9474193 - DNA, 18 bp, Homo sapiens
agagggaatcagttggat

SEQ ID NO: 9474194 - DNA, 22 bp, Homo sapiens
attccaggaagtgtgggaccaa

SEQ ID NO: 9474195 - DNA, 22 bp, Homo sapiens
attccaggactaaaggaacagc

SEQ ID NO: 9474196 - DNA, 22 bp, Homo sapiens
attccaggcaaagcagagaaga

SEQ ID NO: 9474197 - DNA, 22 bp, Homo sapiens
attccaggattccaggacaaat

SEQ ID NO: 9474198 - DNA, 22 bp, Homo sapiens
attccaggattccaggacaaat

SEQ ID NO: 9474199 - DNA, 22 bp, Homo sapiens
attccattgtatgtgtagacta

SEQ ID NO: 9474200 - DNA, 22 bp, Homo sapiens
attccattgtatgtgtagacta

SEQ ID NO: 9474201 - DNA, 22 bp, Homo sapiens
attccagtgtgcttccttgcta

SEQ ID NO: 9474202 - DNA, 22 bp, Homo sapiens
attccagtgtcatgctctcagg

SEQ ID NO: 9474203 - DNA, 22 bp, Homo sapiens
attccagttagtggcagcttat

SEQ ID NO: 9474204 - DNA, 22 bp, Homo sapiens
attccagttagtggcagcttat

SEQ ID NO: 9474205 - DNA, 22 bp, Homo sapiens
attccaggttgtagaaaagttt

SEQ ID NO: 9474206 - DNA, 22 bp, Homo sapiens
attccaggcatgcaggaacaag

SEQ ID NO: 9474207 - DNA, 22 bp, Homo sapiens
attgcagtgttgcctggggcct

SEQ ID NO: 9474208 - DNA, 22 bp, Homo sapiens
attgcagtgtgtgttccatgag

SEQ ID NO: 9474209 - DNA, 20 bp, Homo sapiens
attgcagttggacctgtctc

SEQ ID NO: 9474210 - DNA, 22 bp, Homo sapiens
attgcatatgcagcacatcagg

SEQ ID NO: 9474211 - DNA, 22 bp, Homo sapiens
attgcattcattgacatatgag

SEQ ID NO: 9474212 - DNA, 22 bp, Homo sapiens
attgcagtgtgtgttccatgag

SEQ ID NO: 9474213 - DNA, 22 bp, Homo sapiens
attgcagtgatggttgcataat

SEQ ID NO: 9474214 - DNA, 22 bp, Homo sapiens
attgagtagtaggaaaataact

SEQ ID NO: 9474215 - DNA, 22 bp, Homo sapiens
attgataaattgcaatggggct

SEQ ID NO: 9474216 - DNA, 22 bp, Homo sapiens
attccattgtatgtgtagacta

SEQ ID NO: 9474217 - DNA, 22 bp, Homo sapiens
agaggctcagaggcctggtcct

SEQ ID NO: 9474218 - DNA, 22 bp, Homo sapiens
agaggctcagaggcctggtcct

SEQ ID NO: 9474219 - DNA, 22 bp, Homo sapiens
agaggctccaccttctctgtcc

SEQ ID NO: 9474220 - DNA, 22 bp, Homo sapiens
agaggctccaccttctctgtcc

SEQ ID NO: 9474221 - DNA, 22 bp, Homo sapiens
agaggcggaggttgcagtgagc

SEQ ID NO: 9474222 - DNA, 22 bp, Homo sapiens
agaggcggagcttgcagtgagc

SEQ ID NO: 9474223 - DNA, 22 bp, Homo sapiens
attcatttgctattgtgtatgg

SEQ ID NO: 9474224 - DNA, 22 bp, Homo sapiens
attcatttgctattgtgtatgg

SEQ ID NO: 9474225 - DNA, 22 bp, Homo sapiens
attcatttgctattgtgtatgg

SEQ ID NO: 9474226 - DNA, 22 bp, Homo sapiens
attcatttgctattgtgtatgg

SEQ ID NO: 9474227 - DNA, 22 bp, Homo sapiens
agaggcctgtgtgctccagtgg

SEQ ID NO: 9474228 - DNA, 22 bp, Homo sapiens
agaggcctgtgtgctccagtgg

SEQ ID NO: 9474229 - DNA, 22 bp, Homo sapiens
agaggcctgtgtgctccagtgg

SEQ ID NO: 9474230 - DNA, 22 bp, Homo sapiens
attcatttaggtattcacttac

SEQ ID NO: 9474231 - DNA, 22 bp, Homo sapiens
attcatttaggtattcacttac

SEQ ID NO: 9474232 - DNA, 22 bp, Homo sapiens
attcatttaggtattcacttac

SEQ ID NO: 9474233 - DNA, 22 bp, Homo sapiens
attcatttagagggattaagca

SEQ ID NO: 9474234 - DNA, 22 bp, Homo sapiens
attcatttagagggattaagca

SEQ ID NO: 9474235 - DNA, 22 bp, Homo sapiens
attcatttagagggattaagca

SEQ ID NO: 9474236 - DNA, 22 bp, Homo sapiens
attcatttagagggattaagca

SEQ ID NO: 9474237 - DNA, 22 bp, Homo sapiens
attcatttagagggattaagca

SEQ ID NO: 9474238 - DNA, 22 bp, Homo sapiens
agaggcaggaagagctgatttt

SEQ ID NO: 9474239 - DNA, 22 bp, Homo sapiens
agaggcaggaagagctgatttt

SEQ ID NO: 9474240 - DNA, 22 bp, Homo sapiens
attcattagccactaactagca

SEQ ID NO: 9474241 - DNA, 22 bp, Homo sapiens
attcattctgacctcaagagaa

SEQ ID NO: 9474242 - DNA, 22 bp, Homo sapiens
attcattcttggtatgaacagc

SEQ ID NO: 9474243 - DNA, 22 bp, Homo sapiens
attcattccaggtcagtcagac

SEQ ID NO: 9474244 - DNA, 22 bp, Homo sapiens
attcattcttggtatgaacagc

SEQ ID NO: 9474245 - DNA, 20 bp, Homo sapiens
attcatgtctttataaaagc

SEQ ID NO: 9474246 - DNA, 18 bp, Homo sapiens
attcaggggctgaatgtg

SEQ ID NO: 9474247 - DNA, 22 bp, Homo sapiens
atttcacaaagaacagatgcag

SEQ ID NO: 9474248 - DNA, 22 bp, Homo sapiens
atttcacaaagaacagatgcag

SEQ ID NO: 9474249 - DNA, 22 bp, Homo sapiens
atttcacagcgtggttgactgc

SEQ ID NO: 9474250 - DNA, 22 bp, Homo sapiens
atttcacagctgctgttcaggt

SEQ ID NO: 9474251 - DNA, 22 bp, Homo sapiens
atttattgaagcttattacgtt

SEQ ID NO: 9474252 - DNA, 22 bp, Homo sapiens
atttattgaagcttattacgtt

SEQ ID NO: 9474253 - DNA, 22 bp, Homo sapiens
agataaaatggttcaaaggcta

SEQ ID NO: 9474254 - DNA, 22 bp, Homo sapiens
agataaaatggttcaaaggcta

SEQ ID NO: 9474255 - DNA, 22 bp, Homo sapiens
agataaaatggttcaaaggcta

SEQ ID NO: 9474256 - DNA, 22 bp, Homo sapiens
agataaattcctaagatttcag

SEQ ID NO: 9474257 - DNA, 22 bp, Homo sapiens
agagtttgtgggcttttcctcc

SEQ ID NO: 9474258 - DNA, 22 bp, Homo sapiens
agagtttgtgtcctttatcagg

SEQ ID NO: 9474259 - DNA, 22 bp, Homo sapiens
agagtttgtgtcctttatcagg

SEQ ID NO: 9474260 - DNA, 17 bp, Homo sapiens
agagttttaagaaattt

SEQ ID NO: 9474261 - DNA, 23 bp, Homo sapiens
agagtttgtttctaatgagtgag

SEQ ID NO: 9474262 - DNA, 22 bp, Homo sapiens
agagtttgttgaatttacttgg

SEQ ID NO: 9474263 - DNA, 22 bp, Homo sapiens
agataaaatgattttctggatc

SEQ ID NO: 9474264 - DNA, 22 bp, Homo sapiens
agataaaatgattttctggatc

SEQ ID NO: 9474265 - DNA, 22 bp, Homo sapiens
agataaaatggttcaaaggcta

SEQ ID NO: 9474266 - DNA, 22 bp, Homo sapiens
agagtttggtgaagcaatttga

SEQ ID NO: 9474267 - DNA, 22 bp, Homo sapiens
agagtttgtatttttcagtgaa

SEQ ID NO: 9474268 - DNA, 20 bp, Homo sapiens
agagtttggggtcattttgg

SEQ ID NO: 9474269 - DNA, 22 bp, Homo sapiens
agatacatatagaaaacatcaa

SEQ ID NO: 9474270 - DNA, 22 bp, Homo sapiens
agatacatcatttataccttca

SEQ ID NO: 9474271 - DNA, 22 bp, Homo sapiens
agatacatatagaaaacatcaa

SEQ ID NO: 9474272 - DNA, 22 bp, Homo sapiens
agatacatcttgaacttctaga

SEQ ID NO: 9474273 - DNA, 22 bp, Homo sapiens
agatacatcttgaacttctaga

SEQ ID NO: 9474274 - DNA, 22 bp, Homo sapiens
agatacatcttgaacttctaga

SEQ ID NO: 9474275 - DNA, 22 bp, Homo sapiens
agatacatcatttataccttca

SEQ ID NO: 9474276 - DNA, 22 bp, Homo sapiens
agatacattgagtttcctcctg

SEQ ID NO: 9474277 - DNA, 22 bp, Homo sapiens
agatacatgtcaagagacttat

SEQ ID NO: 9474278 - DNA, 22 bp, Homo sapiens
agatacatggaacgtcaaacct

SEQ ID NO: 9474279 - DNA, 22 bp, Homo sapiens
agatacattagtagttacttgt

SEQ ID NO: 9474280 - DNA, 22 bp, Homo sapiens
agatacatgtcaagagacttat

SEQ ID NO: 9474281 - DNA, 22 bp, Homo sapiens
agatacatagctgtgagcacac

SEQ ID NO: 9474282 - DNA, 22 bp, Homo sapiens
agatacatagctgtgagcacac

SEQ ID NO: 9474283 - DNA, 22 bp, Homo sapiens
agatacatatagaaaacatcaa

SEQ ID NO: 9474284 - DNA, 22 bp, Homo sapiens
agatacatatagaaaacatcaa

SEQ ID NO: 9474285 - DNA, 22 bp, Homo sapiens
agatacatagctgtgagcacac

SEQ ID NO: 9474286 - DNA, 17 bp, Homo sapiens
atttcacttagcatgag

SEQ ID NO: 9474287 - DNA, 22 bp, Homo sapiens
atttcacttagtgtaatgtctt

SEQ ID NO: 9474288 - DNA, 22 bp, Homo sapiens
atttcacattaatttgatgctc

SEQ ID NO: 9474289 - DNA, 22 bp, Homo sapiens
atttcacattaatttgatgctc

SEQ ID NO: 9474290 - DNA, 22 bp, Homo sapiens
atttcacagctgtcagtgttac

SEQ ID NO: 9474291 - DNA, 22 bp, Homo sapiens
atttcacagctgtcagtgttac

SEQ ID NO: 9474292 - DNA, 22 bp, Homo sapiens
atttcacatctatctcagattt

SEQ ID NO: 9474293 - DNA, 22 bp, Homo sapiens
agaggtcagaacaggaaagtgt

SEQ ID NO: 9474294 - DNA, 22 bp, Homo sapiens
agaggtcaatgggacttggatc

SEQ ID NO: 9474295 - DNA, 22 bp, Homo sapiens
agaggtattagatttgcatagg

SEQ ID NO: 9474296 - DNA, 22 bp, Homo sapiens
agaggtattaggtaattcagta

SEQ ID NO: 9474297 - DNA, 22 bp, Homo sapiens
attgctgacaccaagtagtagc

SEQ ID NO: 9474298 - DNA, 22 bp, Homo sapiens
agaggtatgtgtcagtgcttat

SEQ ID NO: 9474299 - DNA, 22 bp, Homo sapiens
attgctgaacttataaatgaat

SEQ ID NO: 9474300 - DNA, 22 bp, Homo sapiens
agaggtcagaggtcgccaggtc

SEQ ID NO: 9474301 - DNA, 22 bp, Homo sapiens
agaggtcagctgcatgccacat

SEQ ID NO: 9474302 - DNA, 22 bp, Homo sapiens
agaggtcatatctcagaagaga

SEQ ID NO: 9474303 - DNA, 22 bp, Homo sapiens
agaggtctcagttatgtttaaa

SEQ ID NO: 9474304 - DNA, 21 bp, Homo sapiens
agaggtctaagattctagctt

SEQ ID NO: 9474305 - DNA, 22 bp, Homo sapiens
attgctgaaagtattttatgac

SEQ ID NO: 9474306 - DNA, 22 bp, Homo sapiens
attgctgaaatgaaaggatatg

SEQ ID NO: 9474307 - DNA, 22 bp, Homo sapiens
attgctgaaagtattttatgac

SEQ ID NO: 9474308 - DNA, 22 bp, Homo sapiens
attgctaatgtgcgaatgtgta

SEQ ID NO: 9474309 - DNA, 22 bp, Homo sapiens
attgcatttgtcattgttgagg

SEQ ID NO: 9474310 - DNA, 22 bp, Homo sapiens
attgcattgcagctagattttg

SEQ ID NO: 9474311 - DNA, 22 bp, Homo sapiens
attgcattgtattgtaaatgtt

SEQ ID NO: 9474312 - DNA, 22 bp, Homo sapiens
attgcattgtgttttaggaggt

SEQ ID NO: 9474313 - DNA, 22 bp, Homo sapiens
attgccatgctcatagggtcga

SEQ ID NO: 9474314 - DNA, 22 bp, Homo sapiens
agagttctgaaattatctttac

SEQ ID NO: 9474315 - DNA, 22 bp, Homo sapiens
agagttctgaattttattctct

SEQ ID NO: 9474316 - DNA, 22 bp, Homo sapiens
agagttctgaaattatctttac

SEQ ID NO: 9474317 - DNA, 22 bp, Homo sapiens
agagttctgctcttctcagtga

SEQ ID NO: 9474318 - DNA, 22 bp, Homo sapiens
agagttctgtctgccacacgaa

SEQ ID NO: 9474319 - DNA, 22 bp, Homo sapiens
agagttctgctcttctcagtga

SEQ ID NO: 9474320 - DNA, 22 bp, Homo sapiens
agagtggggacagggcctgtcc

SEQ ID NO: 9474321 - DNA, 22 bp, Homo sapiens
agagtgggtgatctctgttgtc

SEQ ID NO: 9474322 - DNA, 22 bp, Homo sapiens
agaggtgaaagaatttggctct

SEQ ID NO: 9474323 - DNA, 22 bp, Homo sapiens
agaggtcttttggtctgcagaa

SEQ ID NO: 9474324 - DNA, 22 bp, Homo sapiens
agaggtgaaagaatttggctct

SEQ ID NO: 9474325 - DNA, 22 bp, Homo sapiens
agagttgctatagaaggatgga

SEQ ID NO: 9474326 - DNA, 22 bp, Homo sapiens
agagttggcccacgtgtaggcg

SEQ ID NO: 9474327 - DNA, 23 bp, Homo sapiens
agagttgtatcctatgtgcttct

SEQ ID NO: 9474328 - DNA, 22 bp, Homo sapiens
agagttgttgtacaaactaaat

SEQ ID NO: 9474329 - DNA, 22 bp, Homo sapiens
agagttggagaaattaaaattt

SEQ ID NO: 9474330 - DNA, 22 bp, Homo sapiens
agagtttacagaaataagctgt

SEQ ID NO: 9474331 - DNA, 22 bp, Homo sapiens
agagtttacagaaataagctgt

SEQ ID NO: 9474332 - DNA, 22 bp, Homo sapiens
agagtttcttgtgagcactgac

SEQ ID NO: 9474333 - DNA, 22 bp, Homo sapiens
agagtttcttgtgagcactgac

SEQ ID NO: 9474334 - DNA, 22 bp, Homo sapiens
atttgttctcataaagaatgaa

SEQ ID NO: 9474335 - DNA, 22 bp, Homo sapiens
atttgttccacacatatttact

SEQ ID NO: 9474336 - DNA, 22 bp, Homo sapiens
atttgttcatgggttgttatgc

SEQ ID NO: 9474337 - DNA, 22 bp, Homo sapiens
atttgttcagcattgaatttgg

SEQ ID NO: 9474338 - DNA, 22 bp, Homo sapiens
atttgttcatgggttgttatgc

SEQ ID NO: 9474339 - DNA, 22 bp, Homo sapiens
atttgtgataatttgttacagc

SEQ ID NO: 9474340 - DNA, 15 bp, Homo sapiens
atttggcatggcctc

SEQ ID NO: 9474341 - DNA, 22 bp, Homo sapiens
atttgtgccaaattatttctaa

SEQ ID NO: 9474342 - DNA, 22 bp, Homo sapiens
atttgtgataatttgttacagc

SEQ ID NO: 9474343 - DNA, 22 bp, Homo sapiens
atttgtgggactataatgcagg

SEQ ID NO: 9474344 - DNA, 22 bp, Homo sapiens
atttggcataggcagaggccca

SEQ ID NO: 9474345 - DNA, 20 bp, Homo sapiens
atttggcatgaagtattgat

SEQ ID NO: 9474346 - DNA, 22 bp, Homo sapiens
atttggcaaaaattagcagtag

SEQ ID NO: 9474347 - DNA, 22 bp, Homo sapiens
caaaagggagttctctggaagg

SEQ ID NO: 9474348 - DNA, 22 bp, Homo sapiens
caaaagtaatcgtggcttttgc

SEQ ID NO: 9474349 - DNA, 22 bp, Homo sapiens
caaaaggcaggggaaagagtgc

SEQ ID NO: 9474350 - DNA, 22 bp, Homo sapiens
caaaaggcaggggaaagagtgc

SEQ ID NO: 9474351 - DNA, 22 bp, Homo sapiens
caaaaggccagtactttgtttg

SEQ ID NO: 9474352 - DNA, 22 bp, Homo sapiens
caaaaggccagtactttgtttg

SEQ ID NO: 9474353 - DNA, 22 bp, Homo sapiens
caaaagtaattatggtttttgc

SEQ ID NO: 9474354 - DNA, 22 bp, Homo sapiens
caaaagtaatggcggtttttac

SEQ ID NO: 9474355 - DNA, 22 bp, Homo sapiens
caaaagtaccttgtgtgctttg

SEQ ID NO: 9474356 - DNA, 22 bp, Homo sapiens
caaaagtaattgtggtttttgc

SEQ ID NO: 9474357 - DNA, 22 bp, Homo sapiens
caaaagtaccttgtgtgctttg

SEQ ID NO: 9474358 - DNA, 22 bp, Homo sapiens
caaaagtaccttgtgtgctttg

SEQ ID NO: 9474359 - DNA, 22 bp, Homo sapiens
caaaagtaccttgtgtgctttg

SEQ ID NO: 9474360 - DNA, 22 bp, Homo sapiens
caaaagtaattgcagtttttgc

SEQ ID NO: 9474361 - DNA, 22 bp, Homo sapiens
caaaagtaattgcagtttttgc

SEQ ID NO: 9474362 - DNA, 22 bp, Homo sapiens
caaaagtaattgcagtttttgc

SEQ ID NO: 9474363 - DNA, 22 bp, Homo sapiens
caaaagtaattgcagtttttgc

SEQ ID NO: 9474364 - DNA, 22 bp, Homo sapiens
caaaagtaattgcggtttttgc

SEQ ID NO: 9474365 - DNA, 21 bp, Homo sapiens
caaaaggataggaaattaggg

SEQ ID NO: 9474366 - DNA, 21 bp, Homo sapiens
caaaaggataggaaattaggg

SEQ ID NO: 9474367 - DNA, 22 bp, Homo sapiens
caaaaaacacagatgtctgtgt

SEQ ID NO: 9474368 - DNA, 21 bp, Homo sapiens
caaaaggataggaaattaggg

SEQ ID NO: 9474369 - DNA, 22 bp, Homo sapiens
attttttgttaactcaggatag

SEQ ID NO: 9474370 - DNA, 22 bp, Homo sapiens
caaaaaacacagatgtctgtgt

SEQ ID NO: 9474371 - DNA, 22 bp, Homo sapiens
caaaaaacacagatgtctgtgt

SEQ ID NO: 9474372 - DNA, 22 bp, Homo sapiens
atttgtttatcgtcgattgtag

SEQ ID NO: 9474373 - DNA, 22 bp, Homo sapiens
atttgtttatcgtcgattgtag

SEQ ID NO: 9474374 - DNA, 22 bp, Homo sapiens
atttgtttatcgtcgattgtag

SEQ ID NO: 9474375 - DNA, 22 bp, Homo sapiens
atttgtttcagggccttggtat

SEQ ID NO: 9474376 - DNA, 22 bp, Homo sapiens
atttgtttcagggccttggtat

SEQ ID NO: 9474377 - DNA, 22 bp, Homo sapiens
atttgtttcagggccttggtat

SEQ ID NO: 9474378 - DNA, 20 bp, Homo sapiens
atttgtttctactctctgac

SEQ ID NO: 9474379 - DNA, 20 bp, Homo sapiens
atttgtttctactctctgac

SEQ ID NO: 9474380 - DNA, 20 bp, Homo sapiens
atttgtttctactctctgac

SEQ ID NO: 9474381 - DNA, 20 bp, Homo sapiens
atttgtttctactctctgac

SEQ ID NO: 9474382 - DNA, 22 bp, Homo sapiens
atttctctgcctcagcttctgc

SEQ ID NO: 9474383 - DNA, 22 bp, Homo sapiens
atttctctgcagtgttcggaat

SEQ ID NO: 9474384 - DNA, 22 bp, Homo sapiens
atttgcttttactatgttaaaa

SEQ ID NO: 9474385 - DNA, 22 bp, Homo sapiens
atttgctttgggacagcttaaa

SEQ ID NO: 9474386 - DNA, 18 bp, Homo sapiens
atttctctggggtgattc

SEQ ID NO: 9474387 - DNA, 22 bp, Homo sapiens
atttggatatcactgaatacat

SEQ ID NO: 9474388 - DNA, 22 bp, Homo sapiens
atttggatgcactaaataaaat

SEQ ID NO: 9474389 - DNA, 22 bp, Homo sapiens
atttggatgcactaaataaaat

SEQ ID NO: 9474390 - DNA, 22 bp, Homo sapiens
atttgcttttactatgttaaaa

SEQ ID NO: 9474391 - DNA, 22 bp, Homo sapiens
atttgcttttactatgttaaaa

SEQ ID NO: 9474392 - DNA, 22 bp, Homo sapiens
atttggacatttacaatagtga

SEQ ID NO: 9474393 - DNA, 22 bp, Homo sapiens
atttggagacaggatttttcag

SEQ ID NO: 9474394 - DNA, 22 bp, Homo sapiens
atttctctcattgttagctagg

SEQ ID NO: 9474395 - DNA, 22 bp, Homo sapiens
atttctctcattgttagctagg

SEQ ID NO: 9474396 - DNA, 22 bp, Homo sapiens
atttctctcattgttagctagg

SEQ ID NO: 9474397 - DNA, 22 bp, Homo sapiens
atttctctcattgttagctagg

SEQ ID NO: 9474398 - DNA, 22 bp, Homo sapiens
atttctctaagcatccgtttgc

SEQ ID NO: 9474399 - DNA, 22 bp, Homo sapiens
atttctctaagcatccgtttgc

SEQ ID NO: 9474400 - DNA, 22 bp, Homo sapiens
atttccttcatcagcctatcct

SEQ ID NO: 9474401 - DNA, 22 bp, Homo sapiens
atttccttcatcagcctatcct

SEQ ID NO: 9474402 - DNA, 22 bp, Homo sapiens
atttctcatgtacaaaaacact

SEQ ID NO: 9474403 - DNA, 22 bp, Homo sapiens
atttctcatgtacaaaaacact

SEQ ID NO: 9474404 - DNA, 22 bp, Homo sapiens
atttccttcagtgtttaatact

SEQ ID NO: 9474405 - DNA, 22 bp, Homo sapiens
atttccttcagtgtttaatact

SEQ ID NO: 9474406 - DNA, 22 bp, Homo sapiens
atttcctcatgatcataatgca

SEQ ID NO: 9474407 - DNA, 17 bp, Homo sapiens
atttcctcagggctgag

SEQ ID NO: 9474408 - DNA, 22 bp, Homo sapiens
agatactatggaattttatgag

SEQ ID NO: 9474409 - DNA, 19 bp, Homo sapiens
agataggctgtcttagagt

SEQ ID NO: 9474410 - DNA, 22 bp, Homo sapiens
agataggccattaagaaggata

SEQ ID NO: 9474411 - DNA, 22 bp, Homo sapiens
agatacattgttctaagcattg

SEQ ID NO: 9474412 - DNA, 22 bp, Homo sapiens
agatacattgttctaagcattg

SEQ ID NO: 9474413 - DNA, 22 bp, Homo sapiens
agatacattgttctaagcattg

SEQ ID NO: 9474414 - DNA, 22 bp, Homo sapiens
agatactaagcatttccagcac

SEQ ID NO: 9474415 - DNA, 22 bp, Homo sapiens
agatacatttgtgtgcatgtat

SEQ ID NO: 9474416 - DNA, 22 bp, Homo sapiens
atttcctatagatatggtgagt

SEQ ID NO: 9474417 - DNA, 22 bp, Homo sapiens
atttcctatcctggtcttaaaa

SEQ ID NO: 9474418 - DNA, 22 bp, Homo sapiens
atttcctatagatatggtgagt

SEQ ID NO: 9474419 - DNA, 22 bp, Homo sapiens
atttccagcagcatatttgtct

SEQ ID NO: 9474420 - DNA, 22 bp, Homo sapiens
agaagtgagtgtgactcagcag

SEQ ID NO: 9474421 - DNA, 22 bp, Homo sapiens
agaagtgagactcagttgatga

SEQ ID NO: 9474422 - DNA, 22 bp, Homo sapiens
agaagtgagactcagttgatga

SEQ ID NO: 9474423 - DNA, 22 bp, Homo sapiens
agaagtgctccagtgagttggg

SEQ ID NO: 9474424 - DNA, 22 bp, Homo sapiens
agaagtgccgaaaggaagacag

SEQ ID NO: 9474425 - DNA, 23 bp, Homo sapiens
agaagtggaatggccgtggggtc

SEQ ID NO: 9474426 - DNA, 23 bp, Homo sapiens
agaagtggaatggccgtggggtc

SEQ ID NO: 9474427 - DNA, 20 bp, Homo sapiens
agaagtcagctcagaagtga

SEQ ID NO: 9474428 - DNA, 22 bp, Homo sapiens
atctcaggaggaccctgatgct

SEQ ID NO: 9474429 - DNA, 22 bp, Homo sapiens
agaaggctggccatggtgccct

SEQ ID NO: 9474430 - DNA, 16 bp, Homo sapiens
atctcaggagagtctt

SEQ ID NO: 9474431 - DNA, 22 bp, Homo sapiens
atctcagaaacatatctaatcc

SEQ ID NO: 9474432 - DNA, 22 bp, Homo sapiens
atctcaccaagttattacgaga

SEQ ID NO: 9474433 - DNA, 22 bp, Homo sapiens
atctcagaaacatatctaatcc

SEQ ID NO: 9474434 - DNA, 22 bp, Homo sapiens
atctcagaaggcatttccaaga

SEQ ID NO: 9474435 - DNA, 22 bp, Homo sapiens
agaagtattctgcatgtactga

SEQ ID NO: 9474436 - DNA, 22 bp, Homo sapiens
agaaggctttaagtactggcat

SEQ ID NO: 9474437 - DNA, 22 bp, Homo sapiens
agaaggctggccatggtgccct

SEQ ID NO: 9474438 - DNA, 22 bp, Homo sapiens
agaaggctggccctgggtggcc

SEQ ID NO: 9474439 - DNA, 22 bp, Homo sapiens
agaagtcaagtggtctatgaaa

SEQ ID NO: 9474440 - DNA, 22 bp, Homo sapiens
agaagtatttggctaaaagaca

SEQ ID NO: 9474441 - DNA, 22 bp, Homo sapiens
atctttgttgctctcatttctg

SEQ ID NO: 9474442 - DNA, 23 bp, Homo sapiens
atgaaactcaagccagatccaag

SEQ ID NO: 9474443 - DNA, 23 bp, Homo sapiens
atgaaactcaagccagatccaag

SEQ ID NO: 9474444 - DNA, 22 bp, Homo sapiens
atgaaactaaactacataagtt

SEQ ID NO: 9474445 - DNA, 22 bp, Homo sapiens
atgaaactaaactacataagtt

SEQ ID NO: 9474446 - DNA, 22 bp, Homo sapiens
atgaaactctaacttaacaagt

SEQ ID NO: 9474447 - DNA, 22 bp, Homo sapiens
atgaaactctaacttaacaagt

SEQ ID NO: 9474448 - DNA, 22 bp, Homo sapiens
atgaaactctaacttaacaagt

SEQ ID NO: 9474449 - DNA, 22 bp, Homo sapiens
atgaaactgaaggacaaccaga

SEQ ID NO: 9474450 - DNA, 22 bp, Homo sapiens
atgaaactgaaggacaaccaga

SEQ ID NO: 9474451 - DNA, 22 bp, Homo sapiens
atgaaactgaaggacaaccaga

SEQ ID NO: 9474452 - DNA, 22 bp, Homo sapiens
atgaaactctaacttaacaagt

SEQ ID NO: 9474453 - DNA, 22 bp, Homo sapiens
agaagtttggtcctataaactc

SEQ ID NO: 9474454 - DNA, 22 bp, Homo sapiens
agaagtttggtcctataaactc

SEQ ID NO: 9474455 - DNA, 22 bp, Homo sapiens
agaagtttggtcctataaactc

SEQ ID NO: 9474456 - DNA, 22 bp, Homo sapiens
agaagtttggtcctataaactc

SEQ ID NO: 9474457 - DNA, 22 bp, Homo sapiens
agaagtttggtccttttcaagg

SEQ ID NO: 9474458 - DNA, 22 bp, Homo sapiens
agaagtttggtcctataaactc

SEQ ID NO: 9474459 - DNA, 22 bp, Homo sapiens
agaagtttgaaattaggagaaa

SEQ ID NO: 9474460 - DNA, 22 bp, Homo sapiens
agaagtttgaaattaggagaaa

SEQ ID NO: 9474461 - DNA, 22 bp, Homo sapiens
agaagtggtgtgtggccgagct

SEQ ID NO: 9474462 - DNA, 22 bp, Homo sapiens
agaagtgtggtctagcagtggc

SEQ ID NO: 9474463 - DNA, 22 bp, Homo sapiens
agaagttaattcctgaaattct

SEQ ID NO: 9474464 - DNA, 22 bp, Homo sapiens
agaagtgtttatttcagcaaca

SEQ ID NO: 9474465 - DNA, 22 bp, Homo sapiens
agaagttaccacatacttctct

SEQ ID NO: 9474466 - DNA, 19 bp, Homo sapiens
agaagttagacattgcaat

SEQ ID NO: 9474467 - DNA, 22 bp, Homo sapiens
agaagttctctccaccttgggt

SEQ ID NO: 9474468 - DNA, 22 bp, Homo sapiens
agaagtttccagtctagtaagg

SEQ ID NO: 9474469 - DNA, 22 bp, Homo sapiens
agaagtttatttatgccccaat

SEQ ID NO: 9474470 - DNA, 22 bp, Homo sapiens
agaagttgttcaaggtggtgag

SEQ ID NO: 9474471 - DNA, 22 bp, Homo sapiens
agaagttgtaggtttgcatatt

SEQ ID NO: 9474472 - DNA, 22 bp, Homo sapiens
atgaaattgatcttgaactttt

SEQ ID NO: 9474473 - DNA, 22 bp, Homo sapiens
atgaaatttgaccaattattta

SEQ ID NO: 9474474 - DNA, 23 bp, Homo sapiens
atgaaagttcttaaaatgtcatg

SEQ ID NO: 9474475 - DNA, 23 bp, Homo sapiens
atgaaagttcttaaaatgtcatg

SEQ ID NO: 9474476 - DNA, 22 bp, Homo sapiens
atgaaagtttgcattcctcagt

SEQ ID NO: 9474477 - DNA, 22 bp, Homo sapiens
atgaaattttaattatacctct

SEQ ID NO: 9474478 - DNA, 22 bp, Homo sapiens
atgaaattttaattatacctct

SEQ ID NO: 9474479 - DNA, 22 bp, Homo sapiens
atgaacaataaaatagatcaca

SEQ ID NO: 9474480 - DNA, 22 bp, Homo sapiens
atgaacaataaaatagatcaca

SEQ ID NO: 9474481 - DNA, 22 bp, Homo sapiens
atgaaagtacctgtaatatgtt

SEQ ID NO: 9474482 - DNA, 22 bp, Homo sapiens
atgaaagtacctgtaatatgtt

SEQ ID NO: 9474483 - DNA, 22 bp, Homo sapiens
atgaaagtacctgtaatatgtt

SEQ ID NO: 9474484 - DNA, 22 bp, Homo sapiens
atgaaagtacctgtaatatgtt

SEQ ID NO: 9474485 - DNA, 22 bp, Homo sapiens
atgaaagtagggtaaaatcaca

SEQ ID NO: 9474486 - DNA, 22 bp, Homo sapiens
atgaaagtgaaggtttactaag

SEQ ID NO: 9474487 - DNA, 22 bp, Homo sapiens
atgaaagtggcttgattaaatg

SEQ ID NO: 9474488 - DNA, 22 bp, Homo sapiens
atgaaagtgtttaagtttatgt

SEQ ID NO: 9474489 - DNA, 22 bp, Homo sapiens
atgaaagtgtttaagtttatgt

SEQ ID NO: 9474490 - DNA, 23 bp, Homo sapiens
atgaaagttcttaaaatgtcatg

SEQ ID NO: 9474491 - DNA, 22 bp, Homo sapiens
atgaaagtgtttaagtttatgt

SEQ ID NO: 9474492 - DNA, 22 bp, Homo sapiens
atgaaagtgaaggtttactaag

SEQ ID NO: 9474493 - DNA, 22 bp, Homo sapiens
atgaaagcaacttatttgagat

SEQ ID NO: 9474494 - DNA, 22 bp, Homo sapiens
atgaaagcaagaagtgagttga

SEQ ID NO: 9474495 - DNA, 22 bp, Homo sapiens
atgaaagcacgtgggaagataa

SEQ ID NO: 9474496 - DNA, 22 bp, Homo sapiens
atgaaagatgatttaaagtact

SEQ ID NO: 9474497 - DNA, 22 bp, Homo sapiens
atgaaactgaaggacaaccaga

SEQ ID NO: 9474498 - DNA, 22 bp, Homo sapiens
atgaaactgggataactatagc

SEQ ID NO: 9474499 - DNA, 22 bp, Homo sapiens
atgaaactgggataactatagc

SEQ ID NO: 9474500 - DNA, 22 bp, Homo sapiens
atgaaagatgatttaaagtact

SEQ ID NO: 9474501 - DNA, 22 bp, Homo sapiens
agacaaatgaacaaatatgtga

SEQ ID NO: 9474502 - DNA, 22 bp, Homo sapiens
agacaaataagtgctgggattt

SEQ ID NO: 9474503 - DNA, 22 bp, Homo sapiens
agacaaaggattaatgatgatg

SEQ ID NO: 9474504 - DNA, 22 bp, Homo sapiens
agacaaagacagcatctcaggt

SEQ ID NO: 9474505 - DNA, 22 bp, Homo sapiens
agacaaaggattaatgatgatg

SEQ ID NO: 9474506 - DNA, 22 bp, Homo sapiens
agacaaatggagtatgagcaac

SEQ ID NO: 9474507 - DNA, 22 bp, Homo sapiens
agacaaattgggacattgtgtt

SEQ ID NO: 9474508 - DNA, 22 bp, Homo sapiens
agacaaattgggacattgtgtt

SEQ ID NO: 9474509 - DNA, 22 bp, Homo sapiens
agacaaagaaaccgtagaagca

SEQ ID NO: 9474510 - DNA, 22 bp, Homo sapiens
agacaaagacagcatctcaggt

SEQ ID NO: 9474511 - DNA, 22 bp, Homo sapiens
agacaaagacagcatctcaggt

SEQ ID NO: 9474512 - DNA, 18 bp, Homo sapiens
agacaaacttcttctgcc

SEQ ID NO: 9474513 - DNA, 18 bp, Homo sapiens
agacaaacttcttctgcc

SEQ ID NO: 9474514 - DNA, 22 bp, Homo sapiens
agaattgctggaatttgcttta

SEQ ID NO: 9474515 - DNA, 22 bp, Homo sapiens
agaattcttggtggttagaata

SEQ ID NO: 9474516 - DNA, 22 bp, Homo sapiens
agaattcttggtggttagaata

SEQ ID NO: 9474517 - DNA, 20 bp, Homo sapiens
agaattcttaccctttgatg

SEQ ID NO: 9474518 - DNA, 22 bp, Homo sapiens
agacagcagaaactagagcact

SEQ ID NO: 9474519 - DNA, 22 bp, Homo sapiens
agacagcagaaactagagcact

SEQ ID NO: 9474520 - DNA, 22 bp, Homo sapiens
agacagcagaaactagagcact

SEQ ID NO: 9474521 - DNA, 21 bp, Homo sapiens
agacagcagatagtcgaaagg

SEQ ID NO: 9474522 - DNA, 21 bp, Homo sapiens
agacagcagatagtcgaaagg

SEQ ID NO: 9474523 - DNA, 22 bp, Homo sapiens
agacagcagcagaggggctccc

SEQ ID NO: 9474524 - DNA, 22 bp, Homo sapiens
agacagcagcagaggggctccc

SEQ ID NO: 9474525 - DNA, 22 bp, Homo sapiens
agacagcatgagcctgctgatg

SEQ ID NO: 9474526 - DNA, 22 bp, Homo sapiens
agacagcatgagcctgctgatg

SEQ ID NO: 9474527 - DNA, 22 bp, Homo sapiens
agacagcaggggagtctggttt

SEQ ID NO: 9474528 - DNA, 22 bp, Homo sapiens
agacagcagggagcaggattca

SEQ ID NO: 9474529 - DNA, 21 bp, Homo sapiens
agacagcagtctccaaacccc

SEQ ID NO: 9474530 - DNA, 22 bp, Homo sapiens
agacagcaggggagtctggttt

SEQ ID NO: 9474531 - DNA, 22 bp, Homo sapiens
agacagcatgatacatgatgct

SEQ ID NO: 9474532 - DNA, 22 bp, Homo sapiens
agacagcatgatacatgatgct

SEQ ID NO: 9474533 - DNA, 22 bp, Homo sapiens
agacagcatgatacatgatgct

SEQ ID NO: 9474534 - DNA, 22 bp, Homo sapiens
agacagcatggagctgataaca

SEQ ID NO: 9474535 - DNA, 22 bp, Homo sapiens
agacagcatttctagcaccagg

SEQ ID NO: 9474536 - DNA, 22 bp, Homo sapiens
agacagcatggagctgataaca

SEQ ID NO: 9474537 - DNA, 22 bp, Homo sapiens
agacagcatttcccggaaccgc

SEQ ID NO: 9474538 - DNA, 22 bp, Homo sapiens
agacagcatttctagcaccagg

SEQ ID NO: 9474539 - DNA, 22 bp, Homo sapiens
agacagccaatgctggaagatg

SEQ ID NO: 9474540 - DNA, 22 bp, Homo sapiens
agacagcatttctagcaccagg

SEQ ID NO: 9474541 - DNA, 22 bp, Homo sapiens
agacagctccaagtgtctctgt

SEQ ID NO: 9474542 - DNA, 22 bp, Homo sapiens
agacagctctgggttccacact

SEQ ID NO: 9474543 - DNA, 22 bp, Homo sapiens
agacagctgcctccaccacagc

SEQ ID NO: 9474544 - DNA, 22 bp, Homo sapiens
agacagctagggctgcagggac

SEQ ID NO: 9474545 - DNA, 22 bp, Homo sapiens
agacagcgaggacagaggggtg

SEQ ID NO: 9474546 - DNA, 22 bp, Homo sapiens
agacatatggtgaaacatttta

SEQ ID NO: 9474547 - DNA, 22 bp, Homo sapiens
agacatattggcttgctttaat

SEQ ID NO: 9474548 - DNA, 22 bp, Homo sapiens
agacatattggcttgctttaat

SEQ ID NO: 9474549 - DNA, 22 bp, Homo sapiens
agacatttattcacacatttat

SEQ ID NO: 9474550 - DNA, 22 bp, Homo sapiens
agacatttcctagacatcaatg

SEQ ID NO: 9474551 - DNA, 22 bp, Homo sapiens
agacatttcctagacatcaatg

SEQ ID NO: 9474552 - DNA, 22 bp, Homo sapiens
agacatttattcacacatttat

SEQ ID NO: 9474553 - DNA, 22 bp, Homo sapiens
agacatttattcacacatttat

SEQ ID NO: 9474554 - DNA, 22 bp, Homo sapiens
agacatttggaagatacacata

SEQ ID NO: 9474555 - DNA, 22 bp, Homo sapiens
agacatttggaagatacacata

SEQ ID NO: 9474556 - DNA, 22 bp, Homo sapiens
agacatttggaagatacacata

SEQ ID NO: 9474557 - DNA, 22 bp, Homo sapiens
agacatttggagccaactttcc

SEQ ID NO: 9474558 - DNA, 23 bp, Homo sapiens
agacattttaataaggacttttt

SEQ ID NO: 9474559 - DNA, 22 bp, Homo sapiens
agacattttaacatctgggttt

SEQ ID NO: 9474560 - DNA, 22 bp, Homo sapiens
agacatttggagccaactttcc

SEQ ID NO: 9474561 - DNA, 22 bp, Homo sapiens
agacatttcctgtgaacctact

SEQ ID NO: 9474562 - DNA, 22 bp, Homo sapiens
agacatttcctgtgaacctact

SEQ ID NO: 9474563 - DNA, 22 bp, Homo sapiens
agacatttcctagacatcaatg

SEQ ID NO: 9474564 - DNA, 22 bp, Homo sapiens
agacatttcctagacatcaatg

SEQ ID NO: 9474565 - DNA, 22 bp, Homo sapiens
agacatttcctagacatcaatg

SEQ ID NO: 9474566 - DNA, 22 bp, Homo sapiens
agacatttggaagatacacata

SEQ ID NO: 9474567 - DNA, 22 bp, Homo sapiens
agacatttggaagatacacata

SEQ ID NO: 9474568 - DNA, 22 bp, Homo sapiens
agacagctgctcgcagagctat

SEQ ID NO: 9474569 - DNA, 22 bp, Homo sapiens
agacagctgctcgcagagctat

SEQ ID NO: 9474570 - DNA, 22 bp, Homo sapiens
agacagctgggaaatggagtgt

SEQ ID NO: 9474571 - DNA, 22 bp, Homo sapiens
agacagctgggagtgtccttct

SEQ ID NO: 9474572 - DNA, 22 bp, Homo sapiens
agacaggatgcatactcttggt

SEQ ID NO: 9474573 - DNA, 22 bp, Homo sapiens
agacaggatgcatactcttggt

SEQ ID NO: 9474574 - DNA, 20 bp, Homo sapiens
agacaggagcccccattcag

SEQ ID NO: 9474575 - DNA, 22 bp, Homo sapiens
agacaggagagggaactgccgg

SEQ ID NO: 9474576 - DNA, 22 bp, Homo sapiens
agacaggagagggaactgccgg

SEQ ID NO: 9474577 - DNA, 22 bp, Homo sapiens
agacaggacacaagctgcataa

SEQ ID NO: 9474578 - DNA, 22 bp, Homo sapiens
agacaggagagggaactgccgg

SEQ ID NO: 9474579 - DNA, 22 bp, Homo sapiens
atgacaaaagaagacatgaggt

SEQ ID NO: 9474580 - DNA, 22 bp, Homo sapiens
atgacaaaagaagacatgaggt

SEQ ID NO: 9474581 - DNA, 22 bp, Homo sapiens
atgacaaaagaagacatgaggt

SEQ ID NO: 9474582 - DNA, 22 bp, Homo sapiens
atgacaaaagaagacatgaggt

SEQ ID NO: 9474583 - DNA, 22 bp, Homo sapiens
atgacaaaagaagacatgaggt

SEQ ID NO: 9474584 - DNA, 22 bp, Homo sapiens
atgacaaaatgaatgcagctag

SEQ ID NO: 9474585 - DNA, 22 bp, Homo sapiens
atgacaaaataaatggtctctg

SEQ ID NO: 9474586 - DNA, 23 bp, Homo sapiens
atgacaaacaggacatcttgtgc

SEQ ID NO: 9474587 - DNA, 22 bp, Homo sapiens
atgacaaaattcacaggtgtga

SEQ ID NO: 9474588 - DNA, 23 bp, Homo sapiens
atgacaaacaggacatcttgtgc

SEQ ID NO: 9474589 - DNA, 23 bp, Homo sapiens
atgacaaacaggacatcttgtgc

SEQ ID NO: 9474590 - DNA, 22 bp, Homo sapiens
atgacaaaggctgaaagggaaa

SEQ ID NO: 9474591 - DNA, 22 bp, Homo sapiens
atgacaaacccaggatgtaaca

SEQ ID NO: 9474592 - DNA, 22 bp, Homo sapiens
atgacaaacccaggatgtaaca

SEQ ID NO: 9474593 - DNA, 22 bp, Homo sapiens
atgcacatcttacagatgcaga

SEQ ID NO: 9474594 - DNA, 22 bp, Homo sapiens
atgcacatcttacagatgcaga

SEQ ID NO: 9474595 - DNA, 22 bp, Homo sapiens
atgcacataggccaaatcattt

SEQ ID NO: 9474596 - DNA, 22 bp, Homo sapiens
atgcacatacatatgctctata

SEQ ID NO: 9474597 - DNA, 22 bp, Homo sapiens
atgcaactgagatggcctctgg

SEQ ID NO: 9474598 - DNA, 22 bp, Homo sapiens
atgcaactacttctgcaccaat

SEQ ID NO: 9474599 - DNA, 22 bp, Homo sapiens
atgacaaattcagaccatagca

SEQ ID NO: 9474600 - DNA, 22 bp, Homo sapiens
atgacaaattcagaccatagca

SEQ ID NO: 9474601 - DNA, 22 bp, Homo sapiens
atgacaaattcagaccatagca

SEQ ID NO: 9474602 - DNA, 22 bp, Homo sapiens
atgacaaattcagaccatagca

SEQ ID NO: 9474603 - DNA, 22 bp, Homo sapiens
atgacaacctgtgagctggtat

SEQ ID NO: 9474604 - DNA, 22 bp, Homo sapiens
atgacaacacatggtgctgaat

SEQ ID NO: 9474605 - DNA, 22 bp, Homo sapiens
atgacaagggagggtcctgcta

SEQ ID NO: 9474606 - DNA, 17 bp, Homo sapiens
agacagacctctgcatc

SEQ ID NO: 9474607 - DNA, 17 bp, Homo sapiens
agacagacctctgcatc

SEQ ID NO: 9474608 - DNA, 22 bp, Homo sapiens
agacagaccatggctattcaga

SEQ ID NO: 9474609 - DNA, 22 bp, Homo sapiens
agacagacattctagagccacc

SEQ ID NO: 9474610 - DNA, 22 bp, Homo sapiens
atgcacatgtatctatatacaa

SEQ ID NO: 9474611 - DNA, 22 bp, Homo sapiens
atgcacatgaggcaagcaaaat

SEQ ID NO: 9474612 - DNA, 22 bp, Homo sapiens
atgcacatgaggcaagcaaaat

SEQ ID NO: 9474613 - DNA, 22 bp, Homo sapiens
atgcacatgtatgtcaatattt

SEQ ID NO: 9474614 - DNA, 22 bp, Homo sapiens
atgcacatgtggctttatgtat

SEQ ID NO: 9474615 - DNA, 22 bp, Homo sapiens
atgcacattgtagccacacaat

SEQ ID NO: 9474616 - DNA, 22 bp, Homo sapiens
atgcaccccagaagctgcagtg

SEQ ID NO: 9474617 - DNA, 22 bp, Homo sapiens
atgcaccccagaagctgcagtg

SEQ ID NO: 9474618 - DNA, 22 bp, Homo sapiens
atgcacctgaactccatcagct

SEQ ID NO: 9474619 - DNA, 22 bp, Homo sapiens
atgcacctgaactccatcagct

SEQ ID NO: 9474620 - DNA, 22 bp, Homo sapiens
atgcacctgaactccatcagct

SEQ ID NO: 9474621 - DNA, 22 bp, Homo sapiens
atgcacctgaactccatcagct

SEQ ID NO: 9474622 - DNA, 22 bp, Homo sapiens
atgcacctgaactccatcagct

SEQ ID NO: 9474623 - DNA, 22 bp, Homo sapiens
atgcacctgaactccatcagct

SEQ ID NO: 9474624 - DNA, 22 bp, Homo sapiens
atgcactgggtgaggaaggaga

SEQ ID NO: 9474625 - DNA, 22 bp, Homo sapiens
atgcactatgatgagctagtct

SEQ ID NO: 9474626 - DNA, 22 bp, Homo sapiens
atgcactacttggctttactga

SEQ ID NO: 9474627 - DNA, 22 bp, Homo sapiens
atgcactacttggctttactga

SEQ ID NO: 9474628 - DNA, 22 bp, Homo sapiens
atgcactgcccctctgcacctc

SEQ ID NO: 9474629 - DNA, 22 bp, Homo sapiens
atggcctggccagagctctgct

SEQ ID NO: 9474630 - DNA, 22 bp, Homo sapiens
atggcctgggcccgcttcagat

SEQ ID NO: 9474631 - DNA, 20 bp, Homo sapiens
agagaccctgtagcttgcag

SEQ ID NO: 9474632 - DNA, 22 bp, Homo sapiens
agagaccttcctgactccagag

SEQ ID NO: 9474633 - DNA, 22 bp, Homo sapiens
agagactaagccagcatagtgc

SEQ ID NO: 9474634 - DNA, 22 bp, Homo sapiens
atggcctccgacccatgacgtg

SEQ ID NO: 9474635 - DNA, 22 bp, Homo sapiens
atggcctctagctgagaccaat

SEQ ID NO: 9474636 - DNA, 22 bp, Homo sapiens
atggcctctagctgagaccaat

SEQ ID NO: 9474637 - DNA, 22 bp, Homo sapiens
atggccgcctgtccttcccgcc

SEQ ID NO: 9474638 - DNA, 22 bp, Homo sapiens
agagatgaaaagtggagactgg

SEQ ID NO: 9474639 - DNA, 22 bp, Homo sapiens
agagatgaaaagtggagactgg

SEQ ID NO: 9474640 - DNA, 22 bp, Homo sapiens
agagagttgtatgtttctaaaa

SEQ ID NO: 9474641 - DNA, 22 bp, Homo sapiens
agagatgaacataaaacaagga

SEQ ID NO: 9474642 - DNA, 22 bp, Homo sapiens
atggctcagcccatggaagaaa

SEQ ID NO: 9474643 - DNA, 22 bp, Homo sapiens
atggctcagcccatggaagaaa

SEQ ID NO: 9474644 - DNA, 22 bp, Homo sapiens
agagagttgtaccacactcata

SEQ ID NO: 9474645 - DNA, 22 bp, Homo sapiens
agagagttgaggaagcaacact

SEQ ID NO: 9474646 - DNA, 17 bp, Homo sapiens
atggctcacctgtgggc

SEQ ID NO: 9474647 - DNA, 17 bp, Homo sapiens
atggctcacctgtgggc

SEQ ID NO: 9474648 - DNA, 17 bp, Homo sapiens
atggctcacctgtgggc

SEQ ID NO: 9474649 - DNA, 22 bp, Homo sapiens
atggccttagtgatgattaata

SEQ ID NO: 9474650 - DNA, 22 bp, Homo sapiens
agagacagggttttgccatgtt

SEQ ID NO: 9474651 - DNA, 21 bp, Homo sapiens
agagacagagaaagtaacatt

SEQ ID NO: 9474652 - DNA, 21 bp, Homo sapiens
agagacagagaaagtaacatt

SEQ ID NO: 9474653 - DNA, 22 bp, Homo sapiens
agagaaggaaagctgacatggg

SEQ ID NO: 9474654 - DNA, 22 bp, Homo sapiens
agagaaggaaagctgacatggg

SEQ ID NO: 9474655 - DNA, 22 bp, Homo sapiens
agagaaggaaagctgacatggg

SEQ ID NO: 9474656 - DNA, 22 bp, Homo sapiens
agagaagagtcttgtcaaatta

SEQ ID NO: 9474657 - DNA, 22 bp, Homo sapiens
agagaagcagggagtcatctgt

SEQ ID NO: 9474658 - DNA, 22 bp, Homo sapiens
agagaagcagggagtcatctgt

SEQ ID NO: 9474659 - DNA, 22 bp, Homo sapiens
agagaagcattcttctcagggc

SEQ ID NO: 9474660 - DNA, 22 bp, Homo sapiens
agagacagggttttgtcgtgtt

SEQ ID NO: 9474661 - DNA, 23 bp, Homo sapiens
agagacatttggatacagaaaca

SEQ ID NO: 9474662 - DNA, 22 bp, Homo sapiens
agagacagggttttgtcgtgtt

SEQ ID NO: 9474663 - DNA, 22 bp, Homo sapiens
agagacagggttttgtcgtgtt

SEQ ID NO: 9474664 - DNA, 22 bp, Homo sapiens
agagacagggttttgtcgtgtt

SEQ ID NO: 9474665 - DNA, 22 bp, Homo sapiens
agagacagggttttgtcgtgtt

SEQ ID NO: 9474666 - DNA, 22 bp, Homo sapiens
agagacagggttttgtcgtgtt

SEQ ID NO: 9474667 - DNA, 22 bp, Homo sapiens
agagaccagaatccagctgcct

SEQ ID NO: 9474668 - DNA, 22 bp, Homo sapiens
agagacccagactgatcattgc

SEQ ID NO: 9474669 - DNA, 22 bp, Homo sapiens
agagacccgcagcctcggagct

SEQ ID NO: 9474670 - DNA, 22 bp, Homo sapiens
agagacccattgccggaatcac

SEQ ID NO: 9474671 - DNA, 22 bp, Homo sapiens
agagaccctggagttcttcact

SEQ ID NO: 9474672 - DNA, 22 bp, Homo sapiens
agagacccgcagcctcggagct

SEQ ID NO: 9474673 - DNA, 19 bp, Homo sapiens
agagaccacagagctgcct

SEQ ID NO: 9474674 - DNA, 22 bp, Homo sapiens
agagaccaagggaatagtctca

SEQ ID NO: 9474675 - DNA, 22 bp, Homo sapiens
agagaccaagggaatagtctca

SEQ ID NO: 9474676 - DNA, 22 bp, Homo sapiens
atggccagcccttcccgcagct

SEQ ID NO: 9474677 - DNA, 22 bp, Homo sapiens
atggccagcccttcccgcagct

SEQ ID NO: 9474678 - DNA, 22 bp, Homo sapiens
atggccagccactcctgatggc

SEQ ID NO: 9474679 - DNA, 22 bp, Homo sapiens
atggccagccactcctgatggc

SEQ ID NO: 9474680 - DNA, 22 bp, Homo sapiens
atggccagctcagagcactcag

SEQ ID NO: 9474681 - DNA, 22 bp, Homo sapiens
atggccagctcagagcactcag

SEQ ID NO: 9474682 - DNA, 22 bp, Homo sapiens
atggccagctcagagcactcag

SEQ ID NO: 9474683 - DNA, 22 bp, Homo sapiens
atggccagcccttcccgcagct

SEQ ID NO: 9474684 - DNA, 22 bp, Homo sapiens
atggccagcctggtacttggca

SEQ ID NO: 9474685 - DNA, 22 bp, Homo sapiens
atggccagctagcacttgcatt

SEQ ID NO: 9474686 - DNA, 22 bp, Homo sapiens
atggccagcaaggtagggcaat

SEQ ID NO: 9474687 - DNA, 22 bp, Homo sapiens
atggcagcctgtggacagtcaa

SEQ ID NO: 9474688 - DNA, 22 bp, Homo sapiens
atggccagcaagttcagaattt

SEQ ID NO: 9474689 - DNA, 22 bp, Homo sapiens
atggccagcaagttcagaattt

SEQ ID NO: 9474690 - DNA, 22 bp, Homo sapiens
atggcagcctgagcagaggaat

SEQ ID NO: 9474691 - DNA, 23 bp, Homo sapiens
agacccagagactggctctgctc

SEQ ID NO: 9474692 - DNA, 22 bp, Homo sapiens
agagaagagcaatgataaattt

SEQ ID NO: 9474693 - DNA, 22 bp, Homo sapiens
atggccagggtggcactgtggt

SEQ ID NO: 9474694 - DNA, 22 bp, Homo sapiens
atggccagggtggcactgtggt

SEQ ID NO: 9474695 - DNA, 22 bp, Homo sapiens
atggccagggtggcactgtggt

SEQ ID NO: 9474696 - DNA, 22 bp, Homo sapiens
atggccagtcaagcctctggct

SEQ ID NO: 9474697 - DNA, 22 bp, Homo sapiens
atggccaggcacctctggctga

SEQ ID NO: 9474698 - DNA, 22 bp, Homo sapiens
atggccaggcacctctggctga

SEQ ID NO: 9474699 - DNA, 22 bp, Homo sapiens
atggccagggccaaaagagatg

SEQ ID NO: 9474700 - DNA, 22 bp, Homo sapiens
atggccaggcacctctggctga

SEQ ID NO: 9474701 - DNA, 22 bp, Homo sapiens
atggccagcttataggggctca

SEQ ID NO: 9474702 - DNA, 22 bp, Homo sapiens
atggccagcttataggggctca

SEQ ID NO: 9474703 - DNA, 18 bp, Homo sapiens
agaccagacaagaatggt

SEQ ID NO: 9474704 - DNA, 22 bp, Homo sapiens
agaccacttggataagaaacag

SEQ ID NO: 9474705 - DNA, 22 bp, Homo sapiens
agaccaggtctttatggctcca

SEQ ID NO: 9474706 - DNA, 22 bp, Homo sapiens
agaccagggtcccacagagtct

SEQ ID NO: 9474707 - DNA, 22 bp, Homo sapiens
agaccatgggctctgaagagca

SEQ ID NO: 9474708 - DNA, 22 bp, Homo sapiens
agacccacactttgagtagcaa

SEQ ID NO: 9474709 - DNA, 22 bp, Homo sapiens
agacccacactttgagtagcaa

SEQ ID NO: 9474710 - DNA, 22 bp, Homo sapiens
agaccatggccatcctaggaaa

SEQ ID NO: 9474711 - DNA, 22 bp, Homo sapiens
agacattttgatacccctaccg

SEQ ID NO: 9474712 - DNA, 22 bp, Homo sapiens
agacattttagacataaaagat

SEQ ID NO: 9474713 - DNA, 22 bp, Homo sapiens
agacattttagacataaaagat

SEQ ID NO: 9474714 - DNA, 22 bp, Homo sapiens
agacattttgcattccctgaag

SEQ ID NO: 9474715 - DNA, 22 bp, Homo sapiens
agacattttgcaatgggtagct

SEQ ID NO: 9474716 - DNA, 22 bp, Homo sapiens
agacattttgcaatgggtagct

SEQ ID NO: 9474717 - DNA, 22 bp, Homo sapiens
agacattttgcattccctgaag

SEQ ID NO: 9474718 - DNA, 22 bp, Homo sapiens
agacattttagacataaaagat

SEQ ID NO: 9474719 - DNA, 22 bp, Homo sapiens
agacattttacattcttccatt

SEQ ID NO: 9474720 - DNA, 22 bp, Homo sapiens
agacattttacattcttccatt

SEQ ID NO: 9474721 - DNA, 23 bp, Homo sapiens
agacattttaataaggacttttt

SEQ ID NO: 9474722 - DNA, 23 bp, Homo sapiens
agacattttaataaggacttttt

SEQ ID NO: 9474723 - DNA, 22 bp, Homo sapiens
agacattttggaaagtattact

SEQ ID NO: 9474724 - DNA, 22 bp, Homo sapiens
agacattttggaaagtattact

SEQ ID NO: 9474725 - DNA, 22 bp, Homo sapiens
agacattttggaaagtattact

SEQ ID NO: 9474726 - DNA, 22 bp, Homo sapiens
agacattttggaaagtattact

SEQ ID NO: 9474727 - DNA, 22 bp, Homo sapiens
agaccactaaaactttctctat

SEQ ID NO: 9474728 - DNA, 22 bp, Homo sapiens
agaccacaggcatgcacagagc

SEQ ID NO: 9474729 - DNA, 22 bp, Homo sapiens
agagatgctgtgggtagaggca

SEQ ID NO: 9474730 - DNA, 19 bp, Homo sapiens
agagatgctaagagtcttt

SEQ ID NO: 9474731 - DNA, 22 bp, Homo sapiens
agagatgcattcagcatggatg

SEQ ID NO: 9474732 - DNA, 22 bp, Homo sapiens
agagatgcattcagcatggatg

SEQ ID NO: 9474733 - DNA, 22 bp, Homo sapiens
agagatgagaacatgcttggat

SEQ ID NO: 9474734 - DNA, 22 bp, Homo sapiens
agagatgagaacatgcttggat

SEQ ID NO: 9474735 - DNA, 22 bp, Homo sapiens
agagatgcagggtacatggaat

SEQ ID NO: 9474736 - DNA, 22 bp, Homo sapiens
agagatgcagggtacatggaat

SEQ ID NO: 9474737 - DNA, 22 bp, Homo sapiens
agagatgactgatggctgatta

SEQ ID NO: 9474738 - DNA, 22 bp, Homo sapiens
agagatgacatgagggacttaa

SEQ ID NO: 9474739 - DNA, 22 bp, Homo sapiens
agagatgacatgagggacttaa

SEQ ID NO: 9474740 - DNA, 22 bp, Homo sapiens
agagatgacatgagggacttaa

SEQ ID NO: 9474741 - DNA, 22 bp, Homo sapiens
agagatgaatcttgagactctg

SEQ ID NO: 9474742 - DNA, 22 bp, Homo sapiens
agagatgaatcttgagactctg

SEQ ID NO: 9474743 - DNA, 22 bp, Homo sapiens
agagatgaatcttgagactctg

SEQ ID NO: 9474744 - DNA, 22 bp, Homo sapiens
atggggtgcatgcagattggga

SEQ ID NO: 9474745 - DNA, 22 bp, Homo sapiens
atggggtgcatgcagattggga

SEQ ID NO: 9474746 - DNA, 22 bp, Homo sapiens
atggggtgcatgcagattggga

SEQ ID NO: 9474747 - DNA, 22 bp, Homo sapiens
atggggtgagactaggattaaa

SEQ ID NO: 9474748 - DNA, 22 bp, Homo sapiens
atggggtgaccatgagcattta

SEQ ID NO: 9474749 - DNA, 22 bp, Homo sapiens
atggggggatgaaggagtccaa

SEQ ID NO: 9474750 - DNA, 22 bp, Homo sapiens
atggggggatgaaggagtccaa

SEQ ID NO: 9474751 - DNA, 22 bp, Homo sapiens
atgggggcggctgaagcccagg

SEQ ID NO: 9474752 - DNA, 22 bp, Homo sapiens
agagatggcgtctcagagcctg

SEQ ID NO: 9474753 - DNA, 22 bp, Homo sapiens
atgggggcctgaacaggcaaaa

SEQ ID NO: 9474754 - DNA, 22 bp, Homo sapiens
agagatggatgttattatgggt

SEQ ID NO: 9474755 - DNA, 22 bp, Homo sapiens
atgggtggaggagaaaggcatc

SEQ ID NO: 9474756 - DNA, 22 bp, Homo sapiens
atgggtggagggtgacacggat

SEQ ID NO: 9474757 - DNA, 22 bp, Homo sapiens
atgggtggaggagaaaggcatc

SEQ ID NO: 9474758 - DNA, 22 bp, Homo sapiens
atgggtgagtatgagttgactt

SEQ ID NO: 9474759 - DNA, 22 bp, Homo sapiens
atggggttcacctgacagagaa

SEQ ID NO: 9474760 - DNA, 22 bp, Homo sapiens
atgggtaggatttactcagatg

SEQ ID NO: 9474761 - DNA, 22 bp, Homo sapiens
agagccaaggcctcagtctcaa

SEQ ID NO: 9474762 - DNA, 22 bp, Homo sapiens
agagcagcctcagctccctgtg

SEQ ID NO: 9474763 - DNA, 22 bp, Homo sapiens
atgggtggagggtgacacggat

SEQ ID NO: 9474764 - DNA, 22 bp, Homo sapiens
agagcagcctgtgatgatgcac

SEQ ID NO: 9474765 - DNA, 18 bp, Homo sapiens
agagcagcggcatcacac

SEQ ID NO: 9474766 - DNA, 22 bp, Homo sapiens
agagccagaccattgccgtgca

SEQ ID NO: 9474767 - DNA, 22 bp, Homo sapiens
agagccagaccattgccgtgca

SEQ ID NO: 9474768 - DNA, 22 bp, Homo sapiens
agagccagagacctgggttcac

SEQ ID NO: 9474769 - DNA, 22 bp, Homo sapiens
agagccagagacctgggttcac

SEQ ID NO: 9474770 - DNA, 22 bp, Homo sapiens
agagccacggcaggcctaggaa

SEQ ID NO: 9474771 - DNA, 22 bp, Homo sapiens
agagccaatcttcagagcagag

SEQ ID NO: 9474772 - DNA, 22 bp, Homo sapiens
agagccaatcttcagagcagag

SEQ ID NO: 9474773 - DNA, 22 bp, Homo sapiens
agagccacagtggataggagcc

SEQ ID NO: 9474774 - DNA, 22 bp, Homo sapiens
agagccaaggctgagagctatt

SEQ ID NO: 9474775 - DNA, 22 bp, Homo sapiens
agagccaagttgtcaaggcact

SEQ ID NO: 9474776 - DNA, 22 bp, Homo sapiens
agagccaagttgtcaaggcact

SEQ ID NO: 9474777 - DNA, 22 bp, Homo sapiens
agagccactgggagacagagca

SEQ ID NO: 9474778 - DNA, 19 bp, Homo sapiens
agagccagacagcatagga

SEQ ID NO: 9474779 - DNA, 22 bp, Homo sapiens
atgtattttaagatttgcctca

SEQ ID NO: 9474780 - DNA, 22 bp, Homo sapiens
atgtattttaagatttgcctca

SEQ ID NO: 9474781 - DNA, 22 bp, Homo sapiens
atgtattttgccagactgtctc

SEQ ID NO: 9474782 - DNA, 22 bp, Homo sapiens
atgtattttgccagactgtctc

SEQ ID NO: 9474783 - DNA, 22 bp, Homo sapiens
atgtcaaacacaacaccagtgg

SEQ ID NO: 9474784 - DNA, 22 bp, Homo sapiens
atgtcaaacacaacaccagtgg

SEQ ID NO: 9474785 - DNA, 22 bp, Homo sapiens
atgtcaaacacaacaccagtgg

SEQ ID NO: 9474786 - DNA, 22 bp, Homo sapiens
atgtcaaagcagactgagagcg

SEQ ID NO: 9474787 - DNA, 22 bp, Homo sapiens
agagcctgggcagctcctctgg

SEQ ID NO: 9474788 - DNA, 22 bp, Homo sapiens
atgtatttgaaatttgagacat

SEQ ID NO: 9474789 - DNA, 22 bp, Homo sapiens
atgtatttgcgaggttaggaaa

SEQ ID NO: 9474790 - DNA, 22 bp, Homo sapiens
atgtatttgaaatttgagacat

SEQ ID NO: 9474791 - DNA, 22 bp, Homo sapiens
agagccagcaactctagccctg

SEQ ID NO: 9474792 - DNA, 22 bp, Homo sapiens
agagccagcaactctagccctg

SEQ ID NO: 9474793 - DNA, 22 bp, Homo sapiens
agagccagatggagccgtgtgt

SEQ ID NO: 9474794 - DNA, 22 bp, Homo sapiens
atgtatttgcgtatggacatac

SEQ ID NO: 9474795 - DNA, 22 bp, Homo sapiens
atgtatttgcttgttatggatt

SEQ ID NO: 9474796 - DNA, 22 bp, Homo sapiens
atgtatttgcttgttatggatt

SEQ ID NO: 9474797 - DNA, 22 bp, Homo sapiens
atgtatttgcttgttatggatt

SEQ ID NO: 9474798 - DNA, 22 bp, Homo sapiens
agagcctgtgattgtcatcacc

SEQ ID NO: 9474799 - DNA, 22 bp, Homo sapiens
agagcctgtgggagatgcagct

SEQ ID NO: 9474800 - DNA, 22 bp, Homo sapiens
agagcctggggattggcaaggg

SEQ ID NO: 9474801 - DNA, 22 bp, Homo sapiens
atgtggggactctgagagaatt

SEQ ID NO: 9474802 - DNA, 22 bp, Homo sapiens
atgtgtaaaaggcatgttttat

SEQ ID NO: 9474803 - DNA, 22 bp, Homo sapiens
atgtgtaaaaagtgcttaatat

SEQ ID NO: 9474804 - DNA, 22 bp, Homo sapiens
atgtgtaatgtggtattttaat

SEQ ID NO: 9474805 - DNA, 22 bp, Homo sapiens
atgtggggacaaaatgatggcc

SEQ ID NO: 9474806 - DNA, 22 bp, Homo sapiens
atgtggggactctgagagaatt

SEQ ID NO: 9474807 - DNA, 22 bp, Homo sapiens
atgtggggactctgagagaatt

SEQ ID NO: 9474808 - DNA, 22 bp, Homo sapiens
atgtggggacaaaatgatggcc

SEQ ID NO: 9474809 - DNA, 22 bp, Homo sapiens
atgtgggccgtgcgggtgtcct

SEQ ID NO: 9474810 - DNA, 22 bp, Homo sapiens
atgtgggccgtgcgggtgtcct

SEQ ID NO: 9474811 - DNA, 22 bp, Homo sapiens
atgtgggccgtgcgggtgtcct

SEQ ID NO: 9474812 - DNA, 22 bp, Homo sapiens
atgtggggacaaaatgatggcc

SEQ ID NO: 9474813 - DNA, 22 bp, Homo sapiens
atgtgggccgtgcgggtgtcct

SEQ ID NO: 9474814 - DNA, 22 bp, Homo sapiens
atgtgggccgtgcgggtgtcct

SEQ ID NO: 9474815 - DNA, 22 bp, Homo sapiens
aaagttacagtaattcagtgta

SEQ ID NO: 9474816 - DNA, 22 bp, Homo sapiens
aaagttactttgctgtgcttca

SEQ ID NO: 9474817 - DNA, 22 bp, Homo sapiens
aaagttactatcacaatgaaat

SEQ ID NO: 9474818 - DNA, 18 bp, Homo sapiens
aaagttcagggagagttg

SEQ ID NO: 9474819 - DNA, 22 bp, Homo sapiens
aaactctcattttagtgcactg

SEQ ID NO: 9474820 - DNA, 22 bp, Homo sapiens
aaactctcttttcttcagtagg

SEQ ID NO: 9474821 - DNA, 22 bp, Homo sapiens
aaactctatttctgttggctta

SEQ ID NO: 9474822 - DNA, 22 bp, Homo sapiens
aaactagatgattatgaagcat

SEQ ID NO: 9474823 - DNA, 22 bp, Homo sapiens
aaactagatgaaacgagtaaag

SEQ ID NO: 9474824 - DNA, 22 bp, Homo sapiens
aaactagatgaaacgagtaaag

SEQ ID NO: 9474825 - DNA, 22 bp, Homo sapiens
aaactctagtaaaatgtattca

SEQ ID NO: 9474826 - DNA, 22 bp, Homo sapiens
aaactctagttatgaagtttgt

SEQ ID NO: 9474827 - DNA, 22 bp, Homo sapiens
aaactctagggctccacattcc

SEQ ID NO: 9474828 - DNA, 20 bp, Homo sapiens
aaagttcatgtttgcacttt

SEQ ID NO: 9474829 - DNA, 22 bp, Homo sapiens
aaactagaaatcagcaagatag

SEQ ID NO: 9474830 - DNA, 21 bp, Homo sapiens
aaactagagtgtggcaaagct

SEQ ID NO: 9474831 - DNA, 21 bp, Homo sapiens
aaagttcatgctttaatattc

SEQ ID NO: 9474832 - DNA, 22 bp, Homo sapiens
aaagttcatggtgttatagaaa

SEQ ID NO: 9474833 - DNA, 22 bp, Homo sapiens
aaacccagggttttgtcttccc

SEQ ID NO: 9474834 - DNA, 22 bp, Homo sapiens
aaacccatggctgatatcacta

SEQ ID NO: 9474835 - DNA, 22 bp, Homo sapiens
aaacattgtacattctgtagct

SEQ ID NO: 9474836 - DNA, 22 bp, Homo sapiens
aaacattgttatgataaattac

SEQ ID NO: 9474837 - DNA, 22 bp, Homo sapiens
aaacattgtacattctgtagct

SEQ ID NO: 9474838 - DNA, 22 bp, Homo sapiens
aaacctattggcaagaataata

SEQ ID NO: 9474839 - DNA, 22 bp, Homo sapiens
aaacctatatagtcttagaagc

SEQ ID NO: 9474840 - DNA, 22 bp, Homo sapiens
aaaggtcttgtcttgacagagt

SEQ ID NO: 9474841 - DNA, 22 bp, Homo sapiens
aaaggtcttgtcttgacagagt

SEQ ID NO: 9474842 - DNA, 22 bp, Homo sapiens
aaaggtcttgtcttgacagagt

SEQ ID NO: 9474843 - DNA, 23 bp, Homo sapiens
aaaggtctctgagccttggtttc

SEQ ID NO: 9474844 - DNA, 22 bp, Homo sapiens
aaaggtcttcagtgctttcact

SEQ ID NO: 9474845 - DNA, 22 bp, Homo sapiens
aaaggtgttgccttggagacct

SEQ ID NO: 9474846 - DNA, 22 bp, Homo sapiens
aaacattgtaattttagcatgg

SEQ ID NO: 9474847 - DNA, 22 bp, Homo sapiens
aaaggtggagttgtgcccattt

SEQ ID NO: 9474848 - DNA, 19 bp, Homo sapiens
aaacctgttagtagagcac

SEQ ID NO: 9474849 - DNA, 22 bp, Homo sapiens
aaaccttcacatctactctaca

SEQ ID NO: 9474850 - DNA, 22 bp, Homo sapiens
aaaccttagctagagtgtgtca

SEQ ID NO: 9474851 - DNA, 22 bp, Homo sapiens
aaaccttaaaccaagctcttga

SEQ ID NO: 9474852 - DNA, 22 bp, Homo sapiens
aaaccttaaaccaagctcttga

SEQ ID NO: 9474853 - DNA, 22 bp, Homo sapiens
aaacctggtggaacggtgaata

SEQ ID NO: 9474854 - DNA, 22 bp, Homo sapiens
aaacctgaagtacgttacataa

SEQ ID NO: 9474855 - DNA, 22 bp, Homo sapiens
aaacctcttttaaggagttgtt

SEQ ID NO: 9474856 - DNA, 22 bp, Homo sapiens
aaacctcttctcaagatttctg

SEQ ID NO: 9474857 - DNA, 22 bp, Homo sapiens
aaacctctttccattagaggaa

SEQ ID NO: 9474858 - DNA, 22 bp, Homo sapiens
aaacctctgggttccgtggttt

SEQ ID NO: 9474859 - DNA, 22 bp, Homo sapiens
aaacctctgtgctatgacaccc

SEQ ID NO: 9474860 - DNA, 22 bp, Homo sapiens
aaacctcttaatggcctgtaat

SEQ ID NO: 9474861 - DNA, 22 bp, Homo sapiens
aaacctctgaatactgttggca

SEQ ID NO: 9474862 - DNA, 22 bp, Homo sapiens
aaacctctccactacatgacag

SEQ ID NO: 9474863 - DNA, 22 bp, Homo sapiens
aaacacaagaggcagggtacag

SEQ ID NO: 9474864 - DNA, 22 bp, Homo sapiens
aaacaatttccacctctcctga

SEQ ID NO: 9474865 - DNA, 22 bp, Homo sapiens
aaacaatgtagattaccattta

SEQ ID NO: 9474866 - DNA, 22 bp, Homo sapiens
aaacaatgttcctatattagag

SEQ ID NO: 9474867 - DNA, 22 bp, Homo sapiens
aaacaatgttcctatattagag

SEQ ID NO: 9474868 - DNA, 22 bp, Homo sapiens
aaacagtgcaggaagttaagca

SEQ ID NO: 9474869 - DNA, 22 bp, Homo sapiens
aaacagtgactggtacataata

SEQ ID NO: 9474870 - DNA, 22 bp, Homo sapiens
aaacagtgactggtacataata

SEQ ID NO: 9474871 - DNA, 22 bp, Homo sapiens
aaacagctgtcattgttttaaa

SEQ ID NO: 9474872 - DNA, 22 bp, Homo sapiens
aaacacaagaggcagggtacag

SEQ ID NO: 9474873 - DNA, 22 bp, Homo sapiens
aaacagcttgtaaggtgtaatt

SEQ ID NO: 9474874 - DNA, 22 bp, Homo sapiens
aaacagctgtcattgttttaaa

SEQ ID NO: 9474875 - DNA, 22 bp, Homo sapiens
aaacaatgtacacatgaatgtt

SEQ ID NO: 9474876 - DNA, 22 bp, Homo sapiens
aaacaatgtacacatgaatgtt

SEQ ID NO: 9474877 - DNA, 22 bp, Homo sapiens
aaacaatgtacatttataatgc

SEQ ID NO: 9474878 - DNA, 22 bp, Homo sapiens
aaacaatgtacatttataatgc

SEQ ID NO: 9474879 - DNA, 17 bp, Homo sapiens
aaacaatgcagacaagc

SEQ ID NO: 9474880 - DNA, 22 bp, Homo sapiens
aaacaatgtagattaccattta

SEQ ID NO: 9474881 - DNA, 22 bp, Homo sapiens
aaacaatgtagattaccattta

SEQ ID NO: 9474882 - DNA, 22 bp, Homo sapiens
aaacaatgtacatttataatgc

SEQ ID NO: 9474883 - DNA, 22 bp, Homo sapiens
aaacaatgtacatttataatgc

SEQ ID NO: 9474884 - DNA, 22 bp, Homo sapiens
aaacaatgtacatttataatgc

SEQ ID NO: 9474885 - DNA, 22 bp, Homo sapiens
aaacaatgacaacacagctgcg

SEQ ID NO: 9474886 - DNA, 22 bp, Homo sapiens
aaacaatgagcttttacacact

SEQ ID NO: 9474887 - DNA, 22 bp, Homo sapiens
aaacaatgacaacacagctgcg

SEQ ID NO: 9474888 - DNA, 22 bp, Homo sapiens
aaacaatgacaacacagctgcg

SEQ ID NO: 9474889 - DNA, 22 bp, Homo sapiens
aaacaatgagcttttacacact

SEQ ID NO: 9474890 - DNA, 22 bp, Homo sapiens
aaacaatgagcttttacacact

SEQ ID NO: 9474891 - DNA, 22 bp, Homo sapiens
aaacagtttcattttcatgacc

SEQ ID NO: 9474892 - DNA, 22 bp, Homo sapiens
aaagggctgtcaaataagcaac

SEQ ID NO: 9474893 - DNA, 22 bp, Homo sapiens
aaacagtttctaatcatggaga

SEQ ID NO: 9474894 - DNA, 22 bp, Homo sapiens
aaacagtttctaatcatggaga

SEQ ID NO: 9474895 - DNA, 22 bp, Homo sapiens
aaacagtttcattttcatgacc

SEQ ID NO: 9474896 - DNA, 22 bp, Homo sapiens
aaaggtaacagttataaccagg

SEQ ID NO: 9474897 - DNA, 22 bp, Homo sapiens
aaaggtaactggggttttgcca

SEQ ID NO: 9474898 - DNA, 22 bp, Homo sapiens
aaaggtaaagtatctgcccaag

SEQ ID NO: 9474899 - DNA, 22 bp, Homo sapiens
aaaggtaacagttataaccagg

SEQ ID NO: 9474900 - DNA, 22 bp, Homo sapiens
aaagggttgttgtaaggattat

SEQ ID NO: 9474901 - DNA, 22 bp, Homo sapiens
aaaggtagtacttctagaaggg

SEQ ID NO: 9474902 - DNA, 22 bp, Homo sapiens
aaaggtatcatgtccatacagt

SEQ ID NO: 9474903 - DNA, 22 bp, Homo sapiens
aaaggtatgatactgtgacatg

SEQ ID NO: 9474904 - DNA, 22 bp, Homo sapiens
aaaggtatgatactgtgacatg

SEQ ID NO: 9474905 - DNA, 22 bp, Homo sapiens
aaaggtcaaaatcgtgacattg

SEQ ID NO: 9474906 - DNA, 22 bp, Homo sapiens
aaaggtcagacttaggctgggc

SEQ ID NO: 9474907 - DNA, 22 bp, Homo sapiens
aaaggtcttaaggttaagcagg

SEQ ID NO: 9474908 - DNA, 22 bp, Homo sapiens
aaaggtcattgaaaaggaggaa

SEQ ID NO: 9474909 - DNA, 22 bp, Homo sapiens
aaaggtcattgaaaaggaggaa

SEQ ID NO: 9474910 - DNA, 22 bp, Homo sapiens
aaacagttctcatttgtttaga

SEQ ID NO: 9474911 - DNA, 22 bp, Homo sapiens
aaacagtttataacatgatact

SEQ ID NO: 9474912 - DNA, 22 bp, Homo sapiens
aaacagtttcattttcatgacc

SEQ ID NO: 9474913 - DNA, 22 bp, Homo sapiens
aaacagtttcattttcatgacc

SEQ ID NO: 9474914 - DNA, 22 bp, Homo sapiens
aaacagtggccaattctggaga

SEQ ID NO: 9474915 - DNA, 22 bp, Homo sapiens
aaacagtgcctggcatggagga

SEQ ID NO: 9474916 - DNA, 22 bp, Homo sapiens
aaacagtgtttttatgatttat

SEQ ID NO: 9474917 - DNA, 22 bp, Homo sapiens
aaagagttctgtttgagctgaa

SEQ ID NO: 9474918 - DNA, 22 bp, Homo sapiens
aaagagttctgtttgagctgaa

SEQ ID NO: 9474919 - DNA, 22 bp, Homo sapiens
aaagagttgaggcagttatcca

SEQ ID NO: 9474920 - DNA, 22 bp, Homo sapiens
aaattaagagtaactctgtaga

SEQ ID NO: 9474921 - DNA, 22 bp, Homo sapiens
aaagagttgttgtataacagga

SEQ ID NO: 9474922 - DNA, 22 bp, Homo sapiens
aaagaggggactgttaattcca

SEQ ID NO: 9474923 - DNA, 20 bp, Homo sapiens
aaattactgccacacatttc

SEQ ID NO: 9474924 - DNA, 22 bp, Homo sapiens
aaattaccattgtaaagtattt

SEQ ID NO: 9474925 - DNA, 22 bp, Homo sapiens
aaattaagggtgagaagagttg

SEQ ID NO: 9474926 - DNA, 22 bp, Homo sapiens
aaattacagatcaccaatgcat

SEQ ID NO: 9474927 - DNA, 22 bp, Homo sapiens
aaattaagggtgagaagagttg

SEQ ID NO: 9474928 - DNA, 22 bp, Homo sapiens
aaattaagggtgagaagagttg

SEQ ID NO: 9474929 - DNA, 22 bp, Homo sapiens
aaattagaccagggctcctgga

SEQ ID NO: 9474930 - DNA, 22 bp, Homo sapiens
aaattagaagtgctcaggaata

SEQ ID NO: 9474931 - DNA, 22 bp, Homo sapiens
aaattagaaatactttcaaagc

SEQ ID NO: 9474932 - DNA, 20 bp, Homo sapiens
aaattactgccacacatttc

SEQ ID NO: 9474933 - DNA, 22 bp, Homo sapiens
aaattactttacactttcatct

SEQ ID NO: 9474934 - DNA, 22 bp, Homo sapiens
aaatgcagatccctgaatctca

SEQ ID NO: 9474935 - DNA, 22 bp, Homo sapiens
aaatgcagatccctgaatctca

SEQ ID NO: 9474936 - DNA, 22 bp, Homo sapiens
aaatgcagatccctgaatctca

SEQ ID NO: 9474937 - DNA, 22 bp, Homo sapiens
aaatgcagatccctgaatctca

SEQ ID NO: 9474938 - DNA, 22 bp, Homo sapiens
aaatgcagacagcttcacacac

SEQ ID NO: 9474939 - DNA, 22 bp, Homo sapiens
aaatgcagattgtcattcagga

SEQ ID NO: 9474940 - DNA, 22 bp, Homo sapiens
aaatgcagattgtcattcagga

SEQ ID NO: 9474941 - DNA, 22 bp, Homo sapiens
aaatgcagattttgatgcagca

SEQ ID NO: 9474942 - DNA, 22 bp, Homo sapiens
aaatgcagaatgatttcatcta

SEQ ID NO: 9474943 - DNA, 22 bp, Homo sapiens
aaatgcactgaatattccaaat

SEQ ID NO: 9474944 - DNA, 22 bp, Homo sapiens
aaatgcagaatctcagacccca

SEQ ID NO: 9474945 - DNA, 22 bp, Homo sapiens
aaatgcactgaacacatgttgt

SEQ ID NO: 9474946 - DNA, 22 bp, Homo sapiens
aaagacacaaatgtagaccaaa

SEQ ID NO: 9474947 - DNA, 22 bp, Homo sapiens
aaatgcacgctacccagctaga

SEQ ID NO: 9474948 - DNA, 22 bp, Homo sapiens
aaatgcactgaacacatgttgt

SEQ ID NO: 9474949 - DNA, 22 bp, Homo sapiens
aaatgcactctgcttctgtgac

SEQ ID NO: 9474950 - DNA, 22 bp, Homo sapiens
aaatgcagcagctaattgaaaa

SEQ ID NO: 9474951 - DNA, 22 bp, Homo sapiens
aaagagcaccctcaatgtctga

SEQ ID NO: 9474952 - DNA, 21 bp, Homo sapiens
aaagagcttttgtgctagtta

SEQ ID NO: 9474953 - DNA, 22 bp, Homo sapiens
aaagaggaaccaagagcacgtg

SEQ ID NO: 9474954 - DNA, 22 bp, Homo sapiens
aaagaggctcaaggtgggccag

SEQ ID NO: 9474955 - DNA, 22 bp, Homo sapiens
aaagaggctcaaggtgggccag

SEQ ID NO: 9474956 - DNA, 22 bp, Homo sapiens
aaagaggcaatcaatgtagcaa

SEQ ID NO: 9474957 - DNA, 22 bp, Homo sapiens
aaagaggcaatcaatgtagcaa

SEQ ID NO: 9474958 - DNA, 22 bp, Homo sapiens
aaagaaggtagggctggtgact

SEQ ID NO: 9474959 - DNA, 22 bp, Homo sapiens
aaagaagtgttgaatttgcaag

SEQ ID NO: 9474960 - DNA, 22 bp, Homo sapiens
aaagaagtgttgaatttgcaag

SEQ ID NO: 9474961 - DNA, 22 bp, Homo sapiens
aaagaataccctgggtcataaa

SEQ ID NO: 9474962 - DNA, 22 bp, Homo sapiens
aaactgagtggcttataaacaa

SEQ ID NO: 9474963 - DNA, 21 bp, Homo sapiens
aaagaacaggcagatgttctt

SEQ ID NO: 9474964 - DNA, 22 bp, Homo sapiens
aaactgattttaacattgatat

SEQ ID NO: 9474965 - DNA, 21 bp, Homo sapiens
aaagaatcatgggtaatttca

SEQ ID NO: 9474966 - DNA, 22 bp, Homo sapiens
aaagaatcagaagtctcaaaca

SEQ ID NO: 9474967 - DNA, 22 bp, Homo sapiens
aaagaatgcagtgccttccagc

SEQ ID NO: 9474968 - DNA, 22 bp, Homo sapiens
aaagacacaaatgtagaccaaa

SEQ ID NO: 9474969 - DNA, 22 bp, Homo sapiens
aaagacacaaatgtagaccaaa

SEQ ID NO: 9474970 - DNA, 22 bp, Homo sapiens
aaagacacaaatgtagaccaaa

SEQ ID NO: 9474971 - DNA, 22 bp, Homo sapiens
aaagaatgtctgaacagctggc

SEQ ID NO: 9474972 - DNA, 22 bp, Homo sapiens
aaagaatttgtacaccctacta

SEQ ID NO: 9474973 - DNA, 22 bp, Homo sapiens
aaagaatactccttttgccttg

SEQ ID NO: 9474974 - DNA, 22 bp, Homo sapiens
aaagaatactccttttgccttg

SEQ ID NO: 9474975 - DNA, 22 bp, Homo sapiens
aaagaatagcctttgtccaaat

SEQ ID NO: 9474976 - DNA, 22 bp, Homo sapiens
aaagaatagcctttgtccaaat

SEQ ID NO: 9474977 - DNA, 21 bp, Homo sapiens
aaactgaggcttcaagcagtg

SEQ ID NO: 9474978 - DNA, 22 bp, Homo sapiens
aaactgaggctcccgagggtgt

SEQ ID NO: 9474979 - DNA, 21 bp, Homo sapiens
aaactgaggcttcaagcagtg

SEQ ID NO: 9474980 - DNA, 22 bp, Homo sapiens
aaactgaggagttagactaggg

SEQ ID NO: 9474981 - DNA, 22 bp, Homo sapiens
aaactgaggagttagactaggg

SEQ ID NO: 9474982 - DNA, 22 bp, Homo sapiens
aaactgaggagttagactaggg

SEQ ID NO: 9474983 - DNA, 22 bp, Homo sapiens
aaactgaggaacaaggaaggat

SEQ ID NO: 9474984 - DNA, 22 bp, Homo sapiens
aaactgaggaacaaggaaggat

SEQ ID NO: 9474985 - DNA, 21 bp, Homo sapiens
aaactgaccttgcctgagaca

SEQ ID NO: 9474986 - DNA, 22 bp, Homo sapiens
aaactgagaccgaaaggggtag

SEQ ID NO: 9474987 - DNA, 22 bp, Homo sapiens
aaactgaattcaagtatccagt

SEQ ID NO: 9474988 - DNA, 22 bp, Homo sapiens
aaactgaattcccaagggcatg

SEQ ID NO: 9474989 - DNA, 22 bp, Homo sapiens
aaactgaagccttggagtgaca

SEQ ID NO: 9474990 - DNA, 22 bp, Homo sapiens
aaactgaattcaagtatccagt

SEQ ID NO: 9474991 - DNA, 22 bp, Homo sapiens
aaactgaattcccaagggcatg

SEQ ID NO: 9474992 - DNA, 22 bp, Homo sapiens
aaactgaattcccaagggcatg

SEQ ID NO: 9474993 - DNA, 21 bp, Homo sapiens
aaactgaccttgcctgagaca

SEQ ID NO: 9474994 - DNA, 22 bp, Homo sapiens
aaactctgttgagataatattt

SEQ ID NO: 9474995 - DNA, 17 bp, Homo sapiens
aaactgaaaaattcact

SEQ ID NO: 9474996 - DNA, 22 bp, Homo sapiens
aaactcttttgcatattagagg

SEQ ID NO: 9474997 - DNA, 17 bp, Homo sapiens
aaactgaaaaattcact

SEQ ID NO: 9474998 - DNA, 21 bp, Homo sapiens
aaactgaagagacaggaactt

SEQ ID NO: 9474999 - DNA, 22 bp, Homo sapiens
aaactagatgattatgaagcat

SEQ ID NO: 9475000 - DNA, 22 bp, Homo sapiens
aaactagatgattatgaagcat

SEQ ID NO: 9475001 - DNA, 22 bp, Homo sapiens
aaactagattaccactgctaga

SEQ ID NO: 9475002 - DNA, 22 bp, Homo sapiens
aaaagagagttgccagtctgta

SEQ ID NO: 9475003 - DNA, 22 bp, Homo sapiens
aaaagagagttgccagtctgta

SEQ ID NO: 9475004 - DNA, 22 bp, Homo sapiens
aaaagagagttgccagtctgta

SEQ ID NO: 9475005 - DNA, 22 bp, Homo sapiens
aaaagagcaaacatgtaatagt

SEQ ID NO: 9475006 - DNA, 22 bp, Homo sapiens
aaaagagcaaacatgtaatagt

SEQ ID NO: 9475007 - DNA, 22 bp, Homo sapiens
aaaagagaaagtggcaggcttt

SEQ ID NO: 9475008 - DNA, 22 bp, Homo sapiens
aaaagagaatcctgtacagaga

SEQ ID NO: 9475009 - DNA, 22 bp, Homo sapiens
aaaagagaaagtggcaggcttt

SEQ ID NO: 9475010 - DNA, 22 bp, Homo sapiens
aaaagagagctgaggagctcca

SEQ ID NO: 9475011 - DNA, 22 bp, Homo sapiens
aaaagagaatcctgtacagaga

SEQ ID NO: 9475012 - DNA, 22 bp, Homo sapiens
aaaagagaatcctgtacagaga

SEQ ID NO: 9475013 - DNA, 22 bp, Homo sapiens
aaaagagaatcctgtacagaga

SEQ ID NO: 9475014 - DNA, 22 bp, Homo sapiens
aaaagagaatcctgtacagaga

SEQ ID NO: 9475015 - DNA, 22 bp, Homo sapiens
aaaagagagctgaggagctcca

SEQ ID NO: 9475016 - DNA, 20 bp, Homo sapiens
aaactagattagcagggcag

SEQ ID NO: 9475017 - DNA, 21 bp, Homo sapiens
aaactagcagcaaccatgatc

SEQ ID NO: 9475018 - DNA, 22 bp, Homo sapiens
aaactatccctgccataatttt

SEQ ID NO: 9475019 - DNA, 22 bp, Homo sapiens
aaactatccctgccataatttt

SEQ ID NO: 9475020 - DNA, 22 bp, Homo sapiens
aaactatcaagtgttgggggag

SEQ ID NO: 9475021 - DNA, 22 bp, Homo sapiens
aaactagtatgtatattaccaa

SEQ ID NO: 9475022 - DNA, 22 bp, Homo sapiens
aaactcaaggatttagacgaag

SEQ ID NO: 9475023 - DNA, 22 bp, Homo sapiens
aaactcaagtctatgaacaagg

SEQ ID NO: 9475024 - DNA, 22 bp, Homo sapiens
aaactcaagtctatgaacaagg

SEQ ID NO: 9475025 - DNA, 22 bp, Homo sapiens
aaactcaagtctatgaacaagg

SEQ ID NO: 9475026 - DNA, 22 bp, Homo sapiens
aaactcaaattaaactagctta

SEQ ID NO: 9475027 - DNA, 22 bp, Homo sapiens
aaactcaaattaaactagctta

SEQ ID NO: 9475028 - DNA, 22 bp, Homo sapiens
aaactcaaattaaactagctta

SEQ ID NO: 9475029 - DNA, 22 bp, Homo sapiens
aaactcaaagtcagatcagaga

SEQ ID NO: 9475030 - DNA, 22 bp, Homo sapiens
aaactcaaagtcagatcagaga

SEQ ID NO: 9475031 - DNA, 19 bp, Homo sapiens
aaactcatagactcatatt

SEQ ID NO: 9475032 - DNA, 22 bp, Homo sapiens
aaactcagaaggtacagaaggg

SEQ ID NO: 9475033 - DNA, 22 bp, Homo sapiens
aaactcaagtctatgaacaagg

SEQ ID NO: 9475034 - DNA, 22 bp, Homo sapiens
aaactcaagtctatgaacaagg

SEQ ID NO: 9475035 - DNA, 22 bp, Homo sapiens
aaactcaagtttcttaatgtca

SEQ ID NO: 9475036 - DNA, 22 bp, Homo sapiens
aaactcaagtttcttaatgtca

SEQ ID NO: 9475037 - DNA, 22 bp, Homo sapiens
aaaagtatttatggctatgtaa

SEQ ID NO: 9475038 - DNA, 22 bp, Homo sapiens
aaagaaggggtctacatccaat

SEQ ID NO: 9475039 - DNA, 22 bp, Homo sapiens
aaagaagggacagactgcctct

SEQ ID NO: 9475040 - DNA, 22 bp, Homo sapiens
aaagacatggaactagagatgg

SEQ ID NO: 9475041 - DNA, 22 bp, Homo sapiens
aaagacatggaactagagatgg

SEQ ID NO: 9475042 - DNA, 22 bp, Homo sapiens
aaagaaggggtctacatccaat

SEQ ID NO: 9475043 - DNA, 22 bp, Homo sapiens
aaaagtattggccaccatttct

SEQ ID NO: 9475044 - DNA, 22 bp, Homo sapiens
aaaagtattggccaccatttct

SEQ ID NO: 9475045 - DNA, 22 bp, Homo sapiens
aaaagtattggccaccatttct

SEQ ID NO: 9475046 - DNA, 22 bp, Homo sapiens
aaaagtattggccaccatttct

SEQ ID NO: 9475047 - DNA, 22 bp, Homo sapiens
aaaagtattggccaccatttct

SEQ ID NO: 9475048 - DNA, 22 bp, Homo sapiens
aaaagtatggtggtccttttta

SEQ ID NO: 9475049 - DNA, 22 bp, Homo sapiens
aaaagtatggtggtccttttta

SEQ ID NO: 9475050 - DNA, 22 bp, Homo sapiens
aaaagtatggtggtccttttta

SEQ ID NO: 9475051 - DNA, 22 bp, Homo sapiens
aaaagtatggtggtccttttta

SEQ ID NO: 9475052 - DNA, 22 bp, Homo sapiens
aaaagtatggtggtccttttta

SEQ ID NO: 9475053 - DNA, 22 bp, Homo sapiens
aaaagtatagggtttggagtca

SEQ ID NO: 9475054 - DNA, 22 bp, Homo sapiens
aaaagtatccacagctcaggag

SEQ ID NO: 9475055 - DNA, 22 bp, Homo sapiens
aaaagtatccacagctcaggag

SEQ ID NO: 9475056 - DNA, 22 bp, Homo sapiens
aaaagtatggtggtccttttta

SEQ ID NO: 9475057 - DNA, 22 bp, Homo sapiens
aaaagtatagggtttggagtca

SEQ ID NO: 9475058 - DNA, 22 bp, Homo sapiens
aaaagtactattttaacaaagt

SEQ ID NO: 9475059 - DNA, 22 bp, Homo sapiens
aaaagtatagggtttggagtca

SEQ ID NO: 9475060 - DNA, 22 bp, Homo sapiens
aaaagtactattttaacaaagt

SEQ ID NO: 9475061 - DNA, 22 bp, Homo sapiens
aaaagtaattgtggtttttgcc

SEQ ID NO: 9475062 - DNA, 22 bp, Homo sapiens
aaaagtaattgtggtttttgct

SEQ ID NO: 9475063 - DNA, 22 bp, Homo sapiens
aaaagtaattgtggtttttgct

SEQ ID NO: 9475064 - DNA, 22 bp, Homo sapiens
aaaagtaattgtggtttttgct

SEQ ID NO: 9475065 - DNA, 22 bp, Homo sapiens
aaactctaatcaaatatagcat

SEQ ID NO: 9475066 - DNA, 22 bp, Homo sapiens
aaactctagctactaggataac

SEQ ID NO: 9475067 - DNA, 22 bp, Homo sapiens
aaactcctgggctcaagcagtt

SEQ ID NO: 9475068 - DNA, 22 bp, Homo sapiens
aaactcctgcatactcagaagc

SEQ ID NO: 9475069 - DNA, 22 bp, Homo sapiens
aaactccagtgaatactagaat

SEQ ID NO: 9475070 - DNA, 23 bp, Homo sapiens
aaaatcattaatttaccctgaaa

SEQ ID NO: 9475071 - DNA, 23 bp, Homo sapiens
aaaatcattaatttaccctgaaa

SEQ ID NO: 9475072 - DNA, 22 bp, Homo sapiens
aaaatccacaacgctcatttca

SEQ ID NO: 9475073 - DNA, 23 bp, Homo sapiens
aaaatcattaatttaccctgaaa

SEQ ID NO: 9475074 - DNA, 22 bp, Homo sapiens
aaaatcctctaattctagaata

SEQ ID NO: 9475075 - DNA, 22 bp, Homo sapiens
aaaatcctctaattctagaata

SEQ ID NO: 9475076 - DNA, 22 bp, Homo sapiens
aaaatccacaacgctcatttca

SEQ ID NO: 9475077 - DNA, 22 bp, Homo sapiens
aaaatcctctaattctagaata

SEQ ID NO: 9475078 - DNA, 22 bp, Homo sapiens
aaaatcctctaattctagaata

SEQ ID NO: 9475079 - DNA, 22 bp, Homo sapiens
aaaatcctgctgactcgagatg

SEQ ID NO: 9475080 - DNA, 22 bp, Homo sapiens
aaagactaaccagttgtcaaaa

SEQ ID NO: 9475081 - DNA, 22 bp, Homo sapiens
aaaatcagtacactttattttg

SEQ ID NO: 9475082 - DNA, 22 bp, Homo sapiens
aaaatcagtacactttattttg

SEQ ID NO: 9475083 - DNA, 21 bp, Homo sapiens
aaaatcaccttaggtcactgg

SEQ ID NO: 9475084 - DNA, 22 bp, Homo sapiens
aaaatcagtacactttattttg

SEQ ID NO: 9475085 - DNA, 22 bp, Homo sapiens
aaaatcagtacactttattttg

SEQ ID NO: 9475086 - DNA, 22 bp, Homo sapiens
aaaatcagtacactttattttg

SEQ ID NO: 9475087 - DNA, 22 bp, Homo sapiens
aaagacattgaagaaggactta

SEQ ID NO: 9475088 - DNA, 22 bp, Homo sapiens
aaagaccatgtttacagctagg

SEQ ID NO: 9475089 - DNA, 22 bp, Homo sapiens
aaagaccatgtttacagctagg

SEQ ID NO: 9475090 - DNA, 22 bp, Homo sapiens
aaagacattagcttagatgtca

SEQ ID NO: 9475091 - DNA, 23 bp, Homo sapiens
aaagacctaggatgagggagacg

SEQ ID NO: 9475092 - DNA, 22 bp, Homo sapiens
aaagacctgaaatataatctag

SEQ ID NO: 9475093 - DNA, 22 bp, Homo sapiens
aaagacctgtggtagctctaaa

SEQ ID NO: 9475094 - DNA, 22 bp, Homo sapiens
aaagactaaacaaccaatatct

SEQ ID NO: 9475095 - DNA, 22 bp, Homo sapiens
aaagacatggaactagagatgg

SEQ ID NO: 9475096 - DNA, 22 bp, Homo sapiens
aaagacattagcttagatgtca

SEQ ID NO: 9475097 - DNA, 22 bp, Homo sapiens
aaagacattagattaacgtaca

SEQ ID NO: 9475098 - DNA, 22 bp, Homo sapiens
aaagacattagattaacgtaca

SEQ ID NO: 9475099 - DNA, 22 bp, Homo sapiens
aaacaatccaggaacctgttta

SEQ ID NO: 9475100 - DNA, 22 bp, Homo sapiens
aaacaatccaggaacctgttta

SEQ ID NO: 9475101 - DNA, 22 bp, Homo sapiens
aaacaagtttgtagactagcca

SEQ ID NO: 9475102 - DNA, 22 bp, Homo sapiens
aaacaagtttagaataatgaat

SEQ ID NO: 9475103 - DNA, 22 bp, Homo sapiens
aaacaagtttagaataatgaat

SEQ ID NO: 9475104 - DNA, 22 bp, Homo sapiens
aaacaagtttgtagactagcca

SEQ ID NO: 9475105 - DNA, 22 bp, Homo sapiens
aaacaatgaaatatttttatgg

SEQ ID NO: 9475106 - DNA, 22 bp, Homo sapiens
aaacaatgaaatatttttatgg

SEQ ID NO: 9475107 - DNA, 22 bp, Homo sapiens
aaacaatgaaatatttttatgg

SEQ ID NO: 9475108 - DNA, 22 bp, Homo sapiens
aaacaatgaaattcattcttca

SEQ ID NO: 9475109 - DNA, 22 bp, Homo sapiens
aaacaagtcactttatcttgaa

SEQ ID NO: 9475110 - DNA, 23 bp, Homo sapiens
aaacaagtctctcaatggcttgc

SEQ ID NO: 9475111 - DNA, 22 bp, Homo sapiens
aaacaagtttagaataatgaat

SEQ ID NO: 9475112 - DNA, 22 bp, Homo sapiens
aaacaagtttagaataatgaat

SEQ ID NO: 9475113 - DNA, 22 bp, Homo sapiens
aaacaaggtacacagtaatggt

SEQ ID NO: 9475114 - DNA, 22 bp, Homo sapiens
aaacaagctgcagacaagccat

SEQ ID NO: 9475115 - DNA, 22 bp, Homo sapiens
aaacaagctgcagacaagccat

SEQ ID NO: 9475116 - DNA, 22 bp, Homo sapiens
aaacaagctgcagacaagccat

SEQ ID NO: 9475117 - DNA, 23 bp, Homo sapiens
aaacaagccctaatgaagagtcc

SEQ ID NO: 9475118 - DNA, 22 bp, Homo sapiens
aaaattttgccctatccttcat

SEQ ID NO: 9475119 - DNA, 20 bp, Homo sapiens
aaaatctcccagaaacttat

SEQ ID NO: 9475120 - DNA, 22 bp, Homo sapiens
aaaatctaagtagcgagtaagg

SEQ ID NO: 9475121 - DNA, 22 bp, Homo sapiens
aaaatctaagtagcgagtaagg

SEQ ID NO: 9475122 - DNA, 22 bp, Homo sapiens
aaaatccttagccgagtgaggt

SEQ ID NO: 9475123 - DNA, 22 bp, Homo sapiens
aaaatctcattatcaggaaggg

SEQ ID NO: 9475124 - DNA, 22 bp, Homo sapiens
aaaatctaagtagcgagtaagg

SEQ ID NO: 9475125 - DNA, 22 bp, Homo sapiens
aaaatctcattatcaggaaggg

SEQ ID NO: 9475126 - DNA, 20 bp, Homo sapiens
aaaatctcccagaaacttat

SEQ ID NO: 9475127 - DNA, 22 bp, Homo sapiens
aaaaacacaactgtctttctct

SEQ ID NO: 9475128 - DNA, 22 bp, Homo sapiens
aaaaaattccattctgtgcctt

SEQ ID NO: 9475129 - DNA, 22 bp, Homo sapiens
aaaaaattatcatagttcctga

SEQ ID NO: 9475130 - DNA, 22 bp, Homo sapiens
aaaaaattccattctgtgcctt

SEQ ID NO: 9475131 - DNA, 22 bp, Homo sapiens
aaaaacacaactgtctttctct

SEQ ID NO: 9475132 - DNA, 22 bp, Homo sapiens
aaaaacagaatgtgtctaactc

SEQ ID NO: 9475133 - DNA, 20 bp, Homo sapiens
aaaaacagtaatgctgaaga

SEQ ID NO: 9475134 - DNA, 22 bp, Homo sapiens
aaaaacactgggctgggagtca

SEQ ID NO: 9475135 - DNA, 22 bp, Homo sapiens
aaaaacactgggctgggagtca

SEQ ID NO: 9475136 - DNA, 22 bp, Homo sapiens
aaaaacagaatgtgtctaactc

SEQ ID NO: 9475137 - DNA, 23 bp, Homo sapiens
aaaaaaccatgtaggcactcagt

SEQ ID NO: 9475138 - DNA, 23 bp, Homo sapiens
aaaaaaccatgtaggcactcagt

SEQ ID NO: 9475139 - DNA, 23 bp, Homo sapiens
aaaaaaccatgtaggcactcagt

SEQ ID NO: 9475140 - DNA, 22 bp, Homo sapiens
aaaaaatcagatctttggttaa

SEQ ID NO: 9475141 - DNA, 22 bp, Homo sapiens
aaaaaagattgatggtggatgc

SEQ ID NO: 9475142 - DNA, 22 bp, Homo sapiens
aaaaaagattgatggtggatgc

SEQ ID NO: 9475143 - DNA, 22 bp, Homo sapiens
aaaaaagattgatggtggatgc

SEQ ID NO: 9475144 - DNA, 22 bp, Homo sapiens
aaaaaattatcatagttcctga

SEQ ID NO: 9475145 - DNA, 22 bp, Homo sapiens
aaaaaattatcatagttcctga

SEQ ID NO: 9475146 - DNA, 22 bp, Homo sapiens
aaaaaattatcatagttcctga

SEQ ID NO: 9475147 - DNA, 22 bp, Homo sapiens
aaaaaatcagatctttggttaa

SEQ ID NO: 9475148 - DNA, 22 bp, Homo sapiens
aaaatgaagcaaaggcattcag

SEQ ID NO: 9475149 - DNA, 22 bp, Homo sapiens
aaaatgaacagaacaatgggga

SEQ ID NO: 9475150 - DNA, 22 bp, Homo sapiens
aaaatgaacagaacaatgggga

SEQ ID NO: 9475151 - DNA, 22 bp, Homo sapiens
aaaatcttgtgacttaggaagg

SEQ ID NO: 9475152 - DNA, 22 bp, Homo sapiens
aaaatcttgtgacttaggaagg

SEQ ID NO: 9475153 - DNA, 22 bp, Homo sapiens
aaaatcttgtgacttaggaagg

SEQ ID NO: 9475154 - DNA, 23 bp, Homo sapiens
aaaatcttctgcctatgaagaaa

SEQ ID NO: 9475155 - DNA, 23 bp, Homo sapiens
aaaatcttctgcctatgaagaaa

SEQ ID NO: 9475156 - DNA, 22 bp, Homo sapiens
aaaatcttgtgacttaggaagg

SEQ ID NO: 9475157 - DNA, 22 bp, Homo sapiens
aaaatcttgactgtttttagaa

SEQ ID NO: 9475158 - DNA, 22 bp, Homo sapiens
aaaatcttgactgtttttagaa

SEQ ID NO: 9475159 - DNA, 22 bp, Homo sapiens
aaaatcttgactgtttttagaa

SEQ ID NO: 9475160 - DNA, 22 bp, Homo sapiens
aaaatcttgactgtttttagaa

SEQ ID NO: 9475161 - DNA, 22 bp, Homo sapiens
aaaaacctttcattgcaaatgt

SEQ ID NO: 9475162 - DNA, 22 bp, Homo sapiens
aaaaacctcaattacttttgca

SEQ ID NO: 9475163 - DNA, 22 bp, Homo sapiens
aaaaacctcaattacttttgca

SEQ ID NO: 9475164 - DNA, 22 bp, Homo sapiens
aaaaaccattgtcttcagtctc

SEQ ID NO: 9475165 - DNA, 22 bp, Homo sapiens
aaaaaccattgtcttcagtctc

SEQ ID NO: 9475166 - DNA, 20 bp, Homo sapiens
aaaaacagtaatgctgaaga

SEQ ID NO: 9475167 - DNA, 22 bp, Homo sapiens
aaaaacctttcattgcaaatgt

SEQ ID NO: 9475168 - DNA, 22 bp, Homo sapiens
aaaaacctttcccatactaaga

SEQ ID NO: 9475169 - DNA, 22 bp, Homo sapiens
aaaatagttaacgttcagagta

SEQ ID NO: 9475170 - DNA, 22 bp, Homo sapiens
aaaatctggtaatttgaatgtg

SEQ ID NO: 9475171 - DNA, 22 bp, Homo sapiens
aaaatctggcaacactaagttt

SEQ ID NO: 9475172 - DNA, 22 bp, Homo sapiens
aaaatagttaacgttcagagta

SEQ ID NO: 9475173 - DNA, 22 bp, Homo sapiens
aaaagacaggtgtctgcggccc

SEQ ID NO: 9475174 - DNA, 22 bp, Homo sapiens
aaaagaacctagctcctcagtc

SEQ ID NO: 9475175 - DNA, 22 bp, Homo sapiens
aaacagactgaagagttgaagc

SEQ ID NO: 9475176 - DNA, 22 bp, Homo sapiens
aaacagactgcactgccagtca

SEQ ID NO: 9475177 - DNA, 22 bp, Homo sapiens
aaacagagagatgtatgtggag

SEQ ID NO: 9475178 - DNA, 22 bp, Homo sapiens
aaacagactgaagagttgaagc

SEQ ID NO: 9475179 - DNA, 22 bp, Homo sapiens
aaacagaagggtaggtaaacat

SEQ ID NO: 9475180 - DNA, 22 bp, Homo sapiens
aaaagacaggtgtctgcggccc

SEQ ID NO: 9475181 - DNA, 22 bp, Homo sapiens
aaaagacatatgtgggcattct

SEQ ID NO: 9475182 - DNA, 22 bp, Homo sapiens
aaaagacatctatttcaggcag

SEQ ID NO: 9475183 - DNA, 22 bp, Homo sapiens
aaaagacatctatttcaggcag

SEQ ID NO: 9475184 - DNA, 22 bp, Homo sapiens
aaaagagaaagtggcaggcttt

SEQ ID NO: 9475185 - DNA, 22 bp, Homo sapiens
aaacactttagaaagggacttg

SEQ ID NO: 9475186 - DNA, 22 bp, Homo sapiens
aaacacttgcaaaatggttcct

SEQ ID NO: 9475187 - DNA, 22 bp, Homo sapiens
aaacacttcttaggtcttaagt

SEQ ID NO: 9475188 - DNA, 22 bp, Homo sapiens
aaacacttcttaggtcttaagt

SEQ ID NO: 9475189 - DNA, 22 bp, Homo sapiens
aaacacttcctgtaacatgaca

SEQ ID NO: 9475190 - DNA, 22 bp, Homo sapiens
aaacacttcctgtaacatgaca

SEQ ID NO: 9475191 - DNA, 22 bp, Homo sapiens
aaacacttcctgtaacatgaca

SEQ ID NO: 9475192 - DNA, 22 bp, Homo sapiens
aaacacttcttaggtcttaagt

SEQ ID NO: 9475193 - DNA, 22 bp, Homo sapiens
aaacactgtgtcaaactggggc

SEQ ID NO: 9475194 - DNA, 22 bp, Homo sapiens
aaacactgtgggacatcttact

SEQ ID NO: 9475195 - DNA, 22 bp, Homo sapiens
aaacacttcaaggacttctgtc

SEQ ID NO: 9475196 - DNA, 22 bp, Homo sapiens
aaaaataggtcaaccgtgtatg

SEQ ID NO: 9475197 - DNA, 22 bp, Homo sapiens
aaaaataggtcaaccgtgtatg

SEQ ID NO: 9475198 - DNA, 22 bp, Homo sapiens
aaaaatcacttttataggcagc

SEQ ID NO: 9475199 - DNA, 22 bp, Homo sapiens
aaaaatcacttttataggcagc

SEQ ID NO: 9475200 - DNA, 22 bp, Homo sapiens
aaaaatcacttttataggcagc

SEQ ID NO: 9475201 - DNA, 22 bp, Homo sapiens
aaaaatcacttttataggcagc

SEQ ID NO: 9475202 - DNA, 22 bp, Homo sapiens
aaaaatcacttttataggcagc

SEQ ID NO: 9475203 - DNA, 22 bp, Homo sapiens
aaaaatcacttttataggcagc

SEQ ID NO: 9475204 - DNA, 22 bp, Homo sapiens
aaaaatcacttttataggcagc

SEQ ID NO: 9475205 - DNA, 22 bp, Homo sapiens
aaaaatcacttttataggcagc

SEQ ID NO: 9475206 - DNA, 22 bp, Homo sapiens
aaacacaggtactgcagaagtg

SEQ ID NO: 9475207 - DNA, 22 bp, Homo sapiens
aaacactgtgggacatcttact

SEQ ID NO: 9475208 - DNA, 22 bp, Homo sapiens
aaaaatcacttttataggcagc

SEQ ID NO: 9475209 - DNA, 22 bp, Homo sapiens
aaaaatctatgactgcttctcc

SEQ ID NO: 9475210 - DNA, 22 bp, Homo sapiens
aaaaatctatgactgcttctcc

SEQ ID NO: 9475211 - DNA, 22 bp, Homo sapiens
aaaaatagcttctcttgtccct

SEQ ID NO: 9475212 - DNA, 22 bp, Homo sapiens
aaaaatagcttctcttgtccct

SEQ ID NO: 9475213 - DNA, 22 bp, Homo sapiens
aaaaatagcttctcttgtccct

SEQ ID NO: 9475214 - DNA, 22 bp, Homo sapiens
aaaaatagaaggattgactgag

SEQ ID NO: 9475215 - DNA, 22 bp, Homo sapiens
aaaaatagaaggattgactgag

SEQ ID NO: 9475216 - DNA, 22 bp, Homo sapiens
aaaaatagaaggattgactgag

SEQ ID NO: 9475217 - DNA, 22 bp, Homo sapiens
aaaaatagaaggattgactgag

SEQ ID NO: 9475218 - DNA, 22 bp, Homo sapiens
aaaaatagaaggattgactgag

SEQ ID NO: 9475219 - DNA, 22 bp, Homo sapiens
aaaatgaataagttaacccagg

SEQ ID NO: 9475220 - DNA, 22 bp, Homo sapiens
aaaatgaataagttaacccagg

SEQ ID NO: 9475221 - DNA, 22 bp, Homo sapiens
aaaatgacattccagtgatatt

SEQ ID NO: 9475222 - DNA, 22 bp, Homo sapiens
aaaatgaataagttaacccagg

SEQ ID NO: 9475223 - DNA, 22 bp, Homo sapiens
aaaatgacattccagtgatatt

SEQ ID NO: 9475224 - DNA, 22 bp, Homo sapiens
aaaaatagaaggattgactgag

SEQ ID NO: 9475225 - DNA, 22 bp, Homo sapiens
aaatagcagctttgacagcaca

SEQ ID NO: 9475226 - DNA, 22 bp, Homo sapiens
aaatagcagctttgacagcaca

SEQ ID NO: 9475227 - DNA, 22 bp, Homo sapiens
aaatagcagcctttagttaaca

SEQ ID NO: 9475228 - DNA, 22 bp, Homo sapiens
aaatagcagcctttagttaaca

SEQ ID NO: 9475229 - DNA, 22 bp, Homo sapiens
aaatagctacatgatctctagg

SEQ ID NO: 9475230 - DNA, 22 bp, Homo sapiens
aaatagcattgtatttagctga

SEQ ID NO: 9475231 - DNA, 22 bp, Homo sapiens
aaatagcttttcataattctca

SEQ ID NO: 9475232 - DNA, 22 bp, Homo sapiens
aaatagcttctaagccttttga

SEQ ID NO: 9475233 - DNA, 22 bp, Homo sapiens
aaatagcttttcataattctca

SEQ ID NO: 9475234 - DNA, 22 bp, Homo sapiens
aaatagctacatgatctctagg

SEQ ID NO: 9475235 - DNA, 22 bp, Homo sapiens
aaatagctacatgatctctagg

SEQ ID NO: 9475236 - DNA, 22 bp, Homo sapiens
aaatagctgaaagttcctagat

SEQ ID NO: 9475237 - DNA, 23 bp, Homo sapiens
aaataggagtatctggatcatga

SEQ ID NO: 9475238 - DNA, 23 bp, Homo sapiens
aaataggagtatctggatcatga

SEQ ID NO: 9475239 - DNA, 22 bp, Homo sapiens
aaataggagcttaagcacttct

SEQ ID NO: 9475240 - DNA, 23 bp, Homo sapiens
aaataggagtatctggatcatga

SEQ ID NO: 9475241 - DNA, 23 bp, Homo sapiens
aaataggagtatctggatcatga

SEQ ID NO: 9475242 - DNA, 22 bp, Homo sapiens
aaatcagatcttacacaattgt

SEQ ID NO: 9475243 - DNA, 22 bp, Homo sapiens
aaatcagatgcttcctagttgg

SEQ ID NO: 9475244 - DNA, 22 bp, Homo sapiens
aaatccatcaaatcttctagaa

SEQ ID NO: 9475245 - DNA, 22 bp, Homo sapiens
aaatccatggtaatctgttaca

SEQ ID NO: 9475246 - DNA, 22 bp, Homo sapiens
aaatccatcaaatcttctagaa

SEQ ID NO: 9475247 - DNA, 22 bp, Homo sapiens
aaatccatggtaatctgttaca

SEQ ID NO: 9475248 - DNA, 22 bp, Homo sapiens
aaatcccagatagtaatgtatt

SEQ ID NO: 9475249 - DNA, 22 bp, Homo sapiens
aaatcccactcagaaactgcca

SEQ ID NO: 9475250 - DNA, 22 bp, Homo sapiens
aaatcccactcagaaactgcca

SEQ ID NO: 9475251 - DNA, 22 bp, Homo sapiens
aaatccattctgttttaaaagt

SEQ ID NO: 9475252 - DNA, 22 bp, Homo sapiens
aaatcccaatgctagacccggt

SEQ ID NO: 9475253 - DNA, 22 bp, Homo sapiens
aaatcccactcacgagttttgc

SEQ ID NO: 9475254 - DNA, 22 bp, Homo sapiens
aaataattatagcgagtctatc

SEQ ID NO: 9475255 - DNA, 22 bp, Homo sapiens
aaataattatagcgagtctatc

SEQ ID NO: 9475256 - DNA, 22 bp, Homo sapiens
aaataattatagcgagtctatc

SEQ ID NO: 9475257 - DNA, 22 bp, Homo sapiens
aaataattatagcgagtctatc

SEQ ID NO: 9475258 - DNA, 22 bp, Homo sapiens
aaataattgagttggtcaatat

SEQ ID NO: 9475259 - DNA, 22 bp, Homo sapiens
aaataattgagttggtcaatat

SEQ ID NO: 9475260 - DNA, 22 bp, Homo sapiens
aaataattgagttggtcaatat

SEQ ID NO: 9475261 - DNA, 22 bp, Homo sapiens
aaataattgagttggtcaatat

SEQ ID NO: 9475262 - DNA, 22 bp, Homo sapiens
aaatagacaggcttaaatagga

SEQ ID NO: 9475263 - DNA, 22 bp, Homo sapiens
aaatagacaggcttaaatagga

SEQ ID NO: 9475264 - DNA, 22 bp, Homo sapiens
aaatagacaggcttaaatagga

SEQ ID NO: 9475265 - DNA, 23 bp, Homo sapiens
aaatagagataggccagctttgc

SEQ ID NO: 9475266 - DNA, 22 bp, Homo sapiens
aaatactgtagataatagagtt

SEQ ID NO: 9475267 - DNA, 22 bp, Homo sapiens
aaatactggttttggagatgct

SEQ ID NO: 9475268 - DNA, 22 bp, Homo sapiens
aaatactgtagataatagagtt

SEQ ID NO: 9475269 - DNA, 22 bp, Homo sapiens
aaatagacacatgcgttcatat

SEQ ID NO: 9475270 - DNA, 22 bp, Homo sapiens
aaatagaattggaagcagagtt

SEQ ID NO: 9475271 - DNA, 22 bp, Homo sapiens
aaatagatttcctagcattgga

SEQ ID NO: 9475272 - DNA, 22 bp, Homo sapiens
aaatagatttcctagcattgga

SEQ ID NO: 9475273 - DNA, 22 bp, Homo sapiens
aaatagcaatgtgaaaagagga

SEQ ID NO: 9475274 - DNA, 22 bp, Homo sapiens
aaatagatttctctgggtttgt

SEQ ID NO: 9475275 - DNA, 22 bp, Homo sapiens
aaatagcagcctttagttaaca

SEQ ID NO: 9475276 - DNA, 22 bp, Homo sapiens
aaatagcaatgtgaaaagagga

SEQ ID NO: 9475277 - DNA, 22 bp, Homo sapiens
aaatagcaatgtgaaaagagga

SEQ ID NO: 9475278 - DNA, 22 bp, Homo sapiens
aaatagcagaagcagagggggt

SEQ ID NO: 9475279 - DNA, 22 bp, Homo sapiens
aaatagagctgggttaaacttt

SEQ ID NO: 9475280 - DNA, 22 bp, Homo sapiens
aaatagagctgggttaaacttt

SEQ ID NO: 9475281 - DNA, 22 bp, Homo sapiens
aaatagattgctgaggcattac

SEQ ID NO: 9475282 - DNA, 22 bp, Homo sapiens
aaatagattgctgaggcattac

SEQ ID NO: 9475283 - DNA, 22 bp, Homo sapiens
aaatagatttcctagcattgga

SEQ ID NO: 9475284 - DNA, 22 bp, Homo sapiens
aaagtgtggtcgttcattttgt

SEQ ID NO: 9475285 - DNA, 22 bp, Homo sapiens
aaagtgtaggcttcaaagaggg

SEQ ID NO: 9475286 - DNA, 23 bp, Homo sapiens
aaagtgtagccaggttaagaacc

SEQ ID NO: 9475287 - DNA, 22 bp, Homo sapiens
aaagtgtagagtgcctcaaaat

SEQ ID NO: 9475288 - DNA, 22 bp, Homo sapiens
aaagtgttgaagaaaatgttca

SEQ ID NO: 9475289 - DNA, 22 bp, Homo sapiens
aaataacagtcagggacaacat

SEQ ID NO: 9475290 - DNA, 22 bp, Homo sapiens
aaataacttatgatcgtctggc

SEQ ID NO: 9475291 - DNA, 22 bp, Homo sapiens
aaataacagtcagggacaacat

SEQ ID NO: 9475292 - DNA, 22 bp, Homo sapiens
aaataacagtcagggacaacat

SEQ ID NO: 9475293 - DNA, 22 bp, Homo sapiens
aaagttttatatgctgcagcga

SEQ ID NO: 9475294 - DNA, 22 bp, Homo sapiens
aaagtgtttacattgctataag

SEQ ID NO: 9475295 - DNA, 22 bp, Homo sapiens
aaataagttaaactagaatgat

SEQ ID NO: 9475296 - DNA, 22 bp, Homo sapiens
aaataagttaaactagaatgat

SEQ ID NO: 9475297 - DNA, 22 bp, Homo sapiens
aaataagtgtgggccagtcaaa

SEQ ID NO: 9475298 - DNA, 22 bp, Homo sapiens
aaataagtagtttagtgttgtg

SEQ ID NO: 9475299 - DNA, 22 bp, Homo sapiens
aaataagtagtttagtgttgtg

SEQ ID NO: 9475300 - DNA, 22 bp, Homo sapiens
aaataagtagtttagtgttgtg

SEQ ID NO: 9475301 - DNA, 22 bp, Homo sapiens
aaataagtgtgggccagtcaaa

SEQ ID NO: 9475302 - DNA, 22 bp, Homo sapiens
aaataagtgtgggccagtcaaa

SEQ ID NO: 9475303 - DNA, 22 bp, Homo sapiens
aaataagtgtgggccagtcaaa

SEQ ID NO: 9475304 - DNA, 22 bp, Homo sapiens
aaataagtgtgggccagtcaaa

SEQ ID NO: 9475305 - DNA, 22 bp, Homo sapiens
aaataagtgtgggccagtcaaa

SEQ ID NO: 9475306 - DNA, 22 bp, Homo sapiens
aaataatcaatttttgtagata

SEQ ID NO: 9475307 - DNA, 22 bp, Homo sapiens
aaataatgttaggcctttgctc

SEQ ID NO: 9475308 - DNA, 22 bp, Homo sapiens
aaataagttaaactagaatgat

SEQ ID NO: 9475309 - DNA, 22 bp, Homo sapiens
aaataagttaaactagaatgat

SEQ ID NO: 9475310 - DNA, 22 bp, Homo sapiens
aaataagttagcagattccagt

SEQ ID NO: 9475311 - DNA, 22 bp, Homo sapiens
aaataatcaatttttgtagata

SEQ ID NO: 9475312 - DNA, 22 bp, Homo sapiens
aaataagttagcagattccagt

SEQ ID NO: 9475313 - DNA, 22 bp, Homo sapiens
aaataagttagcagattccagt

SEQ ID NO: 9475314 - DNA, 22 bp, Homo sapiens
aaataagaaattcttctttgca

SEQ ID NO: 9475315 - DNA, 22 bp, Homo sapiens
aaataagaaattcttctttgca

SEQ ID NO: 9475316 - DNA, 22 bp, Homo sapiens
aaataagaaattcttctttgca

SEQ ID NO: 9475317 - DNA, 22 bp, Homo sapiens
aaataagcacttaactgtatca

SEQ ID NO: 9475318 - DNA, 22 bp, Homo sapiens
aaataagcacttaactgtatca

SEQ ID NO: 9475319 - DNA, 22 bp, Homo sapiens
aaataagaggacagatgtttgg

SEQ ID NO: 9475320 - DNA, 22 bp, Homo sapiens
aaataagaggacagatgtttgg

SEQ ID NO: 9475321 - DNA, 22 bp, Homo sapiens
aaataacttggtttcatcagag

SEQ ID NO: 9475322 - DNA, 22 bp, Homo sapiens
aaataacttggtttcatcagag

SEQ ID NO: 9475323 - DNA, 22 bp, Homo sapiens
aaataactttctgtgtatagtc

SEQ ID NO: 9475324 - DNA, 22 bp, Homo sapiens
aaataactttctgtgtatagtc

SEQ ID NO: 9475325 - DNA, 22 bp, Homo sapiens
aaataagaaattcttctttgca

SEQ ID NO: 9475326 - DNA, 22 bp, Homo sapiens
aaataactttctgtgtatagtc

SEQ ID NO: 9475327 - DNA, 22 bp, Homo sapiens
aaataactttctgtgtatagtc

SEQ ID NO: 9475328 - DNA, 22 bp, Homo sapiens
aaataactttctgtgtatagtc

SEQ ID NO: 9475329 - DNA, 22 bp, Homo sapiens
aaatctcaaaggcttagcatct

SEQ ID NO: 9475330 - DNA, 22 bp, Homo sapiens
aaatctcaaaggcttagcatct

SEQ ID NO: 9475331 - DNA, 22 bp, Homo sapiens
aaatctcaaaggcttagcatct

SEQ ID NO: 9475332 - DNA, 22 bp, Homo sapiens
aagcacagaaaaggagcatgga

SEQ ID NO: 9475333 - DNA, 22 bp, Homo sapiens
aagcacagagaggtaaagtaac

SEQ ID NO: 9475334 - DNA, 22 bp, Homo sapiens
aagcacagactccctctgagtg

SEQ ID NO: 9475335 - DNA, 22 bp, Homo sapiens
aaatcctaaggagaatatgatt

SEQ ID NO: 9475336 - DNA, 22 bp, Homo sapiens
aaatccctgataatgtaggtct

SEQ ID NO: 9475337 - DNA, 22 bp, Homo sapiens
aaatcccttgctctctcagacc

SEQ ID NO: 9475338 - DNA, 22 bp, Homo sapiens
aaatcccagatagtaatgtatt

SEQ ID NO: 9475339 - DNA, 22 bp, Homo sapiens
aaatcctaaggagaatatgatt

SEQ ID NO: 9475340 - DNA, 22 bp, Homo sapiens
aaatcctaatgacaagtttagt

SEQ ID NO: 9475341 - DNA, 22 bp, Homo sapiens
aaatccttgatagtttgcccta

SEQ ID NO: 9475342 - DNA, 22 bp, Homo sapiens
aaatccttttctatacagcata

SEQ ID NO: 9475343 - DNA, 22 bp, Homo sapiens
aaatcgcttgaacccaggaagt

SEQ ID NO: 9475344 - DNA, 22 bp, Homo sapiens
aaatctagtacctttttgatta

SEQ ID NO: 9475345 - DNA, 22 bp, Homo sapiens
aaatctcaaaggcttagcatct

SEQ ID NO: 9475346 - DNA, 22 bp, Homo sapiens
aaatgcatcagctcataagaga

SEQ ID NO: 9475347 - DNA, 22 bp, Homo sapiens
aaatgcatatcaaagacttgaa

SEQ ID NO: 9475348 - DNA, 22 bp, Homo sapiens
aaatgcatatcaaagacttgaa

SEQ ID NO: 9475349 - DNA, 22 bp, Homo sapiens
aagcatcaacactatattgatg

SEQ ID NO: 9475350 - DNA, 22 bp, Homo sapiens
aaatgcatgagaaagtattctg

SEQ ID NO: 9475351 - DNA, 22 bp, Homo sapiens
aaatgcatcagctcataagaga

SEQ ID NO: 9475352 - DNA, 22 bp, Homo sapiens
aaatgcaggttcttgagccaag

SEQ ID NO: 9475353 - DNA, 22 bp, Homo sapiens
aaatgcaggttcttgagccaag

SEQ ID NO: 9475354 - DNA, 22 bp, Homo sapiens
aaatgcagtggttctacttctc

SEQ ID NO: 9475355 - DNA, 21 bp, Homo sapiens
aaatgcagtctctgagatctg

SEQ ID NO: 9475356 - DNA, 22 bp, Homo sapiens
aaatgcaggtagtatttatttt

SEQ ID NO: 9475357 - DNA, 22 bp, Homo sapiens
aaatgcaggttcttgagccaag

SEQ ID NO: 9475358 - DNA, 22 bp, Homo sapiens
aaatgcaggtagtatttatttt

SEQ ID NO: 9475359 - DNA, 22 bp, Homo sapiens
aagcacagctggaacagcagga

SEQ ID NO: 9475360 - DNA, 22 bp, Homo sapiens
aagcacagattgctgcatccat

SEQ ID NO: 9475361 - DNA, 22 bp, Homo sapiens
aagcacagattgctgcatccat

SEQ ID NO: 9475362 - DNA, 22 bp, Homo sapiens
aagcacagataaaacaggattc

SEQ ID NO: 9475363 - DNA, 22 bp, Homo sapiens
aaatgcagctgggcatgagagg

SEQ ID NO: 9475364 - DNA, 22 bp, Homo sapiens
aaatgcagctgggcatgagagg

SEQ ID NO: 9475365 - DNA, 22 bp, Homo sapiens
aaatgcaggaaattatgctttt

SEQ ID NO: 9475366 - DNA, 22 bp, Homo sapiens
aaatgcaccttgctgtgagact

SEQ ID NO: 9475367 - DNA, 23 bp, Homo sapiens
aaatgcacagtattgatttttaa

SEQ ID NO: 9475368 - DNA, 22 bp, Homo sapiens
aaatgcaggaaattatgctttt

SEQ ID NO: 9475369 - DNA, 22 bp, Homo sapiens
aaatgcaggaaattatgctttt

SEQ ID NO: 9475370 - DNA, 22 bp, Homo sapiens
aaatgcaggaaattatgctttt

SEQ ID NO: 9475371 - DNA, 22 bp, Homo sapiens
aaatgcaggattaacagctttg

SEQ ID NO: 9475372 - DNA, 22 bp, Homo sapiens
aaatgcaggaaattatgctttt

SEQ ID NO: 9475373 - DNA, 22 bp, Homo sapiens
aaatgcaggattaacagctttg

SEQ ID NO: 9475374 - DNA, 22 bp, Homo sapiens
aaatgcaggattaacagctttg

SEQ ID NO: 9475375 - DNA, 22 bp, Homo sapiens
aaatgtacgggagtagaattag

SEQ ID NO: 9475376 - DNA, 22 bp, Homo sapiens
aaatgtacgggagtagaattag

SEQ ID NO: 9475377 - DNA, 22 bp, Homo sapiens
aaatgtacactttgcatcttga

SEQ ID NO: 9475378 - DNA, 22 bp, Homo sapiens
aaatgtaccttgatagtttggt

SEQ ID NO: 9475379 - DNA, 18 bp, Homo sapiens
aaatgtactgtccatggc

SEQ ID NO: 9475380 - DNA, 18 bp, Homo sapiens
aaatgtactgtccatggc

SEQ ID NO: 9475381 - DNA, 22 bp, Homo sapiens
aaatgtattgcataggatattt

SEQ ID NO: 9475382 - DNA, 22 bp, Homo sapiens
aaatgtattgcataggatattt

SEQ ID NO: 9475383 - DNA, 22 bp, Homo sapiens
aaatgtatcctacttcctgagt

SEQ ID NO: 9475384 - DNA, 22 bp, Homo sapiens
aaatgtagttgaaaagttaagg

SEQ ID NO: 9475385 - DNA, 22 bp, Homo sapiens
aaatgtagttgaaaagttaagg

SEQ ID NO: 9475386 - DNA, 22 bp, Homo sapiens
aaatgtatcctacttcctgagt

SEQ ID NO: 9475387 - DNA, 20 bp, Homo sapiens
aaatgtataggacccttcta

SEQ ID NO: 9475388 - DNA, 22 bp, Homo sapiens
aaatgtattgcataggatattt

SEQ ID NO: 9475389 - DNA, 22 bp, Homo sapiens
aagctgaaataatatctatgtt

SEQ ID NO: 9475390 - DNA, 22 bp, Homo sapiens
aagctgaaattcctcctgaaat

SEQ ID NO: 9475391 - DNA, 22 bp, Homo sapiens
aagctgaaaatgagactctaca

SEQ ID NO: 9475392 - DNA, 22 bp, Homo sapiens
aagctcttttctgcctcaccca

SEQ ID NO: 9475393 - DNA, 22 bp, Homo sapiens
aagctgaaacattagcctaaac

SEQ ID NO: 9475394 - DNA, 22 bp, Homo sapiens
aagctgaaaatgagactctaca

SEQ ID NO: 9475395 - DNA, 22 bp, Homo sapiens
aagctgaagccggatcaaaaag

SEQ ID NO: 9475396 - DNA, 22 bp, Homo sapiens
aagctgaatctgaaatagaatt

SEQ ID NO: 9475397 - DNA, 22 bp, Homo sapiens
aagctgaagacacagctccagt

SEQ ID NO: 9475398 - DNA, 22 bp, Homo sapiens
aagctctttccactaaaccact

SEQ ID NO: 9475399 - DNA, 22 bp, Homo sapiens
aagctctttaatagtctaaaaa

SEQ ID NO: 9475400 - DNA, 22 bp, Homo sapiens
aaatgtattgcataggatattt

SEQ ID NO: 9475401 - DNA, 22 bp, Homo sapiens
aaatgtcaaagacgtgtttttg

SEQ ID NO: 9475402 - DNA, 22 bp, Homo sapiens
aagctctttccctcttcagaac

SEQ ID NO: 9475403 - DNA, 22 bp, Homo sapiens
aagctctttgacctgggcctgg

SEQ ID NO: 9475404 - DNA, 22 bp, Homo sapiens
aagctcttttcataagagcaaa

SEQ ID NO: 9475405 - DNA, 22 bp, Homo sapiens
aaatgtacaacatccatatata

SEQ ID NO: 9475406 - DNA, 22 bp, Homo sapiens
aaatgtacactttgcatcttga

SEQ ID NO: 9475407 - DNA, 22 bp, Homo sapiens
aaatgtacaacatccatatata

SEQ ID NO: 9475408 - DNA, 22 bp, Homo sapiens
aaatgtaagtctttgtttctta

SEQ ID NO: 9475409 - DNA, 22 bp, Homo sapiens
aaatgtaagtctttgtttctta

SEQ ID NO: 9475410 - DNA, 22 bp, Homo sapiens
aaatgtacaacatccatatata

SEQ ID NO: 9475411 - DNA, 22 bp, Homo sapiens
aaatgtacaacatccatatata

SEQ ID NO: 9475412 - DNA, 22 bp, Homo sapiens
aaatggcagcccagaggtaagg

SEQ ID NO: 9475413 - DNA, 22 bp, Homo sapiens
aaatggcaggctctttgctagt

SEQ ID NO: 9475414 - DNA, 22 bp, Homo sapiens
aaatgtaagtctttgtttctta

SEQ ID NO: 9475415 - DNA, 22 bp, Homo sapiens
aagcatgggaggcctggaggag

SEQ ID NO: 9475416 - DNA, 22 bp, Homo sapiens
aagcatgggaggcctggaggag

SEQ ID NO: 9475417 - DNA, 22 bp, Homo sapiens
aagcatgcaatctgtgataagg

SEQ ID NO: 9475418 - DNA, 22 bp, Homo sapiens
aagcatcaacctgtatgctgca

SEQ ID NO: 9475419 - DNA, 22 bp, Homo sapiens
aagcatccggggctccaggtgc

SEQ ID NO: 9475420 - DNA, 22 bp, Homo sapiens
aagcatcattcacttccttctg

SEQ ID NO: 9475421 - DNA, 22 bp, Homo sapiens
aagcatctataggttctaggag

SEQ ID NO: 9475422 - DNA, 22 bp, Homo sapiens
aaagtgggaacaatggagagtg

SEQ ID NO: 9475423 - DNA, 22 bp, Homo sapiens
aaagtgggaacaatggagagtg

SEQ ID NO: 9475424 - DNA, 22 bp, Homo sapiens
aaagtggcttctctgtgctttt

SEQ ID NO: 9475425 - DNA, 22 bp, Homo sapiens
aaagtgggaacaatggagagtg

SEQ ID NO: 9475426 - DNA, 22 bp, Homo sapiens
aaagtggtcaccttctcatttc

SEQ ID NO: 9475427 - DNA, 22 bp, Homo sapiens
aaagtggtctgcatcccttctg

SEQ ID NO: 9475428 - DNA, 22 bp, Homo sapiens
aaagtggttgctgtcagcctct

SEQ ID NO: 9475429 - DNA, 22 bp, Homo sapiens
aaagtggttcttacatccgtgg

SEQ ID NO: 9475430 - DNA, 22 bp, Homo sapiens
aaagtggtttcccagttcagta

SEQ ID NO: 9475431 - DNA, 20 bp, Homo sapiens
aaagtgtaaggcaaagttgt

SEQ ID NO: 9475432 - DNA, 20 bp, Homo sapiens
aaagtgtaagcatataatta

SEQ ID NO: 9475433 - DNA, 22 bp, Homo sapiens
aaagtcacagtttaggggatat

SEQ ID NO: 9475434 - DNA, 22 bp, Homo sapiens
aaagtcacagtttaggggatat

SEQ ID NO: 9475435 - DNA, 22 bp, Homo sapiens
aaagtcacaatattggaaggtg

SEQ ID NO: 9475436 - DNA, 22 bp, Homo sapiens
aaagtcacaatattggaaggtg

SEQ ID NO: 9475437 - DNA, 22 bp, Homo sapiens
aaagtcaaggtttagactagag

SEQ ID NO: 9475438 - DNA, 22 bp, Homo sapiens
aaagtgcagggtgctctggtat

SEQ ID NO: 9475439 - DNA, 22 bp, Homo sapiens
aaagtcacatagcatcacttct

SEQ ID NO: 9475440 - DNA, 22 bp, Homo sapiens
aaagtgcagctgaaaacatcct

SEQ ID NO: 9475441 - DNA, 22 bp, Homo sapiens
aaagtgctgggattccaggcgt

SEQ ID NO: 9475442 - DNA, 22 bp, Homo sapiens
aaagtgctggtattacaggtgt

SEQ ID NO: 9475443 - DNA, 22 bp, Homo sapiens
aaagtgctgtgattacaggcat

SEQ ID NO: 9475444 - DNA, 22 bp, Homo sapiens
aaagtgctgtgattacaggcat

SEQ ID NO: 9475445 - DNA, 22 bp, Homo sapiens
aaagtggccatcctctgcatcg

SEQ ID NO: 9475446 - DNA, 22 bp, Homo sapiens
aaagtattcaaaaatatttggt

SEQ ID NO: 9475447 - DNA, 22 bp, Homo sapiens
aaagtattcaaaaatatttggt

SEQ ID NO: 9475448 - DNA, 22 bp, Homo sapiens
aaagtattcaaaaatatttggt

SEQ ID NO: 9475449 - DNA, 22 bp, Homo sapiens
aaagtatgttgtggcttttaaa

SEQ ID NO: 9475450 - DNA, 22 bp, Homo sapiens
aaagtatgattggggattattt

SEQ ID NO: 9475451 - DNA, 22 bp, Homo sapiens
aaagtattcttgactgtttttc

SEQ ID NO: 9475452 - DNA, 22 bp, Homo sapiens
aaagtattcttgactgtttttc

SEQ ID NO: 9475453 - DNA, 22 bp, Homo sapiens
aaagtattcttgactgtttttc

SEQ ID NO: 9475454 - DNA, 22 bp, Homo sapiens
aaagtattcttgactgtttttc

SEQ ID NO: 9475455 - DNA, 22 bp, Homo sapiens
aaagtatttgtgatttttacca

SEQ ID NO: 9475456 - DNA, 22 bp, Homo sapiens
aaagtatttttgacaggcatta

SEQ ID NO: 9475457 - DNA, 22 bp, Homo sapiens
aaagtatttgtgatttttacca

SEQ ID NO: 9475458 - DNA, 22 bp, Homo sapiens
aaagtatttgtgatttttacca

SEQ ID NO: 9475459 - DNA, 22 bp, Homo sapiens
aaagtatttgtgatttttacca

SEQ ID NO: 9475460 - DNA, 22 bp, Homo sapiens
aaagtcaaggtttagactagag

SEQ ID NO: 9475461 - DNA, 22 bp, Homo sapiens
aaagtcaaggtttagactagag

SEQ ID NO: 9475462 - DNA, 22 bp, Homo sapiens
aaagtcaaggtttagactagag

SEQ ID NO: 9475463 - DNA, 22 bp, Homo sapiens
aaagtatttttgacaggcatta

SEQ ID NO: 9475464 - DNA, 22 bp, Homo sapiens
aaagtagctttgtaggtacagt

SEQ ID NO: 9475465 - DNA, 22 bp, Homo sapiens
aaagtagaggcattgatcaggt

SEQ ID NO: 9475466 - DNA, 22 bp, Homo sapiens
aaagtagagttgtggaattact

SEQ ID NO: 9475467 - DNA, 22 bp, Homo sapiens
aaagtatatttacttactgtga

SEQ ID NO: 9475468 - DNA, 22 bp, Homo sapiens
aaagtatatttacttactgtga

SEQ ID NO: 9475469 - DNA, 22 bp, Homo sapiens
aaagtatatatgcactttagaa

SEQ ID NO: 9475470 - DNA, 22 bp, Homo sapiens
aaagtagttagtcatgtgaaaa

SEQ ID NO: 9475471 - DNA, 22 bp, Homo sapiens
aaagtatatatgcactttagaa

SEQ ID NO: 9475472 - DNA, 22 bp, Homo sapiens
aaagtatgattggggattattt

SEQ ID NO: 9475473 - DNA, 22 bp, Homo sapiens
aactaacagtcattaaaagaac

SEQ ID NO: 9475474 - DNA, 22 bp, Homo sapiens
aactaaatctggcatttagagc

SEQ ID NO: 9475475 - DNA, 22 bp, Homo sapiens
aactaaatctggcatttagagc

SEQ ID NO: 9475476 - DNA, 22 bp, Homo sapiens
aactaaatctggcatttagagc

SEQ ID NO: 9475477 - DNA, 18 bp, Homo sapiens
aactaaagatctttaagc

SEQ ID NO: 9475478 - DNA, 22 bp, Homo sapiens
aactaaatctggcatttagagc

SEQ ID NO: 9475479 - DNA, 22 bp, Homo sapiens
aactaaaccatgacattatatt

SEQ ID NO: 9475480 - DNA, 22 bp, Homo sapiens
aactaaaagtgtgtctcttgta

SEQ ID NO: 9475481 - DNA, 22 bp, Homo sapiens
aactaaaactggtttgttctct

SEQ ID NO: 9475482 - DNA, 22 bp, Homo sapiens
aactaaaagtgtgtctcttgta

SEQ ID NO: 9475483 - DNA, 22 bp, Homo sapiens
aacgttttatcgtgtgctcttc

SEQ ID NO: 9475484 - DNA, 22 bp, Homo sapiens
aaaggttttcatcacagcaaga

SEQ ID NO: 9475485 - DNA, 22 bp, Homo sapiens
aaagtacccaagaacagagtga

SEQ ID NO: 9475486 - DNA, 22 bp, Homo sapiens
aaagtaattgtggttcttgcca

SEQ ID NO: 9475487 - DNA, 22 bp, Homo sapiens
aactaacagtcattaaaagaac

SEQ ID NO: 9475488 - DNA, 22 bp, Homo sapiens
aactaacagtcattaaaagaac

SEQ ID NO: 9475489 - DNA, 22 bp, Homo sapiens
aactaacagtcattaaaagaac

SEQ ID NO: 9475490 - DNA, 22 bp, Homo sapiens
aactaacagtcattaaaagaac

SEQ ID NO: 9475491 - DNA, 22 bp, Homo sapiens
aactaagtcatagagtccctca

SEQ ID NO: 9475492 - DNA, 22 bp, Homo sapiens
aaagtagaggcattgatcaggt

SEQ ID NO: 9475493 - DNA, 22 bp, Homo sapiens
aaagtacttgatgctacagagt

SEQ ID NO: 9475494 - DNA, 22 bp, Homo sapiens
aaagtactaatgaatattttgc

SEQ ID NO: 9475495 - DNA, 22 bp, Homo sapiens
aaagtactgatgccatcagcac

SEQ ID NO: 9475496 - DNA, 22 bp, Homo sapiens
aaagtactgggattacaggtct

SEQ ID NO: 9475497 - DNA, 22 bp, Homo sapiens
aaagtactcgaggaggaggagc

SEQ ID NO: 9475498 - DNA, 22 bp, Homo sapiens
aaagtacttacagtatgcttgg

SEQ ID NO: 9475499 - DNA, 22 bp, Homo sapiens
aaaggttctcttgttcattatt

SEQ ID NO: 9475500 - DNA, 22 bp, Homo sapiens
aaaggttctacttttaaagaat

SEQ ID NO: 9475501 - DNA, 22 bp, Homo sapiens
aaaggttgaattcaggatccac

SEQ ID NO: 9475502 - DNA, 22 bp, Homo sapiens
aaaggtttatttaatcagggag

SEQ ID NO: 9475503 - DNA, 22 bp, Homo sapiens
aaaggaagatgccaggactctg

SEQ ID NO: 9475504 - DNA, 22 bp, Homo sapiens
aaaggaagatgccaggactctg

SEQ ID NO: 9475505 - DNA, 22 bp, Homo sapiens
aaaggaagattgagcttttcca

SEQ ID NO: 9475506 - DNA, 22 bp, Homo sapiens
aaagggcagagttcactagaaa

SEQ ID NO: 9475507 - DNA, 22 bp, Homo sapiens
aaaggttattattactattgtc

SEQ ID NO: 9475508 - DNA, 22 bp, Homo sapiens
aaagggccaatggagagtgtgg

SEQ ID NO: 9475509 - DNA, 22 bp, Homo sapiens
aaagcttttcagtatgttcatg

SEQ ID NO: 9475510 - DNA, 22 bp, Homo sapiens
aaaggaaaataagtagttccat

SEQ ID NO: 9475511 - DNA, 22 bp, Homo sapiens
aaaggaaaataagtagttccat

SEQ ID NO: 9475512 - DNA, 22 bp, Homo sapiens
aaaggaaaataagtagttccat

SEQ ID NO: 9475513 - DNA, 22 bp, Homo sapiens
aaaggaaaataagtagttccat

SEQ ID NO: 9475514 - DNA, 22 bp, Homo sapiens
aaagcttttgttttcgtaactg

SEQ ID NO: 9475515 - DNA, 22 bp, Homo sapiens
aaagcttttgttttcgtaactg

SEQ ID NO: 9475516 - DNA, 20 bp, Homo sapiens
aaagatactttttgtaatgg

SEQ ID NO: 9475517 - DNA, 22 bp, Homo sapiens
aaagatacttaatagttgtctg

SEQ ID NO: 9475518 - DNA, 20 bp, Homo sapiens
aaagatactttttgtaatgg

SEQ ID NO: 9475519 - DNA, 22 bp, Homo sapiens
aaagatcaatagataaagctac

SEQ ID NO: 9475520 - DNA, 22 bp, Homo sapiens
aaagatcaatagataaagctac

SEQ ID NO: 9475521 - DNA, 22 bp, Homo sapiens
aaagatcaatagataaagctac

SEQ ID NO: 9475522 - DNA, 22 bp, Homo sapiens
aaagatatgtctccaaagagat

SEQ ID NO: 9475523 - DNA, 22 bp, Homo sapiens
aaagatatgtctccaaagagat

SEQ ID NO: 9475524 - DNA, 22 bp, Homo sapiens
aaagatatgtctccaaagagat

SEQ ID NO: 9475525 - DNA, 23 bp, Homo sapiens
aaagatcaaagtggcaggcctgt

SEQ ID NO: 9475526 - DNA, 22 bp, Homo sapiens
aaagatcaatagataaagctac

SEQ ID NO: 9475527 - DNA, 22 bp, Homo sapiens
aaagatcacgtcccaggactcg

SEQ ID NO: 9475528 - DNA, 22 bp, Homo sapiens
aaagatcacgtcccaggactcg

SEQ ID NO: 9475529 - DNA, 22 bp, Homo sapiens
aaagccacgtggcctggggagc

SEQ ID NO: 9475530 - DNA, 22 bp, Homo sapiens
aaagatcagaggatagctgagt

SEQ ID NO: 9475531 - DNA, 22 bp, Homo sapiens
aaagccacagttctatgtctgc

SEQ ID NO: 9475532 - DNA, 22 bp, Homo sapiens
aaagccagggtccaggcctgcc

SEQ ID NO: 9475533 - DNA, 22 bp, Homo sapiens
aaagccagggtccaggcctgcc

SEQ ID NO: 9475534 - DNA, 22 bp, Homo sapiens
aaagccaggttgtgtgcaggaa

SEQ ID NO: 9475535 - DNA, 22 bp, Homo sapiens
aaagccagtggtatgagagaaa

SEQ ID NO: 9475536 - DNA, 22 bp, Homo sapiens
aaagccagttcttagagaaagc

SEQ ID NO: 9475537 - DNA, 22 bp, Homo sapiens
aaagccagtggtatgagagaaa

SEQ ID NO: 9475538 - DNA, 22 bp, Homo sapiens
aaagccagtggtatgagagaaa

SEQ ID NO: 9475539 - DNA, 22 bp, Homo sapiens
aaagccagtggtatgagagaaa

SEQ ID NO: 9475540 - DNA, 22 bp, Homo sapiens
aaagccagttcttagagaaagc

SEQ ID NO: 9475541 - DNA, 22 bp, Homo sapiens
aaagccagttcttagagaaagc

SEQ ID NO: 9475542 - DNA, 22 bp, Homo sapiens
aaagccatcagtaaaatgattt

SEQ ID NO: 9475543 - DNA, 22 bp, Homo sapiens
aaagccatcagtaaaatgattt

SEQ ID NO: 9475544 - DNA, 22 bp, Homo sapiens
aaagccatcagtaaaatgattt

SEQ ID NO: 9475545 - DNA, 22 bp, Homo sapiens
aaagccataagcctaatactaa

SEQ ID NO: 9475546 - DNA, 22 bp, Homo sapiens
aaagccatatctattctattct

SEQ ID NO: 9475547 - DNA, 22 bp, Homo sapiens
aaagccagtttgtctctttaaa

SEQ ID NO: 9475548 - DNA, 22 bp, Homo sapiens
aaagccagtttctggaagtacc

SEQ ID NO: 9475549 - DNA, 22 bp, Homo sapiens
aaagccagtttctggaagtacc

SEQ ID NO: 9475550 - DNA, 22 bp, Homo sapiens
aaagccagtttctggaagtacc

SEQ ID NO: 9475551 - DNA, 22 bp, Homo sapiens
aacaaacaaacattttgtcatc

SEQ ID NO: 9475552 - DNA, 22 bp, Homo sapiens
aacaaacaaacattttgtcatc

SEQ ID NO: 9475553 - DNA, 22 bp, Homo sapiens
aacaaaacatttgtcttgtttc

SEQ ID NO: 9475554 - DNA, 22 bp, Homo sapiens
aacaaaacatttgtcttgtttc

SEQ ID NO: 9475555 - DNA, 22 bp, Homo sapiens
aacaaaacatttgtcttgtttc

SEQ ID NO: 9475556 - DNA, 22 bp, Homo sapiens
aaagagtttccattgacatttc

SEQ ID NO: 9475557 - DNA, 22 bp, Homo sapiens
aacaaacaaacattttgtcatc

SEQ ID NO: 9475558 - DNA, 22 bp, Homo sapiens
aacaaacaaacattttgtcatc

SEQ ID NO: 9475559 - DNA, 22 bp, Homo sapiens
aacaaacaaacattttgtcatc

SEQ ID NO: 9475560 - DNA, 22 bp, Homo sapiens
aacaaacaaacattttgtcatc

SEQ ID NO: 9475561 - DNA, 22 bp, Homo sapiens
aaagatacttaatagttgtctg

SEQ ID NO: 9475562 - DNA, 22 bp, Homo sapiens
aaagagtttggagacaagatca

SEQ ID NO: 9475563 - DNA, 22 bp, Homo sapiens
aaattttagtaaggaagttgag

SEQ ID NO: 9475564 - DNA, 22 bp, Homo sapiens
aaattttcagagcactagagaa

SEQ ID NO: 9475565 - DNA, 21 bp, Homo sapiens
aaattttcttggctgtagtgt

SEQ ID NO: 9475566 - DNA, 21 bp, Homo sapiens
aaattttcttggctgtagtgt

SEQ ID NO: 9475567 - DNA, 22 bp, Homo sapiens
aaattttgtattctagttctag

SEQ ID NO: 9475568 - DNA, 22 bp, Homo sapiens
aaattttgtattctagttctag

SEQ ID NO: 9475569 - DNA, 22 bp, Homo sapiens
aaagctgcccttgtgaaacaag

SEQ ID NO: 9475570 - DNA, 22 bp, Homo sapiens
aaagctgccaaggagaatacta

SEQ ID NO: 9475571 - DNA, 22 bp, Homo sapiens
aaagctcttttccaagtattga

SEQ ID NO: 9475572 - DNA, 22 bp, Homo sapiens
aaagctcttttccaagtattga

SEQ ID NO: 9475573 - DNA, 22 bp, Homo sapiens
aaagctgatgtctactagagaa

SEQ ID NO: 9475574 - DNA, 22 bp, Homo sapiens
aaagctgctttaaacatctatg

SEQ ID NO: 9475575 - DNA, 22 bp, Homo sapiens
aaagctgcccttgtgaaacaag

SEQ ID NO: 9475576 - DNA, 22 bp, Homo sapiens
aaagctgctttaaacatctatg

SEQ ID NO: 9475577 - DNA, 22 bp, Homo sapiens
aaagctggcctctcaggcttta

SEQ ID NO: 9475578 - DNA, 22 bp, Homo sapiens
aaagcttctattcacttacttg

SEQ ID NO: 9475579 - DNA, 22 bp, Homo sapiens
aaagctttgggtaggaatggga

SEQ ID NO: 9475580 - DNA, 22 bp, Homo sapiens
aaagcttctattcacttacttg

SEQ ID NO: 9475581 - DNA, 22 bp, Homo sapiens
aaagcttctaggcctattgctt

SEQ ID NO: 9475582 - DNA, 22 bp, Homo sapiens
aaagcttatttgtatgcatgtt

SEQ ID NO: 9475583 - DNA, 22 bp, Homo sapiens
aaagcttagcattttcaaaatg

SEQ ID NO: 9475584 - DNA, 22 bp, Homo sapiens
aaagctgttgtatggcccttgg

SEQ ID NO: 9475585 - DNA, 22 bp, Homo sapiens
aaagctgttaaatgcataatgc

SEQ ID NO: 9475586 - DNA, 22 bp, Homo sapiens
aaagctgtagaatcatcttaat

SEQ ID NO: 9475587 - DNA, 22 bp, Homo sapiens
aaagctgtcaaggcaggaggct

SEQ ID NO: 9475588 - DNA, 22 bp, Homo sapiens
aaagctgtaatgcatgctttct

SEQ ID NO: 9475589 - DNA, 22 bp, Homo sapiens
aacagatttgtgaagctactca

SEQ ID NO: 9475590 - DNA, 22 bp, Homo sapiens
aacagatttgtgaagctactca

SEQ ID NO: 9475591 - DNA, 22 bp, Homo sapiens
aacagcaagggcggggtcaaga

SEQ ID NO: 9475592 - DNA, 22 bp, Homo sapiens
aacagcaagggcggggtcaaga

SEQ ID NO: 9475593 - DNA, 19 bp, Homo sapiens
aacagcaacttcctagtca

SEQ ID NO: 9475594 - DNA, 22 bp, Homo sapiens
aaagccatgaatgttatagagg

SEQ ID NO: 9475595 - DNA, 22 bp, Homo sapiens
aaagccatgaatgttatagagg

SEQ ID NO: 9475596 - DNA, 22 bp, Homo sapiens
aacagataagtatatctatgta

SEQ ID NO: 9475597 - DNA, 22 bp, Homo sapiens
aacagatataggcagaactttg

SEQ ID NO: 9475598 - DNA, 22 bp, Homo sapiens
aacagcagcaagtaagcaggtc

SEQ ID NO: 9475599 - DNA, 22 bp, Homo sapiens
aacagcagaggagcgatggctg

SEQ ID NO: 9475600 - DNA, 22 bp, Homo sapiens
aacagcagaaactgcaagctac

SEQ ID NO: 9475601 - DNA, 22 bp, Homo sapiens
aacagcagaaactgcaagctac

SEQ ID NO: 9475602 - DNA, 22 bp, Homo sapiens
aacagcaatagcactattcatt

SEQ ID NO: 9475603 - DNA, 22 bp, Homo sapiens
aacagcaatagcactattcatt

SEQ ID NO: 9475604 - DNA, 22 bp, Homo sapiens
aacagcaatagcactattcatt

SEQ ID NO: 9475605 - DNA, 22 bp, Homo sapiens
aacagcaatagcactattcatt

SEQ ID NO: 9475606 - DNA, 22 bp, Homo sapiens
aacagcaatagcactattcatt

SEQ ID NO: 9475607 - DNA, 22 bp, Homo sapiens
aaagcgtaagttatattctgta

SEQ ID NO: 9475608 - DNA, 22 bp, Homo sapiens
aaagcgctatataaatgttaac

SEQ ID NO: 9475609 - DNA, 22 bp, Homo sapiens
aaagcgcatagggggcagcaag

SEQ ID NO: 9475610 - DNA, 22 bp, Homo sapiens
aacagcagcaagtaagcaggtc

SEQ ID NO: 9475611 - DNA, 22 bp, Homo sapiens
aacagcagcaagtaagcaggtc

SEQ ID NO: 9475612 - DNA, 22 bp, Homo sapiens
aacagcagcatgacagctgggt

SEQ ID NO: 9475613 - DNA, 22 bp, Homo sapiens
aaagctacctttgtgttcatag

SEQ ID NO: 9475614 - DNA, 22 bp, Homo sapiens
aaagctacctttgtgttcatag

SEQ ID NO: 9475615 - DNA, 22 bp, Homo sapiens
aaagctacctttgtgttcatag

SEQ ID NO: 9475616 - DNA, 22 bp, Homo sapiens
aaagctaaggtagcattggaga

SEQ ID NO: 9475617 - DNA, 22 bp, Homo sapiens
acagaattgaagctgagtaaat

SEQ ID NO: 9475618 - DNA, 22 bp, Homo sapiens
acagaattgaaagtataatctg

SEQ ID NO: 9475619 - DNA, 22 bp, Homo sapiens
acagaattgaaagtataatctg

SEQ ID NO: 9475620 - DNA, 22 bp, Homo sapiens
acagaattgaagctgagtaaat

SEQ ID NO: 9475621 - DNA, 22 bp, Homo sapiens
acagaattgatggaaatctcag

SEQ ID NO: 9475622 - DNA, 22 bp, Homo sapiens
acagaattctctctgcagaggc

SEQ ID NO: 9475623 - DNA, 22 bp, Homo sapiens
acagaattctagtatgtggctt

SEQ ID NO: 9475624 - DNA, 22 bp, Homo sapiens
acagaattatcaggaaatgtta

SEQ ID NO: 9475625 - DNA, 22 bp, Homo sapiens
acagaattatcaggaaatgtta

SEQ ID NO: 9475626 - DNA, 18 bp, Homo sapiens
acagacaaaatggaaatg

SEQ ID NO: 9475627 - DNA, 18 bp, Homo sapiens
acagacaaaatggaaatg

SEQ ID NO: 9475628 - DNA, 18 bp, Homo sapiens
acagacaaaatggaaatg

SEQ ID NO: 9475629 - DNA, 22 bp, Homo sapiens
acagaatttacacatctctaaa

SEQ ID NO: 9475630 - DNA, 22 bp, Homo sapiens
acagaatttgcttgggcaatgg

SEQ ID NO: 9475631 - DNA, 22 bp, Homo sapiens
acagaatttgcttgggcaatgg

SEQ ID NO: 9475632 - DNA, 22 bp, Homo sapiens
acagaatttttacacagggtaa

SEQ ID NO: 9475633 - DNA, 22 bp, Homo sapiens
acagaattggggttcttgggga

SEQ ID NO: 9475634 - DNA, 22 bp, Homo sapiens
acagaattggggttcttgggga

SEQ ID NO: 9475635 - DNA, 22 bp, Homo sapiens
acagaatttaaagctctagact

SEQ ID NO: 9475636 - DNA, 22 bp, Homo sapiens
acagaatttacacatctctaaa

SEQ ID NO: 9475637 - DNA, 22 bp, Homo sapiens
acagaatttacacatctctaaa

SEQ ID NO: 9475638 - DNA, 22 bp, Homo sapiens
aagcagagtccccttcccatgg

SEQ ID NO: 9475639 - DNA, 23 bp, Homo sapiens
acagacaacactgatgagagaaa

SEQ ID NO: 9475640 - DNA, 18 bp, Homo sapiens
acagacaaaatggaaatg

SEQ ID NO: 9475641 - DNA, 22 bp, Homo sapiens
aagcagagtgatataaacatgg

SEQ ID NO: 9475642 - DNA, 22 bp, Homo sapiens
aagcagcatgattgtaatacta

SEQ ID NO: 9475643 - DNA, 22 bp, Homo sapiens
aagcagcatcctgggcagacct

SEQ ID NO: 9475644 - DNA, 22 bp, Homo sapiens
aagcagcctggcatgatgcttt

SEQ ID NO: 9475645 - DNA, 22 bp, Homo sapiens
aagcagcctggacttgggctgg

SEQ ID NO: 9475646 - DNA, 22 bp, Homo sapiens
aagcagcctcatttgtggtaag

SEQ ID NO: 9475647 - DNA, 22 bp, Homo sapiens
aagcagccacctcatctccact

SEQ ID NO: 9475648 - DNA, 22 bp, Homo sapiens
aagcagccagccatcatgcccg

SEQ ID NO: 9475649 - DNA, 22 bp, Homo sapiens
aagcagctgatttcacagctca

SEQ ID NO: 9475650 - DNA, 22 bp, Homo sapiens
aagcagctgatttcacagctca

SEQ ID NO: 9475651 - DNA, 22 bp, Homo sapiens
aagcagctgatttcacagctca

SEQ ID NO: 9475652 - DNA, 22 bp, Homo sapiens
aagcagctgaaggattcagggt

SEQ ID NO: 9475653 - DNA, 22 bp, Homo sapiens
acagaggtggacctcagcaggc

SEQ ID NO: 9475654 - DNA, 22 bp, Homo sapiens
acagaggtttccattgaggttt

SEQ ID NO: 9475655 - DNA, 22 bp, Homo sapiens
acagagtacagacaaaggtcag

SEQ ID NO: 9475656 - DNA, 20 bp, Homo sapiens
acagagtagaacatatgcca

SEQ ID NO: 9475657 - DNA, 22 bp, Homo sapiens
aagcataacttgctgcacatag

SEQ ID NO: 9475658 - DNA, 22 bp, Homo sapiens
acagagtattggaaaggcagtg

SEQ ID NO: 9475659 - DNA, 22 bp, Homo sapiens
aagcatagagacacaaatttgg

SEQ ID NO: 9475660 - DNA, 21 bp, Homo sapiens
acagagtagttgaaacagaga

SEQ ID NO: 9475661 - DNA, 22 bp, Homo sapiens
acagagtaggtgctcagtaaat

SEQ ID NO: 9475662 - DNA, 22 bp, Homo sapiens
acagagtaggtgctgtcgactg

SEQ ID NO: 9475663 - DNA, 22 bp, Homo sapiens
acagcagctgccttcaggctct

SEQ ID NO: 9475664 - DNA, 22 bp, Homo sapiens
acagcagctgccttcaggctct

SEQ ID NO: 9475665 - DNA, 22 bp, Homo sapiens
acagcagctgggttcccaccat

SEQ ID NO: 9475666 - DNA, 22 bp, Homo sapiens
acagcagctgggttcccaccat

SEQ ID NO: 9475667 - DNA, 22 bp, Homo sapiens
acagcagctaacccctgggcca

SEQ ID NO: 9475668 - DNA, 22 bp, Homo sapiens
acagcagctaacccctgggcca

SEQ ID NO: 9475669 - DNA, 22 bp, Homo sapiens
acagcagctaacccctgggcca

SEQ ID NO: 9475670 - DNA, 22 bp, Homo sapiens
acagcagcttgcgtgtctggtc

SEQ ID NO: 9475671 - DNA, 22 bp, Homo sapiens
acagcagcttgtctgttcttta

SEQ ID NO: 9475672 - DNA, 22 bp, Homo sapiens
aagccaagtgctggccatgggc

SEQ ID NO: 9475673 - DNA, 22 bp, Homo sapiens
acagcagcttgtctgttcttta

SEQ ID NO: 9475674 - DNA, 22 bp, Homo sapiens
acagcagcttgcgtgtctggtc

SEQ ID NO: 9475675 - DNA, 22 bp, Homo sapiens
acagcagcttgcgtgtctggtc

SEQ ID NO: 9475676 - DNA, 22 bp, Homo sapiens
acagcagcttcctgactgtact

SEQ ID NO: 9475677 - DNA, 22 bp, Homo sapiens
acagcagcttcctgactgtact

SEQ ID NO: 9475678 - DNA, 22 bp, Homo sapiens
aagccagcctgtttccttcttc

SEQ ID NO: 9475679 - DNA, 21 bp, Homo sapiens
aagccagcccacagtggtttg

SEQ ID NO: 9475680 - DNA, 22 bp, Homo sapiens
aagccaagtgctggccatgggc

SEQ ID NO: 9475681 - DNA, 22 bp, Homo sapiens
aagccaagtgctggccatgggc

SEQ ID NO: 9475682 - DNA, 22 bp, Homo sapiens
aagccagctccagcatatcact

SEQ ID NO: 9475683 - DNA, 22 bp, Homo sapiens
aagccaggaagagagccttcac

SEQ ID NO: 9475684 - DNA, 22 bp, Homo sapiens
aagccaggaccaaactcatcct

SEQ ID NO: 9475685 - DNA, 22 bp, Homo sapiens
aagccaggaccaaactcatcct

SEQ ID NO: 9475686 - DNA, 22 bp, Homo sapiens
aagccaggaatggagtcttcgc

SEQ ID NO: 9475687 - DNA, 22 bp, Homo sapiens
aagccaggaatggagtcttcgc

SEQ ID NO: 9475688 - DNA, 22 bp, Homo sapiens
aagccaggaatggagtcttcgc

SEQ ID NO: 9475689 - DNA, 22 bp, Homo sapiens
aagccaggaagggagctgtccc

SEQ ID NO: 9475690 - DNA, 22 bp, Homo sapiens
aagccaggagcgaggcctcggc

SEQ ID NO: 9475691 - DNA, 22 bp, Homo sapiens
aagccaggagcgaggcctcggc

SEQ ID NO: 9475692 - DNA, 22 bp, Homo sapiens
aagccaggagcgaggcctcggc

SEQ ID NO: 9475693 - DNA, 22 bp, Homo sapiens
aagccaggagcgaggcctcggc

SEQ ID NO: 9475694 - DNA, 22 bp, Homo sapiens
aagccaggcatgcttggacagt

SEQ ID NO: 9475695 - DNA, 22 bp, Homo sapiens
aagccaggataaagttgtttta

SEQ ID NO: 9475696 - DNA, 22 bp, Homo sapiens
aagccaggataaagttgtttta

SEQ ID NO: 9475697 - DNA, 22 bp, Homo sapiens
aagcatttcaatataatattca

SEQ ID NO: 9475698 - DNA, 22 bp, Homo sapiens
aagcatttcaatataatattca

SEQ ID NO: 9475699 - DNA, 22 bp, Homo sapiens
aagcatttatagataagaattt

SEQ ID NO: 9475700 - DNA, 22 bp, Homo sapiens
aagcatttatagataagaattt

SEQ ID NO: 9475701 - DNA, 22 bp, Homo sapiens
aagcattgtaagcagaagatgc

SEQ ID NO: 9475702 - DNA, 17 bp, Homo sapiens
aagcatttaatttgcta

SEQ ID NO: 9475703 - DNA, 22 bp, Homo sapiens
aagcatttatagataagaattt

SEQ ID NO: 9475704 - DNA, 23 bp, Homo sapiens
aagcatggttcacagttagtact

SEQ ID NO: 9475705 - DNA, 22 bp, Homo sapiens
aagcatgtactcaagcaaatgt

SEQ ID NO: 9475706 - DNA, 22 bp, Homo sapiens
aagcatattttaattagccaca

SEQ ID NO: 9475707 - DNA, 22 bp, Homo sapiens
aagcatagagacacaaatttgg

SEQ ID NO: 9475708 - DNA, 19 bp, Homo sapiens
aagcattagccaaagcatt

SEQ ID NO: 9475709 - DNA, 19 bp, Homo sapiens
aagcattagccaaagcatt

SEQ ID NO: 9475710 - DNA, 22 bp, Homo sapiens
aagcattgtaagcagaagatgc

SEQ ID NO: 9475711 - DNA, 22 bp, Homo sapiens
acagcagctaaaggtgtctcct

SEQ ID NO: 9475712 - DNA, 22 bp, Homo sapiens
acagcagctaaaggtgtctcct

SEQ ID NO: 9475713 - DNA, 22 bp, Homo sapiens
acagcagctaaaggtgtctcct

SEQ ID NO: 9475714 - DNA, 22 bp, Homo sapiens
aagcatttggcatgaaactctt

SEQ ID NO: 9475715 - DNA, 22 bp, Homo sapiens
aagcatttggttctgaagactc

SEQ ID NO: 9475716 - DNA, 22 bp, Homo sapiens
aagcatttctgtttatctatcg

SEQ ID NO: 9475717 - DNA, 22 bp, Homo sapiens
aagcatttggcatgaaactctt

SEQ ID NO: 9475718 - DNA, 22 bp, Homo sapiens
aagcatttcaatataatattca

SEQ ID NO: 9475719 - DNA, 22 bp, Homo sapiens
aagcatttcaatataatattca

SEQ ID NO: 9475720 - DNA, 22 bp, Homo sapiens
aagcatttcaatataatattca

SEQ ID NO: 9475721 - DNA, 22 bp, Homo sapiens
aagcatttcaatataatattca

SEQ ID NO: 9475722 - DNA, 22 bp, Homo sapiens
aagcatttcaggtagagatatt

SEQ ID NO: 9475723 - DNA, 22 bp, Homo sapiens
aagcatttcaggtagagatatt

SEQ ID NO: 9475724 - DNA, 22 bp, Homo sapiens
aagcatttcaggtagagatatt

SEQ ID NO: 9475725 - DNA, 22 bp, Homo sapiens
aagcatttcaggtagagatatt

SEQ ID NO: 9475726 - DNA, 22 bp, Homo sapiens
aagcacaggttgaggattattc

SEQ ID NO: 9475727 - DNA, 22 bp, Homo sapiens
acagaattaggagatcctcttg

SEQ ID NO: 9475728 - DNA, 18 bp, Homo sapiens
aagcacaggtgtttcagg

SEQ ID NO: 9475729 - DNA, 22 bp, Homo sapiens
aagcacagggtgtctgcattca

SEQ ID NO: 9475730 - DNA, 18 bp, Homo sapiens
aagcacaggtgtttcagg

SEQ ID NO: 9475731 - DNA, 22 bp, Homo sapiens
aagcacaggggaaataagttgt

SEQ ID NO: 9475732 - DNA, 22 bp, Homo sapiens
aagcacaggatcttgaggagcg

SEQ ID NO: 9475733 - DNA, 22 bp, Homo sapiens
aagcacaggagacgcacagcca

SEQ ID NO: 9475734 - DNA, 22 bp, Homo sapiens
aagcacaggagacgcacagcca

SEQ ID NO: 9475735 - DNA, 22 bp, Homo sapiens
acactgggtaacatatctgtta

SEQ ID NO: 9475736 - DNA, 22 bp, Homo sapiens
acactgggtaacatatctgtta

SEQ ID NO: 9475737 - DNA, 22 bp, Homo sapiens
acactgggcttgttacgttgca

SEQ ID NO: 9475738 - DNA, 22 bp, Homo sapiens
acactgggttacctgtactatt

SEQ ID NO: 9475739 - DNA, 22 bp, Homo sapiens
acactggtaggaagagatggct

SEQ ID NO: 9475740 - DNA, 22 bp, Homo sapiens
acactggtaggaagagatggct

SEQ ID NO: 9475741 - DNA, 22 bp, Homo sapiens
acactggtatgactgttccagt

SEQ ID NO: 9475742 - DNA, 22 bp, Homo sapiens
acactggtgatcaaagggtaga

SEQ ID NO: 9475743 - DNA, 22 bp, Homo sapiens
acactggtcatgcctgggtgtt

SEQ ID NO: 9475744 - DNA, 22 bp, Homo sapiens
aagcacacttggctctgtgtac

SEQ ID NO: 9475745 - DNA, 22 bp, Homo sapiens
acactggaccatttaaacttga

SEQ ID NO: 9475746 - DNA, 22 bp, Homo sapiens
acactgctcacttcttcccttg

SEQ ID NO: 9475747 - DNA, 22 bp, Homo sapiens
acactggaaatagggaggtttt

SEQ ID NO: 9475748 - DNA, 22 bp, Homo sapiens
acactggaaatagggaggtttt

SEQ ID NO: 9475749 - DNA, 19 bp, Homo sapiens
acactgggagaagactgct

SEQ ID NO: 9475750 - DNA, 21 bp, Homo sapiens
acactgcaggtgaagtgcact

SEQ ID NO: 9475751 - DNA, 21 bp, Homo sapiens
acactgcaggtgaagtgcact

SEQ ID NO: 9475752 - DNA, 22 bp, Homo sapiens
acactgcatttcaacaaggccc

SEQ ID NO: 9475753 - DNA, 22 bp, Homo sapiens
acactgctaaacagtaaagatg

SEQ ID NO: 9475754 - DNA, 22 bp, Homo sapiens
acactgctaaacagtaaagatg

SEQ ID NO: 9475755 - DNA, 22 bp, Homo sapiens
acactgcttctctggcagagcc

SEQ ID NO: 9475756 - DNA, 22 bp, Homo sapiens
acactgcttctctggcagagcc

SEQ ID NO: 9475757 - DNA, 21 bp, Homo sapiens
acactgctgtagcatattggg

SEQ ID NO: 9475758 - DNA, 22 bp, Homo sapiens
aagatttactttctttgtaata

SEQ ID NO: 9475759 - DNA, 22 bp, Homo sapiens
aagatttactagcataatagct

SEQ ID NO: 9475760 - DNA, 22 bp, Homo sapiens
aagatttattagatgcttacct

SEQ ID NO: 9475761 - DNA, 18 bp, Homo sapiens
acactgcagcagtctgct

SEQ ID NO: 9475762 - DNA, 22 bp, Homo sapiens
aagattgacggctttgagtgct

SEQ ID NO: 9475763 - DNA, 22 bp, Homo sapiens
aagattgccccatttacactgc

SEQ ID NO: 9475764 - DNA, 22 bp, Homo sapiens
aagattctttgaggattttact

SEQ ID NO: 9475765 - DNA, 22 bp, Homo sapiens
aagattctttgaggattttact

SEQ ID NO: 9475766 - DNA, 22 bp, Homo sapiens
aagattcttgactagaatgatt

SEQ ID NO: 9475767 - DNA, 22 bp, Homo sapiens
aagattcttgactagaatgatt

SEQ ID NO: 9475768 - DNA, 22 bp, Homo sapiens
aagatttaccactttattcaag

SEQ ID NO: 9475769 - DNA, 20 bp, Homo sapiens
aagattctgatttgtagcgt

SEQ ID NO: 9475770 - DNA, 18 bp, Homo sapiens
aagattctgcttctctct

SEQ ID NO: 9475771 - DNA, 22 bp, Homo sapiens
aagatgttctattttcactttt

SEQ ID NO: 9475772 - DNA, 22 bp, Homo sapiens
aagatgttctattttcactttt

SEQ ID NO: 9475773 - DNA, 22 bp, Homo sapiens
aagattcttaaatttgtttctc

SEQ ID NO: 9475774 - DNA, 22 bp, Homo sapiens
aagattctgtcagttaggagga

SEQ ID NO: 9475775 - DNA, 22 bp, Homo sapiens
aagattcttacctatacccagt

SEQ ID NO: 9475776 - DNA, 22 bp, Homo sapiens
aagattcttattaggtaatttt

SEQ ID NO: 9475777 - DNA, 22 bp, Homo sapiens
aagattctgtatttctaacaat

SEQ ID NO: 9475778 - DNA, 22 bp, Homo sapiens
aagaggcctggaggcagaggtg

SEQ ID NO: 9475779 - DNA, 22 bp, Homo sapiens
aagaggccccccagcaggtgaa

SEQ ID NO: 9475780 - DNA, 22 bp, Homo sapiens
aagaggcgctcctcacttccta

SEQ ID NO: 9475781 - DNA, 22 bp, Homo sapiens
aagaggcctggaggcagaggtg

SEQ ID NO: 9475782 - DNA, 22 bp, Homo sapiens
aagaggcctggaggcagaggtg

SEQ ID NO: 9475783 - DNA, 22 bp, Homo sapiens
aagaggctgaatgagaaagtac

SEQ ID NO: 9475784 - DNA, 22 bp, Homo sapiens
aagaggctagccggctcactaa

SEQ ID NO: 9475785 - DNA, 22 bp, Homo sapiens
aagaggctagccggctcactaa

SEQ ID NO: 9475786 - DNA, 22 bp, Homo sapiens
aagaggctggaggatactgcgc

SEQ ID NO: 9475787 - DNA, 18 bp, Homo sapiens
aagaggctgttctgtggg

SEQ ID NO: 9475788 - DNA, 22 bp, Homo sapiens
acacagtaggccaccatgtcat

SEQ ID NO: 9475789 - DNA, 22 bp, Homo sapiens
aagaggccacagctgacagcac

SEQ ID NO: 9475790 - DNA, 22 bp, Homo sapiens
aagaggccacagctgacagcac

SEQ ID NO: 9475791 - DNA, 22 bp, Homo sapiens
aagaggcatctcagcttcctct

SEQ ID NO: 9475792 - DNA, 22 bp, Homo sapiens
aagaggcatctcagcttcctct

SEQ ID NO: 9475793 - DNA, 22 bp, Homo sapiens
acacagtagtttgtcattgcta

SEQ ID NO: 9475794 - DNA, 22 bp, Homo sapiens
acacagtagtttgtcattgcta

SEQ ID NO: 9475795 - DNA, 17 bp, Homo sapiens
acacagtacttttttgc

SEQ ID NO: 9475796 - DNA, 22 bp, Homo sapiens
acacagtaccccaaggctgggc

SEQ ID NO: 9475797 - DNA, 22 bp, Homo sapiens
acacagtaaatatgtattgaat

SEQ ID NO: 9475798 - DNA, 22 bp, Homo sapiens
acacaggttccatctccacctt

SEQ ID NO: 9475799 - DNA, 22 bp, Homo sapiens
acacaggttccatctccacctt

SEQ ID NO: 9475800 - DNA, 18 bp, Homo sapiens
acacaggttattctctcc

SEQ ID NO: 9475801 - DNA, 18 bp, Homo sapiens
acacaggttattctctcc

SEQ ID NO: 9475802 - DNA, 22 bp, Homo sapiens
acacagtaaatattgtctcctc

SEQ ID NO: 9475803 - DNA, 22 bp, Homo sapiens
acacagtaaatattgtctcctc

SEQ ID NO: 9475804 - DNA, 22 bp, Homo sapiens
acacaggtacacatatgtacct

SEQ ID NO: 9475805 - DNA, 18 bp, Homo sapiens
acacaggttattctctcc

SEQ ID NO: 9475806 - DNA, 22 bp, Homo sapiens
acacaggttaaaataattggga

SEQ ID NO: 9475807 - DNA, 22 bp, Homo sapiens
acacagggtctagagttaggcc

SEQ ID NO: 9475808 - DNA, 22 bp, Homo sapiens
acacagggggcattctaggagt

SEQ ID NO: 9475809 - DNA, 22 bp, Homo sapiens
acacagggctgcgcctgacccc

SEQ ID NO: 9475810 - DNA, 22 bp, Homo sapiens
acacaggggaaagtggagctga

SEQ ID NO: 9475811 - DNA, 22 bp, Homo sapiens
aagacagcattgctgagggctt

SEQ ID NO: 9475812 - DNA, 22 bp, Homo sapiens
aagacagcattgctgagggctt

SEQ ID NO: 9475813 - DNA, 22 bp, Homo sapiens
aagacagcctttccctggtgcc

SEQ ID NO: 9475814 - DNA, 22 bp, Homo sapiens
aagacacagcgaaatgttcctg

SEQ ID NO: 9475815 - DNA, 20 bp, Homo sapiens
aagacaccagtggcagcccc

SEQ ID NO: 9475816 - DNA, 22 bp, Homo sapiens
aagacaggaacatagcaaatcc

SEQ ID NO: 9475817 - DNA, 22 bp, Homo sapiens
aagacaggaaaagctccaggcc

SEQ ID NO: 9475818 - DNA, 22 bp, Homo sapiens
aagacaggaaaagctccaggcc

SEQ ID NO: 9475819 - DNA, 22 bp, Homo sapiens
aagacaggaacatagcaaatcc

SEQ ID NO: 9475820 - DNA, 22 bp, Homo sapiens
aagacaggaacatagcaaatcc

SEQ ID NO: 9475821 - DNA, 22 bp, Homo sapiens
aattgtcaaacacaaataagag

SEQ ID NO: 9475822 - DNA, 22 bp, Homo sapiens
aattgtcaaacacaaataagag

SEQ ID NO: 9475823 - DNA, 17 bp, Homo sapiens
aattgtcagcagtagct

SEQ ID NO: 9475824 - DNA, 22 bp, Homo sapiens
aattgtcttggtgcaatcatga

SEQ ID NO: 9475825 - DNA, 22 bp, Homo sapiens
aattgtcttctccttcctggca

SEQ ID NO: 9475826 - DNA, 22 bp, Homo sapiens
aattgtcttgaaagcaacactt

SEQ ID NO: 9475827 - DNA, 22 bp, Homo sapiens
aattgtcaaaaattgcaattgt

SEQ ID NO: 9475828 - DNA, 22 bp, Homo sapiens
aattgtaagtgctgagttaagg

SEQ ID NO: 9475829 - DNA, 22 bp, Homo sapiens
aattgtaactacattgagaaca

SEQ ID NO: 9475830 - DNA, 22 bp, Homo sapiens
aagaataacacttaggttttgc

SEQ ID NO: 9475831 - DNA, 22 bp, Homo sapiens
aagaataacacttaggttttgc

SEQ ID NO: 9475832 - DNA, 22 bp, Homo sapiens
aagaataaattaagatacttag

SEQ ID NO: 9475833 - DNA, 22 bp, Homo sapiens
aagaataaattaagatacttag

SEQ ID NO: 9475834 - DNA, 22 bp, Homo sapiens
aagaataaattaagatacttag

SEQ ID NO: 9475835 - DNA, 22 bp, Homo sapiens
aagaataaattaagatacttag

SEQ ID NO: 9475836 - DNA, 22 bp, Homo sapiens
aagaataaattaagatacttag

SEQ ID NO: 9475837 - DNA, 22 bp, Homo sapiens
aagaataaattaagatacttag

SEQ ID NO: 9475838 - DNA, 23 bp, Homo sapiens
aagaataaatgacattaaaggtg

SEQ ID NO: 9475839 - DNA, 23 bp, Homo sapiens
aagaataaatgacattaaaggtg

SEQ ID NO: 9475840 - DNA, 21 bp, Homo sapiens
aagaagtttggattttgtcct

SEQ ID NO: 9475841 - DNA, 22 bp, Homo sapiens
aagaataagaggatttagaaca

SEQ ID NO: 9475842 - DNA, 22 bp, Homo sapiens
aagaataagaggatttagaaca

SEQ ID NO: 9475843 - DNA, 22 bp, Homo sapiens
aagaataagaggatttagaaca

SEQ ID NO: 9475844 - DNA, 22 bp, Homo sapiens
aagaataagtagatgggagaag

SEQ ID NO: 9475845 - DNA, 22 bp, Homo sapiens
aagaataagtagatgggagaag

SEQ ID NO: 9475846 - DNA, 22 bp, Homo sapiens
aattggactgtgctgctcaaaa

SEQ ID NO: 9475847 - DNA, 23 bp, Homo sapiens
aattggacttgctgtcaaacttc

SEQ ID NO: 9475848 - DNA, 22 bp, Homo sapiens
aattggttattctgtccttttt

SEQ ID NO: 9475849 - DNA, 22 bp, Homo sapiens
aagaaatgctgatgttggatgg

SEQ ID NO: 9475850 - DNA, 22 bp, Homo sapiens
aagaaatgcagaaatgtgctgg

SEQ ID NO: 9475851 - DNA, 22 bp, Homo sapiens
aagaaatggaagatccatggtg

SEQ ID NO: 9475852 - DNA, 22 bp, Homo sapiens
aagaaatgcacacaactgctgg

SEQ ID NO: 9475853 - DNA, 22 bp, Homo sapiens
aagaaatgcacacaactgctgg

SEQ ID NO: 9475854 - DNA, 22 bp, Homo sapiens
aagaaatgcacacaactgctgg

SEQ ID NO: 9475855 - DNA, 22 bp, Homo sapiens
aagaaatgcagaaatgtgctgg

SEQ ID NO: 9475856 - DNA, 22 bp, Homo sapiens
aatgttttaaaagagattgaga

SEQ ID NO: 9475857 - DNA, 22 bp, Homo sapiens
aatgttttaaaagagattgaga

SEQ ID NO: 9475858 - DNA, 22 bp, Homo sapiens
aatgttttaaaagagattgaga

SEQ ID NO: 9475859 - DNA, 22 bp, Homo sapiens
aatgttttatagctcaagcaat

SEQ ID NO: 9475860 - DNA, 22 bp, Homo sapiens
aatgttttagattactgctggg

SEQ ID NO: 9475861 - DNA, 22 bp, Homo sapiens
aatgttttctctgtgaacacat

SEQ ID NO: 9475862 - DNA, 22 bp, Homo sapiens
aatgttttatagctcaagcaat

SEQ ID NO: 9475863 - DNA, 22 bp, Homo sapiens
aatgttttgcattagttttcta

SEQ ID NO: 9475864 - DNA, 22 bp, Homo sapiens
aatgttttgcattagttttcta

SEQ ID NO: 9475865 - DNA, 22 bp, Homo sapiens
aatgttttgcattagttttcta

SEQ ID NO: 9475866 - DNA, 22 bp, Homo sapiens
aatgttttgcattagttttcta

SEQ ID NO: 9475867 - DNA, 22 bp, Homo sapiens
aagaaatcagaaaagcattcgt

SEQ ID NO: 9475868 - DNA, 22 bp, Homo sapiens
aagaaatcagaaaagcattcgt

SEQ ID NO: 9475869 - DNA, 22 bp, Homo sapiens
aagaaatctgatatttgtttca

SEQ ID NO: 9475870 - DNA, 22 bp, Homo sapiens
aagaaatcatatcatttcttgg

SEQ ID NO: 9475871 - DNA, 22 bp, Homo sapiens
aagaaatcatatcatttcttgg

SEQ ID NO: 9475872 - DNA, 22 bp, Homo sapiens
aagaaatattgggccttataaa

SEQ ID NO: 9475873 - DNA, 22 bp, Homo sapiens
aagaaatattgggccttataaa

SEQ ID NO: 9475874 - DNA, 22 bp, Homo sapiens
aagaaatattgggccttataaa

SEQ ID NO: 9475875 - DNA, 22 bp, Homo sapiens
aagaaatattgggccttataaa

SEQ ID NO: 9475876 - DNA, 22 bp, Homo sapiens
aagaaatattgggccttataaa

SEQ ID NO: 9475877 - DNA, 22 bp, Homo sapiens
aagaaatattgggccttataaa

SEQ ID NO: 9475878 - DNA, 22 bp, Homo sapiens
aagaaatacatggtttttgagt

SEQ ID NO: 9475879 - DNA, 22 bp, Homo sapiens
aagaaatacatggtttttgagt

SEQ ID NO: 9475880 - DNA, 22 bp, Homo sapiens
aagaaataagacttctctgtcc

SEQ ID NO: 9475881 - DNA, 22 bp, Homo sapiens
aagaaataagacttctctgtcc

SEQ ID NO: 9475882 - DNA, 22 bp, Homo sapiens
aagaaagcattagacaggcatt

SEQ ID NO: 9475883 - DNA, 22 bp, Homo sapiens
aagaaagcattagacaggcatt

SEQ ID NO: 9475884 - DNA, 22 bp, Homo sapiens
aagaaatacatggtttttgagt

SEQ ID NO: 9475885 - DNA, 22 bp, Homo sapiens
aagaaatattgggccttataaa

SEQ ID NO: 9475886 - DNA, 22 bp, Homo sapiens
aagaaatacatggtttttgagt

SEQ ID NO: 9475887 - DNA, 22 bp, Homo sapiens
aagaaagcattagacaggcatt

SEQ ID NO: 9475888 - DNA, 22 bp, Homo sapiens
aacttcatgggttcaaagctgg

SEQ ID NO: 9475889 - DNA, 22 bp, Homo sapiens
aacttcagttgagaaaggcatg

SEQ ID NO: 9475890 - DNA, 22 bp, Homo sapiens
aacttcatgtaatttaaaacag

SEQ ID NO: 9475891 - DNA, 22 bp, Homo sapiens
aacttcagggggcacattcaag

SEQ ID NO: 9475892 - DNA, 22 bp, Homo sapiens
aacttcagggggcacattcaag

SEQ ID NO: 9475893 - DNA, 22 bp, Homo sapiens
aacttcagggacagaaaagagc

SEQ ID NO: 9475894 - DNA, 22 bp, Homo sapiens
aacttattccataggctcactg

SEQ ID NO: 9475895 - DNA, 22 bp, Homo sapiens
aacttagtttagggtattgatt

SEQ ID NO: 9475896 - DNA, 22 bp, Homo sapiens
aacttagttggggacaccatgg

SEQ ID NO: 9475897 - DNA, 22 bp, Homo sapiens
aacttagtttagggtattgatt

SEQ ID NO: 9475898 - DNA, 22 bp, Homo sapiens
aacttcagagctgtgtggtttg

SEQ ID NO: 9475899 - DNA, 18 bp, Homo sapiens
aacttcaactacaatgga

SEQ ID NO: 9475900 - DNA, 22 bp, Homo sapiens
aacttcaaatgtgactttgcat

SEQ ID NO: 9475901 - DNA, 22 bp, Homo sapiens
acaaggatttgttcctaatgtt

SEQ ID NO: 9475902 - DNA, 22 bp, Homo sapiens
acaaggatttgttcctaatgtt

SEQ ID NO: 9475903 - DNA, 22 bp, Homo sapiens
acaaggcaatggcaggatttca

SEQ ID NO: 9475904 - DNA, 22 bp, Homo sapiens
acaaggcactttatgaagagga

SEQ ID NO: 9475905 - DNA, 22 bp, Homo sapiens
acaaggcaattcctggtgaatt

SEQ ID NO: 9475906 - DNA, 22 bp, Homo sapiens
acaaggcgtgacggagagagga

SEQ ID NO: 9475907 - DNA, 22 bp, Homo sapiens
acaaggcattccggaagtaacc

SEQ ID NO: 9475908 - DNA, 22 bp, Homo sapiens
acaaggcattccggaagtaacc

SEQ ID NO: 9475909 - DNA, 22 bp, Homo sapiens
acaaggcattccggaagtaacc

SEQ ID NO: 9475910 - DNA, 22 bp, Homo sapiens
acaaggcagttaaaatggttaa

SEQ ID NO: 9475911 - DNA, 22 bp, Homo sapiens
acaaggcagtacaatgatgaca

SEQ ID NO: 9475912 - DNA, 22 bp, Homo sapiens
acaaggcagtacaatgatgaca

SEQ ID NO: 9475913 - DNA, 22 bp, Homo sapiens
acaaggcagttaaaatggttaa

SEQ ID NO: 9475914 - DNA, 22 bp, Homo sapiens
acaaggcagtacaatgatgaca

SEQ ID NO: 9475915 - DNA, 22 bp, Homo sapiens
acaaggcactttatgaagagga

SEQ ID NO: 9475916 - DNA, 19 bp, Homo sapiens
acaaggctgggagagcgcc

SEQ ID NO: 9475917 - DNA, 22 bp, Homo sapiens
acaaggctgtggggagaactga

SEQ ID NO: 9475918 - DNA, 22 bp, Homo sapiens
acaaggctgaacagtgaagccg

SEQ ID NO: 9475919 - DNA, 22 bp, Homo sapiens
acaaggctggctgggaaaaact

SEQ ID NO: 9475920 - DNA, 22 bp, Homo sapiens
acaaggctctggagaagcagaa

SEQ ID NO: 9475921 - DNA, 23 bp, Homo sapiens
acaaggctctgttctgcagtttc

SEQ ID NO: 9475922 - DNA, 20 bp, Homo sapiens
aagagctgactcacagtggt

SEQ ID NO: 9475923 - DNA, 22 bp, Homo sapiens
aagagctgattaagtcatgagg

SEQ ID NO: 9475924 - DNA, 22 bp, Homo sapiens
aagagctgattaagtcatgagg

SEQ ID NO: 9475925 - DNA, 22 bp, Homo sapiens
aagagctgattaagtcatgagg

SEQ ID NO: 9475926 - DNA, 22 bp, Homo sapiens
aagagctgcacatatttatatc

SEQ ID NO: 9475927 - DNA, 22 bp, Homo sapiens
aagagctatgttaaggaagaga

SEQ ID NO: 9475928 - DNA, 20 bp, Homo sapiens
aagagctgactcacagtggt

SEQ ID NO: 9475929 - DNA, 19 bp, Homo sapiens
aagagcagggaaagaattg

SEQ ID NO: 9475930 - DNA, 22 bp, Homo sapiens
acaaggctgttggtcacaaacc

SEQ ID NO: 9475931 - DNA, 22 bp, Homo sapiens
acaaggctgttggtcacaaacc

SEQ ID NO: 9475932 - DNA, 22 bp, Homo sapiens
aagagcagtgttttactcagct

SEQ ID NO: 9475933 - DNA, 23 bp, Homo sapiens
aagagcagggaatatttatttgc

SEQ ID NO: 9475934 - DNA, 22 bp, Homo sapiens
aagagctggagctgctacagga

SEQ ID NO: 9475935 - DNA, 22 bp, Homo sapiens
aagagctggagctgctacagga

SEQ ID NO: 9475936 - DNA, 22 bp, Homo sapiens
aagagctggagtttgcagccct

SEQ ID NO: 9475937 - DNA, 22 bp, Homo sapiens
aagagctggagctgctacagga

SEQ ID NO: 9475938 - DNA, 21 bp, Homo sapiens
aagagctggatcaaggataag

SEQ ID NO: 9475939 - DNA, 21 bp, Homo sapiens
aagagctggatcaaggataag

SEQ ID NO: 9475940 - DNA, 21 bp, Homo sapiens
aagagctggatcaaggataag

SEQ ID NO: 9475941 - DNA, 22 bp, Homo sapiens
aagagctggattgtgctgcaga

SEQ ID NO: 9475942 - DNA, 22 bp, Homo sapiens
aagagctggattgtgctgcaga

SEQ ID NO: 9475943 - DNA, 22 bp, Homo sapiens
aagagcttggactttcaagtca

SEQ ID NO: 9475944 - DNA, 22 bp, Homo sapiens
aagagcttccctgttgtagagg

SEQ ID NO: 9475945 - DNA, 22 bp, Homo sapiens
aagagctgttgtctgcttactg

SEQ ID NO: 9475946 - DNA, 22 bp, Homo sapiens
aagagctgtgggtggtagtcct

SEQ ID NO: 9475947 - DNA, 22 bp, Homo sapiens
aagaggaactgggggctgagtc

SEQ ID NO: 9475948 - DNA, 22 bp, Homo sapiens
aagaggaactgggggctgagtc

SEQ ID NO: 9475949 - DNA, 22 bp, Homo sapiens
aagaggaaatgattgactatat

SEQ ID NO: 9475950 - DNA, 22 bp, Homo sapiens
aagagctgtgggtggtagtcct

SEQ ID NO: 9475951 - DNA, 21 bp, Homo sapiens
aagagctgtcaggaaggctgc

SEQ ID NO: 9475952 - DNA, 22 bp, Homo sapiens
aagagctgtatgccatatgatt

SEQ ID NO: 9475953 - DNA, 22 bp, Homo sapiens
aagagctgtatgccatatgatt

SEQ ID NO: 9475954 - DNA, 22 bp, Homo sapiens
aagagctggctcttgcagcagc

SEQ ID NO: 9475955 - DNA, 22 bp, Homo sapiens
aagagctggcccaatctgagca

SEQ ID NO: 9475956 - DNA, 22 bp, Homo sapiens
aagagctggctcttgcagcagc

SEQ ID NO: 9475957 - DNA, 22 bp, Homo sapiens
acaaagagaccatgagccaaac

SEQ ID NO: 9475958 - DNA, 20 bp, Homo sapiens
acaaagactggaaaagcaag

SEQ ID NO: 9475959 - DNA, 22 bp, Homo sapiens
acaaagagggaccagtgacttg

SEQ ID NO: 9475960 - DNA, 22 bp, Homo sapiens
acaaagacgggataaggtttgg

SEQ ID NO: 9475961 - DNA, 22 bp, Homo sapiens
acaaagacgggataaggtttgg

SEQ ID NO: 9475962 - DNA, 20 bp, Homo sapiens
acaaagactggaaaagcaag

SEQ ID NO: 9475963 - DNA, 22 bp, Homo sapiens
aagacagtgacagtcacaattg

SEQ ID NO: 9475964 - DNA, 22 bp, Homo sapiens
aagacagtgtgtcaggcaggtg

SEQ ID NO: 9475965 - DNA, 22 bp, Homo sapiens
aagacatcagtgatgacatttg

SEQ ID NO: 9475966 - DNA, 22 bp, Homo sapiens
aagacatcagtgatgacatttg

SEQ ID NO: 9475967 - DNA, 22 bp, Homo sapiens
aagacatcagtgatgacatttg

SEQ ID NO: 9475968 - DNA, 22 bp, Homo sapiens
aagacattactggaatctgact

SEQ ID NO: 9475969 - DNA, 22 bp, Homo sapiens
aagacatgactgcacagccaaa

SEQ ID NO: 9475970 - DNA, 22 bp, Homo sapiens
aagacatgcagtttgttccatt

SEQ ID NO: 9475971 - DNA, 22 bp, Homo sapiens
aagacatgcaattagcaaggaa

SEQ ID NO: 9475972 - DNA, 22 bp, Homo sapiens
acaaagatcttgctttcctact

SEQ ID NO: 9475973 - DNA, 22 bp, Homo sapiens
acaaagatgtttaaagcattta

SEQ ID NO: 9475974 - DNA, 22 bp, Homo sapiens
acaaagatgtttaaagcattta

SEQ ID NO: 9475975 - DNA, 22 bp, Homo sapiens
acaaagataagtcagaaagtca

SEQ ID NO: 9475976 - DNA, 22 bp, Homo sapiens
acaaagataagtcagaaagtca

SEQ ID NO: 9475977 - DNA, 22 bp, Homo sapiens
acaaagataagtcagaaagtca

SEQ ID NO: 9475978 - DNA, 22 bp, Homo sapiens
acaaagataagtcagaaagtca

SEQ ID NO: 9475979 - DNA, 20 bp, Homo sapiens
aagagaggaagttatactag

SEQ ID NO: 9475980 - DNA, 22 bp, Homo sapiens
aagagagaacacagcttgggca

SEQ ID NO: 9475981 - DNA, 22 bp, Homo sapiens
acaaagcacgagtgccatggac

SEQ ID NO: 9475982 - DNA, 22 bp, Homo sapiens
acaaagatgtttaaagcattta

SEQ ID NO: 9475983 - DNA, 22 bp, Homo sapiens
acaaagcacgagtgccatggac

SEQ ID NO: 9475984 - DNA, 22 bp, Homo sapiens
acaaagattcatttgcattatt

SEQ ID NO: 9475985 - DNA, 22 bp, Homo sapiens
acaaagattcatttgcattatt

SEQ ID NO: 9475986 - DNA, 22 bp, Homo sapiens
acaaagattcatttgcattatt

SEQ ID NO: 9475987 - DNA, 17 bp, Homo sapiens
aagagaggctgagctgg

SEQ ID NO: 9475988 - DNA, 17 bp, Homo sapiens
aagagaggctgagctgg

SEQ ID NO: 9475989 - DNA, 17 bp, Homo sapiens
aagagaggctgagctgg

SEQ ID NO: 9475990 - DNA, 22 bp, Homo sapiens
aagagaggggttgcatggaaat

SEQ ID NO: 9475991 - DNA, 22 bp, Homo sapiens
aagagaggggttgcatggaaat

SEQ ID NO: 9475992 - DNA, 22 bp, Homo sapiens
aagagaggggttgcatggaaat

SEQ ID NO: 9475993 - DNA, 22 bp, Homo sapiens
aagagagggatttggtttattg

SEQ ID NO: 9475994 - DNA, 22 bp, Homo sapiens
aagagaggggttgcatggaaat

SEQ ID NO: 9475995 - DNA, 22 bp, Homo sapiens
aagagagggatttggtttattg

SEQ ID NO: 9475996 - DNA, 22 bp, Homo sapiens
acaaggagaagaaattggtcat

SEQ ID NO: 9475997 - DNA, 22 bp, Homo sapiens
acaaggacgtcacttccacggt

SEQ ID NO: 9475998 - DNA, 22 bp, Homo sapiens
aagagattggttataagagatt

SEQ ID NO: 9475999 - DNA, 22 bp, Homo sapiens
aagagattggttataagagatt

SEQ ID NO: 9476000 - DNA, 20 bp, Homo sapiens
acaaggaaccaggaggtggc

SEQ ID NO: 9476001 - DNA, 22 bp, Homo sapiens
acaaggacataggaaactacaa

SEQ ID NO: 9476002 - DNA, 22 bp, Homo sapiens
aagagatgctttacatcggatg

SEQ ID NO: 9476003 - DNA, 22 bp, Homo sapiens
aagagatgatggcagccagagg

SEQ ID NO: 9476004 - DNA, 22 bp, Homo sapiens
aagagattcctcactcagaatg

SEQ ID NO: 9476005 - DNA, 22 bp, Homo sapiens
aagagatgttgaagtttattag

SEQ ID NO: 9476006 - DNA, 22 bp, Homo sapiens
aagagatgtgggctgctgtgca

SEQ ID NO: 9476007 - DNA, 22 bp, Homo sapiens
aaattctctaaagaaaacatga

SEQ ID NO: 9476008 - DNA, 22 bp, Homo sapiens
aaattctatgtcaatgtttatt

SEQ ID NO: 9476009 - DNA, 22 bp, Homo sapiens
aaattctatgtcaatgtttatt

SEQ ID NO: 9476010 - DNA, 22 bp, Homo sapiens
aaattctatgtcaatgtttatt

SEQ ID NO: 9476011 - DNA, 22 bp, Homo sapiens
aaattctaaggtcacaatgttg

SEQ ID NO: 9476012 - DNA, 19 bp, Homo sapiens
aaattctgacagtctttta

SEQ ID NO: 9476013 - DNA, 22 bp, Homo sapiens
aaattctttcatggctaataag

SEQ ID NO: 9476014 - DNA, 22 bp, Homo sapiens
aaattcttcaggtaattttgat

SEQ ID NO: 9476015 - DNA, 22 bp, Homo sapiens
aaattctggcctatcacagtga

SEQ ID NO: 9476016 - DNA, 22 bp, Homo sapiens
aaattctttcatggctaataag

SEQ ID NO: 9476017 - DNA, 22 bp, Homo sapiens
aaattctttcatggctaataag

SEQ ID NO: 9476018 - DNA, 22 bp, Homo sapiens
aaattgaatttgggaaacattg

SEQ ID NO: 9476019 - DNA, 22 bp, Homo sapiens
aaattcttttgtgcggtgaagt

SEQ ID NO: 9476020 - DNA, 22 bp, Homo sapiens
aaattgcacaatatagacatga

SEQ ID NO: 9476021 - DNA, 22 bp, Homo sapiens
aaattgcacaatatagacatga

SEQ ID NO: 9476022 - DNA, 22 bp, Homo sapiens
aaattgcagatgctaaatgact

SEQ ID NO: 9476023 - DNA, 22 bp, Homo sapiens
aaattgcagatgctaaatgact

SEQ ID NO: 9476024 - DNA, 22 bp, Homo sapiens
aaattgcaaaagtacttttagg

SEQ ID NO: 9476025 - DNA, 22 bp, Homo sapiens
aaattgcaaaagtacttttagg

SEQ ID NO: 9476026 - DNA, 22 bp, Homo sapiens
aaattgcaaaagtacttttagg

SEQ ID NO: 9476027 - DNA, 22 bp, Homo sapiens
aacaaagcaccactgagtcagt

SEQ ID NO: 9476028 - DNA, 22 bp, Homo sapiens
aacaaagcaccactgagtcagt

SEQ ID NO: 9476029 - DNA, 22 bp, Homo sapiens
aacaaagccctgcccaagagct

SEQ ID NO: 9476030 - DNA, 21 bp, Homo sapiens
aacaaagggatgctcatcttt

SEQ ID NO: 9476031 - DNA, 21 bp, Homo sapiens
aacaaagggatgctcatcttt

SEQ ID NO: 9476032 - DNA, 22 bp, Homo sapiens
aacaaagtacttttcagtgctt

SEQ ID NO: 9476033 - DNA, 22 bp, Homo sapiens
aacaaagtacttttcagtgctt

SEQ ID NO: 9476034 - DNA, 22 bp, Homo sapiens
aacaaagtagctgctgttctta

SEQ ID NO: 9476035 - DNA, 22 bp, Homo sapiens
aacaaagtcgttgcctagaaga

SEQ ID NO: 9476036 - DNA, 22 bp, Homo sapiens
aacaaagtagctgctgttctta

SEQ ID NO: 9476037 - DNA, 22 bp, Homo sapiens
aacaaagatgggtgggaaagag

SEQ ID NO: 9476038 - DNA, 22 bp, Homo sapiens
aacaaagcaccactgagtcagt

SEQ ID NO: 9476039 - DNA, 22 bp, Homo sapiens
aacaaagcaccactgagtcagt

SEQ ID NO: 9476040 - DNA, 22 bp, Homo sapiens
aacaaagatgggtgggaaagag

SEQ ID NO: 9476041 - DNA, 22 bp, Homo sapiens
aacaaactcaaatggaagagtg

SEQ ID NO: 9476042 - DNA, 22 bp, Homo sapiens
aacaaagaagactggttatttt

SEQ ID NO: 9476043 - DNA, 22 bp, Homo sapiens
aacaaacattacctggtgctgg

SEQ ID NO: 9476044 - DNA, 22 bp, Homo sapiens
aacaaacagttaagtgtggatg

SEQ ID NO: 9476045 - DNA, 20 bp, Homo sapiens
aacaaactacaaaattatgt

SEQ ID NO: 9476046 - DNA, 20 bp, Homo sapiens
aacaaactacaaaattatgt

SEQ ID NO: 9476047 - DNA, 22 bp, Homo sapiens
aacaaaccttccctatacgtct

SEQ ID NO: 9476048 - DNA, 22 bp, Homo sapiens
aacaaaccttccctatacgtct

SEQ ID NO: 9476049 - DNA, 22 bp, Homo sapiens
aacaaacctgggtggagaaagg

SEQ ID NO: 9476050 - DNA, 22 bp, Homo sapiens
aaattgcattcaggatgcagga

SEQ ID NO: 9476051 - DNA, 22 bp, Homo sapiens
aaattgcaggtaggtgggtgat

SEQ ID NO: 9476052 - DNA, 22 bp, Homo sapiens
aaattgcattcaggatgcagga

SEQ ID NO: 9476053 - DNA, 22 bp, Homo sapiens
aaattttagaccaggcaaaact

SEQ ID NO: 9476054 - DNA, 22 bp, Homo sapiens
aaattgcattgagctgcttatt

SEQ ID NO: 9476055 - DNA, 22 bp, Homo sapiens
aaattgcattcttgtcttgata

SEQ ID NO: 9476056 - DNA, 22 bp, Homo sapiens
aacaaacagttaagtgtggatg

SEQ ID NO: 9476057 - DNA, 22 bp, Homo sapiens
aaattttagaccaggcaaaact

SEQ ID NO: 9476058 - DNA, 22 bp, Homo sapiens
aaattcactctgttcctcatgg

SEQ ID NO: 9476059 - DNA, 22 bp, Homo sapiens
aaattcactctgttcctcatgg

SEQ ID NO: 9476060 - DNA, 22 bp, Homo sapiens
aaattcacttgcctgcttagct

SEQ ID NO: 9476061 - DNA, 22 bp, Homo sapiens
aaattcctgtcatttgcacttt

SEQ ID NO: 9476062 - DNA, 22 bp, Homo sapiens
aaattctaaggtcacaatgttg

SEQ ID NO: 9476063 - DNA, 22 bp, Homo sapiens
aaatgtgtttctttgtgaatgg

SEQ ID NO: 9476064 - DNA, 22 bp, Homo sapiens
aaatgtgtttagatggtttatt

SEQ ID NO: 9476065 - DNA, 22 bp, Homo sapiens
aaatgtgttcctttgctacaga

SEQ ID NO: 9476066 - DNA, 22 bp, Homo sapiens
aaatgttcccaatatgaagctg

SEQ ID NO: 9476067 - DNA, 22 bp, Homo sapiens
aaatgttccattattgtgtaat

SEQ ID NO: 9476068 - DNA, 22 bp, Homo sapiens
aaatgttaggttgtactgagtc

SEQ ID NO: 9476069 - DNA, 22 bp, Homo sapiens
aaatgttctaaattacatgtga

SEQ ID NO: 9476070 - DNA, 22 bp, Homo sapiens
aaatgttctaaattacatgtga

SEQ ID NO: 9476071 - DNA, 22 bp, Homo sapiens
aaatgttccgggtaaggagaaa

SEQ ID NO: 9476072 - DNA, 22 bp, Homo sapiens
aaatgttcctttggattaaact

SEQ ID NO: 9476073 - DNA, 22 bp, Homo sapiens
aaatgtctatctggcatattcc

SEQ ID NO: 9476074 - DNA, 22 bp, Homo sapiens
aaatgtgagttatagcaataga

SEQ ID NO: 9476075 - DNA, 19 bp, Homo sapiens
aaatgtgatggtacaattc

SEQ ID NO: 9476076 - DNA, 19 bp, Homo sapiens
aaatgtgatggtacaattc

SEQ ID NO: 9476077 - DNA, 22 bp, Homo sapiens
aaatgtgatactgttcttttta

SEQ ID NO: 9476078 - DNA, 19 bp, Homo sapiens
aaatgtgatggtacaattc

SEQ ID NO: 9476079 - DNA, 22 bp, Homo sapiens
aaatgtgctcatttataaaagt

SEQ ID NO: 9476080 - DNA, 22 bp, Homo sapiens
aaatgtgcatgagtcagaagtg

SEQ ID NO: 9476081 - DNA, 22 bp, Homo sapiens
aaatgtgctaaagtattaacat

SEQ ID NO: 9476082 - DNA, 22 bp, Homo sapiens
aagctgaattttctaaaagaat

SEQ ID NO: 9476083 - DNA, 22 bp, Homo sapiens
aaatgtgttcctttgctacaga

SEQ ID NO: 9476084 - DNA, 22 bp, Homo sapiens
aaatgtgttcctttgctacaga

SEQ ID NO: 9476085 - DNA, 22 bp, Homo sapiens
aaatgtgcttcttactctcaat

SEQ ID NO: 9476086 - DNA, 22 bp, Homo sapiens
aaatgtgcttgtgatcagctgt

SEQ ID NO: 9476087 - DNA, 22 bp, Homo sapiens
aaatgtgcttgtgatcagctgt

SEQ ID NO: 9476088 - DNA, 22 bp, Homo sapiens
aaatgtgggtaatgggactgga

SEQ ID NO: 9476089 - DNA, 22 bp, Homo sapiens
aaatgtgcttgtgatcagctgt

SEQ ID NO: 9476090 - DNA, 22 bp, Homo sapiens
aaatgtgtcagtttcattctct

SEQ ID NO: 9476091 - DNA, 22 bp, Homo sapiens
aacactctacgtgcagctccta

SEQ ID NO: 9476092 - DNA, 22 bp, Homo sapiens
aacactgaaacattgattgaca

SEQ ID NO: 9476093 - DNA, 22 bp, Homo sapiens
aacactgaaacattgattgaca

SEQ ID NO: 9476094 - DNA, 22 bp, Homo sapiens
aacactctctgttggtaaggct

SEQ ID NO: 9476095 - DNA, 22 bp, Homo sapiens
aacactaatgggagaacaaccc

SEQ ID NO: 9476096 - DNA, 22 bp, Homo sapiens
aacactaaaggtcagttagaag

SEQ ID NO: 9476097 - DNA, 22 bp, Homo sapiens
aacactcaatttacaaactctg

SEQ ID NO: 9476098 - DNA, 22 bp, Homo sapiens
aacactccgtggaggcatgcag

SEQ ID NO: 9476099 - DNA, 22 bp, Homo sapiens
aacactcaatttacaaactctg

SEQ ID NO: 9476100 - DNA, 19 bp, Homo sapiens
aacaccagagtcaggagtc

SEQ ID NO: 9476101 - DNA, 22 bp, Homo sapiens
aacacataggcagagcatgaca

SEQ ID NO: 9476102 - DNA, 22 bp, Homo sapiens
aacaccttgcagggattatgac

SEQ ID NO: 9476103 - DNA, 22 bp, Homo sapiens
aacactaaaggtcagttagaag

SEQ ID NO: 9476104 - DNA, 22 bp, Homo sapiens
aacaaatgtaaaatgcagatgc

SEQ ID NO: 9476105 - DNA, 22 bp, Homo sapiens
aacacatagacgtttgatatca

SEQ ID NO: 9476106 - DNA, 22 bp, Homo sapiens
aacacatagacgtttgatatca

SEQ ID NO: 9476107 - DNA, 22 bp, Homo sapiens
aacacatagacgtttgatatca

SEQ ID NO: 9476108 - DNA, 22 bp, Homo sapiens
aacaaatggggccttgtatgaa

SEQ ID NO: 9476109 - DNA, 22 bp, Homo sapiens
aacaaatggaacacaaatcttt

SEQ ID NO: 9476110 - DNA, 22 bp, Homo sapiens
aacaaatggaacacaaatcttt

SEQ ID NO: 9476111 - DNA, 22 bp, Homo sapiens
aacaaatggaacacaaatcttt

SEQ ID NO: 9476112 - DNA, 22 bp, Homo sapiens
aacaaatgattgttggttggag

SEQ ID NO: 9476113 - DNA, 22 bp, Homo sapiens
aacaaatgattgttggttggag

SEQ ID NO: 9476114 - DNA, 22 bp, Homo sapiens
aacaaatgataccagttctcaa

SEQ ID NO: 9476115 - DNA, 22 bp, Homo sapiens
aacaaatgacctgatttcttcc

SEQ ID NO: 9476116 - DNA, 22 bp, Homo sapiens
aacaaatcttaaagtaattcaa

SEQ ID NO: 9476117 - DNA, 22 bp, Homo sapiens
aacaaatgacctgatttcttcc

SEQ ID NO: 9476118 - DNA, 22 bp, Homo sapiens
aacaaagtcgttgcctagaaga

SEQ ID NO: 9476119 - DNA, 22 bp, Homo sapiens
aacaaagtttcaggaagataga

SEQ ID NO: 9476120 - DNA, 22 bp, Homo sapiens
aacaaagtttcaggaagataga

SEQ ID NO: 9476121 - DNA, 22 bp, Homo sapiens
aacaaagtttcaggaagataga

SEQ ID NO: 9476122 - DNA, 22 bp, Homo sapiens
aacactgaaatgtcttaagatt

SEQ ID NO: 9476123 - DNA, 22 bp, Homo sapiens
aacactgaagccgttaaacctt

SEQ ID NO: 9476124 - DNA, 22 bp, Homo sapiens
aacactgaaatgtcttaagatt

SEQ ID NO: 9476125 - DNA, 22 bp, Homo sapiens
aacactgacgacgtgaactaaa

SEQ ID NO: 9476126 - DNA, 22 bp, Homo sapiens
aacactgacctctaccctcagt

SEQ ID NO: 9476127 - DNA, 22 bp, Homo sapiens
aacactgacctctaccctcagt

SEQ ID NO: 9476128 - DNA, 22 bp, Homo sapiens
aacactgaagtagtgaatactg

SEQ ID NO: 9476129 - DNA, 22 bp, Homo sapiens
aacactgaagtagtgaatactg

SEQ ID NO: 9476130 - DNA, 22 bp, Homo sapiens
aacactgagaacaatacagagt

SEQ ID NO: 9476131 - DNA, 22 bp, Homo sapiens
aacactgacgacgtgaactaaa

SEQ ID NO: 9476132 - DNA, 22 bp, Homo sapiens
aacactgacgacgtgaactaaa

SEQ ID NO: 9476133 - DNA, 22 bp, Homo sapiens
aacactgacgacgtgaactaaa

SEQ ID NO: 9476134 - DNA, 22 bp, Homo sapiens
aacactgagaggggagtggcac

SEQ ID NO: 9476135 - DNA, 22 bp, Homo sapiens
aaggtatatgtacaatagacat

SEQ ID NO: 9476136 - DNA, 22 bp, Homo sapiens
aaggtatatctgatccatgagg

SEQ ID NO: 9476137 - DNA, 22 bp, Homo sapiens
aaggtatatgtacaatagacat

SEQ ID NO: 9476138 - DNA, 22 bp, Homo sapiens
aaggtatagcttgcatacagaa

SEQ ID NO: 9476139 - DNA, 22 bp, Homo sapiens
aaggtatagcttgcatacagaa

SEQ ID NO: 9476140 - DNA, 22 bp, Homo sapiens
aaggtattatttgcaatcattt

SEQ ID NO: 9476141 - DNA, 22 bp, Homo sapiens
aaggtattattgtctatgtact

SEQ ID NO: 9476142 - DNA, 22 bp, Homo sapiens
aaggtattttctaatgtatact

SEQ ID NO: 9476143 - DNA, 23 bp, Homo sapiens
aaggtatttattttaaaggtaag

SEQ ID NO: 9476144 - DNA, 23 bp, Homo sapiens
aaggtcacagaacttagcaagcc

SEQ ID NO: 9476145 - DNA, 22 bp, Homo sapiens
aaggtcagagcaggaaggagtc

SEQ ID NO: 9476146 - DNA, 22 bp, Homo sapiens
aaggtccagaggtcccgtcacc

SEQ ID NO: 9476147 - DNA, 20 bp, Homo sapiens
aaggtccaaactctgtgttc

SEQ ID NO: 9476148 - DNA, 20 bp, Homo sapiens
aaggtccaaactctgtgttc

SEQ ID NO: 9476149 - DNA, 22 bp, Homo sapiens
aaggtcattttttcctctgttg

SEQ ID NO: 9476150 - DNA, 22 bp, Homo sapiens
aagtccaaggctgggtgcagtg

SEQ ID NO: 9476151 - DNA, 22 bp, Homo sapiens
aagtccaaggtcaccattcaca

SEQ ID NO: 9476152 - DNA, 22 bp, Homo sapiens
aagtccaaggtcaccattcaca

SEQ ID NO: 9476153 - DNA, 23 bp, Homo sapiens
aagtccacacgtagtgaaacagt

SEQ ID NO: 9476154 - DNA, 22 bp, Homo sapiens
aagtcattatctcttctaatct

SEQ ID NO: 9476155 - DNA, 22 bp, Homo sapiens
aagtcattatctcttctaatct

SEQ ID NO: 9476156 - DNA, 22 bp, Homo sapiens
aagtcattcctgcttgttgccc

SEQ ID NO: 9476157 - DNA, 22 bp, Homo sapiens
aagtcatcttgagtctaagatt

SEQ ID NO: 9476158 - DNA, 22 bp, Homo sapiens
aagtcatgagtcctcttctgtg

SEQ ID NO: 9476159 - DNA, 22 bp, Homo sapiens
aagtcattatctcttctaatct

SEQ ID NO: 9476160 - DNA, 22 bp, Homo sapiens
aagtccaggctggcgtagagtc

SEQ ID NO: 9476161 - DNA, 22 bp, Homo sapiens
aacaggaatgaggagaaaaggt

SEQ ID NO: 9476162 - DNA, 22 bp, Homo sapiens
aacaggaattgatgggagtcct

SEQ ID NO: 9476163 - DNA, 22 bp, Homo sapiens
aacaggaattgatgggagtcct

SEQ ID NO: 9476164 - DNA, 22 bp, Homo sapiens
aagtccaggtccaggaggttcc

SEQ ID NO: 9476165 - DNA, 22 bp, Homo sapiens
aagtccaggtccaggaggttcc

SEQ ID NO: 9476166 - DNA, 22 bp, Homo sapiens
aagtccaggtcccgggctctgg

SEQ ID NO: 9476167 - DNA, 22 bp, Homo sapiens
aacagcttgaggaatatcatca

SEQ ID NO: 9476168 - DNA, 22 bp, Homo sapiens
aagtccaggctggcgtagagtc

SEQ ID NO: 9476169 - DNA, 17 bp, Homo sapiens
aagtccagagttgagca

SEQ ID NO: 9476170 - DNA, 22 bp, Homo sapiens
aagtccagaactcctgtgatag

SEQ ID NO: 9476171 - DNA, 22 bp, Homo sapiens
aagtccagacctgaggccctca

SEQ ID NO: 9476172 - DNA, 22 bp, Homo sapiens
aagtccagacctgaggccctca

SEQ ID NO: 9476173 - DNA, 22 bp, Homo sapiens
aagtccagcatttgggtagatt

SEQ ID NO: 9476174 - DNA, 17 bp, Homo sapiens
aagtccagcctgcagct

SEQ ID NO: 9476175 - DNA, 17 bp, Homo sapiens
aagtccagagttgagca

SEQ ID NO: 9476176 - DNA, 22 bp, Homo sapiens
aagtccagcatttgggtagatt

SEQ ID NO: 9476177 - DNA, 22 bp, Homo sapiens
aagtccagctgtagctcaacag

SEQ ID NO: 9476178 - DNA, 17 bp, Homo sapiens
aagtccagcctgcagct

SEQ ID NO: 9476179 - DNA, 22 bp, Homo sapiens
aacagcagctgcctgaatttgc

SEQ ID NO: 9476180 - DNA, 22 bp, Homo sapiens
aacagcagctttcaggatcatc

SEQ ID NO: 9476181 - DNA, 22 bp, Homo sapiens
aacagcagctttcaggatcatc

SEQ ID NO: 9476182 - DNA, 22 bp, Homo sapiens
aacagaggatgtttgaaattca

SEQ ID NO: 9476183 - DNA, 22 bp, Homo sapiens
aacagcagctgaggagctgggc

SEQ ID NO: 9476184 - DNA, 22 bp, Homo sapiens
aacagcagctgaggagctgggc

SEQ ID NO: 9476185 - DNA, 22 bp, Homo sapiens
aacagcaggcaccaaggctatg

SEQ ID NO: 9476186 - DNA, 22 bp, Homo sapiens
aacagcaggcatttcttagctc

SEQ ID NO: 9476187 - DNA, 22 bp, Homo sapiens
aacagcaggcaccaaggctatg

SEQ ID NO: 9476188 - DNA, 22 bp, Homo sapiens
aacagcaggcaccaaggctatg

SEQ ID NO: 9476189 - DNA, 23 bp, Homo sapiens
aacagcaggatgatagaggaggt

SEQ ID NO: 9476190 - DNA, 23 bp, Homo sapiens
aacagcaggatgatagaggaggt

SEQ ID NO: 9476191 - DNA, 23 bp, Homo sapiens
aacagcaggatgatagaggaggt

SEQ ID NO: 9476192 - DNA, 22 bp, Homo sapiens
aacagagctggtgactccaggt

SEQ ID NO: 9476193 - DNA, 22 bp, Homo sapiens
aaggtccatgactcggcatagt

SEQ ID NO: 9476194 - DNA, 22 bp, Homo sapiens
aaggtcctgtagccacagagcc

SEQ ID NO: 9476195 - DNA, 22 bp, Homo sapiens
aaggtctgagttttgccaggcc

SEQ ID NO: 9476196 - DNA, 22 bp, Homo sapiens
aaggtctcaagttttccaaagt

SEQ ID NO: 9476197 - DNA, 22 bp, Homo sapiens
aaggtctcaagttttccaaagt

SEQ ID NO: 9476198 - DNA, 22 bp, Homo sapiens
aacagcagggaaattccaagtc

SEQ ID NO: 9476199 - DNA, 22 bp, Homo sapiens
aacagcaggcatttcttagctc

SEQ ID NO: 9476200 - DNA, 22 bp, Homo sapiens
aacagcagggaaattccaagtc

SEQ ID NO: 9476201 - DNA, 22 bp, Homo sapiens
aacagcagggacttgaatggaa

SEQ ID NO: 9476202 - DNA, 22 bp, Homo sapiens
aacagcagggatgacatggcca

SEQ ID NO: 9476203 - DNA, 22 bp, Homo sapiens
aacagcagggatgacatggcca

SEQ ID NO: 9476204 - DNA, 22 bp, Homo sapiens
aacagcagggatggggtggcca

SEQ ID NO: 9476205 - DNA, 22 bp, Homo sapiens
aacagcagggggacctgctggt

SEQ ID NO: 9476206 - DNA, 22 bp, Homo sapiens
aacagcaggtcctggcatgggt

SEQ ID NO: 9476207 - DNA, 22 bp, Homo sapiens
aacagcagtggcaggagaaggc

SEQ ID NO: 9476208 - DNA, 22 bp, Homo sapiens
aacagcagtggcaggagaaggc

SEQ ID NO: 9476209 - DNA, 22 bp, Homo sapiens
aacagcagttacttttgcatca

SEQ ID NO: 9476210 - DNA, 22 bp, Homo sapiens
aacagcagttacttttgcatca

SEQ ID NO: 9476211 - DNA, 22 bp, Homo sapiens
aacagcagtggcaggagaaggc

SEQ ID NO: 9476212 - DNA, 22 bp, Homo sapiens
aacagcataagtatttatttca

SEQ ID NO: 9476213 - DNA, 22 bp, Homo sapiens
aacagcatatttcatatattga

SEQ ID NO: 9476214 - DNA, 22 bp, Homo sapiens
aacagcataccaatgtacatat

SEQ ID NO: 9476215 - DNA, 22 bp, Homo sapiens
aacagcataccaatgtacatat

SEQ ID NO: 9476216 - DNA, 22 bp, Homo sapiens
aactacagtagtttgcccttct

SEQ ID NO: 9476217 - DNA, 22 bp, Homo sapiens
aactacagtgggcagaggcaat

SEQ ID NO: 9476218 - DNA, 22 bp, Homo sapiens
aactacagtatgtccaaagaat

SEQ ID NO: 9476219 - DNA, 22 bp, Homo sapiens
aactacagtgggcagaggcaat

SEQ ID NO: 9476220 - DNA, 22 bp, Homo sapiens
aactacagcatctatacaaata

SEQ ID NO: 9476221 - DNA, 22 bp, Homo sapiens
aactacagcatctatacaaata

SEQ ID NO: 9476222 - DNA, 19 bp, Homo sapiens
aactacagcgcactgtcct

SEQ ID NO: 9476223 - DNA, 22 bp, Homo sapiens
aactacattttacagaagatga

SEQ ID NO: 9476224 - DNA, 22 bp, Homo sapiens
aatcataattgtatacattcat

SEQ ID NO: 9476225 - DNA, 22 bp, Homo sapiens
aactacattgtcctttctgaag

SEQ ID NO: 9476226 - DNA, 22 bp, Homo sapiens
aactacattgtcctttctgaag

SEQ ID NO: 9476227 - DNA, 22 bp, Homo sapiens
aactacatagaaattagtattt

SEQ ID NO: 9476228 - DNA, 22 bp, Homo sapiens
aactacatagaaattagtattt

SEQ ID NO: 9476229 - DNA, 22 bp, Homo sapiens
aactacatagaaattagtattt

SEQ ID NO: 9476230 - DNA, 22 bp, Homo sapiens
aactacatagaaattagtattt

SEQ ID NO: 9476231 - DNA, 22 bp, Homo sapiens
aactacatagaaattagtattt

SEQ ID NO: 9476232 - DNA, 22 bp, Homo sapiens
aacgcccgtggttgccaaggta

SEQ ID NO: 9476233 - DNA, 22 bp, Homo sapiens
aatataaattcctgggcccagc

SEQ ID NO: 9476234 - DNA, 22 bp, Homo sapiens
aatataaattcctgggcccagc

SEQ ID NO: 9476235 - DNA, 22 bp, Homo sapiens
aactacagaaaaggtaagctct

SEQ ID NO: 9476236 - DNA, 22 bp, Homo sapiens
aactacagaatcatagaaaata

SEQ ID NO: 9476237 - DNA, 22 bp, Homo sapiens
aactacagaatcatagaaaata

SEQ ID NO: 9476238 - DNA, 22 bp, Homo sapiens
aacgtcttctctccaagtaaat

SEQ ID NO: 9476239 - DNA, 22 bp, Homo sapiens
aacggctgtggctggcggcagc

SEQ ID NO: 9476240 - DNA, 20 bp, Homo sapiens
aacggctgctttggggttgt

SEQ ID NO: 9476241 - DNA, 22 bp, Homo sapiens
aacggctgtggctggcggcagc

SEQ ID NO: 9476242 - DNA, 22 bp, Homo sapiens
aacgcccgtggttgccaaggta

SEQ ID NO: 9476243 - DNA, 22 bp, Homo sapiens
aatccaatcctactcagaaagt

SEQ ID NO: 9476244 - DNA, 22 bp, Homo sapiens
aactgaaacttaggaagtaatc

SEQ ID NO: 9476245 - DNA, 22 bp, Homo sapiens
aactgaaacttaggaagtaatc

SEQ ID NO: 9476246 - DNA, 22 bp, Homo sapiens
aactgaaacttaggaagtaatc

SEQ ID NO: 9476247 - DNA, 22 bp, Homo sapiens
aactgcaagagtaaatgtctag

SEQ ID NO: 9476248 - DNA, 22 bp, Homo sapiens
aactgcaagagtaaatgtctag

SEQ ID NO: 9476249 - DNA, 22 bp, Homo sapiens
aactgcaagctctttactgcta

SEQ ID NO: 9476250 - DNA, 22 bp, Homo sapiens
aactgcaagtggggcttgtcat

SEQ ID NO: 9476251 - DNA, 22 bp, Homo sapiens
aactgcattcagaaagctcact

SEQ ID NO: 9476252 - DNA, 22 bp, Homo sapiens
aactgcattagctaacgtgagt

SEQ ID NO: 9476253 - DNA, 22 bp, Homo sapiens
aactgcagttaacaagtcttca

SEQ ID NO: 9476254 - DNA, 22 bp, Homo sapiens
aatcatgtttacgtgacatgtc

SEQ ID NO: 9476255 - DNA, 22 bp, Homo sapiens
aatcatgtttcagatgagtttt

SEQ ID NO: 9476256 - DNA, 22 bp, Homo sapiens
aatcatgtttacgtgacatgtc

SEQ ID NO: 9476257 - DNA, 22 bp, Homo sapiens
aatcattcttatttcacagcaa

SEQ ID NO: 9476258 - DNA, 22 bp, Homo sapiens
aatcattctcatgccagtttcc

SEQ ID NO: 9476259 - DNA, 22 bp, Homo sapiens
aatccaatcctactcagaaagt

SEQ ID NO: 9476260 - DNA, 22 bp, Homo sapiens
aatccaatcctactcagaaagt

SEQ ID NO: 9476261 - DNA, 22 bp, Homo sapiens
aatcattgagacaaattagctt

SEQ ID NO: 9476262 - DNA, 22 bp, Homo sapiens
aatcattgagacaaattagctt

SEQ ID NO: 9476263 - DNA, 22 bp, Homo sapiens
aatcatctccgaaaaaagagta

SEQ ID NO: 9476264 - DNA, 22 bp, Homo sapiens
aatcatcctgaagtcaataaag

SEQ ID NO: 9476265 - DNA, 22 bp, Homo sapiens
aatcatcacgaacacaacagcg

SEQ ID NO: 9476266 - DNA, 22 bp, Homo sapiens
aatcatcacgaacacaacagcg

SEQ ID NO: 9476267 - DNA, 22 bp, Homo sapiens
aatcataattttgtgaatgtag

SEQ ID NO: 9476268 - DNA, 21 bp, Homo sapiens
aatcatacaaaacatgtcagg

SEQ ID NO: 9476269 - DNA, 22 bp, Homo sapiens
aatcatgacaggaatagaaggg

SEQ ID NO: 9476270 - DNA, 22 bp, Homo sapiens
aatcatgaaatatcagttcttt

SEQ ID NO: 9476271 - DNA, 22 bp, Homo sapiens
aatcatcttcatcttacacaga

SEQ ID NO: 9476272 - DNA, 23 bp, Homo sapiens
aacttaatactgggataagatgc

SEQ ID NO: 9476273 - DNA, 23 bp, Homo sapiens
aacttaatactgggataagatgc

SEQ ID NO: 9476274 - DNA, 22 bp, Homo sapiens
aacttacaatgttagagtctca

SEQ ID NO: 9476275 - DNA, 22 bp, Homo sapiens
aacttacaaggatgatagctgc

SEQ ID NO: 9476276 - DNA, 22 bp, Homo sapiens
aacttacaaggatgatagctgc

SEQ ID NO: 9476277 - DNA, 22 bp, Homo sapiens
aacttacaaggatgatagctgc

SEQ ID NO: 9476278 - DNA, 22 bp, Homo sapiens
aacttacaaggatgatagctgc

SEQ ID NO: 9476279 - DNA, 22 bp, Homo sapiens
aacttaggaaaataaggcatga

SEQ ID NO: 9476280 - DNA, 22 bp, Homo sapiens
aacttaaacccactcatgtaga

SEQ ID NO: 9476281 - DNA, 22 bp, Homo sapiens
aacttaaacccactcatgtaga

SEQ ID NO: 9476282 - DNA, 22 bp, Homo sapiens
aacttaaacccactcatgtaga

SEQ ID NO: 9476283 - DNA, 22 bp, Homo sapiens
aacttaaacccactcatgtaga

SEQ ID NO: 9476284 - DNA, 22 bp, Homo sapiens
aacttaaacaagctcccaagtt

SEQ ID NO: 9476285 - DNA, 22 bp, Homo sapiens
aactgtttttcacgtgtctcat

SEQ ID NO: 9476286 - DNA, 22 bp, Homo sapiens
aactgttttttactagaggact

SEQ ID NO: 9476287 - DNA, 19 bp, Homo sapiens
aactgtaaagatctgtagc

SEQ ID NO: 9476288 - DNA, 22 bp, Homo sapiens
aactgttacatagttatagatc

SEQ ID NO: 9476289 - DNA, 22 bp, Homo sapiens
aactgttctacccttcatttca

SEQ ID NO: 9476290 - DNA, 22 bp, Homo sapiens
aactgttccttaagatgttaat

SEQ ID NO: 9476291 - DNA, 22 bp, Homo sapiens
aactgttcttcattttcagtat

SEQ ID NO: 9476292 - DNA, 22 bp, Homo sapiens
aactgttcttgtgtttgctatg

SEQ ID NO: 9476293 - DNA, 22 bp, Homo sapiens
aactgttcttgtgtttgctatg

SEQ ID NO: 9476294 - DNA, 22 bp, Homo sapiens
aactgtttcagaaatattgttg

SEQ ID NO: 9476295 - DNA, 22 bp, Homo sapiens
aactgtttatgtaagtatgcag

SEQ ID NO: 9476296 - DNA, 22 bp, Homo sapiens
aactgtttggaactcttccaca

SEQ ID NO: 9476297 - DNA, 22 bp, Homo sapiens
aactgtttttcacgtgtctcat

SEQ ID NO: 9476298 - DNA, 22 bp, Homo sapiens
aactgtttatgtaagtatgcag

SEQ ID NO: 9476299 - DNA, 20 bp, Homo sapiens
aatgatcagcatagcaagga

SEQ ID NO: 9476300 - DNA, 20 bp, Homo sapiens
aatgatcagcatagcaagga

SEQ ID NO: 9476301 - DNA, 22 bp, Homo sapiens
aatgatcacctggtaaagagag

SEQ ID NO: 9476302 - DNA, 22 bp, Homo sapiens
aatgatcacctggtaaagagag

SEQ ID NO: 9476303 - DNA, 22 bp, Homo sapiens
aatgatcacctggtaaagagag

SEQ ID NO: 9476304 - DNA, 22 bp, Homo sapiens
aatgatcacctggtaaagagag

SEQ ID NO: 9476305 - DNA, 22 bp, Homo sapiens
aatgatcactgcagttgatgag

SEQ ID NO: 9476306 - DNA, 22 bp, Homo sapiens
aatgatcccatttagaaacaga

SEQ ID NO: 9476307 - DNA, 22 bp, Homo sapiens
aatgatcattataaagtgctct

SEQ ID NO: 9476308 - DNA, 22 bp, Homo sapiens
aatgatcattataaagtgctct

SEQ ID NO: 9476309 - DNA, 22 bp, Homo sapiens
aatgatcattataaagtgctct

SEQ ID NO: 9476310 - DNA, 20 bp, Homo sapiens
aatgatcagcatagcaagga

SEQ ID NO: 9476311 - DNA, 22 bp, Homo sapiens
aatgatcattataaagtgctct

SEQ ID NO: 9476312 - DNA, 22 bp, Homo sapiens
aatgatctactctcattatctc

SEQ ID NO: 9476313 - DNA, 22 bp, Homo sapiens
aatgatatagcagacatagcct

SEQ ID NO: 9476314 - DNA, 22 bp, Homo sapiens
aatgatatagcagacatagcct

SEQ ID NO: 9476315 - DNA, 22 bp, Homo sapiens
aatgatatagcagacatagcct

SEQ ID NO: 9476316 - DNA, 22 bp, Homo sapiens
aatgatatttattgaatagatg

SEQ ID NO: 9476317 - DNA, 22 bp, Homo sapiens
aatgatatttattgaatagatg

SEQ ID NO: 9476318 - DNA, 22 bp, Homo sapiens
aactgcatttaacaaatactct

SEQ ID NO: 9476319 - DNA, 22 bp, Homo sapiens
aactgcatttgcataagtccat

SEQ ID NO: 9476320 - DNA, 22 bp, Homo sapiens
aactgctctgcatgcaatggaa

SEQ ID NO: 9476321 - DNA, 22 bp, Homo sapiens
aactgctgcatcttagaatgca

SEQ ID NO: 9476322 - DNA, 22 bp, Homo sapiens
aactgctggggaggccaaactc

SEQ ID NO: 9476323 - DNA, 22 bp, Homo sapiens
aatgataccgccaatattacca

SEQ ID NO: 9476324 - DNA, 22 bp, Homo sapiens
aatgataccgccaatattacca

SEQ ID NO: 9476325 - DNA, 22 bp, Homo sapiens
aatgataccaaacatgtagata

SEQ ID NO: 9476326 - DNA, 22 bp, Homo sapiens
aatgatacatatgtatcgttag

SEQ ID NO: 9476327 - DNA, 22 bp, Homo sapiens
aatgataagacatgagtagagg

SEQ ID NO: 9476328 - DNA, 22 bp, Homo sapiens
aatgataagacatgagtagagg

SEQ ID NO: 9476329 - DNA, 22 bp, Homo sapiens
aacaggaattgcaggcagatct

SEQ ID NO: 9476330 - DNA, 22 bp, Homo sapiens
aacaggaattgcaggcagatct

SEQ ID NO: 9476331 - DNA, 22 bp, Homo sapiens
aacaggaattgatgggagtcct

SEQ ID NO: 9476332 - DNA, 22 bp, Homo sapiens
aacaggaccttccaatccatca

SEQ ID NO: 9476333 - DNA, 22 bp, Homo sapiens
aacaggagaggggaatgtagag

SEQ ID NO: 9476334 - DNA, 22 bp, Homo sapiens
aacaggagagtaaatatatgat

SEQ ID NO: 9476335 - DNA, 22 bp, Homo sapiens
aacaggaggccttccagtccag

SEQ ID NO: 9476336 - DNA, 22 bp, Homo sapiens
aacaggagtcattgtcattatt

SEQ ID NO: 9476337 - DNA, 22 bp, Homo sapiens
aacaggaggccttccagtccag

SEQ ID NO: 9476338 - DNA, 22 bp, Homo sapiens
aacaggaggccttccagtccag

SEQ ID NO: 9476339 - DNA, 22 bp, Homo sapiens
aacaggcaacagttgactctga

SEQ ID NO: 9476340 - DNA, 22 bp, Homo sapiens
aacaggagtcattgtcattatt

SEQ ID NO: 9476341 - DNA, 22 bp, Homo sapiens
aacaggctagttttaaagcata

SEQ ID NO: 9476342 - DNA, 22 bp, Homo sapiens
aacaggctatttctttacaaac

SEQ ID NO: 9476343 - DNA, 22 bp, Homo sapiens
aacaggctaagtatttggtagc

SEQ ID NO: 9476344 - DNA, 22 bp, Homo sapiens
aacaggcagcagactgaatctg

SEQ ID NO: 9476345 - DNA, 22 bp, Homo sapiens
aacaggcaggagaattctgcct

SEQ ID NO: 9476346 - DNA, 20 bp, Homo sapiens
aacagggcagaagcggagac

SEQ ID NO: 9476347 - DNA, 22 bp, Homo sapiens
aacagggctttggaagtctccg

SEQ ID NO: 9476348 - DNA, 22 bp, Homo sapiens
aacagggacaaggatagagaaa

SEQ ID NO: 9476349 - DNA, 22 bp, Homo sapiens
aacaggcttttggaaagttaca

SEQ ID NO: 9476350 - DNA, 22 bp, Homo sapiens
aacaggcttccaggagggacga

SEQ ID NO: 9476351 - DNA, 22 bp, Homo sapiens
aacaggcttcttctgggctcct

SEQ ID NO: 9476352 - DNA, 22 bp, Homo sapiens
aacaggctggccttgaagcagt

SEQ ID NO: 9476353 - DNA, 22 bp, Homo sapiens
aacaggctggccttgaagcagt

SEQ ID NO: 9476354 - DNA, 18 bp, Homo sapiens
aacatgcattagaactgc

SEQ ID NO: 9476355 - DNA, 22 bp, Homo sapiens
aacatgcatgttatttatcagt

SEQ ID NO: 9476356 - DNA, 22 bp, Homo sapiens
aacatgctctgtttcttggatg

SEQ ID NO: 9476357 - DNA, 22 bp, Homo sapiens
aacatgctcttcctggctagtc

SEQ ID NO: 9476358 - DNA, 22 bp, Homo sapiens
aacatgctctggattgctgtga

SEQ ID NO: 9476359 - DNA, 22 bp, Homo sapiens
aacatgctgggtgtttttgatg

SEQ ID NO: 9476360 - DNA, 22 bp, Homo sapiens
aacatgaaacccaaacagaata

SEQ ID NO: 9476361 - DNA, 22 bp, Homo sapiens
aacatgaaacccaaacagaata

SEQ ID NO: 9476362 - DNA, 22 bp, Homo sapiens
aacatgaaacccaaacagaata

SEQ ID NO: 9476363 - DNA, 22 bp, Homo sapiens
aacatgcaggttttagggttgc

SEQ ID NO: 9476364 - DNA, 22 bp, Homo sapiens
aacagtaaaaatcatttagttg

SEQ ID NO: 9476365 - DNA, 22 bp, Homo sapiens
aacaggggtgggtgctactgga

SEQ ID NO: 9476366 - DNA, 22 bp, Homo sapiens
aacaggggctggttgaaagagc

SEQ ID NO: 9476367 - DNA, 22 bp, Homo sapiens
aacaggggattagatagcaggc

SEQ ID NO: 9476368 - DNA, 20 bp, Homo sapiens
aacagggggctgcagagggc

SEQ ID NO: 9476369 - DNA, 20 bp, Homo sapiens
aacagggggctgcagagggc

SEQ ID NO: 9476370 - DNA, 22 bp, Homo sapiens
aaccacatgaaaagagtaatat

SEQ ID NO: 9476371 - DNA, 22 bp, Homo sapiens
aaccacagagccccctcagatg

SEQ ID NO: 9476372 - DNA, 22 bp, Homo sapiens
aaccacaacactaaatgctggt

SEQ ID NO: 9476373 - DNA, 22 bp, Homo sapiens
aaccaatttaaatataaagact

SEQ ID NO: 9476374 - DNA, 22 bp, Homo sapiens
aaccacaacactaaatgctggt

SEQ ID NO: 9476375 - DNA, 22 bp, Homo sapiens
aaccaagagggttttccttgaa

SEQ ID NO: 9476376 - DNA, 22 bp, Homo sapiens
aaccaagcccattactttactt

SEQ ID NO: 9476377 - DNA, 22 bp, Homo sapiens
aaccaagagggttttccttgaa

SEQ ID NO: 9476378 - DNA, 22 bp, Homo sapiens
aaccaaggacagctagtgatgc

SEQ ID NO: 9476379 - DNA, 22 bp, Homo sapiens
aaccaagctcaatggtctgagt

SEQ ID NO: 9476380 - DNA, 22 bp, Homo sapiens
aaccaagtttattccaagttac

SEQ ID NO: 9476381 - DNA, 22 bp, Homo sapiens
aaccacatggctcagtggacat

SEQ ID NO: 9476382 - DNA, 22 bp, Homo sapiens
aaccaccattctctcctcttcc

SEQ ID NO: 9476383 - DNA, 22 bp, Homo sapiens
aaccagaaggaatctgagctga

SEQ ID NO: 9476384 - DNA, 22 bp, Homo sapiens
aaccagaaggaatctgagctga

SEQ ID NO: 9476385 - DNA, 22 bp, Homo sapiens
aaccactggtctgaggtacaag

SEQ ID NO: 9476386 - DNA, 22 bp, Homo sapiens
aaccactggtctgaggtacaag

SEQ ID NO: 9476387 - DNA, 22 bp, Homo sapiens
aatagtttgaatttatcagatg

SEQ ID NO: 9476388 - DNA, 22 bp, Homo sapiens
aatagtttgaatttatcagatg

SEQ ID NO: 9476389 - DNA, 22 bp, Homo sapiens
aatagttgtgaatcaggactag

SEQ ID NO: 9476390 - DNA, 22 bp, Homo sapiens
aatataaattcctgggcccagc

SEQ ID NO: 9476391 - DNA, 21 bp, Homo sapiens
aaccagagccaggctctcagc

SEQ ID NO: 9476392 - DNA, 22 bp, Homo sapiens
aaccagagctttaaaaatctgt

SEQ ID NO: 9476393 - DNA, 22 bp, Homo sapiens
aatagtgcttacattatcatga

SEQ ID NO: 9476394 - DNA, 22 bp, Homo sapiens
aatagttaagcaactttttcca

SEQ ID NO: 9476395 - DNA, 22 bp, Homo sapiens
aataagaactccatttactcgt

SEQ ID NO: 9476396 - DNA, 22 bp, Homo sapiens
aataagaactccatttactcgt

SEQ ID NO: 9476397 - DNA, 22 bp, Homo sapiens
aataacttttaaaagaccctgg

SEQ ID NO: 9476398 - DNA, 22 bp, Homo sapiens
aataacttttaaaagaccctgg

SEQ ID NO: 9476399 - DNA, 22 bp, Homo sapiens
aataagaacaactaaggtttat

SEQ ID NO: 9476400 - DNA, 22 bp, Homo sapiens
aataagaaagagtcagcttcag

SEQ ID NO: 9476401 - DNA, 22 bp, Homo sapiens
aacatttttaagaccaagtgct

SEQ ID NO: 9476402 - DNA, 22 bp, Homo sapiens
aacatttcataacttgactttt

SEQ ID NO: 9476403 - DNA, 22 bp, Homo sapiens
aacatttttaagaccaagtgct

SEQ ID NO: 9476404 - DNA, 21 bp, Homo sapiens
aacatttcaggatccaaattg

SEQ ID NO: 9476405 - DNA, 21 bp, Homo sapiens
aacatttcaggatccaaattg

SEQ ID NO: 9476406 - DNA, 22 bp, Homo sapiens
aataacttgaagatctcttcca

SEQ ID NO: 9476407 - DNA, 22 bp, Homo sapiens
aataacttgaagatctcttcca

SEQ ID NO: 9476408 - DNA, 22 bp, Homo sapiens
aataacttgtatggttattcca

SEQ ID NO: 9476409 - DNA, 22 bp, Homo sapiens
aataacttcatcttcaggatag

SEQ ID NO: 9476410 - DNA, 22 bp, Homo sapiens
aataacttcatcttcaggatag

SEQ ID NO: 9476411 - DNA, 22 bp, Homo sapiens
aataacttcatgtaacatttaa

SEQ ID NO: 9476412 - DNA, 22 bp, Homo sapiens
aataacttcatgtaacatttaa

SEQ ID NO: 9476413 - DNA, 22 bp, Homo sapiens
aataacttcagttcttacatta

SEQ ID NO: 9476414 - DNA, 22 bp, Homo sapiens
aataacttcagttcttacatta

SEQ ID NO: 9476415 - DNA, 22 bp, Homo sapiens
aacatggctcatgagagatttg

SEQ ID NO: 9476416 - DNA, 22 bp, Homo sapiens
aacatggaggcagacagacgtg

SEQ ID NO: 9476417 - DNA, 19 bp, Homo sapiens
aacatggaactggagaggg

SEQ ID NO: 9476418 - DNA, 22 bp, Homo sapiens
agaaaacataggagacaggaaa

SEQ ID NO: 9476419 - DNA, 22 bp, Homo sapiens
agaaaacagaaagtcattggtg

SEQ ID NO: 9476420 - DNA, 22 bp, Homo sapiens
agaaaacataggagacaggaaa

SEQ ID NO: 9476421 - DNA, 22 bp, Homo sapiens
agaaaacataggagacaggaaa

SEQ ID NO: 9476422 - DNA, 22 bp, Homo sapiens
agaaaacataggagacaggaaa

SEQ ID NO: 9476423 - DNA, 22 bp, Homo sapiens
agaaaacataggagacaggaaa

SEQ ID NO: 9476424 - DNA, 22 bp, Homo sapiens
agaaaacataggagacaggaaa

SEQ ID NO: 9476425 - DNA, 22 bp, Homo sapiens
agaaaacataggagacaggaaa

SEQ ID NO: 9476426 - DNA, 22 bp, Homo sapiens
agaaaacactgccccctctctc

SEQ ID NO: 9476427 - DNA, 22 bp, Homo sapiens
agaaaacagaaagtcattggtg

SEQ ID NO: 9476428 - DNA, 22 bp, Homo sapiens
agaaaaatcttggcgcttgtct

SEQ ID NO: 9476429 - DNA, 22 bp, Homo sapiens
agaaaaatcttggcgcttgtct

SEQ ID NO: 9476430 - DNA, 22 bp, Homo sapiens
agaaaactctacatctgtatgt

SEQ ID NO: 9476431 - DNA, 22 bp, Homo sapiens
agaaaacattacataggtgtgt

SEQ ID NO: 9476432 - DNA, 22 bp, Homo sapiens
agaaaacattacataggtgtgt

SEQ ID NO: 9476433 - DNA, 22 bp, Homo sapiens
agaaaacattacataggtgtgt

SEQ ID NO: 9476434 - DNA, 22 bp, Homo sapiens
agaaaactctacatctgtatgt

SEQ ID NO: 9476435 - DNA, 22 bp, Homo sapiens
agaaaactgcagagtagcctca

SEQ ID NO: 9476436 - DNA, 22 bp, Homo sapiens
agaaaactgcagagtagcctca

SEQ ID NO: 9476437 - DNA, 22 bp, Homo sapiens
aatgaaactcgaaataatcaca

SEQ ID NO: 9476438 - DNA, 22 bp, Homo sapiens
aatgaacaagaaagactttgag

SEQ ID NO: 9476439 - DNA, 22 bp, Homo sapiens
aatgaacaagaaagactttgag

SEQ ID NO: 9476440 - DNA, 22 bp, Homo sapiens
aatgaacacatgtggtcagttt

SEQ ID NO: 9476441 - DNA, 22 bp, Homo sapiens
aatgaacacagccctctacttt

SEQ ID NO: 9476442 - DNA, 22 bp, Homo sapiens
aatgaacacgctggtggtgcaa

SEQ ID NO: 9476443 - DNA, 22 bp, Homo sapiens
aatgaacagtgggtgaggtacc

SEQ ID NO: 9476444 - DNA, 22 bp, Homo sapiens
aatgaacatataaagagatctt

SEQ ID NO: 9476445 - DNA, 22 bp, Homo sapiens
aatgaacatataaagagatctt

SEQ ID NO: 9476446 - DNA, 22 bp, Homo sapiens
aatgaacaggtgaatgtcagat

SEQ ID NO: 9476447 - DNA, 22 bp, Homo sapiens
aatgaacccttcaagctctgat

SEQ ID NO: 9476448 - DNA, 22 bp, Homo sapiens
aatgaacccttcaagctctgat

SEQ ID NO: 9476449 - DNA, 22 bp, Homo sapiens
aatgaacatggacaagttaata

SEQ ID NO: 9476450 - DNA, 22 bp, Homo sapiens
aatgaacatggacaagttaata

SEQ ID NO: 9476451 - DNA, 22 bp, Homo sapiens
aatgaacatataaagagatctt

SEQ ID NO: 9476452 - DNA, 22 bp, Homo sapiens
aatgaacatataaagagatctt

SEQ ID NO: 9476453 - DNA, 22 bp, Homo sapiens
agaaatactaggaatattcata

SEQ ID NO: 9476454 - DNA, 22 bp, Homo sapiens
agaaatactaggaatattcata

SEQ ID NO: 9476455 - DNA, 22 bp, Homo sapiens
agaaatacaaagtactaagata

SEQ ID NO: 9476456 - DNA, 21 bp, Homo sapiens
agaaatacagcagggatgatc

SEQ ID NO: 9476457 - DNA, 20 bp, Homo sapiens
agaaatacatgcatgcatga

SEQ ID NO: 9476458 - DNA, 22 bp, Homo sapiens
agaaataagagctttccttggg

SEQ ID NO: 9476459 - DNA, 22 bp, Homo sapiens
agaaataatcagcttaggggca

SEQ ID NO: 9476460 - DNA, 22 bp, Homo sapiens
agaaataagagctttccttggg

SEQ ID NO: 9476461 - DNA, 22 bp, Homo sapiens
agaaataagagctttccttggg

SEQ ID NO: 9476462 - DNA, 19 bp, Homo sapiens
aatgactgagtacattgtc

SEQ ID NO: 9476463 - DNA, 22 bp, Homo sapiens
aatgactttgaaatatttgagt

SEQ ID NO: 9476464 - DNA, 22 bp, Homo sapiens
aatgagaaaacacagaggaggt

SEQ ID NO: 9476465 - DNA, 22 bp, Homo sapiens
aatgagaaaacacagaggaggt

SEQ ID NO: 9476466 - DNA, 22 bp, Homo sapiens
aatgagaaccttgaaaggaact

SEQ ID NO: 9476467 - DNA, 22 bp, Homo sapiens
aatgagaaccttgaaaggaact

SEQ ID NO: 9476468 - DNA, 22 bp, Homo sapiens
aatgagacacgtgaagcagatg

SEQ ID NO: 9476469 - DNA, 22 bp, Homo sapiens
aatgagaatgtaagtgaagaga

SEQ ID NO: 9476470 - DNA, 22 bp, Homo sapiens
aatgagaatgtaagtgaagaga

SEQ ID NO: 9476471 - DNA, 22 bp, Homo sapiens
aatgagagaagacaggcaagtg

SEQ ID NO: 9476472 - DNA, 23 bp, Homo sapiens
aatgagagaccatgtggagcaga

SEQ ID NO: 9476473 - DNA, 22 bp, Homo sapiens
aatgagaatgtaagtgaagaga

SEQ ID NO: 9476474 - DNA, 22 bp, Homo sapiens
aatgagaatgtaagtgaagaga

SEQ ID NO: 9476475 - DNA, 22 bp, Homo sapiens
aatgagaatgtaagtgaagaga

SEQ ID NO: 9476476 - DNA, 22 bp, Homo sapiens
aatgagaactgggagttggtgg

SEQ ID NO: 9476477 - DNA, 22 bp, Homo sapiens
aatgagaactgggagttggtgg

SEQ ID NO: 9476478 - DNA, 22 bp, Homo sapiens
aatgagaaccttgaaaggaact

SEQ ID NO: 9476479 - DNA, 22 bp, Homo sapiens
agaaatactgcctaagactgta

SEQ ID NO: 9476480 - DNA, 22 bp, Homo sapiens
agaaatactgtgagagcagcct

SEQ ID NO: 9476481 - DNA, 22 bp, Homo sapiens
agaaatactgcctaagactgta

SEQ ID NO: 9476482 - DNA, 20 bp, Homo sapiens
agaaatactttggtataatg

SEQ ID NO: 9476483 - DNA, 22 bp, Homo sapiens
aatgaatgtgattaacttcaag

SEQ ID NO: 9476484 - DNA, 22 bp, Homo sapiens
aatgaatgtgattaacttcaag

SEQ ID NO: 9476485 - DNA, 22 bp, Homo sapiens
aatgaatgggtttaatatttta

SEQ ID NO: 9476486 - DNA, 22 bp, Homo sapiens
aatgaatgtgattaacttcaag

SEQ ID NO: 9476487 - DNA, 22 bp, Homo sapiens
aatgaccagcgcctgcagaggg

SEQ ID NO: 9476488 - DNA, 22 bp, Homo sapiens
aatgactctgctgcagagacac

SEQ ID NO: 9476489 - DNA, 22 bp, Homo sapiens
aatgactagtccacatttgtaa

SEQ ID NO: 9476490 - DNA, 22 bp, Homo sapiens
aatgactgaagcaattgcagtg

SEQ ID NO: 9476491 - DNA, 22 bp, Homo sapiens
aatgaggtgaggaaggcctcag

SEQ ID NO: 9476492 - DNA, 20 bp, Homo sapiens
aatgaggcaatggagggcat

SEQ ID NO: 9476493 - DNA, 21 bp, Homo sapiens
aatgaggcaaggaggaggata

SEQ ID NO: 9476494 - DNA, 22 bp, Homo sapiens
aatgagcttctataatcttgtc

SEQ ID NO: 9476495 - DNA, 22 bp, Homo sapiens
aatgagatcagagataactcaa

SEQ ID NO: 9476496 - DNA, 22 bp, Homo sapiens
aatgagatggaattcccgccta

SEQ ID NO: 9476497 - DNA, 22 bp, Homo sapiens
aatgagattccaatagctcctg

SEQ ID NO: 9476498 - DNA, 22 bp, Homo sapiens
aatgagtcaaaacagcatatag

SEQ ID NO: 9476499 - DNA, 22 bp, Homo sapiens
aatgagtcaaaacagcatatag

SEQ ID NO: 9476500 - DNA, 20 bp, Homo sapiens
aatgagtcctgctggatcac

SEQ ID NO: 9476501 - DNA, 22 bp, Homo sapiens
aatgagttatttaatagaaagg

SEQ ID NO: 9476502 - DNA, 22 bp, Homo sapiens
aatgagttagatgagaaaataa

SEQ ID NO: 9476503 - DNA, 19 bp, Homo sapiens
aatgagttccatgaaaaga

SEQ ID NO: 9476504 - DNA, 18 bp, Homo sapiens
agaaggagctatgggcag

SEQ ID NO: 9476505 - DNA, 22 bp, Homo sapiens
aatgagttctgacacttcacga

SEQ ID NO: 9476506 - DNA, 22 bp, Homo sapiens
agaagggagagaaagttggtta

SEQ ID NO: 9476507 - DNA, 22 bp, Homo sapiens
agaagggaactcagagatgatt

SEQ ID NO: 9476508 - DNA, 18 bp, Homo sapiens
agaaggagctatgggcag

SEQ ID NO: 9476509 - DNA, 22 bp, Homo sapiens
agaagggaactcagagatgatt

SEQ ID NO: 9476510 - DNA, 22 bp, Homo sapiens
agaagggaactcagagatgatt

SEQ ID NO: 9476511 - DNA, 22 bp, Homo sapiens
agaagggaactcagagatgatt

SEQ ID NO: 9476512 - DNA, 22 bp, Homo sapiens
aatatttttgaggccctgttat

SEQ ID NO: 9476513 - DNA, 22 bp, Homo sapiens
aatatttttgaggccctgttat

SEQ ID NO: 9476514 - DNA, 22 bp, Homo sapiens
aatatttttgaggccctgttat

SEQ ID NO: 9476515 - DNA, 22 bp, Homo sapiens
aatattttaggctttccaggct

SEQ ID NO: 9476516 - DNA, 19 bp, Homo sapiens
aatattttagcctcttcct

SEQ ID NO: 9476517 - DNA, 19 bp, Homo sapiens
aatattttagcctcttcct

SEQ ID NO: 9476518 - DNA, 22 bp, Homo sapiens
aatcaaagaatgggctagttgg

SEQ ID NO: 9476519 - DNA, 22 bp, Homo sapiens
aatcaacattgttttaagtcaa

SEQ ID NO: 9476520 - DNA, 22 bp, Homo sapiens
aatcaacaggatgtgcattgta

SEQ ID NO: 9476521 - DNA, 22 bp, Homo sapiens
aatcaaagaatgggctagttgg

SEQ ID NO: 9476522 - DNA, 22 bp, Homo sapiens
aatcaaagaatgggctagttgg

SEQ ID NO: 9476523 - DNA, 22 bp, Homo sapiens
acttgtgttaccaaggtttggt

SEQ ID NO: 9476524 - DNA, 22 bp, Homo sapiens
acttgttagttttatctgcatg

SEQ ID NO: 9476525 - DNA, 22 bp, Homo sapiens
acttgtttacaagcagttctga

SEQ ID NO: 9476526 - DNA, 22 bp, Homo sapiens
acttgttcattgagtacatatg

SEQ ID NO: 9476527 - DNA, 22 bp, Homo sapiens
acttgtctttgtaaaatagaaa

SEQ ID NO: 9476528 - DNA, 22 bp, Homo sapiens
acttggttggtctcaccctgtt

SEQ ID NO: 9476529 - DNA, 22 bp, Homo sapiens
aatcaagaggcgatggatggaa

SEQ ID NO: 9476530 - DNA, 22 bp, Homo sapiens
aatcaagagctgactatatttt

SEQ ID NO: 9476531 - DNA, 22 bp, Homo sapiens
aatcaagagctgactatatttt

SEQ ID NO: 9476532 - DNA, 22 bp, Homo sapiens
aatcaagaggcgatggatggaa

SEQ ID NO: 9476533 - DNA, 22 bp, Homo sapiens
aatccagctgtgtcacaggtga

SEQ ID NO: 9476534 - DNA, 22 bp, Homo sapiens
aatccagctgtgtcacaggtga

SEQ ID NO: 9476535 - DNA, 22 bp, Homo sapiens
aatccagggtgtggcctttcca

SEQ ID NO: 9476536 - DNA, 19 bp, Homo sapiens
aatccaggataagcccctt

SEQ ID NO: 9476537 - DNA, 22 bp, Homo sapiens
aatccagggtgtggcctttcca

SEQ ID NO: 9476538 - DNA, 22 bp, Homo sapiens
actttaaaaagagccttctaac

SEQ ID NO: 9476539 - DNA, 22 bp, Homo sapiens
aatcataattgtatacattcat

SEQ ID NO: 9476540 - DNA, 22 bp, Homo sapiens
aatcataattgtatacattcat

SEQ ID NO: 9476541 - DNA, 22 bp, Homo sapiens
acttgtttcaactgtactctca

SEQ ID NO: 9476542 - DNA, 22 bp, Homo sapiens
acttgtttcaactgtactctcc

SEQ ID NO: 9476543 - DNA, 19 bp, Homo sapiens
acttgttttggaggtgatg

SEQ ID NO: 9476544 - DNA, 22 bp, Homo sapiens
actttaaaaagagccttctaac

SEQ ID NO: 9476545 - DNA, 22 bp, Homo sapiens
aatccatttactctttacaaga

SEQ ID NO: 9476546 - DNA, 20 bp, Homo sapiens
aatccattggtctatatgtc

SEQ ID NO: 9476547 - DNA, 22 bp, Homo sapiens
aatccatttacctttgcttgaa

SEQ ID NO: 9476548 - DNA, 22 bp, Homo sapiens
aatcccagctactcaggaagtt

SEQ ID NO: 9476549 - DNA, 22 bp, Homo sapiens
aatcccattgtggaattaagga

SEQ ID NO: 9476550 - DNA, 22 bp, Homo sapiens
aatcccagctactcaggaagtt

SEQ ID NO: 9476551 - DNA, 22 bp, Homo sapiens
aatccatgttgatgtatatttt

SEQ ID NO: 9476552 - DNA, 22 bp, Homo sapiens
aatccatgcatgcaaggaaagg

SEQ ID NO: 9476553 - DNA, 22 bp, Homo sapiens
aatccatctcaatttattccta

SEQ ID NO: 9476554 - DNA, 22 bp, Homo sapiens
aatccatctctccgagaagttt

SEQ ID NO: 9476555 - DNA, 22 bp, Homo sapiens
aatccatgaagtgaacaatctg

SEQ ID NO: 9476556 - DNA, 22 bp, Homo sapiens
aatccattaaaaacaagcgcat

SEQ ID NO: 9476557 - DNA, 22 bp, Homo sapiens
aatccattaaaaacaagcgcat

SEQ ID NO: 9476558 - DNA, 22 bp, Homo sapiens
aatccattcagaaattgggaat

SEQ ID NO: 9476559 - DNA, 22 bp, Homo sapiens
aatccattgctgtgctgccagg

SEQ ID NO: 9476560 - DNA, 22 bp, Homo sapiens
aatccattgctgtgctgccagg

SEQ ID NO: 9476561 - DNA, 22 bp, Homo sapiens
aatcccattgtggaattaagga

SEQ ID NO: 9476562 - DNA, 22 bp, Homo sapiens
aatcctgaggcaaagagatgag

SEQ ID NO: 9476563 - DNA, 22 bp, Homo sapiens
aatcctgaggcaaagagatgag

SEQ ID NO: 9476564 - DNA, 22 bp, Homo sapiens
aatacagagaatgttatttgga

SEQ ID NO: 9476565 - DNA, 21 bp, Homo sapiens
aatacagaaatgagtagttgc

SEQ ID NO: 9476566 - DNA, 22 bp, Homo sapiens
aatacaatcaaattcactagca

SEQ ID NO: 9476567 - DNA, 22 bp, Homo sapiens
acttcttttcaaatcatgcaaa

SEQ ID NO: 9476568 - DNA, 22 bp, Homo sapiens
aatacagagaatgttatttgga

SEQ ID NO: 9476569 - DNA, 22 bp, Homo sapiens
acttcctggattcccaagggct

SEQ ID NO: 9476570 - DNA, 22 bp, Homo sapiens
acttgaaacatctttaaatgta

SEQ ID NO: 9476571 - DNA, 22 bp, Homo sapiens
acttgaaaccctgagatgataa

SEQ ID NO: 9476572 - DNA, 22 bp, Homo sapiens
acttgaaaccttggcaaacaat

SEQ ID NO: 9476573 - DNA, 22 bp, Homo sapiens
acttgaaaagctcagcagtagt

SEQ ID NO: 9476574 - DNA, 22 bp, Homo sapiens
acttgaaaagctcagcagtagt

SEQ ID NO: 9476575 - DNA, 22 bp, Homo sapiens
acttgaaaagctcagcagtagt

SEQ ID NO: 9476576 - DNA, 19 bp, Homo sapiens
acttcttttcaacacagga

SEQ ID NO: 9476577 - DNA, 22 bp, Homo sapiens
acttgaaagaagtttccttaaa

SEQ ID NO: 9476578 - DNA, 19 bp, Homo sapiens
acttgaaagcagagagttt

SEQ ID NO: 9476579 - DNA, 22 bp, Homo sapiens
acttgaaaggaagctctaaaac

SEQ ID NO: 9476580 - DNA, 21 bp, Homo sapiens
acttgaagttggagtttctgt

SEQ ID NO: 9476581 - DNA, 22 bp, Homo sapiens
aatattctaataaatgcccatc

SEQ ID NO: 9476582 - DNA, 22 bp, Homo sapiens
aatatttgttagtgttttaatg

SEQ ID NO: 9476583 - DNA, 19 bp, Homo sapiens
aatattttagcctcttcct

SEQ ID NO: 9476584 - DNA, 23 bp, Homo sapiens
aatattcctgccattaatgactc

SEQ ID NO: 9476585 - DNA, 22 bp, Homo sapiens
aatattcatttgcagaagaagt

SEQ ID NO: 9476586 - DNA, 22 bp, Homo sapiens
aatattcatttgcagaagaagt

SEQ ID NO: 9476587 - DNA, 22 bp, Homo sapiens
aatatcacaggaggagaccaag

SEQ ID NO: 9476588 - DNA, 22 bp, Homo sapiens
aatatcacaggaggagaccaag

SEQ ID NO: 9476589 - DNA, 22 bp, Homo sapiens
aatatcaacagtgtccttctaa

SEQ ID NO: 9476590 - DNA, 22 bp, Homo sapiens
aatatcaacagtgtccttctaa

SEQ ID NO: 9476591 - DNA, 23 bp, Homo sapiens
aatatcaaggtgatgttcccaga

SEQ ID NO: 9476592 - DNA, 23 bp, Homo sapiens
aatatatgtgtttttctgcttca

SEQ ID NO: 9476593 - DNA, 22 bp, Homo sapiens
aatatatttgaatcaggaacaa

SEQ ID NO: 9476594 - DNA, 22 bp, Homo sapiens
aatatatttgaatcaggaacaa

SEQ ID NO: 9476595 - DNA, 22 bp, Homo sapiens
aatatatagaagtacccgttgt

SEQ ID NO: 9476596 - DNA, 22 bp, Homo sapiens
aatatatagaagtacccgttgt

SEQ ID NO: 9476597 - DNA, 21 bp, Homo sapiens
aatatatgcaatgctttctgc

SEQ ID NO: 9476598 - DNA, 22 bp, Homo sapiens
aatatatgactccactgcatga

SEQ ID NO: 9476599 - DNA, 22 bp, Homo sapiens
aatatatgactccactgcatga

SEQ ID NO: 9476600 - DNA, 22 bp, Homo sapiens
aatatatgactccactgcatga

SEQ ID NO: 9476601 - DNA, 22 bp, Homo sapiens
acttgaggaagcagcaagggat

SEQ ID NO: 9476602 - DNA, 23 bp, Homo sapiens
acttgattattgttgatagattc

SEQ ID NO: 9476603 - DNA, 22 bp, Homo sapiens
acttgaatttagtttttcctaa

SEQ ID NO: 9476604 - DNA, 22 bp, Homo sapiens
actaagtagtttgttcctcttt

SEQ ID NO: 9476605 - DNA, 22 bp, Homo sapiens
actaagtagtttgttcctcttt

SEQ ID NO: 9476606 - DNA, 22 bp, Homo sapiens
actaagtagtttcacatataat

SEQ ID NO: 9476607 - DNA, 22 bp, Homo sapiens
actaagtagtttcacatataat

SEQ ID NO: 9476608 - DNA, 23 bp, Homo sapiens
actaaggcttctttaagacagag

SEQ ID NO: 9476609 - DNA, 22 bp, Homo sapiens
actacaatactcttagtaaaag

SEQ ID NO: 9476610 - DNA, 22 bp, Homo sapiens
aagtgttttggcttctgtacac

SEQ ID NO: 9476611 - DNA, 20 bp, Homo sapiens
aagtgttttgacttctgacc

SEQ ID NO: 9476612 - DNA, 22 bp, Homo sapiens
actacaatactcttagtaaaag

SEQ ID NO: 9476613 - DNA, 22 bp, Homo sapiens
actacaaaagcactgggtatta

SEQ ID NO: 9476614 - DNA, 22 bp, Homo sapiens
aagttactatgactcttctttt

SEQ ID NO: 9476615 - DNA, 22 bp, Homo sapiens
aagttactaaaaggattttcag

SEQ ID NO: 9476616 - DNA, 21 bp, Homo sapiens
aagttactactgtttccaaga

SEQ ID NO: 9476617 - DNA, 22 bp, Homo sapiens
aagttagagattccatcatgct

SEQ ID NO: 9476618 - DNA, 22 bp, Homo sapiens
aagttactttacctctttagct

SEQ ID NO: 9476619 - DNA, 22 bp, Homo sapiens
aagttactttacctctttagct

SEQ ID NO: 9476620 - DNA, 22 bp, Homo sapiens
aagttactttatgtagaagaaa

SEQ ID NO: 9476621 - DNA, 22 bp, Homo sapiens
aagttactatgactcttctttt

SEQ ID NO: 9476622 - DNA, 22 bp, Homo sapiens
aagttatatcatctcattgacg

SEQ ID NO: 9476623 - DNA, 22 bp, Homo sapiens
aagttagtggataaacagcaaa

SEQ ID NO: 9476624 - DNA, 23 bp, Homo sapiens
aagttagtttcaataaagcaatt

SEQ ID NO: 9476625 - DNA, 22 bp, Homo sapiens
aagttattgcagcaatccaagt

SEQ ID NO: 9476626 - DNA, 22 bp, Homo sapiens
aagttatgaaatttggacagct

SEQ ID NO: 9476627 - DNA, 22 bp, Homo sapiens
aagttatatcatctcattgacg

SEQ ID NO: 9476628 - DNA, 22 bp, Homo sapiens
aagttatatcatctcattgacg

SEQ ID NO: 9476629 - DNA, 22 bp, Homo sapiens
aagttatatcatctcattgacg

SEQ ID NO: 9476630 - DNA, 18 bp, Homo sapiens
actccccacaggctctgt

SEQ ID NO: 9476631 - DNA, 18 bp, Homo sapiens
actccccacaggctctgt

SEQ ID NO: 9476632 - DNA, 18 bp, Homo sapiens
actccccacaggctctgt

SEQ ID NO: 9476633 - DNA, 22 bp, Homo sapiens
actccccagactgccatgctgg

SEQ ID NO: 9476634 - DNA, 22 bp, Homo sapiens
actcccagaacatgctcttctt

SEQ ID NO: 9476635 - DNA, 22 bp, Homo sapiens
actcccagaacatgctcttctt

SEQ ID NO: 9476636 - DNA, 22 bp, Homo sapiens
actcccagctcagggctttccc

SEQ ID NO: 9476637 - DNA, 22 bp, Homo sapiens
actccaggttttctctcaagtt

SEQ ID NO: 9476638 - DNA, 22 bp, Homo sapiens
actccagttctcttgtttataa

SEQ ID NO: 9476639 - DNA, 22 bp, Homo sapiens
actccaggttttttcactgaag

SEQ ID NO: 9476640 - DNA, 22 bp, Homo sapiens
aagttcaaaaatgtaatcagtg

SEQ ID NO: 9476641 - DNA, 22 bp, Homo sapiens
aagttatttttcaagatccttt

SEQ ID NO: 9476642 - DNA, 22 bp, Homo sapiens
aagttattgcagcaatccaagt

SEQ ID NO: 9476643 - DNA, 22 bp, Homo sapiens
aagttatttcctcgtgactgaa

SEQ ID NO: 9476644 - DNA, 22 bp, Homo sapiens
aagttatttttcaagatccttt

SEQ ID NO: 9476645 - DNA, 22 bp, Homo sapiens
actccagggttttgcacctgga

SEQ ID NO: 9476646 - DNA, 22 bp, Homo sapiens
actccagggttttgcacctgga

SEQ ID NO: 9476647 - DNA, 22 bp, Homo sapiens
actccaggtaggcacattgaca

SEQ ID NO: 9476648 - DNA, 20 bp, Homo sapiens
actccaggtggcatgaggac

SEQ ID NO: 9476649 - DNA, 22 bp, Homo sapiens
actccaggtgtgttggactcta

SEQ ID NO: 9476650 - DNA, 22 bp, Homo sapiens
aagtcactggaggaactctact

SEQ ID NO: 9476651 - DNA, 22 bp, Homo sapiens
aagtcactgaaggccatgaaca

SEQ ID NO: 9476652 - DNA, 22 bp, Homo sapiens
aagtcactggcaaaagctgcag

SEQ ID NO: 9476653 - DNA, 22 bp, Homo sapiens
aagtcactgttttagttttctc

SEQ ID NO: 9476654 - DNA, 22 bp, Homo sapiens
aagtcactgtgaaaggtgaagc

SEQ ID NO: 9476655 - DNA, 22 bp, Homo sapiens
aagtcactgttttagttttctc

SEQ ID NO: 9476656 - DNA, 20 bp, Homo sapiens
aagtcacttaagatgggcag

SEQ ID NO: 9476657 - DNA, 17 bp, Homo sapiens
aagtcacttctgggcca

SEQ ID NO: 9476658 - DNA, 22 bp, Homo sapiens
aagtcacttgattgttgacaga

SEQ ID NO: 9476659 - DNA, 22 bp, Homo sapiens
aagtcacttcttaggaaaggag

SEQ ID NO: 9476660 - DNA, 22 bp, Homo sapiens
aagtcactgaaagggcagaaag

SEQ ID NO: 9476661 - DNA, 22 bp, Homo sapiens
aagtcactaagtgaaccactgg

SEQ ID NO: 9476662 - DNA, 22 bp, Homo sapiens
aagtcactaagtgaaccactgg

SEQ ID NO: 9476663 - DNA, 22 bp, Homo sapiens
aagtcactcatattcctcaagc

SEQ ID NO: 9476664 - DNA, 22 bp, Homo sapiens
aagtcacagaacccattgtaac

SEQ ID NO: 9476665 - DNA, 22 bp, Homo sapiens
aagtcacactagacaactgagg

SEQ ID NO: 9476666 - DNA, 22 bp, Homo sapiens
aagtcacagagttggaagtcag

SEQ ID NO: 9476667 - DNA, 22 bp, Homo sapiens
aagtcacagctaaatagctaag

SEQ ID NO: 9476668 - DNA, 22 bp, Homo sapiens
aagtcacagctaaatagctaag

SEQ ID NO: 9476669 - DNA, 22 bp, Homo sapiens
aagtcacttgattgttgacaga

SEQ ID NO: 9476670 - DNA, 19 bp, Homo sapiens
aagtcacttgagggcagga

SEQ ID NO: 9476671 - DNA, 22 bp, Homo sapiens
aagtcactttcccattccttgc

SEQ ID NO: 9476672 - DNA, 22 bp, Homo sapiens
aagtcactttcccattccttgc

SEQ ID NO: 9476673 - DNA, 22 bp, Homo sapiens
aagtcagaaaacagagcaatta

SEQ ID NO: 9476674 - DNA, 22 bp, Homo sapiens
aagtcagaaaacagagcaatta

SEQ ID NO: 9476675 - DNA, 22 bp, Homo sapiens
aagtcagaccttgttgatagct

SEQ ID NO: 9476676 - DNA, 22 bp, Homo sapiens
aagtcagaaatcatctagtgta

SEQ ID NO: 9476677 - DNA, 22 bp, Homo sapiens
aagtcagacagctgagctgcct

SEQ ID NO: 9476678 - DNA, 22 bp, Homo sapiens
aagtcagcactccaggaagcca

SEQ ID NO: 9476679 - DNA, 23 bp, Homo sapiens
aagtcagagccaagtcaatgaga

SEQ ID NO: 9476680 - DNA, 22 bp, Homo sapiens
aagtcagagcaactgagacatt

SEQ ID NO: 9476681 - DNA, 22 bp, Homo sapiens
aagtcagagatgccaaagatta

SEQ ID NO: 9476682 - DNA, 22 bp, Homo sapiens
aagtcagagcaactgagacatt

SEQ ID NO: 9476683 - DNA, 22 bp, Homo sapiens
aagtcagagcaactgagacatt

SEQ ID NO: 9476684 - DNA, 22 bp, Homo sapiens
actaaatttgtcaatgacactt

SEQ ID NO: 9476685 - DNA, 20 bp, Homo sapiens
actaacatttgcaaggggct

SEQ ID NO: 9476686 - DNA, 22 bp, Homo sapiens
aagtggagccagggaaactgaa

SEQ ID NO: 9476687 - DNA, 22 bp, Homo sapiens
actaaatgagatactgtcttca

SEQ ID NO: 9476688 - DNA, 22 bp, Homo sapiens
actaaatgctgcataaatgctt

SEQ ID NO: 9476689 - DNA, 22 bp, Homo sapiens
actaaatggaatgattactata

SEQ ID NO: 9476690 - DNA, 22 bp, Homo sapiens
aagtggagctataggctcagat

SEQ ID NO: 9476691 - DNA, 22 bp, Homo sapiens
aagtggagccagggaaactgaa

SEQ ID NO: 9476692 - DNA, 22 bp, Homo sapiens
aagtggagccagggaaactgaa

SEQ ID NO: 9476693 - DNA, 22 bp, Homo sapiens
aagtggagagccctggaggtct

SEQ ID NO: 9476694 - DNA, 22 bp, Homo sapiens
aagtggagagccctggaggtct

SEQ ID NO: 9476695 - DNA, 22 bp, Homo sapiens
aagtggagagccctggaggtct

SEQ ID NO: 9476696 - DNA, 21 bp, Homo sapiens
aagtggagaagaaaagctgga

SEQ ID NO: 9476697 - DNA, 21 bp, Homo sapiens
aagtggagaagaaaagctgga

SEQ ID NO: 9476698 - DNA, 22 bp, Homo sapiens
aagtggagagccctggaggtct

SEQ ID NO: 9476699 - DNA, 21 bp, Homo sapiens
aagtggagaagaaaagctgga

SEQ ID NO: 9476700 - DNA, 22 bp, Homo sapiens
aagtggactaatacaaggacta

SEQ ID NO: 9476701 - DNA, 21 bp, Homo sapiens
aagtggagaagaaaagctgga

SEQ ID NO: 9476702 - DNA, 22 bp, Homo sapiens
aagtggactaatacaaggacta

SEQ ID NO: 9476703 - DNA, 22 bp, Homo sapiens
aagtgcatacactagttaattg

SEQ ID NO: 9476704 - DNA, 22 bp, Homo sapiens
aagtgcttggctaatggttatg

SEQ ID NO: 9476705 - DNA, 22 bp, Homo sapiens
aagtgcttggctaatggttatg

SEQ ID NO: 9476706 - DNA, 22 bp, Homo sapiens
aagtcaggacttatgctacctg

SEQ ID NO: 9476707 - DNA, 22 bp, Homo sapiens
aagtcaggacttatgctacctg

SEQ ID NO: 9476708 - DNA, 22 bp, Homo sapiens
aagtgcataagtatgattattt

SEQ ID NO: 9476709 - DNA, 21 bp, Homo sapiens
aagtcagtcagttctatacta

SEQ ID NO: 9476710 - DNA, 22 bp, Homo sapiens
aagtgctttttcttgagctgct

SEQ ID NO: 9476711 - DNA, 22 bp, Homo sapiens
aagtgctttataaacaatgaag

SEQ ID NO: 9476712 - DNA, 22 bp, Homo sapiens
aagtgctttcatatagtcttaa

SEQ ID NO: 9476713 - DNA, 22 bp, Homo sapiens
aagtgctttacaaatgtctgtt

SEQ ID NO: 9476714 - DNA, 22 bp, Homo sapiens
aagtgctttaaaatttcctgag

SEQ ID NO: 9476715 - DNA, 22 bp, Homo sapiens
actgcctgtgtcccttcagtgc

SEQ ID NO: 9476716 - DNA, 22 bp, Homo sapiens
actgcctgtgtcccttcagtgc

SEQ ID NO: 9476717 - DNA, 22 bp, Homo sapiens
aataagattgacacaagtacct

SEQ ID NO: 9476718 - DNA, 23 bp, Homo sapiens
actgcctgtgccgatctctctca

SEQ ID NO: 9476719 - DNA, 22 bp, Homo sapiens
actgcctgtttggcatggcccc

SEQ ID NO: 9476720 - DNA, 22 bp, Homo sapiens
actgcctgtttggcatggcccc

SEQ ID NO: 9476721 - DNA, 22 bp, Homo sapiens
actgcctgtttggcatggcccc

SEQ ID NO: 9476722 - DNA, 22 bp, Homo sapiens
actgcctgtttggcatggcccc

SEQ ID NO: 9476723 - DNA, 22 bp, Homo sapiens
actgcctgtttggcatggcccc

SEQ ID NO: 9476724 - DNA, 22 bp, Homo sapiens
actgcctgtgtcccttcagtgc

SEQ ID NO: 9476725 - DNA, 22 bp, Homo sapiens
aataagatgtgcttgagtttgg

SEQ ID NO: 9476726 - DNA, 22 bp, Homo sapiens
aataagatcctgaagatatgtt

SEQ ID NO: 9476727 - DNA, 22 bp, Homo sapiens
aataagatcttaaaggttatat

SEQ ID NO: 9476728 - DNA, 22 bp, Homo sapiens
aataagatgtgcttgagtttgg

SEQ ID NO: 9476729 - DNA, 22 bp, Homo sapiens
aataagatgtgcttgagtttgg

SEQ ID NO: 9476730 - DNA, 22 bp, Homo sapiens
aataagatgtgcttgagtttgg

SEQ ID NO: 9476731 - DNA, 22 bp, Homo sapiens
aataagattgacacaagtacct

SEQ ID NO: 9476732 - DNA, 22 bp, Homo sapiens
aataatagttgcaaagtgttta

SEQ ID NO: 9476733 - DNA, 22 bp, Homo sapiens
actgcgctccagcctgggtgac

SEQ ID NO: 9476734 - DNA, 22 bp, Homo sapiens
actgcgctccagcctgggtgac

SEQ ID NO: 9476735 - DNA, 22 bp, Homo sapiens
actgcgctccagcctgggtgac

SEQ ID NO: 9476736 - DNA, 22 bp, Homo sapiens
aataattagtgggacagagaac

SEQ ID NO: 9476737 - DNA, 22 bp, Homo sapiens
aataattagtgggacagagaac

SEQ ID NO: 9476738 - DNA, 22 bp, Homo sapiens
aataattagtgggacagagaac

SEQ ID NO: 9476739 - DNA, 22 bp, Homo sapiens
aataattagtgggacagagaac

SEQ ID NO: 9476740 - DNA, 22 bp, Homo sapiens
aataattagtgggacagagaac

SEQ ID NO: 9476741 - DNA, 22 bp, Homo sapiens
aataattacccatctttttgta

SEQ ID NO: 9476742 - DNA, 22 bp, Homo sapiens
aataattagtgggacagagaac

SEQ ID NO: 9476743 - DNA, 22 bp, Homo sapiens
aataattacccatctttttgta

SEQ ID NO: 9476744 - DNA, 22 bp, Homo sapiens
aataattagtgggacagagaac

SEQ ID NO: 9476745 - DNA, 22 bp, Homo sapiens
aataatgtttatttgtattctc

SEQ ID NO: 9476746 - DNA, 22 bp, Homo sapiens
aataattacccatctttttgta

SEQ ID NO: 9476747 - DNA, 22 bp, Homo sapiens
aataatgtttatttgtattctc

SEQ ID NO: 9476748 - DNA, 22 bp, Homo sapiens
aataatgtgtgctgcagtctta

SEQ ID NO: 9476749 - DNA, 22 bp, Homo sapiens
aataatgttatgtcattcttct

SEQ ID NO: 9476750 - DNA, 19 bp, Homo sapiens
aataatgttcatgagattg

SEQ ID NO: 9476751 - DNA, 22 bp, Homo sapiens
aataatgttatgtcattcttct

SEQ ID NO: 9476752 - DNA, 22 bp, Homo sapiens
aataatgttgacgatagtctta

SEQ ID NO: 9476753 - DNA, 19 bp, Homo sapiens
aataatgttcatgagattg

SEQ ID NO: 9476754 - DNA, 22 bp, Homo sapiens
aataatgttgacgatagtctta

SEQ ID NO: 9476755 - DNA, 22 bp, Homo sapiens
aataatgttgacgatagtctta

SEQ ID NO: 9476756 - DNA, 22 bp, Homo sapiens
aatacaatcaaattcactagca

SEQ ID NO: 9476757 - DNA, 22 bp, Homo sapiens
aataattttgagagcctggaaa

SEQ ID NO: 9476758 - DNA, 22 bp, Homo sapiens
aataattttagctcagagttgt

SEQ ID NO: 9476759 - DNA, 22 bp, Homo sapiens
aataattttagctcagagttgt

SEQ ID NO: 9476760 - DNA, 22 bp, Homo sapiens
aataattatttgagagcagacc

SEQ ID NO: 9476761 - DNA, 22 bp, Homo sapiens
aataattatttgagagcagacc

SEQ ID NO: 9476762 - DNA, 22 bp, Homo sapiens
aataattatttgagagcagacc

SEQ ID NO: 9476763 - DNA, 22 bp, Homo sapiens
aataattagtgggacagagaac

SEQ ID NO: 9476764 - DNA, 22 bp, Homo sapiens
aataatttccagccaactggaa

SEQ ID NO: 9476765 - DNA, 22 bp, Homo sapiens
aataatttccagccaactggaa

SEQ ID NO: 9476766 - DNA, 22 bp, Homo sapiens
aataattgtcaactatgctaca

SEQ ID NO: 9476767 - DNA, 22 bp, Homo sapiens
aataatttccagccaactggaa

SEQ ID NO: 9476768 - DNA, 22 bp, Homo sapiens
aagtttatccctctcacagtta

SEQ ID NO: 9476769 - DNA, 22 bp, Homo sapiens
aagtttagaactataagagtga

SEQ ID NO: 9476770 - DNA, 22 bp, Homo sapiens
aagtttaacttgaattctttct

SEQ ID NO: 9476771 - DNA, 22 bp, Homo sapiens
aagttgtatgtcttagaaagta

SEQ ID NO: 9476772 - DNA, 22 bp, Homo sapiens
aagtttaaggtggaagtggtgg

SEQ ID NO: 9476773 - DNA, 22 bp, Homo sapiens
aagtttaacttgaattctttct

SEQ ID NO: 9476774 - DNA, 22 bp, Homo sapiens
aagtttaacttgaattctttct

SEQ ID NO: 9476775 - DNA, 22 bp, Homo sapiens
aagttggttctgtgacatgttg

SEQ ID NO: 9476776 - DNA, 22 bp, Homo sapiens
aagttctagaggttgatttggt

SEQ ID NO: 9476777 - DNA, 22 bp, Homo sapiens
aagttggaatctggaactgatc

SEQ ID NO: 9476778 - DNA, 20 bp, Homo sapiens
aagtttcatgctctggggat

SEQ ID NO: 9476779 - DNA, 22 bp, Homo sapiens
aagtttcatgatgtaattattg

SEQ ID NO: 9476780 - DNA, 22 bp, Homo sapiens
aagtttctacatctccatcata

SEQ ID NO: 9476781 - DNA, 22 bp, Homo sapiens
aagtttcaaatataaaattaca

SEQ ID NO: 9476782 - DNA, 22 bp, Homo sapiens
aagtttatgttggtaagatatc

SEQ ID NO: 9476783 - DNA, 22 bp, Homo sapiens
aagtttatgttggtaagatatc

SEQ ID NO: 9476784 - DNA, 22 bp, Homo sapiens
aataacttaagaaatttcccca

SEQ ID NO: 9476785 - DNA, 22 bp, Homo sapiens
aagtttctattattacattcgt

SEQ ID NO: 9476786 - DNA, 22 bp, Homo sapiens
aataagaattgccagatttgaa

SEQ ID NO: 9476787 - DNA, 22 bp, Homo sapiens
aataacttcagttcttacatta

SEQ ID NO: 9476788 - DNA, 22 bp, Homo sapiens
aataagaattgccagatttgaa

SEQ ID NO: 9476789 - DNA, 22 bp, Homo sapiens
aataagaattgccagatttgaa

SEQ ID NO: 9476790 - DNA, 22 bp, Homo sapiens
aataagaatttacttgtcaaga

SEQ ID NO: 9476791 - DNA, 22 bp, Homo sapiens
aataagaatttacttgtcaaga

SEQ ID NO: 9476792 - DNA, 22 bp, Homo sapiens
aataagataagatttctgctct

SEQ ID NO: 9476793 - DNA, 22 bp, Homo sapiens
aataagatcctgaagatatgtt

SEQ ID NO: 9476794 - DNA, 22 bp, Homo sapiens
aataagatcctgaagatatgtt

SEQ ID NO: 9476795 - DNA, 22 bp, Homo sapiens
aataagatcctgaagatatgtt

SEQ ID NO: 9476796 - DNA, 22 bp, Homo sapiens
aataagatcctgaagatatgtt

SEQ ID NO: 9476797 - DNA, 22 bp, Homo sapiens
aataagatcctgaagatatgtt

SEQ ID NO: 9476798 - DNA, 22 bp, Homo sapiens
aataagaatttacttgtcaaga

SEQ ID NO: 9476799 - DNA, 22 bp, Homo sapiens
acagtacagtgcagaggaagat

SEQ ID NO: 9476800 - DNA, 22 bp, Homo sapiens
acagtacagctgaaactttagt

SEQ ID NO: 9476801 - DNA, 22 bp, Homo sapiens
acagggcttagaacttggcctc

SEQ ID NO: 9476802 - DNA, 22 bp, Homo sapiens
acagggcttagaaatctgttgc

SEQ ID NO: 9476803 - DNA, 22 bp, Homo sapiens
acagggctggcgttgggacaga

SEQ ID NO: 9476804 - DNA, 22 bp, Homo sapiens
acagggctggggcacttggctg

SEQ ID NO: 9476805 - DNA, 23 bp, Homo sapiens
acagggctggcagctgcaagacc

SEQ ID NO: 9476806 - DNA, 22 bp, Homo sapiens
acagggctgaggctggcttctt

SEQ ID NO: 9476807 - DNA, 19 bp, Homo sapiens
acagggctctggacgccat

SEQ ID NO: 9476808 - DNA, 22 bp, Homo sapiens
acagggctccttgggctgacac

SEQ ID NO: 9476809 - DNA, 22 bp, Homo sapiens
aaggaaatctttgtaacatctt

SEQ ID NO: 9476810 - DNA, 22 bp, Homo sapiens
aaggaaatctttgtaacatctt

SEQ ID NO: 9476811 - DNA, 22 bp, Homo sapiens
acagggctccttgggctgacac

SEQ ID NO: 9476812 - DNA, 22 bp, Homo sapiens
aaggaaagattctctctctaga

SEQ ID NO: 9476813 - DNA, 22 bp, Homo sapiens
aaggaaagattctctctctaga

SEQ ID NO: 9476814 - DNA, 22 bp, Homo sapiens
aaggaaagattctctctctaga

SEQ ID NO: 9476815 - DNA, 22 bp, Homo sapiens
aaggaaagattctctctctaga

SEQ ID NO: 9476816 - DNA, 22 bp, Homo sapiens
aaggaaagctgtggttctgaga

SEQ ID NO: 9476817 - DNA, 22 bp, Homo sapiens
aaggaaaggatgagcatgcatt

SEQ ID NO: 9476818 - DNA, 22 bp, Homo sapiens
aaggaaagattctctctctaga

SEQ ID NO: 9476819 - DNA, 22 bp, Homo sapiens
aaggaaagattctctctctaga

SEQ ID NO: 9476820 - DNA, 22 bp, Homo sapiens
aaggaaagctgtggttctgaga

SEQ ID NO: 9476821 - DNA, 22 bp, Homo sapiens
aaggaaatacaacatgtattca

SEQ ID NO: 9476822 - DNA, 22 bp, Homo sapiens
aaggaaatacaacatgtattca

SEQ ID NO: 9476823 - DNA, 22 bp, Homo sapiens
aaggaaaggatgagcatgcatt

SEQ ID NO: 9476824 - DNA, 22 bp, Homo sapiens
aaggaaaggatgagcatgcatt

SEQ ID NO: 9476825 - DNA, 22 bp, Homo sapiens
aaggaaaggatgagcatgcatt

SEQ ID NO: 9476826 - DNA, 22 bp, Homo sapiens
aaggaaaggatgagcatgcatt

SEQ ID NO: 9476827 - DNA, 22 bp, Homo sapiens
aaggaaatacaacatgtattca

SEQ ID NO: 9476828 - DNA, 22 bp, Homo sapiens
aaggaaatacaacatgtattca

SEQ ID NO: 9476829 - DNA, 22 bp, Homo sapiens
aaggaaatacttctgcagagca

SEQ ID NO: 9476830 - DNA, 22 bp, Homo sapiens
aaggaaatagatgcagatggta

SEQ ID NO: 9476831 - DNA, 22 bp, Homo sapiens
aaggaaatacttctgcagagca

SEQ ID NO: 9476832 - DNA, 22 bp, Homo sapiens
aaggaaatacttctgcagagca

SEQ ID NO: 9476833 - DNA, 22 bp, Homo sapiens
aaggaaatagatgcagatggta

SEQ ID NO: 9476834 - DNA, 22 bp, Homo sapiens
aaggaaatagatgcagatggta

SEQ ID NO: 9476835 - DNA, 22 bp, Homo sapiens
aagctttaagtgtcagtcagcc

SEQ ID NO: 9476836 - DNA, 22 bp, Homo sapiens
aaggaaagacatataaatgact

SEQ ID NO: 9476837 - DNA, 22 bp, Homo sapiens
aaggaaagagtatgcaccttgt

SEQ ID NO: 9476838 - DNA, 22 bp, Homo sapiens
aaggaaagacatataaatgact

SEQ ID NO: 9476839 - DNA, 22 bp, Homo sapiens
aaggaaagacatataaatgact

SEQ ID NO: 9476840 - DNA, 22 bp, Homo sapiens
aaggaaagacatataaatgact

SEQ ID NO: 9476841 - DNA, 22 bp, Homo sapiens
aaggaaagacatataaatgact

SEQ ID NO: 9476842 - DNA, 22 bp, Homo sapiens
acaggcagttgaggtttgtgtg

SEQ ID NO: 9476843 - DNA, 22 bp, Homo sapiens
acaggcagttgaggtttgtgtg

SEQ ID NO: 9476844 - DNA, 22 bp, Homo sapiens
acaggcagttgaggtttgtgtg

SEQ ID NO: 9476845 - DNA, 22 bp, Homo sapiens
acaggcagtgggccagatttgt

SEQ ID NO: 9476846 - DNA, 22 bp, Homo sapiens
acaggcattgggatggaggttg

SEQ ID NO: 9476847 - DNA, 22 bp, Homo sapiens
acaggcatccaggactaggcct

SEQ ID NO: 9476848 - DNA, 22 bp, Homo sapiens
aagctgcagatgtgcctgtgga

SEQ ID NO: 9476849 - DNA, 22 bp, Homo sapiens
aagctgcagatgtgcctgtgga

SEQ ID NO: 9476850 - DNA, 22 bp, Homo sapiens
aagctgcagcacagagaggtgg

SEQ ID NO: 9476851 - DNA, 22 bp, Homo sapiens
aagctgcaggttgaatccaggt

SEQ ID NO: 9476852 - DNA, 22 bp, Homo sapiens
aagctgcatgaagttgagtaga

SEQ ID NO: 9476853 - DNA, 22 bp, Homo sapiens
aagctgcactacttgagggacc

SEQ ID NO: 9476854 - DNA, 22 bp, Homo sapiens
aagctgcagaccccctgtctca

SEQ ID NO: 9476855 - DNA, 22 bp, Homo sapiens
aagctgcaaggaagtgtgccag

SEQ ID NO: 9476856 - DNA, 22 bp, Homo sapiens
aagctgcagaccccctgtctca

SEQ ID NO: 9476857 - DNA, 22 bp, Homo sapiens
aagctgccagctgagctgaggc

SEQ ID NO: 9476858 - DNA, 22 bp, Homo sapiens
aagctgccagattcagtctgct

SEQ ID NO: 9476859 - DNA, 23 bp, Homo sapiens
aagctgccagtctgaagcctggg

SEQ ID NO: 9476860 - DNA, 22 bp, Homo sapiens
aagctgccaccagcccagggca

SEQ ID NO: 9476861 - DNA, 22 bp, Homo sapiens
aagctgccaatggtaagctgct

SEQ ID NO: 9476862 - DNA, 22 bp, Homo sapiens
acaggcaggtcctgtcccagct

SEQ ID NO: 9476863 - DNA, 22 bp, Homo sapiens
acaggcaggtcctgtcccagct

SEQ ID NO: 9476864 - DNA, 22 bp, Homo sapiens
acaggcaggtcctgtcccagct

SEQ ID NO: 9476865 - DNA, 22 bp, Homo sapiens
aagctgcccaagactgaagcat

SEQ ID NO: 9476866 - DNA, 22 bp, Homo sapiens
aagctgcccaagactgaagcat

SEQ ID NO: 9476867 - DNA, 22 bp, Homo sapiens
acaggcagtgatttcctctggt

SEQ ID NO: 9476868 - DNA, 22 bp, Homo sapiens
acaggcagtgggccagatttgt

SEQ ID NO: 9476869 - DNA, 22 bp, Homo sapiens
acaggcaggttgagaaacattt

SEQ ID NO: 9476870 - DNA, 22 bp, Homo sapiens
aagctgcaaaaaatttctgtct

SEQ ID NO: 9476871 - DNA, 22 bp, Homo sapiens
aagctcttctgtggatttgagt

SEQ ID NO: 9476872 - DNA, 22 bp, Homo sapiens
aagccaggtgtttaggccagcg

SEQ ID NO: 9476873 - DNA, 22 bp, Homo sapiens
aagccaggtgtttaggccagcg

SEQ ID NO: 9476874 - DNA, 22 bp, Homo sapiens
aagccaggtgtttaggccagcg

SEQ ID NO: 9476875 - DNA, 22 bp, Homo sapiens
aagccaggtgtttaggccagcg

SEQ ID NO: 9476876 - DNA, 22 bp, Homo sapiens
aagccagggtttgtggatctat

SEQ ID NO: 9476877 - DNA, 22 bp, Homo sapiens
aagccagggtttgtggatctat

SEQ ID NO: 9476878 - DNA, 18 bp, Homo sapiens
aagccaggtcaagataag

SEQ ID NO: 9476879 - DNA, 22 bp, Homo sapiens
aagccaggtgtgcccaggatcc

SEQ ID NO: 9476880 - DNA, 18 bp, Homo sapiens
aagccaggtcaagataag

SEQ ID NO: 9476881 - DNA, 22 bp, Homo sapiens
aagccaggtgttgtggtaagag

SEQ ID NO: 9476882 - DNA, 22 bp, Homo sapiens
aagccaggtgtgcccaggatcc

SEQ ID NO: 9476883 - DNA, 22 bp, Homo sapiens
aagccaggtgttgtggtaagag

SEQ ID NO: 9476884 - DNA, 22 bp, Homo sapiens
aagccaggtgtgcccaggatcc

SEQ ID NO: 9476885 - DNA, 22 bp, Homo sapiens
aagccaggctgcacttgctggg

SEQ ID NO: 9476886 - DNA, 22 bp, Homo sapiens
aagccaggctgcacttgctggg

SEQ ID NO: 9476887 - DNA, 22 bp, Homo sapiens
aagccaggccattctctggttc

SEQ ID NO: 9476888 - DNA, 22 bp, Homo sapiens
aagccaggccattctctggttc

SEQ ID NO: 9476889 - DNA, 22 bp, Homo sapiens
aagccaggctgcacttgctggg

SEQ ID NO: 9476890 - DNA, 22 bp, Homo sapiens
aagccaggctgcacttgctggg

SEQ ID NO: 9476891 - DNA, 22 bp, Homo sapiens
aagccagggatggaatgatagg

SEQ ID NO: 9476892 - DNA, 22 bp, Homo sapiens
aagccagggattcctgagggag

SEQ ID NO: 9476893 - DNA, 22 bp, Homo sapiens
aagccagggattcctgagggag

SEQ ID NO: 9476894 - DNA, 22 bp, Homo sapiens
aagccagggtcagaatttgggc

SEQ ID NO: 9476895 - DNA, 22 bp, Homo sapiens
aagccaggggttggtatgctat

SEQ ID NO: 9476896 - DNA, 22 bp, Homo sapiens
aagccaggggttggtatgctat

SEQ ID NO: 9476897 - DNA, 22 bp, Homo sapiens
aagccagggtcaggggcctcct

SEQ ID NO: 9476898 - DNA, 22 bp, Homo sapiens
aagccagggtcaggggcctcct

SEQ ID NO: 9476899 - DNA, 22 bp, Homo sapiens
aagccagggtcaggggcctcct

SEQ ID NO: 9476900 - DNA, 22 bp, Homo sapiens
aagccaggggctgcttaggaga

SEQ ID NO: 9476901 - DNA, 22 bp, Homo sapiens
aagccagggattcctgagggag

SEQ ID NO: 9476902 - DNA, 22 bp, Homo sapiens
aagccaggggttggtatgctat

SEQ ID NO: 9476903 - DNA, 22 bp, Homo sapiens
acagttctccagtgcctttgag

SEQ ID NO: 9476904 - DNA, 22 bp, Homo sapiens
acagttctagcttttacatttt

SEQ ID NO: 9476905 - DNA, 22 bp, Homo sapiens
acagttctagcttttacatttt

SEQ ID NO: 9476906 - DNA, 23 bp, Homo sapiens
acagttctctgatgggtttaaca

SEQ ID NO: 9476907 - DNA, 22 bp, Homo sapiens
acagttctgagctataattgct

SEQ ID NO: 9476908 - DNA, 22 bp, Homo sapiens
acagttctgaagactagagcct

SEQ ID NO: 9476909 - DNA, 19 bp, Homo sapiens
acagttctaatttctgtgg

SEQ ID NO: 9476910 - DNA, 22 bp, Homo sapiens
acagttctaaatcttggataat

SEQ ID NO: 9476911 - DNA, 19 bp, Homo sapiens
acagttctaatttctgtgg

SEQ ID NO: 9476912 - DNA, 22 bp, Homo sapiens
aaggcagagatattcttgatct

SEQ ID NO: 9476913 - DNA, 22 bp, Homo sapiens
acagttctgcctgtttgagaag

SEQ ID NO: 9476914 - DNA, 21 bp, Homo sapiens
acagttctgccggcatctttc

SEQ ID NO: 9476915 - DNA, 21 bp, Homo sapiens
acagttctgccggcatctttc

SEQ ID NO: 9476916 - DNA, 22 bp, Homo sapiens
acagttctgagctataattgct

SEQ ID NO: 9476917 - DNA, 22 bp, Homo sapiens
acagttcttaaaacttgaatta

SEQ ID NO: 9476918 - DNA, 22 bp, Homo sapiens
acagttcttaaaacttgaatta

SEQ ID NO: 9476919 - DNA, 22 bp, Homo sapiens
acagttctttggatggaagaat

SEQ ID NO: 9476920 - DNA, 22 bp, Homo sapiens
aaggcagatataaagactagag

SEQ ID NO: 9476921 - DNA, 22 bp, Homo sapiens
aaggcagatataaagactagag

SEQ ID NO: 9476922 - DNA, 20 bp, Homo sapiens
acagttgacattgctctgtg

SEQ ID NO: 9476923 - DNA, 22 bp, Homo sapiens
acagttgagtgtctctaggaag

SEQ ID NO: 9476924 - DNA, 22 bp, Homo sapiens
acagttgggctgtagcatgctt

SEQ ID NO: 9476925 - DNA, 22 bp, Homo sapiens
aaggcagccgtgtgactgcatg

SEQ ID NO: 9476926 - DNA, 22 bp, Homo sapiens
aaggcagccgtgtgactgcatg

SEQ ID NO: 9476927 - DNA, 22 bp, Homo sapiens
aaggcagctcagctcatggcag

SEQ ID NO: 9476928 - DNA, 22 bp, Homo sapiens
aaggcagccttttgagttgatt

SEQ ID NO: 9476929 - DNA, 22 bp, Homo sapiens
aaggcaggatgggaaaagattt

SEQ ID NO: 9476930 - DNA, 22 bp, Homo sapiens
aaggcaggatgggaaaagattt

SEQ ID NO: 9476931 - DNA, 22 bp, Homo sapiens
aaggcagggaaagtggattagg

SEQ ID NO: 9476932 - DNA, 22 bp, Homo sapiens
aaggcagggaaagtggattagg

SEQ ID NO: 9476933 - DNA, 22 bp, Homo sapiens
aaggcagggaaagtggattagg

SEQ ID NO: 9476934 - DNA, 22 bp, Homo sapiens
aaggcagggaaagtggattagg

SEQ ID NO: 9476935 - DNA, 22 bp, Homo sapiens
aaggcagcttcaccacagcatt

SEQ ID NO: 9476936 - DNA, 22 bp, Homo sapiens
aaggcagctcagctcatggcag

SEQ ID NO: 9476937 - DNA, 22 bp, Homo sapiens
aaggcagcttcaccacagcatt

SEQ ID NO: 9476938 - DNA, 22 bp, Homo sapiens
aaggcaggatgcggacccatct

SEQ ID NO: 9476939 - DNA, 22 bp, Homo sapiens
aaggcaggagctgtatcttatt

SEQ ID NO: 9476940 - DNA, 22 bp, Homo sapiens
aaggcagctttaaaaaagatgc

SEQ ID NO: 9476941 - DNA, 22 bp, Homo sapiens
aaggcaggagctgtatcttatt

SEQ ID NO: 9476942 - DNA, 22 bp, Homo sapiens
aaggcaggagctgtatcttatt

SEQ ID NO: 9476943 - DNA, 22 bp, Homo sapiens
aaggcagttaccgcaatggagg

SEQ ID NO: 9476944 - DNA, 22 bp, Homo sapiens
aaggcatacatattgttatagg

SEQ ID NO: 9476945 - DNA, 22 bp, Homo sapiens
aaggcagtctggtttcaaagca

SEQ ID NO: 9476946 - DNA, 22 bp, Homo sapiens
aaggcaggtattgatgccacag

SEQ ID NO: 9476947 - DNA, 22 bp, Homo sapiens
aaggcaggtattgatgccacag

SEQ ID NO: 9476948 - DNA, 18 bp, Homo sapiens
aaggcagtatgattgcac

SEQ ID NO: 9476949 - DNA, 22 bp, Homo sapiens
aaggcagtatctgtagagtgct

SEQ ID NO: 9476950 - DNA, 22 bp, Homo sapiens
aaggcagtactttatgtccata

SEQ ID NO: 9476951 - DNA, 22 bp, Homo sapiens
aaggaagaaatgaataggtgga

SEQ ID NO: 9476952 - DNA, 22 bp, Homo sapiens
aaggaagaaatgaataggtgga

SEQ ID NO: 9476953 - DNA, 22 bp, Homo sapiens
aaggaagaagactctttactcc

SEQ ID NO: 9476954 - DNA, 22 bp, Homo sapiens
aaggaagaaatgaataggtgga

SEQ ID NO: 9476955 - DNA, 22 bp, Homo sapiens
aaggaactgatgctcaaagaat

SEQ ID NO: 9476956 - DNA, 22 bp, Homo sapiens
aaggaacttgccacagaaaaga

SEQ ID NO: 9476957 - DNA, 22 bp, Homo sapiens
aaggcacttgcccagagctgca

SEQ ID NO: 9476958 - DNA, 22 bp, Homo sapiens
aaggcacttaacgtgggaggat

SEQ ID NO: 9476959 - DNA, 22 bp, Homo sapiens
aaggcactacgctgctggggcg

SEQ ID NO: 9476960 - DNA, 22 bp, Homo sapiens
aaggcacttgcccagagctgca

SEQ ID NO: 9476961 - DNA, 22 bp, Homo sapiens
aaggcacttttcctgagatgat

SEQ ID NO: 9476962 - DNA, 22 bp, Homo sapiens
aaggcacttgcccagagctgca

SEQ ID NO: 9476963 - DNA, 22 bp, Homo sapiens
aaggcacttgcccagagctgca

SEQ ID NO: 9476964 - DNA, 22 bp, Homo sapiens
aaggcactacgctgctggggcg

SEQ ID NO: 9476965 - DNA, 22 bp, Homo sapiens
aaggaagaagactctttactcc

SEQ ID NO: 9476966 - DNA, 22 bp, Homo sapiens
aaggaagaagggaagttactta

SEQ ID NO: 9476967 - DNA, 22 bp, Homo sapiens
aaggcacttttctaaagacctt

SEQ ID NO: 9476968 - DNA, 22 bp, Homo sapiens
aaggcagaaagggatgtgagtg

SEQ ID NO: 9476969 - DNA, 22 bp, Homo sapiens
aaggcagaaagggatgtgagtg

SEQ ID NO: 9476970 - DNA, 22 bp, Homo sapiens
aaggcacttttcctgagatgat

SEQ ID NO: 9476971 - DNA, 22 bp, Homo sapiens
aaggcacttttctaaagacctt

SEQ ID NO: 9476972 - DNA, 22 bp, Homo sapiens
aaggcagaaagggatgtgagtg

SEQ ID NO: 9476973 - DNA, 22 bp, Homo sapiens
aaggcagaaagggatgtgagtg

SEQ ID NO: 9476974 - DNA, 21 bp, Homo sapiens
aaggcagaagcatggaatgag

SEQ ID NO: 9476975 - DNA, 19 bp, Homo sapiens
aaggcagaagttggatatg

SEQ ID NO: 9476976 - DNA, 22 bp, Homo sapiens
aaggcagaaagggatgtgagtg

SEQ ID NO: 9476977 - DNA, 22 bp, Homo sapiens
aaggcagaaattcaactactgg

SEQ ID NO: 9476978 - DNA, 21 bp, Homo sapiens
aaggcagaagcatggaatgag

SEQ ID NO: 9476979 - DNA, 22 bp, Homo sapiens
acagtagtgctcaatcagtgtt

SEQ ID NO: 9476980 - DNA, 22 bp, Homo sapiens
acagtagtgtgtgaaacttgcc

SEQ ID NO: 9476981 - DNA, 22 bp, Homo sapiens
acagtataaactcctaaaagcc

SEQ ID NO: 9476982 - DNA, 22 bp, Homo sapiens
acagtagtttataaaaatgttg

SEQ ID NO: 9476983 - DNA, 22 bp, Homo sapiens
acagtagattggtatgatgtca

SEQ ID NO: 9476984 - DNA, 22 bp, Homo sapiens
acagtagctaatattgcattat

SEQ ID NO: 9476985 - DNA, 20 bp, Homo sapiens
acagtagaagggatttcaaa

SEQ ID NO: 9476986 - DNA, 22 bp, Homo sapiens
acagtagagtaaatggttagat

SEQ ID NO: 9476987 - DNA, 22 bp, Homo sapiens
acagtagatggctcagagacag

SEQ ID NO: 9476988 - DNA, 22 bp, Homo sapiens
acagtagaccctggataaacat

SEQ ID NO: 9476989 - DNA, 22 bp, Homo sapiens
acagtataactccatgccaccc

SEQ ID NO: 9476990 - DNA, 22 bp, Homo sapiens
acagtataccattgtgactttg

SEQ ID NO: 9476991 - DNA, 22 bp, Homo sapiens
aaggaaatgaagctgatgttgg

SEQ ID NO: 9476992 - DNA, 22 bp, Homo sapiens
aaggaaatgaggttgatggatg

SEQ ID NO: 9476993 - DNA, 22 bp, Homo sapiens
aaggaaatctttgtaacatctt

SEQ ID NO: 9476994 - DNA, 22 bp, Homo sapiens
aaggaaatgaagctgatgttgg

SEQ ID NO: 9476995 - DNA, 22 bp, Homo sapiens
aaggaaatctttgtaacatctt

SEQ ID NO: 9476996 - DNA, 22 bp, Homo sapiens
aaggaaatctttgtaacatctt

SEQ ID NO: 9476997 - DNA, 22 bp, Homo sapiens
aaggaaatctttgtaacatctt

SEQ ID NO: 9476998 - DNA, 22 bp, Homo sapiens
aaggaaatctttgtaacatctt

SEQ ID NO: 9476999 - DNA, 22 bp, Homo sapiens
aaggaaattaggttattttgct

SEQ ID NO: 9477000 - DNA, 22 bp, Homo sapiens
aaggaaattaggttattttgct

SEQ ID NO: 9477001 - DNA, 22 bp, Homo sapiens
aaggaaattaggttattttgct

SEQ ID NO: 9477002 - DNA, 22 bp, Homo sapiens
aaggaacactacaaggctggga

SEQ ID NO: 9477003 - DNA, 22 bp, Homo sapiens
aaggaaatgtgcctgacactgc

SEQ ID NO: 9477004 - DNA, 22 bp, Homo sapiens
aaggaaattaggttattttgct

SEQ ID NO: 9477005 - DNA, 22 bp, Homo sapiens
aaggaaatgtgcctgacactgc

SEQ ID NO: 9477006 - DNA, 22 bp, Homo sapiens
aaggaaatgtgcctgacactgc

SEQ ID NO: 9477007 - DNA, 22 bp, Homo sapiens
aaggaaatgtgcctgacactgc

SEQ ID NO: 9477008 - DNA, 22 bp, Homo sapiens
aaggaaatgaggttgatggatg

SEQ ID NO: 9477009 - DNA, 22 bp, Homo sapiens
aaggaaatgaggttgatggatg

SEQ ID NO: 9477010 - DNA, 22 bp, Homo sapiens
aaggaaatgaggttgatggatg

SEQ ID NO: 9477011 - DNA, 22 bp, Homo sapiens
aaggctgagggctgtacctggc

SEQ ID NO: 9477012 - DNA, 22 bp, Homo sapiens
aaggctgaggtagggcctaaaa

SEQ ID NO: 9477013 - DNA, 22 bp, Homo sapiens
aaggctgattagactgatagct

SEQ ID NO: 9477014 - DNA, 22 bp, Homo sapiens
aaggctgattagactgatagct

SEQ ID NO: 9477015 - DNA, 22 bp, Homo sapiens
aaggctgagtaaaacagagaac

SEQ ID NO: 9477016 - DNA, 22 bp, Homo sapiens
aaggctgagtaaaacagagaac

SEQ ID NO: 9477017 - DNA, 16 bp, Homo sapiens
aaggctgattttccct

SEQ ID NO: 9477018 - DNA, 22 bp, Homo sapiens
aaggctgcctctgccagaggag

SEQ ID NO: 9477019 - DNA, 22 bp, Homo sapiens
acatgtgtacatatatatgtgc

SEQ ID NO: 9477020 - DNA, 22 bp, Homo sapiens
aaggctcttgagtggtgatagt

SEQ ID NO: 9477021 - DNA, 22 bp, Homo sapiens
aaggcatggcagggtttacaca

SEQ ID NO: 9477022 - DNA, 22 bp, Homo sapiens
aaggcatgatgtaatcaatgat

SEQ ID NO: 9477023 - DNA, 22 bp, Homo sapiens
aaggcatctggatggaggagga

SEQ ID NO: 9477024 - DNA, 22 bp, Homo sapiens
aaggcatatattctaaacagga

SEQ ID NO: 9477025 - DNA, 22 bp, Homo sapiens
aaggcatacctgaatgtttgtg

SEQ ID NO: 9477026 - DNA, 22 bp, Homo sapiens
aaggctgaggcagtgaggcaga

SEQ ID NO: 9477027 - DNA, 22 bp, Homo sapiens
aaggctgaggctggagaattac

SEQ ID NO: 9477028 - DNA, 22 bp, Homo sapiens
aaggctgaggctggagaattac

SEQ ID NO: 9477029 - DNA, 22 bp, Homo sapiens
aaggctgaggagggcctgcagg

SEQ ID NO: 9477030 - DNA, 22 bp, Homo sapiens
aaggcttggaccagctacagtg

SEQ ID NO: 9477031 - DNA, 22 bp, Homo sapiens
aaggctgtgtcagaagctccct

SEQ ID NO: 9477032 - DNA, 22 bp, Homo sapiens
aaggctgtggttctatacagaa

SEQ ID NO: 9477033 - DNA, 22 bp, Homo sapiens
aaggctgtttattagaaaaagt

SEQ ID NO: 9477034 - DNA, 22 bp, Homo sapiens
aaggcttccactttgttgggtc

SEQ ID NO: 9477035 - DNA, 22 bp, Homo sapiens
aaggcttaaataataatttctg

SEQ ID NO: 9477036 - DNA, 22 bp, Homo sapiens
aaggcttcctggaggaggtgtc

SEQ ID NO: 9477037 - DNA, 22 bp, Homo sapiens
aaggctgtttgagcactggagc

SEQ ID NO: 9477038 - DNA, 22 bp, Homo sapiens
aaggcttctttagtgtcctaat

SEQ ID NO: 9477039 - DNA, 22 bp, Homo sapiens
aaggctgggaaacatgcaggcc

SEQ ID NO: 9477040 - DNA, 22 bp, Homo sapiens
aaggctgggaaacatgcaggcc

SEQ ID NO: 9477041 - DNA, 22 bp, Homo sapiens
aaggctggtttccttgatgttt

SEQ ID NO: 9477042 - DNA, 22 bp, Homo sapiens
aaggctggtttccttgatgttt

SEQ ID NO: 9477043 - DNA, 22 bp, Homo sapiens
aagggctcttctatttatggcc

SEQ ID NO: 9477044 - DNA, 22 bp, Homo sapiens
aagggctctgttgccatttcag

SEQ ID NO: 9477045 - DNA, 22 bp, Homo sapiens
aagggctctgtgtgcctcccca

SEQ ID NO: 9477046 - DNA, 22 bp, Homo sapiens
aagggctctgggctacgcactg

SEQ ID NO: 9477047 - DNA, 22 bp, Homo sapiens
aagggctctgggctacgcactg

SEQ ID NO: 9477048 - DNA, 22 bp, Homo sapiens
aagggctctgctgtctctcccc

SEQ ID NO: 9477049 - DNA, 22 bp, Homo sapiens
aagggctccaagaggtagctgg

SEQ ID NO: 9477050 - DNA, 22 bp, Homo sapiens
aagggctcacccaactcacttc

SEQ ID NO: 9477051 - DNA, 22 bp, Homo sapiens
aagggctccaagaggtagctgg

SEQ ID NO: 9477052 - DNA, 22 bp, Homo sapiens
aagggctcacccaactcacttc

SEQ ID NO: 9477053 - DNA, 22 bp, Homo sapiens
aagggccaagctcttctcccat

SEQ ID NO: 9477054 - DNA, 22 bp, Homo sapiens
aagggcaggaaaagatggatgt

SEQ ID NO: 9477055 - DNA, 22 bp, Homo sapiens
aagggcaggtgggcatttctgg

SEQ ID NO: 9477056 - DNA, 22 bp, Homo sapiens
aagggcaggtgggcatttctgg

SEQ ID NO: 9477057 - DNA, 22 bp, Homo sapiens
aagggcaggtgggcatttctgg

SEQ ID NO: 9477058 - DNA, 22 bp, Homo sapiens
aagggccacatttgggtccctg

SEQ ID NO: 9477059 - DNA, 22 bp, Homo sapiens
aagggccataacttgcagtgtt

SEQ ID NO: 9477060 - DNA, 22 bp, Homo sapiens
aagggccatcccagaacagaaa

SEQ ID NO: 9477061 - DNA, 22 bp, Homo sapiens
aagggccattgctgagagcagt

SEQ ID NO: 9477062 - DNA, 22 bp, Homo sapiens
aagggccattgctgagagcagt

SEQ ID NO: 9477063 - DNA, 22 bp, Homo sapiens
aagggccattgctgagagcagt

SEQ ID NO: 9477064 - DNA, 22 bp, Homo sapiens
aagggccatcttggactcccca

SEQ ID NO: 9477065 - DNA, 22 bp, Homo sapiens
aagggccattgctgagagcagt

SEQ ID NO: 9477066 - DNA, 22 bp, Homo sapiens
aagggacatagactgtacatct

SEQ ID NO: 9477067 - DNA, 22 bp, Homo sapiens
aagggacatagactgtacatct

SEQ ID NO: 9477068 - DNA, 22 bp, Homo sapiens
aagggactttgtcagctttcca

SEQ ID NO: 9477069 - DNA, 22 bp, Homo sapiens
aagggaagtttgcatcctcact

SEQ ID NO: 9477070 - DNA, 22 bp, Homo sapiens
aagggaagtttgcatcctcact

SEQ ID NO: 9477071 - DNA, 22 bp, Homo sapiens
aagggagaaaacttgtggctta

SEQ ID NO: 9477072 - DNA, 22 bp, Homo sapiens
aagggcaggaaaagatggatgt

SEQ ID NO: 9477073 - DNA, 22 bp, Homo sapiens
aagggagaaaacttgtggctta

SEQ ID NO: 9477074 - DNA, 22 bp, Homo sapiens
aagggaaatcctcagcccagga

SEQ ID NO: 9477075 - DNA, 22 bp, Homo sapiens
aagggaaatcctcagcccagga

SEQ ID NO: 9477076 - DNA, 22 bp, Homo sapiens
aagggaaatggccaggcagaga

SEQ ID NO: 9477077 - DNA, 22 bp, Homo sapiens
aagggaaggttccattatactt

SEQ ID NO: 9477078 - DNA, 22 bp, Homo sapiens
aagggaaactttcacaatgtcc

SEQ ID NO: 9477079 - DNA, 22 bp, Homo sapiens
aagggaaatcatatggtgcagt

SEQ ID NO: 9477080 - DNA, 22 bp, Homo sapiens
aagggaaactttcacaatgtcc

SEQ ID NO: 9477081 - DNA, 22 bp, Homo sapiens
aagggaaaatagttgatgacca

SEQ ID NO: 9477082 - DNA, 22 bp, Homo sapiens
aaggctttgattccattgccct

SEQ ID NO: 9477083 - DNA, 22 bp, Homo sapiens
aagggaaaatagttgatgacca

SEQ ID NO: 9477084 - DNA, 22 bp, Homo sapiens
aaggctttttcactggtgactc

SEQ ID NO: 9477085 - DNA, 22 bp, Homo sapiens
aaggcttttgggaattttcaac

SEQ ID NO: 9477086 - DNA, 22 bp, Homo sapiens
accccaggtctccaggctctgg

SEQ ID NO: 9477087 - DNA, 20 bp, Homo sapiens
accccagtgtgtgcctcaag

SEQ ID NO: 9477088 - DNA, 22 bp, Homo sapiens
acccccaaacatgatcatggtg

SEQ ID NO: 9477089 - DNA, 22 bp, Homo sapiens
acccccaaacatcaagggctga

SEQ ID NO: 9477090 - DNA, 21 bp, Homo sapiens
acccccacacctccttagttc

SEQ ID NO: 9477091 - DNA, 22 bp, Homo sapiens
acccccaagaggggccttcagc

SEQ ID NO: 9477092 - DNA, 22 bp, Homo sapiens
accccaggtcatctgagagtcc

SEQ ID NO: 9477093 - DNA, 22 bp, Homo sapiens
accccagggctgccagcctcct

SEQ ID NO: 9477094 - DNA, 23 bp, Homo sapiens
accccaggcatcgcattcctctt

SEQ ID NO: 9477095 - DNA, 22 bp, Homo sapiens
accccaggcccagggaagaggc

SEQ ID NO: 9477096 - DNA, 22 bp, Homo sapiens
aagtatctgggagatttgcttt

SEQ ID NO: 9477097 - DNA, 22 bp, Homo sapiens
aagtatctgggagatttgcttt

SEQ ID NO: 9477098 - DNA, 22 bp, Homo sapiens
accccccagataatcccttgag

SEQ ID NO: 9477099 - DNA, 22 bp, Homo sapiens
acccccacggaaggccgtacgc

SEQ ID NO: 9477100 - DNA, 22 bp, Homo sapiens
acccccacggaaggccgtacgc

SEQ ID NO: 9477101 - DNA, 21 bp, Homo sapiens
acccccacacctccttagttc

SEQ ID NO: 9477102 - DNA, 22 bp, Homo sapiens
aagtatgaatcaaagactatct

SEQ ID NO: 9477103 - DNA, 22 bp, Homo sapiens
aagtatgaatcaaagactatct

SEQ ID NO: 9477104 - DNA, 22 bp, Homo sapiens
aagtcacacagttaacatgagg

SEQ ID NO: 9477105 - DNA, 22 bp, Homo sapiens
aagtcacaagcatatatgcatt

SEQ ID NO: 9477106 - DNA, 22 bp, Homo sapiens
aagtcacaagcatatatgcatt

SEQ ID NO: 9477107 - DNA, 22 bp, Homo sapiens
aagtcacaagcatatatgcatt

SEQ ID NO: 9477108 - DNA, 22 bp, Homo sapiens
aagtacatgctgtaatgattgg

SEQ ID NO: 9477109 - DNA, 22 bp, Homo sapiens
aagtacatgttgttcaaaagcc

SEQ ID NO: 9477110 - DNA, 22 bp, Homo sapiens
aagtacatgttgctcaacagcc

SEQ ID NO: 9477111 - DNA, 22 bp, Homo sapiens
aagtacatatatttatgattct

SEQ ID NO: 9477112 - DNA, 22 bp, Homo sapiens
aagtacataaaggaattagcca

SEQ ID NO: 9477113 - DNA, 22 bp, Homo sapiens
aagtacagccagcacccagact

SEQ ID NO: 9477114 - DNA, 22 bp, Homo sapiens
aagtacttgatagattaactgt

SEQ ID NO: 9477115 - DNA, 22 bp, Homo sapiens
aagtagaaaaccgcactggact

SEQ ID NO: 9477116 - DNA, 22 bp, Homo sapiens
aagtagaaaaccgcactggact

SEQ ID NO: 9477117 - DNA, 21 bp, Homo sapiens
aagtagaagggagaagggtta

SEQ ID NO: 9477118 - DNA, 22 bp, Homo sapiens
aagtactttaggatatgtaact

SEQ ID NO: 9477119 - DNA, 22 bp, Homo sapiens
aagtagaatctcaggtaggcta

SEQ ID NO: 9477120 - DNA, 22 bp, Homo sapiens
accccaggagctgtgcctagtc

SEQ ID NO: 9477121 - DNA, 22 bp, Homo sapiens
aagtacttctagatggataatc

SEQ ID NO: 9477122 - DNA, 22 bp, Homo sapiens
aagtactgacagagaagaatga

SEQ ID NO: 9477123 - DNA, 22 bp, Homo sapiens
aagtacatttttaacttacagc

SEQ ID NO: 9477124 - DNA, 22 bp, Homo sapiens
aagtaccaagtttgtttgacgc

SEQ ID NO: 9477125 - DNA, 22 bp, Homo sapiens
aagtacatttttaacttacagc

SEQ ID NO: 9477126 - DNA, 22 bp, Homo sapiens
aagtacattatatgagcagaat

SEQ ID NO: 9477127 - DNA, 22 bp, Homo sapiens
aagggctgaatgaagggttgaa

SEQ ID NO: 9477128 - DNA, 22 bp, Homo sapiens
aagggctgaatgaagggttgaa

SEQ ID NO: 9477129 - DNA, 22 bp, Homo sapiens
aagggctgagcacagtgagcca

SEQ ID NO: 9477130 - DNA, 22 bp, Homo sapiens
aagggctgagcacagtgagcca

SEQ ID NO: 9477131 - DNA, 22 bp, Homo sapiens
aagggctgagcacagtgagcca

SEQ ID NO: 9477132 - DNA, 22 bp, Homo sapiens
aaggtgagagggaaattttcca

SEQ ID NO: 9477133 - DNA, 22 bp, Homo sapiens
aaggtcttatctccaaatacag

SEQ ID NO: 9477134 - DNA, 22 bp, Homo sapiens
aaggtcttaagaactgctacat

SEQ ID NO: 9477135 - DNA, 22 bp, Homo sapiens
aaggtgaaactggaagctggcc

SEQ ID NO: 9477136 - DNA, 22 bp, Homo sapiens
aaggtgaactggtaatgacaga

SEQ ID NO: 9477137 - DNA, 22 bp, Homo sapiens
aaggtctgtggccacctctggg

SEQ ID NO: 9477138 - DNA, 22 bp, Homo sapiens
aaggtctgtattagagtttcat

SEQ ID NO: 9477139 - DNA, 22 bp, Homo sapiens
aaggtctgtgaggctgtttgtc

SEQ ID NO: 9477140 - DNA, 22 bp, Homo sapiens
aaggtatagagtttggaaaaat

SEQ ID NO: 9477141 - DNA, 22 bp, Homo sapiens
aaggtaggttaacctgcaggag

SEQ ID NO: 9477142 - DNA, 18 bp, Homo sapiens
aaggtctgtctggtaggt

SEQ ID NO: 9477143 - DNA, 22 bp, Homo sapiens
accatgcacagctgttctatta

SEQ ID NO: 9477144 - DNA, 23 bp, Homo sapiens
accatgatgggagtgcaaataag

SEQ ID NO: 9477145 - DNA, 22 bp, Homo sapiens
accatgatgccactatgcagaa

SEQ ID NO: 9477146 - DNA, 22 bp, Homo sapiens
accatgagttatttgacaggcc

SEQ ID NO: 9477147 - DNA, 22 bp, Homo sapiens
accatgggtcagccacctcagc

SEQ ID NO: 9477148 - DNA, 22 bp, Homo sapiens
accatgccagtggcagccagac

SEQ ID NO: 9477149 - DNA, 22 bp, Homo sapiens
accatgcatcaaagctaatata

SEQ ID NO: 9477150 - DNA, 22 bp, Homo sapiens
accatgttggccaagctggtct

SEQ ID NO: 9477151 - DNA, 22 bp, Homo sapiens
accatgttggccaagctggtct

SEQ ID NO: 9477152 - DNA, 23 bp, Homo sapiens
aagtaacagggataatagcagtt

SEQ ID NO: 9477153 - DNA, 23 bp, Homo sapiens
aagtaacagggataatagcagtt

SEQ ID NO: 9477154 - DNA, 23 bp, Homo sapiens
aagtaacagggataatagcagtt

SEQ ID NO: 9477155 - DNA, 22 bp, Homo sapiens
aaggtgggcagatcacaaggtc

SEQ ID NO: 9477156 - DNA, 22 bp, Homo sapiens
accatcttaaggggacttctta

SEQ ID NO: 9477157 - DNA, 22 bp, Homo sapiens
accatcttttcctctgcctcct

SEQ ID NO: 9477158 - DNA, 21 bp, Homo sapiens
accatcttccatgcattatat

SEQ ID NO: 9477159 - DNA, 22 bp, Homo sapiens
accatcttttcctctgcctcct

SEQ ID NO: 9477160 - DNA, 22 bp, Homo sapiens
accatcttagtggccagctctc

SEQ ID NO: 9477161 - DNA, 22 bp, Homo sapiens
accatcttagcagactgcagtg

SEQ ID NO: 9477162 - DNA, 22 bp, Homo sapiens
accatcttagcagactgcagtg

SEQ ID NO: 9477163 - DNA, 21 bp, Homo sapiens
accatcttccatgcattatat

SEQ ID NO: 9477164 - DNA, 23 bp, Homo sapiens
acacatatattcagatacagatg

SEQ ID NO: 9477165 - DNA, 22 bp, Homo sapiens
acacatatatttgcatatacac

SEQ ID NO: 9477166 - DNA, 23 bp, Homo sapiens
acacatatattcagatacagatg

SEQ ID NO: 9477167 - DNA, 22 bp, Homo sapiens
acacatatgccattacagcaaa

SEQ ID NO: 9477168 - DNA, 22 bp, Homo sapiens
acacatatgccattacagcaaa

SEQ ID NO: 9477169 - DNA, 22 bp, Homo sapiens
acacatatctaagatagatgac

SEQ ID NO: 9477170 - DNA, 22 bp, Homo sapiens
acacatatctaagatagatgac

SEQ ID NO: 9477171 - DNA, 22 bp, Homo sapiens
acacatatgtatgcatcatgtg

SEQ ID NO: 9477172 - DNA, 18 bp, Homo sapiens
agcagctttgtgcttgat

SEQ ID NO: 9477173 - DNA, 23 bp, Homo sapiens
agcaggaaaccgagggtgatgtt

SEQ ID NO: 9477174 - DNA, 20 bp, Homo sapiens
agcaggaaaagtgccagtct

SEQ ID NO: 9477175 - DNA, 22 bp, Homo sapiens
agcagctttaagtcactggtta

SEQ ID NO: 9477176 - DNA, 22 bp, Homo sapiens
agcagcttgggtctctcctgct

SEQ ID NO: 9477177 - DNA, 22 bp, Homo sapiens
agcagcttgggtctctcctgct

SEQ ID NO: 9477178 - DNA, 22 bp, Homo sapiens
agcagcagtacatataagacta

SEQ ID NO: 9477179 - DNA, 22 bp, Homo sapiens
agcagcagtcctttgtgtaatt

SEQ ID NO: 9477180 - DNA, 22 bp, Homo sapiens
agcagcaggtgacctcgatgcc

SEQ ID NO: 9477181 - DNA, 22 bp, Homo sapiens
agcagcaggtgacctcgatgcc

SEQ ID NO: 9477182 - DNA, 22 bp, Homo sapiens
agcagcaggtgacctcgatgcc

SEQ ID NO: 9477183 - DNA, 22 bp, Homo sapiens
agcagcaggtgacctcgatgcc

SEQ ID NO: 9477184 - DNA, 22 bp, Homo sapiens
acacaggcaagagtgcaggtct

SEQ ID NO: 9477185 - DNA, 22 bp, Homo sapiens
acacaggcaatgtgagtgggag

SEQ ID NO: 9477186 - DNA, 21 bp, Homo sapiens
acacaggcagtgtcccgaggt

SEQ ID NO: 9477187 - DNA, 22 bp, Homo sapiens
acacataagaaactacaaagag

SEQ ID NO: 9477188 - DNA, 22 bp, Homo sapiens
acacataagaaactacaaagag

SEQ ID NO: 9477189 - DNA, 22 bp, Homo sapiens
acacataagaaactacaaagag

SEQ ID NO: 9477190 - DNA, 22 bp, Homo sapiens
agcagcagtgtgtggtcatgtt

SEQ ID NO: 9477191 - DNA, 22 bp, Homo sapiens
agcagcagtgtgtggtcatgtt

SEQ ID NO: 9477192 - DNA, 23 bp, Homo sapiens
agcagcagtgagaggtgtcttac

SEQ ID NO: 9477193 - DNA, 23 bp, Homo sapiens
agcagcagtgagaggtgtcttac

SEQ ID NO: 9477194 - DNA, 22 bp, Homo sapiens
agcagcagtgacagccgaaagc

SEQ ID NO: 9477195 - DNA, 22 bp, Homo sapiens
acacaggacagggatgtgtttt

SEQ ID NO: 9477196 - DNA, 22 bp, Homo sapiens
acacaggaagtcagcactgatg

SEQ ID NO: 9477197 - DNA, 22 bp, Homo sapiens
acacaggaagtcagcactgatg

SEQ ID NO: 9477198 - DNA, 22 bp, Homo sapiens
acacaggagaaaagatctccca

SEQ ID NO: 9477199 - DNA, 22 bp, Homo sapiens
acacaggagatatgtaatggct

SEQ ID NO: 9477200 - DNA, 22 bp, Homo sapiens
acacaggaggaggatggtggtc

SEQ ID NO: 9477201 - DNA, 22 bp, Homo sapiens
acacaggaggaggatggtggtc

SEQ ID NO: 9477202 - DNA, 22 bp, Homo sapiens
acacaggaagagagataataat

SEQ ID NO: 9477203 - DNA, 22 bp, Homo sapiens
acacaggaactctgagaggtgg

SEQ ID NO: 9477204 - DNA, 22 bp, Homo sapiens
acacaggaactctgagaggtgg

SEQ ID NO: 9477205 - DNA, 22 bp, Homo sapiens
acacagattttacatgttatgc

SEQ ID NO: 9477206 - DNA, 22 bp, Homo sapiens
acaattttaagccagagtgggt

SEQ ID NO: 9477207 - DNA, 22 bp, Homo sapiens
acaatttgaggctactcaattg

SEQ ID NO: 9477208 - DNA, 22 bp, Homo sapiens
acaatttctaatatagatctta

SEQ ID NO: 9477209 - DNA, 22 bp, Homo sapiens
agcaccctcagccttatccaga

SEQ ID NO: 9477210 - DNA, 22 bp, Homo sapiens
agcaccatttatcatctaggta

SEQ ID NO: 9477211 - DNA, 22 bp, Homo sapiens
agcaccattgcaaatatggcag

SEQ ID NO: 9477212 - DNA, 22 bp, Homo sapiens
agcaccctggggaagcacaaag

SEQ ID NO: 9477213 - DNA, 22 bp, Homo sapiens
agcacccttcagcccagcctgg

SEQ ID NO: 9477214 - DNA, 22 bp, Homo sapiens
agcaccctcccaccctctcaga

SEQ ID NO: 9477215 - DNA, 22 bp, Homo sapiens
agcacctccagagcttgaagct

SEQ ID NO: 9477216 - DNA, 22 bp, Homo sapiens
agcaccctttgtgagcataagt

SEQ ID NO: 9477217 - DNA, 22 bp, Homo sapiens
agcacctccttagctatgacca

SEQ ID NO: 9477218 - DNA, 22 bp, Homo sapiens
agcacctccttagctatgacca

SEQ ID NO: 9477219 - DNA, 22 bp, Homo sapiens
agcacctgcacagtggaggaaa

SEQ ID NO: 9477220 - DNA, 22 bp, Homo sapiens
agcacctgcacagtggaggaaa

SEQ ID NO: 9477221 - DNA, 22 bp, Homo sapiens
agcacctccttagctatgacca

SEQ ID NO: 9477222 - DNA, 22 bp, Homo sapiens
agcacctgcctgcattggctat

SEQ ID NO: 9477223 - DNA, 22 bp, Homo sapiens
acaattctgatggtttcccagt

SEQ ID NO: 9477224 - DNA, 22 bp, Homo sapiens
agcacctgctatgtgtcaggga

SEQ ID NO: 9477225 - DNA, 22 bp, Homo sapiens
acaatttatccattgtatagtt

SEQ ID NO: 9477226 - DNA, 22 bp, Homo sapiens
acaatttatccattgtatagtt

SEQ ID NO: 9477227 - DNA, 22 bp, Homo sapiens
acaatttatccattgtatagtt

SEQ ID NO: 9477228 - DNA, 22 bp, Homo sapiens
acaatttatccattgtatagtt

SEQ ID NO: 9477229 - DNA, 22 bp, Homo sapiens
acaattgcattgtcacaaataa

SEQ ID NO: 9477230 - DNA, 20 bp, Homo sapiens
acaattgtccctgtctgtca

SEQ ID NO: 9477231 - DNA, 22 bp, Homo sapiens
acaattgtggcaatttgtatgt

SEQ ID NO: 9477232 - DNA, 22 bp, Homo sapiens
acaattgtggcaatttgtatgt

SEQ ID NO: 9477233 - DNA, 23 bp, Homo sapiens
acacatttttcccgttctgaggt

SEQ ID NO: 9477234 - DNA, 22 bp, Homo sapiens
acaccaaagtagaattaatgta

SEQ ID NO: 9477235 - DNA, 22 bp, Homo sapiens
acacattttcaacactgtcaag

SEQ ID NO: 9477236 - DNA, 22 bp, Homo sapiens
acacattttcaacactgtcaag

SEQ ID NO: 9477237 - DNA, 22 bp, Homo sapiens
acacattttggctaggtggaga

SEQ ID NO: 9477238 - DNA, 22 bp, Homo sapiens
acacattttggctaggtggaga

SEQ ID NO: 9477239 - DNA, 22 bp, Homo sapiens
acacatttgctaaaatgagctc

SEQ ID NO: 9477240 - DNA, 22 bp, Homo sapiens
acacatttgggctcctacataa

SEQ ID NO: 9477241 - DNA, 22 bp, Homo sapiens
acacatttgggctcctacataa

SEQ ID NO: 9477242 - DNA, 22 bp, Homo sapiens
acacatttgctaaaatgagctc

SEQ ID NO: 9477243 - DNA, 22 bp, Homo sapiens
acacatttgctaaaatgagctc

SEQ ID NO: 9477244 - DNA, 22 bp, Homo sapiens
acacatttgctaaaatgagctc

SEQ ID NO: 9477245 - DNA, 22 bp, Homo sapiens
acacatttgcataatacctcat

SEQ ID NO: 9477246 - DNA, 19 bp, Homo sapiens
acacatttgcacaatccac

SEQ ID NO: 9477247 - DNA, 23 bp, Homo sapiens
agcaggaaaccgagggtgatgtt

SEQ ID NO: 9477248 - DNA, 22 bp, Homo sapiens
acacattataggcaatcaaaag

SEQ ID NO: 9477249 - DNA, 22 bp, Homo sapiens
acacatttctctttttgtaagt

SEQ ID NO: 9477250 - DNA, 22 bp, Homo sapiens
acacattatctcattaaatact

SEQ ID NO: 9477251 - DNA, 22 bp, Homo sapiens
acacattatctcattaaatact

SEQ ID NO: 9477252 - DNA, 22 bp, Homo sapiens
acactgtgagctgaagggctgc

SEQ ID NO: 9477253 - DNA, 22 bp, Homo sapiens
acactgtctgggactcaggagt

SEQ ID NO: 9477254 - DNA, 23 bp, Homo sapiens
acactgtctcatggatagactgc

SEQ ID NO: 9477255 - DNA, 22 bp, Homo sapiens
acactgtatgaaaacaggaaat

SEQ ID NO: 9477256 - DNA, 18 bp, Homo sapiens
acactgcagcagtctgct

SEQ ID NO: 9477257 - DNA, 22 bp, Homo sapiens
acactgtaaacatctcaagcac

SEQ ID NO: 9477258 - DNA, 22 bp, Homo sapiens
acactgcagatgtaatttgagt

SEQ ID NO: 9477259 - DNA, 22 bp, Homo sapiens
acactgcagatgtaatttgagt

SEQ ID NO: 9477260 - DNA, 18 bp, Homo sapiens
acactgcagcagtctgct

SEQ ID NO: 9477261 - DNA, 22 bp, Homo sapiens
acactgtaaagtgatgcttaaa

SEQ ID NO: 9477262 - DNA, 22 bp, Homo sapiens
acactgtaaattgagtgcgtga

SEQ ID NO: 9477263 - DNA, 22 bp, Homo sapiens
acactgtagatatagagttagt

SEQ ID NO: 9477264 - DNA, 19 bp, Homo sapiens
acactgtagatatagctat

SEQ ID NO: 9477265 - DNA, 19 bp, Homo sapiens
acactgtagatatagctat

SEQ ID NO: 9477266 - DNA, 22 bp, Homo sapiens
acactgtaggagaaaggagttt

SEQ ID NO: 9477267 - DNA, 22 bp, Homo sapiens
agcagggcccactaggggagat

SEQ ID NO: 9477268 - DNA, 22 bp, Homo sapiens
agcagggcccactaggggagat

SEQ ID NO: 9477269 - DNA, 22 bp, Homo sapiens
acactgcagatgaaagcataag

SEQ ID NO: 9477270 - DNA, 22 bp, Homo sapiens
acactgcagatgaaagcataag

SEQ ID NO: 9477271 - DNA, 22 bp, Homo sapiens
agcagggcccactaggggagat

SEQ ID NO: 9477272 - DNA, 22 bp, Homo sapiens
agcagggcagttaaagggtcct

SEQ ID NO: 9477273 - DNA, 22 bp, Homo sapiens
agcagggcatgaataagggttt

SEQ ID NO: 9477274 - DNA, 22 bp, Homo sapiens
agcagggcagttaaagggtcct

SEQ ID NO: 9477275 - DNA, 22 bp, Homo sapiens
agcagggcagttaaagggtcct

SEQ ID NO: 9477276 - DNA, 22 bp, Homo sapiens
agcagggcatgaataagggttt

SEQ ID NO: 9477277 - DNA, 18 bp, Homo sapiens
agcagggcattttgccat

SEQ ID NO: 9477278 - DNA, 22 bp, Homo sapiens
agcagggccaacagtaaacacc

SEQ ID NO: 9477279 - DNA, 22 bp, Homo sapiens
acagaaagataggcacaaggtc

SEQ ID NO: 9477280 - DNA, 22 bp, Homo sapiens
agcagtgttcaatgatacactg

SEQ ID NO: 9477281 - DNA, 22 bp, Homo sapiens
agcagtggtgtgaggagggctc

SEQ ID NO: 9477282 - DNA, 21 bp, Homo sapiens
acactgtgtcataatgcttaa

SEQ ID NO: 9477283 - DNA, 21 bp, Homo sapiens
acactgtgtcataatgcttaa

SEQ ID NO: 9477284 - DNA, 22 bp, Homo sapiens
acactgtgcttagatgctgaac

SEQ ID NO: 9477285 - DNA, 22 bp, Homo sapiens
acactgtgcatgcatatacaca

SEQ ID NO: 9477286 - DNA, 22 bp, Homo sapiens
acactgtgcatgcatatacaca

SEQ ID NO: 9477287 - DNA, 22 bp, Homo sapiens
acactgtgcagattccctgtga

SEQ ID NO: 9477288 - DNA, 22 bp, Homo sapiens
agcagtggtgtgaggagggctc

SEQ ID NO: 9477289 - DNA, 22 bp, Homo sapiens
acagaaattctgggacagaaaa

SEQ ID NO: 9477290 - DNA, 22 bp, Homo sapiens
acagaaattctgggacagaaaa

SEQ ID NO: 9477291 - DNA, 22 bp, Homo sapiens
acagaaattctgggacagaaaa

SEQ ID NO: 9477292 - DNA, 22 bp, Homo sapiens
acagaaattgctaatagctcat

SEQ ID NO: 9477293 - DNA, 22 bp, Homo sapiens
acagaaattgctaatagctcat

SEQ ID NO: 9477294 - DNA, 22 bp, Homo sapiens
acagaaattgctaatagctcat

SEQ ID NO: 9477295 - DNA, 19 bp, Homo sapiens
acagaaattagttattttc

SEQ ID NO: 9477296 - DNA, 22 bp, Homo sapiens
acagaaattcaaactggaattt

SEQ ID NO: 9477297 - DNA, 22 bp, Homo sapiens
acagaaattcaaactggaattt

SEQ ID NO: 9477298 - DNA, 22 bp, Homo sapiens
acagaaattcaaactggaattt

SEQ ID NO: 9477299 - DNA, 22 bp, Homo sapiens
acagaaattgggcaaatggaag

SEQ ID NO: 9477300 - DNA, 22 bp, Homo sapiens
acagaacaacaaggtggaccag

SEQ ID NO: 9477301 - DNA, 22 bp, Homo sapiens
acagaaattgggcaaatggaag

SEQ ID NO: 9477302 - DNA, 22 bp, Homo sapiens
acagaaattgggcaaatggaag

SEQ ID NO: 9477303 - DNA, 22 bp, Homo sapiens
acagaacaagacctgcttattg

SEQ ID NO: 9477304 - DNA, 22 bp, Homo sapiens
acagaacaacaaggtggaccag

SEQ ID NO: 9477305 - DNA, 22 bp, Homo sapiens
acagaacaagacctgcttattg

SEQ ID NO: 9477306 - DNA, 22 bp, Homo sapiens
agccacaggccatgagatacca

SEQ ID NO: 9477307 - DNA, 22 bp, Homo sapiens
agccacaggccatgagatacca

SEQ ID NO: 9477308 - DNA, 22 bp, Homo sapiens
agccacaggaaacagagacagc

SEQ ID NO: 9477309 - DNA, 22 bp, Homo sapiens
agccacaggaaacagagacagc

SEQ ID NO: 9477310 - DNA, 22 bp, Homo sapiens
agccacagggggtgagggacaa

SEQ ID NO: 9477311 - DNA, 22 bp, Homo sapiens
agccacagggggtgagggacaa

SEQ ID NO: 9477312 - DNA, 17 bp, Homo sapiens
agcctgccccatgctgc

SEQ ID NO: 9477313 - DNA, 17 bp, Homo sapiens
agcctgccccatgctgc

SEQ ID NO: 9477314 - DNA, 22 bp, Homo sapiens
agcctgccaggcgctgcctgga

SEQ ID NO: 9477315 - DNA, 17 bp, Homo sapiens
agcctgccccatgctgc

SEQ ID NO: 9477316 - DNA, 22 bp, Homo sapiens
agcctgcctcagactcaggata

SEQ ID NO: 9477317 - DNA, 22 bp, Homo sapiens
agcctgcctcagactcaggata

SEQ ID NO: 9477318 - DNA, 22 bp, Homo sapiens
agcctgcctcagactcaggata

SEQ ID NO: 9477319 - DNA, 22 bp, Homo sapiens
agcctgcctgtgaggctttgag

SEQ ID NO: 9477320 - DNA, 21 bp, Homo sapiens
agcctgcctgaactctgtggc

SEQ ID NO: 9477321 - DNA, 22 bp, Homo sapiens
agcctgccttgggctgcttgag

SEQ ID NO: 9477322 - DNA, 22 bp, Homo sapiens
agcctgcaggatgggcagcacc

SEQ ID NO: 9477323 - DNA, 22 bp, Homo sapiens
agcctgagtgcttaggactgtt

SEQ ID NO: 9477324 - DNA, 22 bp, Homo sapiens
acagataaggcagttaagagtt

SEQ ID NO: 9477325 - DNA, 21 bp, Homo sapiens
agcctgcaatgtaggtaccgg

SEQ ID NO: 9477326 - DNA, 22 bp, Homo sapiens
agcctgccaggcgctgcctgga

SEQ ID NO: 9477327 - DNA, 20 bp, Homo sapiens
agcctgccagctggcccaga

SEQ ID NO: 9477328 - DNA, 22 bp, Homo sapiens
acagcaagacccctagcatggt

SEQ ID NO: 9477329 - DNA, 22 bp, Homo sapiens
acagcaactcctgcttctgagt

SEQ ID NO: 9477330 - DNA, 22 bp, Homo sapiens
acagcaactcctgcttctgagt

SEQ ID NO: 9477331 - DNA, 22 bp, Homo sapiens
acagcaaaggacgaacactctg

SEQ ID NO: 9477332 - DNA, 22 bp, Homo sapiens
acagcaaaggacgaacactctg

SEQ ID NO: 9477333 - DNA, 22 bp, Homo sapiens
acagcaaaggacgaacactctg

SEQ ID NO: 9477334 - DNA, 22 bp, Homo sapiens
acagcaaaggacgaacactctg

SEQ ID NO: 9477335 - DNA, 22 bp, Homo sapiens
acagcaaaagacaagaacttaa

SEQ ID NO: 9477336 - DNA, 22 bp, Homo sapiens
agcctgctggaccaagctcatg

SEQ ID NO: 9477337 - DNA, 17 bp, Homo sapiens
agcctgctgatctcaca

SEQ ID NO: 9477338 - DNA, 22 bp, Homo sapiens
agcctgcgatcccacctggcct

SEQ ID NO: 9477339 - DNA, 17 bp, Homo sapiens
agcctgctgatctcaca

SEQ ID NO: 9477340 - DNA, 21 bp, Homo sapiens
acagcaagccttcacatgagt

SEQ ID NO: 9477341 - DNA, 21 bp, Homo sapiens
acagcaagccttcacatgagt

SEQ ID NO: 9477342 - DNA, 21 bp, Homo sapiens
acagcaagccttcctttcagg

SEQ ID NO: 9477343 - DNA, 21 bp, Homo sapiens
acagcaagccttcctttcagg

SEQ ID NO: 9477344 - DNA, 22 bp, Homo sapiens
acagcaatctgagagacatagt

SEQ ID NO: 9477345 - DNA, 22 bp, Homo sapiens
acagcaataggaaatacttgca

SEQ ID NO: 9477346 - DNA, 23 bp, Homo sapiens
acagcaagaggaccagatgtgag

SEQ ID NO: 9477347 - DNA, 22 bp, Homo sapiens
acagcaagacccctagcatggt

SEQ ID NO: 9477348 - DNA, 21 bp, Homo sapiens
acagcaagccttcacatgagt

SEQ ID NO: 9477349 - DNA, 22 bp, Homo sapiens
acagcaagccagcttgtcactg

SEQ ID NO: 9477350 - DNA, 22 bp, Homo sapiens
acagcaagacccctagcatggt

SEQ ID NO: 9477351 - DNA, 22 bp, Homo sapiens
acagcaagacccctagcatggt

SEQ ID NO: 9477352 - DNA, 23 bp, Homo sapiens
acagcaagaggaccagatgtgag

SEQ ID NO: 9477353 - DNA, 22 bp, Homo sapiens
agctagggctttcgtagacagt

SEQ ID NO: 9477354 - DNA, 22 bp, Homo sapiens
agctaggggaccaaggtggccc

SEQ ID NO: 9477355 - DNA, 22 bp, Homo sapiens
agctaggataagcagagactgg

SEQ ID NO: 9477356 - DNA, 19 bp, Homo sapiens
agctagtgctcagctgtca

SEQ ID NO: 9477357 - DNA, 23 bp, Homo sapiens
agctataaaatctgtgacagcag

SEQ ID NO: 9477358 - DNA, 23 bp, Homo sapiens
agctataaaatctgtgacagcag

SEQ ID NO: 9477359 - DNA, 22 bp, Homo sapiens
agctccttgaagggctctggga

SEQ ID NO: 9477360 - DNA, 22 bp, Homo sapiens
agctccttgaagggctctggga

SEQ ID NO: 9477361 - DNA, 22 bp, Homo sapiens
agctccttgaagggctctggga

SEQ ID NO: 9477362 - DNA, 22 bp, Homo sapiens
agctctaaatggaattttgcct

SEQ ID NO: 9477363 - DNA, 22 bp, Homo sapiens
agctctatcacctgtcagttgc

SEQ ID NO: 9477364 - DNA, 22 bp, Homo sapiens
agctctcaagataagaaagaac

SEQ ID NO: 9477365 - DNA, 20 bp, Homo sapiens
agctctcagcatgctgcctg

SEQ ID NO: 9477366 - DNA, 22 bp, Homo sapiens
agctctcaagataagaaagaac

SEQ ID NO: 9477367 - DNA, 22 bp, Homo sapiens
agctctcattactttacagatg

SEQ ID NO: 9477368 - DNA, 22 bp, Homo sapiens
agctctccacacataggactag

SEQ ID NO: 9477369 - DNA, 22 bp, Homo sapiens
agctccttgaagggctctggga

SEQ ID NO: 9477370 - DNA, 22 bp, Homo sapiens
agctcctgttctgagagcagga

SEQ ID NO: 9477371 - DNA, 22 bp, Homo sapiens
agctcctgttctgagagcagga

SEQ ID NO: 9477372 - DNA, 19 bp, Homo sapiens
agctcctgttcagcagctc

SEQ ID NO: 9477373 - DNA, 19 bp, Homo sapiens
agctcctgttcagcagctc

SEQ ID NO: 9477374 - DNA, 22 bp, Homo sapiens
agctctccatctatctgtgatg

SEQ ID NO: 9477375 - DNA, 22 bp, Homo sapiens
agctctgggctgacatgctccc

SEQ ID NO: 9477376 - DNA, 22 bp, Homo sapiens
agctctgggctgacatgctccc

SEQ ID NO: 9477377 - DNA, 22 bp, Homo sapiens
agctctgggccaggaaccctaa

SEQ ID NO: 9477378 - DNA, 22 bp, Homo sapiens
agctctgggctgacatgctccc

SEQ ID NO: 9477379 - DNA, 22 bp, Homo sapiens
agctctgggctgacatgctccc

SEQ ID NO: 9477380 - DNA, 22 bp, Homo sapiens
agctctgggctgacatgctccc

SEQ ID NO: 9477381 - DNA, 22 bp, Homo sapiens
agctctgggctgacatgctccc

SEQ ID NO: 9477382 - DNA, 18 bp, Homo sapiens
agctctggggagatgggc

SEQ ID NO: 9477383 - DNA, 22 bp, Homo sapiens
agctctgggggaaagtctgctc

SEQ ID NO: 9477384 - DNA, 22 bp, Homo sapiens
agctctgggggaaagtctgctc

SEQ ID NO: 9477385 - DNA, 22 bp, Homo sapiens
agctctgggggaaagtctgctc

SEQ ID NO: 9477386 - DNA, 22 bp, Homo sapiens
agctctgggggaaagtctgctc

SEQ ID NO: 9477387 - DNA, 22 bp, Homo sapiens
agctctggggcctgtcccacat

SEQ ID NO: 9477388 - DNA, 22 bp, Homo sapiens
agctctggggcctgtcccacat

SEQ ID NO: 9477389 - DNA, 22 bp, Homo sapiens
acagcagcgtgaagtgtgttat

SEQ ID NO: 9477390 - DNA, 22 bp, Homo sapiens
acagcagcgtgaagtgtgttat

SEQ ID NO: 9477391 - DNA, 22 bp, Homo sapiens
agctcaagagtagttcgagggg

SEQ ID NO: 9477392 - DNA, 21 bp, Homo sapiens
agctatttcagatttgagagc

SEQ ID NO: 9477393 - DNA, 22 bp, Homo sapiens
agctatttcaaagtttgagaca

SEQ ID NO: 9477394 - DNA, 22 bp, Homo sapiens
agctattgtgtgcccagcagga

SEQ ID NO: 9477395 - DNA, 22 bp, Homo sapiens
acagcaggatttggcgatgttg

SEQ ID NO: 9477396 - DNA, 22 bp, Homo sapiens
acagcaggagccttcatatgct

SEQ ID NO: 9477397 - DNA, 22 bp, Homo sapiens
acagcaggagccttcatatgct

SEQ ID NO: 9477398 - DNA, 22 bp, Homo sapiens
acagcaggagccttcatatgct

SEQ ID NO: 9477399 - DNA, 22 bp, Homo sapiens
acagcaggaattaacatataag

SEQ ID NO: 9477400 - DNA, 22 bp, Homo sapiens
acagcaggaattaacatataag

SEQ ID NO: 9477401 - DNA, 22 bp, Homo sapiens
acagcaggaagctggagggaaa

SEQ ID NO: 9477402 - DNA, 22 bp, Homo sapiens
acagcaggaattaacatataag

SEQ ID NO: 9477403 - DNA, 22 bp, Homo sapiens
acagcaggatttggcgatgttg

SEQ ID NO: 9477404 - DNA, 22 bp, Homo sapiens
acagcaggatttggcgatgttg

SEQ ID NO: 9477405 - DNA, 22 bp, Homo sapiens
acagcaggcacacaaggataga

SEQ ID NO: 9477406 - DNA, 22 bp, Homo sapiens
acagcaggcacacaaggataga

SEQ ID NO: 9477407 - DNA, 22 bp, Homo sapiens
acagcaggcacacaaggataga

SEQ ID NO: 9477408 - DNA, 22 bp, Homo sapiens
acagcaggcatgaagaaatgtt

SEQ ID NO: 9477409 - DNA, 22 bp, Homo sapiens
acagcaggcatgaagaaatgtt

SEQ ID NO: 9477410 - DNA, 22 bp, Homo sapiens
acagcaggcatgaagaaatgtt

SEQ ID NO: 9477411 - DNA, 22 bp, Homo sapiens
acagcaggcatgaagaaatgtt

SEQ ID NO: 9477412 - DNA, 22 bp, Homo sapiens
acagcaggcatgaagaaatgtt

SEQ ID NO: 9477413 - DNA, 22 bp, Homo sapiens
acagcaggcatgaagaaatgtt

SEQ ID NO: 9477414 - DNA, 22 bp, Homo sapiens
acagcaggcatgaatgacactg

SEQ ID NO: 9477415 - DNA, 22 bp, Homo sapiens
acagcaggcatgaatgacactg

SEQ ID NO: 9477416 - DNA, 22 bp, Homo sapiens
agctcctgtgtgcccacctgct

SEQ ID NO: 9477417 - DNA, 22 bp, Homo sapiens
agctcctgtgtgcccacctgct

SEQ ID NO: 9477418 - DNA, 22 bp, Homo sapiens
agctcctgtgtgcccacctgct

SEQ ID NO: 9477419 - DNA, 22 bp, Homo sapiens
acagagtttatgtgtgtacaaa

SEQ ID NO: 9477420 - DNA, 22 bp, Homo sapiens
acagataaaagttgtttaaaat

SEQ ID NO: 9477421 - DNA, 22 bp, Homo sapiens
acagataaaagttgtttaaaat

SEQ ID NO: 9477422 - DNA, 22 bp, Homo sapiens
acagataaagaaacaatcacag

SEQ ID NO: 9477423 - DNA, 22 bp, Homo sapiens
acagataatacattgtgctaca

SEQ ID NO: 9477424 - DNA, 22 bp, Homo sapiens
acagataatacattgtgctaca

SEQ ID NO: 9477425 - DNA, 22 bp, Homo sapiens
acagataaggcagttaagagtt

SEQ ID NO: 9477426 - DNA, 22 bp, Homo sapiens
acagataaatttataggagtgt

SEQ ID NO: 9477427 - DNA, 17 bp, Homo sapiens
acagagtgtcccgcagt

SEQ ID NO: 9477428 - DNA, 22 bp, Homo sapiens
acagagtgtttttaagtatatt

SEQ ID NO: 9477429 - DNA, 22 bp, Homo sapiens
acagagttgtgtttgtacaacg

SEQ ID NO: 9477430 - DNA, 22 bp, Homo sapiens
acagagttgtgtttgtacaacg

SEQ ID NO: 9477431 - DNA, 22 bp, Homo sapiens
acagagttgtaaacatttacca

SEQ ID NO: 9477432 - DNA, 23 bp, Homo sapiens
acagaggtccaaacagtataagc

SEQ ID NO: 9477433 - DNA, 22 bp, Homo sapiens
agcccctctgtggctctgcctc

SEQ ID NO: 9477434 - DNA, 22 bp, Homo sapiens
agcccctgctgggtgtagctca

SEQ ID NO: 9477435 - DNA, 22 bp, Homo sapiens
agcccctgctgggtgtagctca

SEQ ID NO: 9477436 - DNA, 22 bp, Homo sapiens
acagagcataatgtctagcaca

SEQ ID NO: 9477437 - DNA, 22 bp, Homo sapiens
acagagcataatgtctagcaca

SEQ ID NO: 9477438 - DNA, 21 bp, Homo sapiens
acagagcataatggtgtggca

SEQ ID NO: 9477439 - DNA, 22 bp, Homo sapiens
acagagcagtaagaacacagct

SEQ ID NO: 9477440 - DNA, 22 bp, Homo sapiens
acagagcagtaagaacacagct

SEQ ID NO: 9477441 - DNA, 22 bp, Homo sapiens
acagagcatataaagtgctttg

SEQ ID NO: 9477442 - DNA, 22 bp, Homo sapiens
acagagcatataaagtgctttg

SEQ ID NO: 9477443 - DNA, 22 bp, Homo sapiens
acagagcatgatggaagatcga

SEQ ID NO: 9477444 - DNA, 22 bp, Homo sapiens
acagagcatcagatgaaatcaa

SEQ ID NO: 9477445 - DNA, 22 bp, Homo sapiens
agcccctctgtagctaatagta

SEQ ID NO: 9477446 - DNA, 22 bp, Homo sapiens
agcccctctccgccctgagtcg

SEQ ID NO: 9477447 - DNA, 22 bp, Homo sapiens
agcccctccagtggcataaaat

SEQ ID NO: 9477448 - DNA, 23 bp, Homo sapiens
agcccctcatatctgctttctct

SEQ ID NO: 9477449 - DNA, 23 bp, Homo sapiens
agcccctcatggtgtctagacag

SEQ ID NO: 9477450 - DNA, 22 bp, Homo sapiens
agcccccaggagtctccacgcc

SEQ ID NO: 9477451 - DNA, 22 bp, Homo sapiens
agcccccaggagtctccacgcc

SEQ ID NO: 9477452 - DNA, 22 bp, Homo sapiens
agcccccaggagtctccacgcc

SEQ ID NO: 9477453 - DNA, 22 bp, Homo sapiens
agccacagtcaacctgtccata

SEQ ID NO: 9477454 - DNA, 22 bp, Homo sapiens
agccacagtcaacctgtccata

SEQ ID NO: 9477455 - DNA, 22 bp, Homo sapiens
agccacagtcaacctgtccata

SEQ ID NO: 9477456 - DNA, 22 bp, Homo sapiens
agccagggtgggtgaatgctat

SEQ ID NO: 9477457 - DNA, 22 bp, Homo sapiens
agccatcctactacctcagcat

SEQ ID NO: 9477458 - DNA, 22 bp, Homo sapiens
agccatcctcccacctcagcct

SEQ ID NO: 9477459 - DNA, 22 bp, Homo sapiens
agccatcctccacagccttgat

SEQ ID NO: 9477460 - DNA, 22 bp, Homo sapiens
agccatcctcccacctcagcct

SEQ ID NO: 9477461 - DNA, 22 bp, Homo sapiens
agccacagtctgatgcctgaga

SEQ ID NO: 9477462 - DNA, 22 bp, Homo sapiens
agccacagtctgatgcctgaga

SEQ ID NO: 9477463 - DNA, 22 bp, Homo sapiens
agccacagtctgatgcctgaga

SEQ ID NO: 9477464 - DNA, 22 bp, Homo sapiens
agccacagtctgatgcctgaga

SEQ ID NO: 9477465 - DNA, 21 bp, Homo sapiens
agccagggtggacactgtatg

SEQ ID NO: 9477466 - DNA, 22 bp, Homo sapiens
agccatgggctcccagtccttt

SEQ ID NO: 9477467 - DNA, 22 bp, Homo sapiens
agccatgggctcccagtccttt

SEQ ID NO: 9477468 - DNA, 22 bp, Homo sapiens
agccatggtctcagggccataa

SEQ ID NO: 9477469 - DNA, 22 bp, Homo sapiens
agccattgaatttagtgccttt

SEQ ID NO: 9477470 - DNA, 22 bp, Homo sapiens
agccattggctgcctggtgcgt

SEQ ID NO: 9477471 - DNA, 22 bp, Homo sapiens
agccattcattgtgctctcaga

SEQ ID NO: 9477472 - DNA, 22 bp, Homo sapiens
agccatgcaccttactcttgct

SEQ ID NO: 9477473 - DNA, 22 bp, Homo sapiens
agccatgaccttgcagacctgc

SEQ ID NO: 9477474 - DNA, 22 bp, Homo sapiens
agccatgaccttgcagacctgc

SEQ ID NO: 9477475 - DNA, 22 bp, Homo sapiens
agccatgggagactgtgggaga

SEQ ID NO: 9477476 - DNA, 22 bp, Homo sapiens
agccatgggctcccagtccttt

SEQ ID NO: 9477477 - DNA, 22 bp, Homo sapiens
agccatggcgccactagaggga

SEQ ID NO: 9477478 - DNA, 22 bp, Homo sapiens
agcccagctcctccacagaata

SEQ ID NO: 9477479 - DNA, 22 bp, Homo sapiens
agcccagctcctccacagaata

SEQ ID NO: 9477480 - DNA, 22 bp, Homo sapiens
agcccagctcctccacagaata

SEQ ID NO: 9477481 - DNA, 18 bp, Homo sapiens
agcccagcggagtgaatc

SEQ ID NO: 9477482 - DNA, 18 bp, Homo sapiens
agcccagcggagtgaatc

SEQ ID NO: 9477483 - DNA, 22 bp, Homo sapiens
agcccagctgcctgcctgctgt

SEQ ID NO: 9477484 - DNA, 22 bp, Homo sapiens
agcccagctgcctgcctgctgt

SEQ ID NO: 9477485 - DNA, 22 bp, Homo sapiens
agcccagctgcctgcctgctgt

SEQ ID NO: 9477486 - DNA, 22 bp, Homo sapiens
agcccagctgctatgtacctgg

SEQ ID NO: 9477487 - DNA, 22 bp, Homo sapiens
agccattttcctgaaatataac

SEQ ID NO: 9477488 - DNA, 22 bp, Homo sapiens
agccattttggtaatgataaca

SEQ ID NO: 9477489 - DNA, 22 bp, Homo sapiens
agccattttcctgaaatataac

SEQ ID NO: 9477490 - DNA, 22 bp, Homo sapiens
agccattttggtaatgataaca

SEQ ID NO: 9477491 - DNA, 22 bp, Homo sapiens
agcccagcctgattctacaccc

SEQ ID NO: 9477492 - DNA, 22 bp, Homo sapiens
agcccagcggagcgggcccggg

SEQ ID NO: 9477493 - DNA, 17 bp, Homo sapiens
acagagcacatcaagat

SEQ ID NO: 9477494 - DNA, 22 bp, Homo sapiens
acagagcactgccctgtgccgc

SEQ ID NO: 9477495 - DNA, 17 bp, Homo sapiens
acagagcacatcaagat

SEQ ID NO: 9477496 - DNA, 22 bp, Homo sapiens
acagagcaggtccagaagtgcc

SEQ ID NO: 9477497 - DNA, 22 bp, Homo sapiens
acagagcaggtccagaagtgcc

SEQ ID NO: 9477498 - DNA, 22 bp, Homo sapiens
acagagcactgccctgtgccgc

SEQ ID NO: 9477499 - DNA, 22 bp, Homo sapiens
agcccagctttcacccctctgg

SEQ ID NO: 9477500 - DNA, 22 bp, Homo sapiens
agcccagctttcacccctctgg

SEQ ID NO: 9477501 - DNA, 19 bp, Homo sapiens
agcccagcttatttgtcag

SEQ ID NO: 9477502 - DNA, 19 bp, Homo sapiens
agcccagcttatttgtcag

SEQ ID NO: 9477503 - DNA, 22 bp, Homo sapiens
agcccagcttccttctgtctct

SEQ ID NO: 9477504 - DNA, 22 bp, Homo sapiens
agcccagcttccttctgtctct

SEQ ID NO: 9477505 - DNA, 22 bp, Homo sapiens
acaaaatagagttctcccctgg

SEQ ID NO: 9477506 - DNA, 22 bp, Homo sapiens
acaaaatagagttctcccctgg

SEQ ID NO: 9477507 - DNA, 20 bp, Homo sapiens
acaaaataggtactgggtag

SEQ ID NO: 9477508 - DNA, 20 bp, Homo sapiens
acaaaataggtactgggtag

SEQ ID NO: 9477509 - DNA, 20 bp, Homo sapiens
acaaaataggtactgggtag

SEQ ID NO: 9477510 - DNA, 22 bp, Homo sapiens
acaaaaagggagatgaggtaga

SEQ ID NO: 9477511 - DNA, 22 bp, Homo sapiens
acaaaaagggagatgaggtaga

SEQ ID NO: 9477512 - DNA, 22 bp, Homo sapiens
acaaaatagagttctcccctgg

SEQ ID NO: 9477513 - DNA, 22 bp, Homo sapiens
acaaaaagctccattactgtcc

SEQ ID NO: 9477514 - DNA, 22 bp, Homo sapiens
agaggccatgctagaggcctgg

SEQ ID NO: 9477515 - DNA, 22 bp, Homo sapiens
agaggccatgctagaggcctgg

SEQ ID NO: 9477516 - DNA, 22 bp, Homo sapiens
agaggccatggggcatttttca

SEQ ID NO: 9477517 - DNA, 22 bp, Homo sapiens
agaggccatggggcatttttca

SEQ ID NO: 9477518 - DNA, 22 bp, Homo sapiens
agaggccccatgggatggcggt

SEQ ID NO: 9477519 - DNA, 22 bp, Homo sapiens
agaggccccaggtgagcatgcc

SEQ ID NO: 9477520 - DNA, 22 bp, Homo sapiens
agaggccccaggtgagcatgcc

SEQ ID NO: 9477521 - DNA, 22 bp, Homo sapiens
agaggccatgctagaggcctgg

SEQ ID NO: 9477522 - DNA, 22 bp, Homo sapiens
agaggccatctgctctgtgggg

SEQ ID NO: 9477523 - DNA, 22 bp, Homo sapiens
agaggccatctgctctgtgggg

SEQ ID NO: 9477524 - DNA, 22 bp, Homo sapiens
agaggccatctgctctgtgggg

SEQ ID NO: 9477525 - DNA, 22 bp, Homo sapiens
agaggccatctgctctgtgggg

SEQ ID NO: 9477526 - DNA, 22 bp, Homo sapiens
agaggccatctgctctgtgggg

SEQ ID NO: 9477527 - DNA, 20 bp, Homo sapiens
agaggccagttaggagtcta

SEQ ID NO: 9477528 - DNA, 20 bp, Homo sapiens
agaggccagttaggagtcta

SEQ ID NO: 9477529 - DNA, 22 bp, Homo sapiens
agaggccagtggctgtgctgtc

SEQ ID NO: 9477530 - DNA, 20 bp, Homo sapiens
agaggccagttaggagtcta

SEQ ID NO: 9477531 - DNA, 20 bp, Homo sapiens
agaggccagttaggagtcta

SEQ ID NO: 9477532 - DNA, 20 bp, Homo sapiens
agaggccagttaggagtcta

SEQ ID NO: 9477533 - DNA, 20 bp, Homo sapiens
agaggccagttaggagtcta

SEQ ID NO: 9477534 - DNA, 22 bp, Homo sapiens
aattttctgatgatgaagcacg

SEQ ID NO: 9477535 - DNA, 22 bp, Homo sapiens
aattttctgatgatgaagcacg

SEQ ID NO: 9477536 - DNA, 22 bp, Homo sapiens
aattttctgcctagcaaaaact

SEQ ID NO: 9477537 - DNA, 22 bp, Homo sapiens
agaggccagtggctgtgctgtc

SEQ ID NO: 9477538 - DNA, 22 bp, Homo sapiens
agaggccaggtccagagtttgt

SEQ ID NO: 9477539 - DNA, 22 bp, Homo sapiens
agaggccaggtccagagtttgt

SEQ ID NO: 9477540 - DNA, 22 bp, Homo sapiens
agagctgggtgaagtgccatca

SEQ ID NO: 9477541 - DNA, 22 bp, Homo sapiens
agagctgggtgaagtgccatca

SEQ ID NO: 9477542 - DNA, 22 bp, Homo sapiens
agagctggggccagagtcaagg

SEQ ID NO: 9477543 - DNA, 22 bp, Homo sapiens
agagctggggccagagtcaagg

SEQ ID NO: 9477544 - DNA, 22 bp, Homo sapiens
agagctggggccagagtcaagg

SEQ ID NO: 9477545 - DNA, 22 bp, Homo sapiens
agagctgggtggtggtgactca

SEQ ID NO: 9477546 - DNA, 22 bp, Homo sapiens
aatttgtatacatgttacattt

SEQ ID NO: 9477547 - DNA, 22 bp, Homo sapiens
aatttgtatacatgttacattt

SEQ ID NO: 9477548 - DNA, 22 bp, Homo sapiens
agagctgggtggtggtgactca

SEQ ID NO: 9477549 - DNA, 22 bp, Homo sapiens
aattttattagaaggcaagggg

SEQ ID NO: 9477550 - DNA, 22 bp, Homo sapiens
aattttccatccaaagtaacat

SEQ ID NO: 9477551 - DNA, 22 bp, Homo sapiens
aattttctaaggtgatgatctg

SEQ ID NO: 9477552 - DNA, 22 bp, Homo sapiens
aattttccatccaaagtaacat

SEQ ID NO: 9477553 - DNA, 22 bp, Homo sapiens
aattttattaactggatgtagc

SEQ ID NO: 9477554 - DNA, 22 bp, Homo sapiens
aattttatgccttgcacgttgg

SEQ ID NO: 9477555 - DNA, 22 bp, Homo sapiens
aattttatgccttgcacgttgg

SEQ ID NO: 9477556 - DNA, 22 bp, Homo sapiens
acaaatatggtactcggagaaa

SEQ ID NO: 9477557 - DNA, 19 bp, Homo sapiens
acaaatagttacatatcct

SEQ ID NO: 9477558 - DNA, 22 bp, Homo sapiens
acaaatatggtactcggagaaa

SEQ ID NO: 9477559 - DNA, 19 bp, Homo sapiens
acaaatagttacatatcct

SEQ ID NO: 9477560 - DNA, 21 bp, Homo sapiens
acaaactgaaatgagtttcct

SEQ ID NO: 9477561 - DNA, 19 bp, Homo sapiens
acaaactgagtacacttgt

SEQ ID NO: 9477562 - DNA, 22 bp, Homo sapiens
acaaactgaatgggttttctgt

SEQ ID NO: 9477563 - DNA, 22 bp, Homo sapiens
acaaacttatgtttcatatgta

SEQ ID NO: 9477564 - DNA, 22 bp, Homo sapiens
acaaatgagaatgtagacagag

SEQ ID NO: 9477565 - DNA, 22 bp, Homo sapiens
acaaatgagaatgtagacagag

SEQ ID NO: 9477566 - DNA, 22 bp, Homo sapiens
acaaatgactcaaacaccactt

SEQ ID NO: 9477567 - DNA, 22 bp, Homo sapiens
acaaatgagaatgtagacagag

SEQ ID NO: 9477568 - DNA, 22 bp, Homo sapiens
acaaatgagaatgtagacagag

SEQ ID NO: 9477569 - DNA, 22 bp, Homo sapiens
acaaatgattatcacagaggag

SEQ ID NO: 9477570 - DNA, 22 bp, Homo sapiens
acaaatgattatcacagaggag

SEQ ID NO: 9477571 - DNA, 22 bp, Homo sapiens
acaaatgattttccaagccagt

SEQ ID NO: 9477572 - DNA, 22 bp, Homo sapiens
acaaatgattatcacagaggag

SEQ ID NO: 9477573 - DNA, 22 bp, Homo sapiens
acaaatgattatcacagaggag

SEQ ID NO: 9477574 - DNA, 23 bp, Homo sapiens
acaaatgcccatacatctagttc

SEQ ID NO: 9477575 - DNA, 22 bp, Homo sapiens
acaaatgattttccaagccagt

SEQ ID NO: 9477576 - DNA, 22 bp, Homo sapiens
acaaatgattttccaagccagt

SEQ ID NO: 9477577 - DNA, 22 bp, Homo sapiens
acaaatgattttccaagccagt

SEQ ID NO: 9477578 - DNA, 22 bp, Homo sapiens
acaaacatcttgacctcagatt

SEQ ID NO: 9477579 - DNA, 22 bp, Homo sapiens
acaaaccagcttaagcaagatg

SEQ ID NO: 9477580 - DNA, 22 bp, Homo sapiens
acaaaccagcttaagcaagatg

SEQ ID NO: 9477581 - DNA, 22 bp, Homo sapiens
acaaaccagcttaagcaagatg

SEQ ID NO: 9477582 - DNA, 22 bp, Homo sapiens
acaaaccagcttaagcaagatg

SEQ ID NO: 9477583 - DNA, 22 bp, Homo sapiens
acaaaccagcttaagcaagatg

SEQ ID NO: 9477584 - DNA, 22 bp, Homo sapiens
acaaactaaaattctttattga

SEQ ID NO: 9477585 - DNA, 22 bp, Homo sapiens
acaaacagagttgaaaaatagg

SEQ ID NO: 9477586 - DNA, 22 bp, Homo sapiens
acaaacagagttgaaaaatagg

SEQ ID NO: 9477587 - DNA, 22 bp, Homo sapiens
acaaacagagttgaaaaatagg

SEQ ID NO: 9477588 - DNA, 22 bp, Homo sapiens
acaaacagagttgaaaaatagg

SEQ ID NO: 9477589 - DNA, 22 bp, Homo sapiens
acaaacacgagacgccactgtg

SEQ ID NO: 9477590 - DNA, 22 bp, Homo sapiens
acaaacagctaacatatgttaa

SEQ ID NO: 9477591 - DNA, 22 bp, Homo sapiens
acaaacagctaacatatgttaa

SEQ ID NO: 9477592 - DNA, 22 bp, Homo sapiens
acaaacagagttgaaaaatagg

SEQ ID NO: 9477593 - DNA, 22 bp, Homo sapiens
acaaacagagttgaaaaatagg

SEQ ID NO: 9477594 - DNA, 22 bp, Homo sapiens
acaaaattacctagttattttc

SEQ ID NO: 9477595 - DNA, 22 bp, Homo sapiens
acaaaattacctagttattttc

SEQ ID NO: 9477596 - DNA, 22 bp, Homo sapiens
acaaaattacctagttattttc

SEQ ID NO: 9477597 - DNA, 22 bp, Homo sapiens
acaaaatcaaaggagtgattca

SEQ ID NO: 9477598 - DNA, 22 bp, Homo sapiens
acaaaatcaaaggagtgattca

SEQ ID NO: 9477599 - DNA, 22 bp, Homo sapiens
acaaaatcaaaggagtgattca

SEQ ID NO: 9477600 - DNA, 22 bp, Homo sapiens
acaaaatcaaaggagtgattca

SEQ ID NO: 9477601 - DNA, 20 bp, Homo sapiens
acaaaataggtactgggtag

SEQ ID NO: 9477602 - DNA, 22 bp, Homo sapiens
acaaaatttttagacaaggctt

SEQ ID NO: 9477603 - DNA, 22 bp, Homo sapiens
acaaaattgtgttaaactttat

SEQ ID NO: 9477604 - DNA, 22 bp, Homo sapiens
acaaaattgtgttaaactttat

SEQ ID NO: 9477605 - DNA, 22 bp, Homo sapiens
acaagttaccaaaaaagattca

SEQ ID NO: 9477606 - DNA, 22 bp, Homo sapiens
acaagttctgggaattaggaca

SEQ ID NO: 9477607 - DNA, 22 bp, Homo sapiens
acaagtttatttgattagaaca

SEQ ID NO: 9477608 - DNA, 22 bp, Homo sapiens
acaagtttatttgattagaaca

SEQ ID NO: 9477609 - DNA, 22 bp, Homo sapiens
acaagtttatttgattagaaca

SEQ ID NO: 9477610 - DNA, 22 bp, Homo sapiens
acaagtttatttgattagaaca

SEQ ID NO: 9477611 - DNA, 22 bp, Homo sapiens
acaagtttcattgtttagaacc

SEQ ID NO: 9477612 - DNA, 19 bp, Homo sapiens
agatggggaagagtgtgag

SEQ ID NO: 9477613 - DNA, 19 bp, Homo sapiens
agatggggaagagtgtgag

SEQ ID NO: 9477614 - DNA, 22 bp, Homo sapiens
agatggggcagaatggagccat

SEQ ID NO: 9477615 - DNA, 22 bp, Homo sapiens
agatggggcagaatggagccat

SEQ ID NO: 9477616 - DNA, 22 bp, Homo sapiens
agatggggctcagtgtggaggc

SEQ ID NO: 9477617 - DNA, 22 bp, Homo sapiens
agatggggctcagtgtggaggc

SEQ ID NO: 9477618 - DNA, 22 bp, Homo sapiens
agatggggcagaatggagccat

SEQ ID NO: 9477619 - DNA, 22 bp, Homo sapiens
agatggggcagaatggagccat

SEQ ID NO: 9477620 - DNA, 22 bp, Homo sapiens
acaagtctttttcatgtcttct

SEQ ID NO: 9477621 - DNA, 22 bp, Homo sapiens
acaagtgttgcattttgccatt

SEQ ID NO: 9477622 - DNA, 22 bp, Homo sapiens
acaagtgtgtgcagtttgtaaa

SEQ ID NO: 9477623 - DNA, 22 bp, Homo sapiens
acaaggtttggtcctatatttt

SEQ ID NO: 9477624 - DNA, 18 bp, Homo sapiens
acaaggtcaattggttac

SEQ ID NO: 9477625 - DNA, 22 bp, Homo sapiens
acaaggtatccacattaaatgt

SEQ ID NO: 9477626 - DNA, 22 bp, Homo sapiens
acaaggtacaaaacagagcaca

SEQ ID NO: 9477627 - DNA, 22 bp, Homo sapiens
acaaggtatcatcttggaagca

SEQ ID NO: 9477628 - DNA, 22 bp, Homo sapiens
acaaggttggctctttctttgt

SEQ ID NO: 9477629 - DNA, 22 bp, Homo sapiens
acaaatgtctacattgagaata

SEQ ID NO: 9477630 - DNA, 22 bp, Homo sapiens
acaaatgtctacattgagaata

SEQ ID NO: 9477631 - DNA, 23 bp, Homo sapiens
acaaatgtctagagagggtgtga

SEQ ID NO: 9477632 - DNA, 22 bp, Homo sapiens
acaaatggactctcatcttttg

SEQ ID NO: 9477633 - DNA, 18 bp, Homo sapiens
acaaatgtagtgtcttaa

SEQ ID NO: 9477634 - DNA, 22 bp, Homo sapiens
acaaatggaaggtgttctcttc

SEQ ID NO: 9477635 - DNA, 22 bp, Homo sapiens
acaaatggaacaatgaagactg

SEQ ID NO: 9477636 - DNA, 18 bp, Homo sapiens
acaaatgtgtcacaggaa

SEQ ID NO: 9477637 - DNA, 18 bp, Homo sapiens
acaaatgtgtcacaggaa

SEQ ID NO: 9477638 - DNA, 22 bp, Homo sapiens
acaaatgtctcctcttttgtta

SEQ ID NO: 9477639 - DNA, 22 bp, Homo sapiens
acaaatgtctcctcttttgtta

SEQ ID NO: 9477640 - DNA, 22 bp, Homo sapiens
acaaatgtgattgtttctgaaa

SEQ ID NO: 9477641 - DNA, 22 bp, Homo sapiens
acaaatgtgattgtttctgaaa

SEQ ID NO: 9477642 - DNA, 22 bp, Homo sapiens
acaaatgtgtctaattgtgcct

SEQ ID NO: 9477643 - DNA, 22 bp, Homo sapiens
acaaatgttggatttgtcttcc

SEQ ID NO: 9477644 - DNA, 22 bp, Homo sapiens
acaaatgttacataagtttgga

SEQ ID NO: 9477645 - DNA, 22 bp, Homo sapiens
acaaattaccatggaatttggg

SEQ ID NO: 9477646 - DNA, 22 bp, Homo sapiens
acaaattatagaaaattgagct

SEQ ID NO: 9477647 - DNA, 22 bp, Homo sapiens
acaaattaccatggaatttggg

SEQ ID NO: 9477648 - DNA, 22 bp, Homo sapiens
acaaatgttggatttgtcttcc

SEQ ID NO: 9477649 - DNA, 22 bp, Homo sapiens
acaaattaccatggaatttggg

SEQ ID NO: 9477650 - DNA, 22 bp, Homo sapiens
acaaattatagaaaattgagct

SEQ ID NO: 9477651 - DNA, 22 bp, Homo sapiens
acaaattgaccgcaagattcat

SEQ ID NO: 9477652 - DNA, 22 bp, Homo sapiens
acaaattctacaatcatatgat

SEQ ID NO: 9477653 - DNA, 22 bp, Homo sapiens
acaaattctacaatcatatgat

SEQ ID NO: 9477654 - DNA, 22 bp, Homo sapiens
acaaattctctaggcaaggaag
